United States Patent 11,926,839 (PLATFORM FOR T LYMPHOCYTE GENOME ENGINEERING AND IN VIVO HIGH-THROUGHPUT SCREENING THEREOF) - sequence listing, part 3

SEQ ID NO: 50168 - RNA, 20 nt, Artificial Sequence
  MKO10050168_A_Smo
  gRNA
uccggaaugccccccgcugc

SEQ ID NO: 50169 - RNA, 20 nt, Artificial Sequence
  MKO10050169_A_Smo
  gRNA
ugucaaugcguguuucuucg

SEQ ID NO: 50170 - RNA, 20 nt, Artificial Sequence
  MKO10050170_A_Smo
  gRNA
gagaccagugaccgccccga

SEQ ID NO: 50171 - RNA, 20 nt, Artificial Sequence
  MKO10050171_A_Smpd1
  gRNA
guaaguaccuuaggguguga

SEQ ID NO: 50172 - RNA, 20 nt, Artificial Sequence
  MKO10050172_A_Smpd1
  gRNA
agagccuacccgugccacau

SEQ ID NO: 50173 - RNA, 20 nt, Artificial Sequence
  MKO10050173_A_Smpd1
  gRNA
accuuuaucaaccuuaaccc

SEQ ID NO: 50174 - RNA, 20 nt, Artificial Sequence
  MKO10050174_A_Smpd2
  gRNA
gcggaccgcaugaagcgcuu

SEQ ID NO: 50175 - RNA, 20 nt, Artificial Sequence
  MKO10050175_A_Smpd2
  gRNA
cgcccuauguuugcucaggu

SEQ ID NO: 50176 - RNA, 20 nt, Artificial Sequence
  MKO10050176_A_Smpd2
  gRNA
guucuccaaacacccaaucc

SEQ ID NO: 50177 - RNA, 20 nt, Artificial Sequence
  MKO10050177_A_Smpd3
  gRNA
cacaaacggucucuaugaug

SEQ ID NO: 50178 - RNA, 20 nt, Artificial Sequence
  MKO10050178_A_Smpd3
  gRNA
agagaccguuuguguccagc

SEQ ID NO: 50179 - RNA, 20 nt, Artificial Sequence
  MKO10050179_A_Smpd3
  gRNA
cgauguacccaacaauucuu

SEQ ID NO: 50180 - RNA, 20 nt, Artificial Sequence
  MKO10050180_A_Smpd4
  gRNA
uuggaaucuccgaugccuac

SEQ ID NO: 50181 - RNA, 20 nt, Artificial Sequence
  MKO10050181_A_Smpd4
  gRNA
aucgcugugcuguacuccac

SEQ ID NO: 50182 - RNA, 20 nt, Artificial Sequence
  MKO10050182_A_Smpd4
  gRNA
ugcacaacguugccaagauu

SEQ ID NO: 50183 - RNA, 20 nt, Artificial Sequence
  MKO10050183_A_Smpd5
  gRNA
ggcaauggaguggcguagca

SEQ ID NO: 50184 - RNA, 20 nt, Artificial Sequence
  MKO10050184_A_Smpd5
  gRNA
guuccuggcaaacgccuagc

SEQ ID NO: 50185 - RNA, 20 nt, Artificial Sequence
  MKO10050185_A_Smpd5
  gRNA
cugccggcuaggcguuugcc

SEQ ID NO: 50186 - RNA, 20 nt, Artificial Sequence
  MKO10050186_A_Smpdl3a
  gRNA
cacugggcaaucaugacuac

SEQ ID NO: 50187 - RNA, 20 nt, Artificial Sequence
  MKO10050187_A_Smpdl3a
  gRNA
gcugccaauagucaccagua

SEQ ID NO: 50188 - RNA, 20 nt, Artificial Sequence
  MKO10050188_A_Smpdl3a
  gRNA
cacagcacuguagaccuuac

SEQ ID NO: 50189 - RNA, 20 nt, Artificial Sequence
  MKO10050189_A_Smpdl3b
  gRNA
cagccaccggaacugcucgc

SEQ ID NO: 50190 - RNA, 20 nt, Artificial Sequence
  MKO10050190_A_Smpdl3b
  gRNA
agccggccgacgggcacacc

SEQ ID NO: 50191 - RNA, 20 nt, Artificial Sequence
  MKO10050191_A_Smpdl3b
  gRNA
gcacaucuccgaccugcauc

SEQ ID NO: 50192 - RNA, 20 nt, Artificial Sequence
  MKO10050192_A_Smpx
  gRNA
cugcccagcucccggacgaa

SEQ ID NO: 50193 - RNA, 20 nt, Artificial Sequence
  MKO10050193_A_Smpx
  gRNA
ggcgaauaucaauauuccaa

SEQ ID NO: 50194 - RNA, 20 nt, Artificial Sequence
  MKO10050194_A_Smpx
  gRNA
uaccuggauggcucugacgu

SEQ ID NO: 50195 - RNA, 20 nt, Artificial Sequence
  MKO10050195_A_Smr2
  gRNA
aacgaugaaggcacuguaua

SEQ ID NO: 50196 - RNA, 20 nt, Artificial Sequence
  MKO10050196_A_Smr2
  gRNA
cagucuagugagugccaaag

SEQ ID NO: 50197 - RNA, 20 nt, Artificial Sequence
  MKO10050197_A_Smr2
  gRNA
uugagaaaucuguacacgau

SEQ ID NO: 50198 - RNA, 20 nt, Artificial Sequence
  MKO10050198_A_Smr3a
  gRNA
ucuagcaguaggaguaguua

SEQ ID NO: 50199 - RNA, 20 nt, Artificial Sequence
  MKO10050199_A_Smr3a
  gRNA
ccuagaagacaugauccuag

SEQ ID NO: 50200 - RNA, 20 nt, Artificial Sequence
  MKO10050200_A_Smr3a
  gRNA
agcauccuacaagaaugcag

SEQ ID NO: 50201 - RNA, 20 nt, Artificial Sequence
  MKO10050201_A_Sms
  gRNA
acuuacuaacauccccgcug

SEQ ID NO: 50202 - RNA, 20 nt, Artificial Sequence
  MKO10050202_A_Sms
  gRNA
cugucuuccagcugauggug

SEQ ID NO: 50203 - RNA, 20 nt, Artificial Sequence
  MKO10050203_A_Sms
  gRNA
agauuaccacccauaguucg

SEQ ID NO: 50204 - RNA, 20 nt, Artificial Sequence
  MKO10050204_A_Smtnl1
  gRNA
ggugccgacacucugcguuc

SEQ ID NO: 50205 - RNA, 20 nt, Artificial Sequence
  MKO10050205_A_Smtnl1
  gRNA
caccucguaguuucucguca

SEQ ID NO: 50206 - RNA, 20 nt, Artificial Sequence
  MKO10050206_A_Smtnl1
  gRNA
ggccaugacgagaaacuacg

SEQ ID NO: 50207 - RNA, 20 nt, Artificial Sequence
  MKO10050207_A_Smtnl2
  gRNA
cucgccagggagagcgucgc

SEQ ID NO: 50208 - RNA, 20 nt, Artificial Sequence
  MKO10050208_A_Smtnl2
  gRNA
cgagucuccgagaaauucuc

SEQ ID NO: 50209 - RNA, 20 nt, Artificial Sequence
  MKO10050209_A_Smtnl2
  gRNA
uugaagcacgucucaccuca

SEQ ID NO: 50210 - RNA, 20 nt, Artificial Sequence
  MKO10050210_A_Smtn
  gRNA
ccgcccucgcacgauuggca

SEQ ID NO: 50211 - RNA, 20 nt, Artificial Sequence
  MKO10050211_A_Smtn
  gRNA
cauccgccgagugcgagcuc

SEQ ID NO: 50212 - RNA, 20 nt, Artificial Sequence
  MKO10050212_A_Smtn
  gRNA
ccaaacguuuccgugcugag

SEQ ID NO: 50213 - RNA, 20 nt, Artificial Sequence
  MKO10050213_A_Smu1
  gRNA
uccagaugaauauagcgcuc

SEQ ID NO: 50214 - RNA, 20 nt, Artificial Sequence
  MKO10050214_A_Smu1
  gRNA
auugauagagcuucgugaau

SEQ ID NO: 50215 - RNA, 20 nt, Artificial Sequence
  MKO10050215_A_Smu1
  gRNA
cuugccucgaaacaaaucga

SEQ ID NO: 50216 - RNA, 20 nt, Artificial Sequence
  MKO10050216_A_Smug1
  gRNA
cgagcccgaagagcucuagc

SEQ ID NO: 50217 - RNA, 20 nt, Artificial Sequence
  MKO10050217_A_Smug1
  gRNA
gaacccucauccguuagcag

SEQ ID NO: 50218 - RNA, 20 nt, Artificial Sequence
  MKO10050218_A_Smug1
  gRNA
ucugccuuguacacgaagcu

SEQ ID NO: 50219 - RNA, 20 nt, Artificial Sequence
  MKO10050219_A_Smurf1
  gRNA
agcaucaagauccgucugac

SEQ ID NO: 50220 - RNA, 20 nt, Artificial Sequence
  MKO10050220_A_Smurf1
  gRNA
agccguuccuacgggucccg

SEQ ID NO: 50221 - RNA, 20 nt, Artificial Sequence
  MKO10050221_A_Smurf1
  gRNA
agagccguccacaacaaucu

SEQ ID NO: 50222 - RNA, 20 nt, Artificial Sequence
  MKO10050222_A_Smurf2
  gRNA
auucaguuacgaucagcgua

SEQ ID NO: 50223 - RNA, 20 nt, Artificial Sequence
  MKO10050223_A_Smurf2
  gRNA
caaugccaucaaccgccuca

SEQ ID NO: 50224 - RNA, 20 nt, Artificial Sequence
  MKO10050224_A_Smurf2
  gRNA
ucaacuaccaccuuagcaaa

SEQ ID NO: 50225 - RNA, 20 nt, Artificial Sequence
  MKO10050225_A_Smyd1
  gRNA
cugcgaccgcacgugccaga

SEQ ID NO: 50226 - RNA, 20 nt, Artificial Sequence
  MKO10050226_A_Smyd1
  gRNA
gaaggaacuccgaguagacg

SEQ ID NO: 50227 - RNA, 20 nt, Artificial Sequence
  MKO10050227_A_Smyd1
  gRNA
ggcuggccgcccgcaucaug

SEQ ID NO: 50228 - RNA, 20 nt, Artificial Sequence
  MKO10050228_A_Smyd2
  gRNA
gcaggcguucuacugcgacg

SEQ ID NO: 50229 - RNA, 20 nt, Artificial Sequence
  MKO10050229_A_Smyd2
  gRNA
gugagccgcacagucuccga

SEQ ID NO: 50230 - RNA, 20 nt, Artificial Sequence
  MKO10050230_A_Smyd2
  gRNA
ccagguacuuggaguagaac

SEQ ID NO: 50231 - RNA, 20 nt, Artificial Sequence
  MKO10050231_A_Smyd3
  gRNA
gacaacugcauucccgucug

SEQ ID NO: 50232 - RNA, 20 nt, Artificial Sequence
  MKO10050232_A_Smyd3
  gRNA
gcccgacuccgugagacuuc

SEQ ID NO: 50233 - RNA, 20 nt, Artificial Sequence
  MKO10050233_A_Smyd3
  gRNA
gcggcagcugagacgcaucc

SEQ ID NO: 50234 - RNA, 20 nt, Artificial Sequence
  MKO10050234_A_Smyd4
  gRNA
ugucuuacgcaccaucaucu

SEQ ID NO: 50235 - RNA, 20 nt, Artificial Sequence
  MKO10050235_A_Smyd4
  gRNA
ggcauuugauuacacaaguc

SEQ ID NO: 50236 - RNA, 20 nt, Artificial Sequence
  MKO10050236_A_Smyd4
  gRNA
acuuucuaguaguuacucgg

SEQ ID NO: 50237 - RNA, 20 nt, Artificial Sequence
  MKO10050237_A_Smyd5
  gRNA
agagcuaugcagugugcgua

SEQ ID NO: 50238 - RNA, 20 nt, Artificial Sequence
  MKO10050238_A_Smyd5
  gRNA
cuggcucaccuguuucaccg

SEQ ID NO: 50239 - RNA, 20 nt, Artificial Sequence
  MKO10050239_A_Smyd5
  gRNA
agcauuauacucgcagucuc

SEQ ID NO: 50240 - RNA, 20 nt, Artificial Sequence
  MKO10050240_A_Snai1
  gRNA
aguugaagaucuuccgcgac

SEQ ID NO: 50241 - RNA, 20 nt, Artificial Sequence
  MKO10050241_A_Snai1
  gRNA
cccaggcaaccggccgcacu

SEQ ID NO: 50242 - RNA, 20 nt, Artificial Sequence
  MKO10050242_A_Snai1
  gRNA
guccugcagcucgcuauagu

SEQ ID NO: 50243 - RNA, 20 nt, Artificial Sequence
  MKO10050243_A_Snai2
  gRNA
aagucccauuagugacgaag

SEQ ID NO: 50244 - RNA, 20 nt, Artificial Sequence
  MKO10050244_A_Snai2
  gRNA
uuuaugcagaagcgacauuc

SEQ ID NO: 50245 - RNA, 20 nt, Artificial Sequence
  MKO10050245_A_Snai2
  gRNA
gaagcccaacuacagcgaac

SEQ ID NO: 50246 - RNA, 20 nt, Artificial Sequence
  MKO10050246_A_Snai3
  gRNA
uguucauuuagagcuccguc

SEQ ID NO: 50247 - RNA, 20 nt, Artificial Sequence
  MKO10050247_A_Snai3
  gRNA
cacggcgcaccuguacuucu

SEQ ID NO: 50248 - RNA, 20 nt, Artificial Sequence
  MKO10050248_A_Snai3
  gRNA
ugaaggcgcgcccagucggc

SEQ ID NO: 50249 - RNA, 20 nt, Artificial Sequence
  MKO10050249_A_Snap23
  gRNA
aauccuggguuuagccauug

SEQ ID NO: 50250 - RNA, 20 nt, Artificial Sequence
  MKO10050250_A_Snap23
  gRNA
uuaccucaauggcuaaaccc

SEQ ID NO: 50251 - RNA, 20 nt, Artificial Sequence
  MKO10050251_A_Snap23
  gRNA
cauggauaaucuguccccag

SEQ ID NO: 50252 - RNA, 20 nt, Artificial Sequence
  MKO10050252_A_Snap25
  gRNA
cacccgucgcaugcugcagc

SEQ ID NO: 50253 - RNA, 20 nt, Artificial Sequence
  MKO10050253_A_Snap25
  gRNA
caaccagcugcagcaugcga

SEQ ID NO: 50254 - RNA, 20 nt, Artificial Sequence
  MKO10050254_A_Snap25
  gRNA
uccauccugauuauugcccc

SEQ ID NO: 50255 - RNA, 20 nt, Artificial Sequence
  MKO10050255_A_Snap29
  gRNA
guucgaagggucgaguucuu

SEQ ID NO: 50256 - RNA, 20 nt, Artificial Sequence
  MKO10050256_A_Snap29
  gRNA
ccaccugaaggacauagccu

SEQ ID NO: 50257 - RNA, 20 nt, Artificial Sequence
  MKO10050257_A_Snap29
  gRNA
cuucagguggccuaauccca

SEQ ID NO: 50258 - RNA, 20 nt, Artificial Sequence
  MKO10050258_A_Snap47
  gRNA
acauacccucccacgugacc

SEQ ID NO: 50259 - RNA, 20 nt, Artificial Sequence
  MKO10050259_A_Snap47
  gRNA
agcauacgccagcgcuucau

SEQ ID NO: 50260 - RNA, 20 nt, Artificial Sequence
  MKO10050260_A_Snap47
  gRNA
ccgaccuggacguggcugac

SEQ ID NO: 50261 - RNA, 20 nt, Artificial Sequence
  MKO10050261_A_Snap91
  gRNA
cgauccgauccgugagcguu

SEQ ID NO: 50262 - RNA, 20 nt, Artificial Sequence
  MKO10050262_A_Snap91
  gRNA
agcgggcgacaaacaguagc

SEQ ID NO: 50263 - RNA, 20 nt, Artificial Sequence
  MKO10050263_A_Snap91
  gRNA
gccgcucaguacagcgugac

SEQ ID NO: 50264 - RNA, 20 nt, Artificial Sequence
  MKO10050264_A_Snapc1
  gRNA
gaacgcacagcauuucgacg

SEQ ID NO: 50265 - RNA, 20 nt, Artificial Sequence
  MKO10050265_A_Snapc1
  gRNA
gcugugccagccgaaacaaa

SEQ ID NO: 50266 - RNA, 20 nt, Artificial Sequence
  MKO10050266_A_Snapc1
  gRNA
acaaagcgccaacucugauc

SEQ ID NO: 50267 - RNA, 20 nt, Artificial Sequence
  MKO10050267_A_Snapc2
  gRNA
ugcugcugacccuacucgug

SEQ ID NO: 50268 - RNA, 20 nt, Artificial Sequence
  MKO10050268_A_Snapc2
  gRNA
uguuccagcagggccgugca

SEQ ID NO: 50269 - RNA, 20 nt, Artificial Sequence
  MKO10050269_A_Snapc2
  gRNA
ugccucaccucuaccggggc

SEQ ID NO: 50270 - RNA, 20 nt, Artificial Sequence
  MKO10050270_A_Snapc3
  gRNA
ugcugaauucuccaccgauc

SEQ ID NO: 50271 - RNA, 20 nt, Artificial Sequence
  MKO10050271_A_Snapc3
  gRNA
cgaggcaucucaguuuauca

SEQ ID NO: 50272 - RNA, 20 nt, Artificial Sequence
  MKO10050272_A_Snapc3
  gRNA
acucauaccauaaagucacu

SEQ ID NO: 50273 - RNA, 20 nt, Artificial Sequence
  MKO10050273_A_Snapc4
  gRNA
gaccauauuuagcugcagac

SEQ ID NO: 50274 - RNA, 20 nt, Artificial Sequence
  MKO10050274_A_Snapc4
  gRNA
cuucucccguguuucuucgu

SEQ ID NO: 50275 - RNA, 20 nt, Artificial Sequence
  MKO10050275_A_Snapc4
  gRNA
uacagauucgcugccugaug

SEQ ID NO: 50276 - RNA, 20 nt, Artificial Sequence
  MKO10050276_A_Snapc5
  gRNA
ggggauguugagucgacugc

SEQ ID NO: 50277 - RNA, 20 nt, Artificial Sequence
  MKO10050277_A_Snapc5
  gRNA
ggaaacccugcugcgucuaa

SEQ ID NO: 50278 - RNA, 20 nt, Artificial Sequence
  MKO10050278_A_Snapc5
  gRNA
ccuuccucgagaauuuauca

SEQ ID NO: 50279 - RNA, 20 nt, Artificial Sequence
  MKO10050279_A_Snapin
  gRNA
gcucgacucucacgugcacg

SEQ ID NO: 50280 - RNA, 20 nt, Artificial Sequence
  MKO10050280_A_Snapin
  gRNA
gaccaagacaacucgucgcc

SEQ ID NO: 50281 - RNA, 20 nt, Artificial Sequence
  MKO10050281_A_Snapin
  gRNA
caguucgcgauggccgcggc

SEQ ID NO: 50282 - RNA, 20 nt, Artificial Sequence
  MKO10050282_A_Sncaip
  gRNA
cccgcucacgaaggugacuu

SEQ ID NO: 50283 - RNA, 20 nt, Artificial Sequence
  MKO10050283_A_Sncaip
  gRNA
uccgaagucaccuucgugag

SEQ ID NO: 50284 - RNA, 20 nt, Artificial Sequence
  MKO10050284_A_Sncaip
  gRNA
cuucgcccaucagugacgug

SEQ ID NO: 50285 - RNA, 20 nt, Artificial Sequence
  MKO10050285_A_Snca
  gRNA
gggaauauagcugcugccac

SEQ ID NO: 50286 - RNA, 20 nt, Artificial Sequence
  MKO10050286_A_Snca
  gRNA
gcagccauaccuugcccauc

SEQ ID NO: 50287 - RNA, 20 nt, Artificial Sequence
  MKO10050287_A_Snca
  gRNA
gugguucauggagugacaac

SEQ ID NO: 50288 - RNA, 20 nt, Artificial Sequence
  MKO10050288_A_Sncb
  gRNA
uccuggaccccuuacgccuc

SEQ ID NO: 50289 - RNA, 20 nt, Artificial Sequence
  MKO10050289_A_Sncb
  gRNA
cagaugcgaugccugcuccu

SEQ ID NO: 50290 - RNA, 20 nt, Artificial Sequence
  MKO10050290_A_Sncb
  gRNA
uuugaugcaggaggaauacc

SEQ ID NO: 50291 - RNA, 20 nt, Artificial Sequence
  MKO10050291_A_Sncg
  gRNA
gcuuaccuugcgcaccaccc

SEQ ID NO: 50292 - RNA, 20 nt, Artificial Sequence
  MKO10050292_A_Sncg
  gRNA
cacaguggccaacaagaccg

SEQ ID NO: 50293 - RNA, 20 nt, Artificial Sequence
  MKO10050293_A_Sncg
  gRNA
ggacuuggaacccccugcac

SEQ ID NO: 50294 - RNA, 20 nt, Artificial Sequence
  MKO10050294_A_Snd1
  gRNA
gggcugcccucggacaauua

SEQ ID NO: 50295 - RNA, 20 nt, Artificial Sequence
  MKO10050295_A_Snd1
  gRNA
gcaacgguucacacaccauc

SEQ ID NO: 50296 - RNA, 20 nt, Artificial Sequence
  MKO10050296_A_Snd1
  gRNA
gcagagucgcuaguugcaga

SEQ ID NO: 50297 - RNA, 20 nt, Artificial Sequence
  MKO10050297_A_Sned1
  gRNA
caucgauucuaaacgcccag

SEQ ID NO: 50298 - RNA, 20 nt, Artificial Sequence
  MKO10050298_A_Sned1
  gRNA
aguagacaucaccugcacgc

SEQ ID NO: 50299 - RNA, 20 nt, Artificial Sequence
  MKO10050299_A_Sned1
  gRNA
accaccaacgugggcgugcc

SEQ ID NO: 50300 - RNA, 20 nt, Artificial Sequence
  MKO10050300_A_Snf8
  gRNA
agucccucgcuccuuauacu

SEQ ID NO: 50301 - RNA, 20 nt, Artificial Sequence
  MKO10050301_A_Snf8
  gRNA
uccaacaggucugauaacuc

SEQ ID NO: 50302 - RNA, 20 nt, Artificial Sequence
  MKO10050302_A_Snf8
  gRNA
uaccuccauuccgauguuug

SEQ ID NO: 50303 - RNA, 20 nt, Artificial Sequence
  MKO10050303_A_Snhg11
  gRNA
ccagaugagccuuugccgca

SEQ ID NO: 50304 - RNA, 20 nt, Artificial Sequence
  MKO10050304_A_Snhg11
  gRNA
cguacuccccaacaucagug

SEQ ID NO: 50305 - RNA, 20 nt, Artificial Sequence
  MKO10050305_A_Snhg11
  gRNA
ugcaggcgaucacugcgaga

SEQ ID NO: 50306 - RNA, 20 nt, Artificial Sequence
  MKO10050306_A_Snip1
  gRNA
aggcgacgcucugacgaccg

SEQ ID NO: 50307 - RNA, 20 nt, Artificial Sequence
  MKO10050307_A_Snip1
  gRNA
ucgucagagcgucgccugac

SEQ ID NO: 50308 - RNA, 20 nt, Artificial Sequence
  MKO10050308_A_Snip1
  gRNA
aagcccuacauuaucgaccu

SEQ ID NO: 50309 - RNA, 20 nt, Artificial Sequence
  MKO10050309_A_Snn
  gRNA
gacaaugaccguuaccaccc

SEQ ID NO: 50310 - RNA, 20 nt, Artificial Sequence
  MKO10050310_A_Snn
  gRNA
gcuguuggcggucaucaacu

SEQ ID NO: 50311 - RNA, 20 nt, Artificial Sequence
  MKO10050311_A_Snn
  gRNA
gcagcgcaucagccagucag

SEQ ID NO: 50312 - RNA, 20 nt, Artificial Sequence
  MKO10050312_A_Snph
  gRNA
gagccucugccggaucucgc

SEQ ID NO: 50313 - RNA, 20 nt, Artificial Sequence
  MKO10050313_A_Snph
  gRNA
ccagggcguccguccgacuc

SEQ ID NO: 50314 - RNA, 20 nt, Artificial Sequence
  MKO10050314_A_Snph
  gRNA
cuggagccgccacuacaucg

SEQ ID NO: 50315 - RNA, 20 nt, Artificial Sequence
  MKO10050315_A_Snrk
  gRNA
cguacucuacgauggcgucu

SEQ ID NO: 50316 - RNA, 20 nt, Artificial Sequence
  MKO10050316_A_Snrk
  gRNA
gcaccggcgugacagcagug

SEQ ID NO: 50317 - RNA, 20 nt, Artificial Sequence
  MKO10050317_A_Snrk
  gRNA
gucagacgacgaguuugaca

SEQ ID NO: 50318 - RNA, 20 nt, Artificial Sequence
  MKO10050318_A_Snrnp200
  gRNA
acccgccgggaugaaccgac

SEQ ID NO: 50319 - RNA, 20 nt, Artificial Sequence
  MKO10050319_A_Snrnp200
  gRNA
gcuccacaaagaauaucucg

SEQ ID NO: 50320 - RNA, 20 nt, Artificial Sequence
  MKO10050320_A_Snrnp200
  gRNA
ggguccggucaaugagagag

SEQ ID NO: 50321 - RNA, 20 nt, Artificial Sequence
  MKO10050321_A_Snrnp25
  gRNA
augguauguccgccauacau

SEQ ID NO: 50322 - RNA, 20 nt, Artificial Sequence
  MKO10050322_A_Snrnp25
  gRNA
ggucgucguacagaaugcca

SEQ ID NO: 50323 - RNA, 20 nt, Artificial Sequence
  MKO10050323_A_Snrnp25
  gRNA
gcggcguucagcacaucagc

SEQ ID NO: 50324 - RNA, 20 nt, Artificial Sequence
  MKO10050324_A_Snrnp27
  gRNA
uguuagaacguaggcggucc

SEQ ID NO: 50325 - RNA, 20 nt, Artificial Sequence
  MKO10050325_A_Snrnp27
  gRNA
cuccacaccgaagacgcucc

SEQ ID NO: 50326 - RNA, 20 nt, Artificial Sequence
  MKO10050326_A_Snrnp27
  gRNA
gauguggaucuaugucgucu

SEQ ID NO: 50327 - RNA, 20 nt, Artificial Sequence
  MKO10050327_A_Snrnp35
  gRNA
aauccgccacccagccgccg

SEQ ID NO: 50328 - RNA, 20 nt, Artificial Sequence
  MKO10050328_A_Snrnp35
  gRNA
uguucuagagcaugagcgac

SEQ ID NO: 50329 - RNA, 20 nt, Artificial Sequence
  MKO10050329_A_Snrnp35
  gRNA
aguccacgaauaucucgugc

SEQ ID NO: 50330 - RNA, 20 nt, Artificial Sequence
  MKO10050330_A_Snrnp40
  gRNA
ugauaacuaugcgacguuga

SEQ ID NO: 50331 - RNA, 20 nt, Artificial Sequence
  MKO10050331_A_Snrnp40
  gRNA
gacauuucagaacacguacc

SEQ ID NO: 50332 - RNA, 20 nt, Artificial Sequence
  MKO10050332_A_Snrnp40
  gRNA
cugaucgcucgugucauuga

SEQ ID NO: 50333 - RNA, 20 nt, Artificial Sequence
  MKO10050333_A_Snrnp48
  gRNA
caaggcgauccguuugugug

SEQ ID NO: 50334 - RNA, 20 nt, Artificial Sequence
  MKO10050334_A_Snrnp48
  gRNA
uagcagccaagucuacaaac

SEQ ID NO: 50335 - RNA, 20 nt, Artificial Sequence
  MKO10050335_A_Snrnp48
  gRNA
uccuagcuuguuuaauuauc

SEQ ID NO: 50336 - RNA, 20 nt, Artificial Sequence
  MKO10050336_A_Snrnp70
  gRNA
ugccuucaagacucuguucg

SEQ ID NO: 50337 - RNA, 20 nt, Artificial Sequence
  MKO10050337_A_Snrnp70
  gRNA
ucacaaugaucccaaugcuc

SEQ ID NO: 50338 - RNA, 20 nt, Artificial Sequence
  MKO10050338_A_Snrnp70
  gRNA
uucucuccaugcguucuucc

SEQ ID NO: 50339 - RNA, 20 nt, Artificial Sequence
  MKO10050339_A_Snrpa1
  gRNA
auagggugaucuggacccgu

SEQ ID NO: 50340 - RNA, 20 nt, Artificial Sequence
  MKO10050340_A_Snrpa1
  gRNA
gcacccagauucucaauaac

SEQ ID NO: 50341 - RNA, 20 nt, Artificial Sequence
  MKO10050341_A_Snrpa1
  gRNA
aagucgauaaugcuucuuau

SEQ ID NO: 50342 - RNA, 20 nt, Artificial Sequence
  MKO10050342_A_Snrpa
  gRNA
cgcaucaugcaccauaugcc

SEQ ID NO: 50343 - RNA, 20 nt, Artificial Sequence
  MKO10050343_A_Snrpa
  gRNA
cccugcuuaccgguacgggc

SEQ ID NO: 50344 - RNA, 20 nt, Artificial Sequence
  MKO10050344_A_Snrpa
  gRNA
accaugggcuugucguagaa

SEQ ID NO: 50345 - RNA, 20 nt, Artificial Sequence
  MKO10050345_A_Snrpb2
  gRNA
aacuuacugguugaacagca

SEQ ID NO: 50346 - RNA, 20 nt, Artificial Sequence
  MKO10050346_A_Snrpb2
  gRNA
cacugcagcgccaaauccuc

SEQ ID NO: 50347 - RNA, 20 nt, Artificial Sequence
  MKO10050347_A_Snrpb2
  gRNA
ggaaacauuaccugaggauu

SEQ ID NO: 50348 - RNA, 20 nt, Artificial Sequence
  MKO10050348_A_Snrpb
  gRNA
guugcuucgaggggagaacc

SEQ ID NO: 50349 - RNA, 20 nt, Artificial Sequence
  MKO10050349_A_Snrpb
  gRNA
gcugggccaguccgaggugu

SEQ ID NO: 50350 - RNA, 20 nt, Artificial Sequence
  MKO10050350_A_Snrpb
  gRNA
gaaggacuuacaucuuuggg

SEQ ID NO: 50351 - RNA, 20 nt, Artificial Sequence
  MKO10050351_A_Snrpc
  gRNA
guauuguagcgggcccuccu

SEQ ID NO: 50352 - RNA, 20 nt, Artificial Sequence
  MKO10050352_A_Snrpc
  gRNA
acguacuugucuugucaauc

SEQ ID NO: 50353 - RNA, 20 nt, Artificial Sequence
  MKO10050353_A_Snrpc
  gRNA
uugaaacuuacggagacugg

SEQ ID NO: 50354 - RNA, 20 nt, Artificial Sequence
  MKO10050354_A_Snrpd1
  gRNA
guauucgaggcaauaacauu

SEQ ID NO: 50355 - RNA, 20 nt, Artificial Sequence
  MKO10050355_A_Snrpd1
  gRNA
ucgcuaggaugaagcucgug

SEQ ID NO: 50356 - RNA, 20 nt, Artificial Sequence
  MKO10050356_A_Snrpd1
  gRNA
ucuuaccugugauuguucca

SEQ ID NO: 50357 - RNA, 20 nt, Artificial Sequence
  MKO10050357_A_Snrpd2
  gRNA
ccccaucaggcacugcaaca

SEQ ID NO: 50358 - RNA, 20 nt, Artificial Sequence
  MKO10050358_A_Snrpd2
  gRNA
cgaugaccgaguccccgcgc

SEQ ID NO: 50359 - RNA, 20 nt, Artificial Sequence
  MKO10050359_A_Snrpd2
  gRNA
accugucaaaggccuucacc

SEQ ID NO: 50360 - RNA, 20 nt, Artificial Sequence
  MKO10050360_A_Snrpd3
  gRNA
gccucgugcaagacuuuaau

SEQ ID NO: 50361 - RNA, 20 nt, Artificial Sequence
  MKO10050361_A_Snrpd3
  gRNA
gccgauuaaagucuugcacg

SEQ ID NO: 50362 - RNA, 20 nt, Artificial Sequence
  MKO10050362_A_Snrpd3
  gRNA
uuuguuucaguggccgcacg

SEQ ID NO: 50363 - RNA, 20 nt, Artificial Sequence
  MKO10050363_A_Snrpe
  gRNA
acaggucggaucaugcuaaa

SEQ ID NO: 50364 - RNA, 20 nt, Artificial Sequence
  MKO10050364_A_Snrpe
  gRNA
auuucagagaucucgaauuc

SEQ ID NO: 50365 - RNA, 20 nt, Artificial Sequence
  MKO10050365_A_Snrpe
  gRNA
cuucugcaucaucuaauacg

SEQ ID NO: 50366 - RNA, 20 nt, Artificial Sequence
  MKO10050366_A_Snrpf
  gRNA
cccugucagcccauugagaa

SEQ ID NO: 50367 - RNA, 20 nt, Artificial Sequence
  MKO10050367_A_Snrpf
  gRNA
ggauggcuacaugaacaugc

SEQ ID NO: 50368 - RNA, 20 nt, Artificial Sequence
  MKO10050368_A_Snrpf
  gRNA
aauacagaagaguacauaga

SEQ ID NO: 50369 - RNA, 20 nt, Artificial Sequence
  MKO10050369_A_Snrpg
  gRNA
cucuacucacuucuucagcu

SEQ ID NO: 50370 - RNA, 20 nt, Artificial Sequence
  MKO10050370_A_Snrpg
  gRNA
ucucuuacagugaaguuaaa

SEQ ID NO: 50371 - RNA, 20 nt, Artificial Sequence
  MKO10050371_A_Snrpg
  gRNA
aauguuguucuguugcccac

SEQ ID NO: 50372 - RNA, 20 nt, Artificial Sequence
  MKO10050372_A_Snrpn
  gRNA
ggaacuccaccuccaccugu

SEQ ID NO: 50373 - RNA, 20 nt, Artificial Sequence
  MKO10050373_A_Snrpn
  gRNA
uggggaauagguacaccugc

SEQ ID NO: 50374 - RNA, 20 nt, Artificial Sequence
  MKO10050374_A_Snrpn
  gRNA
uucacaggucaugaccccac

SEQ ID NO: 50375 - RNA, 20 nt, Artificial Sequence
  MKO10050375_A_Snua1
  gRNA
ggcgccauccaagcgcagau

SEQ ID NO: 50376 - RNA, 20 nt, Artificial Sequence
  MKO10050376_A_Snua1
  gRNA
cuguaccgcuucaucguggg

SEQ ID NO: 50377 - RNA, 20 nt, Artificial Sequence
  MKO10050377_A_Snua1
  gRNA
gguuggugccguucccccgc

SEQ ID NO: 50378 - RNA, 20 nt, Artificial Sequence
  MKO10050378_A_Sntb1
  gRNA
agcgccauucauuccaacgc

SEQ ID NO: 50379 - RNA, 20 nt, Artificial Sequence
  MKO10050379_A_Sntb1
  gRNA
cucacugccgaaaucaccac

SEQ ID NO: 50380 - RNA, 20 nt, Artificial Sequence
  MKO10050380_A_Sntb1
  gRNA
cccuuucuucacguaaggug

SEQ ID NO: 50381 - RNA, 20 nt, Artificial Sequence
  MKO10050381_A_Sntb2
  gRNA
cucaucgggauuugucgacc

SEQ ID NO: 50382 - RNA, 20 nt, Artificial Sequence
  MKO10050382_A_Sntb2
  gRNA
auccuugcagcguaagauca

SEQ ID NO: 50383 - RNA, 20 nt, Artificial Sequence
  MKO10050383_A_Sntb2
  gRNA
cuugcugccucccgcuguac

SEQ ID NO: 50384 - RNA, 20 nt, Artificial Sequence
  MKO10050384_A_Snug1
  gRNA
aggauucggauuaagcauaa

SEQ ID NO: 50385 - RNA, 20 nt, Artificial Sequence
  MKO10050385_A_Snug1
  gRNA
agguguaaccggacuuuaaa

SEQ ID NO: 50386 - RNA, 20 nt, Artificial Sequence
  MKO10050386_A_Snug1
  gRNA
uauuggagaugcaauucuac

SEQ ID NO: 50387 - RNA, 20 nt, Artificial Sequence
  MKO10050387_A_Snug2
  gRNA
ggagcacuuacauuagcacc

SEQ ID NO: 50388 - RNA, 20 nt, Artificial Sequence
  MKO10050388_A_Snug2
  gRNA
uggccugggccuaaguauca

SEQ ID NO: 50389 - RNA, 20 nt, Artificial Sequence
  MKO10050389_A_Snug2
  gRNA
cuuguuguaugacgaggggu

SEQ ID NO: 50390 - RNA, 20 nt, Artificial Sequence
  MKO10050390_A_Sntn
  gRNA
gaccacgcacuccacucaag

SEQ ID NO: 50391 - RNA, 20 nt, Artificial Sequence
  MKO10050391_A_Sntn
  gRNA
cagaucugcuacgaaauaug

SEQ ID NO: 50392 - RNA, 20 nt, Artificial Sequence
  MKO10050392_A_Sntn
  gRNA
cuuucccaaguuuaccauca

SEQ ID NO: 50393 - RNA, 20 nt, Artificial Sequence
  MKO10050393_A_Snupn
  gRNA
ucacccuggaggccacgaua

SEQ ID NO: 50394 - RNA, 20 nt, Artificial Sequence
  MKO10050394_A_Snupn
  gRNA
aauugacgucccuucagauu

SEQ ID NO: 50395 - RNA, 20 nt, Artificial Sequence
  MKO10050395_A_Snupn
  gRNA
acuugauuagcauagcguuu

SEQ ID NO: 50396 - RNA, 20 nt, Artificial Sequence
  MKO10050396_A_Snurf
  gRNA
uacugaacagcacgugcccg

SEQ ID NO: 50397 - RNA, 20 nt, Artificial Sequence
  MKO10050397_A_Snurf
  gRNA
agguccaggucaaacgucga

SEQ ID NO: 50398 - RNA, 20 nt, Artificial Sequence
  MKO10050398_A_Snurf
  gRNA
gcaacgcaauggagcgagga

SEQ ID NO: 50399 - RNA, 20 nt, Artificial Sequence
  MKO10050399_A_Snw1
  gRNA
cagccuuuccuauauccgua

SEQ ID NO: 50400 - RNA, 20 nt, Artificial Sequence
  MKO10050400_A_Snw1
  gRNA
agcuugucagcugcacgaac

SEQ ID NO: 50401 - RNA, 20 nt, Artificial Sequence
  MKO10050401_A_Snw1
  gRNA
ccauaccggauauacugagc

SEQ ID NO: 50402 - RNA, 20 nt, Artificial Sequence
  MKO10050402_A_Snx10
  gRNA
gcaugucgaccaacgccgcc

SEQ ID NO: 50403 - RNA, 20 nt, Artificial Sequence
  MKO10050403_A_Snx10
  gRNA
acaccagcaacgcguugcuu

SEQ ID NO: 50404 - RNA, 20 nt, Artificial Sequence
  MKO10050404_A_Snx10
  gRNA
acuccaaagcaacgcguugc

SEQ ID NO: 50405 - RNA, 20 nt, Artificial Sequence
  MKO10050405_A_Snx11
  gRNA
aauggcaucggacaccguca

SEQ ID NO: 50406 - RNA, 20 nt, Artificial Sequence
  MKO10050406_A_Snx11
  gRNA
uucauugagaagcgacguca

SEQ ID NO: 50407 - RNA, 20 nt, Artificial Sequence
  MKO10050407_A_Snx11
  gRNA
ccgccgcacacaggacgucu

SEQ ID NO: 50408 - RNA, 20 nt, Artificial Sequence
  MKO10050408_A_Snx12
  gRNA
cacccgcaugcgaaccucau

SEQ ID NO: 50409 - RNA, 20 nt, Artificial Sequence
  MKO10050409_A_Snx12
  gRNA
gcggcccguaagcgucgguc

SEQ ID NO: 50410 - RNA, 20 nt, Artificial Sequence
  MKO10050410_A_Snx12
  gRNA
acuauagcgucgccguacac

SEQ ID NO: 50411 - RNA, 20 nt, Artificial Sequence
  MKO10050411_A_Snx13
  gRNA
cgcucauucaguuugcuacu

SEQ ID NO: 50412 - RNA, 20 nt, Artificial Sequence
  MKO10050412_A_Snx13
  gRNA
aagaaaugaaacgcgaagcc

SEQ ID NO: 50413 - RNA, 20 nt, Artificial Sequence
  MKO10050413_A_Snx13
  gRNA
ucugucaaucuuuauagucc

SEQ ID NO: 50414 - RNA, 20 nt, Artificial Sequence
  MKO10050414_A_Snx14
  gRNA
cuucaagaguuauuuccgca

SEQ ID NO: 50415 - RNA, 20 nt, Artificial Sequence
  MKO10050415_A_Snx14
  gRNA
cuaccuucgaagaaacuuuc

SEQ ID NO: 50416 - RNA, 20 nt, Artificial Sequence
  MKO10050416_A_Snx14
  gRNA
agaccugaaaguuucuucga

SEQ ID NO: 50417 - RNA, 20 nt, Artificial Sequence
  MKO10050417_A_Snx15
  gRNA
aaaccucuuccgucgccuag

SEQ ID NO: 50418 - RNA, 20 nt, Artificial Sequence
  MKO10050418_A_Snx15
  gRNA
gcgccgcuccucgaucacag

SEQ ID NO: 50419 - RNA, 20 nt, Artificial Sequence
  MKO10050419_A_Snx15
  gRNA
ugaaguagccgggccucauc

SEQ ID NO: 50420 - RNA, 20 nt, Artificial Sequence
  MKO10050420_A_Snx16
  gRNA
ggaagugcuaaucgaaagcc

SEQ ID NO: 50421 - RNA, 20 nt, Artificial Sequence
  MKO10050421_A_Snx16
  gRNA
ucuuaagcagacgaaugucc

SEQ ID NO: 50422 - RNA, 20 nt, Artificial Sequence
  MKO10050422_A_Snx16
  gRNA
gcggaguuuccuauuggcau

SEQ ID NO: 50423 - RNA, 20 nt, Artificial Sequence
  MKO10050423_A_Snx17
  gRNA
gccuauaacauucacgugaa

SEQ ID NO: 50424 - RNA, 20 nt, Artificial Sequence
  MKO10050424_A_Snx17
  gRNA
uguagcgcacccgacagugc

SEQ ID NO: 50425 - RNA, 20 nt, Artificial Sequence
  MKO10050425_A_Snx17
  gRNA
guucggcaagacccauugcu

SEQ ID NO: 50426 - RNA, 20 nt, Artificial Sequence
  MKO10050426_A_Snx18
  gRNA
cgcuacgccaacgugccgcc

SEQ ID NO: 50427 - RNA, 20 nt, Artificial Sequence
  MKO10050427_A_Snx18
  gRNA
gcgccggcuuucccuacggc

SEQ ID NO: 50428 - RNA, 20 nt, Artificial Sequence
  MKO10050428_A_Snx18
  gRNA
gugaugaaucucggccaacg

SEQ ID NO: 50429 - RNA, 20 nt, Artificial Sequence
  MKO10050429_A_Snx19
  gRNA
acaccgugaaccgccgcuac

SEQ ID NO: 50430 - RNA, 20 nt, Artificial Sequence
  MKO10050430_A_Snx19
  gRNA
gcggcgguucacggugugau

SEQ ID NO: 50431 - RNA, 20 nt, Artificial Sequence
  MKO10050431_A_Snx19
  gRNA
cucugcgccauuccugagau

SEQ ID NO: 50432 - RNA, 20 nt, Artificial Sequence
  MKO10050432_A_Snx1
  gRNA
aucaccgauccugagaagau

SEQ ID NO: 50433 - RNA, 20 nt, Artificial Sequence
  MKO10050433_A_Snx1
  gRNA
gaagccacagccaagcuaug

SEQ ID NO: 50434 - RNA, 20 nt, Artificial Sequence
  MKO10050434_A_Snx1
  gRNA
agauacuuaccgaucuucuc

SEQ ID NO: 50435 - RNA, 20 nt, Artificial Sequence
  MKO10050435_A_Snx20
  gRNA
ucugcuugcgcgaccucgag

SEQ ID NO: 50436 - RNA, 20 nt, Artificial Sequence
  MKO10050436_A_Snx20
  gRNA
agucgaggaacucgcgcgag

SEQ ID NO: 50437 - RNA, 20 nt, Artificial Sequence
  MKO10050437_A_Snx20
  gRNA
agagccgcuggaaacauguc

SEQ ID NO: 50438 - RNA, 20 nt, Artificial Sequence
  MKO10050438_A_Snx21
  gRNA
gcucuacacccucgccguga

SEQ ID NO: 50439 - RNA, 20 nt, Artificial Sequence
  MKO10050439_A_Snx21
  gRNA
ccagaucucucgccgauacu

SEQ ID NO: 50440 - RNA, 20 nt, Artificial Sequence
  MKO10050440_A_Snx21
  gRNA
ugacccugacgacgaagacg

SEQ ID NO: 50441 - RNA, 20 nt, Artificial Sequence
  MKO10050441_A_Snx22
  gRNA
gacgcagacacaccgugccg

SEQ ID NO: 50442 - RNA, 20 nt, Artificial Sequence
  MKO10050442_A_Snx22
  gRNA
ucacccgcuuguguagagcg

SEQ ID NO: 50443 - RNA, 20 nt, Artificial Sequence
  MKO10050443_A_Snx22
  gRNA
ccucaaaacgccugcccaac

SEQ ID NO: 50444 - RNA, 20 nt, Artificial Sequence
  MKO10050444_A_Snx24
  gRNA
gcuuucacaggccgucauuu

SEQ ID NO: 50445 - RNA, 20 nt, Artificial Sequence
  MKO10050445_A_Snx24
  gRNA
ccgccguuguuccaagacuu

SEQ ID NO: 50446 - RNA, 20 nt, Artificial Sequence
  MKO10050446_A_Snx24
  gRNA
aggccuggaaacguauuuac

SEQ ID NO: 50447 - RNA, 20 nt, Artificial Sequence
  MKO10050447_A_Snx25
  gRNA
cacguacgcgccuuccuacg

SEQ ID NO: 50448 - RNA, 20 nt, Artificial Sequence
  MKO10050448_A_Snx25
  gRNA
uugucaagcagauucgccag

SEQ ID NO: 50449 - RNA, 20 nt, Artificial Sequence
  MKO10050449_A_Snx25
  gRNA
gagcuugauaaaguccucgu

SEQ ID NO: 50450 - RNA, 20 nt, Artificial Sequence
  MKO10050450_A_Snx27
  gRNA
uugacaaugcgcacgacccg

SEQ ID NO: 50451 - RNA, 20 nt, Artificial Sequence
  MKO10050451_A_Snx27
  gRNA
auucuuccaacccacgacgc

SEQ ID NO: 50452 - RNA, 20 nt, Artificial Sequence
  MKO10050452_A_Snx27
  gRNA
cgcauugucaaguccgaauc

SEQ ID NO: 50453 - RNA, 20 nt, Artificial Sequence
  MKO10050453_A_Snx29
  gRNA
ucgccucagauuccgacagc

SEQ ID NO: 50454 - RNA, 20 nt, Artificial Sequence
  MKO10050454_A_Snx29
  gRNA
caccacaucaccuccgaugc

SEQ ID NO: 50455 - RNA, 20 nt, Artificial Sequence
  MKO10050455_A_Snx29
  gRNA
auuuagggcgcagcgcagcc

SEQ ID NO: 50456 - RNA, 20 nt, Artificial Sequence
  MKO10050456_A_Snx2
  gRNA
gugucagauccggaaaaagu

SEQ ID NO: 50457 - RNA, 20 nt, Artificial Sequence
  MKO10050457_A_Snx2
  gRNA
ggugaccgcaggagacggcu

SEQ ID NO: 50458 - RNA, 20 nt, Artificial Sequence
  MKO10050458_A_Snx2
  gRNA
auacucuuugauucgauucu

SEQ ID NO: 50459 - RNA, 20 nt, Artificial Sequence
  MKO10050459_A_Snx30
  gRNA
ccaucgaucggauagcccag

SEQ ID NO: 50460 - RNA, 20 nt, Artificial Sequence
  MKO10050460_A_Snx30
  gRNA
gagucagucaagcacgucac

SEQ ID NO: 50461 - RNA, 20 nt, Artificial Sequence
  MKO10050461_A_Snx30
  gRNA
cgccgacgaacagaauauuc

SEQ ID NO: 50462 - RNA, 20 nt, Artificial Sequence
  MKO10050462_A_Snx31
  gRNA
cugcggauccccgugugaca

SEQ ID NO: 50463 - RNA, 20 nt, Artificial Sequence
  MKO10050463_A_Snx31
  gRNA
caccauccagaaugucgagc

SEQ ID NO: 50464 - RNA, 20 nt, Artificial Sequence
  MKO10050464_A_Snx31
  gRNA
auacagccagcucgacauuc

SEQ ID NO: 50465 - RNA, 20 nt, Artificial Sequence
  MKO10050465_A_Snx32
  gRNA
agaaguuguggucccgacgc

SEQ ID NO: 50466 - RNA, 20 nt, Artificial Sequence
  MKO10050466_A_Snx32
  gRNA
gccagaugaacucuucgugc

SEQ ID NO: 50467 - RNA, 20 nt, Artificial Sequence
  MKO10050467_A_Snx32
  gRNA
guggaaaacgaagaguacgc

SEQ ID NO: 50468 - RNA, 20 nt, Artificial Sequence
  MKO10050468_A_Snx33
  gRNA
cgaagcacgagaaacgauug

SEQ ID NO: 50469 - RNA, 20 nt, Artificial Sequence
  MKO10050469_A_Snx33
  gRNA
uacgucgagauuguccgucc

SEQ ID NO: 50470 - RNA, 20 nt, Artificial Sequence
  MKO10050470_A_Snx33
  gRNA
cauucgcaggcgcugccgug

SEQ ID NO: 50471 - RNA, 20 nt, Artificial Sequence
  MKO10050471_A_Snx3
  gRNA
cgugagcaacccgcagaccg

SEQ ID NO: 50472 - RNA, 20 nt, Artificial Sequence
  MKO10050472_A_Snx3
  gRNA
gcuucaccaccuacgagauc

SEQ ID NO: 50473 - RNA, 20 nt, Artificial Sequence
  MKO10050473_A_Snx3
  gRNA
auuccaucgucuccucuaaa

SEQ ID NO: 50474 - RNA, 20 nt, Artificial Sequence
  MKO10050474_A_Snx4
  gRNA
cgucgucucuccacaaaguc

SEQ ID NO: 50475 - RNA, 20 nt, Artificial Sequence
  MKO10050475_A_Snx4
  gRNA
uuaccuaggcagaguucgug

SEQ ID NO: 50476 - RNA, 20 nt, Artificial Sequence
  MKO10050476_A_Snx4
  gRNA
gugugcucacagacucgcug

SEQ ID NO: 50477 - RNA, 20 nt, Artificial Sequence
  MKO10050477_A_Snx5
  gRNA
caaguuuacagugcacacca

SEQ ID NO: 50478 - RNA, 20 nt, Artificial Sequence
  MKO10050478_A_Snx5
  gRNA
gaagcgaugggucaacauuc

SEQ ID NO: 50479 - RNA, 20 nt, Artificial Sequence
  MKO10050479_A_Snx5
  gRNA
ugccuuguaacagaaaacuc

SEQ ID NO: 50480 - RNA, 20 nt, Artificial Sequence
  MKO10050480_A_Snx6
  gRNA
ucccgugaagcaucaaaauc

SEQ ID NO: 50481 - RNA, 20 nt, Artificial Sequence
  MKO10050481_A_Snx6
  gRNA
uucagucguucgacaacaug

SEQ ID NO: 50482 - RNA, 20 nt, Artificial Sequence
  MKO10050482_A_Snx6
  gRNA
ccagagugacgcugcucugc

SEQ ID NO: 50483 - RNA, 20 nt, Artificial Sequence
  MKO10050483_A_Snx7
  gRNA
augacuucauugagacccgc

SEQ ID NO: 50484 - RNA, 20 nt, Artificial Sequence
  MKO10050484_A_Snx7
  gRNA
cgcugcacaaguuucugaac

SEQ ID NO: 50485 - RNA, 20 nt, Artificial Sequence
  MKO10050485_A_Snx7
  gRNA
ccgguucuucacuccucgca

SEQ ID NO: 50486 - RNA, 20 nt, Artificial Sequence
  MKO10050486_A_Snx8
  gRNA
ucacaaguucccguaccgca

SEQ ID NO: 50487 - RNA, 20 nt, Artificial Sequence
  MKO10050487_A_Snx8
  gRNA
ucugcauucgcccggggucc

SEQ ID NO: 50488 - RNA, 20 nt, Artificial Sequence
  MKO10050488_A_Snx8
  gRNA
cagacgcuacaaugacuucg

SEQ ID NO: 50489 - RNA, 20 nt, Artificial Sequence
  MKO10050489_A_Snx9
  gRNA
agcgcuaguuccgucugucc

SEQ ID NO: 50490 - RNA, 20 nt, Artificial Sequence
  MKO10050490_A_Snx9
  gRNA
cuuacuuccacguagucagu

SEQ ID NO: 50491 - RNA, 20 nt, Artificial Sequence
  MKO10050491_A_Snx9
  gRNA
aaugagcugaccguuacuga

SEQ ID NO: 50492 - RNA, 20 nt, Artificial Sequence
  MKO10050492_A_Soau1
  gRNA
cguccucagcacgaucgucg

SEQ ID NO: 50493 - RNA, 20 nt, Artificial Sequence
  MKO10050493_A_Soau1
  gRNA
aguccacgacgaucgugcug

SEQ ID NO: 50494 - RNA, 20 nt, Artificial Sequence
  MKO10050494_A_Soau1
  gRNA
cauugaaaaguccgcaucgc

SEQ ID NO: 50495 - RNA, 20 nt, Artificial Sequence
  MKO10050495_A_Soau2
  gRNA
ggugcaauggacucgacaua

SEQ ID NO: 50496 - RNA, 20 nt, Artificial Sequence
  MKO10050496_A_Soau2
  gRNA
ugcugaugaucaggacgcau

SEQ ID NO: 50497 - RNA, 20 nt, Artificial Sequence
  MKO10050497_A_Soau2
  gRNA
gcccucaucaaugaagucga

SEQ ID NO: 50498 - RNA, 20 nt, Artificial Sequence
  MKO10050498_A_Sobp
  gRNA
caagcgcuauucccugagua

SEQ ID NO: 50499 - RNA, 20 nt, Artificial Sequence
  MKO10050499_A_Sobp
  gRNA
uaguucgcaguuauucuuga

SEQ ID NO: 50500 - RNA, 20 nt, Artificial Sequence
  MKO10050500_A_Sobp
  gRNA
ccuuucauaaagccgccagc

SEQ ID NO: 50501 - RNA, 20 nt, Artificial Sequence
  MKO10050501_A_Socs1
  gRNA
gguuaagagggaugcgcgcc

SEQ ID NO: 50502 - RNA, 20 nt, Artificial Sequence
  MKO10050502_A_Socs1
  gRNA
cgugcgccccgugcacgcuc

SEQ ID NO: 50503 - RNA, 20 nt, Artificial Sequence
  MKO10050503_A_Socs1
  gRNA
gcgcgaagaagcaguuccgu

SEQ ID NO: 50504 - RNA, 20 nt, Artificial Sequence
  MKO10050504_A_Socs2
  gRNA
uuucgccagacgcgccgccu

SEQ ID NO: 50505 - RNA, 20 nt, Artificial Sequence
  MKO10050505_A_Socs2
  gRNA
auauccguuaagacgucagc

SEQ ID NO: 50506 - RNA, 20 nt, Artificial Sequence
  MKO10050506_A_Socs2
  gRNA
ucuuaacggauauaguuagu

SEQ ID NO: 50507 - RNA, 20 nt, Artificial Sequence
  MKO10050507_A_Socs3
  gRNA
uucuacuggagcgccgugac

SEQ ID NO: 50508 - RNA, 20 nt, Artificial Sequence
  MKO10050508_A_Socs3
  gRNA
cuuucuuauccgcgacagcu

SEQ ID NO: 50509 - RNA, 20 nt, Artificial Sequence
  MKO10050509_A_Socs3
  gRNA
cgagcugucgcggauaagaa

SEQ ID NO: 50510 - RNA, 20 nt, Artificial Sequence
  MKO10050510_A_Socs4
  gRNA
uguaauuguacgacuuacga

SEQ ID NO: 50511 - RNA, 20 nt, Artificial Sequence
  MKO10050511_A_Socs4
  gRNA
ggcaguggacguagucgauc

SEQ ID NO: 50512 - RNA, 20 nt, Artificial Sequence
  MKO10050512_A_Socs4
  gRNA
uagcuguucguccauugagu

SEQ ID NO: 50513 - RNA, 20 nt, Artificial Sequence
  MKO10050513_A_Socs5
  gRNA
ccuacucgcggcacgccccg

SEQ ID NO: 50514 - RNA, 20 nt, Artificial Sequence
  MKO10050514_A_Socs5
  gRNA
cccgcuaccgucgauguuac

SEQ ID NO: 50515 - RNA, 20 nt, Artificial Sequence
  MKO10050515_A_Socs5
  gRNA
ccacgcgcacguuagcagac

SEQ ID NO: 50516 - RNA, 20 nt, Artificial Sequence
  MKO10050516_A_Socs6
  gRNA
uauucaagaucucgauugcc

SEQ ID NO: 50517 - RNA, 20 nt, Artificial Sequence
  MKO10050517_A_Socs6
  gRNA
acuuaaucgagcauucaauc

SEQ ID NO: 50518 - RNA, 20 nt, Artificial Sequence
  MKO10050518_A_Socs6
  gRNA
uccagugucacgauucaugc

SEQ ID NO: 50519 - RNA, 20 nt, Artificial Sequence
  MKO10050519_A_Socs7
  gRNA
aggugagacaguaucgcuug

SEQ ID NO: 50520 - RNA, 20 nt, Artificial Sequence
  MKO10050520_A_Socs7
  gRNA
gcuaagcuaaccuggggcgu

SEQ ID NO: 50521 - RNA, 20 nt, Artificial Sequence
  MKO10050521_A_Socs7
  gRNA
acgcucugaugggagcaauu

SEQ ID NO: 50522 - RNA, 20 nt, Artificial Sequence
  MKO10050522_A_Sod1
  gRNA
uaaauaggcuguaccagugc

SEQ ID NO: 50523 - RNA, 20 nt, Artificial Sequence
  MKO10050523_A_Sod1
  gRNA
aaaaacuuaccaccauugua

SEQ ID NO: 50524 - RNA, 20 nt, Artificial Sequence
  MKO10050524_A_Sod1
  gRNA
uguuaggcauguuggagacc

SEQ ID NO: 50525 - RNA, 20 nt, Artificial Sequence
  MKO10050525_A_Sod2
  gRNA
uccagcgcgccauagucgua

SEQ ID NO: 50526 - RNA, 20 nt, Artificial Sequence
  MKO10050526_A_Sod2
  gRNA
gaacaaucucaacgccaccg

SEQ ID NO: 50527 - RNA, 20 nt, Artificial Sequence
  MKO10050527_A_Sod2
  gRNA
gauaggccuuauuccgcugc

SEQ ID NO: 50528 - RNA, 20 nt, Artificial Sequence
  MKO10050528_A_Sod3
  gRNA
gugcgguccggccagcgacg

SEQ ID NO: 50529 - RNA, 20 nt, Artificial Sequence
  MKO10050529_A_Sod3
  gRNA
cgucggccugaccgcgucgc

SEQ ID NO: 50530 - RNA, 20 nt, Artificial Sequence
  MKO10050530_A_Sod3
  gRNA
gccgcacuacaacccgaugg

SEQ ID NO: 50531 - RNA, 20 nt, Artificial Sequence
  MKO10050531_A_Soga1
  gRNA
ugucguccaucucggcucgc

SEQ ID NO: 50532 - RNA, 20 nt, Artificial Sequence
  MKO10050532_A_Soga1
  gRNA
auaccgcucggagcacgagc

SEQ ID NO: 50533 - RNA, 20 nt, Artificial Sequence
  MKO10050533_A_Soga1
  gRNA
agaacgaggggcuucgacag

SEQ ID NO: 50534 - RNA, 20 nt, Artificial Sequence
  MKO10050534_A_Soga2
  gRNA
cuacaccgcugcgucgggag

SEQ ID NO: 50535 - RNA, 20 nt, Artificial Sequence
  MKO10050535_A_Soga2
  gRNA
ggucgccucucccgacgcag

SEQ ID NO: 50536 - RNA, 20 nt, Artificial Sequence
  MKO10050536_A_Soga2
  gRNA
acaccacgaacucgagaccg

SEQ ID NO: 50537 - RNA, 20 nt, Artificial Sequence
  MKO10050537_A_Soga3
  gRNA
ccgcgagcugucauggccgc

SEQ ID NO: 50538 - RNA, 20 nt, Artificial Sequence
  MKO10050538_A_Soga3
  gRNA
gucugcgaugagccgaucga

SEQ ID NO: 50539 - RNA, 20 nt, Artificial Sequence
  MKO10050539_A_Soga3
  gRNA
uccgcaaagccgagcgcaaa

SEQ ID NO: 50540 - RNA, 20 nt, Artificial Sequence
  MKO10050540_A_Sohlh1
  gRNA
gaccacguuucuccgaagac

SEQ ID NO: 50541 - RNA, 20 nt, Artificial Sequence
  MKO10050541_A_Sohlh1
  gRNA
uggucagcgagagagaacgc

SEQ ID NO: 50542 - RNA, 20 nt, Artificial Sequence
  MKO10050542_A_Sohlh1
  gRNA
cacugaaugacaacgcgcuc

SEQ ID NO: 50543 - RNA, 20 nt, Artificial Sequence
  MKO10050543_A_Sohlh2
  gRNA
cagacgucccgcagugaacu

SEQ ID NO: 50544 - RNA, 20 nt, Artificial Sequence
  MKO10050544_A_Sohlh2
  gRNA
aacgcccuccgaguucacug

SEQ ID NO: 50545 - RNA, 20 nt, Artificial Sequence
  MKO10050545_A_Sohlh2
  gRNA
ugaacacggugauacacuac

SEQ ID NO: 50546 - RNA, 20 nt, Artificial Sequence
  MKO10050546_A_Son
  gRNA
cagaccgugaucuucuccga

SEQ ID NO: 50547 - RNA, 20 nt, Artificial Sequence
  MKO10050547_A_Son
  gRNA
cucggagucgaaccccgagu

SEQ ID NO: 50548 - RNA, 20 nt, Artificial Sequence
  MKO10050548_A_Son
  gRNA
ccugaaaaccugcucgaugu

SEQ ID NO: 50549 - RNA, 20 nt, Artificial Sequence
  MKO10050549_A_Sorbs1
  gRNA
ggagggcugggcguugccau

SEQ ID NO: 50550 - RNA, 20 nt, Artificial Sequence
  MKO10050550_A_Sorbs1
  gRNA
gguuccccuguaggaagacg

SEQ ID NO: 50551 - RNA, 20 nt, Artificial Sequence
  MKO10050551_A_Sorbs1
  gRNA
ccgaagcaugaaagcaaguc

SEQ ID NO: 50552 - RNA, 20 nt, Artificial Sequence
  MKO10050552_A_Sorbs2
  gRNA
agacaaaagaucaccgaccc

SEQ ID NO: 50553 - RNA, 20 nt, Artificial Sequence
  MKO10050553_A_Sorbs2
  gRNA
gcaucuccguucagugucuc

SEQ ID NO: 50554 - RNA, 20 nt, Artificial Sequence
  MKO10050554_A_Sorbs2
  gRNA
acguuauaccugcagccaau

SEQ ID NO: 50555 - RNA, 20 nt, Artificial Sequence
  MKO10050555_A_Sorbs3
  gRNA
caagcgcugggugaaguacg

SEQ ID NO: 50556 - RNA, 20 nt, Artificial Sequence
  MKO10050556_A_Sorbs3
  gRNA
gagccaccauuccggaucac

SEQ ID NO: 50557 - RNA, 20 nt, Artificial Sequence
  MKO10050557_A_Sorbs3
  gRNA
ggucaccuccgaacccauau

SEQ ID NO: 50558 - RNA, 20 nt, Artificial Sequence
  MKO10050558_A_Sorcs1
  gRNA
cggggaccgugcgcuguuuc

SEQ ID NO: 50559 - RNA, 20 nt, Artificial Sequence
  MKO10050559_A_Sorcs1
  gRNA
aauuacaggucaaccgauua

SEQ ID NO: 50560 - RNA, 20 nt, Artificial Sequence
  MKO10050560_A_Sorcs1
  gRNA
ccgcugcacgcucuggccgu

SEQ ID NO: 50561 - RNA, 20 nt, Artificial Sequence
  MKO10050561_A_Sorcs2
  gRNA
guagguugucccaaaaucug

SEQ ID NO: 50562 - RNA, 20 nt, Artificial Sequence
  MKO10050562_A_Sorcs2
  gRNA
caaggugcuggccuacacca

SEQ ID NO: 50563 - RNA, 20 nt, Artificial Sequence
  MKO10050563_A_Sorcs2
  gRNA
caccgagggaugagcucacc

SEQ ID NO: 50564 - RNA, 20 nt, Artificial Sequence
  MKO10050564_A_Sorcs3
  gRNA
augaacgcaucacgcccaac

SEQ ID NO: 50565 - RNA, 20 nt, Artificial Sequence
  MKO10050565_A_Sorcs3
  gRNA
ccaucgucugccgaagucca

SEQ ID NO: 50566 - RNA, 20 nt, Artificial Sequence
  MKO10050566_A_Sorcs3
  gRNA
uacugcaggucaguagauua

SEQ ID NO: 50567 - RNA, 20 nt, Artificial Sequence
  MKO10050567_A_Sord
  gRNA
cuaccauuugggccgagcuc

SEQ ID NO: 50568 - RNA, 20 nt, Artificial Sequence
  MKO10050568_A_Sord
  gRNA
ucuuaccagcgccacacaca

SEQ ID NO: 50569 - RNA, 20 nt, Artificial Sequence
  MKO10050569_A_Sord
  gRNA
cagcauugugcuuguagaau

SEQ ID NO: 50570 - RNA, 20 nt, Artificial Sequence
  MKO10050570_A_Sorl1
  gRNA
augcuuacgcccaauaccuc

SEQ ID NO: 50571 - RNA, 20 nt, Artificial Sequence
  MKO10050571_A_Sorl1
  gRNA
aggagaucagccgcccggaa

SEQ ID NO: 50572 - RNA, 20 nt, Artificial Sequence
  MKO10050572_A_Sorl1
  gRNA
guguaugugucuuacgacua

SEQ ID NO: 50573 - RNA, 20 nt, Artificial Sequence
  MKO10050573_A_Sort1
  gRNA
gccaaauuccguccgaauga

SEQ ID NO: 50574 - RNA, 20 nt, Artificial Sequence
  MKO10050574_A_Sort1
  gRNA
gucucaccuucgauacaacu

SEQ ID NO: 50575 - RNA, 20 nt, Artificial Sequence
  MKO10050575_A_Sort1
  gRNA
acggaauuuggcauggcuau

SEQ ID NO: 50576 - RNA, 20 nt, Artificial Sequence
  MKO10050576_A_Sos1
  gRNA
gaugaagagccuuccaccuc

SEQ ID NO: 50577 - RNA, 20 nt, Artificial Sequence
  MKO10050577_A_Sos1
  gRNA
cgguuauaaaauugaccacc

SEQ ID NO: 50578 - RNA, 20 nt, Artificial Sequence
  MKO10050578_A_Sos1
  gRNA
uuccucauccaauugauaag

SEQ ID NO: 50579 - RNA, 20 nt, Artificial Sequence
  MKO10050579_A_Sos2
  gRNA
uaaacuauuaugaccucguc

SEQ ID NO: 50580 - RNA, 20 nt, Artificial Sequence
  MKO10050580_A_Sos2
  gRNA
uuugauggacauguucgauc

SEQ ID NO: 50581 - RNA, 20 nt, Artificial Sequence
  MKO10050581_A_Sos2
  gRNA
gcugcuuaauaagcuaugca

SEQ ID NO: 50582 - RNA, 20 nt, Artificial Sequence
  MKO10050582_A_Sostdc1
  gRNA
gcgcaccuacaaaaucaccg

SEQ ID NO: 50583 - RNA, 20 nt, Artificial Sequence
  MKO10050583_A_Sostdc1
  gRNA
ucacggcgugcaagugcaag

SEQ ID NO: 50584 - RNA, 20 nt, Artificial Sequence
  MKO10050584_A_Sostdc1
  gRNA
acagcacccugaaucaagcc

SEQ ID NO: 50585 - RNA, 20 nt, Artificial Sequence
  MKO10050585_A_Sost
  gRNA
ccaccacuucacgcgcccga

SEQ ID NO: 50586 - RNA, 20 nt, Artificial Sequence
  MKO10050586_A_Sost
  gRNA
gugaagugguggcgcccgaa

SEQ ID NO: 50587 - RNA, 20 nt, Artificial Sequence
  MKO10050587_A_Sost
  gRNA
ucccguaccuuuggcgucau

SEQ ID NO: 50588 - RNA, 20 nt, Artificial Sequence
  MKO10050588_A_Sowaha
  gRNA
caguaaacgccucagcgcgu

SEQ ID NO: 50589 - RNA, 20 nt, Artificial Sequence
  MKO10050589_A_Sowaha
  gRNA
cacgccggccgcuguagucg

SEQ ID NO: 50590 - RNA, 20 nt, Artificial Sequence
  MKO10050590_A_Sowaha
  gRNA
agagcgcgcguucacgucca

SEQ ID NO: 50591 - RNA, 20 nt, Artificial Sequence
  MKO10050591_A_Sowahb
  gRNA
gcagcucugcguuacgcacu

SEQ ID NO: 50592 - RNA, 20 nt, Artificial Sequence
  MKO10050592_A_Sowahb
  gRNA
uucgggcuguccuccgggcu

SEQ ID NO: 50593 - RNA, 20 nt, Artificial Sequence
  MKO10050593_A_Sowahb
  gRNA
cgcgacccucacgugucucc

SEQ ID NO: 50594 - RNA, 20 nt, Artificial Sequence
  MKO10050594_A_Sowahc
  gRNA
ccgggcgggacacucggaau

SEQ ID NO: 50595 - RNA, 20 nt, Artificial Sequence
  MKO10050595_A_Sowahc
  gRNA
ccgagagcccccgcguaucg

SEQ ID NO: 50596 - RNA, 20 nt, Artificial Sequence
  MKO10050596_A_Sowahc
  gRNA
caccgugcgcaccgaucccg

SEQ ID NO: 50597 - RNA, 20 nt, Artificial Sequence
  MKO10050597_A_Sowahd
  gRNA
gccacugugaucucgacgcg

SEQ ID NO: 50598 - RNA, 20 nt, Artificial Sequence
  MKO10050598_A_Sowahd
  gRNA
ccguuugaugugagcgcccc

SEQ ID NO: 50599 - RNA, 20 nt, Artificial Sequence
  MKO10050599_A_Sowahd
  gRNA
gucgcugggcgccuccgacu

SEQ ID NO: 50600 - RNA, 20 nt, Artificial Sequence
  MKO10050600_A_Sox10
  gRNA
gggaagccccacaucgacuu

SEQ ID NO: 50601 - RNA, 20 nt, Artificial Sequence
  MKO10050601_A_Sox10
  gRNA
cccagcgacggcgcgcugcc

SEQ ID NO: 50602 - RNA, 20 nt, Artificial Sequence
  MKO10050602_A_Sox10
  gRNA
cgggauagagucguauauac

SEQ ID NO: 50603 - RNA, 20 nt, Artificial Sequence
  MKO10050603_A_Sox11
  gRNA
ccgcgcgcacuucgucguac

SEQ ID NO: 50604 - RNA, 20 nt, Artificial Sequence
  MKO10050604_A_Sox11
  gRNA
ccuguacgacgaagugcgcg

SEQ ID NO: 50605 - RNA, 20 nt, Artificial Sequence
  MKO10050605_A_Sox11
  gRNA
gguccuuauccaccagcgac

SEQ ID NO: 50606 - RNA, 20 nt, Artificial Sequence
  MKO10050606_A_Sox12
  gRNA
cucgucuaguaucgccgacc

SEQ ID NO: 50607 - RNA, 20 nt, Artificial Sequence
  MKO10050607_A_Sox12
  gRNA
ccgcuuaauguggccgcucg

SEQ ID NO: 50608 - RNA, 20 nt, Artificial Sequence
  MKO10050608_A_Sox12
  gRNA
ucgaaaugugacgugcccga

SEQ ID NO: 50609 - RNA, 20 nt, Artificial Sequence
  MKO10050609_A_Sox13
  gRNA
cuucaaccgcaacuuacagg

SEQ ID NO: 50610 - RNA, 20 nt, Artificial Sequence
  MKO10050610_A_Sox13
  gRNA
ccguaaggagcuggucccga

SEQ ID NO: 50611 - RNA, 20 nt, Artificial Sequence
  MKO10050611_A_Sox13
  gRNA
gccuacccuccuguaaguug

SEQ ID NO: 50612 - RNA, 20 nt, Artificial Sequence
  MKO10050612_A_Sox14
  gRNA
gggguuacauggccguagcg

SEQ ID NO: 50613 - RNA, 20 nt, Artificial Sequence
  MKO10050613_A_Sox14
  gRNA
ccugggccaucuugcgccgc

SEQ ID NO: 50614 - RNA, 20 nt, Artificial Sequence
  MKO10050614_A_Sox14
  gRNA
ugagcgcgcccgagaaagcc

SEQ ID NO: 50615 - RNA, 20 nt, Artificial Sequence
  MKO10050615_A_Sox15
  gRNA
acuuguagucgggauagucg

SEQ ID NO: 50616 - RNA, 20 nt, Artificial Sequence
  MKO10050616_A_Sox15
  gRNA
cucuguucagcgccgccaga

SEQ ID NO: 50617 - RNA, 20 nt, Artificial Sequence
  MKO10050617_A_Sox15
  gRNA
gccaguuaaagguggguuac

SEQ ID NO: 50618 - RNA, 20 nt, Artificial Sequence
  MKO10050618_A_Sox17
  gRNA
ccggaugcgagacuccgcuu

SEQ ID NO: 50619 - RNA, 20 nt, Artificial Sequence
  MKO10050619_A_Sox17
  gRNA
gaaaccgcgccccgcacuug

SEQ ID NO: 50620 - RNA, 20 nt, Artificial Sequence
  MKO10050620_A_Sox17
  gRNA
cugggcgcucccgcgcucga

SEQ ID NO: 50621 - RNA, 20 nt, Artificial Sequence
  MKO10050621_A_Sox18
  gRNA
ccgccgaaugcgcaacucgu

SEQ ID NO: 50622 - RNA, 20 nt, Artificial Sequence
  MKO10050622_A_Sox18
  gRNA
cugccgacgaguugcgcauu

SEQ ID NO: 50623 - RNA, 20 nt, Artificial Sequence
  MKO10050623_A_Sox18
  gRNA
ccgcaaaaaacaggcgcgca

SEQ ID NO: 50624 - RNA, 20 nt, Artificial Sequence
  MKO10050624_A_Sox1
  gRNA
ggagccgagcggcaguccgc

SEQ ID NO: 50625 - RNA, 20 nt, Artificial Sequence
  MKO10050625_A_Sox1
  gRNA
cgcggcgcuagaugugcguc

SEQ ID NO: 50626 - RNA, 20 nt, Artificial Sequence
  MKO10050626_A_Sox1
  gRNA
cggcaucccuuacggcgccg

SEQ ID NO: 50627 - RNA, 20 nt, Artificial Sequence
  MKO10050627_A_Sox21
  gRNA
gggucauagcgcggcagcgu

SEQ ID NO: 50628 - RNA, 20 nt, Artificial Sequence
  MKO10050628_A_Sox21
  gRNA
uaccccagcgacgacgcgua

SEQ ID NO: 50629 - RNA, 20 nt, Artificial Sequence
  MKO10050629_A_Sox21
  gRNA
ccugccguacgcgucgucgc

SEQ ID NO: 50630 - RNA, 20 nt, Artificial Sequence
  MKO10050630_A_Sox2
  gRNA
ggugggcgagccguucaugu

SEQ ID NO: 50631 - RNA, 20 nt, Artificial Sequence
  MKO10050631_A_Sox2
  gRNA
gcuacgcgcacaugaacggc

SEQ ID NO: 50632 - RNA, 20 nt, Artificial Sequence
  MKO10050632_A_Sox2
  gRNA
aaaguuuccacuccgcgccc

SEQ ID NO: 50633 - RNA, 20 nt, Artificial Sequence
  MKO10050633_A_Sox30
  gRNA
ccgaagcacuccgauacccc

SEQ ID NO: 50634 - RNA, 20 nt, Artificial Sequence
  MKO10050634_A_Sox30
  gRNA
caaugucacugacagcgacg

SEQ ID NO: 50635 - RNA, 20 nt, Artificial Sequence
  MKO10050635_A_Sox30
  gRNA
uaccuugacgggaaguaaug

SEQ ID NO: 50636 - RNA, 20 nt, Artificial Sequence
  MKO10050636_A_Sox3
  gRNA
gaguucccgccgacuuugcg

SEQ ID NO: 50637 - RNA, 20 nt, Artificial Sequence
  MKO10050637_A_Sox3
  gRNA
gcgcugcgagugcgaagcga

SEQ ID NO: 50638 - RNA, 20 nt, Artificial Sequence
  MKO10050638_A_Sox3
  gRNA
cgaagggcuccgcgcaaagu

SEQ ID NO: 50639 - RNA, 20 nt, Artificial Sequence
  MKO10050639_A_Sox4
  gRNA
gcuccucaucggcgcucgau

SEQ ID NO: 50640 - RNA, 20 nt, Artificial Sequence
  MKO10050640_A_Sox4
  gRNA
cgccuugccgcccgucgacg

SEQ ID NO: 50641 - RNA, 20 nt, Artificial Sequence
  MKO10050641_A_Sox4
  gRNA
gggaguccgcaccuuguaga

SEQ ID NO: 50642 - RNA, 20 nt, Artificial Sequence
  MKO10050642_A_Sox5
  gRNA
aagcgaccagccucuccgua

SEQ ID NO: 50643 - RNA, 20 nt, Artificial Sequence
  MKO10050643_A_Sox5
  gRNA
uaagcugcccuugcgccgcu

SEQ ID NO: 50644 - RNA, 20 nt, Artificial Sequence
  MKO10050644_A_Sox5
  gRNA
guccgugucgagcgcagccc

SEQ ID NO: 50645 - RNA, 20 nt, Artificial Sequence
  MKO10050645_A_Sox6
  gRNA
aggcucccuuugcggcguuc

SEQ ID NO: 50646 - RNA, 20 nt, Artificial Sequence
  MKO10050646_A_Sox6
  gRNA
guggugagguagacguauuu

SEQ ID NO: 50647 - RNA, 20 nt, Artificial Sequence
  MKO10050647_A_Sox6
  gRNA
cuaaauacgagugaacuucu

SEQ ID NO: 50648 - RNA, 20 nt, Artificial Sequence
  MKO10050648_A_Sox7
  gRNA
caagcgccucugcaagcgcg

SEQ ID NO: 50649 - RNA, 20 nt, Artificial Sequence
  MKO10050649_A_Sox7
  gRNA
cuauccguggaccgagggac

SEQ ID NO: 50650 - RNA, 20 nt, Artificial Sequence
  MKO10050650_A_Sox7
  gRNA
cugcacagcugcuaccgcga

SEQ ID NO: 50651 - RNA, 20 nt, Artificial Sequence
  MKO10050651_A_Sox8
  gRNA
acaggcggcgcgccgcaagc

SEQ ID NO: 50652 - RNA, 20 nt, Artificial Sequence
  MKO10050652_A_Sox8
  gRNA
ccuaugccugugcgcggcgg

SEQ ID NO: 50653 - RNA, 20 nt, Artificial Sequence
  MKO10050653_A_Sox8
  gRNA
caugugacuggucguuguag

SEQ ID NO: 50654 - RNA, 20 nt, Artificial Sequence
  MKO10050654_A_Sox9
  gRNA
cagcguagucguauugcgag

SEQ ID NO: 50655 - RNA, 20 nt, Artificial Sequence
  MKO10050655_A_Sox9
  gRNA
ccgucuugaugugcguucgc

SEQ ID NO: 50656 - RNA, 20 nt, Artificial Sequence
  MKO10050656_A_Sox9
  gRNA
gguguucuccguguccgagc

SEQ ID NO: 50657 - RNA, 20 nt, Artificial Sequence
  MKO10050657_A_Sp100
  gRNA
aaucucauucguagaagcuu

SEQ ID NO: 50658 - RNA, 20 nt, Artificial Sequence
  MKO10050658_A_Sp100
  gRNA
uaccuuguucaagacuuagc

SEQ ID NO: 50659 - RNA, 20 nt, Artificial Sequence
  MKO10050659_A_Sp100
  gRNA
agaucuaaggaugacccauu

SEQ ID NO: 50660 - RNA, 20 nt, Artificial Sequence
  MKO10050660_A_Sp110
  gRNA
guacuucccuggccauuucc

SEQ ID NO: 50661 - RNA, 20 nt, Artificial Sequence
  MKO10050661_A_Sp110
  gRNA
ccccgagcugugccucuccu

SEQ ID NO: 50662 - RNA, 20 nt, Artificial Sequence
  MKO10050662_A_Sp110
  gRNA
ucuggaagccugucaaaauc

SEQ ID NO: 50663 - RNA, 20 nt, Artificial Sequence
  MKO10050663_A_Sp140
  gRNA
acaaacaagacaagagcccc

SEQ ID NO: 50664 - RNA, 20 nt, Artificial Sequence
  MKO10050664_A_Sp140
  gRNA
ucugcuccgagaugaagucu

SEQ ID NO: 50665 - RNA, 20 nt, Artificial Sequence
  MKO10050665_A_Sp140
  gRNA
guccccuaggacaaucccag

SEQ ID NO: 50666 - RNA, 20 nt, Artificial Sequence
  MKO10050666_A_Sp1
  gRNA
aucuccgagcacacuugcgc

SEQ ID NO: 50667 - RNA, 20 nt, Artificial Sequence
  MKO10050667_A_Sp1
  gRNA
cauauacuuugccgcauccu

SEQ ID NO: 50668 - RNA, 20 nt, Artificial Sequence
  MKO10050668_A_Sp1
  gRNA
gguugguguccgaaugauga

SEQ ID NO: 50669 - RNA, 20 nt, Artificial Sequence
  MKO10050669_A_Sp2
  gRNA
augcgccgccguuucucccc

SEQ ID NO: 50670 - RNA, 20 nt, Artificial Sequence
  MKO10050670_A_Sp2
  gRNA
cugaccgugcagaacguuuc

SEQ ID NO: 50671 - RNA, 20 nt, Artificial Sequence
  MKO10050671_A_Sp2
  gRNA
caauaucgcugguguucacc

SEQ ID NO: 50672 - RNA, 20 nt, Artificial Sequence
  MKO10050672_A_Sp3
  gRNA
cgaaaagcccgugaaacaag

SEQ ID NO: 50673 - RNA, 20 nt, Artificial Sequence
  MKO10050673_A_Sp3
  gRNA
gcugcuguagauacucgccg

SEQ ID NO: 50674 - RNA, 20 nt, Artificial Sequence
  MKO10050674_A_Sp3
  gRNA
aucgccgggcgacgacgacg

SEQ ID NO: 50675 - RNA, 20 nt, Artificial Sequence
  MKO10050675_A_Sp4
  gRNA
gggcgauucaggcauaguac

SEQ ID NO: 50676 - RNA, 20 nt, Artificial Sequence
  MKO10050676_A_Sp4
  gRNA
gggauugcuaaugcgacaau

SEQ ID NO: 50677 - RNA, 20 nt, Artificial Sequence
  MKO10050677_A_Sp4
  gRNA
aauggugcguucagaacuac

SEQ ID NO: 50678 - RNA, 20 nt, Artificial Sequence
  MKO10050678_A_Sp5
  gRNA
agcaucccgcaaucgggcgc

SEQ ID NO: 50679 - RNA, 20 nt, Artificial Sequence
  MKO10050679_A_Sp5
  gRNA
ccaacacuagaccccguugc

SEQ ID NO: 50680 - RNA, 20 nt, Artificial Sequence
  MKO10050680_A_Sp5
  gRNA
ccuccggaacgacucacugc

SEQ ID NO: 50681 - RNA, 20 nt, Artificial Sequence
  MKO10050681_A_Sp6
  gRNA
gccggaaccacgauucauag

SEQ ID NO: 50682 - RNA, 20 nt, Artificial Sequence
  MKO10050682_A_Sp6
  gRNA
cucgcagguuacccgcgagg

SEQ ID NO: 50683 - RNA, 20 nt, Artificial Sequence
  MKO10050683_A_Sp6
  gRNA
cggugaagcgugaggcgcgu

SEQ ID NO: 50684 - RNA, 20 nt, Artificial Sequence
  MKO10050684_A_Sp7
  gRNA
cccgggugugagugcgcacg

SEQ ID NO: 50685 - RNA, 20 nt, Artificial Sequence
  MKO10050685_A_Sp7
  gRNA
guucacucgcucugacgagc

SEQ ID NO: 50686 - RNA, 20 nt, Artificial Sequence
  MKO10050686_A_Sp7
  gRNA
gauggcguccucucugcuug

SEQ ID NO: 50687 - RNA, 20 nt, Artificial Sequence
  MKO10050687_A_Sp8
  gRNA
ggaccccccuaacugcgccg

SEQ ID NO: 50688 - RNA, 20 nt, Artificial Sequence
  MKO10050688_A_Sp8
  gRNA
gcuauccugcgagugcgcuc

SEQ ID NO: 50689 - RNA, 20 nt, Artificial Sequence
  MKO10050689_A_Sp8
  gRNA
cagcggcgacggggcggaau

SEQ ID NO: 50690 - RNA, 20 nt, Artificial Sequence
  MKO10050690_A_Sp9
  gRNA
ccacgaugacgccgcgccgu

SEQ ID NO: 50691 - RNA, 20 nt, Artificial Sequence
  MKO10050691_A_Sp9
  gRNA
cgcccgccgcuagggucgag

SEQ ID NO: 50692 - RNA, 20 nt, Artificial Sequence
  MKO10050692_A_Sp9
  gRNA
acuuaccccaaguauagacg

SEQ ID NO: 50693 - RNA, 20 nt, Artificial Sequence
  MKO10050693_A_Spa17
  gRNA
aagacuauaccuugaaugcg

SEQ ID NO: 50694 - RNA, 20 nt, Artificial Sequence
  MKO10050694_A_Spa17
  gRNA
aaauacgcugcggcaaaagc

SEQ ID NO: 50695 - RNA, 20 nt, Artificial Sequence
  MKO10050695_A_Spa17
  gRNA
acccacuaccgaauuccaca

SEQ ID NO: 50696 - RNA, 20 nt, Artificial Sequence
  MKO10050696_A_Spaca1
  gRNA
aacgagagaaauucguccuc

SEQ ID NO: 50697 - RNA, 20 nt, Artificial Sequence
  MKO10050697_A_Spaca1
  gRNA
aacuuacagccacaaucaac

SEQ ID NO: 50698 - RNA, 20 nt, Artificial Sequence
  MKO10050698_A_Spaca1
  gRNA
ugccguggaccuguugauug

SEQ ID NO: 50699 - RNA, 20 nt, Artificial Sequence
  MKO10050699_A_Spaca3
  gRNA
uggcuaccgggguuauaacc

SEQ ID NO: 50700 - RNA, 20 nt, Artificial Sequence
  MKO10050700_A_Spaca3
  gRNA
ugcagaacccucgccucgaa

SEQ ID NO: 50701 - RNA, 20 nt, Artificial Sequence
  MKO10050701_A_Spaca3
  gRNA
agagaugcaugacuucgguc

SEQ ID NO: 50702 - RNA, 20 nt, Artificial Sequence
  MKO10050702_A_Spaca4
  gRNA
gaugacgaagauugcuucac

SEQ ID NO: 50703 - RNA, 20 nt, Artificial Sequence
  MKO10050703_A_Spaca4
  gRNA
uguagcugauggguuccucg

SEQ ID NO: 50704 - RNA, 20 nt, Artificial Sequence
  MKO10050704_A_Spaca4
  gRNA
caccuuugcaauaagggcac

SEQ ID NO: 50705 - RNA, 20 nt, Artificial Sequence
  MKO10050705_A_Spaca5
  gRNA
cucugcaacaucgauuguaa

SEQ ID NO: 50706 - RNA, 20 nt, Artificial Sequence
  MKO10050706_A_Spaca5
  gRNA
cauuacaaucgauguugcag

SEQ ID NO: 50707 - RNA, 20 nt, Artificial Sequence
  MKO10050707_A_Spaca5
  gRNA
ccugcucaaccgccauauuc

SEQ ID NO: 50708 - RNA, 20 nt, Artificial Sequence
  MKO10050708_A_Spaca6
  gRNA
cucucaccuggacaaucgag

SEQ ID NO: 50709 - RNA, 20 nt, Artificial Sequence
  MKO10050709_A_Spaca6
  gRNA
gaucugccucucgauugucc

SEQ ID NO: 50710 - RNA, 20 nt, Artificial Sequence
  MKO10050710_A_Spaca6
  gRNA
uaccuucagacuaugaugag

SEQ ID NO: 50711 - RNA, 20 nt, Artificial Sequence
  MKO10050711_A_Spaca7
  gRNA
guugucaguaucgaugaucu

SEQ ID NO: 50712 - RNA, 20 nt, Artificial Sequence
  MKO10050712_A_Spaca7
  gRNA
gagccacccucgucuccuga

SEQ ID NO: 50713 - RNA, 20 nt, Artificial Sequence
  MKO10050713_A_Spaca7
  gRNA
gaaaacauacccgaagcauu

SEQ ID NO: 50714 - RNA, 20 nt, Artificial Sequence
  MKO10050714_A_Spag11a
  gRNA
caccgugugccucaugcaac

SEQ ID NO: 50715 - RNA, 20 nt, Artificial Sequence
  MKO10050715_A_Spag11a
  gRNA
gggauaucugcuccgacccc

SEQ ID NO: 50716 - RNA, 20 nt, Artificial Sequence
  MKO10050716_A_Spag11a
  gRNA
gacauuuaccugaguuuccu

SEQ ID NO: 50717 - RNA, 20 nt, Artificial Sequence
  MKO10050717_A_Spag11b
  gRNA
gcuugacuuaccgugguaag

SEQ ID NO: 50718 - RNA, 20 nt, Artificial Sequence
  MKO10050718_A_Spag11b
  gRNA
gacccauuuacuccucgagc

SEQ ID NO: 50719 - RNA, 20 nt, Artificial Sequence
  MKO10050719_A_Spag11b
  gRNA
ucagaacggauguaagcagc

SEQ ID NO: 50720 - RNA, 20 nt, Artificial Sequence
  MKO10050720_A_Spag16
  gRNA
uaaugguuuaccacucggcc

SEQ ID NO: 50721 - RNA, 20 nt, Artificial Sequence
  MKO10050721_A_Spag16
  gRNA
uguucccgaugucuacagcc

SEQ ID NO: 50722 - RNA, 20 nt, Artificial Sequence
  MKO10050722_A_Spag16
  gRNA
aucuuccgauguuuccguua

SEQ ID NO: 50723 - RNA, 20 nt, Artificial Sequence
  MKO10050723_A_Spag17
  gRNA
acacugaccgauauaggauu

SEQ ID NO: 50724 - RNA, 20 nt, Artificial Sequence
  MKO10050724_A_Spag17
  gRNA
uuacucaccucguaauguaa

SEQ ID NO: 50725 - RNA, 20 nt, Artificial Sequence
  MKO10050725_A_Spag17
  gRNA
caauuuaccguuacauuacg

SEQ ID NO: 50726 - RNA, 20 nt, Artificial Sequence
  MKO10050726_A_Spag1
  gRNA
ccacucuuccgcugaaaagc

SEQ ID NO: 50727 - RNA, 20 nt, Artificial Sequence
  MKO10050727_A_Spag1
  gRNA
ucgcaaaauuccgugaguuc

SEQ ID NO: 50728 - RNA, 20 nt, Artificial Sequence
  MKO10050728_A_Spag1
  gRNA
cagcagguggagccgcggac

SEQ ID NO: 50729 - RNA, 20 nt, Artificial Sequence
  MKO10050729_A_Spag4
  gRNA
agaccagcccaucgacugcc

SEQ ID NO: 50730 - RNA, 20 nt, Artificial Sequence
  MKO10050730_A_Spag4
  gRNA
acucaaccuucucccgaucc

SEQ ID NO: 50731 - RNA, 20 nt, Artificial Sequence
  MKO10050731_A_Spag4
  gRNA
ggcaggagaugccuaccccg

SEQ ID NO: 50732 - RNA, 20 nt, Artificial Sequence
  MKO10050732_A_Spag5
  gRNA
gaccuuucccugaaucggcg

SEQ ID NO: 50733 - RNA, 20 nt, Artificial Sequence
  MKO10050733_A_Spag5
  gRNA
uaccuugucccgacacgacu

SEQ ID NO: 50734 - RNA, 20 nt, Artificial Sequence
  MKO10050734_A_Spag5
  gRNA
caagcuucuaugugcguuga

SEQ ID NO: 50735 - RNA, 20 nt, Artificial Sequence
  MKO10050735_A_Spag6
  gRNA
ccaucugcacgaauugcguc

SEQ ID NO: 50736 - RNA, 20 nt, Artificial Sequence
  MKO10050736_A_Spag6
  gRNA
ucugcagcguuucgauguuu

SEQ ID NO: 50737 - RNA, 20 nt, Artificial Sequence
  MKO10050737_A_Spag6
  gRNA
ugcaauguauccgagugccc

SEQ ID NO: 50738 - RNA, 20 nt, Artificial Sequence
  MKO10050738_A_Spag7
  gRNA
gagcuagacuccuaccguca

SEQ ID NO: 50739 - RNA, 20 nt, Artificial Sequence
  MKO10050739_A_Spag7
  gRNA
cuccgcucuaucuuguucau

SEQ ID NO: 50740 - RNA, 20 nt, Artificial Sequence
  MKO10050740_A_Spag7
  gRNA
ucugauuucauccaggacag

SEQ ID NO: 50741 - RNA, 20 nt, Artificial Sequence
  MKO10050741_A_Spag8
  gRNA
cccguaaagacugucagaag

SEQ ID NO: 50742 - RNA, 20 nt, Artificial Sequence
  MKO10050742_A_Spag8
  gRNA
gcugaggucugccauauuac

SEQ ID NO: 50743 - RNA, 20 nt, Artificial Sequence
  MKO10050743_A_Spag8
  gRNA
gaagcucuuugagaccgagu

SEQ ID NO: 50744 - RNA, 20 nt, Artificial Sequence
  MKO10050744_A_Spag9
  gRNA
cauugaauccacuccugaau

SEQ ID NO: 50745 - RNA, 20 nt, Artificial Sequence
  MKO10050745_A_Spag9
  gRNA
uucaggcugguaugagaacg

SEQ ID NO: 50746 - RNA, 20 nt, Artificial Sequence
  MKO10050746_A_Spag9
  gRNA
uccuccugauacuccgucaa

SEQ ID NO: 50747 - RNA, 20 nt, Artificial Sequence
  MKO10050747_A_Spam1
  gRNA
gcuaagcccaauuugucguc

SEQ ID NO: 50748 - RNA, 20 nt, Artificial Sequence
  MKO10050748_A_Spam1
  gRNA
cuauguccgcuaccgaguug

SEQ ID NO: 50749 - RNA, 20 nt, Artificial Sequence
  MKO10050749_A_Spam1
  gRNA
guacugacuagugucuuccg

SEQ ID NO: 50750 - RNA, 20 nt, Artificial Sequence
  MKO10050750_A_Sparcl1
  gRNA
ccucgccgccgccauauuug

SEQ ID NO: 50751 - RNA, 20 nt, Artificial Sequence
  MKO10050751_A_Sparcl1
  gRNA
ccuuugugauguuugcgcgu

SEQ ID NO: 50752 - RNA, 20 nt, Artificial Sequence
  MKO10050752_A_Sparcl1
  gRNA
auggggacuguagcgucuuc

SEQ ID NO: 50753 - RNA, 20 nt, Artificial Sequence
  MKO10050753_A_Sparc
  gRNA
uaccuucucaaacucgccaa

SEQ ID NO: 50754 - RNA, 20 nt, Artificial Sequence
  MKO10050754_A_Sparc
  gRNA
ugcagaggaaacggucgagg

SEQ ID NO: 50755 - RNA, 20 nt, Artificial Sequence
  MKO10050755_A_Sparc
  gRNA
gaagggccacaagcuccacc

SEQ ID NO: 50756 - RNA, 20 nt, Artificial Sequence
  MKO10050756_A_Spast
  gRNA
cacugcaacuaggcgcccug

SEQ ID NO: 50757 - RNA, 20 nt, Artificial Sequence
  MKO10050757_A_Spast
  gRNA
acuaaccugacaugccgcaa

SEQ ID NO: 50758 - RNA, 20 nt, Artificial Sequence
  MKO10050758_A_Spast
  gRNA
auagacguccgucugugacu

SEQ ID NO: 50759 - RNA, 20 nt, Artificial Sequence
  MKO10050759_A_Spaua13
  gRNA
ugcggagucuucggccuuag

SEQ ID NO: 50760 - RNA, 20 nt, Artificial Sequence
  MKO10050760_A_Spaua13
  gRNA
aggcgaccuauaucugugau

SEQ ID NO: 50761 - RNA, 20 nt, Artificial Sequence
  MKO10050761_A_Spaua13
  gRNA
ggggcucgggacgccgcacc

SEQ ID NO: 50762 - RNA, 20 nt, Artificial Sequence
  MKO10050762_A_Spaua16
  gRNA
ggucaggcuuccgcauacgu

SEQ ID NO: 50763 - RNA, 20 nt, Artificial Sequence
  MKO10050763_A_Spaua16
  gRNA
uuuccgaaaccaucuucguc

SEQ ID NO: 50764 - RNA, 20 nt, Artificial Sequence
  MKO10050764_A_Spaua16
  gRNA
cgcugucagccuuccguuua

SEQ ID NO: 50765 - RNA, 20 nt, Artificial Sequence
  MKO10050765_A_Spaua17
  gRNA
gccaaguccgggccuauaug

SEQ ID NO: 50766 - RNA, 20 nt, Artificial Sequence
  MKO10050766_A_Spaua17
  gRNA
uagccauguccuucaacucc

SEQ ID NO: 50767 - RNA, 20 nt, Artificial Sequence
  MKO10050767_A_Spaua17
  gRNA
cuagcgccguugauucauuu

SEQ ID NO: 50768 - RNA, 20 nt, Artificial Sequence
  MKO10050768_A_Spaua18
  gRNA
ggauaugguugauccguucu

SEQ ID NO: 50769 - RNA, 20 nt, Artificial Sequence
  MKO10050769_A_Spaua18
  gRNA
ccucuuacucgucuugaacc

SEQ ID NO: 50770 - RNA, 20 nt, Artificial Sequence
  MKO10050770_A_Spaua18
  gRNA
cgaacaaguugcuaaagugc

SEQ ID NO: 50771 - RNA, 20 nt, Artificial Sequence
  MKO10050771_A_Spaua19
  gRNA
cuguauccguugugcagcac

SEQ ID NO: 50772 - RNA, 20 nt, Artificial Sequence
  MKO10050772_A_Spaua19
  gRNA
gaauagaucaagugagacga

SEQ ID NO: 50773 - RNA, 20 nt, Artificial Sequence
  MKO10050773_A_Spaua19
  gRNA
caaggauccaguuuauaaga

SEQ ID NO: 50774 - RNA, 20 nt, Artificial Sequence
  MKO10050774_A_Spaua1
  gRNA
uuauaguuccacgauccuuc

SEQ ID NO: 50775 - RNA, 20 nt, Artificial Sequence
  MKO10050775_A_Spaua1
  gRNA
aaugauacuacggagauuaa

SEQ ID NO: 50776 - RNA, 20 nt, Artificial Sequence
  MKO10050776_A_Spaua1
  gRNA
acgcucccucagagcuugua

SEQ ID NO: 50777 - RNA, 20 nt, Artificial Sequence
  MKO10050777_A_Spaua20
  gRNA
aaguaggugcccccaacgaa

SEQ ID NO: 50778 - RNA, 20 nt, Artificial Sequence
  MKO10050778_A_Spaua20
  gRNA
auggcucucaccaauccacc

SEQ ID NO: 50779 - RNA, 20 nt, Artificial Sequence
  MKO10050779_A_Spaua20
  gRNA
cucauugaucaggcgauuga

SEQ ID NO: 50780 - RNA, 20 nt, Artificial Sequence
  MKO10050780_A_Spaua21
  gRNA
aggagcccucagcaagaccg

SEQ ID NO: 50781 - RNA, 20 nt, Artificial Sequence
  MKO10050781_A_Spaua21
  gRNA
gacucacaaggacaaccccc

SEQ ID NO: 50782 - RNA, 20 nt, Artificial Sequence
  MKO10050782_A_Spaua21
  gRNA
caagagccgaugccagcgcc

SEQ ID NO: 50783 - RNA, 20 nt, Artificial Sequence
  MKO10050783_A_Spaua22
  gRNA
cugaacucacuguuugccgc

SEQ ID NO: 50784 - RNA, 20 nt, Artificial Sequence
  MKO10050784_A_Spaua22
  gRNA
uguugagcucccaaauucac

SEQ ID NO: 50785 - RNA, 20 nt, Artificial Sequence
  MKO10050785_A_Spaua22
  gRNA
auacuucugagauugggcgu

SEQ ID NO: 50786 - RNA, 20 nt, Artificial Sequence
  MKO10050786_A_Spaua24
  gRNA
gucucgccuucgaucaacug

SEQ ID NO: 50787 - RNA, 20 nt, Artificial Sequence
  MKO10050787_A_Spaua24
  gRNA
cacgucccgcaguugaucga

SEQ ID NO: 50788 - RNA, 20 nt, Artificial Sequence
  MKO10050788_A_Spaua24
  gRNA
cucccgccuaccauugcacu

SEQ ID NO: 50789 - RNA, 20 nt, Artificial Sequence
  MKO10050789_A_Spaua25
  gRNA
gucccaaauugccccccaug

SEQ ID NO: 50790 - RNA, 20 nt, Artificial Sequence
  MKO10050790_A_Spaua25
  gRNA
gguucugccaauauccuccg

SEQ ID NO: 50791 - RNA, 20 nt, Artificial Sequence
  MKO10050791_A_Spaua25
  gRNA
cgugucuccacaaagucauc

SEQ ID NO: 50792 - RNA, 20 nt, Artificial Sequence
  MKO10050792_A_Spaua2l
  gRNA
cagggacaaccaccgccuaa

SEQ ID NO: 50793 - RNA, 20 nt, Artificial Sequence
  MKO10050793_A_Spaua2l
  gRNA
ggucgccgcaaacgcccgcg

SEQ ID NO: 50794 - RNA, 20 nt, Artificial Sequence
  MKO10050794_A_Spaua2l
  gRNA
cgcggccgcgcgggcguuug

SEQ ID NO: 50795 - RNA, 20 nt, Artificial Sequence
  MKO10050795_A_Spaua2
  gRNA
aucagccgaaaucgauauaa

SEQ ID NO: 50796 - RNA, 20 nt, Artificial Sequence
  MKO10050796_A_Spaua2
  gRNA
aggccuaucuguacacgagc

SEQ ID NO: 50797 - RNA, 20 nt, Artificial Sequence
  MKO10050797_A_Spaua2
  gRNA
uggguucugaauccguauac

SEQ ID NO: 50798 - RNA, 20 nt, Artificial Sequence
  MKO10050798_A_Spaua31d1a
  gRNA
uagcgcuugccgaaagcccg

SEQ ID NO: 50799 - RNA, 20 nt, Artificial Sequence
  MKO10050799_A_Spaua31d1a
  gRNA
cuuuguuacauacgcgacaa

SEQ ID NO: 50800 - RNA, 20 nt, Artificial Sequence
  MKO10050800_A_Spaua31d1a
  gRNA
uacagcggcagaacagcauc

SEQ ID NO: 50801 - RNA, 20 nt, Artificial Sequence
  MKO10050801_A_Spaua31d1b
  gRNA
gccugcccauacgacucuuc

SEQ ID NO: 50802 - RNA, 20 nt, Artificial Sequence
  MKO10050802_A_Spaua31d1b
  gRNA
cucgaaaucggaugccuaga

SEQ ID NO: 50803 - RNA, 20 nt, Artificial Sequence
  MKO10050803_A_Spaua31d1b
  gRNA
cguuggcagcuaugggagaa

SEQ ID NO: 50804 - RNA, 20 nt, Artificial Sequence
  MKO10050804_A_Spaua31d1c
  gRNA
gcuagugaucugacgcucaa

SEQ ID NO: 50805 - RNA, 20 nt, Artificial Sequence
  MKO10050805_A_Spaua31d1c
  gRNA
acacaguaguugccgaaaau

SEQ ID NO: 50806 - RNA, 20 nt, Artificial Sequence
  MKO10050806_A_Spaua31d1c
  gRNA
aggcuuuggaucagcauucu

SEQ ID NO: 50807 - RNA, 20 nt, Artificial Sequence
  MKO10050807_A_Spaua31d1d
  gRNA
ugcgcaggauagcccgaccc

SEQ ID NO: 50808 - RNA, 20 nt, Artificial Sequence
  MKO10050808_A_Spaua31d1d
  gRNA
aacacugugucgaaccaauc

SEQ ID NO: 50809 - RNA, 20 nt, Artificial Sequence
  MKO10050809_A_Spaua31d1d
  gRNA
cuccauucuaacuagcgcua

SEQ ID NO: 50810 - RNA, 20 nt, Artificial Sequence
  MKO10050810_A_Spaua31
  gRNA
ggcaugcuccuggaacguuu

SEQ ID NO: 50811 - RNA, 20 nt, Artificial Sequence
  MKO10050811_A_Spaua31
  gRNA
aagcugcguuacgggacaag

SEQ ID NO: 50812 - RNA, 20 nt, Artificial Sequence
  MKO10050812_A_Spaua31
  gRNA
ugagccucagcuccacuaua

SEQ ID NO: 50813 - RNA, 20 nt, Artificial Sequence
  MKO10050813_A_Spaua32
  gRNA
guagacugugcuccgacgcc

SEQ ID NO: 50814 - RNA, 20 nt, Artificial Sequence
  MKO10050814_A_Spaua32
  gRNA
cgaugcgaaguugaucagau

SEQ ID NO: 50815 - RNA, 20 nt, Artificial Sequence
  MKO10050815_A_Spaua32
  gRNA
uuguguugcagcucggugcc

SEQ ID NO: 50816 - RNA, 20 nt, Artificial Sequence
  MKO10050816_A_Spaua33
  gRNA
gcuuggaugucgcgaacaac

SEQ ID NO: 50817 - RNA, 20 nt, Artificial Sequence
  MKO10050817_A_Spaua33
  gRNA
gggguccuuaccaccgacac

SEQ ID NO: 50818 - RNA, 20 nt, Artificial Sequence
  MKO10050818_A_Spaua33
  gRNA
guagcugauuagcgucucgu

SEQ ID NO: 50819 - RNA, 20 nt, Artificial Sequence
  MKO10050819_A_Spaua3
  gRNA
cuccgcuugcuggcaucguc

SEQ ID NO: 50820 - RNA, 20 nt, Artificial Sequence
  MKO10050820_A_Spaua3
  gRNA
ugcuguugcgguuuaggcuc

SEQ ID NO: 50821 - RNA, 20 nt, Artificial Sequence
  MKO10050821_A_Spaua3
  gRNA
ugcuuuguagaaaaccguca

SEQ ID NO: 50822 - RNA, 20 nt, Artificial Sequence
  MKO10050822_A_Spaua4
  gRNA
uuaccaaaugcguuugcccc

SEQ ID NO: 50823 - RNA, 20 nt, Artificial Sequence
  MKO10050823_A_Spaua4
  gRNA
uguaucugcgcuuauagcua

SEQ ID NO: 50824 - RNA, 20 nt, Artificial Sequence
  MKO10050824_A_Spaua4
  gRNA
aagcgcagauacaagucaag

SEQ ID NO: 50825 - RNA, 20 nt, Artificial Sequence
  MKO10050825_A_Spaua5l1
  gRNA
ggugagcgccccggcguugc

SEQ ID NO: 50826 - RNA, 20 nt, Artificial Sequence
  MKO10050826_A_Spaua5l1
  gRNA
gaugcgccgcacguucuccu

SEQ ID NO: 50827 - RNA, 20 nt, Artificial Sequence
  MKO10050827_A_Spaua5l1
  gRNA
agccaaccgucauuucugcc

SEQ ID NO: 50828 - RNA, 20 nt, Artificial Sequence
  MKO10050828_A_Spaua5
  gRNA
cggcugggcgaaaggagucg

SEQ ID NO: 50829 - RNA, 20 nt, Artificial Sequence
  MKO10050829_A_Spaua5
  gRNA
uccuuucgcccagccgagcc

SEQ ID NO: 50830 - RNA, 20 nt, Artificial Sequence
  MKO10050830_A_Spaua5
  gRNA
cuccugcuuuccauccaaac

SEQ ID NO: 50831 - RNA, 20 nt, Artificial Sequence
  MKO10050831_A_Spaua6
  gRNA
acaccaugauucaaaccgcc

SEQ ID NO: 50832 - RNA, 20 nt, Artificial Sequence
  MKO10050832_A_Spaua6
  gRNA
uaaccuggcgguuugaauca

SEQ ID NO: 50833 - RNA, 20 nt, Artificial Sequence
  MKO10050833_A_Spaua6
  gRNA
uucccggaagcaguagaccc

SEQ ID NO: 50834 - RNA, 20 nt, Artificial Sequence
  MKO10050834_A_Spaua7
  gRNA
cgcucacuuaccguugcucu

SEQ ID NO: 50835 - RNA, 20 nt, Artificial Sequence
  MKO10050835_A_Spaua7
  gRNA
agcccuccaugcuuguuuac

SEQ ID NO: 50836 - RNA, 20 nt, Artificial Sequence
  MKO10050836_A_Spaua7
  gRNA
cacguuuaccuuuggcugaa

SEQ ID NO: 50837 - RNA, 20 nt, Artificial Sequence
  MKO10050837_A_Spaua9
  gRNA
gccuuagccaagaucaaccg

SEQ ID NO: 50838 - RNA, 20 nt, Artificial Sequence
  MKO10050838_A_Spaua9
  gRNA
uucucuggcaacgaccugua

SEQ ID NO: 50839 - RNA, 20 nt, Artificial Sequence
  MKO10050839_A_Spaua9
  gRNA
gguugaucuaaaagguuguc

SEQ ID NO: 50840 - RNA, 20 nt, Artificial Sequence
  MKO10050840_A_Spauc1l
  gRNA
cuacagccgcgaagugcacc

SEQ ID NO: 50841 - RNA, 20 nt, Artificial Sequence
  MKO10050841_A_Spauc1l
  gRNA
auccgcgaguguaguucuga

SEQ ID NO: 50842 - RNA, 20 nt, Artificial Sequence
  MKO10050842_A_Spauc1l
  gRNA
gagaaggauggccgaaucgu

SEQ ID NO: 50843 - RNA, 20 nt, Artificial Sequence
  MKO10050843_A_Spauc1
  gRNA
guuccaucacgcgugaaccc

SEQ ID NO: 50844 - RNA, 20 nt, Artificial Sequence
  MKO10050844_A_Spauc1
  gRNA
cguaacgcugugugagcguc

SEQ ID NO: 50845 - RNA, 20 nt, Artificial Sequence
  MKO10050845_A_Spauc1
  gRNA
ccguagagacguacgcgcuc

SEQ ID NO: 50846 - RNA, 20 nt, Artificial Sequence
  MKO10050846_A_Spaus1
  gRNA
aacauguacggauuaucccc

SEQ ID NO: 50847 - RNA, 20 nt, Artificial Sequence
  MKO10050847_A_Spaus1
  gRNA
uuccagcacggcugcggagc

SEQ ID NO: 50848 - RNA, 20 nt, Artificial Sequence
  MKO10050848_A_Spaus1
  gRNA
cuguuccgucagaagacgag

SEQ ID NO: 50849 - RNA, 20 nt, Artificial Sequence
  MKO10050849_A_Spaus2l
  gRNA
ugagaaaaagaucucgauac

SEQ ID NO: 50850 - RNA, 20 nt, Artificial Sequence
  MKO10050850_A_Spaus2l
  gRNA
uaaagccguacaggccuuug

SEQ ID NO: 50851 - RNA, 20 nt, Artificial Sequence
  MKO10050851_A_Spaus2l
  gRNA
cguauaccuaccauccacaa

SEQ ID NO: 50852 - RNA, 20 nt, Artificial Sequence
  MKO10050852_A_Spaus2
  gRNA
cguugauggcaccguuuacg

SEQ ID NO: 50853 - RNA, 20 nt, Artificial Sequence
  MKO10050853_A_Spaus2
  gRNA
caucaacgaugccgagucug

SEQ ID NO: 50854 - RNA, 20 nt, Artificial Sequence
  MKO10050854_A_Spaus2
  gRNA
caaaacagugcaagcguuca

SEQ ID NO: 50855 - RNA, 20 nt, Artificial Sequence
  MKO10050855_A_Spc24
  gRNA
acugaaagaauguacgcgcc

SEQ ID NO: 50856 - RNA, 20 nt, Artificial Sequence
  MKO10050856_A_Spc24
  gRNA
augcgagccagggaugauca

SEQ ID NO: 50857 - RNA, 20 nt, Artificial Sequence
  MKO10050857_A_Spc24
  gRNA
ucguagccuagccugcacac

SEQ ID NO: 50858 - RNA, 20 nt, Artificial Sequence
  MKO10050858_A_Spc25
  gRNA
gaucuguauagagauuaccu

SEQ ID NO: 50859 - RNA, 20 nt, Artificial Sequence
  MKO10050859_A_Spc25
  gRNA
agcucaaggaagaguacgcu

SEQ ID NO: 50860 - RNA, 20 nt, Artificial Sequence
  MKO10050860_A_Spc25
  gRNA
cguacucuuccuugagcucc

SEQ ID NO: 50861 - RNA, 20 nt, Artificial Sequence
  MKO10050861_A_Spcs1
  gRNA
guccguuucguugucgguau

SEQ ID NO: 50862 - RNA, 20 nt, Artificial Sequence
  MKO10050862_A_Spcs1
  gRNA
cccuugucgauggcgcgggg

SEQ ID NO: 50863 - RNA, 20 nt, Artificial Sequence
  MKO10050863_A_Spcs1
  gRNA
uucgucccuaggauuacaag

SEQ ID NO: 50864 - RNA, 20 nt, Artificial Sequence
  MKO10050864_A_Spcs2
  gRNA
ccaugaccaaugucccgcug

SEQ ID NO: 50865 - RNA, 20 nt, Artificial Sequence
  MKO10050865_A_Spcs2
  gRNA
cauaugaaccugaaauaucc

SEQ ID NO: 50866 - RNA, 20 nt, Artificial Sequence
  MKO10050866_A_Spcs2
  gRNA
agagaagagcaucuuccuug

SEQ ID NO: 50867 - RNA, 20 nt, Artificial Sequence
  MKO10050867_A_Spcs3
  gRNA
agcguuugguacaacguucc

SEQ ID NO: 50868 - RNA, 20 nt, Artificial Sequence
  MKO10050868_A_Spcs3
  gRNA
augucacucugacgcucucc

SEQ ID NO: 50869 - RNA, 20 nt, Artificial Sequence
  MKO10050869_A_Spcs3
  gRNA
cccuagagaaagaagugacc

SEQ ID NO: 50870 - RNA, 20 nt, Artificial Sequence
  MKO10050870_A_Spdef
  gRNA
cauccgccaguauuacaaga

SEQ ID NO: 50871 - RNA, 20 nt, Artificial Sequence
  MKO10050871_A_Spdef
  gRNA
guuccgucagcgugcacccu

SEQ ID NO: 50872 - RNA, 20 nt, Artificial Sequence
  MKO10050872_A_Spdef
  gRNA
agccacuucugcacguuacc

SEQ ID NO: 50873 - RNA, 20 nt, Artificial Sequence
  MKO10050873_A_Spdl1
  gRNA
cggcggaccccaauagcaaa

SEQ ID NO: 50874 - RNA, 20 nt, Artificial Sequence
  MKO10050874_A_Spdl1
  gRNA
cagcgaguucccuuugcuau

SEQ ID NO: 50875 - RNA, 20 nt, Artificial Sequence
  MKO10050875_A_Spdl1
  gRNA
agcuagaggugcagcuacau

SEQ ID NO: 50876 - RNA, 20 nt, Artificial Sequence
  MKO10050876_A_Spdya
  gRNA
uugucuaaucauacagcgcc

SEQ ID NO: 50877 - RNA, 20 nt, Artificial Sequence
  MKO10050877_A_Spdya
  gRNA
uguuagguaucuggcuaaua

SEQ ID NO: 50878 - RNA, 20 nt, Artificial Sequence
  MKO10050878_A_Spdya
  gRNA
cugcugcaagauugcagaca

SEQ ID NO: 50879 - RNA, 20 nt, Artificial Sequence
  MKO10050879_A_Spdyb
  gRNA
gcgucucuuaccgagcagcu

SEQ ID NO: 50880 - RNA, 20 nt, Artificial Sequence
  MKO10050880_A_Spdyb
  gRNA
ggcgacgugugucuacagug

SEQ ID NO: 50881 - RNA, 20 nt, Artificial Sequence
  MKO10050881_A_Spdyb
  gRNA
aacugcgcuuucaguucauu

SEQ ID NO: 50882 - RNA, 20 nt, Artificial Sequence
  MKO10050882_A_Specc1l
  gRNA
accagccgaaguacuccguu

SEQ ID NO: 50883 - RNA, 20 nt, Artificial Sequence
  MKO10050883_A_Specc1l
  gRNA
gauagagaugaaucgcuuga

SEQ ID NO: 50884 - RNA, 20 nt, Artificial Sequence
  MKO10050884_A_Specc1l
  gRNA
ugucaugcagcuucacggcg

SEQ ID NO: 50885 - RNA, 20 nt, Artificial Sequence
  MKO10050885_A_Specc1
  gRNA
agccucacacuugaugucgu

SEQ ID NO: 50886 - RNA, 20 nt, Artificial Sequence
  MKO10050886_A_Specc1
  gRNA
cugccagaaguucucguacc

SEQ ID NO: 50887 - RNA, 20 nt, Artificial Sequence
  MKO10050887_A_Specc1
  gRNA
uaaucaugucuauagcgccu

SEQ ID NO: 50888 - RNA, 20 nt, Artificial Sequence
  MKO10050888_A_Speer2
  gRNA
uuucuaacucauucucgauu

SEQ ID NO: 50889 - RNA, 20 nt, Artificial Sequence
  MKO10050889_A_Speer2
  gRNA
caucuguaacuugugcagag

SEQ ID NO: 50890 - RNA, 20 nt, Artificial Sequence
  MKO10050890_A_Speer2
  gRNA
auuuagcuucuguaagggcc

SEQ ID NO: 50891 - RNA, 20 nt, Artificial Sequence
  MKO10050891_A_Speer3
  gRNA
uguacgugaccuaagugaga

SEQ ID NO: 50892 - RNA, 20 nt, Artificial Sequence
  MKO10050892_A_Speer3
  gRNA
aaugauaguuguucauagaa

SEQ ID NO: 50893 - RNA, 20 nt, Artificial Sequence
  MKO10050893_A_Speer3
  gRNA
uacagugggugauaucuuuc

SEQ ID NO: 50894 - RNA, 20 nt, Artificial Sequence
  MKO10050894_A_Speer4a
  gRNA
ggccaucauucaagaacguu

SEQ ID NO: 50895 - RNA, 20 nt, Artificial Sequence
  MKO10050895_A_Speer4a
  gRNA
caccaaacguucuugaauga

SEQ ID NO: 50896 - RNA, 20 nt, Artificial Sequence
  MKO10050896_A_Speer4a
  gRNA
cuuauagcacauguccugcg

SEQ ID NO: 50897 - RNA, 20 nt, Artificial Sequence
  MKO10050897_A_Speer4b
  gRNA
guuagggccuauucccagga

SEQ ID NO: 50898 - RNA, 20 nt, Artificial Sequence
  MKO10050898_A_Speer4b
  gRNA
ggccaucauucaucaauguu

SEQ ID NO: 50899 - RNA, 20 nt, Artificial Sequence
  MKO10050899_A_Speer4b
  gRNA
ccugauguucuugagucuuc

SEQ ID NO: 50900 - RNA, 20 nt, Artificial Sequence
  MKO10050900_A_Speer4c
  gRNA
uuaugaaaaacugaaguuaa

SEQ ID NO: 50901 - RNA, 20 nt, Artificial Sequence
  MKO10050901_A_Speer4c
  gRNA
aagcaagaagcaguuugaga

SEQ ID NO: 50902 - RNA, 20 nt, Artificial Sequence
  MKO10050902_A_Speer4c
  gRNA
caauguauaccucuuguuca

SEQ ID NO: 50903 - RNA, 20 nt, Artificial Sequence
  MKO10050903_A_Speer4d
  gRNA
ccagcaccuacaaucauccu

SEQ ID NO: 50904 - RNA, 20 nt, Artificial Sequence
  MKO10050904_A_Speer4d
  gRNA
augauuguaggugcuggaga

SEQ ID NO: 50905 - RNA, 20 nt, Artificial Sequence
  MKO10050905_A_Speer4d
  gRNA
agagauccagcucacuacca

SEQ ID NO: 50906 - RNA, 20 nt, Artificial Sequence
  MKO10050906_A_Speer4e
  gRNA
caucauucaccaauguuugu

SEQ ID NO: 50907 - RNA, 20 nt, Artificial Sequence
  MKO10050907_A_Speer4e
  gRNA
caacaaacauuggugaauga

SEQ ID NO: 50908 - RNA, 20 nt, Artificial Sequence
  MKO10050908_A_Speer4e
  gRNA
aagcaagaagcaguuugaga

SEQ ID NO: 50909 - RNA, 20 nt, Artificial Sequence
  MKO10050909_A_Speer4f
  gRNA
caacguauaccucaugaucu

SEQ ID NO: 50910 - RNA, 20 nt, Artificial Sequence
  MKO10050910_A_Speer4f
  gRNA
uuauaagauuguucuccauu

SEQ ID NO: 50911 - RNA, 20 nt, Artificial Sequence
  MKO10050911_A_Speer4f
  gRNA
gaacagcauccuugacacuc

SEQ ID NO: 50912 - RNA, 20 nt, Artificial Sequence
  MKO10050912_A_Spef1
  gRNA
aucuuccgcaucacaucguc

SEQ ID NO: 50913 - RNA, 20 nt, Artificial Sequence
  MKO10050913_A_Spef1
  gRNA
acuugauaagcucugcaacc

SEQ ID NO: 50914 - RNA, 20 nt, Artificial Sequence
  MKO10050914_A_Spef1
  gRNA
agcacuagcuccacuacucc

SEQ ID NO: 50915 - RNA, 20 nt, Artificial Sequence
  MKO10050915_A_Spef2
  gRNA
ccguacuuugaaagcuauug

SEQ ID NO: 50916 - RNA, 20 nt, Artificial Sequence
  MKO10050916_A_Spef2
  gRNA
gcgggagaaauuguuaagcu

SEQ ID NO: 50917 - RNA, 20 nt, Artificial Sequence
  MKO10050917_A_Spef2
  gRNA
aggcuuggggaucuguauaa

SEQ ID NO: 50918 - RNA, 20 nt, Artificial Sequence
  MKO10050918_A_Speg
  gRNA
cggucaacgaauauggcgcu

SEQ ID NO: 50919 - RNA, 20 nt, Artificial Sequence
  MKO10050919_A_Speg
  gRNA
agcccgugcgcccagaccag

SEQ ID NO: 50920 - RNA, 20 nt, Artificial Sequence
  MKO10050920_A_Speg
  gRNA
cuugaccuucucucaccgau

SEQ ID NO: 50921 - RNA, 20 nt, Artificial Sequence
  MKO10050921_A_Spem1
  gRNA
cgguaacgacgacgaguggg

SEQ ID NO: 50922 - RNA, 20 nt, Artificial Sequence
  MKO10050922_A_Spem1
  gRNA
ggccucucaaaucggaaauc

SEQ ID NO: 50923 - RNA, 20 nt, Artificial Sequence
  MKO10050923_A_Spem1
  gRNA
acauucgguguaagaggaug

SEQ ID NO: 50924 - RNA, 20 nt, Artificial Sequence
  MKO10050924_A_Spen
  gRNA
uauaauccgugcggaggucu

SEQ ID NO: 50925 - RNA, 20 nt, Artificial Sequence
  MKO10050925_A_Spen
  gRNA
cauagcgucucguaguagag

SEQ ID NO: 50926 - RNA, 20 nt, Artificial Sequence
  MKO10050926_A_Spen
  gRNA
augacccccgauacgaaccu

SEQ ID NO: 50927 - RNA, 20 nt, Artificial Sequence
  MKO10050927_A_Spert
  gRNA
ccuuaccucggaugagccgc

SEQ ID NO: 50928 - RNA, 20 nt, Artificial Sequence
  MKO10050928_A_Spert
  gRNA
gaggguuguagucuaguucc

SEQ ID NO: 50929 - RNA, 20 nt, Artificial Sequence
  MKO10050929_A_Spert
  gRNA
auccuacauuucacccccuc

SEQ ID NO: 50930 - RNA, 20 nt, Artificial Sequence
  MKO10050930_A_Spesp1
  gRNA
acgacaaauucccguacuag

SEQ ID NO: 50931 - RNA, 20 nt, Artificial Sequence
  MKO10050931_A_Spesp1
  gRNA
gaauuugucguuucaucgac

SEQ ID NO: 50932 - RNA, 20 nt, Artificial Sequence
  MKO10050932_A_Spesp1
  gRNA
ggauacgccagcagugacga

SEQ ID NO: 50933 - RNA, 20 nt, Artificial Sequence
  MKO10050933_A_Spg11
  gRNA
uccccggaaacacaacgcgu

SEQ ID NO: 50934 - RNA, 20 nt, Artificial Sequence
  MKO10050934_A_Spg11
  gRNA
uggcacgcagguagcgcaag

SEQ ID NO: 50935 - RNA, 20 nt, Artificial Sequence
  MKO10050935_A_Spg11
  gRNA
agacacucucagcgauguaa

SEQ ID NO: 50936 - RNA, 20 nt, Artificial Sequence
  MKO10050936_A_Spg20
  gRNA
ucccaucgacuucagcacgc

SEQ ID NO: 50937 - RNA, 20 nt, Artificial Sequence
  MKO10050937_A_Spg20
  gRNA
gacuucuugcacgcgucuuu

SEQ ID NO: 50938 - RNA, 20 nt, Artificial Sequence
  MKO10050938_A_Spg20
  gRNA
gauaccauguuacaagcugc

SEQ ID NO: 50939 - RNA, 20 nt, Artificial Sequence
  MKO10050939_A_Spg21
  gRNA
ucagccaucaucgggucuac

SEQ ID NO: 50940 - RNA, 20 nt, Artificial Sequence
  MKO10050940_A_Spg21
  gRNA
uggcccaguagacccgauga

SEQ ID NO: 50941 - RNA, 20 nt, Artificial Sequence
  MKO10050941_A_Spg21
  gRNA
acaucugcaguuccgcugac

SEQ ID NO: 50942 - RNA, 20 nt, Artificial Sequence
  MKO10050942_A_Spg7
  gRNA
caaccugcauccgauacauc

SEQ ID NO: 50943 - RNA, 20 nt, Artificial Sequence
  MKO10050943_A_Spg7
  gRNA
ggugcccgagagugaugugg

SEQ ID NO: 50944 - RNA, 20 nt, Artificial Sequence
  MKO10050944_A_Spg7
  gRNA
ugacuuugucaacgagaugc

SEQ ID NO: 50945 - RNA, 20 nt, Artificial Sequence
  MKO10050945_A_Sphk1
  gRNA
gcaucuguucuacguacgug

SEQ ID NO: 50946 - RNA, 20 nt, Artificial Sequence
  MKO10050946_A_Sphk1
  gRNA
uuuguaguagaaugcccucg

SEQ ID NO: 50947 - RNA, 20 nt, Artificial Sequence
  MKO10050947_A_Sphk1
  gRNA
gccuguacuucucacucucg

SEQ ID NO: 50948 - RNA, 20 nt, Artificial Sequence
  MKO10050948_A_Sphk2
  gRNA
agucaacguacccgccauga

SEQ ID NO: 50949 - RNA, 20 nt, Artificial Sequence
  MKO10050949_A_Sphk2
  gRNA
gugugaaucgagcgcugccc

SEQ ID NO: 50950 - RNA, 20 nt, Artificial Sequence
  MKO10050950_A_Sphk2
  gRNA
cuugaaccacucacgccucg

SEQ ID NO: 50951 - RNA, 20 nt, Artificial Sequence
  MKO10050951_A_Sphkap
  gRNA
ucuucgaagcaauagcuugc

SEQ ID NO: 50952 - RNA, 20 nt, Artificial Sequence
  MKO10050952_A_Sphkap
  gRNA
gaaucaccacugaugcauga

SEQ ID NO: 50953 - RNA, 20 nt, Artificial Sequence
  MKO10050953_A_Sphkap
  gRNA
caucuuccacaaacccaauc

SEQ ID NO: 50954 - RNA, 20 nt, Artificial Sequence
  MKO10050954_A_Spi1
  gRNA
gcugcgcagcggcgacauga

SEQ ID NO: 50955 - RNA, 20 nt, Artificial Sequence
  MKO10050955_A_Spi1
  gRNA
gcagcgcgcgcgccaucuuc

SEQ ID NO: 50956 - RNA, 20 nt, Artificial Sequence
  MKO10050956_A_Spi1
  gRNA
aguagucaugcauuggacgu

SEQ ID NO: 50957 - RNA, 20 nt, Artificial Sequence
  MKO10050957_A_Spib
  gRNA
gggguacggagcauaagcca

SEQ ID NO: 50958 - RNA, 20 nt, Artificial Sequence
  MKO10050958_A_Spib
  gRNA
cucggacagugagucagacg

SEQ ID NO: 50959 - RNA, 20 nt, Artificial Sequence
  MKO10050959_A_Spib
  gRNA
agaaggagucuucuacgacc

SEQ ID NO: 50960 - RNA, 20 nt, Artificial Sequence
  MKO10050960_A_Spice1
  gRNA
gauguuccucguaagcgcac

SEQ ID NO: 50961 - RNA, 20 nt, Artificial Sequence
  MKO10050961_A_Spice1
  gRNA
cgcuuaccugugcgcuuacg

SEQ ID NO: 50962 - RNA, 20 nt, Artificial Sequence
  MKO10050962_A_Spice1
  gRNA
ggucaacuuacuagaucuuc

SEQ ID NO: 50963 - RNA, 20 nt, Artificial Sequence
  MKO10050963_A_Spic
  gRNA
aacccuuauccucacgucag

SEQ ID NO: 50964 - RNA, 20 nt, Artificial Sequence
  MKO10050964_A_Spic
  gRNA
cagagaacccccucuaugac

SEQ ID NO: 50965 - RNA, 20 nt, Artificial Sequence
  MKO10050965_A_Spic
  gRNA
acuugcuccagcuaacuacc

SEQ ID NO: 50966 - RNA, 20 nt, Artificial Sequence
  MKO10050966_A_Spidr
  gRNA
accuucaaugucuucgucuu

SEQ ID NO: 50967 - RNA, 20 nt, Artificial Sequence
  MKO10050967_A_Spidr
  gRNA
acccauccuuucgagaagag

SEQ ID NO: 50968 - RNA, 20 nt, Artificial Sequence
  MKO10050968_A_Spidr
  gRNA
ggcauggcccuagagccgac

SEQ ID NO: 50969 - RNA, 20 nt, Artificial Sequence
  MKO10050969_A_Spin1
  gRNA
cagaaaacaucggaccagug

SEQ ID NO: 50970 - RNA, 20 nt, Artificial Sequence
  MKO10050970_A_Spin1
  gRNA
ccauauuuacgucuacgauu

SEQ ID NO: 50971 - RNA, 20 nt, Artificial Sequence
  MKO10050971_A_Spin1
  gRNA
cacaaugaucggcaaagcag

SEQ ID NO: 50972 - RNA, 20 nt, Artificial Sequence
  MKO10050972_A_Spin2-ps1
  gRNA
ccaagugagugacauguaug

SEQ ID NO: 50973 - RNA, 20 nt, Artificial Sequence
  MKO10050973_A_Spin2-ps1
  gRNA
cuuggagccccccaggaccc

SEQ ID NO: 50974 - RNA, 20 nt, Artificial Sequence
  MKO10050974_A_Spin2-ps1
  gRNA
cagcuuuguugaugccauag

SEQ ID NO: 50975 - RNA, 20 nt, Artificial Sequence
  MKO10050975_A_Spin2c
  gRNA
aagcgccuaucaugaacgcc

SEQ ID NO: 50976 - RNA, 20 nt, Artificial Sequence
  MKO10050976_A_Spin2c
  gRNA
ucaugauaggcgcuugagcc

SEQ ID NO: 50977 - RNA, 20 nt, Artificial Sequence
  MKO10050977_A_Spin2c
  gRNA
uacagcccacgaugcuccua

SEQ ID NO: 50978 - RNA, 20 nt, Artificial Sequence
  MKO10050978_A_Spin2d
  gRNA
cccuaaaaguuaucuccaag

SEQ ID NO: 50979 - RNA, 20 nt, Artificial Sequence
  MKO10050979_A_Spin2d
  gRNA
aagcugaccaagaaaagagc

SEQ ID NO: 50980 - RNA, 20 nt, Artificial Sequence
  MKO10050980_A_Spin2d
  gRNA
ccaagugagugacauguaua

SEQ ID NO: 50981 - RNA, 20 nt, Artificial Sequence
  MKO10050981_A_Spin4
  gRNA
guuggcgcgagcccccauca

SEQ ID NO: 50982 - RNA, 20 nt, Artificial Sequence
  MKO10050982_A_Spin4
  gRNA
gugggcugccgcauucaaca

SEQ ID NO: 50983 - RNA, 20 nt, Artificial Sequence
  MKO10050983_A_Spin4
  gRNA
uccucgcauugacucucgcc

SEQ ID NO: 50984 - RNA, 20 nt, Artificial Sequence
  MKO10050984_A_Spink10
  gRNA
uuccaaagaagcucgacguc

SEQ ID NO: 50985 - RNA, 20 nt, Artificial Sequence
  MKO10050985_A_Spink10
  gRNA
uaccugacgucgagcuucuu

SEQ ID NO: 50986 - RNA, 20 nt, Artificial Sequence
  MKO10050986_A_Spink10
  gRNA
gauagacuguagaccauauc

SEQ ID NO: 50987 - RNA, 20 nt, Artificial Sequence
  MKO10050987_A_Spink11
  gRNA
gucagauucacucuuauaca

SEQ ID NO: 50988 - RNA, 20 nt, Artificial Sequence
  MKO10050988_A_Spink11
  gRNA
auuugauuaucugcacaaac

SEQ ID NO: 50989 - RNA, 20 nt, Artificial Sequence
  MKO10050989_A_Spink11
  gRNA
auucuuuaguacaaauacca

SEQ ID NO: 50990 - RNA, 20 nt, Artificial Sequence
  MKO10050990_A_Spink12
  gRNA
ucauggcgcugagaaucuug

SEQ ID NO: 50991 - RNA, 20 nt, Artificial Sequence
  MKO10050991_A_Spink12
  gRNA
uacauaccugaaagccuccu

SEQ ID NO: 50992 - RNA, 20 nt, Artificial Sequence
  MKO10050992_A_Spink12
  gRNA
cucagcgccaugaagccagc

SEQ ID NO: 50993 - RNA, 20 nt, Artificial Sequence
  MKO10050993_A_Spink13
  gRNA
guguccaagucaaaaguacg

SEQ ID NO: 50994 - RNA, 20 nt, Artificial Sequence
  MKO10050994_A_Spink13
  gRNA
gcuucauaaucagggucuau

SEQ ID NO: 50995 - RNA, 20 nt, Artificial Sequence
  MKO10050995_A_Spink13
  gRNA
cacauccaguuugucaaaua

SEQ ID NO: 50996 - RNA, 20 nt, Artificial Sequence
  MKO10050996_A_Spink14
  gRNA
uagcuccaggugcucgaguu

SEQ ID NO: 50997 - RNA, 20 nt, Artificial Sequence
  MKO10050997_A_Spink14
  gRNA
gccuacacauggacuuauua

SEQ ID NO: 50998 - RNA, 20 nt, Artificial Sequence
  MKO10050998_A_Spink14
  gRNA
gcucucaacacacaagaugc

SEQ ID NO: 50999 - RNA, 20 nt, Artificial Sequence
  MKO10050999_A_Spink2
  gRNA
uucauauccguuccgcacac

SEQ ID NO: 51000 - RNA, 20 nt, Artificial Sequence
  MKO10051000_A_Spink2
  gRNA
guacccugugcaugaaaauc

SEQ ID NO: 51001 - RNA, 20 nt, Artificial Sequence
  MKO10051001_A_Spink2
  gRNA
agagucgagagucucaugag

SEQ ID NO: 51002 - RNA, 20 nt, Artificial Sequence
  MKO10051002_A_Spink3
  gRNA
accuaccugcuaaacucagc

SEQ ID NO: 51003 - RNA, 20 nt, Artificial Sequence
  MKO10051003_A_Spink3
  gRNA
gagccuguccucauucgaaa

SEQ ID NO: 51004 - RNA, 20 nt, Artificial Sequence
  MKO10051004_A_Spink3
  gRNA
gacaucccgccacugcauca

SEQ ID NO: 51005 - RNA, 20 nt, Artificial Sequence
  MKO10051005_A_Spink4
  gRNA
gcccauccgugccacagauc

SEQ ID NO: 51006 - RNA, 20 nt, Artificial Sequence
  MKO10051006_A_Spink4
  gRNA
aagaaacuuacauccggguc

SEQ ID NO: 51007 - RNA, 20 nt, Artificial Sequence
  MKO10051007_A_Spink4
  gRNA
gcagcauggcuaugcaucug

SEQ ID NO: 51008 - RNA, 20 nt, Artificial Sequence
  MKO10051008_A_Spink5
  gRNA
uugagaagaauuguugccuu

SEQ ID NO: 51009 - RNA, 20 nt, Artificial Sequence
  MKO10051009_A_Spink5
  gRNA
aaccuucacauucaugaucu

SEQ ID NO: 51010 - RNA, 20 nt, Artificial Sequence
  MKO10051010_A_Spink5
  gRNA
ugcacaagaugcauucacuu

SEQ ID NO: 51011 - RNA, 20 nt, Artificial Sequence
  MKO10051011_A_Spink6
  gRNA
agaucagagggccgauuucc

SEQ ID NO: 51012 - RNA, 20 nt, Artificial Sequence
  MKO10051012_A_Spink6
  gRNA
aagaucaaccugaagcaucg

SEQ ID NO: 51013 - RNA, 20 nt, Artificial Sequence
  MKO10051013_A_Spink6
  gRNA
cacauuuauucccauauguc

SEQ ID NO: 51014 - RNA, 20 nt, Artificial Sequence
  MKO10051014_A_Spink7
  gRNA
aacauacuuacuguugcuga

SEQ ID NO: 51015 - RNA, 20 nt, Artificial Sequence
  MKO10051015_A_Spink7
  gRNA
auuguaaacauaccaguuug

SEQ ID NO: 51016 - RNA, 20 nt, Artificial Sequence
  MKO10051016_A_Spink7
  gRNA
gagaccaccaacaagcuuca

SEQ ID NO: 51017 - RNA, 20 nt, Artificial Sequence
  MKO10051017_A_Spink8
  gRNA
acucgcccucguaggucacu

SEQ ID NO: 51018 - RNA, 20 nt, Artificial Sequence
  MKO10051018_A_Spink8
  gRNA
cagcaaccaagugaccuacg

SEQ ID NO: 51019 - RNA, 20 nt, Artificial Sequence
  MKO10051019_A_Spink8
  gRNA
ucaguguucagacucauccg

SEQ ID NO: 51020 - RNA, 20 nt, Artificial Sequence
  MKO10051020_A_Spinkl
  gRNA
accucuuuaauaacauucuc

SEQ ID NO: 51021 - RNA, 20 nt, Artificial Sequence
  MKO10051021_A_Spinkl
  gRNA
gaguggaaaaacuuaaauau

SEQ ID NO: 51022 - RNA, 20 nt, Artificial Sequence
  MKO10051022_A_Spinkl
  gRNA
uccagagaauguuauuaaag

SEQ ID NO: 51023 - RNA, 20 nt, Artificial Sequence
  MKO10051023_A_Spint1
  gRNA
ggucccggaucccucgaauc

SEQ ID NO: 51024 - RNA, 20 nt, Artificial Sequence
  MKO10051024_A_Spint1
  gRNA
caagaacaacuaccuucgug

SEQ ID NO: 51025 - RNA, 20 nt, Artificial Sequence
  MKO10051025_A_Spint1
  gRNA
cccuaggaaucucaccgaaa

SEQ ID NO: 51026 - RNA, 20 nt, Artificial Sequence
  MKO10051026_A_Spint2
  gRNA
gggccgggcgcuccucgccu

SEQ ID NO: 51027 - RNA, 20 nt, Artificial Sequence
  MKO10051027_A_Spint2
  gRNA
ugcgcggcacggcccaguga

SEQ ID NO: 51028 - RNA, 20 nt, Artificial Sequence
  MKO10051028_A_Spint2
  gRNA
caccguggacgucuaguucu

SEQ ID NO: 51029 - RNA, 20 nt, Artificial Sequence
  MKO10051029_A_Spint3
  gRNA
cuuugcgcagaaccaaauaa

SEQ ID NO: 51030 - RNA, 20 nt, Artificial Sequence
  MKO10051030_A_Spint3
  gRNA
cauaggcgguaaggacuucc

SEQ ID NO: 51031 - RNA, 20 nt, Artificial Sequence
  MKO10051031_A_Spint3
  gRNA
uugguucugcgcaaagcucu

SEQ ID NO: 51032 - RNA, 20 nt, Artificial Sequence
  MKO10051032_A_Spint4
  gRNA
auuacaauagcggcgauaag

SEQ ID NO: 51033 - RNA, 20 nt, Artificial Sequence
  MKO10051033_A_Spint4
  gRNA
ucaaucuccaauccguagca

SEQ ID NO: 51034 - RNA, 20 nt, Artificial Sequence
  MKO10051034_A_Spint4
  gRNA
auuccuuaccucggcagcgg

SEQ ID NO: 51035 - RNA, 20 nt, Artificial Sequence
  MKO10051035_A_Spint5
  gRNA
acucacauagggccgauucu

SEQ ID NO: 51036 - RNA, 20 nt, Artificial Sequence
  MKO10051036_A_Spint5
  gRNA
aguccguugcauucacguag

SEQ ID NO: 51037 - RNA, 20 nt, Artificial Sequence
  MKO10051037_A_Spint5
  gRNA
cgcuuucgcagaguugacuu

SEQ ID NO: 51038 - RNA, 20 nt, Artificial Sequence
  MKO10051038_A_Spire1
  gRNA
gguucuuacaggcccgguuc

SEQ ID NO: 51039 - RNA, 20 nt, Artificial Sequence
  MKO10051039_A_Spire1
  gRNA
aagcuacguacuggauuuaa

SEQ ID NO: 51040 - RNA, 20 nt, Artificial Sequence
  MKO10051040_A_Spire1
  gRNA
uaaauggugacguccccccu

SEQ ID NO: 51041 - RNA, 20 nt, Artificial Sequence
  MKO10051041_A_Spire2
  gRNA
cuuugccauuuaccgugcgc

SEQ ID NO: 51042 - RNA, 20 nt, Artificial Sequence
  MKO10051042_A_Spire2
  gRNA
cucaugcgggagcuccguca

SEQ ID NO: 51043 - RNA, 20 nt, Artificial Sequence
  MKO10051043_A_Spire2
  gRNA
gcugucuucgcagucgcugu

SEQ ID NO: 51044 - RNA, 20 nt, Artificial Sequence
  MKO10051044_A_Spns1
  gRNA
uacugagcauccgacuccgc

SEQ ID NO: 51045 - RNA, 20 nt, Artificial Sequence
  MKO10051045_A_Spns1
  gRNA
ccacgaagaggucggcgauc

SEQ ID NO: 51046 - RNA, 20 nt, Artificial Sequence
  MKO10051046_A_Spns1
  gRNA
aaucgaaaguaccucaugug

SEQ ID NO: 51047 - RNA, 20 nt, Artificial Sequence
  MKO10051047_A_Spns2
  gRNA
uucuauugaagcggucgccc

SEQ ID NO: 51048 - RNA, 20 nt, Artificial Sequence
  MKO10051048_A_Spns2
  gRNA
aaacaagucgccaaugaugg

SEQ ID NO: 51049 - RNA, 20 nt, Artificial Sequence
  MKO10051049_A_Spns2
  gRNA
ggcgccggcuugcugcaguc

SEQ ID NO: 51050 - RNA, 20 nt, Artificial Sequence
  MKO10051050_A_Spns3
  gRNA
uccgcugguccuucacgaag

SEQ ID NO: 51051 - RNA, 20 nt, Artificial Sequence
  MKO10051051_A_Spns3
  gRNA
caccgguacccacgaauccc

SEQ ID NO: 51052 - RNA, 20 nt, Artificial Sequence
  MKO10051052_A_Spns3
  gRNA
ucaacuguggcggagcugac

SEQ ID NO: 51053 - RNA, 20 nt, Artificial Sequence
  MKO10051053_A_Spn
  gRNA
gggcccucgagugagaugca

SEQ ID NO: 51054 - RNA, 20 nt, Artificial Sequence
  MKO10051054_A_Spn
  gRNA
acaacagcaguagcgccacg

SEQ ID NO: 51055 - RNA, 20 nt, Artificial Sequence
  MKO10051055_A_Spn
  gRNA
gcugaagaacguagugagcg

SEQ ID NO: 51056 - RNA, 20 nt, Artificial Sequence
  MKO10051056_A_Spo11
  gRNA
cauuauggcguucgcgccua

SEQ ID NO: 51057 - RNA, 20 nt, Artificial Sequence
  MKO10051057_A_Spo11
  gRNA
ggccucguucuucgacgccc

SEQ ID NO: 51058 - RNA, 20 nt, Artificial Sequence
  MKO10051058_A_Spo11
  gRNA
gcgacacuuaugcaaccaag

SEQ ID NO: 51059 - RNA, 20 nt, Artificial Sequence
  MKO10051059_A_Spock1
  gRNA
caaccuuggacguguacgug

SEQ ID NO: 51060 - RNA, 20 nt, Artificial Sequence
  MKO10051060_A_Spock1
  gRNA
uaagugcaagccuugccccg

SEQ ID NO: 51061 - RNA, 20 nt, Artificial Sequence
  MKO10051061_A_Spock1
  gRNA
gaauuccacgcuuguucuac

SEQ ID NO: 51062 - RNA, 20 nt, Artificial Sequence
  MKO10051062_A_Spock2
  gRNA
gugcaucagccgcaagaagu

SEQ ID NO: 51063 - RNA, 20 nt, Artificial Sequence
  MKO10051063_A_Spock2
  gRNA
ggugaagugcagucgccaca

SEQ ID NO: 51064 - RNA, 20 nt, Artificial Sequence
  MKO10051064_A_Spock2
  gRNA
cgucugcaagcccugucaua

SEQ ID NO: 51065 - RNA, 20 nt, Artificial Sequence
  MKO10051065_A_Spock3
  gRNA
ccacaaaguuugcauuacgc

SEQ ID NO: 51066 - RNA, 20 nt, Artificial Sequence
  MKO10051066_A_Spock3
  gRNA
accgccguccgaccgccccc

SEQ ID NO: 51067 - RNA, 20 nt, Artificial Sequence
  MKO10051067_A_Spock3
  gRNA
aggaugauuauuuccgcacu

SEQ ID NO: 51068 - RNA, 20 nt, Artificial Sequence
  MKO10051068_A_Spon1
  gRNA
uacucacgaggguaauccuu

SEQ ID NO: 51069 - RNA, 20 nt, Artificial Sequence
  MKO10051069_A_Spon1
  gRNA
guccgagaagacucauccga

SEQ ID NO: 51070 - RNA, 20 nt, Artificial Sequence
  MKO10051070_A_Spon1
  gRNA
uggauccguguccuccuccg

SEQ ID NO: 51071 - RNA, 20 nt, Artificial Sequence
  MKO10051071_A_Spon2
  gRNA
acucugcuguagccgcacga

SEQ ID NO: 51072 - RNA, 20 nt, Artificial Sequence
  MKO10051072_A_Spon2
  gRNA
ggggacaaugcguaccacga

SEQ ID NO: 51073 - RNA, 20 nt, Artificial Sequence
  MKO10051073_A_Spon2
  gRNA
gaucuuuauccacacgaugc

SEQ ID NO: 51074 - RNA, 20 nt, Artificial Sequence
  MKO10051074_A_Spopl
  gRNA
ugucgacuagcagaagauuu

SEQ ID NO: 51075 - RNA, 20 nt, Artificial Sequence
  MKO10051075_A_Spopl
  gRNA
cuuucgucaucuaaucccuu

SEQ ID NO: 51076 - RNA, 20 nt, Artificial Sequence
  MKO10051076_A_Spopl
  gRNA
caagcuuacguuauucugug

SEQ ID NO: 51077 - RNA, 20 nt, Artificial Sequence
  MKO10051077_A_Spop
  gRNA
uguuugcgaguaaacccgaa

SEQ ID NO: 51078 - RNA, 20 nt, Artificial Sequence
  MKO10051078_A_Spop
  gRNA
cagagagucagcgagcuuau

SEQ ID NO: 51079 - RNA, 20 nt, Artificial Sequence
  MKO10051079_A_Spop
  gRNA
cuaagauagccuugugagcc

SEQ ID NO: 51080 - RNA, 20 nt, Artificial Sequence
  MKO10051080_A_Spp1
  gRNA
gcagaaucuccuugcgccac

SEQ ID NO: 51081 - RNA, 20 nt, Artificial Sequence
  MKO10051081_A_Spp1
  gRNA
aacacaauaccuguggcgca

SEQ ID NO: 51082 - RNA, 20 nt, Artificial Sequence
  MKO10051082_A_Spp1
  gRNA
aaggugaaagugacugauuc

SEQ ID NO: 51083 - RNA, 20 nt, Artificial Sequence
  MKO10051083_A_Spp2
  gRNA
aagggucguagucguacacc

SEQ ID NO: 51084 - RNA, 20 nt, Artificial Sequence
  MKO10051084_A_Spp2
  gRNA
cuuugugaaggucaacgucc

SEQ ID NO: 51085 - RNA, 20 nt, Artificial Sequence
  MKO10051085_A_Spp2
  gRNA
gauaaucauuucuucgucug

SEQ ID NO: 51086 - RNA, 20 nt, Artificial Sequence
  MKO10051086_A_Sppl2a
  gRNA
auaauacaugcaguaguccu

SEQ ID NO: 51087 - RNA, 20 nt, Artificial Sequence
  MKO10051087_A_Sppl2a
  gRNA
uccacuccaguauccuccua

SEQ ID NO: 51088 - RNA, 20 nt, Artificial Sequence
  MKO10051088_A_Sppl2a
  gRNA
accaccuuccugugcaauuc

SEQ ID NO: 51089 - RNA, 20 nt, Artificial Sequence
  MKO10051089_A_Sppl2b
  gRNA
ucgaagcacgccgaacucac

SEQ ID NO: 51090 - RNA, 20 nt, Artificial Sequence
  MKO10051090_A_Sppl2b
  gRNA
cccgggccaccagugcgauu

SEQ ID NO: 51091 - RNA, 20 nt, Artificial Sequence
  MKO10051091_A_Sppl2b
  gRNA
gugggcaccgucgccaucgg

SEQ ID NO: 51092 - RNA, 20 nt, Artificial Sequence
  MKO10051092_A_Sppl2c
  gRNA
caucggugucaccguaagug

SEQ ID NO: 51093 - RNA, 20 nt, Artificial Sequence
  MKO10051093_A_Sppl2c
  gRNA
caugcaaguccaaucucgcc

SEQ ID NO: 51094 - RNA, 20 nt, Artificial Sequence
  MKO10051094_A_Sppl2c
  gRNA
guucacacaaaaucuuccuc

SEQ ID NO: 51095 - RNA, 20 nt, Artificial Sequence
  MKO10051095_A_Sppl3
  gRNA
caagcacuguuccucccgau

SEQ ID NO: 51096 - RNA, 20 nt, Artificial Sequence
  MKO10051096_A_Sppl3
  gRNA
cagaaaugucgacacuugac

SEQ ID NO: 51097 - RNA, 20 nt, Artificial Sequence
  MKO10051097_A_Sppl3
  gRNA
uuucucuagggccuauuccc

SEQ ID NO: 51098 - RNA, 20 nt, Artificial Sequence
  MKO10051098_A_Spred1
  gRNA
uuaugcacgagugcgagcug

SEQ ID NO: 51099 - RNA, 20 nt, Artificial Sequence
  MKO10051099_A_Spred1
  gRNA
gugcccagcgucaaaaacug

SEQ ID NO: 51100 - RNA, 20 nt, Artificial Sequence
  MKO10051100_A_Spred1
  gRNA
cucaguccgcucccuccgag

SEQ ID NO: 51101 - RNA, 20 nt, Artificial Sequence
  MKO10051101_A_Spred2
  gRNA
auaaaucuuccggugcucac

SEQ ID NO: 51102 - RNA, 20 nt, Artificial Sequence
  MKO10051102_A_Spred2
  gRNA
cuccgagcucagcuucguua

SEQ ID NO: 51103 - RNA, 20 nt, Artificial Sequence
  MKO10051103_A_Spred2
  gRNA
ugucuuucugucgcucgcca

SEQ ID NO: 51104 - RNA, 20 nt, Artificial Sequence
  MKO10051104_A_Spred3
  gRNA
caggucgccugcuagugcgc

SEQ ID NO: 51105 - RNA, 20 nt, Artificial Sequence
  MKO10051105_A_Spred3
  gRNA
uaugaggacuaccggcgauc

SEQ ID NO: 51106 - RNA, 20 nt, Artificial Sequence
  MKO10051106_A_Spred3
  gRNA
agcuugggggacugcaaguu

SEQ ID NO: 51107 - RNA, 20 nt, Artificial Sequence
  MKO10051107_A_Sprn
  gRNA
aucaagaguacgcguaaggc

SEQ ID NO: 51108 - RNA, 20 nt, Artificial Sequence
  MKO10051108_A_Sprn
  gRNA
ugcagccgccacgcgcagag

SEQ ID NO: 51109 - RNA, 20 nt, Artificial Sequence
  MKO10051109_A_Sprn
  gRNA
ggaggcaacggaaccgaccg

SEQ ID NO: 51110 - RNA, 20 nt, Artificial Sequence
  MKO10051110_A_Sprr1a
  gRNA
ggcagggcucgggaacaaca

SEQ ID NO: 51111 - RNA, 20 nt, Artificial Sequence
  MKO10051111_A_Sprr1a
  gRNA
accuugugcccccaaaacca

SEQ ID NO: 51112 - RNA, 20 nt, Artificial Sequence
  MKO10051112_A_Sprr1a
  gRNA
cuucugcuggugggaacuca

SEQ ID NO: 51113 - RNA, 20 nt, Artificial Sequence
  MKO10051113_A_Sprr1b
  gRNA
cucaggaaccuuggugucac

SEQ ID NO: 51114 - RNA, 20 nt, Artificial Sequence
  MKO10051114_A_Sprr1b
  gRNA
acuuguugcucaugcaacug

SEQ ID NO: 51115 - RNA, 20 nt, Artificial Sequence
  MKO10051115_A_Sprr1b
  gRNA
caagacacccugugacacca

SEQ ID NO: 51116 - RNA, 20 nt, Artificial Sequence
  MKO10051116_A_Sprr2a1
  gRNA
uguuggguggucacuucugc

SEQ ID NO: 51117 - RNA, 20 nt, Artificial Sequence
  MKO10051117_A_Sprr2a1
  gRNA
agcagugcaaucagccgugc

SEQ ID NO: 51118 - RNA, 20 nt, Artificial Sequence
  MKO10051118_A_Sprr2a1
  gRNA
acggcugauugcacugcugc

SEQ ID NO: 51119 - RNA, 20 nt, Artificial Sequence
  MKO10051119_A_Sprr2a2
  gRNA
uguuggguggucacuucugc

SEQ ID NO: 51120 - RNA, 20 nt, Artificial Sequence
  MKO10051120_A_Sprr2a2
  gRNA
agcagugcaaucagccgugc

SEQ ID NO: 51121 - RNA, 20 nt, Artificial Sequence
  MKO10051121_A_Sprr2a2
  gRNA
acggcugauugcacugcugc

SEQ ID NO: 51122 - RNA, 20 nt, Artificial Sequence
  MKO10051122_A_Sprr2b
  gRNA
aauugcacaggagggcauuu

SEQ ID NO: 51123 - RNA, 20 nt, Artificial Sequence
  MKO10051123_A_Sprr2b
  gRNA
ugccauggcugaggggggca

SEQ ID NO: 51124 - RNA, 20 nt, Artificial Sequence
  MKO10051124_A_Sprr2b
  gRNA
uguccacccaagaauaaaug

SEQ ID NO: 51125 - RNA, 20 nt, Artificial Sequence
  MKO10051125_A_Sprr2d
  gRNA
caaggcucaggacacuuuag

SEQ ID NO: 51126 - RNA, 20 nt, Artificial Sequence
  MKO10051126_A_Sprr2d
  gRNA
ugcccaccuaagagcaagug

SEQ ID NO: 51127 - RNA, 20 nt, Artificial Sequence
  MKO10051127_A_Sprr2d
  gRNA
ugaagaccucacuugcucuu

SEQ ID NO: 51128 - RNA, 20 nt, Artificial Sequence
  MKO10051128_A_Sprr2e
  gRNA
gggcacuucuguugacaugg

SEQ ID NO: 51129 - RNA, 20 nt, Artificial Sequence
  MKO10051129_A_Sprr2e
  gRNA
cugaaucccucacuugcucu

SEQ ID NO: 51130 - RNA, 20 nt, Artificial Sequence
  MKO10051130_A_Sprr2e
  gRNA
ggacaaggcucaggacacug

SEQ ID NO: 51131 - RNA, 20 nt, Artificial Sequence
  MKO10051131_A_Sprr2f
  gRNA
cugaagacuucacuugcucu

SEQ ID NO: 51132 - RNA, 20 nt, Artificial Sequence
  MKO10051132_A_Sprr2f
  gRNA
acaaggcucagggcacaccg

SEQ ID NO: 51133 - RNA, 20 nt, Artificial Sequence
  MKO10051133_A_Sprr2f
  gRNA
guugcuugcacugcuguucu

SEQ ID NO: 51134 - RNA, 20 nt, Artificial Sequence
  MKO10051134_A_Sprr2h
  gRNA
uguccacccaagaacaaaug

SEQ ID NO: 51135 - RNA, 20 nt, Artificial Sequence
  MKO10051135_A_Sprr2h
  gRNA
ggacacuucuguugacaugg

SEQ ID NO: 51136 - RNA, 20 nt, Artificial Sequence
  MKO10051136_A_Sprr2h
  gRNA
cugaggaccucauuuguucu

SEQ ID NO: 51137 - RNA, 20 nt, Artificial Sequence
  MKO10051137_A_Sprr2i
  gRNA
cugaggcauucacuugcuuu

SEQ ID NO: 51138 - RNA, 20 nt, Artificial Sequence
  MKO10051138_A_Sprr2i
  gRNA
ggacaagguucaggacacug

SEQ ID NO: 51139 - RNA, 20 nt, Artificial Sequence
  MKO10051139_A_Sprr2i
  gRNA
gagggagggggacaugacuc

SEQ ID NO: 51140 - RNA, 20 nt, Artificial Sequence
  MKO10051140_A_Sprr2k
  gRNA
ucugcuggcauggugccucc

SEQ ID NO: 51141 - RNA, 20 nt, Artificial Sequence
  MKO10051141_A_Sprr2k
  gRNA
gcccuccucagccaugccag

SEQ ID NO: 51142 - RNA, 20 nt, Artificial Sequence
  MKO10051142_A_Sprr2k
  gRNA
ggagggcauuuccgcuggca

SEQ ID NO: 51143 - RNA, 20 nt, Artificial Sequence
  MKO10051143_A_Sprr3
  gRNA
ccagaucguaccgugguucc

SEQ ID NO: 51144 - RNA, 20 nt, Artificial Sequence
  MKO10051144_A_Sprr3
  gRNA
ucuaucaauguucgugaacc

SEQ ID NO: 51145 - RNA, 20 nt, Artificial Sequence
  MKO10051145_A_Sprr3
  gRNA
ccagauuauacuacgaugcc

SEQ ID NO: 51146 - RNA, 20 nt, Artificial Sequence
  MKO10051146_A_Sprr4
  gRNA
accuccuaccaaaugucaag

SEQ ID NO: 51147 - RNA, 20 nt, Artificial Sequence
  MKO10051147_A_Sprr4
  gRNA
gcaggacacuucucuugagc

SEQ ID NO: 51148 - RNA, 20 nt, Artificial Sequence
  MKO10051148_A_Sprr4
  gRNA
ccaaaaaacaaugcccagcg

SEQ ID NO: 51149 - RNA, 20 nt, Artificial Sequence
  MKO10051149_A_Sprtn
  gRNA
auccgcaaccauaucccgag

SEQ ID NO: 51150 - RNA, 20 nt, Artificial Sequence
  MKO10051150_A_Sprtn
  gRNA
acgcuucacauagccguagu

SEQ ID NO: 51151 - RNA, 20 nt, Artificial Sequence
  MKO10051151_A_Sprtn
  gRNA
uggaugaguaucgccggcac

SEQ ID NO: 51152 - RNA, 20 nt, Artificial Sequence
  MKO10051152_A_Spry1
  gRNA
uaggacggucuccgcccacc

SEQ ID NO: 51153 - RNA, 20 nt, Artificial Sequence
  MKO10051153_A_Spry1
  gRNA
ugggcggagaccguccuaau

SEQ ID NO: 51154 - RNA, 20 nt, Artificial Sequence
  MKO10051154_A_Spry1
  gRNA
acccgaucugaccuaugacc

SEQ ID NO: 51155 - RNA, 20 nt, Artificial Sequence
  MKO10051155_A_Spry2
  gRNA
aauccgagugcagccuaaau

SEQ ID NO: 51156 - RNA, 20 nt, Artificial Sequence
  MKO10051156_A_Spry2
  gRNA
cugaccaucgcguacaacaa

SEQ ID NO: 51157 - RNA, 20 nt, Artificial Sequence
  MKO10051157_A_Spry2
  gRNA
agucccauuguuguacgcga

SEQ ID NO: 51158 - RNA, 20 nt, Artificial Sequence
  MKO10051158_A_Spry3
  gRNA
uaugauagccuccgucgacc

SEQ ID NO: 51159 - RNA, 20 nt, Artificial Sequence
  MKO10051159_A_Spry3
  gRNA
agagggcgaaccgcugugca

SEQ ID NO: 51160 - RNA, 20 nt, Artificial Sequence
  MKO10051160_A_Spry3
  gRNA
gacuccuguaccuagaaaac

SEQ ID NO: 51161 - RNA, 20 nt, Artificial Sequence
  MKO10051161_A_Spry4
  gRNA
uacgaccgccugagacgccc

SEQ ID NO: 51162 - RNA, 20 nt, Artificial Sequence
  MKO10051162_A_Spry4
  gRNA
ucaggcggucguagccucgc

SEQ ID NO: 51163 - RNA, 20 nt, Artificial Sequence
  MKO10051163_A_Spry4
  gRNA
ucacauggcuccaccgcccg

SEQ ID NO: 51164 - RNA, 20 nt, Artificial Sequence
  MKO10051164_A_Spryd3
  gRNA
ggcgucucgaccccugacca

SEQ ID NO: 51165 - RNA, 20 nt, Artificial Sequence
  MKO10051165_A_Spryd3
  gRNA
aguugcacuuugacccgaac

SEQ ID NO: 51166 - RNA, 20 nt, Artificial Sequence
  MKO10051166_A_Spryd3
  gRNA
cguccggggcaccauugcug

SEQ ID NO: 51167 - RNA, 20 nt, Artificial Sequence
  MKO10051167_A_Spryd4
  gRNA
cccugaauuuggagcgcuuc

SEQ ID NO: 51168 - RNA, 20 nt, Artificial Sequence
  MKO10051168_A_Spryd4
  gRNA
ggcgacacgggugucaaaua

SEQ ID NO: 51169 - RNA, 20 nt, Artificial Sequence
  MKO10051169_A_Spryd4
  gRNA
cgcugcccuuugcacgcugu

SEQ ID NO: 51170 - RNA, 20 nt, Artificial Sequence
  MKO10051170_A_Spryd7
  gRNA
aguugacgacagugcaauuc

SEQ ID NO: 51171 - RNA, 20 nt, Artificial Sequence
  MKO10051171_A_Spryd7
  gRNA
cuaugcaugucucggccaag

SEQ ID NO: 51172 - RNA, 20 nt, Artificial Sequence
  MKO10051172_A_Spryd7
  gRNA
cugagcuuaccauauacaac

SEQ ID NO: 51173 - RNA, 20 nt, Artificial Sequence
  MKO10051173_A_Spr
  gRNA
gcgcaguacgcgagcucccg

SEQ ID NO: 51174 - RNA, 20 nt, Artificial Sequence
  MKO10051174_A_Spr
  gRNA
ccagggcgcgaccaaagccc

SEQ ID NO: 51175 - RNA, 20 nt, Artificial Sequence
  MKO10051175_A_Spr
  gRNA
auggggcgcugguggacugu

SEQ ID NO: 51176 - RNA, 20 nt, Artificial Sequence
  MKO10051176_A_Spsb1
  gRNA
guccguucaaguagcgcaug

SEQ ID NO: 51177 - RNA, 20 nt, Artificial Sequence
  MKO10051177_A_Spsb1
  gRNA
gcaacgaggcacgcaugccg

SEQ ID NO: 51178 - RNA, 20 nt, Artificial Sequence
  MKO10051178_A_Spsb1
  gRNA
gcgcuaggcgcaccgaacgc

SEQ ID NO: 51179 - RNA, 20 nt, Artificial Sequence
  MKO10051179_A_Spsb2
  gRNA
ugcccaaaagcgccgcauag

SEQ ID NO: 51180 - RNA, 20 nt, Artificial Sequence
  MKO10051180_A_Spsb2
  gRNA
gggaaacggggcuauucgag

SEQ ID NO: 51181 - RNA, 20 nt, Artificial Sequence
  MKO10051181_A_Spsb2
  gRNA
guagagcagauagcgcuuca

SEQ ID NO: 51182 - RNA, 20 nt, Artificial Sequence
  MKO10051182_A_Spsb3
  gRNA
cccggcguacacggaguagc

SEQ ID NO: 51183 - RNA, 20 nt, Artificial Sequence
  MKO10051183_A_Spsb3
  gRNA
uaucucggcgggcugcgcuc

SEQ ID NO: 51184 - RNA, 20 nt, Artificial Sequence
  MKO10051184_A_Spsb3
  gRNA
uaggggauggccaacacuuc

SEQ ID NO: 51185 - RNA, 20 nt, Artificial Sequence
  MKO10051185_A_Spsb4
  gRNA
cgacagcgccugcgugacau

SEQ ID NO: 51186 - RNA, 20 nt, Artificial Sequence
  MKO10051186_A_Spsb4
  gRNA
gcagggagccgaugucacgc

SEQ ID NO: 51187 - RNA, 20 nt, Artificial Sequence
  MKO10051187_A_Spsb4
  gRNA
aaggccguugauguagcgca

SEQ ID NO: 51188 - RNA, 20 nt, Artificial Sequence
  MKO10051188_A_Spt1
  gRNA
uucuucuucgacugaaucag

SEQ ID NO: 51189 - RNA, 20 nt, Artificial Sequence
  MKO10051189_A_Spt1
  gRNA
cuaaagaauuucuuacaacg

SEQ ID NO: 51190 - RNA, 20 nt, Artificial Sequence
  MKO10051190_A_Spt1
  gRNA
aacgccacuguucugaucag

SEQ ID NO: 51191 - RNA, 20 nt, Artificial Sequence
  MKO10051191_A_Spua1
  gRNA
ucaaggaucgcguugccgag

SEQ ID NO: 51192 - RNA, 20 nt, Artificial Sequence
  MKO10051192_A_Spua1
  gRNA
caacgcgauccuugaaccuc

SEQ ID NO: 51193 - RNA, 20 nt, Artificial Sequence
  MKO10051193_A_Spua1
  gRNA
cgaugacugggagcgaacug

SEQ ID NO: 51194 - RNA, 20 nt, Artificial Sequence
  MKO10051194_A_Spuan1
  gRNA
cuccagcuucugacgccgua

SEQ ID NO: 51195 - RNA, 20 nt, Artificial Sequence
  MKO10051195_A_Spuan1
  gRNA
uagagagcuccuugaagcgg

SEQ ID NO: 51196 - RNA, 20 nt, Artificial Sequence
  MKO10051196_A_Spuan1
  gRNA
guagcaccucuacaugcucc

SEQ ID NO: 51197 - RNA, 20 nt, Artificial Sequence
  MKO10051197_A_Sptbn1
  gRNA
auccgcauccgucccuuagu

SEQ ID NO: 51198 - RNA, 20 nt, Artificial Sequence
  MKO10051198_A_Sptbn1
  gRNA
acggaugcggauccacuguc

SEQ ID NO: 51199 - RNA, 20 nt, Artificial Sequence
  MKO10051199_A_Sptbn1
  gRNA
ugagcauccguccaucucga

SEQ ID NO: 51200 - RNA, 20 nt, Artificial Sequence
  MKO10051200_A_Sptbn2
  gRNA
ccgaaugcggauucacugcc

SEQ ID NO: 51201 - RNA, 20 nt, Artificial Sequence
  MKO10051201_A_Sptbn2
  gRNA
ggagguugcgcccgucccgc

SEQ ID NO: 51202 - RNA, 20 nt, Artificial Sequence
  MKO10051202_A_Sptbn2
  gRNA
gugaauccgcauucggcccu

SEQ ID NO: 51203 - RNA, 20 nt, Artificial Sequence
  MKO10051203_A_Sptbn4
  gRNA
aagcggcgucgcuccugcaa

SEQ ID NO: 51204 - RNA, 20 nt, Artificial Sequence
  MKO10051204_A_Sptbn4
  gRNA
ggagcgacgccgcuuguugc

SEQ ID NO: 51205 - RNA, 20 nt, Artificial Sequence
  MKO10051205_A_Sptbn4
  gRNA
ccgcgaagcucugcacuagc

SEQ ID NO: 51206 - RNA, 20 nt, Artificial Sequence
  MKO10051206_A_Sptb
  gRNA
ugagcauccguccgucccgc

SEQ ID NO: 51207 - RNA, 20 nt, Artificial Sequence
  MKO10051207_A_Sptb
  gRNA
cccuuagccaaggccgacca

SEQ ID NO: 51208 - RNA, 20 nt, Artificial Sequence
  MKO10051208_A_Sptb
  gRNA
uguggaugguaaccaccgcc

SEQ ID NO: 51209 - RNA, 20 nt, Artificial Sequence
  MKO10051209_A_Sptlc1
  gRNA
gcuggccaacccucgaguua

SEQ ID NO: 51210 - RNA, 20 nt, Artificial Sequence
  MKO10051210_A_Sptlc1
  gRNA
uuguuacucaccuuaacucg

SEQ ID NO: 51211 - RNA, 20 nt, Artificial Sequence
  MKO10051211_A_Sptlc1
  gRNA
cucaacuacaacaucguguc

SEQ ID NO: 51212 - RNA, 20 nt, Artificial Sequence
  MKO10051212_A_Sptlc2
  gRNA
cgaccuaucuguagugugcc

SEQ ID NO: 51213 - RNA, 20 nt, Artificial Sequence
  MKO10051213_A_Sptlc2
  gRNA
gauaucuucgagauuucuug

SEQ ID NO: 51214 - RNA, 20 nt, Artificial Sequence
  MKO10051214_A_Sptlc2
  gRNA
aggggugugcagcacucguc

SEQ ID NO: 51215 - RNA, 20 nt, Artificial Sequence
  MKO10051215_A_Sptlc3
  gRNA
agucucugagauagccgaau

SEQ ID NO: 51216 - RNA, 20 nt, Artificial Sequence
  MKO10051216_A_Sptlc3
  gRNA
aagugacugaugacuauaac

SEQ ID NO: 51217 - RNA, 20 nt, Artificial Sequence
  MKO10051217_A_Sptlc3
  gRNA
ggacuuugugccgcuguauc

SEQ ID NO: 51218 - RNA, 20 nt, Artificial Sequence
  MKO10051218_A_Sptssa
  gRNA
ccaucacgcagauucgaugc

SEQ ID NO: 51219 - RNA, 20 nt, Artificial Sequence
  MKO10051219_A_Sptssa
  gRNA
acugaacacgguucgcuccc

SEQ ID NO: 51220 - RNA, 20 nt, Artificial Sequence
  MKO10051220_A_Sptssa
  gRNA
gcagaauagccaugaugugc

SEQ ID NO: 51221 - RNA, 20 nt, Artificial Sequence
  MKO10051221_A_Sptssb
  gRNA
cauggauuucaagcgcguga

SEQ ID NO: 51222 - RNA, 20 nt, Artificial Sequence
  MKO10051222_A_Sptssb
  gRNA
cuucacgcgcuugaaaucca

SEQ ID NO: 51223 - RNA, 20 nt, Artificial Sequence
  MKO10051223_A_Sptssb
  gRNA
acugucauagccacauauuu

SEQ ID NO: 51224 - RNA, 20 nt, Artificial Sequence
  MKO10051224_A_Spty2d1
  gRNA
gauuucugagucccgcuagc

SEQ ID NO: 51225 - RNA, 20 nt, Artificial Sequence
  MKO10051225_A_Spty2d1
  gRNA
gcuggacgaacugucaauuc

SEQ ID NO: 51226 - RNA, 20 nt, Artificial Sequence
  MKO10051226_A_Spty2d1
  gRNA
ugacuaugccuuacguuaca

SEQ ID NO: 51227 - RNA, 20 nt, Artificial Sequence
  MKO10051227_A_Spz1
  gRNA
acgaacucagcgaacuaaug

SEQ ID NO: 51228 - RNA, 20 nt, Artificial Sequence
  MKO10051228_A_Spz1
  gRNA
cgugccuuccguugcccucg

SEQ ID NO: 51229 - RNA, 20 nt, Artificial Sequence
  MKO10051229_A_Spz1
  gRNA
cugcgaucaaaugcagcgcg

SEQ ID NO: 51230 - RNA, 20 nt, Artificial Sequence
  MKO10051230_A_Sqle
  gRNA
agugucgaccucguucguga

SEQ ID NO: 51231 - RNA, 20 nt, Artificial Sequence
  MKO10051231_A_Sqle
  gRNA
cacgaacgaggucgacacug

SEQ ID NO: 51232 - RNA, 20 nt, Artificial Sequence
  MKO10051232_A_Sqle
  gRNA
uguaaucggcgugcaauaca

SEQ ID NO: 51233 - RNA, 20 nt, Artificial Sequence
  MKO10051233_A_Sqrdl
  gRNA
ugucaggucggaccucaaua

SEQ ID NO: 51234 - RNA, 20 nt, Artificial Sequence
  MKO10051234_A_Sqrdl
  gRNA
agcgaugauaagguaucugu

SEQ ID NO: 51235 - RNA, 20 nt, Artificial Sequence
  MKO10051235_A_Sqrdl
  gRNA
ggaaucacaugcgucucccc

SEQ ID NO: 51236 - RNA, 20 nt, Artificial Sequence
  MKO10051236_A_Sqstm1
  gRNA
gggcggccauccccugcacg

SEQ ID NO: 51237 - RNA, 20 nt, Artificial Sequence
  MKO10051237_A_Sqstm1
  gRNA
cgaccugugcagcgugugcg

SEQ ID NO: 51238 - RNA, 20 nt, Artificial Sequence
  MKO10051238_A_Sqstm1
  gRNA
uuauagcgaguucccaccac

SEQ ID NO: 51239 - RNA, 20 nt, Artificial Sequence
  MKO10051239_A_Sra1
  gRNA
ggccgcgacccucuuaguaa

SEQ ID NO: 51240 - RNA, 20 nt, Artificial Sequence
  MKO10051240_A_Sra1
  gRNA
cucgaagcagcgccaagcgu

SEQ ID NO: 51241 - RNA, 20 nt, Artificial Sequence
  MKO10051241_A_Sra1
  gRNA
aacgcacuccccuuacuaag

SEQ ID NO: 51242 - RNA, 20 nt, Artificial Sequence
  MKO10051242_A_Srbd1
  gRNA
aaugaacugggacguaguac

SEQ ID NO: 51243 - RNA, 20 nt, Artificial Sequence
  MKO10051243_A_Srbd1
  gRNA
guugaacuguaaaacguucg

SEQ ID NO: 51244 - RNA, 20 nt, Artificial Sequence
  MKO10051244_A_Srbd1
  gRNA
ggcuuuauagaacagcccgg

SEQ ID NO: 51245 - RNA, 20 nt, Artificial Sequence
  MKO10051245_A_Srcin1
  gRNA
ccgcaagcgagaugcguuca

SEQ ID NO: 51246 - RNA, 20 nt, Artificial Sequence
  MKO10051246_A_Srcin1
  gRNA
ccgcagcucgcgccauacuc

SEQ ID NO: 51247 - RNA, 20 nt, Artificial Sequence
  MKO10051247_A_Srcin1
  gRNA
ccgguacucccgaggguacu

SEQ ID NO: 51248 - RNA, 20 nt, Artificial Sequence
  MKO10051248_A_Srcrb4d
  gRNA
aucgucgcaaacgcugcccc

SEQ ID NO: 51249 - RNA, 20 nt, Artificial Sequence
  MKO10051249_A_Srcrb4d
  gRNA
cgccucgaggucaugcauag

SEQ ID NO: 51250 - RNA, 20 nt, Artificial Sequence
  MKO10051250_A_Srcrb4d
  gRNA
cccgguaccauagccgaaaa

SEQ ID NO: 51251 - RNA, 20 nt, Artificial Sequence
  MKO10051251_A_Src
  gRNA
cucggccgcgggcggcacga

SEQ ID NO: 51252 - RNA, 20 nt, Artificial Sequence
  MKO10051252_A_Src
  gRNA
cucaacgccgagaacccgag

SEQ ID NO: 51253 - RNA, 20 nt, Artificial Sequence
  MKO10051253_A_Src
  gRNA
cgccgccuucgugccgcccg

SEQ ID NO: 51254 - RNA, 20 nt, Artificial Sequence
  MKO10051254_A_Srd5a1
  gRNA
cacgagcuccccaaaauagu

SEQ ID NO: 51255 - RNA, 20 nt, Artificial Sequence
  MKO10051255_A_Srd5a1
  gRNA
gguaaucuucaaacuucucg

SEQ ID NO: 51256 - RNA, 20 nt, Artificial Sequence
  MKO10051256_A_Srd5a1
  gRNA
uucucagauuccgcaggaug

SEQ ID NO: 51257 - RNA, 20 nt, Artificial Sequence
  MKO10051257_A_Srd5a2
  gRNA
acagacaugcgguuuagcgu

SEQ ID NO: 51258 - RNA, 20 nt, Artificial Sequence
  MKO10051258_A_Srd5a2
  gRNA
cgcgcaauaaaccagguaau

SEQ ID NO: 51259 - RNA, 20 nt, Artificial Sequence
  MKO10051259_A_Srd5a2
  gRNA
uccauucaauaaucucgccc

SEQ ID NO: 51260 - RNA, 20 nt, Artificial Sequence
  MKO10051260_A_Srd5a3
  gRNA
cacguugugcaguacuguuu

SEQ ID NO: 51261 - RNA, 20 nt, Artificial Sequence
  MKO10051261_A_Srd5a3
  gRNA
agcacucaaagagucuccga

SEQ ID NO: 51262 - RNA, 20 nt, Artificial Sequence
  MKO10051262_A_Srd5a3
  gRNA
ugacguggcauuuauacuga

SEQ ID NO: 51263 - RNA, 20 nt, Artificial Sequence
  MKO10051263_A_Srebf1
  gRNA
cccauccaccgacucgcagc

SEQ ID NO: 51264 - RNA, 20 nt, Artificial Sequence
  MKO10051264_A_Srebf1
  gRNA
cuguuugacgcccccuaugc

SEQ ID NO: 51265 - RNA, 20 nt, Artificial Sequence
  MKO10051265_A_Srebf1
  gRNA
ggugacggcuguggcgcugc

SEQ ID NO: 51266 - RNA, 20 nt, Artificial Sequence
  MKO10051266_A_Srebf2
  gRNA
aagccucgugacguccccgc

SEQ ID NO: 51267 - RNA, 20 nt, Artificial Sequence
  MKO10051267_A_Srebf2
  gRNA
ucagcaccgcuccgcagacg

SEQ ID NO: 51268 - RNA, 20 nt, Artificial Sequence
  MKO10051268_A_Srebf2
  gRNA
acagacggucgcugcgccac

SEQ ID NO: 51269 - RNA, 20 nt, Artificial Sequence
  MKO10051269_A_Srek1ip1
  gRNA
gaucuacccggagaaaauug

SEQ ID NO: 51270 - RNA, 20 nt, Artificial Sequence
  MKO10051270_A_Srek1ip1
  gRNA
cgucagcagcaccaguagug

SEQ ID NO: 51271 - RNA, 20 nt, Artificial Sequence
  MKO10051271_A_Srek1ip1
  gRNA
uuguauuucagguugcaaca

SEQ ID NO: 51272 - RNA, 20 nt, Artificial Sequence
  MKO10051272_A_Srek1
  gRNA
accuggacuuugagcgagug

SEQ ID NO: 51273 - RNA, 20 nt, Artificial Sequence
  MKO10051273_A_Srek1
  gRNA
uccacaaaagcaaaccgagu

SEQ ID NO: 51274 - RNA, 20 nt, Artificial Sequence
  MKO10051274_A_Srek1
  gRNA
ggauccacauuucccauaag

SEQ ID NO: 51275 - RNA, 20 nt, Artificial Sequence
  MKO10051275_A_Srfbp1
  gRNA
agugaagcgaauccgaguuc

SEQ ID NO: 51276 - RNA, 20 nt, Artificial Sequence
  MKO10051276_A_Srfbp1
  gRNA
cgaaaacuugucaggagugu

SEQ ID NO: 51277 - RNA, 20 nt, Artificial Sequence
  MKO10051277_A_Srfbp1
  gRNA
gcaaccuuugggcucgccuu

SEQ ID NO: 51278 - RNA, 20 nt, Artificial Sequence
  MKO10051278_A_Srf
  gRNA
aagaguuauaccugucccgc

SEQ ID NO: 51279 - RNA, 20 nt, Artificial Sequence
  MKO10051279_A_Srf
  gRNA
acucuugagcacagucccgu

SEQ ID NO: 51280 - RNA, 20 nt, Artificial Sequence
  MKO10051280_A_Srf
  gRNA
ucugagcggggcggagaguc

SEQ ID NO: 51281 - RNA, 20 nt, Artificial Sequence
  MKO10051281_A_Srgap1
  gRNA
gauugcguuccagcuucacg

SEQ ID NO: 51282 - RNA, 20 nt, Artificial Sequence
  MKO10051282_A_Srgap1
  gRNA
caccccgagcagauucaaga

SEQ ID NO: 51283 - RNA, 20 nt, Artificial Sequence
  MKO10051283_A_Srgap1
  gRNA
ggccaaaacaagaagcacua

SEQ ID NO: 51284 - RNA, 20 nt, Artificial Sequence
  MKO10051284_A_Srgap2
  gRNA
ucgauuuguucaagucagcg

SEQ ID NO: 51285 - RNA, 20 nt, Artificial Sequence
  MKO10051285_A_Srgap2
  gRNA
cacagccaauguccgcauug

SEQ ID NO: 51286 - RNA, 20 nt, Artificial Sequence
  MKO10051286_A_Srgap2
  gRNA
aguccugaacgagcuuuacu

SEQ ID NO: 51287 - RNA, 20 nt, Artificial Sequence
  MKO10051287_A_Srgap3
  gRNA
uccucucgcccgugaacugu

SEQ ID NO: 51288 - RNA, 20 nt, Artificial Sequence
  MKO10051288_A_Srgap3
  gRNA
uggagcagcaguccgagucg

SEQ ID NO: 51289 - RNA, 20 nt, Artificial Sequence
  MKO10051289_A_Srgap3
  gRNA
gcuggggucuguccucgugc

SEQ ID NO: 51290 - RNA, 20 nt, Artificial Sequence
  MKO10051290_A_Srgn
  gRNA
gcagcggacccacugguacc

SEQ ID NO: 51291 - RNA, 20 nt, Artificial Sequence
  MKO10051291_A_Srgn
  gRNA
uggguccgcugcaaaccgaa

SEQ ID NO: 51292 - RNA, 20 nt, Artificial Sequence
  MKO10051292_A_Srgn
  gRNA
gucaggaugcagguucccgu

SEQ ID NO: 51293 - RNA, 20 nt, Artificial Sequence
  MKO10051293_A_Sri
  gRNA
ucaucaguuucgauagcgau

SEQ ID NO: 51294 - RNA, 20 nt, Artificial Sequence
  MKO10051294_A_Sri
  gRNA
gacacaaacccauagucguc

SEQ ID NO: 51295 - RNA, 20 nt, Artificial Sequence
  MKO10051295_A_Sri
  gRNA
ugaguuuguccagggaacgc

SEQ ID NO: 51296 - RNA, 20 nt, Artificial Sequence
  MKO10051296_A_Srl
  gRNA
aagccagcugacgauuacuc

SEQ ID NO: 51297 - RNA, 20 nt, Artificial Sequence
  MKO10051297_A_Srl
  gRNA
cgauucaucuccggcaggua

SEQ ID NO: 51298 - RNA, 20 nt, Artificial Sequence
  MKO10051298_A_Srl
  gRNA
uuaccugaguaaucgucagc

SEQ ID NO: 51299 - RNA, 20 nt, Artificial Sequence
  MKO10051299_A_Srms
  gRNA
gggaacauauagcgugcagc

SEQ ID NO: 51300 - RNA, 20 nt, Artificial Sequence
  MKO10051300_A_Srms
  gRNA
aguucaguaacgauguacac

SEQ ID NO: 51301 - RNA, 20 nt, Artificial Sequence
  MKO10051301_A_Srms
  gRNA
uggcuuacuacaagaccaac

SEQ ID NO: 51302 - RNA, 20 nt, Artificial Sequence
  MKO10051302_A_Srm
  gRNA
augcgguaccuuccgcgggu

SEQ ID NO: 51303 - RNA, 20 nt, Artificial Sequence
  MKO10051303_A_Srm
  gRNA
ucugcccgcaguaaaaccua

SEQ ID NO: 51304 - RNA, 20 nt, Artificial Sequence
  MKO10051304_A_Srm
  gRNA
ccaccucaucaaucucgcac

SEQ ID NO: 51305 - RNA, 20 nt, Artificial Sequence
  MKO10051305_A_Srp14
  gRNA
ugaacacgcugcccgacgag

SEQ ID NO: 51306 - RNA, 20 nt, Artificial Sequence
  MKO10051306_A_Srp14
  gRNA
cuuccagaagugccgcucgu

SEQ ID NO: 51307 - RNA, 20 nt, Artificial Sequence
  MKO10051307_A_Srp14
  gRNA
gucgcaccaaaccuaucccg

SEQ ID NO: 51308 - RNA, 20 nt, Artificial Sequence
  MKO10051308_A_Srp19
  gRNA
cagcuacucaccuuacuuau

SEQ ID NO: 51309 - RNA, 20 nt, Artificial Sequence
  MKO10051309_A_Srp19
  gRNA
gccgacccaagucuucagca

SEQ ID NO: 51310 - RNA, 20 nt, Artificial Sequence
  MKO10051310_A_Srp19
  gRNA
aaccgugauguucaguuucg

SEQ ID NO: 51311 - RNA, 20 nt, Artificial Sequence
  MKO10051311_A_Srp54a
  gRNA
agaaguauguacagcauuau

SEQ ID NO: 51312 - RNA, 20 nt, Artificial Sequence
  MKO10051312_A_Srp54a
  gRNA
ugcaauugaucuugaagaga

SEQ ID NO: 51313 - RNA, 20 nt, Artificial Sequence
  MKO10051313_A_Srp54a
  gRNA
uguauuuaaagaacuuguaa

SEQ ID NO: 51314 - RNA, 20 nt, Artificial Sequence
  MKO10051314_A_Srp54b
  gRNA
agaaguauguacagcauuau

SEQ ID NO: 51315 - RNA, 20 nt, Artificial Sequence
  MKO10051315_A_Srp54b
  gRNA
ugcaauugaucuugaagaga

SEQ ID NO: 51316 - RNA, 20 nt, Artificial Sequence
  MKO10051316_A_Srp54b
  gRNA
uguauuuaaagaacuuguaa

SEQ ID NO: 51317 - RNA, 20 nt, Artificial Sequence
  MKO10051317_A_Srp54c
  gRNA
agaaguauguacagcauuau

SEQ ID NO: 51318 - RNA, 20 nt, Artificial Sequence
  MKO10051318_A_Srp54c
  gRNA
ugcaauugaucuugaagaga

SEQ ID NO: 51319 - RNA, 20 nt, Artificial Sequence
  MKO10051319_A_Srp54c
  gRNA
uguauuuaaagaacuuguaa

SEQ ID NO: 51320 - RNA, 20 nt, Artificial Sequence
  MKO10051320_A_Srp68
  gRNA
ccaacaccgagccgcggaaa

SEQ ID NO: 51321 - RNA, 20 nt, Artificial Sequence
  MKO10051321_A_Srp68
  gRNA
cucgaagacaaagacgccuc

SEQ ID NO: 51322 - RNA, 20 nt, Artificial Sequence
  MKO10051322_A_Srp68
  gRNA
agcaagugaaaccguuuccg

SEQ ID NO: 51323 - RNA, 20 nt, Artificial Sequence
  MKO10051323_A_Srp72
  gRNA
agcacucaucguagcguucc

SEQ ID NO: 51324 - RNA, 20 nt, Artificial Sequence
  MKO10051324_A_Srp72
  gRNA
ucguugccgcucagagcaac

SEQ ID NO: 51325 - RNA, 20 nt, Artificial Sequence
  MKO10051325_A_Srp72
  gRNA
ggcaaacuacuuuacagugc

SEQ ID NO: 51326 - RNA, 20 nt, Artificial Sequence
  MKO10051326_A_Srp9
  gRNA
ucaccuucaugggguccgcc

SEQ ID NO: 51327 - RNA, 20 nt, Artificial Sequence
  MKO10051327_A_Srp9
  gRNA
cgaugccucaguuccagacc

SEQ ID NO: 51328 - RNA, 20 nt, Artificial Sequence
  MKO10051328_A_Srp9
  gRNA
uacgggugguucucaaauac

SEQ ID NO: 51329 - RNA, 20 nt, Artificial Sequence
  MKO10051329_A_Srpk1
  gRNA
ucccgcagugcucgcgcucc

SEQ ID NO: 51330 - RNA, 20 nt, Artificial Sequence
  MKO10051330_A_Srpk1
  gRNA
agggucugacgaugacgagc

SEQ ID NO: 51331 - RNA, 20 nt, Artificial Sequence
  MKO10051331_A_Srpk1
  gRNA
gaccccaaugacuacuguaa

SEQ ID NO: 51332 - RNA, 20 nt, Artificial Sequence
  MKO10051332_A_Srpk2
  gRNA
gaguaguuuaauuucaucca

SEQ ID NO: 51333 - RNA, 20 nt, Artificial Sequence
  MKO10051333_A_Srpk2
  gRNA
ggcuaucauccagugaaaau

SEQ ID NO: 51334 - RNA, 20 nt, Artificial Sequence
  MKO10051334_A_Srpk2
  gRNA
auugaugacuucaagaucuc

SEQ ID NO: 51335 - RNA, 20 nt, Artificial Sequence
  MKO10051335_A_Srpk3
  gRNA
uuacaggcgcaagcgcuuug

SEQ ID NO: 51336 - RNA, 20 nt, Artificial Sequence
  MKO10051336_A_Srpk3
  gRNA
gucaucgauaaguugaacaa

SEQ ID NO: 51337 - RNA, 20 nt, Artificial Sequence
  MKO10051337_A_Srpk3
  gRNA
uucaacuuaucgaugacuuc

SEQ ID NO: 51338 - RNA, 20 nt, Artificial Sequence
  MKO10051338_A_Srprb
  gRNA
uggacagugcggcguuccag

SEQ ID NO: 51339 - RNA, 20 nt, Artificial Sequence
  MKO10051339_A_Srprb
  gRNA
uguggccgaauuucuguacc

SEQ ID NO: 51340 - RNA, 20 nt, Artificial Sequence
  MKO10051340_A_Srprb
  gRNA
aucgcuuuaagucuucagcu

SEQ ID NO: 51341 - RNA, 20 nt, Artificial Sequence
  MKO10051341_A_Srpr
  gRNA
ccucucaccgaaggagccgc

SEQ ID NO: 51342 - RNA, 20 nt, Artificial Sequence
  MKO10051342_A_Srpr
  gRNA
ccaaagaggagcugauccgu

SEQ ID NO: 51343 - RNA, 20 nt, Artificial Sequence
  MKO10051343_A_Srpr
  gRNA
uaacaacucuuucacucaug

SEQ ID NO: 51344 - RNA, 20 nt, Artificial Sequence
  MKO10051344_A_Srpx2
  gRNA
guuccagaccaacgccggcu

SEQ ID NO: 51345 - RNA, 20 nt, Artificial Sequence
  MKO10051345_A_Srpx2
  gRNA
acuggucaucaucgucgaca

SEQ ID NO: 51346 - RNA, 20 nt, Artificial Sequence
  MKO10051346_A_Srpx2
  gRNA
agagcucacaacgugugccu

SEQ ID NO: 51347 - RNA, 20 nt, Artificial Sequence
  MKO10051347_A_Srpx
  gRNA
augugacauucgcugccgaa

SEQ ID NO: 51348 - RNA, 20 nt, Artificial Sequence
  MKO10051348_A_Srpx
  gRNA
cugaccagcgcuuguuugac

SEQ ID NO: 51349 - RNA, 20 nt, Artificial Sequence
  MKO10051349_A_Srpx
  gRNA
gacucaccacuagaagacga

SEQ ID NO: 51350 - RNA, 20 nt, Artificial Sequence
  MKO10051350_A_Srrd
  gRNA
aucguugccuagugcgucac

SEQ ID NO: 51351 - RNA, 20 nt, Artificial Sequence
  MKO10051351_A_Srrd
  gRNA
guucccgaugaugagcaccc

SEQ ID NO: 51352 - RNA, 20 nt, Artificial Sequence
  MKO10051352_A_Srrd
  gRNA
ugauuucugcaguucggcac

SEQ ID NO: 51353 - RNA, 20 nt, Artificial Sequence
  MKO10051353_A_Srrm1
  gRNA
caacaucaucuucgaaucca

SEQ ID NO: 51354 - RNA, 20 nt, Artificial Sequence
  MKO10051354_A_Srrm1
  gRNA
gucauaccuucacuuccagc

SEQ ID NO: 51355 - RNA, 20 nt, Artificial Sequence
  MKO10051355_A_Srrm1
  gRNA
uuucuugugcacucaacagc

SEQ ID NO: 51356 - RNA, 20 nt, Artificial Sequence
  MKO10051356_A_Srrm2
  gRNA
gcaguucuccucgacgagag

SEQ ID NO: 51357 - RNA, 20 nt, Artificial Sequence
  MKO10051357_A_Srrm2
  gRNA
gcuucucgagcacgucucug

SEQ ID NO: 51358 - RNA, 20 nt, Artificial Sequence
  MKO10051358_A_Srrm2
  gRNA
gaacgacuccgugcugccuu

SEQ ID NO: 51359 - RNA, 20 nt, Artificial Sequence
  MKO10051359_A_Srrm3
  gRNA
cgggccgucguccucaucga

SEQ ID NO: 51360 - RNA, 20 nt, Artificial Sequence
  MKO10051360_A_Srrm3
  gRNA
ggcagagaccccgcgacgaa

SEQ ID NO: 51361 - RNA, 20 nt, Artificial Sequence
  MKO10051361_A_Srrm3
  gRNA
ggcagaaggucgggaccuuc

SEQ ID NO: 51362 - RNA, 20 nt, Artificial Sequence
  MKO10051362_A_Srrm4
  gRNA
ccaagaaacauaagcgacac

SEQ ID NO: 51363 - RNA, 20 nt, Artificial Sequence
  MKO10051363_A_Srrm4
  gRNA
ucugaagguccauccugauc

SEQ ID NO: 51364 - RNA, 20 nt, Artificial Sequence
  MKO10051364_A_Srrm4
  gRNA
ccugugucgcuuauguuucu

SEQ ID NO: 51365 - RNA, 20 nt, Artificial Sequence
  MKO10051365_A_Srrt
  gRNA
gugaauaucgagacuacgac

SEQ ID NO: 51366 - RNA, 20 nt, Artificial Sequence
  MKO10051366_A_Srrt
  gRNA
ggggggcuuaguucgugucg

SEQ ID NO: 51367 - RNA, 20 nt, Artificial Sequence
  MKO10051367_A_Srrt
  gRNA
cgacgcuuucccaccucauc

SEQ ID NO: 51368 - RNA, 20 nt, Artificial Sequence
  MKO10051368_A_Srr
  gRNA
gcuuucuguaccucgucacu

SEQ ID NO: 51369 - RNA, 20 nt, Artificial Sequence
  MKO10051369_A_Srr
  gRNA
auacugugacccaagugacg

SEQ ID NO: 51370 - RNA, 20 nt, Artificial Sequence
  MKO10051370_A_Srr
  gRNA
caucuugguccaucccaacc

SEQ ID NO: 51371 - RNA, 20 nt, Artificial Sequence
  MKO10051371_A_Srsf10
  gRNA
uuaggucugaagauuuacgu

SEQ ID NO: 51372 - RNA, 20 nt, Artificial Sequence
  MKO10051372_A_Srsf10
  gRNA
cuaacacgucucuguucguc

SEQ ID NO: 51373 - RNA, 20 nt, Artificial Sequence
  MKO10051373_A_Srsf10
  gRNA
cugacgaacagagacguguu

SEQ ID NO: 51374 - RNA, 20 nt, Artificial Sequence
  MKO10051374_A_Srsf11
  gRNA
auuucugccgcuauugagcc

SEQ ID NO: 51375 - RNA, 20 nt, Artificial Sequence
  MKO10051375_A_Srsf11
  gRNA
ggcuucacgcacucucuuca

SEQ ID NO: 51376 - RNA, 20 nt, Artificial Sequence
  MKO10051376_A_Srsf11
  gRNA
auuggcaccagcuaaugcag

SEQ ID NO: 51377 - RNA, 20 nt, Artificial Sequence
  MKO10051377_A_Srsf12
  gRNA
auccgaucccccaucgcugc

SEQ ID NO: 51378 - RNA, 20 nt, Artificial Sequence
  MKO10051378_A_Srsf12
  gRNA
ggaucggaucuauucccuag

SEQ ID NO: 51379 - RNA, 20 nt, Artificial Sequence
  MKO10051379_A_Srsf12
  gRNA
cgcgcagccggaguucuuca

SEQ ID NO: 51380 - RNA, 20 nt, Artificial Sequence
  MKO10051380_A_Srsf1
  gRNA
cgcgacggcuacgacuacga

SEQ ID NO: 51381 - RNA, 20 nt, Artificial Sequence
  MKO10051381_A_Srsf1
  gRNA
cuucaggucgaugucgcgga

SEQ ID NO: 51382 - RNA, 20 nt, Artificial Sequence
  MKO10051382_A_Srsf1
  gRNA
cggguccucgaacucaacga

SEQ ID NO: 51383 - RNA, 20 nt, Artificial Sequence
  MKO10051383_A_Srsf2
  gRNA
uucgagaaauacgggcgcgu

SEQ ID NO: 51384 - RNA, 20 nt, Artificial Sequence
  MKO10051384_A_Srsf2
  gRNA
cuucggcgucgcgcuugucg

SEQ ID NO: 51385 - RNA, 20 nt, Artificial Sequence
  MKO10051385_A_Srsf2
  gRNA
uucgcgaccuggaccgacuc

SEQ ID NO: 51386 - RNA, 20 nt, Artificial Sequence
  MKO10051386_A_Srsf3
  gRNA
cucaaguaccugcgccgagg

SEQ ID NO: 51387 - RNA, 20 nt, Artificial Sequence
  MKO10051387_A_Srsf3
  gRNA
ggaguccuccaccucggcgc

SEQ ID NO: 51388 - RNA, 20 nt, Artificial Sequence
  MKO10051388_A_Srsf3
  gRNA
acauuuaccugcuccggcuu

SEQ ID NO: 51389 - RNA, 20 nt, Artificial Sequence
  MKO10051389_A_Srsf4
  gRNA
gucauuguugagcacgcucg

SEQ ID NO: 51390 - RNA, 20 nt, Artificial Sequence
  MKO10051390_A_Srsf4
  gRNA
caaugacucgcucgccacac

SEQ ID NO: 51391 - RNA, 20 nt, Artificial Sequence
  MKO10051391_A_Srsf4
  gRNA
gaccggcgccgccuagaacc

SEQ ID NO: 51392 - RNA, 20 nt, Artificial Sequence
  MKO10051392_A_Srsf5
  gRNA
uuccaccucgagaccgagcc

SEQ ID NO: 51393 - RNA, 20 nt, Artificial Sequence
  MKO10051393_A_Srsf5
  gRNA
gcagaccucgaaaugauaga

SEQ ID NO: 51394 - RNA, 20 nt, Artificial Sequence
  MKO10051394_A_Srsf5
  gRNA
gcuuacccuucauuuaguuu

SEQ ID NO: 51395 - RNA, 20 nt, Artificial Sequence
  MKO10051395_A_Srsf6
  gRNA
ccuccgcagguacgguuucg

SEQ ID NO: 51396 - RNA, 20 nt, Artificial Sequence
  MKO10051396_A_Srsf6
  gRNA
ggcccgcgccgcgaccgcga

SEQ ID NO: 51397 - RNA, 20 nt, Artificial Sequence
  MKO10051397_A_Srsf6
  gRNA
guaucucaaaaagucgcucc

SEQ ID NO: 51398 - RNA, 20 nt, Artificial Sequence
  MKO10051398_A_Srsf7
  gRNA
gauacucucgcucccgcagc

SEQ ID NO: 51399 - RNA, 20 nt, Artificial Sequence
  MKO10051399_A_Srsf7
  gRNA
cagcaucuccucgccgauca

SEQ ID NO: 51400 - RNA, 20 nt, Artificial Sequence
  MKO10051400_A_Srsf7
  gRNA
cugguucuauaauaggaucg

SEQ ID NO: 51401 - RNA, 20 nt, Artificial Sequence
  MKO10051401_A_Srsf9
  gRNA
uccguccgacgugcgcgaga

SEQ ID NO: 51402 - RNA, 20 nt, Artificial Sequence
  MKO10051402_A_Srsf9
  gRNA
uccuucucgcgcacgucgga

SEQ ID NO: 51403 - RNA, 20 nt, Artificial Sequence
  MKO10051403_A_Srsf9
  gRNA
guauggcgagucgcggcccc

SEQ ID NO: 51404 - RNA, 20 nt, Artificial Sequence
  MKO10051404_A_Srxn1
  gRNA
guaaagaggccgggcggcac

SEQ ID NO: 51405 - RNA, 20 nt, Artificial Sequence
  MKO10051405_A_Srxn1
  gRNA
gauugguacguugugcaccg

SEQ ID NO: 51406 - RNA, 20 nt, Artificial Sequence
  MKO10051406_A_Srxn1
  gRNA
uuugauccagaggacgucga

SEQ ID NO: 51407 - RNA, 20 nt, Artificial Sequence
  MKO10051407_A_Sry
  gRNA
gacacuuuagcccuccgaug

SEQ ID NO: 51408 - RNA, 20 nt, Artificial Sequence
  MKO10051408_A_Sry
  gRNA
cagccuguugauauccccac

SEQ ID NO: 51409 - RNA, 20 nt, Artificial Sequence
  MKO10051409_A_Sry
  gRNA
gccuuacagaagccgaaaaa

SEQ ID NO: 51410 - RNA, 20 nt, Artificial Sequence
  MKO10051410_A_Ss18l1
  gRNA
ccugcucaccguuaccgauc

SEQ ID NO: 51411 - RNA, 20 nt, Artificial Sequence
  MKO10051411_A_Ss18l1
  gRNA
uugcauggggacacucugcg

SEQ ID NO: 51412 - RNA, 20 nt, Artificial Sequence
  MKO10051412_A_Ss18l1
  gRNA
cucagcgauaccgucagcac

SEQ ID NO: 51413 - RNA, 20 nt, Artificial Sequence
  MKO10051413_A_Ss18
  gRNA
cacgcccgccgccauccaga

SEQ ID NO: 51414 - RNA, 20 nt, Artificial Sequence
  MKO10051414_A_Ss18
  gRNA
ccggcucaccuucuggaugg

SEQ ID NO: 51415 - RNA, 20 nt, Artificial Sequence
  MKO10051415_A_Ss18
  gRNA
gucuuacugcgagcacuccg

SEQ ID NO: 51416 - RNA, 20 nt, Artificial Sequence
  MKO10051416_A_Ssbp1
  gRNA
agaauaucaguguuucgacc

SEQ ID NO: 51417 - RNA, 20 nt, Artificial Sequence
  MKO10051417_A_Ssbp1
  gRNA
aaagugacuaccuguaacac

SEQ ID NO: 51418 - RNA, 20 nt, Artificial Sequence
  MKO10051418_A_Ssbp1
  gRNA
acguuagucagaagacgacg

SEQ ID NO: 51419 - RNA, 20 nt, Artificial Sequence
  MKO10051419_A_Ssbp2
  gRNA
cgccgucccguccgacagcc

SEQ ID NO: 51420 - RNA, 20 nt, Artificial Sequence
  MKO10051420_A_Ssbp2
  gRNA
agcuucgcucgaguguucac

SEQ ID NO: 51421 - RNA, 20 nt, Artificial Sequence
  MKO10051421_A_Ssbp2
  gRNA
cgcccggauucuuacauucu

SEQ ID NO: 51422 - RNA, 20 nt, Artificial Sequence
  MKO10051422_A_Ssbp3
  gRNA
caaaggcucggcggugcccu

SEQ ID NO: 51423 - RNA, 20 nt, Artificial Sequence
  MKO10051423_A_Ssbp3
  gRNA
uucccgagccugcccguccg

SEQ ID NO: 51424 - RNA, 20 nt, Artificial Sequence
  MKO10051424_A_Ssbp3
  gRNA
uacgaauauuuacugcacgu

SEQ ID NO: 51425 - RNA, 20 nt, Artificial Sequence
  MKO10051425_A_Ssbp4
  gRNA
caugaccccaaacgaugcaa

SEQ ID NO: 51426 - RNA, 20 nt, Artificial Sequence
  MKO10051426_A_Ssbp4
  gRNA
ccugcugccauugcaucguu

SEQ ID NO: 51427 - RNA, 20 nt, Artificial Sequence
  MKO10051427_A_Ssbp4
  gRNA
auaugaguaucuacugcaug

SEQ ID NO: 51428 - RNA, 20 nt, Artificial Sequence
  MKO10051428_A_Ssb
  gRNA
uuauacucauccgucacuuc

SEQ ID NO: 51429 - RNA, 20 nt, Artificial Sequence
  MKO10051429_A_Ssb
  gRNA
cuuacuuaaagaguauuagc

SEQ ID NO: 51430 - RNA, 20 nt, Artificial Sequence
  MKO10051430_A_Ssb
  gRNA
cagaccacucccugaaguga

SEQ ID NO: 51431 - RNA, 20 nt, Artificial Sequence
  MKO10051431_A_Ssc5d
  gRNA
gacgcaggcgucgucugugu

SEQ ID NO: 51432 - RNA, 20 nt, Artificial Sequence
  MKO10051432_A_Ssc5d
  gRNA
ucccucagagcgacuccgcc

SEQ ID NO: 51433 - RNA, 20 nt, Artificial Sequence
  MKO10051433_A_Ssc5d
  gRNA
uugugcucaccgugaguuau

SEQ ID NO: 51434 - RNA, 20 nt, Artificial Sequence
  MKO10051434_A_Ssfa2
  gRNA
ccauaucgcgaucuucucgu

SEQ ID NO: 51435 - RNA, 20 nt, Artificial Sequence
  MKO10051435_A_Ssfa2
  gRNA
ccaacgagaagaucgcgaua

SEQ ID NO: 51436 - RNA, 20 nt, Artificial Sequence
  MKO10051436_A_Ssfa2
  gRNA
cugaugcucaaguugaaaac

SEQ ID NO: 51437 - RNA, 20 nt, Artificial Sequence
  MKO10051437_A_Ssh1
  gRNA
ccgugcgccuagagaguguc

SEQ ID NO: 51438 - RNA, 20 nt, Artificial Sequence
  MKO10051438_A_Ssh1
  gRNA
ccguguccgcuacauggucg

SEQ ID NO: 51439 - RNA, 20 nt, Artificial Sequence
  MKO10051439_A_Ssh1
  gRNA
ugauucugucuucacaacgc

SEQ ID NO: 51440 - RNA, 20 nt, Artificial Sequence
  MKO10051440_A_Ssh2
  gRNA
guagacgagccauucccucg

SEQ ID NO: 51441 - RNA, 20 nt, Artificial Sequence
  MKO10051441_A_Ssh2
  gRNA
ccacgaccauauagcguguu

SEQ ID NO: 51442 - RNA, 20 nt, Artificial Sequence
  MKO10051442_A_Ssh2
  gRNA
ccaaaaccgaacacgcuaua

SEQ ID NO: 51443 - RNA, 20 nt, Artificial Sequence
  MKO10051443_A_Ssh3
  gRNA
ccucuuacccaucgccgucc

SEQ ID NO: 51444 - RNA, 20 nt, Artificial Sequence
  MKO10051444_A_Ssh3
  gRNA
uaccagcagguagcgaaguc

SEQ ID NO: 51445 - RNA, 20 nt, Artificial Sequence
  MKO10051445_A_Ssh3
  gRNA
ccccagacuucgcuaccugc

SEQ ID NO: 51446 - RNA, 20 nt, Artificial Sequence
  MKO10051446_A_Ssmem1
  gRNA
cgaacuccggagcguccucc

SEQ ID NO: 51447 - RNA, 20 nt, Artificial Sequence
  MKO10051447_A_Ssmem1
  gRNA
uuccacaguaaccgauuccg

SEQ ID NO: 51448 - RNA, 20 nt, Artificial Sequence
  MKO10051448_A_Ssmem1
  gRNA
ucuucucucgcgcuuccguc

SEQ ID NO: 51449 - RNA, 20 nt, Artificial Sequence
  MKO10051449_A_Ssna1
  gRNA
gagaggcgaucuugcgcgcc

SEQ ID NO: 51450 - RNA, 20 nt, Artificial Sequence
  MKO10051450_A_Ssna1
  gRNA
aaccgaggccgccuaccuca

SEQ ID NO: 51451 - RNA, 20 nt, Artificial Sequence
  MKO10051451_A_Ssna1
  gRNA
ucugcagcgccgcgcccugu

SEQ ID NO: 51452 - RNA, 20 nt, Artificial Sequence
  MKO10051452_A_Sspn
  gRNA
cgcagguaaacugcgcaagc

SEQ ID NO: 51453 - RNA, 20 nt, Artificial Sequence
  MKO10051453_A_Sspn
  gRNA
uagucagagauacuccguuc

SEQ ID NO: 51454 - RNA, 20 nt, Artificial Sequence
  MKO10051454_A_Sspn
  gRNA
ucucauaccaaguugacgag

SEQ ID NO: 51455 - RNA, 20 nt, Artificial Sequence
  MKO10051455_A_Sspo
  gRNA
agaggaaguaacgccucguc

SEQ ID NO: 51456 - RNA, 20 nt, Artificial Sequence
  MKO10051456_A_Sspo
  gRNA
uuguaccauuauagccgccu

SEQ ID NO: 51457 - RNA, 20 nt, Artificial Sequence
  MKO10051457_A_Sspo
  gRNA
agugauguccgucaaaaguu

SEQ ID NO: 51458 - RNA, 20 nt, Artificial Sequence
  MKO10051458_A_Ssr1
  gRNA
guccugaggauaacggaacg

SEQ ID NO: 51459 - RNA, 20 nt, Artificial Sequence
  MKO10051459_A_Ssr1
  gRNA
ugccucguuccguuauccuc

SEQ ID NO: 51460 - RNA, 20 nt, Artificial Sequence
  MKO10051460_A_Ssr1
  gRNA
uaaacagggcaauguauucc

SEQ ID NO: 51461 - RNA, 20 nt, Artificial Sequence
  MKO10051461_A_Ssr2
  gRNA
ccgguaugcucaaugucaaa

SEQ ID NO: 51462 - RNA, 20 nt, Artificial Sequence
  MKO10051462_A_Ssr2
  gRNA
uucugccacgauuacuuacc

SEQ ID NO: 51463 - RNA, 20 nt, Artificial Sequence
  MKO10051463_A_Ssr2
  gRNA
auuggcuccaccagcgcccc

SEQ ID NO: 51464 - RNA, 20 nt, Artificial Sequence
  MKO10051464_A_Ssr3
  gRNA
aagcuuucgagucacuucuu

SEQ ID NO: 51465 - RNA, 20 nt, Artificial Sequence
  MKO10051465_A_Ssr3
  gRNA
cucaucgcccucuugucuac

SEQ ID NO: 51466 - RNA, 20 nt, Artificial Sequence
  MKO10051466_A_Ssr3
  gRNA
uuguccauaagugcuucauc

SEQ ID NO: 51467 - RNA, 20 nt, Artificial Sequence
  MKO10051467_A_Ssr4
  gRNA
gcucuuuaugccgacguuag

SEQ ID NO: 51468 - RNA, 20 nt, Artificial Sequence
  MKO10051468_A_Ssr4
  gRNA
ccaggaugugggucgauauc

SEQ ID NO: 51469 - RNA, 20 nt, Artificial Sequence
  MKO10051469_A_Ssr4
  gRNA
cgcucaugcgggcaccuaug

SEQ ID NO: 51470 - RNA, 20 nt, Artificial Sequence
  MKO10051470_A_Ssrp1
  gRNA
guacgauggcuuccgcgaau

SEQ ID NO: 51471 - RNA, 20 nt, Artificial Sequence
  MKO10051471_A_Ssrp1
  gRNA
gaugcagauggcgucuccgg

SEQ ID NO: 51472 - RNA, 20 nt, Artificial Sequence
  MKO10051472_A_Ssrp1
  gRNA
ugacagaaggcaucuggcgu

SEQ ID NO: 51473 - RNA, 20 nt, Artificial Sequence
  MKO10051473_A_Sssca1
  gRNA
ggaucgcaucucccgucuga

SEQ ID NO: 51474 - RNA, 20 nt, Artificial Sequence
  MKO10051474_A_Sssca1
  gRNA
gcgacacgugcgccgacugc

SEQ ID NO: 51475 - RNA, 20 nt, Artificial Sequence
  MKO10051475_A_Sssca1
  gRNA
gcgcauaccugcaccguuca

SEQ ID NO: 51476 - RNA, 20 nt, Artificial Sequence
  MKO10051476_A_Sstr1
  gRNA
uuccaugccguccgcagcgc

SEQ ID NO: 51477 - RNA, 20 nt, Artificial Sequence
  MKO10051477_A_Sstr1
  gRNA
cuuccacgcuguugcgccac

SEQ ID NO: 51478 - RNA, 20 nt, Artificial Sequence
  MKO10051478_A_Sstr1
  gRNA
gcaguggcauaguagucgac

SEQ ID NO: 51479 - RNA, 20 nt, Artificial Sequence
  MKO10051479_A_Sstr2
  gRNA
ccgcaugguguccaucguag

SEQ ID NO: 51480 - RNA, 20 nt, Artificial Sequence
  MKO10051480_A_Sstr2
  gRNA
uugcccaucaugauauacgc

SEQ ID NO: 51481 - RNA, 20 nt, Artificial Sequence
  MKO10051481_A_Sstr2
  gRNA
ggcaaugaugucuuccgcuc

SEQ ID NO: 51482 - RNA, 20 nt, Artificial Sequence
  MKO10051482_A_Sstr3
  gRNA
uaagaccaucacgucgcauu

SEQ ID NO: 51483 - RNA, 20 nt, Artificial Sequence
  MKO10051483_A_Sstr3
  gRNA
uggcuccgaaugcgacguga

SEQ ID NO: 51484 - RNA, 20 nt, Artificial Sequence
  MKO10051484_A_Sstr3
  gRNA
acggcacaugagagauccga

SEQ ID NO: 51485 - RNA, 20 nt, Artificial Sequence
  MKO10051485_A_Sstr4
  gRNA
cucugcgcgccgccaccuac

SEQ ID NO: 51486 - RNA, 20 nt, Artificial Sequence
  MKO10051486_A_Sstr4
  gRNA
cauaauccgauggccagaac

SEQ ID NO: 51487 - RNA, 20 nt, Artificial Sequence
  MKO10051487_A_Sstr4
  gRNA
gugucgcgcagugcuuagcg

SEQ ID NO: 51488 - RNA, 20 nt, Artificial Sequence
  MKO10051488_A_Sstr5
  gRNA
ccacaccguauccucuacgu

SEQ ID NO: 51489 - RNA, 20 nt, Artificial Sequence
  MKO10051489_A_Sstr5
  gRNA
gcggaggcgcucagaacgca

SEQ ID NO: 51490 - RNA, 20 nt, Artificial Sequence
  MKO10051490_A_Sstr5
  gRNA
uguggccgcccacucuuguc

SEQ ID NO: 51491 - RNA, 20 nt, Artificial Sequence
  MKO10051491_A_Ssty1
  gRNA
guaccugcaagcugugaaau

SEQ ID NO: 51492 - RNA, 20 nt, Artificial Sequence
  MKO10051492_A_Ssty1
  gRNA
uagaagauguaacuucuaaa

SEQ ID NO: 51493 - RNA, 20 nt, Artificial Sequence
  MKO10051493_A_Ssty1
  gRNA
caggcaauaucuucaaucca

SEQ ID NO: 51494 - RNA, 20 nt, Artificial Sequence
  MKO10051494_A_Ssty2
  gRNA
guucucuuagagaagagucu

SEQ ID NO: 51495 - RNA, 20 nt, Artificial Sequence
  MKO10051495_A_Ssty2
  gRNA
guaaugagccugucacccau

SEQ ID NO: 51496 - RNA, 20 nt, Artificial Sequence
  MKO10051496_A_Ssty2
  gRNA
ugaguucacuaucuucacag

SEQ ID NO: 51497 - RNA, 20 nt, Artificial Sequence
  MKO10051497_A_Sst
  gRNA
cggugucaccggcgcgcccu

SEQ ID NO: 51498 - RNA, 20 nt, Artificial Sequence
  MKO10051498_A_Sst
  gRNA
ugccauugcuggguucgagu

SEQ ID NO: 51499 - RNA, 20 nt, Artificial Sequence
  MKO10051499_A_Sst
  gRNA
ggacgaugcagagcgcagcc

SEQ ID NO: 51500 - RNA, 20 nt, Artificial Sequence
  MKO10051500_A_Ssu2
  gRNA
cgaagcugaguagggccuca

SEQ ID NO: 51501 - RNA, 20 nt, Artificial Sequence
  MKO10051501_A_Ssu2
  gRNA
agggguugcccagcuaugac

SEQ ID NO: 51502 - RNA, 20 nt, Artificial Sequence
  MKO10051502_A_Ssu2
  gRNA
gcgaauccagagucagcgag

SEQ ID NO: 51503 - RNA, 20 nt, Artificial Sequence
  MKO10051503_A_Ssu72
  gRNA
ugaaaucgacgagcugcugc

SEQ ID NO: 51504 - RNA, 20 nt, Artificial Sequence
  MKO10051504_A_Ssu72
  gRNA
acuggcagagcucgcagaua

SEQ ID NO: 51505 - RNA, 20 nt, Artificial Sequence
  MKO10051505_A_Ssu72
  gRNA
caaacagguccgugcaguuc

SEQ ID NO: 51506 - RNA, 20 nt, Artificial Sequence
  MKO10051506_A_Ssx2ip
  gRNA
aagcccgaucaucucccgcc

SEQ ID NO: 51507 - RNA, 20 nt, Artificial Sequence
  MKO10051507_A_Ssx2ip
  gRNA
ccuuuauccaaaaacgugca

SEQ ID NO: 51508 - RNA, 20 nt, Artificial Sequence
  MKO10051508_A_Ssx2ip
  gRNA
gagcugcuacgccaaacuua

SEQ ID NO: 51509 - RNA, 20 nt, Artificial Sequence
  MKO10051509_A_Ssx9
  gRNA
gccaagcaaucccuguucga

SEQ ID NO: 51510 - RNA, 20 nt, Artificial Sequence
  MKO10051510_A_Ssx9
  gRNA
gaacuucaaugccuucgaac

SEQ ID NO: 51511 - RNA, 20 nt, Artificial Sequence
  MKO10051511_A_Ssx9
  gRNA
gauaccgagaaaacgaauga

SEQ ID NO: 51512 - RNA, 20 nt, Artificial Sequence
  MKO10051512_A_Ssxb10
  gRNA
gacaccgagaaaaagaauga

SEQ ID NO: 51513 - RNA, 20 nt, Artificial Sequence
  MKO10051513_A_Ssxb10
  gRNA
uacaucagaaugaccgaccu

SEQ ID NO: 51514 - RNA, 20 nt, Artificial Sequence
  MKO10051514_A_Ssxb10
  gRNA
cauacuucucugaugaagag

SEQ ID NO: 51515 - RNA, 20 nt, Artificial Sequence
  MKO10051515_A_Ssxb1
  gRNA
uggagagaaugauugcaacu

SEQ ID NO: 51516 - RNA, 20 nt, Artificial Sequence
  MKO10051516_A_Ssxb1
  gRNA
aaucauucucuccagaugca

SEQ ID NO: 51517 - RNA, 20 nt, Artificial Sequence
  MKO10051517_A_Ssxb1
  gRNA
cauacuucucugaugaagag

SEQ ID NO: 51518 - RNA, 20 nt, Artificial Sequence
  MKO10051518_A_Ssxb2
  gRNA
uuccugugaaaagaacccca

SEQ ID NO: 51519 - RNA, 20 nt, Artificial Sequence
  MKO10051519_A_Ssxb2
  gRNA
uuucaugcgugguaaggagc

SEQ ID NO: 51520 - RNA, 20 nt, Artificial Sequence
  MKO10051520_A_Ssxb2
  gRNA
uccuuaccacgcaugaaaac

SEQ ID NO: 51521 - RNA, 20 nt, Artificial Sequence
  MKO10051521_A_Ssxb3
  gRNA
aaucauucuuuccagaggca

SEQ ID NO: 51522 - RNA, 20 nt, Artificial Sequence
  MKO10051522_A_Ssxb3
  gRNA
ggagcaggaaaagcaauccc

SEQ ID NO: 51523 - RNA, 20 nt, Artificial Sequence
  MKO10051523_A_Ssxb3
  gRNA
uggaaagaaugauuccaacu

SEQ ID NO: 51524 - RNA, 20 nt, Artificial Sequence
  MKO10051524_A_Ssxb5
  gRNA
ggagcaggccaagcaauucc

SEQ ID NO: 51525 - RNA, 20 nt, Artificial Sequence
  MKO10051525_A_Ssxb5
  gRNA
uuguagccaaccugccaagu

SEQ ID NO: 51526 - RNA, 20 nt, Artificial Sequence
  MKO10051526_A_Ssxb5
  gRNA
cauacuucucugaugaagag

SEQ ID NO: 51527 - RNA, 20 nt, Artificial Sequence
  MKO10051527_A_Ssxb6
  gRNA
uggagagaaugauucaaacu

SEQ ID NO: 51528 - RNA, 20 nt, Artificial Sequence
  MKO10051528_A_Ssxb6
  gRNA
aaucauucucuccagaguca

SEQ ID NO: 51529 - RNA, 20 nt, Artificial Sequence
  MKO10051529_A_Ssxb6
  gRNA
gaauuucaaugccuucgacc

SEQ ID NO: 51530 - RNA, 20 nt, Artificial Sequence
  MKO10051530_A_Ssxb8
  gRNA
uuaugaauacuuauugucac

SEQ ID NO: 51531 - RNA, 20 nt, Artificial Sequence
  MKO10051531_A_Ssxb8
  gRNA
gacaccgauaaaacaaauga

SEQ ID NO: 51532 - RNA, 20 nt, Artificial Sequence
  MKO10051532_A_Ssxb8
  gRNA
aauuauucucuccagaugca

SEQ ID NO: 51533 - RNA, 20 nt, Artificial Sequence
  MKO10051533_A_Ssxb9
  gRNA
aaucauucuuuacagaggca

SEQ ID NO: 51534 - RNA, 20 nt, Artificial Sequence
  MKO10051534_A_Ssxb9
  gRNA
uguaaagaaugauuccaacu

SEQ ID NO: 51535 - RNA, 20 nt, Artificial Sequence
  MKO10051535_A_Ssxb9
  gRNA
cauacuucucugaugaagag

SEQ ID NO: 51536 - RNA, 20 nt, Artificial Sequence
  MKO10051536_A_St13
  gRNA
gacagaggagcuaucaagcg

SEQ ID NO: 51537 - RNA, 20 nt, Artificial Sequence
  MKO10051537_A_St13
  gRNA
gccauugaagcccuaaauga

SEQ ID NO: 51538 - RNA, 20 nt, Artificial Sequence
  MKO10051538_A_St13
  gRNA
accagacacugaugccccuc

SEQ ID NO: 51539 - RNA, 20 nt, Artificial Sequence
  MKO10051539_A_St14
  gRNA
agaagagguugaucgcgcca

SEQ ID NO: 51540 - RNA, 20 nt, Artificial Sequence
  MKO10051540_A_St14
  gRNA
uaacauugccaccccgagca

SEQ ID NO: 51541 - RNA, 20 nt, Artificial Sequence
  MKO10051541_A_St14
  gRNA
caguuacagccgacuucuug

SEQ ID NO: 51542 - RNA, 20 nt, Artificial Sequence
  MKO10051542_A_St18
  gRNA
cgggaguuccaauuaacaag

SEQ ID NO: 51543 - RNA, 20 nt, Artificial Sequence
  MKO10051543_A_St18
  gRNA
ccacaaagugcgaguuccuc

SEQ ID NO: 51544 - RNA, 20 nt, Artificial Sequence
  MKO10051544_A_St18
  gRNA
gauggcacggggcacguaac

SEQ ID NO: 51545 - RNA, 20 nt, Artificial Sequence
  MKO10051545_A_St3gal1
  gRNA
uuccuacaacugcacagcgu

SEQ ID NO: 51546 - RNA, 20 nt, Artificial Sequence
  MKO10051546_A_St3gal1
  gRNA
caugggcgguauccaucgac

SEQ ID NO: 51547 - RNA, 20 nt, Artificial Sequence
  MKO10051547_A_St3gal1
  gRNA
ugccgacgcugugcaguugu

SEQ ID NO: 51548 - RNA, 20 nt, Artificial Sequence
  MKO10051548_A_St3gal2
  gRNA
cacgggcgcuacccuuccac

SEQ ID NO: 51549 - RNA, 20 nt, Artificial Sequence
  MKO10051549_A_St3gal2
  gRNA
ucuucaaguacauucacgac

SEQ ID NO: 51550 - RNA, 20 nt, Artificial Sequence
  MKO10051550_A_St3gal2
  gRNA
cgagaaccccuaccgcuucc

SEQ ID NO: 51551 - RNA, 20 nt, Artificial Sequence
  MKO10051551_A_St3gal3
  gRNA
gauccuagcccacuugcgaa

SEQ ID NO: 51552 - RNA, 20 nt, Artificial Sequence
  MKO10051552_A_St3gal3
  gRNA
caucauggcugaagcguagc

SEQ ID NO: 51553 - RNA, 20 nt, Artificial Sequence
  MKO10051553_A_St3gal3
  gRNA
cucggaaaaguuugcguacu

SEQ ID NO: 51554 - RNA, 20 nt, Artificial Sequence
  MKO10051554_A_St3gal4
  gRNA
cuauaccugagagcauaaag

SEQ ID NO: 51555 - RNA, 20 nt, Artificial Sequence
  MKO10051555_A_St3gal4
  gRNA
accacuuccuuuagucccaa

SEQ ID NO: 51556 - RNA, 20 nt, Artificial Sequence
  MKO10051556_A_St3gal4
  gRNA
ccuuaccucuuuaugcucuc

SEQ ID NO: 51557 - RNA, 20 nt, Artificial Sequence
  MKO10051557_A_St3gal5
  gRNA
uaguauucaacguccgacag

SEQ ID NO: 51558 - RNA, 20 nt, Artificial Sequence
  MKO10051558_A_St3gal5
  gRNA
cgcccucaaccaguucgaug

SEQ ID NO: 51559 - RNA, 20 nt, Artificial Sequence
  MKO10051559_A_St3gal5
  gRNA
uagcucaccuuuauccgguc

SEQ ID NO: 51560 - RNA, 20 nt, Artificial Sequence
  MKO10051560_A_St3gal6
  gRNA
caacggaaaauuauugguac

SEQ ID NO: 51561 - RNA, 20 nt, Artificial Sequence
  MKO10051561_A_St3gal6
  gRNA
cagcuuucgccaaucuucug

SEQ ID NO: 51562 - RNA, 20 nt, Artificial Sequence
  MKO10051562_A_St3gal6
  gRNA
acuccuaugauguaauaaua

SEQ ID NO: 51563 - RNA, 20 nt, Artificial Sequence
  MKO10051563_A_St5
  gRNA
ccggaggcacuaaggccccu

SEQ ID NO: 51564 - RNA, 20 nt, Artificial Sequence
  MKO10051564_A_St5
  gRNA
guuugccacgauuacccaag

SEQ ID NO: 51565 - RNA, 20 nt, Artificial Sequence
  MKO10051565_A_St5
  gRNA
uccgguuccaugagugaugc

SEQ ID NO: 51566 - RNA, 20 nt, Artificial Sequence
  MKO10051566_A_St6gal1
  gRNA
ggauucggcugaaucagauc

SEQ ID NO: 51567 - RNA, 20 nt, Artificial Sequence
  MKO10051567_A_St6gal1
  gRNA
gcacacaucugucuugcgcu

SEQ ID NO: 51568 - RNA, 20 nt, Artificial Sequence
  MKO10051568_A_St6gal1
  gRNA
guaucaugcagacauuccgc

SEQ ID NO: 51569 - RNA, 20 nt, Artificial Sequence
  MKO10051569_A_St6gal2
  gRNA
uuccggcgaugcuggauaua

SEQ ID NO: 51570 - RNA, 20 nt, Artificial Sequence
  MKO10051570_A_St6gal2
  gRNA
cccccuuccagagccgguac

SEQ ID NO: 51571 - RNA, 20 nt, Artificial Sequence
  MKO10051571_A_St6gal2
  gRNA
ggucaucaugggcgcuuugc

SEQ ID NO: 51572 - RNA, 20 nt, Artificial Sequence
  MKO10051572_A_St6galnac1
  gRNA
ugugcaggugccaguucaua

SEQ ID NO: 51573 - RNA, 20 nt, Artificial Sequence
  MKO10051573_A_St6galnac1
  gRNA
cgucauucuuccauaugaac

SEQ ID NO: 51574 - RNA, 20 nt, Artificial Sequence
  MKO10051574_A_St6galnac1
  gRNA
auacacuuggaguacccagu

SEQ ID NO: 51575 - RNA, 20 nt, Artificial Sequence
  MKO10051575_A_St6galnac2
  gRNA
guucacggugaaaccguaga

SEQ ID NO: 51576 - RNA, 20 nt, Artificial Sequence
  MKO10051576_A_St6galnac2
  gRNA
cucaauggcgccauaaccga

SEQ ID NO: 51577 - RNA, 20 nt, Artificial Sequence
  MKO10051577_A_St6galnac2
  gRNA
ugaccccaaaccaccgaauu

SEQ ID NO: 51578 - RNA, 20 nt, Artificial Sequence
  MKO10051578_A_St6galnac3
  gRNA
cauuuaucaucccguagacg

SEQ ID NO: 51579 - RNA, 20 nt, Artificial Sequence
  MKO10051579_A_St6galnac3
  gRNA
ugugccaucgugucaaauuc

SEQ ID NO: 51580 - RNA, 20 nt, Artificial Sequence
  MKO10051580_A_St6galnac3
  gRNA
cuccaugaacaugccccgua

SEQ ID NO: 51581 - RNA, 20 nt, Artificial Sequence
  MKO10051581_A_St6galnac4
  gRNA
cgcacucugcgccaucgauc

SEQ ID NO: 51582 - RNA, 20 nt, Artificial Sequence
  MKO10051582_A_St6galnac4
  gRNA
ucacgcgcagagugcugcgc

SEQ ID NO: 51583 - RNA, 20 nt, Artificial Sequence
  MKO10051583_A_St6galnac4
  gRNA
gaacacgaugggucgcuucu

SEQ ID NO: 51584 - RNA, 20 nt, Artificial Sequence
  MKO10051584_A_St6galnac5
  gRNA
auguaccucucucacgagcg

SEQ ID NO: 51585 - RNA, 20 nt, Artificial Sequence
  MKO10051585_A_St6galnac5
  gRNA
cggcagcucgaaggauaccu

SEQ ID NO: 51586 - RNA, 20 nt, Artificial Sequence
  MKO10051586_A_St6galnac5
  gRNA
acccucggcaugauucacag

SEQ ID NO: 51587 - RNA, 20 nt, Artificial Sequence
  MKO10051587_A_St6galnac6
  gRNA
caaaaccaccuuccgcguag

SEQ ID NO: 51588 - RNA, 20 nt, Artificial Sequence
  MKO10051588_A_St6galnac6
  gRNA
augggccacuacgcggaagg

SEQ ID NO: 51589 - RNA, 20 nt, Artificial Sequence
  MKO10051589_A_St6galnac6
  gRNA
gccguaguggaagaccucgu

SEQ ID NO: 51590 - RNA, 20 nt, Artificial Sequence
  MKO10051590_A_St7l
  gRNA
ggcggacggagacuacuucg

SEQ ID NO: 51591 - RNA, 20 nt, Artificial Sequence
  MKO10051591_A_St7l
  gRNA
gggacaccccacggcccgcg

SEQ ID NO: 51592 - RNA, 20 nt, Artificial Sequence
  MKO10051592_A_St7l
  gRNA
accaaacaccugauagaugg

SEQ ID NO: 51593 - RNA, 20 nt, Artificial Sequence
  MKO10051593_A_St7
  gRNA
aauaagucccgauauuagcg

SEQ ID NO: 51594 - RNA, 20 nt, Artificial Sequence
  MKO10051594_A_St7
  gRNA
guuaaccccaaaguucuacg

SEQ ID NO: 51595 - RNA, 20 nt, Artificial Sequence
  MKO10051595_A_St7
  gRNA
aagccacuugcgcccccuuc

SEQ ID NO: 51596 - RNA, 20 nt, Artificial Sequence
  MKO10051596_A_St8sia1
  gRNA
uucacaaaaucggcgcgcug

SEQ ID NO: 51597 - RNA, 20 nt, Artificial Sequence
  MKO10051597_A_St8sia1
  gRNA
cacgccaagcgcuugucuac

SEQ ID NO: 51598 - RNA, 20 nt, Artificial Sequence
  MKO10051598_A_St8sia1
  gRNA
accccagcauaauucgccag

SEQ ID NO: 51599 - RNA, 20 nt, Artificial Sequence
  MKO10051599_A_St8sia2
  gRNA
aagccgugcgcacguucaca

SEQ ID NO: 51600 - RNA, 20 nt, Artificial Sequence
  MKO10051600_A_St8sia2
  gRNA
gacccccgaguugcccacga

SEQ ID NO: 51601 - RNA, 20 nt, Artificial Sequence
  MKO10051601_A_St8sia2
  gRNA
gcaccaugugaacgugcgca

SEQ ID NO: 51602 - RNA, 20 nt, Artificial Sequence
  MKO10051602_A_St8sia3
  gRNA
auguacauucggggcgcccc

SEQ ID NO: 51603 - RNA, 20 nt, Artificial Sequence
  MKO10051603_A_St8sia3
  gRNA
cacucccaaguacgccagcc

SEQ ID NO: 51604 - RNA, 20 nt, Artificial Sequence
  MKO10051604_A_St8sia3
  gRNA
ucucgauuagcaauaacuuc

SEQ ID NO: 51605 - RNA, 20 nt, Artificial Sequence
  MKO10051605_A_St8sia4
  gRNA
uuucaccaaugaaaaaccgc

SEQ ID NO: 51606 - RNA, 20 nt, Artificial Sequence
  MKO10051606_A_St8sia4
  gRNA
ugaugucauacacuaugugc

SEQ ID NO: 51607 - RNA, 20 nt, Artificial Sequence
  MKO10051607_A_St8sia4
  gRNA
ugcugaaugacagcguccuu

SEQ ID NO: 51608 - RNA, 20 nt, Artificial Sequence
  MKO10051608_A_St8sia5
  gRNA
ggcgacguacuugaagaggc

SEQ ID NO: 51609 - RNA, 20 nt, Artificial Sequence
  MKO10051609_A_St8sia5
  gRNA
cggcuuauaucacaucgacc

SEQ ID NO: 51610 - RNA, 20 nt, Artificial Sequence
  MKO10051610_A_St8sia5
  gRNA
guuuaacuccacgagaugcc

SEQ ID NO: 51611 - RNA, 20 nt, Artificial Sequence
  MKO10051611_A_St8sia6
  gRNA
gacuaacaugagcuacgagg

SEQ ID NO: 51612 - RNA, 20 nt, Artificial Sequence
  MKO10051612_A_St8sia6
  gRNA
cgaugccauucaagacuucg

SEQ ID NO: 51613 - RNA, 20 nt, Artificial Sequence
  MKO10051613_A_St8sia6
  gRNA
caaccccgguaccacgcacc

SEQ ID NO: 51614 - RNA, 20 nt, Artificial Sequence
  MKO10051614_A_Suab1
  gRNA
gauagcugcacacgccguac

SEQ ID NO: 51615 - RNA, 20 nt, Artificial Sequence
  MKO10051615_A_Suab1
  gRNA
caggucccguggccacuaca

SEQ ID NO: 51616 - RNA, 20 nt, Artificial Sequence
  MKO10051616_A_Suab1
  gRNA
gcgacaccguguaguggcca

SEQ ID NO: 51617 - RNA, 20 nt, Artificial Sequence
  MKO10051617_A_Suab2
  gRNA
gacugcaauguuaaccgagc

SEQ ID NO: 51618 - RNA, 20 nt, Artificial Sequence
  MKO10051618_A_Suab2
  gRNA
caucgcuuacccaugcaguc

SEQ ID NO: 51619 - RNA, 20 nt, Artificial Sequence
  MKO10051619_A_Suab2
  gRNA
gguaauccuuccuacagaua

SEQ ID NO: 51620 - RNA, 20 nt, Artificial Sequence
  MKO10051620_A_Suac2
  gRNA
agagggagcgcuuaaaucgc

SEQ ID NO: 51621 - RNA, 20 nt, Artificial Sequence
  MKO10051621_A_Suac2
  gRNA
guuuaugagacgcugcgcua

SEQ ID NO: 51622 - RNA, 20 nt, Artificial Sequence
  MKO10051622_A_Suac2
  gRNA
gugcccagucccucgccccu

SEQ ID NO: 51623 - RNA, 20 nt, Artificial Sequence
  MKO10051623_A_Suac3
  gRNA
guguuugaaacccugcgcgu

SEQ ID NO: 51624 - RNA, 20 nt, Artificial Sequence
  MKO10051624_A_Suac3
  gRNA
ccaugaucaccccgacgcgc

SEQ ID NO: 51625 - RNA, 20 nt, Artificial Sequence
  MKO10051625_A_Suac3
  gRNA
ggcuugucguugacgagcuu

SEQ ID NO: 51626 - RNA, 20 nt, Artificial Sequence
  MKO10051626_A_Suac
  gRNA
gggucuuacccacgaucaug

SEQ ID NO: 51627 - RNA, 20 nt, Artificial Sequence
  MKO10051627_A_Suac
  gRNA
ccagggacgugccgaaccgg

SEQ ID NO: 51628 - RNA, 20 nt, Artificial Sequence
  MKO10051628_A_Suac
  gRNA
uaguaacgccgaaaucccuu

SEQ ID NO: 51629 - RNA, 20 nt, Artificial Sequence
  MKO10051629_A_Suag1
  gRNA
gauccccgucgccguucugu

SEQ ID NO: 51630 - RNA, 20 nt, Artificial Sequence
  MKO10051630_A_Suag1
  gRNA
uauaguccgugguggaugac

SEQ ID NO: 51631 - RNA, 20 nt, Artificial Sequence
  MKO10051631_A_Suag1
  gRNA
cacccccaacagaacggcga

SEQ ID NO: 51632 - RNA, 20 nt, Artificial Sequence
  MKO10051632_A_Suag2
  gRNA
ucgaguccuacaagcaugac

SEQ ID NO: 51633 - RNA, 20 nt, Artificial Sequence
  MKO10051633_A_Suag2
  gRNA
ucuagucggugguagaugac

SEQ ID NO: 51634 - RNA, 20 nt, Artificial Sequence
  MKO10051634_A_Suag2
  gRNA
guuguucgaaguuguuaaaa

SEQ ID NO: 51635 - RNA, 20 nt, Artificial Sequence
  MKO10051635_A_Suag3
  gRNA
gucgcugucuucguuaguug

SEQ ID NO: 51636 - RNA, 20 nt, Artificial Sequence
  MKO10051636_A_Suag3
  gRNA
ccucauuaaacucuuccguu

SEQ ID NO: 51637 - RNA, 20 nt, Artificial Sequence
  MKO10051637_A_Suag3
  gRNA
cagucccgaauaguaucuag

SEQ ID NO: 51638 - RNA, 20 nt, Artificial Sequence
  MKO10051638_A_Suam2
  gRNA
guacuuccguugcaaaauca

SEQ ID NO: 51639 - RNA, 20 nt, Artificial Sequence
  MKO10051639_A_Suam2
  gRNA
uugcagauaucagacuaaau

SEQ ID NO: 51640 - RNA, 20 nt, Artificial Sequence
  MKO10051640_A_Suam2
  gRNA
ggucccucacguugcucugc

SEQ ID NO: 51641 - RNA, 20 nt, Artificial Sequence
  MKO10051641_A_Suambpl1
  gRNA
ucaccccacgccguuacuuc

SEQ ID NO: 51642 - RNA, 20 nt, Artificial Sequence
  MKO10051642_A_Suambpl1
  gRNA
guccgcgcccuaagcaaacu

SEQ ID NO: 51643 - RNA, 20 nt, Artificial Sequence
  MKO10051643_A_Suambpl1
  gRNA
uuggcucgaggccagauucg

SEQ ID NO: 51644 - RNA, 20 nt, Artificial Sequence
  MKO10051644_A_Suambp
  gRNA
ucuaugacgcuuaacgcucc

SEQ ID NO: 51645 - RNA, 20 nt, Artificial Sequence
  MKO10051645_A_Suambp
  gRNA
gagcgucgcuuucccuaaag

SEQ ID NO: 51646 - RNA, 20 nt, Artificial Sequence
  MKO10051646_A_Suambp
  gRNA
gccagugccaauaccgccaa

SEQ ID NO: 51647 - RNA, 20 nt, Artificial Sequence
  MKO10051647_A_Suam
  gRNA
acacucacccugugcgagau

SEQ ID NO: 51648 - RNA, 20 nt, Artificial Sequence
  MKO10051648_A_Suam
  gRNA
gccgauaucagacuaagcug

SEQ ID NO: 51649 - RNA, 20 nt, Artificial Sequence
  MKO10051649_A_Suam
  gRNA
ggagcauguguaucaaacug

SEQ ID NO: 51650 - RNA, 20 nt, Artificial Sequence
  MKO10051650_A_Suap1
  gRNA
acauccgcauagucuuguac

SEQ ID NO: 51651 - RNA, 20 nt, Artificial Sequence
  MKO10051651_A_Suap1
  gRNA
ugcagucuaaucacuugccc

SEQ ID NO: 51652 - RNA, 20 nt, Artificial Sequence
  MKO10051652_A_Suap1
  gRNA
auagaccucgugugccuuac

SEQ ID NO: 51653 - RNA, 20 nt, Artificial Sequence
  MKO10051653_A_Suap2
  gRNA
ggaccucggccaucauguac

SEQ ID NO: 51654 - RNA, 20 nt, Artificial Sequence
  MKO10051654_A_Suap2
  gRNA
ugcccuccguaccuccucuu

SEQ ID NO: 51655 - RNA, 20 nt, Artificial Sequence
  MKO10051655_A_Suap2
  gRNA
gcgccagccccuggaaaagc

SEQ ID NO: 51656 - RNA, 20 nt, Artificial Sequence
  MKO10051656_A_Suard10
  gRNA
uugacugucaacgcugacgu

SEQ ID NO: 51657 - RNA, 20 nt, Artificial Sequence
  MKO10051657_A_Suard10
  gRNA
acaucguagagcgucucagc

SEQ ID NO: 51658 - RNA, 20 nt, Artificial Sequence
  MKO10051658_A_Suard10
  gRNA
gcucggaccaagucuuuccg

SEQ ID NO: 51659 - RNA, 20 nt, Artificial Sequence
  MKO10051659_A_Suard13
  gRNA
uaggauccggcucauccugu

SEQ ID NO: 51660 - RNA, 20 nt, Artificial Sequence
  MKO10051660_A_Suard13
  gRNA
ucauacagcugagcguacug

SEQ ID NO: 51661 - RNA, 20 nt, Artificial Sequence
  MKO10051661_A_Suard13
  gRNA
caaaucgcaaguacaucucc

SEQ ID NO: 51662 - RNA, 20 nt, Artificial Sequence
  MKO10051662_A_Suard3nl
  gRNA
cuguaugcagauugcgccau

SEQ ID NO: 51663 - RNA, 20 nt, Artificial Sequence
  MKO10051663_A_Suard3nl
  gRNA
caggaaccacgucucaaucc

SEQ ID NO: 51664 - RNA, 20 nt, Artificial Sequence
  MKO10051664_A_Suard3nl
  gRNA
ucaccgcuauugcccaccaa

SEQ ID NO: 51665 - RNA, 20 nt, Artificial Sequence
  MKO10051665_A_Suard3
  gRNA
agaugucgaagaacgagcuc

SEQ ID NO: 51666 - RNA, 20 nt, Artificial Sequence
  MKO10051666_A_Suard3
  gRNA
ccccauugucucuuucgucc

SEQ ID NO: 51667 - RNA, 20 nt, Artificial Sequence
  MKO10051667_A_Suard3
  gRNA
ccgcaaucacccaccagugc

SEQ ID NO: 51668 - RNA, 20 nt, Artificial Sequence
  MKO10051668_A_Suard4
  gRNA
guaauagaccauauccgccc

SEQ ID NO: 51669 - RNA, 20 nt, Artificial Sequence
  MKO10051669_A_Suard4
  gRNA
ccggucccaguccaagcgcc

SEQ ID NO: 51670 - RNA, 20 nt, Artificial Sequence
  MKO10051670_A_Suard4
  gRNA
ucuagaaagaugugaccguu

SEQ ID NO: 51671 - RNA, 20 nt, Artificial Sequence
  MKO10051671_A_Suard5
  gRNA
cacuuacauccgugaugcuc

SEQ ID NO: 51672 - RNA, 20 nt, Artificial Sequence
  MKO10051672_A_Suard5
  gRNA
cauucuagguaccgaggaga

SEQ ID NO: 51673 - RNA, 20 nt, Artificial Sequence
  MKO10051673_A_Suard5
  gRNA
gacacaauggauguuccaca

SEQ ID NO: 51674 - RNA, 20 nt, Artificial Sequence
  MKO10051674_A_Suard6
  gRNA
aaccauagauaccgcguuga

SEQ ID NO: 51675 - RNA, 20 nt, Artificial Sequence
  MKO10051675_A_Suard6
  gRNA
gauguacucacagguuuccg

SEQ ID NO: 51676 - RNA, 20 nt, Artificial Sequence
  MKO10051676_A_Suard6
  gRNA
uuaaaucacagcuaaaagug

SEQ ID NO: 51677 - RNA, 20 nt, Artificial Sequence
  MKO10051677_A_Suard7
  gRNA
ugcccuugugaucaagcuag

SEQ ID NO: 51678 - RNA, 20 nt, Artificial Sequence
  MKO10051678_A_Suard7
  gRNA
gcucaccucgguacugguaa

SEQ ID NO: 51679 - RNA, 20 nt, Artificial Sequence
  MKO10051679_A_Suard7
  gRNA
acauaaucacgagaguacau

SEQ ID NO: 51680 - RNA, 20 nt, Artificial Sequence
  MKO10051680_A_Suard8
  gRNA
ccccgugaacgucgugacuc

SEQ ID NO: 51681 - RNA, 20 nt, Artificial Sequence
  MKO10051681_A_Suard8
  gRNA
cccaaauguggucgaaccau

SEQ ID NO: 51682 - RNA, 20 nt, Artificial Sequence
  MKO10051682_A_Suard8
  gRNA
cucauucaugugcagcgcac

SEQ ID NO: 51683 - RNA, 20 nt, Artificial Sequence
  MKO10051683_A_Suar
  gRNA
cgcacgcucacgaagucucg

SEQ ID NO: 51684 - RNA, 20 nt, Artificial Sequence
  MKO10051684_A_Suar
  gRNA
ggaugggucaaguucgacgu

SEQ ID NO: 51685 - RNA, 20 nt, Artificial Sequence
  MKO10051685_A_Suar
  gRNA
gugcgcuguaccaagcgcag

SEQ ID NO: 51686 - RNA, 20 nt, Artificial Sequence
  MKO10051686_A_Suau1
  gRNA
ggucgcaaacgagacaucau

SEQ ID NO: 51687 - RNA, 20 nt, Artificial Sequence
  MKO10051687_A_Suau1
  gRNA
caaguaccugauuaaaucuu

SEQ ID NO: 51688 - RNA, 20 nt, Artificial Sequence
  MKO10051688_A_Suau1
  gRNA
acuggucguccagcugugag

SEQ ID NO: 51689 - RNA, 20 nt, Artificial Sequence
  MKO10051689_A_Suau2
  gRNA
ugagauugaaaaucgaaucc

SEQ ID NO: 51690 - RNA, 20 nt, Artificial Sequence
  MKO10051690_A_Suau2
  gRNA
uccacaacugcuucgggggc

SEQ ID NO: 51691 - RNA, 20 nt, Artificial Sequence
  MKO10051691_A_Suau2
  gRNA
cugagcuguaguggucccac

SEQ ID NO: 51692 - RNA, 20 nt, Artificial Sequence
  MKO10051692_A_Suau3
  gRNA
cgauuaccugcacucgcuuc

SEQ ID NO: 51693 - RNA, 20 nt, Artificial Sequence
  MKO10051693_A_Suau3
  gRNA
gcagcuggacacacgcuacc

SEQ ID NO: 51694 - RNA, 20 nt, Artificial Sequence
  MKO10051694_A_Suau3
  gRNA
gaaacugcuugauucuucga

SEQ ID NO: 51695 - RNA, 20 nt, Artificial Sequence
  MKO10051695_A_Suau4
  gRNA
auuaccacagcuacaugcau

SEQ ID NO: 51696 - RNA, 20 nt, Artificial Sequence
  MKO10051696_A_Suau4
  gRNA
ugcaagaugaguuugacuac

SEQ ID NO: 51697 - RNA, 20 nt, Artificial Sequence
  MKO10051697_A_Suau4
  gRNA
ugguaccuggauaggcaugu

SEQ ID NO: 51698 - RNA, 20 nt, Artificial Sequence
  MKO10051698_A_Suau5a
  gRNA
acggcuggcucucgauccac

SEQ ID NO: 51699 - RNA, 20 nt, Artificial Sequence
  MKO10051699_A_Suau5a
  gRNA
cagguagugccggaccucga

SEQ ID NO: 51700 - RNA, 20 nt, Artificial Sequence
  MKO10051700_A_Suau5a
  gRNA
agcaccuucagaucaaccaa

SEQ ID NO: 51701 - RNA, 20 nt, Artificial Sequence
  MKO10051701_A_Suau5b
  gRNA
cacguacgaccgcugcccca

SEQ ID NO: 51702 - RNA, 20 nt, Artificial Sequence
  MKO10051702_A_Suau5b
  gRNA
cagccucaccuuggauccgc

SEQ ID NO: 51703 - RNA, 20 nt, Artificial Sequence
  MKO10051703_A_Suau5b
  gRNA
ucagaucaaccaaacguuug

SEQ ID NO: 51704 - RNA, 20 nt, Artificial Sequence
  MKO10051704_A_Suau6
  gRNA
uuacucaccucacuuggacc

SEQ ID NO: 51705 - RNA, 20 nt, Artificial Sequence
  MKO10051705_A_Suau6
  gRNA
agaaagcaucugaaccgacc

SEQ ID NO: 51706 - RNA, 20 nt, Artificial Sequence
  MKO10051706_A_Suau6
  gRNA
aaggcuucagcaucgaguaa

SEQ ID NO: 51707 - RNA, 20 nt, Artificial Sequence
  MKO10051707_A_Suau1
  gRNA
auuaaacugcuguccgccca

SEQ ID NO: 51708 - RNA, 20 nt, Artificial Sequence
  MKO10051708_A_Suau1
  gRNA
cuaccaaguugagcucuccg

SEQ ID NO: 51709 - RNA, 20 nt, Artificial Sequence
  MKO10051709_A_Suau1
  gRNA
guggaggugccuaucccccc

SEQ ID NO: 51710 - RNA, 20 nt, Artificial Sequence
  MKO10051710_A_Suau2
  gRNA
ugaaugggcucgcuaugaaa

SEQ ID NO: 51711 - RNA, 20 nt, Artificial Sequence
  MKO10051711_A_Suau2
  gRNA
accucugauuguacaugccc

SEQ ID NO: 51712 - RNA, 20 nt, Artificial Sequence
  MKO10051712_A_Suau2
  gRNA
gagcagacaugggaauccga

SEQ ID NO: 51713 - RNA, 20 nt, Artificial Sequence
  MKO10051713_A_Stbd1
  gRNA
ucucagccaugggcgccguc

SEQ ID NO: 51714 - RNA, 20 nt, Artificial Sequence
  MKO10051714_A_Stbd1
  gRNA
ucagcccugcuggucggcgg

SEQ ID NO: 51715 - RNA, 20 nt, Artificial Sequence
  MKO10051715_A_Stbd1
  gRNA
uguuugugguguagugcacc

SEQ ID NO: 51716 - RNA, 20 nt, Artificial Sequence
  MKO10051716_A_Suc1
  gRNA
uuuccagaggaugaucgccg

SEQ ID NO: 51717 - RNA, 20 nt, Artificial Sequence
  MKO10051717_A_Suc1
  gRNA
gaaagucgaacaccuccgaa

SEQ ID NO: 51718 - RNA, 20 nt, Artificial Sequence
  MKO10051718_A_Suc1
  gRNA
ucccugcuuacgcacucucu

SEQ ID NO: 51719 - RNA, 20 nt, Artificial Sequence
  MKO10051719_A_Suc2
  gRNA
acgcuacucacucaugcagc

SEQ ID NO: 51720 - RNA, 20 nt, Artificial Sequence
  MKO10051720_A_Suc2
  gRNA
cacccgaaugcccaugcucg

SEQ ID NO: 51721 - RNA, 20 nt, Artificial Sequence
  MKO10051721_A_Suc2
  gRNA
aaccgguggccagagcgcuc

SEQ ID NO: 51722 - RNA, 20 nt, Artificial Sequence
  MKO10051722_A_Steap1
  gRNA
augauggcagcgacuuucac

SEQ ID NO: 51723 - RNA, 20 nt, Artificial Sequence
  MKO10051723_A_Steap1
  gRNA
cugugagcgacucuuuaacc

SEQ ID NO: 51724 - RNA, 20 nt, Artificial Sequence
  MKO10051724_A_Steap1
  gRNA
ugcugcaagugcgagagccc

SEQ ID NO: 51725 - RNA, 20 nt, Artificial Sequence
  MKO10051725_A_Steap2
  gRNA
augccaauauugagaacgcg

SEQ ID NO: 51726 - RNA, 20 nt, Artificial Sequence
  MKO10051726_A_Steap2
  gRNA
uccauccguaaauuaacacg

SEQ ID NO: 51727 - RNA, 20 nt, Artificial Sequence
  MKO10051727_A_Steap2
  gRNA
uauuagauguggcuaccacg

SEQ ID NO: 51728 - RNA, 20 nt, Artificial Sequence
  MKO10051728_A_Steap3
  gRNA
gagccguaaccccaaacgca

SEQ ID NO: 51729 - RNA, 20 nt, Artificial Sequence
  MKO10051729_A_Steap3
  gRNA
ccgcucccaccgcuacgacc

SEQ ID NO: 51730 - RNA, 20 nt, Artificial Sequence
  MKO10051730_A_Steap3
  gRNA
auuagcaauggacgggagcg

SEQ ID NO: 51731 - RNA, 20 nt, Artificial Sequence
  MKO10051731_A_Steap4
  gRNA
aacagaugcuacguaccgcc

SEQ ID NO: 51732 - RNA, 20 nt, Artificial Sequence
  MKO10051732_A_Steap4
  gRNA
cuauccguuacuauguucga

SEQ ID NO: 51733 - RNA, 20 nt, Artificial Sequence
  MKO10051733_A_Steap4
  gRNA
gacccucacucgcauccgcc

SEQ ID NO: 51734 - RNA, 20 nt, Artificial Sequence
  MKO10051734_A_Stfa1
  gRNA
cgcaucaagaugagucuugg

SEQ ID NO: 51735 - RNA, 20 nt, Artificial Sequence
  MKO10051735_A_Stfa1
  gRNA
guaggucagcucuucaucca

SEQ ID NO: 51736 - RNA, 20 nt, Artificial Sequence
  MKO10051736_A_Stfa1
  gRNA
ucaccuuguuagcaaucauc

SEQ ID NO: 51737 - RNA, 20 nt, Artificial Sequence
  MKO10051737_A_Stfa2l1
  gRNA
uauuuccagugaaaacgacu

SEQ ID NO: 51738 - RNA, 20 nt, Artificial Sequence
  MKO10051738_A_Stfa2l1
  gRNA
uaccacuuaagacauuuaug

SEQ ID NO: 51739 - RNA, 20 nt, Artificial Sequence
  MKO10051739_A_Stfa2l1
  gRNA
accugccacaucagaaauuc

SEQ ID NO: 51740 - RNA, 20 nt, Artificial Sequence
  MKO10051740_A_Stfa2
  gRNA
uaccacuuaagacguuuaug

SEQ ID NO: 51741 - RNA, 20 nt, Artificial Sequence
  MKO10051741_A_Stfa2
  gRNA
gaauacaccauagaaauaau

SEQ ID NO: 51742 - RNA, 20 nt, Artificial Sequence
  MKO10051742_A_Stfa2
  gRNA
uauuuccagugaaaacgauu

SEQ ID NO: 51743 - RNA, 20 nt, Artificial Sequence
  MKO10051743_A_Stfa3
  gRNA
cucugaagacuuucauguga

SEQ ID NO: 51744 - RNA, 20 nt, Artificial Sequence
  MKO10051744_A_Stfa3
  gRNA
uauaaaucucaagucguugc

SEQ ID NO: 51745 - RNA, 20 nt, Artificial Sequence
  MKO10051745_A_Stfa3
  gRNA
ucaaaucaucuucuccagaa

SEQ ID NO: 51746 - RNA, 20 nt, Artificial Sequence
  MKO10051746_A_Stil
  gRNA
accauagaucgcuuugaucc

SEQ ID NO: 51747 - RNA, 20 nt, Artificial Sequence
  MKO10051747_A_Stil
  gRNA
uacgagcccaaaucaccccc

SEQ ID NO: 51748 - RNA, 20 nt, Artificial Sequence
  MKO10051748_A_Stil
  gRNA
cauucagguauuucucgacc

SEQ ID NO: 51749 - RNA, 20 nt, Artificial Sequence
  MKO10051749_A_Stim1
  gRNA
ugaggauaagcuuaucagcg

SEQ ID NO: 51750 - RNA, 20 nt, Artificial Sequence
  MKO10051750_A_Stim1
  gRNA
uuacuggccacgccaugcca

SEQ ID NO: 51751 - RNA, 20 nt, Artificial Sequence
  MKO10051751_A_Stim1
  gRNA
acaguggcucauuacguaug

SEQ ID NO: 51752 - RNA, 20 nt, Artificial Sequence
  MKO10051752_A_Stim2
  gRNA
caaggacggcgggaucgaag

SEQ ID NO: 51753 - RNA, 20 nt, Artificial Sequence
  MKO10051753_A_Stim2
  gRNA
ugaagggaacaacacucccc

SEQ ID NO: 51754 - RNA, 20 nt, Artificial Sequence
  MKO10051754_A_Stim2
  gRNA
aguucacaauuggacacuug

SEQ ID NO: 51755 - RNA, 20 nt, Artificial Sequence
  MKO10051755_A_Stip1
  gRNA
ucugcagccuacgccaagaa

SEQ ID NO: 51756 - RNA, 20 nt, Artificial Sequence
  MKO10051756_A_Stip1
  gRNA
agucuugcagccguccucau

SEQ ID NO: 51757 - RNA, 20 nt, Artificial Sequence
  MKO10051757_A_Stip1
  gRNA
gccaaacgaaccuaugaaga

SEQ ID NO: 51758 - RNA, 20 nt, Artificial Sequence
  MKO10051758_A_Stk10
  gRNA
cguaugccgccagauguugg

SEQ ID NO: 51759 - RNA, 20 nt, Artificial Sequence
  MKO10051759_A_Stk10
  gRNA
cccguauaucgugaagcucc

SEQ ID NO: 51760 - RNA, 20 nt, Artificial Sequence
  MKO10051760_A_Stk10
  gRNA
cccaggagcuucacgauaua

SEQ ID NO: 51761 - RNA, 20 nt, Artificial Sequence
  MKO10051761_A_Stk11ip
  gRNA
acuucagcuacaaugcgcuc

SEQ ID NO: 51762 - RNA, 20 nt, Artificial Sequence
  MKO10051762_A_Stk11ip
  gRNA
gcaggcgaugcgguucucuc

SEQ ID NO: 51763 - RNA, 20 nt, Artificial Sequence
  MKO10051763_A_Stk11ip
  gRNA
gaaggccaacaccagggaua

SEQ ID NO: 51764 - RNA, 20 nt, Artificial Sequence
  MKO10051764_A_Stk11
  gRNA
gcgcccuacguauaugguga

SEQ ID NO: 51765 - RNA, 20 nt, Artificial Sequence
  MKO10051765_A_Stk11
  gRNA
uguacagcacguccacaagc

SEQ ID NO: 51766 - RNA, 20 nt, Artificial Sequence
  MKO10051766_A_Stk11
  gRNA
auuccaggccgucaaucagc

SEQ ID NO: 51767 - RNA, 20 nt, Artificial Sequence
  MKO10051767_A_Stk16
  gRNA
ucccaacauccuucgccuca

SEQ ID NO: 51768 - RNA, 20 nt, Artificial Sequence
  MKO10051768_A_Stk16
  gRNA
ucgccaggcacuagcucuuc

SEQ ID NO: 51769 - RNA, 20 nt, Artificial Sequence
  MKO10051769_A_Stk16
  gRNA
ugaccugugugcauaaccuu

SEQ ID NO: 51770 - RNA, 20 nt, Artificial Sequence
  MKO10051770_A_Stk17b
  gRNA
ccucaugcagauuaaucacg

SEQ ID NO: 51771 - RNA, 20 nt, Artificial Sequence
  MKO10051771_A_Stk17b
  gRNA
uuuaccugaguuagccgaaa

SEQ ID NO: 51772 - RNA, 20 nt, Artificial Sequence
  MKO10051772_A_Stk17b
  gRNA
ucucaugcagaauuuccgcc

SEQ ID NO: 51773 - RNA, 20 nt, Artificial Sequence
  MKO10051773_A_Stk19
  gRNA
cgcugccgcccaucgcgcug

SEQ ID NO: 51774 - RNA, 20 nt, Artificial Sequence
  MKO10051774_A_Stk19
  gRNA
caccacaggcucggcgcgcg

SEQ ID NO: 51775 - RNA, 20 nt, Artificial Sequence
  MKO10051775_A_Stk19
  gRNA
ccacaucucacgugaucucc

SEQ ID NO: 51776 - RNA, 20 nt, Artificial Sequence
  MKO10051776_A_Stk24
  gRNA
gcagucagccuacgacucaa

SEQ ID NO: 51777 - RNA, 20 nt, Artificial Sequence
  MKO10051777_A_Stk24
  gRNA
cccuacgucaccaaguacua

SEQ ID NO: 51778 - RNA, 20 nt, Artificial Sequence
  MKO10051778_A_Stk24
  gRNA
gucugcaggauacuaaguug

SEQ ID NO: 51779 - RNA, 20 nt, Artificial Sequence
  MKO10051779_A_Stk25
  gRNA
uuucaggaucucccgcaaga

SEQ ID NO: 51780 - RNA, 20 nt, Artificial Sequence
  MKO10051780_A_Stk25
  gRNA
ccuuauaucacccgcuacuu

SEQ ID NO: 51781 - RNA, 20 nt, Artificial Sequence
  MKO10051781_A_Stk25
  gRNA
uucaccaagcuugaccgcau

SEQ ID NO: 51782 - RNA, 20 nt, Artificial Sequence
  MKO10051782_A_Stk30
  gRNA
guaucagcugugcaaaucgc

SEQ ID NO: 51783 - RNA, 20 nt, Artificial Sequence
  MKO10051783_A_Stk30
  gRNA
aaacuacuucgugcagugca

SEQ ID NO: 51784 - RNA, 20 nt, Artificial Sequence
  MKO10051784_A_Stk30
  gRNA
ccgccccauaccugugcaug

SEQ ID NO: 51785 - RNA, 20 nt, Artificial Sequence
  MKO10051785_A_Stk31
  gRNA
aaaaacuaucagcgaugaua

SEQ ID NO: 51786 - RNA, 20 nt, Artificial Sequence
  MKO10051786_A_Stk31
  gRNA
ccaaaaacugaauuagcaag

SEQ ID NO: 51787 - RNA, 20 nt, Artificial Sequence
  MKO10051787_A_Stk31
  gRNA
uagaagaugcaguaacauuu

SEQ ID NO: 51788 - RNA, 20 nt, Artificial Sequence
  MKO10051788_A_Stk32a
  gRNA
ucugcugcaggugauaacgc

SEQ ID NO: 51789 - RNA, 20 nt, Artificial Sequence
  MKO10051789_A_Stk32a
  gRNA
cugaccugugaaugaugcgc

SEQ ID NO: 51790 - RNA, 20 nt, Artificial Sequence
  MKO10051790_A_Stk32a
  gRNA
gcuccaggcccugcaugauc

SEQ ID NO: 51791 - RNA, 20 nt, Artificial Sequence
  MKO10051791_A_Stk32b
  gRNA
augaggugcggaacguguuc

SEQ ID NO: 51792 - RNA, 20 nt, Artificial Sequence
  MKO10051792_A_Stk32b
  gRNA
gggauuagagcaccccuucc

SEQ ID NO: 51793 - RNA, 20 nt, Artificial Sequence
  MKO10051793_A_Stk32b
  gRNA
acucaccaugcucauccagu

SEQ ID NO: 51794 - RNA, 20 nt, Artificial Sequence
  MKO10051794_A_Stk32c
  gRNA
uggcuuacccauguacgguu

SEQ ID NO: 51795 - RNA, 20 nt, Artificial Sequence
  MKO10051795_A_Stk32c
  gRNA
ggaaaucgagcaugucuucc

SEQ ID NO: 51796 - RNA, 20 nt, Artificial Sequence
  MKO10051796_A_Stk32c
  gRNA
gagagggcgacagcuuuagc

SEQ ID NO: 51797 - RNA, 20 nt, Artificial Sequence
  MKO10051797_A_Stk33
  gRNA
ccaucguccauucuuaugug

SEQ ID NO: 51798 - RNA, 20 nt, Artificial Sequence
  MKO10051798_A_Stk33
  gRNA
agucggagcaaugucacagu

SEQ ID NO: 51799 - RNA, 20 nt, Artificial Sequence
  MKO10051799_A_Stk33
  gRNA
acaaguguuugagucgccuc

SEQ ID NO: 51800 - RNA, 20 nt, Artificial Sequence
  MKO10051800_A_Stk35
  gRNA
aacggaccauccuccggcgc

SEQ ID NO: 51801 - RNA, 20 nt, Artificial Sequence
  MKO10051801_A_Stk35
  gRNA
gcugagcguguagcgcgucg

SEQ ID NO: 51802 - RNA, 20 nt, Artificial Sequence
  MKO10051802_A_Stk35
  gRNA
cugcgacgcucccgagaacg

SEQ ID NO: 51803 - RNA, 20 nt, Artificial Sequence
  MKO10051803_A_Stk36
  gRNA
uguucugcgguuucaugucg

SEQ ID NO: 51804 - RNA, 20 nt, Artificial Sequence
  MKO10051804_A_Stk36
  gRNA
gcagaacauucuucucgcca

SEQ ID NO: 51805 - RNA, 20 nt, Artificial Sequence
  MKO10051805_A_Stk36
  gRNA
gucgagcauaugcacaaugu

SEQ ID NO: 51806 - RNA, 20 nt, Artificial Sequence
  MKO10051806_A_Stk38l
  gRNA
agaugacuuugagucucuga

SEQ ID NO: 51807 - RNA, 20 nt, Artificial Sequence
  MKO10051807_A_Stk38l
  gRNA
ucagagacucaaagucaucu

SEQ ID NO: 51808 - RNA, 20 nt, Artificial Sequence
  MKO10051808_A_Stk38l
  gRNA
aaggcagaagaaguuagaag

SEQ ID NO: 51809 - RNA, 20 nt, Artificial Sequence
  MKO10051809_A_Stk38
  gRNA
ugucacgcuccgcacgaaug

SEQ ID NO: 51810 - RNA, 20 nt, Artificial Sequence
  MKO10051810_A_Stk38
  gRNA
uguuuccuuccgagcgugcg

SEQ ID NO: 51811 - RNA, 20 nt, Artificial Sequence
  MKO10051811_A_Stk38
  gRNA
ucagaagauccgcgcacgcu

SEQ ID NO: 51812 - RNA, 20 nt, Artificial Sequence
  MKO10051812_A_Stk39
  gRNA
aucaaauacaucguuaaucg

SEQ ID NO: 51813 - RNA, 20 nt, Artificial Sequence
  MKO10051813_A_Stk39
  gRNA
aagaacgcguagccauaaag

SEQ ID NO: 51814 - RNA, 20 nt, Artificial Sequence
  MKO10051814_A_Stk39
  gRNA
gguguaauaagucacuacgu

SEQ ID NO: 51815 - RNA, 20 nt, Artificial Sequence
  MKO10051815_A_Stk3
  gRNA
ccauaaugcaacaaugugac

SEQ ID NO: 51816 - RNA, 20 nt, Artificial Sequence
  MKO10051816_A_Stk3
  gRNA
ccauauguugugaaguacua

SEQ ID NO: 51817 - RNA, 20 nt, Artificial Sequence
  MKO10051817_A_Stk3
  gRNA
ccauaguacuucacaacaua

SEQ ID NO: 51818 - RNA, 20 nt, Artificial Sequence
  MKO10051818_A_Stk40
  gRNA
uguguccucgaccgcuucac

SEQ ID NO: 51819 - RNA, 20 nt, Artificial Sequence
  MKO10051819_A_Stk40
  gRNA
gugugccguagguccccgcc

SEQ ID NO: 51820 - RNA, 20 nt, Artificial Sequence
  MKO10051820_A_Stk40
  gRNA
gcucagugagcgcgagacug

SEQ ID NO: 51821 - RNA, 20 nt, Artificial Sequence
  MKO10051821_A_Stk4
  gRNA
uaguuuaaccaagcagcccg

SEQ ID NO: 51822 - RNA, 20 nt, Artificial Sequence
  MKO10051822_A_Stk4
  gRNA
uaucugauaucauucggcua

SEQ ID NO: 51823 - RNA, 20 nt, Artificial Sequence
  MKO10051823_A_Stk4
  gRNA
ccauaauacuugacuacgug

SEQ ID NO: 51824 - RNA, 20 nt, Artificial Sequence
  MKO10051824_A_Stmn1
  gRNA
cuguucgacauggcaucuuc

SEQ ID NO: 51825 - RNA, 20 nt, Artificial Sequence
  MKO10051825_A_Stmn1
  gRNA
uuucuuccaggacaagcacg

SEQ ID NO: 51826 - RNA, 20 nt, Artificial Sequence
  MKO10051826_A_Stmn1
  gRNA
agcugcagaagaaagacgca

SEQ ID NO: 51827 - RNA, 20 nt, Artificial Sequence
  MKO10051827_A_Stmn2
  gRNA
aucaacaucuacaccuacga

SEQ ID NO: 51828 - RNA, 20 nt, Artificial Sequence
  MKO10051828_A_Stmn2
  gRNA
ugcuaucauugaacgucugc

SEQ ID NO: 51829 - RNA, 20 nt, Artificial Sequence
  MKO10051829_A_Stmn2
  gRNA
guguagauguugauguugcg

SEQ ID NO: 51830 - RNA, 20 nt, Artificial Sequence
  MKO10051830_A_Stmn3
  gRNA
acuuggcagcgcugcgcgag

SEQ ID NO: 51831 - RNA, 20 nt, Artificial Sequence
  MKO10051831_A_Stmn3
  gRNA
gcgcugccaagugcgccucg

SEQ ID NO: 51832 - RNA, 20 nt, Artificial Sequence
  MKO10051832_A_Stmn3
  gRNA
ccgaacaccaucuaccagua

SEQ ID NO: 51833 - RNA, 20 nt, Artificial Sequence
  MKO10051833_A_Stmn4
  gRNA
cgugcucucguuucuccgcg

SEQ ID NO: 51834 - RNA, 20 nt, Artificial Sequence
  MKO10051834_A_Stmn4
  gRNA
guccaauaaggagaaccggg

SEQ ID NO: 51835 - RNA, 20 nt, Artificial Sequence
  MKO10051835_A_Stmn4
  gRNA
aaacucaggcaccccgucaa

SEQ ID NO: 51836 - RNA, 20 nt, Artificial Sequence
  MKO10051836_A_Stmnd1
  gRNA
ggguuuguuggucaauccau

SEQ ID NO: 51837 - RNA, 20 nt, Artificial Sequence
  MKO10051837_A_Stmnd1
  gRNA
cauagacaacgccaaaaguc

SEQ ID NO: 51838 - RNA, 20 nt, Artificial Sequence
  MKO10051838_A_Stmnd1
  gRNA
ggugguucagcuucgucuga

SEQ ID NO: 51839 - RNA, 20 nt, Artificial Sequence
  MKO10051839_A_Stoml1
  gRNA
ggaggucgaccguguagagc

SEQ ID NO: 51840 - RNA, 20 nt, Artificial Sequence
  MKO10051840_A_Stoml1
  gRNA
cugauguccaguuccgcauc

SEQ ID NO: 51841 - RNA, 20 nt, Artificial Sequence
  MKO10051841_A_Stoml1
  gRNA
ugauuguguuucgacugggc

SEQ ID NO: 51842 - RNA, 20 nt, Artificial Sequence
  MKO10051842_A_Stoml2
  gRNA
guuccgcgccgcgccuccuc

SEQ ID NO: 51843 - RNA, 20 nt, Artificial Sequence
  MKO10051843_A_Stoml2
  gRNA
gagcagucagccguaacucu

SEQ ID NO: 51844 - RNA, 20 nt, Artificial Sequence
  MKO10051844_A_Stoml2
  gRNA
aucgcucucaccaagaguua

SEQ ID NO: 51845 - RNA, 20 nt, Artificial Sequence
  MKO10051845_A_Stoml3
  gRNA
cuacagcgccgucucagccg

SEQ ID NO: 51846 - RNA, 20 nt, Artificial Sequence
  MKO10051846_A_Stoml3
  gRNA
gcgcgcuguugucuucagac

SEQ ID NO: 51847 - RNA, 20 nt, Artificial Sequence
  MKO10051847_A_Stoml3
  gRNA
ugucaaaguagaucuucgaa

SEQ ID NO: 51848 - RNA, 20 nt, Artificial Sequence
  MKO10051848_A_Stom
  gRNA
aacuacccucaggaaugcgc

SEQ ID NO: 51849 - RNA, 20 nt, Artificial Sequence
  MKO10051849_A_Stom
  gRNA
agauucagcaacccgucuuu

SEQ ID NO: 51850 - RNA, 20 nt, Artificial Sequence
  MKO10051850_A_Stom
  gRNA
gaacugcucaccuccugcgg

SEQ ID NO: 51851 - RNA, 20 nt, Artificial Sequence
  MKO10051851_A_Ston1
  gRNA
gagcucacccgcuucguacg

SEQ ID NO: 51852 - RNA, 20 nt, Artificial Sequence
  MKO10051852_A_Ston1
  gRNA
aauagcauucgucccguuuc

SEQ ID NO: 51853 - RNA, 20 nt, Artificial Sequence
  MKO10051853_A_Ston1
  gRNA
gcgagcuugcuacaacaucc

SEQ ID NO: 51854 - RNA, 20 nt, Artificial Sequence
  MKO10051854_A_Ston2
  gRNA
cgcagcgagcauuaacgggg

SEQ ID NO: 51855 - RNA, 20 nt, Artificial Sequence
  MKO10051855_A_Ston2
  gRNA
ccuguucccguuccgcugcg

SEQ ID NO: 51856 - RNA, 20 nt, Artificial Sequence
  MKO10051856_A_Ston2
  gRNA
caacugcucuccgacgucaa

SEQ ID NO: 51857 - RNA, 20 nt, Artificial Sequence
  MKO10051857_A_Stox1
  gRNA
ugaagcccaaccgccguauc

SEQ ID NO: 51858 - RNA, 20 nt, Artificial Sequence
  MKO10051858_A_Stox1
  gRNA
auuguuccggauacggcggu

SEQ ID NO: 51859 - RNA, 20 nt, Artificial Sequence
  MKO10051859_A_Stox1
  gRNA
guuccagaagcagcgcgcgu

SEQ ID NO: 51860 - RNA, 20 nt, Artificial Sequence
  MKO10051860_A_Stox2
  gRNA
ugaugaccaaucguuugcgc

SEQ ID NO: 51861 - RNA, 20 nt, Artificial Sequence
  MKO10051861_A_Stox2
  gRNA
ucgggggauccguacuggcg

SEQ ID NO: 51862 - RNA, 20 nt, Artificial Sequence
  MKO10051862_A_Stox2
  gRNA
uccuucggauggcucgcauc

SEQ ID NO: 51863 - RNA, 20 nt, Artificial Sequence
  MKO10051863_A_Stpg1
  gRNA
aacaaugucugcgcucgagc

SEQ ID NO: 51864 - RNA, 20 nt, Artificial Sequence
  MKO10051864_A_Stpg1
  gRNA
uuucugucgaaaacgccgag

SEQ ID NO: 51865 - RNA, 20 nt, Artificial Sequence
  MKO10051865_A_Stpg1
  gRNA
augguauacgcguuggcagc

SEQ ID NO: 51866 - RNA, 20 nt, Artificial Sequence
  MKO10051866_A_Stpg2
  gRNA
ugugauacguuguagugugc

SEQ ID NO: 51867 - RNA, 20 nt, Artificial Sequence
  MKO10051867_A_Stpg2
  gRNA
aacugaggauuguaguacgc

SEQ ID NO: 51868 - RNA, 20 nt, Artificial Sequence
  MKO10051868_A_Stpg2
  gRNA
cuacaacguaucacaagcac

SEQ ID NO: 51869 - RNA, 20 nt, Artificial Sequence
  MKO10051869_A_Stra13
  gRNA
uuccugaggaucuucguacu

SEQ ID NO: 51870 - RNA, 20 nt, Artificial Sequence
  MKO10051870_A_Stra13
  gRNA
caccuaguacgaagauccuc

SEQ ID NO: 51871 - RNA, 20 nt, Artificial Sequence
  MKO10051871_A_Stra13
  gRNA
ugcaaucccugaagugcaaa

SEQ ID NO: 51872 - RNA, 20 nt, Artificial Sequence
  MKO10051872_A_Stra6
  gRNA
aguccgcgaugaccacagcg

SEQ ID NO: 51873 - RNA, 20 nt, Artificial Sequence
  MKO10051873_A_Stra6
  gRNA
ccuugcuggugagacggcgc

SEQ ID NO: 51874 - RNA, 20 nt, Artificial Sequence
  MKO10051874_A_Stra6
  gRNA
aaaggcaguggguucucauc

SEQ ID NO: 51875 - RNA, 20 nt, Artificial Sequence
  MKO10051875_A_Stra8
  gRNA
cgccuucgcagaccucaccg

SEQ ID NO: 51876 - RNA, 20 nt, Artificial Sequence
  MKO10051876_A_Stra8
  gRNA
cuuaccguucaaauuccaug

SEQ ID NO: 51877 - RNA, 20 nt, Artificial Sequence
  MKO10051877_A_Stra8
  gRNA
ccagcgagcagcucgcuccc

SEQ ID NO: 51878 - RNA, 20 nt, Artificial Sequence
  MKO10051878_A_Strada
  gRNA
ggcucgauacgguacuauau

SEQ ID NO: 51879 - RNA, 20 nt, Artificial Sequence
  MKO10051879_A_Strada
  gRNA
gucacaucauuuauggcgua

SEQ ID NO: 51880 - RNA, 20 nt, Artificial Sequence
  MKO10051880_A_Strada
  gRNA
acugucacauacucucccgu

SEQ ID NO: 51881 - RNA, 20 nt, Artificial Sequence
  MKO10051881_A_Stradb
  gRNA
uucuuaccguaggccauaaa

SEQ ID NO: 51882 - RNA, 20 nt, Artificial Sequence
  MKO10051882_A_Stradb
  gRNA
uucauagugagacacgucag

SEQ ID NO: 51883 - RNA, 20 nt, Artificial Sequence
  MKO10051883_A_Stradb
  gRNA
uguccaauaaguuguaauau

SEQ ID NO: 51884 - RNA, 20 nt, Artificial Sequence
  MKO10051884_A_Strap
  gRNA
uuggggugcaacauugaaua

SEQ ID NO: 51885 - RNA, 20 nt, Artificial Sequence
  MKO10051885_A_Strap
  gRNA
cgauaaacagauccuuucag

SEQ ID NO: 51886 - RNA, 20 nt, Artificial Sequence
  MKO10051886_A_Strap
  gRNA
uggcaagcccaugcuccgcc

SEQ ID NO: 51887 - RNA, 20 nt, Artificial Sequence
  MKO10051887_A_Strbp
  gRNA
caaugaugaucgccauguua

SEQ ID NO: 51888 - RNA, 20 nt, Artificial Sequence
  MKO10051888_A_Strbp
  gRNA
gcaaaaaugccugaaugccu

SEQ ID NO: 51889 - RNA, 20 nt, Artificial Sequence
  MKO10051889_A_Strbp
  gRNA
agcgccaaccuggaaccauu

SEQ ID NO: 51890 - RNA, 20 nt, Artificial Sequence
  MKO10051890_A_Strc
  gRNA
gagauggcucgccgcugucg

SEQ ID NO: 51891 - RNA, 20 nt, Artificial Sequence
  MKO10051891_A_Strc
  gRNA
guaggcgcaggagguaaugu

SEQ ID NO: 51892 - RNA, 20 nt, Artificial Sequence
  MKO10051892_A_Strc
  gRNA
aaaucaugaagucgaagugc

SEQ ID NO: 51893 - RNA, 20 nt, Artificial Sequence
  MKO10051893_A_Strip1
  gRNA
cuauuccgaaucuccagacc

SEQ ID NO: 51894 - RNA, 20 nt, Artificial Sequence
  MKO10051894_A_Strip1
  gRNA
cauugaacgugcccaccucc

SEQ ID NO: 51895 - RNA, 20 nt, Artificial Sequence
  MKO10051895_A_Strip1
  gRNA
ggugggcacguucaaugccu

SEQ ID NO: 51896 - RNA, 20 nt, Artificial Sequence
  MKO10051896_A_Strip2
  gRNA
ccgaggucgaugugcuacac

SEQ ID NO: 51897 - RNA, 20 nt, Artificial Sequence
  MKO10051897_A_Strip2
  gRNA
ccaguguagcacaucgaccu

SEQ ID NO: 51898 - RNA, 20 nt, Artificial Sequence
  MKO10051898_A_Strip2
  gRNA
cauccuagugcaagacacua

SEQ ID NO: 51899 - RNA, 20 nt, Artificial Sequence
  MKO10051899_A_Strn3
  gRNA
ucgagauggagcgggcgcac

SEQ ID NO: 51900 - RNA, 20 nt, Artificial Sequence
  MKO10051900_A_Strn3
  gRNA
ccgcaacaguacacgauccc

SEQ ID NO: 51901 - RNA, 20 nt, Artificial Sequence
  MKO10051901_A_Strn3
  gRNA
cauguuaguugacuauucug

SEQ ID NO: 51902 - RNA, 20 nt, Artificial Sequence
  MKO10051902_A_Strn4
  gRNA
ggugcggcggaucaagaugc

SEQ ID NO: 51903 - RNA, 20 nt, Artificial Sequence
  MKO10051903_A_Strn4
  gRNA
gcaucuugauccgccgcacc

SEQ ID NO: 51904 - RNA, 20 nt, Artificial Sequence
  MKO10051904_A_Strn4
  gRNA
ucgaagccgagaaggcccgc

SEQ ID NO: 51905 - RNA, 20 nt, Artificial Sequence
  MKO10051905_A_Strn
  gRNA
aacuuaccagagucauagcu

SEQ ID NO: 51906 - RNA, 20 nt, Artificial Sequence
  MKO10051906_A_Strn
  gRNA
cugucccauauuucaacuug

SEQ ID NO: 51907 - RNA, 20 nt, Artificial Sequence
  MKO10051907_A_Strn
  gRNA
uuugugcagguaucuccagg

SEQ ID NO: 51908 - RNA, 20 nt, Artificial Sequence
  MKO10051908_A_Suu3a
  gRNA
cccggucaucaaaccaguua

SEQ ID NO: 51909 - RNA, 20 nt, Artificial Sequence
  MKO10051909_A_Suu3a
  gRNA
aaggugguacguaacgaugg

SEQ ID NO: 51910 - RNA, 20 nt, Artificial Sequence
  MKO10051910_A_Suu3a
  gRNA
ugaccgggcuugguacccuu

SEQ ID NO: 51911 - RNA, 20 nt, Artificial Sequence
  MKO10051911_A_Suu3b
  gRNA
ugcuucauugcuaucguacc

SEQ ID NO: 51912 - RNA, 20 nt, Artificial Sequence
  MKO10051912_A_Suu3b
  gRNA
guacauaucucggucagugg

SEQ ID NO: 51913 - RNA, 20 nt, Artificial Sequence
  MKO10051913_A_Suu3b
  gRNA
acacaucaucuugcaucuca

SEQ ID NO: 51914 - RNA, 20 nt, Artificial Sequence
  MKO10051914_A_Stub1
  gRNA
gccauugccaaucugcagcg

SEQ ID NO: 51915 - RNA, 20 nt, Artificial Sequence
  MKO10051915_A_Stub1
  gRNA
cgaggaacggcgcauccacc

SEQ ID NO: 51916 - RNA, 20 nt, Artificial Sequence
  MKO10051916_A_Stub1
  gRNA
cacuccccuagccuauaguu

SEQ ID NO: 51917 - RNA, 20 nt, Artificial Sequence
  MKO10051917_A_Stx11
  gRNA
caucgcgaaugcgacccucc

SEQ ID NO: 51918 - RNA, 20 nt, Artificial Sequence
  MKO10051918_A_Stx11
  gRNA
acacgcgcaguacagcgcgc

SEQ ID NO: 51919 - RNA, 20 nt, Artificial Sequence
  MKO10051919_A_Stx11
  gRNA
guucgagaccgaccacaucc

SEQ ID NO: 51920 - RNA, 20 nt, Artificial Sequence
  MKO10051920_A_Stx12
  gRNA
gcucaugaaugacuucucgu

SEQ ID NO: 51921 - RNA, 20 nt, Artificial Sequence
  MKO10051921_A_Stx12
  gRNA
acuuacagaaagacgagauc

SEQ ID NO: 51922 - RNA, 20 nt, Artificial Sequence
  MKO10051922_A_Stx12
  gRNA
agcagcucgucucauuugac

SEQ ID NO: 51923 - RNA, 20 nt, Artificial Sequence
  MKO10051923_A_Stx16
  gRNA
guagcuugcugaugaccgca

SEQ ID NO: 51924 - RNA, 20 nt, Artificial Sequence
  MKO10051924_A_Stx16
  gRNA
agagcggcuacugcggaacg

SEQ ID NO: 51925 - RNA, 20 nt, Artificial Sequence
  MKO10051925_A_Stx16
  gRNA
acgaagggccugcucggagc

SEQ ID NO: 51926 - RNA, 20 nt, Artificial Sequence
  MKO10051926_A_Stx17
  gRNA
gcgcuccaauauccgagaaa

SEQ ID NO: 51927 - RNA, 20 nt, Artificial Sequence
  MKO10051927_A_Stx17
  gRNA
cacgaagagcacaucaacgc

SEQ ID NO: 51928 - RNA, 20 nt, Artificial Sequence
  MKO10051928_A_Stx17
  gRNA
aguaucagcggugcagaauu

SEQ ID NO: 51929 - RNA, 20 nt, Artificial Sequence
  MKO10051929_A_Stx18
  gRNA
agccauccgagugaagcgcg

SEQ ID NO: 51930 - RNA, 20 nt, Artificial Sequence
  MKO10051930_A_Stx18
  gRNA
uguccaccacgcgcuucacu

SEQ ID NO: 51931 - RNA, 20 nt, Artificial Sequence
  MKO10051931_A_Stx18
  gRNA
aucgucaacgaaauccaaaa

SEQ ID NO: 51932 - RNA, 20 nt, Artificial Sequence
  MKO10051932_A_Stx19
  gRNA
agaacucucucgggacgguc

SEQ ID NO: 51933 - RNA, 20 nt, Artificial Sequence
  MKO10051933_A_Stx19
  gRNA
guggaugauguucaacgauu

SEQ ID NO: 51934 - RNA, 20 nt, Artificial Sequence
  MKO10051934_A_Stx19
  gRNA
cuuuauuuggagccacagcg

SEQ ID NO: 51935 - RNA, 20 nt, Artificial Sequence
  MKO10051935_A_Stx1a
  gRNA
ugacaagauugccgaaaacg

SEQ ID NO: 51936 - RNA, 20 nt, Artificial Sequence
  MKO10051936_A_Stx1a
  gRNA
gucgucgucaucgcuguccu

SEQ ID NO: 51937 - RNA, 20 nt, Artificial Sequence
  MKO10051937_A_Stx1a
  gRNA
gggcgacuuacucuuuagcu

SEQ ID NO: 51938 - RNA, 20 nt, Artificial Sequence
  MKO10051938_A_Stx1b
  gRNA
gaucgagcaaagcauugagc

SEQ ID NO: 51939 - RNA, 20 nt, Artificial Sequence
  MKO10051939_A_Stx1b
  gRNA
cgaagaacucauccauaaag

SEQ ID NO: 51940 - RNA, 20 nt, Artificial Sequence
  MKO10051940_A_Stx1b
  gRNA
gugagccuaccugggucuua

SEQ ID NO: 51941 - RNA, 20 nt, Artificial Sequence
  MKO10051941_A_Stx2
  gRNA
caguguaggacaaacgacga

SEQ ID NO: 51942 - RNA, 20 nt, Artificial Sequence
  MKO10051942_A_Stx2
  gRNA
gaaugggaaccgaacuucag

SEQ ID NO: 51943 - RNA, 20 nt, Artificial Sequence
  MKO10051943_A_Stx2
  gRNA
agacacugcugucgucauug

SEQ ID NO: 51944 - RNA, 20 nt, Artificial Sequence
  MKO10051944_A_Stx3
  gRNA
ccugggacuuucguauccga

SEQ ID NO: 51945 - RNA, 20 nt, Artificial Sequence
  MKO10051945_A_Stx3
  gRNA
cuuguagaagcagcugacgc

SEQ ID NO: 51946 - RNA, 20 nt, Artificial Sequence
  MKO10051946_A_Stx3
  gRNA
agagaagaacucguccauga

SEQ ID NO: 51947 - RNA, 20 nt, Artificial Sequence
  MKO10051947_A_Stx4a
  gRNA
gagguccgggcgcagcuaaa

SEQ ID NO: 51948 - RNA, 20 nt, Artificial Sequence
  MKO10051948_A_Stx4a
  gRNA
cgcuuacucuccucgggaag

SEQ ID NO: 51949 - RNA, 20 nt, Artificial Sequence
  MKO10051949_A_Stx4a
  gRNA
uucuggaagaacucgucguc

SEQ ID NO: 51950 - RNA, 20 nt, Artificial Sequence
  MKO10051950_A_Stx5a
  gRNA
gacccauucuaacaccauug

SEQ ID NO: 51951 - RNA, 20 nt, Artificial Sequence
  MKO10051951_A_Stx5a
  gRNA
cagcaauacauuugccaagc

SEQ ID NO: 51952 - RNA, 20 nt, Artificial Sequence
  MKO10051952_A_Stx5a
  gRNA
caccugcaacgaaaccacaa

SEQ ID NO: 51953 - RNA, 20 nt, Artificial Sequence
  MKO10051953_A_Stx6
  gRNA
ggauauugaugguuucaucg

SEQ ID NO: 51954 - RNA, 20 nt, Artificial Sequence
  MKO10051954_A_Stx6
  gRNA
auuguuccucagcucguugg

SEQ ID NO: 51955 - RNA, 20 nt, Artificial Sequence
  MKO10051955_A_Stx6
  gRNA
uugccgaguacuugugauga

SEQ ID NO: 51956 - RNA, 20 nt, Artificial Sequence
  MKO10051956_A_Stx7
  gRNA
cucgagugcgagccagcucc

SEQ ID NO: 51957 - RNA, 20 nt, Artificial Sequence
  MKO10051957_A_Stx7
  gRNA
gauacagaaagaccgauuag

SEQ ID NO: 51958 - RNA, 20 nt, Artificial Sequence
  MKO10051958_A_Stx7
  gRNA
aaacugcauaccugcucacu

SEQ ID NO: 51959 - RNA, 20 nt, Artificial Sequence
  MKO10051959_A_Stx8
  gRNA
cugacacguagaaucguaug

SEQ ID NO: 51960 - RNA, 20 nt, Artificial Sequence
  MKO10051960_A_Stx8
  gRNA
ccucauucuuaaacgaugcc

SEQ ID NO: 51961 - RNA, 20 nt, Artificial Sequence
  MKO10051961_A_Stx8
  gRNA
gcagucucucucgggugaca

SEQ ID NO: 51962 - RNA, 20 nt, Artificial Sequence
  MKO10051962_A_Stxbp1
  gRNA
ucucuccgaccaccgccuug

SEQ ID NO: 51963 - RNA, 20 nt, Artificial Sequence
  MKO10051963_A_Stxbp1
  gRNA
acagcauccucaugcuuaac

SEQ ID NO: 51964 - RNA, 20 nt, Artificial Sequence
  MKO10051964_A_Stxbp1
  gRNA
ugaugagguacacggccucc

SEQ ID NO: 51965 - RNA, 20 nt, Artificial Sequence
  MKO10051965_A_Stxbp2
  gRNA
auuauagguaccuucuccgu

SEQ ID NO: 51966 - RNA, 20 nt, Artificial Sequence
  MKO10051966_A_Stxbp2
  gRNA
cgucauccggagcguuaaga

SEQ ID NO: 51967 - RNA, 20 nt, Artificial Sequence
  MKO10051967_A_Stxbp2
  gRNA
cgccauccuucuuaacgcuc

SEQ ID NO: 51968 - RNA, 20 nt, Artificial Sequence
  MKO10051968_A_Stxbp3a
  gRNA
cagccguguucgaugacugc

SEQ ID NO: 51969 - RNA, 20 nt, Artificial Sequence
  MKO10051969_A_Stxbp3a
  gRNA
ccuuccauucgccuucuuuc

SEQ ID NO: 51970 - RNA, 20 nt, Artificial Sequence
  MKO10051970_A_Stxbp3a
  gRNA
caaaaugacagaccuucuag

SEQ ID NO: 51971 - RNA, 20 nt, Artificial Sequence
  MKO10051971_A_Stxbp4
  gRNA
aguaacuguaaucacccgaa

SEQ ID NO: 51972 - RNA, 20 nt, Artificial Sequence
  MKO10051972_A_Stxbp4
  gRNA
acuucgugaauauacaccag

SEQ ID NO: 51973 - RNA, 20 nt, Artificial Sequence
  MKO10051973_A_Stxbp4
  gRNA
cccuucuuguaaagcaauuc

SEQ ID NO: 51974 - RNA, 20 nt, Artificial Sequence
  MKO10051974_A_Stxbp5l
  gRNA
cucuuucagacaguucggca

SEQ ID NO: 51975 - RNA, 20 nt, Artificial Sequence
  MKO10051975_A_Stxbp5l
  gRNA
gacugcagggcuuccgagag

SEQ ID NO: 51976 - RNA, 20 nt, Artificial Sequence
  MKO10051976_A_Stxbp5l
  gRNA
caaaacuuaccuugcaaauc

SEQ ID NO: 51977 - RNA, 20 nt, Artificial Sequence
  MKO10051977_A_Stxbp5
  gRNA
cugcugcuccgcugucgugc

SEQ ID NO: 51978 - RNA, 20 nt, Artificial Sequence
  MKO10051978_A_Stxbp5
  gRNA
gacguaaauuccauaagugu

SEQ ID NO: 51979 - RNA, 20 nt, Artificial Sequence
  MKO10051979_A_Stxbp5
  gRNA
uguuauugccagcacgacag

SEQ ID NO: 51980 - RNA, 20 nt, Artificial Sequence
  MKO10051980_A_Stxbp6
  gRNA
ccguuccccacgcucguuca

SEQ ID NO: 51981 - RNA, 20 nt, Artificial Sequence
  MKO10051981_A_Stxbp6
  gRNA
cauucguccgaagaucccaa

SEQ ID NO: 51982 - RNA, 20 nt, Artificial Sequence
  MKO10051982_A_Stxbp6
  gRNA
uaggaucaauaccauuaacu

SEQ ID NO: 51983 - RNA, 20 nt, Artificial Sequence
  MKO10051983_A_Styk1
  gRNA
ggaugagaaagccgccaacc

SEQ ID NO: 51984 - RNA, 20 nt, Artificial Sequence
  MKO10051984_A_Styk1
  gRNA
ugagccuuaccucggggucc

SEQ ID NO: 51985 - RNA, 20 nt, Artificial Sequence
  MKO10051985_A_Styk1
  gRNA
agcagcccuccagcuguacc

SEQ ID NO: 51986 - RNA, 20 nt, Artificial Sequence
  MKO10051986_A_Styxl1
  gRNA
agcauucauagcccccucug

SEQ ID NO: 51987 - RNA, 20 nt, Artificial Sequence
  MKO10051987_A_Styxl1
  gRNA
gcugugcauacggcggcagc

SEQ ID NO: 51988 - RNA, 20 nt, Artificial Sequence
  MKO10051988_A_Styxl1
  gRNA
guuggcggguaaagugaaug

SEQ ID NO: 51989 - RNA, 20 nt, Artificial Sequence
  MKO10051989_A_Styx
  gRNA
accugcaucucucgucucau

SEQ ID NO: 51990 - RNA, 20 nt, Artificial Sequence
  MKO10051990_A_Styx
  gRNA
caaacuuucaacaauuauuu

SEQ ID NO: 51991 - RNA, 20 nt, Artificial Sequence
  MKO10051991_A_Styx
  gRNA
cucuucugcuaugaaaagca

SEQ ID NO: 51992 - RNA, 20 nt, Artificial Sequence
  MKO10051992_A_Sub1
  gRNA
ugcuucuucacgggcuucuc

SEQ ID NO: 51993 - RNA, 20 nt, Artificial Sequence
  MKO10051993_A_Sub1
  gRNA
ggacagcgaaguugaaaaaa

SEQ ID NO: 51994 - RNA, 20 nt, Artificial Sequence
  MKO10051994_A_Sub1
  gRNA
cagagaugacaacauguucc

SEQ ID NO: 51995 - RNA, 20 nt, Artificial Sequence
  MKO10051995_A_Sucla2
  gRNA
ucugugagcgcaaauauccc

SEQ ID NO: 51996 - RNA, 20 nt, Artificial Sequence
  MKO10051996_A_Sucla2
  gRNA
augcccuccacuauaucaau

SEQ ID NO: 51997 - RNA, 20 nt, Artificial Sequence
  MKO10051997_A_Sucla2
  gRNA
ucaaguauucaugcagcgaa

SEQ ID NO: 51998 - RNA, 20 nt, Artificial Sequence
  MKO10051998_A_Suclg1
  gRNA
cgcgucgauugcuucauuaa

SEQ ID NO: 51999 - RNA, 20 nt, Artificial Sequence
  MKO10051999_A_Suclg1
  gRNA
uacacucacguugaugacgc

SEQ ID NO: 52000 - RNA, 20 nt, Artificial Sequence
  MKO10052000_A_Suclg1
  gRNA
ggaguacggcaccaaacucg

SEQ ID NO: 52001 - RNA, 20 nt, Artificial Sequence
  MKO10052001_A_Suclg2
  gRNA
cccuccuagcccuaaaguag

SEQ ID NO: 52002 - RNA, 20 nt, Artificial Sequence
  MKO10052002_A_Suclg2
  gRNA
gaacaacuuacucaaucucu

SEQ ID NO: 52003 - RNA, 20 nt, Artificial Sequence
  MKO10052003_A_Suclg2
  gRNA
ugugauagugggcaguccuc

SEQ ID NO: 52004 - RNA, 20 nt, Artificial Sequence
  MKO10052004_A_Sucnr1
  gRNA
ucgccucacgccuggauagu

SEQ ID NO: 52005 - RNA, 20 nt, Artificial Sequence
  MKO10052005_A_Sucnr1
  gRNA
aucauaucaugcgcaauuug

SEQ ID NO: 52006 - RNA, 20 nt, Artificial Sequence
  MKO10052006_A_Sucnr1
  gRNA
caaauugcgcaugauaugau

SEQ ID NO: 52007 - RNA, 20 nt, Artificial Sequence
  MKO10052007_A_Suco
  gRNA
gugucugcaggcuuccgagu

SEQ ID NO: 52008 - RNA, 20 nt, Artificial Sequence
  MKO10052008_A_Suco
  gRNA
aacgaaguuaagccucccug

SEQ ID NO: 52009 - RNA, 20 nt, Artificial Sequence
  MKO10052009_A_Suco
  gRNA
ccugauagcucagcauuacu

SEQ ID NO: 52010 - RNA, 20 nt, Artificial Sequence
  MKO10052010_A_Suds3
  gRNA
ccgcaccuucgucggacucu

SEQ ID NO: 52011 - RNA, 20 nt, Artificial Sequence
  MKO10052011_A_Suds3
  gRNA
cggggccgagaguccgacga

SEQ ID NO: 52012 - RNA, 20 nt, Artificial Sequence
  MKO10052012_A_Suds3
  gRNA
agcaguaccgagagcggauc

SEQ ID NO: 52013 - RNA, 20 nt, Artificial Sequence
  MKO10052013_A_Sufu
  gRNA
uuaccgcuaucgucaaguac

SEQ ID NO: 52014 - RNA, 20 nt, Artificial Sequence
  MKO10052014_A_Sufu
  gRNA
uaaccuggagcggguucggc

SEQ ID NO: 52015 - RNA, 20 nt, Artificial Sequence
  MKO10052015_A_Sufu
  gRNA
cacaugguccccgcuacaga

SEQ ID NO: 52016 - RNA, 20 nt, Artificial Sequence
  MKO10052016_A_Sugp1
  gRNA
acacucgggcggugugcaac

SEQ ID NO: 52017 - RNA, 20 nt, Artificial Sequence
  MKO10052017_A_Sugp1
  gRNA
ugccaucccaaaccaccgau

SEQ ID NO: 52018 - RNA, 20 nt, Artificial Sequence
  MKO10052018_A_Sugp1
  gRNA
uccaacaaguuugccaauga

SEQ ID NO: 52019 - RNA, 20 nt, Artificial Sequence
  MKO10052019_A_Sugp2
  gRNA
accgcacacugugcgggcgu

SEQ ID NO: 52020 - RNA, 20 nt, Artificial Sequence
  MKO10052020_A_Sugp2
  gRNA
guacucccuuccgaacaaag

SEQ ID NO: 52021 - RNA, 20 nt, Artificial Sequence
  MKO10052021_A_Sugp2
  gRNA
ggcccgucuccucggccaac

SEQ ID NO: 52022 - RNA, 20 nt, Artificial Sequence
  MKO10052022_A_Sugu1
  gRNA
caguaauacugugcgucauc

SEQ ID NO: 52023 - RNA, 20 nt, Artificial Sequence
  MKO10052023_A_Sugu1
  gRNA
uucucagaugcucugaucga

SEQ ID NO: 52024 - RNA, 20 nt, Artificial Sequence
  MKO10052024_A_Sugu1
  gRNA
ggauccccaggcagcauuag

SEQ ID NO: 52025 - RNA, 20 nt, Artificial Sequence
  MKO10052025_A_Sulf1
  gRNA
caguugacgacucugucgag

SEQ ID NO: 52026 - RNA, 20 nt, Artificial Sequence
  MKO10052026_A_Sulf1
  gRNA
ccgagccauucucgccaucc

SEQ ID NO: 52027 - RNA, 20 nt, Artificial Sequence
  MKO10052027_A_Sulf1
  gRNA
cuauaacuaugcaccgaaca

SEQ ID NO: 52028 - RNA, 20 nt, Artificial Sequence
  MKO10052028_A_Sulf2
  gRNA
cgaaggugcggcucucgugc

SEQ ID NO: 52029 - RNA, 20 nt, Artificial Sequence
  MKO10052029_A_Sulf2
  gRNA
gugguuguggacguacuugc

SEQ ID NO: 52030 - RNA, 20 nt, Artificial Sequence
  MKO10052030_A_Sulf2
  gRNA
auacgugccgcccggcugga

SEQ ID NO: 52031 - RNA, 20 nt, Artificial Sequence
  MKO10052031_A_Sult1a1
  gRNA
uccgcaaaguauuugaugag

SEQ ID NO: 52032 - RNA, 20 nt, Artificial Sequence
  MKO10052032_A_Sult1a1
  gRNA
aucagcacguacccaaaguc

SEQ ID NO: 52033 - RNA, 20 nt, Artificial Sequence
  MKO10052033_A_Sult1a1
  gRNA
gguggcaagcuagauaagug

SEQ ID NO: 52034 - RNA, 20 nt, Artificial Sequence
  MKO10052034_A_Sult1b1
  gRNA
aauaguauuaauccucuucc

SEQ ID NO: 52035 - RNA, 20 nt, Artificial Sequence
  MKO10052035_A_Sult1b1
  gRNA
cauccuugccauuucgagca

SEQ ID NO: 52036 - RNA, 20 nt, Artificial Sequence
  MKO10052036_A_Sult1b1
  gRNA
agaugugucuuuauuauccg

SEQ ID NO: 52037 - RNA, 20 nt, Artificial Sequence
  MKO10052037_A_Sult1c1
  gRNA
ggucauagguauuggcccgc

SEQ ID NO: 52038 - RNA, 20 nt, Artificial Sequence
  MKO10052038_A_Sult1c1
  gRNA
gggaaacucaccugaguuga

SEQ ID NO: 52039 - RNA, 20 nt, Artificial Sequence
  MKO10052039_A_Sult1c1
  gRNA
uuaccuccuaggucuggauc

SEQ ID NO: 52040 - RNA, 20 nt, Artificial Sequence
  MKO10052040_A_Sult1c2
  gRNA
uagcauuucgagcuacauaa

SEQ ID NO: 52041 - RNA, 20 nt, Artificial Sequence
  MKO10052041_A_Sult1c2
  gRNA
ucgaaaugcuaaagacugca

SEQ ID NO: 52042 - RNA, 20 nt, Artificial Sequence
  MKO10052042_A_Sult1c2
  gRNA
ggccgugcccacucaauaaa

SEQ ID NO: 52043 - RNA, 20 nt, Artificial Sequence
  MKO10052043_A_Sult1d1
  gRNA
cuacaaacgaguaccauuca

SEQ ID NO: 52044 - RNA, 20 nt, Artificial Sequence
  MKO10052044_A_Sult1d1
  gRNA
gcucuucacaugaucauacc

SEQ ID NO: 52045 - RNA, 20 nt, Artificial Sequence
  MKO10052045_A_Sult1d1
  gRNA
guccauacagauuauuuaug

SEQ ID NO: 52046 - RNA, 20 nt, Artificial Sequence
  MKO10052046_A_Sult1e1
  gRNA
ucuagaugaucuaucuuugc

SEQ ID NO: 52047 - RNA, 20 nt, Artificial Sequence
  MKO10052047_A_Sult1e1
  gRNA
ucguuucugcacuccaaaua

SEQ ID NO: 52048 - RNA, 20 nt, Artificial Sequence
  MKO10052048_A_Sult1e1
  gRNA
uuucaguuccguaugguucc

SEQ ID NO: 52049 - RNA, 20 nt, Artificial Sequence
  MKO10052049_A_Sult2a1
  gRNA
acacaguucuauucggauca

SEQ ID NO: 52050 - RNA, 20 nt, Artificial Sequence
  MKO10052050_A_Sult2a1
  gRNA
guacuaugaagacauaaaaa

SEQ ID NO: 52051 - RNA, 20 nt, Artificial Sequence
  MKO10052051_A_Sult2a1
  gRNA
uuccuuaaugagacuaaaau

SEQ ID NO: 52052 - RNA, 20 nt, Artificial Sequence
  MKO10052052_A_Sult2a2
  gRNA
cccuggauagagacugaaau

SEQ ID NO: 52053 - RNA, 20 nt, Artificial Sequence
  MKO10052053_A_Sult2a2
  gRNA
ccuuccuuauugauuauugc

SEQ ID NO: 52054 - RNA, 20 nt, Artificial Sequence
  MKO10052054_A_Sult2a2
  gRNA
uuuacucaccauuuccuugg

SEQ ID NO: 52055 - RNA, 20 nt, Artificial Sequence
  MKO10052055_A_Sult2a3
  gRNA
agcgaagauaugauuacuaa

SEQ ID NO: 52056 - RNA, 20 nt, Artificial Sequence
  MKO10052056_A_Sult2a3
  gRNA
aaauaaguucugagugaucc

SEQ ID NO: 52057 - RNA, 20 nt, Artificial Sequence
  MKO10052057_A_Sult2a3
  gRNA
agaugagaggaaaugagucg

SEQ ID NO: 52058 - RNA, 20 nt, Artificial Sequence
  MKO10052058_A_Sult2a4
  gRNA
cccuggcuagagacuaauag

SEQ ID NO: 52059 - RNA, 20 nt, Artificial Sequence
  MKO10052059_A_Sult2a4
  gRNA
gguccugaauggacacaguu

SEQ ID NO: 52060 - RNA, 20 nt, Artificial Sequence
  MKO10052060_A_Sult2a4
  gRNA
cccagagauauucuucuuuc

SEQ ID NO: 52061 - RNA, 20 nt, Artificial Sequence
  MKO10052061_A_Sult2a5
  gRNA
ucauucaggaacaaacuggu

SEQ ID NO: 52062 - RNA, 20 nt, Artificial Sequence
  MKO10052062_A_Sult2a5
  gRNA
aaauaaguuccaaaagaccc

SEQ ID NO: 52063 - RNA, 20 nt, Artificial Sequence
  MKO10052063_A_Sult2a5
  gRNA
aagacaagauccagcucauc

SEQ ID NO: 52064 - RNA, 20 nt, Artificial Sequence
  MKO10052064_A_Sult2a6
  gRNA
gagucgugguccuuccuuac

SEQ ID NO: 52065 - RNA, 20 nt, Artificial Sequence
  MKO10052065_A_Sult2a6
  gRNA
guucccaauuaggcacagau

SEQ ID NO: 52066 - RNA, 20 nt, Artificial Sequence
  MKO10052066_A_Sult2a6
  gRNA
accagacacuagaacaucuc

SEQ ID NO: 52067 - RNA, 20 nt, Artificial Sequence
  MKO10052067_A_Sult2a7
  gRNA
uguucaaaccaugauccaua

SEQ ID NO: 52068 - RNA, 20 nt, Artificial Sequence
  MKO10052068_A_Sult2a7
  gRNA
gcagacaaucucaacaagcc

SEQ ID NO: 52069 - RNA, 20 nt, Artificial Sequence
  MKO10052069_A_Sult2a7
  gRNA
ggauccaaucugugcccauc

SEQ ID NO: 52070 - RNA, 20 nt, Artificial Sequence
  MKO10052070_A_Sult2b1
  gRNA
ccaucuggcaacgugcgccc

SEQ ID NO: 52071 - RNA, 20 nt, Artificial Sequence
  MKO10052071_A_Sult2b1
  gRNA
ccggaacccccgcgaugucg

SEQ ID NO: 52072 - RNA, 20 nt, Artificial Sequence
  MKO10052072_A_Sult2b1
  gRNA
ggaucccucguggauccgau

SEQ ID NO: 52073 - RNA, 20 nt, Artificial Sequence
  MKO10052073_A_Sult3a1
  gRNA
augggaaguuuccuucgcaa

SEQ ID NO: 52074 - RNA, 20 nt, Artificial Sequence
  MKO10052074_A_Sult3a1
  gRNA
aaggaucugcuggguccaga

SEQ ID NO: 52075 - RNA, 20 nt, Artificial Sequence
  MKO10052075_A_Sult3a1
  gRNA
gaugcgaggugauggcauuu

SEQ ID NO: 52076 - RNA, 20 nt, Artificial Sequence
  MKO10052076_A_Sult4a1
  gRNA
aucaguuccaccgcucgcug

SEQ ID NO: 52077 - RNA, 20 nt, Artificial Sequence
  MKO10052077_A_Sult4a1
  gRNA
gcugcucgucaauguucauc

SEQ ID NO: 52078 - RNA, 20 nt, Artificial Sequence
  MKO10052078_A_Sult4a1
  gRNA
uuucaucagggucggcaccc

SEQ ID NO: 52079 - RNA, 20 nt, Artificial Sequence
  MKO10052079_A_Sult5a1
  gRNA
accucccacuugaacgccaa

SEQ ID NO: 52080 - RNA, 20 nt, Artificial Sequence
  MKO10052080_A_Sult5a1
  gRNA
ccgcaaguuaagugaauucc

SEQ ID NO: 52081 - RNA, 20 nt, Artificial Sequence
  MKO10052081_A_Sult5a1
  gRNA
guucaggcuucuucggcucc

SEQ ID NO: 52082 - RNA, 20 nt, Artificial Sequence
  MKO10052082_A_Sult6b1
  gRNA
ggugauauuucgaaacccua

SEQ ID NO: 52083 - RNA, 20 nt, Artificial Sequence
  MKO10052083_A_Sult6b1
  gRNA
ccugaagaauucaucccaug

SEQ ID NO: 52084 - RNA, 20 nt, Artificial Sequence
  MKO10052084_A_Sult6b1
  gRNA
acugagguagcuugucauag

SEQ ID NO: 52085 - RNA, 20 nt, Artificial Sequence
  MKO10052085_A_Sumf1
  gRNA
agugaaaacgcauauccacc

SEQ ID NO: 52086 - RNA, 20 nt, Artificial Sequence
  MKO10052086_A_Sumf1
  gRNA
gggcaagagguugccuacug

SEQ ID NO: 52087 - RNA, 20 nt, Artificial Sequence
  MKO10052087_A_Sumf1
  gRNA
ccucucuaggucaaaucauc

SEQ ID NO: 52088 - RNA, 20 nt, Artificial Sequence
  MKO10052088_A_Sumf2
  gRNA
uucccgugguacacgugagc

SEQ ID NO: 52089 - RNA, 20 nt, Artificial Sequence
  MKO10052089_A_Sumf2
  gRNA
cggguggagcuucgucuuug

SEQ ID NO: 52090 - RNA, 20 nt, Artificial Sequence
  MKO10052090_A_Sumf2
  gRNA
uuuacugucacuucccgggc

SEQ ID NO: 52091 - RNA, 20 nt, Artificial Sequence
  MKO10052091_A_Sumo1
  gRNA
uuucuuccagcugggaaugg

SEQ ID NO: 52092 - RNA, 20 nt, Artificial Sequence
  MKO10052092_A_Sumo1
  gRNA
ggaggcaaaaccuucaacug

SEQ ID NO: 52093 - RNA, 20 nt, Artificial Sequence
  MKO10052093_A_Sumo1
  gRNA
ucgccuaaguccucaguuga

SEQ ID NO: 52094 - RNA, 20 nt, Artificial Sequence
  MKO10052094_A_Sumo2
  gRNA
ccucaccugccguucacaau

SEQ ID NO: 52095 - RNA, 20 nt, Artificial Sequence
  MKO10052095_A_Sumo2
  gRNA
gcucaccuuggguuucucgu

SEQ ID NO: 52096 - RNA, 20 nt, Artificial Sequence
  MKO10052096_A_Sumo2
  gRNA
cuuguuaggguuugucaaug

SEQ ID NO: 52097 - RNA, 20 nt, Artificial Sequence
  MKO10052097_A_Sumo3
  gRNA
uuccccagggcuugucaaug

SEQ ID NO: 52098 - RNA, 20 nt, Artificial Sequence
  MKO10052098_A_Sumo3
  gRNA
uggucacugcucaauagcac

SEQ ID NO: 52099 - RNA, 20 nt, Artificial Sequence
  MKO10052099_A_Sumo3
  gRNA
acuugacuagcuggagaugg

SEQ ID NO: 52100 - RNA, 20 nt, Artificial Sequence
  MKO10052100_A_Sun1
  gRNA
cuggcuacacuuacgcacuc

SEQ ID NO: 52101 - RNA, 20 nt, Artificial Sequence
  MKO10052101_A_Sun1
  gRNA
gcagcaccguggcacuccgc

SEQ ID NO: 52102 - RNA, 20 nt, Artificial Sequence
  MKO10052102_A_Sun1
  gRNA
gucccgccgcagcuugcguc

SEQ ID NO: 52103 - RNA, 20 nt, Artificial Sequence
  MKO10052103_A_Sun2
  gRNA
gcgccucacucgcuacucuc

SEQ ID NO: 52104 - RNA, 20 nt, Artificial Sequence
  MKO10052104_A_Sun2
  gRNA
gcucuccgcggugagcccau

SEQ ID NO: 52105 - RNA, 20 nt, Artificial Sequence
  MKO10052105_A_Sun2
  gRNA
agcccgggggcugccgaugu

SEQ ID NO: 52106 - RNA, 20 nt, Artificial Sequence
  MKO10052106_A_Sun3
  gRNA
acauccugauuaagcucgcc

SEQ ID NO: 52107 - RNA, 20 nt, Artificial Sequence
  MKO10052107_A_Sun3
  gRNA
cucaucuagaacgucaguag

SEQ ID NO: 52108 - RNA, 20 nt, Artificial Sequence
  MKO10052108_A_Sun3
  gRNA
ucggagaagguguccccuuc

SEQ ID NO: 52109 - RNA, 20 nt, Artificial Sequence
  MKO10052109_A_Sun5
  gRNA
cuguuuaccugcagguguua

SEQ ID NO: 52110 - RNA, 20 nt, Artificial Sequence
  MKO10052110_A_Sun5
  gRNA
gcaggcuagguaggugagcc

SEQ ID NO: 52111 - RNA, 20 nt, Artificial Sequence
  MKO10052111_A_Sun5
  gRNA
gagacucaccaaaaacacag

SEQ ID NO: 52112 - RNA, 20 nt, Artificial Sequence
  MKO10052112_A_Suox
  gRNA
ccggcgcuccgaaaugagua

SEQ ID NO: 52113 - RNA, 20 nt, Artificial Sequence
  MKO10052113_A_Suox
  gRNA
cauugcugaguacgccccga

SEQ ID NO: 52114 - RNA, 20 nt, Artificial Sequence
  MKO10052114_A_Suox
  gRNA
gagucaagucaacccccuug

SEQ ID NO: 52115 - RNA, 20 nt, Artificial Sequence
  MKO10052115_A_Supt16
  gRNA
ugccaagucaacugccuuac

SEQ ID NO: 52116 - RNA, 20 nt, Artificial Sequence
  MKO10052116_A_Supt16
  gRNA
uuuccauagacguggcucuu

SEQ ID NO: 52117 - RNA, 20 nt, Artificial Sequence
  MKO10052117_A_Supt16
  gRNA
aacacccaccgauacaacaa

SEQ ID NO: 52118 - RNA, 20 nt, Artificial Sequence
  MKO10052118_A_Supt20
  gRNA
agucauaccuuccacuagac

SEQ ID NO: 52119 - RNA, 20 nt, Artificial Sequence
  MKO10052119_A_Supt20
  gRNA
uuaguagucaaucuguaccc

SEQ ID NO: 52120 - RNA, 20 nt, Artificial Sequence
  MKO10052120_A_Supt20
  gRNA
guuagagaagcuuguuaugc

SEQ ID NO: 52121 - RNA, 20 nt, Artificial Sequence
  MKO10052121_A_Supt3
  gRNA
cgagcuugaugaugucaaac

SEQ ID NO: 52122 - RNA, 20 nt, Artificial Sequence
  MKO10052122_A_Supt3
  gRNA
caagagacagaagaucgcuc

SEQ ID NO: 52123 - RNA, 20 nt, Artificial Sequence
  MKO10052123_A_Supt3
  gRNA
ucauacacaacuaauuaacc

SEQ ID NO: 52124 - RNA, 20 nt, Artificial Sequence
  MKO10052124_A_Supt4a
  gRNA
uucugucauaggaaucgugc

SEQ ID NO: 52125 - RNA, 20 nt, Artificial Sequence
  MKO10052125_A_Supt4a
  gRNA
cacacccaucauauucgaac

SEQ ID NO: 52126 - RNA, 20 nt, Artificial Sequence
  MKO10052126_A_Supt4a
  gRNA
uccucagguaacuuuaagcc

SEQ ID NO: 52127 - RNA, 20 nt, Artificial Sequence
  MKO10052127_A_Supt5
  gRNA
cagcacaacguuaucaauau

SEQ ID NO: 52128 - RNA, 20 nt, Artificial Sequence
  MKO10052128_A_Supt5
  gRNA
caauauugauaacguugugc

SEQ ID NO: 52129 - RNA, 20 nt, Artificial Sequence
  MKO10052129_A_Supt5
  gRNA
cacugccugcagcacuucgc

SEQ ID NO: 52130 - RNA, 20 nt, Artificial Sequence
  MKO10052130_A_Supt6
  gRNA
acuuacgcaucuguauaucc

SEQ ID NO: 52131 - RNA, 20 nt, Artificial Sequence
  MKO10052131_A_Supt6
  gRNA
cgucauugauaaagucuuug

SEQ ID NO: 52132 - RNA, 20 nt, Artificial Sequence
  MKO10052132_A_Supt6
  gRNA
ccccauggccccuccugacg

SEQ ID NO: 52133 - RNA, 20 nt, Artificial Sequence
  MKO10052133_A_Supt7l
  gRNA
uuguggcgacugcuugauag

SEQ ID NO: 52134 - RNA, 20 nt, Artificial Sequence
  MKO10052134_A_Supt7l
  gRNA
ggagagauaccaauaccguc

SEQ ID NO: 52135 - RNA, 20 nt, Artificial Sequence
  MKO10052135_A_Supt7l
  gRNA
gccgaagccccccacgaugc

SEQ ID NO: 52136 - RNA, 20 nt, Artificial Sequence
  MKO10052136_A_Supv3l1
  gRNA
acacgccagaggucgcugac

SEQ ID NO: 52137 - RNA, 20 nt, Artificial Sequence
  MKO10052137_A_Supv3l1
  gRNA
uaucuuccgcugucucgcuc

SEQ ID NO: 52138 - RNA, 20 nt, Artificial Sequence
  MKO10052138_A_Supv3l1
  gRNA
cacagcucgucucuuccacc

SEQ ID NO: 52139 - RNA, 20 nt, Artificial Sequence
  MKO10052139_A_Surf1
  gRNA
ucagcuuccauuuccgacgu

SEQ ID NO: 52140 - RNA, 20 nt, Artificial Sequence
  MKO10052140_A_Surf1
  gRNA
ugccagcaucucgcgccucu

SEQ ID NO: 52141 - RNA, 20 nt, Artificial Sequence
  MKO10052141_A_Surf1
  gRNA
agaauuagagucucgaguca

SEQ ID NO: 52142 - RNA, 20 nt, Artificial Sequence
  MKO10052142_A_Surf2
  gRNA
ugcguaaucgaaguuagaga

SEQ ID NO: 52143 - RNA, 20 nt, Artificial Sequence
  MKO10052143_A_Surf2
  gRNA
uacguaccgauucuuugugc

SEQ ID NO: 52144 - RNA, 20 nt, Artificial Sequence
  MKO10052144_A_Surf2
  gRNA
ucaguuuacgaccccucuug

SEQ ID NO: 52145 - RNA, 20 nt, Artificial Sequence
  MKO10052145_A_Surf4
  gRNA
uucgugcaguaugccugcuu

SEQ ID NO: 52146 - RNA, 20 nt, Artificial Sequence
  MKO10052146_A_Surf4
  gRNA
gguacugcuuggugacucga

SEQ ID NO: 52147 - RNA, 20 nt, Artificial Sequence
  MKO10052147_A_Surf4
  gRNA
guuuggaaucaucgcacugc

SEQ ID NO: 52148 - RNA, 20 nt, Artificial Sequence
  MKO10052148_A_Surf6
  gRNA
ccuggacgagcuucgugauc

SEQ ID NO: 52149 - RNA, 20 nt, Artificial Sequence
  MKO10052149_A_Surf6
  gRNA
ccugaucacgaagcucgucc

SEQ ID NO: 52150 - RNA, 20 nt, Artificial Sequence
  MKO10052150_A_Surf6
  gRNA
acuuaccuuuaggggacccc

SEQ ID NO: 52151 - RNA, 20 nt, Artificial Sequence
  MKO10052151_A_Susd1
  gRNA
cuucccacgacguagcccuc

SEQ ID NO: 52152 - RNA, 20 nt, Artificial Sequence
  MKO10052152_A_Susd1
  gRNA
gaacgucucguuguuauuug

SEQ ID NO: 52153 - RNA, 20 nt, Artificial Sequence
  MKO10052153_A_Susd1
  gRNA
cccaccuuggcaauguaacu

SEQ ID NO: 52154 - RNA, 20 nt, Artificial Sequence
  MKO10052154_A_Susd2
  gRNA
uccgggcagacuccguagcc

SEQ ID NO: 52155 - RNA, 20 nt, Artificial Sequence
  MKO10052155_A_Susd2
  gRNA
uacugaggugaugcggguuu

SEQ ID NO: 52156 - RNA, 20 nt, Artificial Sequence
  MKO10052156_A_Susd2
  gRNA
ccaggccagugcgugaucgu

SEQ ID NO: 52157 - RNA, 20 nt, Artificial Sequence
  MKO10052157_A_Susd3
  gRNA
guccacgcguugaacucugc

SEQ ID NO: 52158 - RNA, 20 nt, Artificial Sequence
  MKO10052158_A_Susd3
  gRNA
gcccugcagaguucaacgcg

SEQ ID NO: 52159 - RNA, 20 nt, Artificial Sequence
  MKO10052159_A_Susd3
  gRNA
uugcaagucguccguggaga

SEQ ID NO: 52160 - RNA, 20 nt, Artificial Sequence
  MKO10052160_A_Susd4
  gRNA
uuucguuaugccgugacgau

SEQ ID NO: 52161 - RNA, 20 nt, Artificial Sequence
  MKO10052161_A_Susd4
  gRNA
aaaucuccgugacuuaccau

SEQ ID NO: 52162 - RNA, 20 nt, Artificial Sequence
  MKO10052162_A_Susd4
  gRNA
uucgaagaaaacuccuccgc

SEQ ID NO: 52163 - RNA, 20 nt, Artificial Sequence
  MKO10052163_A_Susd5
  gRNA
acacggcucccgcgacuacc

SEQ ID NO: 52164 - RNA, 20 nt, Artificial Sequence
  MKO10052164_A_Susd5
  gRNA
aaugcucgacguagaagcuc

SEQ ID NO: 52165 - RNA, 20 nt, Artificial Sequence
  MKO10052165_A_Susd5
  gRNA
aggacgaccguguguagcaa

SEQ ID NO: 52166 - RNA, 20 nt, Artificial Sequence
  MKO10052166_A_Suv39h1
  gRNA
agcuuguccgacgacaccgc

SEQ ID NO: 52167 - RNA, 20 nt, Artificial Sequence
  MKO10052167_A_Suv39h1
  gRNA
cguggaagacguauauaccg

SEQ ID NO: 52168 - RNA, 20 nt, Artificial Sequence
  MKO10052168_A_Suv39h1
  gRNA
auacgucuuccacguagucc

SEQ ID NO: 52169 - RNA, 20 nt, Artificial Sequence
  MKO10052169_A_Suv39h2
  gRNA
ucuacuacauuaacgaguac

SEQ ID NO: 52170 - RNA, 20 nt, Artificial Sequence
  MKO10052170_A_Suv39h2
  gRNA
ccuugaguugcauucguaga

SEQ ID NO: 52171 - RNA, 20 nt, Artificial Sequence
  MKO10052171_A_Suv39h2
  gRNA
auagaacuguccccgucucu

SEQ ID NO: 52172 - RNA, 20 nt, Artificial Sequence
  MKO10052172_A_Suv420h1
  gRNA
agccgcuaugugccguccuc

SEQ ID NO: 52173 - RNA, 20 nt, Artificial Sequence
  MKO10052173_A_Suv420h1
  gRNA
ccggcagaaacgccguugag

SEQ ID NO: 52174 - RNA, 20 nt, Artificial Sequence
  MKO10052174_A_Suv420h1
  gRNA
uuccagaggacggcacauag

SEQ ID NO: 52175 - RNA, 20 nt, Artificial Sequence
  MKO10052175_A_Suv420h2
  gRNA
ugguguugucgucgcaaggu

SEQ ID NO: 52176 - RNA, 20 nt, Artificial Sequence
  MKO10052176_A_Suv420h2
  gRNA
uuuccuaaggcaacgggacc

SEQ ID NO: 52177 - RNA, 20 nt, Artificial Sequence
  MKO10052177_A_Suv420h2
  gRNA
agauugugucuacccgugcu

SEQ ID NO: 52178 - RNA, 20 nt, Artificial Sequence
  MKO10052178_A_Suz12
  gRNA
cggcuucggggguucggcgg

SEQ ID NO: 52179 - RNA, 20 nt, Artificial Sequence
  MKO10052179_A_Suz12
  gRNA
gccggugaagaagccgaaaa

SEQ ID NO: 52180 - RNA, 20 nt, Artificial Sequence
  MKO10052180_A_Suz12
  gRNA
cauuugcaacuuacauuuac

SEQ ID NO: 52181 - RNA, 20 nt, Artificial Sequence
  MKO10052181_A_Sv2a
  gRNA
cuuacugagaagacgcgcuc

SEQ ID NO: 52182 - RNA, 20 nt, Artificial Sequence
  MKO10052182_A_Sv2a
  gRNA
uccgacccagccgaucagcc

SEQ ID NO: 52183 - RNA, 20 nt, Artificial Sequence
  MKO10052183_A_Sv2a
  gRNA
cgccagaaacuccgaaaaau

SEQ ID NO: 52184 - RNA, 20 nt, Artificial Sequence
  MKO10052184_A_Sv2b
  gRNA
ggcuccauaucccugcacga

SEQ ID NO: 52185 - RNA, 20 nt, Artificial Sequence
  MKO10052185_A_Sv2b
  gRNA
gaccccggaaaagguguuca

SEQ ID NO: 52186 - RNA, 20 nt, Artificial Sequence
  MKO10052186_A_Sv2b
  gRNA
gccuggcugauaaacuggga

SEQ ID NO: 52187 - RNA, 20 nt, Artificial Sequence
  MKO10052187_A_Sv2c
  gRNA
ugacgaagacgcgccagcug

SEQ ID NO: 52188 - RNA, 20 nt, Artificial Sequence
  MKO10052188_A_Sv2c
  gRNA
cggcaucuacgccuccgcca

SEQ ID NO: 52189 - RNA, 20 nt, Artificial Sequence
  MKO10052189_A_Sv2c
  gRNA
acgcccccaccaucaucccg

SEQ ID NO: 52190 - RNA, 20 nt, Artificial Sequence
  MKO10052190_A_Sval1
  gRNA
uuaccuauuauccugaccag

SEQ ID NO: 52191 - RNA, 20 nt, Artificial Sequence
  MKO10052191_A_Sval1
  gRNA
uugccucuggucaggauaau

SEQ ID NO: 52192 - RNA, 20 nt, Artificial Sequence
  MKO10052192_A_Sval1
  gRNA
agcagaaguuguuucagcua

SEQ ID NO: 52193 - RNA, 20 nt, Artificial Sequence
  MKO10052193_A_Sval2
  gRNA
uuguguagcaguuucuacgu

SEQ ID NO: 52194 - RNA, 20 nt, Artificial Sequence
  MKO10052194_A_Sval2
  gRNA
gcagugcaaacaaauacuuc

SEQ ID NO: 52195 - RNA, 20 nt, Artificial Sequence
  MKO10052195_A_Sval2
  gRNA
cuccuuauggucaggaaaau

SEQ ID NO: 52196 - RNA, 20 nt, Artificial Sequence
  MKO10052196_A_Sval3
  gRNA
cugccuauggucaagacaau

SEQ ID NO: 52197 - RNA, 20 nt, Artificial Sequence
  MKO10052197_A_Sval3
  gRNA
acaagucacuuucacucaac

SEQ ID NO: 52198 - RNA, 20 nt, Artificial Sequence
  MKO10052198_A_Sval3
  gRNA
accuaguaacuaucuaccuc

SEQ ID NO: 52199 - RNA, 20 nt, Artificial Sequence
  MKO10052199_A_Sva
  gRNA
ucugacgaaccacuacuaua

SEQ ID NO: 52200 - RNA, 20 nt, Artificial Sequence
  MKO10052200_A_Sva
  gRNA
uaagagucgccauauaguag

SEQ ID NO: 52201 - RNA, 20 nt, Artificial Sequence
  MKO10052201_A_Sva
  gRNA
guaccauuagcgauuucuuc

SEQ ID NO: 52202 - RNA, 20 nt, Artificial Sequence
  MKO10052202_A_Svep1
  gRNA
cgggcgacaucggaccccac

SEQ ID NO: 52203 - RNA, 20 nt, Artificial Sequence
  MKO10052203_A_Svep1
  gRNA
uccgccauuggaauagccgu

SEQ ID NO: 52204 - RNA, 20 nt, Artificial Sequence
  MKO10052204_A_Svep1
  gRNA
gaccuauugcagcaucgcuu

SEQ ID NO: 52205 - RNA, 20 nt, Artificial Sequence
  MKO10052205_A_Svil
  gRNA
cggcagcuggccgaaaagua

SEQ ID NO: 52206 - RNA, 20 nt, Artificial Sequence
  MKO10052206_A_Svil
  gRNA
augccaauucccggcacucc

SEQ ID NO: 52207 - RNA, 20 nt, Artificial Sequence
  MKO10052207_A_Svil
  gRNA
gacccugcaagcccucauau

SEQ ID NO: 52208 - RNA, 20 nt, Artificial Sequence
  MKO10052208_A_Svip
  gRNA
acucuaagucccccugccgu

SEQ ID NO: 52209 - RNA, 20 nt, Artificial Sequence
  MKO10052209_A_Svip
  gRNA
acaucggggccaccaacggc

SEQ ID NO: 52210 - RNA, 20 nt, Artificial Sequence
  MKO10052210_A_Svip
  gRNA
cuacucaccgggcucgggga

SEQ ID NO: 52211 - RNA, 20 nt, Artificial Sequence
  MKO10052211_A_Svopl
  gRNA
guggaagcgcccgaagccga

SEQ ID NO: 52212 - RNA, 20 nt, Artificial Sequence
  MKO10052212_A_Svopl
  gRNA
gucuuucugcggacgauggu

SEQ ID NO: 52213 - RNA, 20 nt, Artificial Sequence
  MKO10052213_A_Svopl
  gRNA
cuccuguuauccgaugugaa

SEQ ID NO: 52214 - RNA, 20 nt, Artificial Sequence
  MKO10052214_A_Svop
  gRNA
ggaaacaucucggaccagua

SEQ ID NO: 52215 - RNA, 20 nt, Artificial Sequence
  MKO10052215_A_Svop
  gRNA
gggccuagaagccaucgagc

SEQ ID NO: 52216 - RNA, 20 nt, Artificial Sequence
  MKO10052216_A_Svop
  gRNA
guggugaaauuccgacgcac

SEQ ID NO: 52217 - RNA, 20 nt, Artificial Sequence
  MKO10052217_A_Svs1
  gRNA
agaccuccccggcuuucacg

SEQ ID NO: 52218 - RNA, 20 nt, Artificial Sequence
  MKO10052218_A_Svs1
  gRNA
aagaaucccgccgaguuccc

SEQ ID NO: 52219 - RNA, 20 nt, Artificial Sequence
  MKO10052219_A_Svs1
  gRNA
ugggcagagucugccggaag

SEQ ID NO: 52220 - RNA, 20 nt, Artificial Sequence
  MKO10052220_A_Svs2
  gRNA
gagcgcucacaauccuauaa

SEQ ID NO: 52221 - RNA, 20 nt, Artificial Sequence
  MKO10052221_A_Svs2
  gRNA
uuguccauuacgacaaagug

SEQ ID NO: 52222 - RNA, 20 nt, Artificial Sequence
  MKO10052222_A_Svs2
  gRNA
ucagcugugguuggacaaua

SEQ ID NO: 52223 - RNA, 20 nt, Artificial Sequence
  MKO10052223_A_Svs3a
  gRNA
ccagcuaaagaccauagggc

SEQ ID NO: 52224 - RNA, 20 nt, Artificial Sequence
  MKO10052224_A_Svs3a
  gRNA
cagauuaaggcgugcuuuga

SEQ ID NO: 52225 - RNA, 20 nt, Artificial Sequence
  MKO10052225_A_Svs3a
  gRNA
cagcugcuuucuucuccaga

SEQ ID NO: 52226 - RNA, 20 nt, Artificial Sequence
  MKO10052226_A_Svs3b
  gRNA
cagauuaaggcgugcuuugu

SEQ ID NO: 52227 - RNA, 20 nt, Artificial Sequence
  MKO10052227_A_Svs3b
  gRNA
caaacuaagcaccaugcaua

SEQ ID NO: 52228 - RNA, 20 nt, Artificial Sequence
  MKO10052228_A_Svs3b
  gRNA
ccuuucucugcuccuccuuc

SEQ ID NO: 52229 - RNA, 20 nt, Artificial Sequence
  MKO10052229_A_Svs4
  gRNA
cucagaagcuucgucaccga

SEQ ID NO: 52230 - RNA, 20 nt, Artificial Sequence
  MKO10052230_A_Svs4
  gRNA
ugucagagagagcuucucga

SEQ ID NO: 52231 - RNA, 20 nt, Artificial Sequence
  MKO10052231_A_Svs4
  gRNA
agccauugggaagaaaacua

SEQ ID NO: 52232 - RNA, 20 nt, Artificial Sequence
  MKO10052232_A_Svs5
  gRNA
gaacacguuauuugaguauc

SEQ ID NO: 52233 - RNA, 20 nt, Artificial Sequence
  MKO10052233_A_Svs5
  gRNA
agcagcgaaaugaguaguuc

SEQ ID NO: 52234 - RNA, 20 nt, Artificial Sequence
  MKO10052234_A_Svs5
  gRNA
ccuuacauugcuccucguuc

SEQ ID NO: 52235 - RNA, 20 nt, Artificial Sequence
  MKO10052235_A_Svs6
  gRNA
agauagagcggucuuacuug

SEQ ID NO: 52236 - RNA, 20 nt, Artificial Sequence
  MKO10052236_A_Svs6
  gRNA
ccuuacaaugcuccuuguuc

SEQ ID NO: 52237 - RNA, 20 nt, Artificial Sequence
  MKO10052237_A_Svs6
  gRNA
uuuccucauaaaccuccuca

SEQ ID NO: 52238 - RNA, 20 nt, Artificial Sequence
  MKO10052238_A_Swap70
  gRNA
cagauccucgcucacauagu

SEQ ID NO: 52239 - RNA, 20 nt, Artificial Sequence
  MKO10052239_A_Swap70
  gRNA
cucauugaagacuucguuaa

SEQ ID NO: 52240 - RNA, 20 nt, Artificial Sequence
  MKO10052240_A_Swap70
  gRNA
ucuucuggcacaauaauuag

SEQ ID NO: 52241 - RNA, 20 nt, Artificial Sequence
  MKO10052241_A_Swi5
  gRNA
ugagaauaacgaugucagcg

SEQ ID NO: 52242 - RNA, 20 nt, Artificial Sequence
  MKO10052242_A_Swi5
  gRNA
gaagcaugacaugcuggaca

SEQ ID NO: 52243 - RNA, 20 nt, Artificial Sequence
  MKO10052243_A_Swi5
  gRNA
uuucuuucagcugugacucg

SEQ ID NO: 52244 - RNA, 20 nt, Artificial Sequence
  MKO10052244_A_Swsap1
  gRNA
ccguccucuucgugacgcga

SEQ ID NO: 52245 - RNA, 20 nt, Artificial Sequence
  MKO10052245_A_Swsap1
  gRNA
cgcuuaaguaauggcagaug

SEQ ID NO: 52246 - RNA, 20 nt, Artificial Sequence
  MKO10052246_A_Swsap1
  gRNA
ccuucgcgucacgaagagga

SEQ ID NO: 52247 - RNA, 20 nt, Artificial Sequence
  MKO10052247_A_Swt1
  gRNA
aacgaguaguuccgauucua

SEQ ID NO: 52248 - RNA, 20 nt, Artificial Sequence
  MKO10052248_A_Swt1
  gRNA
uauuuaaauaugauaccgcu

SEQ ID NO: 52249 - RNA, 20 nt, Artificial Sequence
  MKO10052249_A_Swt1
  gRNA
gguucuacuaguucagaaca

SEQ ID NO: 52250 - RNA, 20 nt, Artificial Sequence
  MKO10052250_A_Syap1
  gRNA
ucagacaaucaagaaauccg

SEQ ID NO: 52251 - RNA, 20 nt, Artificial Sequence
  MKO10052251_A_Syap1
  gRNA
aaguuaaacugcacaccagc

SEQ ID NO: 52252 - RNA, 20 nt, Artificial Sequence
  MKO10052252_A_Syap1
  gRNA
aauagaugauauccuugaca

SEQ ID NO: 52253 - RNA, 20 nt, Artificial Sequence
  MKO10052253_A_Sybu
  gRNA
ucuucacaggcgauaccgac

SEQ ID NO: 52254 - RNA, 20 nt, Artificial Sequence
  MKO10052254_A_Sybu
  gRNA
cugagcgccgacuccaugag

SEQ ID NO: 52255 - RNA, 20 nt, Artificial Sequence
  MKO10052255_A_Sybu
  gRNA
gcuccauugcuccgcccaug

SEQ ID NO: 52256 - RNA, 20 nt, Artificial Sequence
  MKO10052256_A_Syce1l
  gRNA
ggccgcaucucugaauacga

SEQ ID NO: 52257 - RNA, 20 nt, Artificial Sequence
  MKO10052257_A_Syce1l
  gRNA
gccuuugauggcggaguggc

SEQ ID NO: 52258 - RNA, 20 nt, Artificial Sequence
  MKO10052258_A_Syce1l
  gRNA
cuugcugcagcucauuaaug

SEQ ID NO: 52259 - RNA, 20 nt, Artificial Sequence
  MKO10052259_A_Syce1
  gRNA
uuaaucaggaccucaauccg

SEQ ID NO: 52260 - RNA, 20 nt, Artificial Sequence
  MKO10052260_A_Syce1
  gRNA
ccugauuaaccguauuaaug

SEQ ID NO: 52261 - RNA, 20 nt, Artificial Sequence
  MKO10052261_A_Syce1
  gRNA
ugaagagaaaguacgucuga

SEQ ID NO: 52262 - RNA, 20 nt, Artificial Sequence
  MKO10052262_A_Syce2
  gRNA
aaagacggaauggagcgcca

SEQ ID NO: 52263 - RNA, 20 nt, Artificial Sequence
  MKO10052263_A_Syce2
  gRNA
ucuccgcucuccacaaucgc

SEQ ID NO: 52264 - RNA, 20 nt, Artificial Sequence
  MKO10052264_A_Syce2
  gRNA
gcagguggccgcgccucccg

SEQ ID NO: 52265 - RNA, 20 nt, Artificial Sequence
  MKO10052265_A_Syce3
  gRNA
ggcgucuucuagccggcgca

SEQ ID NO: 52266 - RNA, 20 nt, Artificial Sequence
  MKO10052266_A_Syce3
  gRNA
uagauggcugauuccgaucc

SEQ ID NO: 52267 - RNA, 20 nt, Artificial Sequence
  MKO10052267_A_Syce3
  gRNA
cacuagcagaguccaugcgc

SEQ ID NO: 52268 - RNA, 20 nt, Artificial Sequence
  MKO10052268_A_Sycn
  gRNA
cgccuggaagaguaccgcaa

SEQ ID NO: 52269 - RNA, 20 nt, Artificial Sequence
  MKO10052269_A_Sycn
  gRNA
gucuaacacugcaucgucuc

SEQ ID NO: 52270 - RNA, 20 nt, Artificial Sequence
  MKO10052270_A_Sycn
  gRNA
cgggcaccgggcaauugcca

SEQ ID NO: 52271 - RNA, 20 nt, Artificial Sequence
  MKO10052271_A_Sycp1
  gRNA
cuuacuaaccuguucgagca

SEQ ID NO: 52272 - RNA, 20 nt, Artificial Sequence
  MKO10052272_A_Sycp1
  gRNA
agcccagcgaaaagccauuc

SEQ ID NO: 52273 - RNA, 20 nt, Artificial Sequence
  MKO10052273_A_Sycp1
  gRNA
uuauaccugaaguuccugaa

SEQ ID NO: 52274 - RNA, 20 nt, Artificial Sequence
  MKO10052274_A_Sycp2
  gRNA
caaacaauuccuccgcaagu

SEQ ID NO: 52275 - RNA, 20 nt, Artificial Sequence
  MKO10052275_A_Sycp2
  gRNA
auuuguaaaagugccaacaa

SEQ ID NO: 52276 - RNA, 20 nt, Artificial Sequence
  MKO10052276_A_Sycp2
  gRNA
ucaagcaucuugauaucuau

SEQ ID NO: 52277 - RNA, 20 nt, Artificial Sequence
  MKO10052277_A_Sycp3
  gRNA
gcugggauaauugaagaugu

SEQ ID NO: 52278 - RNA, 20 nt, Artificial Sequence
  MKO10052278_A_Sycp3
  gRNA
gaaaucugggaagccaccuu

SEQ ID NO: 52279 - RNA, 20 nt, Artificial Sequence
  MKO10052279_A_Sycp3
  gRNA
gcuccaguaauugauaaaca

SEQ ID NO: 52280 - RNA, 20 nt, Artificial Sequence
  MKO10052280_A_Syde1
  gRNA
uuacgccaagcuaacauugu

SEQ ID NO: 52281 - RNA, 20 nt, Artificial Sequence
  MKO10052281_A_Syde1
  gRNA
aagucugguccgcuucgaag

SEQ ID NO: 52282 - RNA, 20 nt, Artificial Sequence
  MKO10052282_A_Syde1
  gRNA
agccuaagaaguacucgcac

SEQ ID NO: 52283 - RNA, 20 nt, Artificial Sequence
  MKO10052283_A_Syde2
  gRNA
cgcaucauuguccucgcuaa

SEQ ID NO: 52284 - RNA, 20 nt, Artificial Sequence
  MKO10052284_A_Syde2
  gRNA
guaccggcuuaucacguucc

SEQ ID NO: 52285 - RNA, 20 nt, Artificial Sequence
  MKO10052285_A_Syde2
  gRNA
cuccgaacaucaccgcuucg

SEQ ID NO: 52286 - RNA, 20 nt, Artificial Sequence
  MKO10052286_A_Syf2
  gRNA
gcuuggucagccggugauac

SEQ ID NO: 52287 - RNA, 20 nt, Artificial Sequence
  MKO10052287_A_Syf2
  gRNA
ugaucgcagguccccgcgga

SEQ ID NO: 52288 - RNA, 20 nt, Artificial Sequence
  MKO10052288_A_Syf2
  gRNA
agcucguaagcugaaucacc

SEQ ID NO: 52289 - RNA, 20 nt, Artificial Sequence
  MKO10052289_A_Syk
  gRNA
uauugcacuaccgcauugac

SEQ ID NO: 52290 - RNA, 20 nt, Artificial Sequence
  MKO10052290_A_Syk
  gRNA
aagcccaaaugcccaucccg

SEQ ID NO: 52291 - RNA, 20 nt, Artificial Sequence
  MKO10052291_A_Syk
  gRNA
auaggagccgcuguugucuc

SEQ ID NO: 52292 - RNA, 20 nt, Artificial Sequence
  MKO10052292_A_Sympk
  gRNA
caucccgcaauagcauguug

SEQ ID NO: 52293 - RNA, 20 nt, Artificial Sequence
  MKO10052293_A_Sympk
  gRNA
gaagugcgcaaguuugucau

SEQ ID NO: 52294 - RNA, 20 nt, Artificial Sequence
  MKO10052294_A_Sympk
  gRNA
ccaaccucaacaugcuauug

SEQ ID NO: 52295 - RNA, 20 nt, Artificial Sequence
  MKO10052295_A_Syn1
  gRNA
cuucucgucgcugucuaacg

SEQ ID NO: 52296 - RNA, 20 nt, Artificial Sequence
  MKO10052296_A_Syn1
  gRNA
ccaugaaguugcuguccgac

SEQ ID NO: 52297 - RNA, 20 nt, Artificial Sequence
  MKO10052297_A_Syn1
  gRNA
uaauggagacuaccgaaguu

SEQ ID NO: 52298 - RNA, 20 nt, Artificial Sequence
  MKO10052298_A_Syn2
  gRNA
ccccggugccgcuacggcgu

SEQ ID NO: 52299 - RNA, 20 nt, Artificial Sequence
  MKO10052299_A_Syn2
  gRNA
cuucagcucgcugucgcaag

SEQ ID NO: 52300 - RNA, 20 nt, Artificial Sequence
  MKO10052300_A_Syn2
  gRNA
gguacuucggaauggcacaa

SEQ ID NO: 52301 - RNA, 20 nt, Artificial Sequence
  MKO10052301_A_Syn3
  gRNA
aucgauaaccaacaagaucc

SEQ ID NO: 52302 - RNA, 20 nt, Artificial Sequence
  MKO10052302_A_Syn3
  gRNA
uaccacguaccuguuccacu

SEQ ID NO: 52303 - RNA, 20 nt, Artificial Sequence
  MKO10052303_A_Syn3
  gRNA
uggcgacauugagauccgag

SEQ ID NO: 52304 - RNA, 20 nt, Artificial Sequence
  MKO10052304_A_Syna
  gRNA
ucgaauuguccggcucgaau

SEQ ID NO: 52305 - RNA, 20 nt, Artificial Sequence
  MKO10052305_A_Syna
  gRNA
cuaugcauucgccccauuaa

SEQ ID NO: 52306 - RNA, 20 nt, Artificial Sequence
  MKO10052306_A_Syna
  gRNA
uacccgcgaugccuaacccc

SEQ ID NO: 52307 - RNA, 20 nt, Artificial Sequence
  MKO10052307_A_Synb
  gRNA
aaagcaccaugacaggcuuu

SEQ ID NO: 52308 - RNA, 20 nt, Artificial Sequence
  MKO10052308_A_Synb
  gRNA
aaucugcccaacgcccucuc

SEQ ID NO: 52309 - RNA, 20 nt, Artificial Sequence
  MKO10052309_A_Synb
  gRNA
cgaguucagaugcucguucu

SEQ ID NO: 52310 - RNA, 20 nt, Artificial Sequence
  MKO10052310_A_Syncrip
  gRNA
cagugaucucucucauguuc

SEQ ID NO: 52311 - RNA, 20 nt, Artificial Sequence
  MKO10052311_A_Syncrip
  gRNA
uuuaccucagugccaacaga

SEQ ID NO: 52312 - RNA, 20 nt, Artificial Sequence
  MKO10052312_A_Syncrip
  gRNA
accuuaaucuuugccucauc

SEQ ID NO: 52313 - RNA, 20 nt, Artificial Sequence
  MKO10052313_A_Sync
  gRNA
cacuguuuaucgacgaaucg

SEQ ID NO: 52314 - RNA, 20 nt, Artificial Sequence
  MKO10052314_A_Sync
  gRNA
ucaaccgauucccaacaccg

SEQ ID NO: 52315 - RNA, 20 nt, Artificial Sequence
  MKO10052315_A_Sync
  gRNA
ggagucgaggcacaaucccc

SEQ ID NO: 52316 - RNA, 20 nt, Artificial Sequence
  MKO10052316_A_Syndig1l
  gRNA
uccucugcaggucccgcuaa

SEQ ID NO: 52317 - RNA, 20 nt, Artificial Sequence
  MKO10052317_A_Syndig1l
  gRNA
caacuccucuugaaccccgu

SEQ ID NO: 52318 - RNA, 20 nt, Artificial Sequence
  MKO10052318_A_Syndig1l
  gRNA
gucuucacacucacucucgc

SEQ ID NO: 52319 - RNA, 20 nt, Artificial Sequence
  MKO10052319_A_Syndig1
  gRNA
cuaguggccagugcggcacc

SEQ ID NO: 52320 - RNA, 20 nt, Artificial Sequence
  MKO10052320_A_Syndig1
  gRNA
gcaguccuguccauuacuau

SEQ ID NO: 52321 - RNA, 20 nt, Artificial Sequence
  MKO10052321_A_Syndig1
  gRNA
gaugccaguuccaauaguaa

SEQ ID NO: 52322 - RNA, 20 nt, Artificial Sequence
  MKO10052322_A_Syne1
  gRNA
cagcaugaauacgcuucacc

SEQ ID NO: 52323 - RNA, 20 nt, Artificial Sequence
  MKO10052323_A_Syne1
  gRNA
aaccggugauccucuguaca

SEQ ID NO: 52324 - RNA, 20 nt, Artificial Sequence
  MKO10052324_A_Syne1
  gRNA
ggugaagcguauucaugcug

SEQ ID NO: 52325 - RNA, 20 nt, Artificial Sequence
  MKO10052325_A_Syne2
  gRNA
guauuagauccuuuaucccg

SEQ ID NO: 52326 - RNA, 20 nt, Artificial Sequence
  MKO10052326_A_Syne2
  gRNA
uuaccaacugcugucccgag

SEQ ID NO: 52327 - RNA, 20 nt, Artificial Sequence
  MKO10052327_A_Syne2
  gRNA
ccauuauccuuggccugauc

SEQ ID NO: 52328 - RNA, 20 nt, Artificial Sequence
  MKO10052328_A_Syne3
  gRNA
acuucgucucucuacgcugc

SEQ ID NO: 52329 - RNA, 20 nt, Artificial Sequence
  MKO10052329_A_Syne3
  gRNA
caucccacagucgcaucgag

SEQ ID NO: 52330 - RNA, 20 nt, Artificial Sequence
  MKO10052330_A_Syne3
  gRNA
ggcugaguacgaugccguga

SEQ ID NO: 52331 - RNA, 20 nt, Artificial Sequence
  MKO10052331_A_Syne4
  gRNA
caaugcauccacgcgcucag

SEQ ID NO: 52332 - RNA, 20 nt, Artificial Sequence
  MKO10052332_A_Syne4
  gRNA
aggccuugggucuuggacgc

SEQ ID NO: 52333 - RNA, 20 nt, Artificial Sequence
  MKO10052333_A_Syne4
  gRNA
gcaucuggacaauccuguug

SEQ ID NO: 52334 - RNA, 20 nt, Artificial Sequence
  MKO10052334_A_Syngap1
  gRNA
acccccuucugauccgcgac

SEQ ID NO: 52335 - RNA, 20 nt, Artificial Sequence
  MKO10052335_A_Syngap1
  gRNA
cauuccccguacgaucgucc

SEQ ID NO: 52336 - RNA, 20 nt, Artificial Sequence
  MKO10052336_A_Syngap1
  gRNA
uuccagccaggacgaucgua

SEQ ID NO: 52337 - RNA, 20 nt, Artificial Sequence
  MKO10052337_A_Syngr1
  gRNA
cuucggcucuaucgugaacg

SEQ ID NO: 52338 - RNA, 20 nt, Artificial Sequence
  MKO10052338_A_Syngr1
  gRNA
uuacccaagacacgacgcgc

SEQ ID NO: 52339 - RNA, 20 nt, Artificial Sequence
  MKO10052339_A_Syngr1
  gRNA
guaggggucgaaggcgcccc

SEQ ID NO: 52340 - RNA, 20 nt, Artificial Sequence
  MKO10052340_A_Syngr2
  gRNA
ugccgcuacggcagcgccau

SEQ ID NO: 52341 - RNA, 20 nt, Artificial Sequence
  MKO10052341_A_Syngr2
  gRNA
gccuauggcgcggccaacgc

SEQ ID NO: 52342 - RNA, 20 nt, Artificial Sequence
  MKO10052342_A_Syngr2
  gRNA
guagcccucgccgaagaugc

SEQ ID NO: 52343 - RNA, 20 nt, Artificial Sequence
  MKO10052343_A_Syngr3
  gRNA
guucggaccgauugucaacg

SEQ ID NO: 52344 - RNA, 20 nt, Artificial Sequence
  MKO10052344_A_Syngr3
  gRNA
acguagcccucguugacaau

SEQ ID NO: 52345 - RNA, 20 nt, Artificial Sequence
  MKO10052345_A_Syngr3
  gRNA
ccagguggcgcucaccguga

SEQ ID NO: 52346 - RNA, 20 nt, Artificial Sequence
  MKO10052346_A_Syngr4
  gRNA
aguccccuacaagcgcuccc

SEQ ID NO: 52347 - RNA, 20 nt, Artificial Sequence
  MKO10052347_A_Syngr4
  gRNA
ucuuaaagcgggugcccacg

SEQ ID NO: 52348 - RNA, 20 nt, Artificial Sequence
  MKO10052348_A_Syngr4
  gRNA
ccccuacaugacgacuccaa

SEQ ID NO: 52349 - RNA, 20 nt, Artificial Sequence
  MKO10052349_A_Synj1
  gRNA
guccggggaaccaacgauga

SEQ ID NO: 52350 - RNA, 20 nt, Artificial Sequence
  MKO10052350_A_Synj1
  gRNA
acggugggggauccaauuug

SEQ ID NO: 52351 - RNA, 20 nt, Artificial Sequence
  MKO10052351_A_Synj1
  gRNA
aagagcacacaaccgacaau

SEQ ID NO: 52352 - RNA, 20 nt, Artificial Sequence
  MKO10052352_A_Synj2bp
  gRNA
cuacgucagccguaucaaag

SEQ ID NO: 52353 - RNA, 20 nt, Artificial Sequence
  MKO10052353_A_Synj2bp
  gRNA
caguaugucuccaacgacag

SEQ ID NO: 52354 - RNA, 20 nt, Artificial Sequence
  MKO10052354_A_Synj2bp
  gRNA
cuacccugugcuguacucuc

SEQ ID NO: 52355 - RNA, 20 nt, Artificial Sequence
  MKO10052355_A_Synj2
  gRNA
cgcaucagcugugaacgcgc

SEQ ID NO: 52356 - RNA, 20 nt, Artificial Sequence
  MKO10052356_A_Synj2
  gRNA
acccguggugugaacgauga

SEQ ID NO: 52357 - RNA, 20 nt, Artificial Sequence
  MKO10052357_A_Synj2
  gRNA
ugugcugcagacgauuuaca

SEQ ID NO: 52358 - RNA, 20 nt, Artificial Sequence
  MKO10052358_A_Synm
  gRNA
gggcucguagaucucgcacu

SEQ ID NO: 52359 - RNA, 20 nt, Artificial Sequence
  MKO10052359_A_Synm
  gRNA
cagcgcgucgcgcucgcccu

SEQ ID NO: 52360 - RNA, 20 nt, Artificial Sequence
  MKO10052360_A_Synm
  gRNA
gcucacggcgugucucaccg

SEQ ID NO: 52361 - RNA, 20 nt, Artificial Sequence
  MKO10052361_A_Synpo2l
  gRNA
gaugcgcugcucccgaacgc

SEQ ID NO: 52362 - RNA, 20 nt, Artificial Sequence
  MKO10052362_A_Synpo2l
  gRNA
acuaagaaacucugcgcgcc

SEQ ID NO: 52363 - RNA, 20 nt, Artificial Sequence
  MKO10052363_A_Synpo2l
  gRNA
gacgcccugaggcgucgaug

SEQ ID NO: 52364 - RNA, 20 nt, Artificial Sequence
  MKO10052364_A_Synpo2
  gRNA
gacuugucacacuccgcguu

SEQ ID NO: 52365 - RNA, 20 nt, Artificial Sequence
  MKO10052365_A_Synpo2
  gRNA
gcgucauccacuagaccgag

SEQ ID NO: 52366 - RNA, 20 nt, Artificial Sequence
  MKO10052366_A_Synpo2
  gRNA
acuuacgagcauggcgugca

SEQ ID NO: 52367 - RNA, 20 nt, Artificial Sequence
  MKO10052367_A_Synpo
  gRNA
cgacgugucucucgacuccg

SEQ ID NO: 52368 - RNA, 20 nt, Artificial Sequence
  MKO10052368_A_Synpo
  gRNA
gacggagcgcucgcuccacg

SEQ ID NO: 52369 - RNA, 20 nt, Artificial Sequence
  MKO10052369_A_Synpo
  gRNA
gaagaaucuauggcacgccg

SEQ ID NO: 52370 - RNA, 20 nt, Artificial Sequence
  MKO10052370_A_Synpr
  gRNA
uagcguuugcguacccauuc

SEQ ID NO: 52371 - RNA, 20 nt, Artificial Sequence
  MKO10052371_A_Synpr
  gRNA
uguacacgaccguggcagcc

SEQ ID NO: 52372 - RNA, 20 nt, Artificial Sequence
  MKO10052372_A_Synpr
  gRNA
acaaguaccgcgaaaacaac

SEQ ID NO: 52373 - RNA, 20 nt, Artificial Sequence
  MKO10052373_A_Synrg
  gRNA
gcaaguaccugcauugcaau

SEQ ID NO: 52374 - RNA, 20 nt, Artificial Sequence
  MKO10052374_A_Synrg
  gRNA
ggucucauuccgccugcaac

SEQ ID NO: 52375 - RNA, 20 nt, Artificial Sequence
  MKO10052375_A_Synrg
  gRNA
uucuugagcaugcguccugc

SEQ ID NO: 52376 - RNA, 20 nt, Artificial Sequence
  MKO10052376_A_Sypl2
  gRNA
cuccccgcuguaagagccgc

SEQ ID NO: 52377 - RNA, 20 nt, Artificial Sequence
  MKO10052377_A_Sypl2
  gRNA
agagaacaaacgcuucccgu

SEQ ID NO: 52378 - RNA, 20 nt, Artificial Sequence
  MKO10052378_A_Sypl2
  gRNA
guccugcggcucuuacagcg

SEQ ID NO: 52379 - RNA, 20 nt, Artificial Sequence
  MKO10052379_A_Sypl
  gRNA
cacuuaccacggauacauuc

SEQ ID NO: 52380 - RNA, 20 nt, Artificial Sequence
  MKO10052380_A_Sypl
  gRNA
uaacaugacacuccugauuc

SEQ ID NO: 52381 - RNA, 20 nt, Artificial Sequence
  MKO10052381_A_Sypl
  gRNA
gaucaaccucaacccgcuca

SEQ ID NO: 52382 - RNA, 20 nt, Artificial Sequence
  MKO10052382_A_Syp
  gRNA
ucgaauuugaguacccauuc

SEQ ID NO: 52383 - RNA, 20 nt, Artificial Sequence
  MKO10052383_A_Syp
  gRNA
agugcccccuuuaacgcagg

SEQ ID NO: 52384 - RNA, 20 nt, Artificial Sequence
  MKO10052384_A_Syp
  gRNA
guagcugccgcacguagcaa

SEQ ID NO: 52385 - RNA, 20 nt, Artificial Sequence
  MKO10052385_A_Sys1
  gRNA
gcaugaguacgaucugcgac

SEQ ID NO: 52386 - RNA, 20 nt, Artificial Sequence
  MKO10052386_A_Sys1
  gRNA
uuaccuccgcgucgaacauc

SEQ ID NO: 52387 - RNA, 20 nt, Artificial Sequence
  MKO10052387_A_Sys1
  gRNA
ggaguaccugugcaugcgga

SEQ ID NO: 52388 - RNA, 20 nt, Artificial Sequence
  MKO10052388_A_Syt10
  gRNA
aaacgagaacgagcaucggg

SEQ ID NO: 52389 - RNA, 20 nt, Artificial Sequence
  MKO10052389_A_Syt10
  gRNA
uuaaagucuuccggugcacg

SEQ ID NO: 52390 - RNA, 20 nt, Artificial Sequence
  MKO10052390_A_Syt10
  gRNA
ccgagccuacgucuucaucc

SEQ ID NO: 52391 - RNA, 20 nt, Artificial Sequence
  MKO10052391_A_Syt11
  gRNA
uucacucgaugccgcuuguc

SEQ ID NO: 52392 - RNA, 20 nt, Artificial Sequence
  MKO10052392_A_Syt11
  gRNA
ccgaugaggccagccgcuac

SEQ ID NO: 52393 - RNA, 20 nt, Artificial Sequence
  MKO10052393_A_Syt11
  gRNA
cgaucgcacuacuaagaaug

SEQ ID NO: 52394 - RNA, 20 nt, Artificial Sequence
  MKO10052394_A_Syt12
  gRNA
augcccacgaucuguucguc

SEQ ID NO: 52395 - RNA, 20 nt, Artificial Sequence
  MKO10052395_A_Syt12
  gRNA
cguucccuaauuacgacuac

SEQ ID NO: 52396 - RNA, 20 nt, Artificial Sequence
  MKO10052396_A_Syt12
  gRNA
guccccgaguagugguccgc

SEQ ID NO: 52397 - RNA, 20 nt, Artificial Sequence
  MKO10052397_A_Syt13
  gRNA
ugguccccggccagccguga

SEQ ID NO: 52398 - RNA, 20 nt, Artificial Sequence
  MKO10052398_A_Syt13
  gRNA
caacuacgcagacuacaccu

SEQ ID NO: 52399 - RNA, 20 nt, Artificial Sequence
  MKO10052399_A_Syt13
  gRNA
agaagcggucacaggugcgc

SEQ ID NO: 52400 - RNA, 20 nt, Artificial Sequence
  MKO10052400_A_Syt14
  gRNA
acccgucguacucugcagac

SEQ ID NO: 52401 - RNA, 20 nt, Artificial Sequence
  MKO10052401_A_Syt14
  gRNA
ccccugucugcagaguacga

SEQ ID NO: 52402 - RNA, 20 nt, Artificial Sequence
  MKO10052402_A_Syt14
  gRNA
ccgccuuaccaagacgacag

SEQ ID NO: 52403 - RNA, 20 nt, Artificial Sequence
  MKO10052403_A_Syt15
  gRNA
uggaggaagcgccguucauc

SEQ ID NO: 52404 - RNA, 20 nt, Artificial Sequence
  MKO10052404_A_Syt15
  gRNA
uugcgccaccuucaccuaug

SEQ ID NO: 52405 - RNA, 20 nt, Artificial Sequence
  MKO10052405_A_Syt15
  gRNA
cuucucaccaaggucgagac

SEQ ID NO: 52406 - RNA, 20 nt, Artificial Sequence
  MKO10052406_A_Syt16
  gRNA
caucugcacaaggacgaccg

SEQ ID NO: 52407 - RNA, 20 nt, Artificial Sequence
  MKO10052407_A_Syt16
  gRNA
cauccauacccggagcaacg

SEQ ID NO: 52408 - RNA, 20 nt, Artificial Sequence
  MKO10052408_A_Syt16
  gRNA
augggcaugguccgaagccu

SEQ ID NO: 52409 - RNA, 20 nt, Artificial Sequence
  MKO10052409_A_Syt17
  gRNA
agucaucgggcguguagguc

SEQ ID NO: 52410 - RNA, 20 nt, Artificial Sequence
  MKO10052410_A_Syt17
  gRNA
ccucgaucacccucacggug

SEQ ID NO: 52411 - RNA, 20 nt, Artificial Sequence
  MKO10052411_A_Syt17
  gRNA
aauuaacccaccucguucag

SEQ ID NO: 52412 - RNA, 20 nt, Artificial Sequence
  MKO10052412_A_Syt1
  gRNA
cgcgccacuccucggugacg

SEQ ID NO: 52413 - RNA, 20 nt, Artificial Sequence
  MKO10052413_A_Syt1
  gRNA
gacuagaaggaccgcaacua

SEQ ID NO: 52414 - RNA, 20 nt, Artificial Sequence
  MKO10052414_A_Syt1
  gRNA
uuggccacgucaccgaggag

SEQ ID NO: 52415 - RNA, 20 nt, Artificial Sequence
  MKO10052415_A_Syt2
  gRNA
uuggccagcccaucgaggaa

SEQ ID NO: 52416 - RNA, 20 nt, Artificial Sequence
  MKO10052416_A_Syt2
  gRNA
ugugucggcagugccccccu

SEQ ID NO: 52417 - RNA, 20 nt, Artificial Sequence
  MKO10052417_A_Syt2
  gRNA
cucuccauuccucgaugggc

SEQ ID NO: 52418 - RNA, 20 nt, Artificial Sequence
  MKO10052418_A_Syt3
  gRNA
guaggauccgcaccacgagc

SEQ ID NO: 52419 - RNA, 20 nt, Artificial Sequence
  MKO10052419_A_Syt3
  gRNA
acuggacccgguggucggcg

SEQ ID NO: 52420 - RNA, 20 nt, Artificial Sequence
  MKO10052420_A_Syt3
  gRNA
cugcgcaaagacuuagcccc

SEQ ID NO: 52421 - RNA, 20 nt, Artificial Sequence
  MKO10052421_A_Syt4
  gRNA
cuugcucaccgaauuccacg

SEQ ID NO: 52422 - RNA, 20 nt, Artificial Sequence
  MKO10052422_A_Syt4
  gRNA
guacagguucacuuugacgu

SEQ ID NO: 52423 - RNA, 20 nt, Artificial Sequence
  MKO10052423_A_Syt4
  gRNA
ggucauggauugcucgucca

SEQ ID NO: 52424 - RNA, 20 nt, Artificial Sequence
  MKO10052424_A_Syt5
  gRNA
ccuccccgauggcaucguug

SEQ ID NO: 52425 - RNA, 20 nt, Artificial Sequence
  MKO10052425_A_Syt5
  gRNA
uucucccgcaacgaugccau

SEQ ID NO: 52426 - RNA, 20 nt, Artificial Sequence
  MKO10052426_A_Syt5
  gRNA
uccgucuccgacagcgcuuc

SEQ ID NO: 52427 - RNA, 20 nt, Artificial Sequence
  MKO10052427_A_Syt6
  gRNA
ccacuuccccgugcccuacg

SEQ ID NO: 52428 - RNA, 20 nt, Artificial Sequence
  MKO10052428_A_Syt6
  gRNA
uauuguguguggcguggccc

SEQ ID NO: 52429 - RNA, 20 nt, Artificial Sequence
  MKO10052429_A_Syt6
  gRNA
cuugauacggccaauacugg

SEQ ID NO: 52430 - RNA, 20 nt, Artificial Sequence
  MKO10052430_A_Syt7
  gRNA
cgaugagucugaccgcagaa

SEQ ID NO: 52431 - RNA, 20 nt, Artificial Sequence
  MKO10052431_A_Syt7
  gRNA
ccacuggugucagcgcaaac

SEQ ID NO: 52432 - RNA, 20 nt, Artificial Sequence
  MKO10052432_A_Syt7
  gRNA
gacggugggcacgccagacu

SEQ ID NO: 52433 - RNA, 20 nt, Artificial Sequence
  MKO10052433_A_Syt8
  gRNA
ugcuauuacgggcacugccc

SEQ ID NO: 52434 - RNA, 20 nt, Artificial Sequence
  MKO10052434_A_Syt8
  gRNA
guugaagguccacggugccc

SEQ ID NO: 52435 - RNA, 20 nt, Artificial Sequence
  MKO10052435_A_Syt8
  gRNA
caugagacaaaggugcaccg

SEQ ID NO: 52436 - RNA, 20 nt, Artificial Sequence
  MKO10052436_A_Syt9
  gRNA
acagcucaaccugucgaacc

SEQ ID NO: 52437 - RNA, 20 nt, Artificial Sequence
  MKO10052437_A_Syt9
  gRNA
uauuaaaguccggguucgac

SEQ ID NO: 52438 - RNA, 20 nt, Artificial Sequence
  MKO10052438_A_Syt9
  gRNA
guggaucuggucgaugcucu

SEQ ID NO: 52439 - RNA, 20 nt, Artificial Sequence
  MKO10052439_A_Sytl1
  gRNA
uccaagaagcgcguucccag

SEQ ID NO: 52440 - RNA, 20 nt, Artificial Sequence
  MKO10052440_A_Sytl1
  gRNA
gccucugggaacgcgcuucu

SEQ ID NO: 52441 - RNA, 20 nt, Artificial Sequence
  MKO10052441_A_Sytl1
  gRNA
cucaccauauguacccucaa

SEQ ID NO: 52442 - RNA, 20 nt, Artificial Sequence
  MKO10052442_A_Sytl2
  gRNA
gaagaugacacagaucccgc

SEQ ID NO: 52443 - RNA, 20 nt, Artificial Sequence
  MKO10052443_A_Sytl2
  gRNA
ggagcaagacgccaucuuaa

SEQ ID NO: 52444 - RNA, 20 nt, Artificial Sequence
  MKO10052444_A_Sytl2
  gRNA
cagugugauugauauguccc

SEQ ID NO: 52445 - RNA, 20 nt, Artificial Sequence
  MKO10052445_A_Sytl3
  gRNA
uucaagguuuccucgaaagu

SEQ ID NO: 52446 - RNA, 20 nt, Artificial Sequence
  MKO10052446_A_Sytl3
  gRNA
acgaguccaaaagaacacgc

SEQ ID NO: 52447 - RNA, 20 nt, Artificial Sequence
  MKO10052447_A_Sytl3
  gRNA
gguguuugggaucuucuuga

SEQ ID NO: 52448 - RNA, 20 nt, Artificial Sequence
  MKO10052448_A_Sytl4
  gRNA
aaucgcuuugauuaccgaac

SEQ ID NO: 52449 - RNA, 20 nt, Artificial Sequence
  MKO10052449_A_Sytl4
  gRNA
agguucgaucacuauagugu

SEQ ID NO: 52450 - RNA, 20 nt, Artificial Sequence
  MKO10052450_A_Sytl4
  gRNA
gugccgagaaugccgaguuc

SEQ ID NO: 52451 - RNA, 20 nt, Artificial Sequence
  MKO10052451_A_Sytl5
  gRNA
ugcagugagugucgagucac

SEQ ID NO: 52452 - RNA, 20 nt, Artificial Sequence
  MKO10052452_A_Sytl5
  gRNA
gaucuccccggucaaagaug

SEQ ID NO: 52453 - RNA, 20 nt, Artificial Sequence
  MKO10052453_A_Sytl5
  gRNA
aggcagcuaaggauuauaag

SEQ ID NO: 52454 - RNA, 20 nt, Artificial Sequence
  MKO10052454_A_Syvn1
  gRNA
guaaagagcgccacaaagcg

SEQ ID NO: 52455 - RNA, 20 nt, Artificial Sequence
  MKO10052455_A_Syvn1
  gRNA
acuuacagacgaugcggcag

SEQ ID NO: 52456 - RNA, 20 nt, Artificial Sequence
  MKO10052456_A_Syvn1
  gRNA
agucucaguaacagcguacc

SEQ ID NO: 52457 - RNA, 20 nt, Artificial Sequence
  MKO10052457_A_Szrd1
  gRNA
uugaagccuugugacccguc

SEQ ID NO: 52458 - RNA, 20 nt, Artificial Sequence
  MKO10052458_A_Szrd1
  gRNA
gcugcugaccacaccguugc

SEQ ID NO: 52459 - RNA, 20 nt, Artificial Sequence
  MKO10052459_A_Szrd1
  gRNA
cucuugaggaugcggaucug

SEQ ID NO: 52460 - RNA, 20 nt, Artificial Sequence
  MKO10052460_A_Szt2
  gRNA
uugucacguagaucuccggc

SEQ ID NO: 52461 - RNA, 20 nt, Artificial Sequence
  MKO10052461_A_Szt2
  gRNA
cuucggccguuucgagugcc

SEQ ID NO: 52462 - RNA, 20 nt, Artificial Sequence
  MKO10052462_A_Szt2
  gRNA
aaucucccgaaauguucgcc

SEQ ID NO: 52463 - RNA, 20 nt, Artificial Sequence
  MKO10052463_A_T2
  gRNA
gaagaacaugagcgacgacg

SEQ ID NO: 52464 - RNA, 20 nt, Artificial Sequence
  MKO10052464_A_T2
  gRNA
ugcagucgcagcccgaagcu

SEQ ID NO: 52465 - RNA, 20 nt, Artificial Sequence
  MKO10052465_A_T2
  gRNA
uuggauccacccaagcaucg

SEQ ID NO: 52466 - RNA, 20 nt, Artificial Sequence
  MKO10052466_A_Taar1
  gRNA
cucugaaugacgcacuguau

SEQ ID NO: 52467 - RNA, 20 nt, Artificial Sequence
  MKO10052467_A_Taar1
  gRNA
ggaagagcuguaucgcaguc

SEQ ID NO: 52468 - RNA, 20 nt, Artificial Sequence
  MKO10052468_A_Taar1
  gRNA
aaucguacgaauguucaagu

SEQ ID NO: 52469 - RNA, 20 nt, Artificial Sequence
  MKO10052469_A_Taar2
  gRNA
gcaucaggucgaagcuauaa

SEQ ID NO: 52470 - RNA, 20 nt, Artificial Sequence
  MKO10052470_A_Taar2
  gRNA
agcugccauguacucguuga

SEQ ID NO: 52471 - RNA, 20 nt, Artificial Sequence
  MKO10052471_A_Taar2
  gRNA
agcagcagccgccuaacgac

SEQ ID NO: 52472 - RNA, 20 nt, Artificial Sequence
  MKO10052472_A_Taar3
  gRNA
auaaaaccggucgaucgcga

SEQ ID NO: 52473 - RNA, 20 nt, Artificial Sequence
  MKO10052473_A_Taar3
  gRNA
gcggacacggaaagagcgau

SEQ ID NO: 52474 - RNA, 20 nt, Artificial Sequence
  MKO10052474_A_Taar3
  gRNA
ugugcuccaucgcgaucgac

SEQ ID NO: 52475 - RNA, 20 nt, Artificial Sequence
  MKO10052475_A_Taar4
  gRNA
acgucacccaaaucacgacc

SEQ ID NO: 52476 - RNA, 20 nt, Artificial Sequence
  MKO10052476_A_Taar4
  gRNA
gaaguaccagcaugacucga

SEQ ID NO: 52477 - RNA, 20 nt, Artificial Sequence
  MKO10052477_A_Taar4
  gRNA
cgaugaauacacccgacccc

SEQ ID NO: 52478 - RNA, 20 nt, Artificial Sequence
  MKO10052478_A_Taar5
  gRNA
gccuacagcguucugcuacc

SEQ ID NO: 52479 - RNA, 20 nt, Artificial Sequence
  MKO10052479_A_Taar5
  gRNA
cauccaggucgucaucuauc

SEQ ID NO: 52480 - RNA, 20 nt, Artificial Sequence
  MKO10052480_A_Taar5
  gRNA
cguguggagcacuuuaaagu

SEQ ID NO: 52481 - RNA, 20 nt, Artificial Sequence
  MKO10052481_A_Taar6
  gRNA
gacagcccccuacgcaguug

SEQ ID NO: 52482 - RNA, 20 nt, Artificial Sequence
  MKO10052482_A_Taar6
  gRNA
agcggcgcuguguucuacac

SEQ ID NO: 52483 - RNA, 20 nt, Artificial Sequence
  MKO10052483_A_Taar6
  gRNA
gugaaaacccccuacucucc

SEQ ID NO: 52484 - RNA, 20 nt, Artificial Sequence
  MKO10052484_A_Taar7a
  gRNA
auccuccagcccagcuucgu

SEQ ID NO: 52485 - RNA, 20 nt, Artificial Sequence
  MKO10052485_A_Taar7a
  gRNA
aguaauauacauggacaaau

SEQ ID NO: 52486 - RNA, 20 nt, Artificial Sequence
  MKO10052486_A_Taar7a
  gRNA
gccagugacaaugagcuuga

SEQ ID NO: 52487 - RNA, 20 nt, Artificial Sequence
  MKO10052487_A_Taar7b
  gRNA
aaaacccauaaaugguggac

SEQ ID NO: 52488 - RNA, 20 nt, Artificial Sequence
  MKO10052488_A_Taar7b
  gRNA
cagagaacauaucacugcuc

SEQ ID NO: 52489 - RNA, 20 nt, Artificial Sequence
  MKO10052489_A_Taar7b
  gRNA
gucaggagcccauauucccc

SEQ ID NO: 52490 - RNA, 20 nt, Artificial Sequence
  MKO10052490_A_Taar7d
  gRNA
augacccuucaaagcaagaa

SEQ ID NO: 52491 - RNA, 20 nt, Artificial Sequence
  MKO10052491_A_Taar7d
  gRNA
auccuccagcccagcaucau

SEQ ID NO: 52492 - RNA, 20 nt, Artificial Sequence
  MKO10052492_A_Taar7d
  gRNA
uccugacacaggaucuguuc

SEQ ID NO: 52493 - RNA, 20 nt, Artificial Sequence
  MKO10052493_A_Taar7e
  gRNA
cacuugcuccuguguaaaua

SEQ ID NO: 52494 - RNA, 20 nt, Artificial Sequence
  MKO10052494_A_Taar7e
  gRNA
auagcugauggacagaagcc

SEQ ID NO: 52495 - RNA, 20 nt, Artificial Sequence
  MKO10052495_A_Taar7e
  gRNA
acaagugcaucacuuucucc

SEQ ID NO: 52496 - RNA, 20 nt, Artificial Sequence
  MKO10052496_A_Taar7f
  gRNA
uauugcagucagugaccccc

SEQ ID NO: 52497 - RNA, 20 nt, Artificial Sequence
  MKO10052497_A_Taar7f
  gRNA
aaaacccauagcugauggac

SEQ ID NO: 52498 - RNA, 20 nt, Artificial Sequence
  MKO10052498_A_Taar7f
  gRNA
ugagaaguugauaaagaccc

SEQ ID NO: 52499 - RNA, 20 nt, Artificial Sequence
  MKO10052499_A_Taar8a
  gRNA
agucuugauugauaacaauu

SEQ ID NO: 52500 - RNA, 20 nt, Artificial Sequence
  MKO10052500_A_Taar8a
  gRNA
cccauacacaauugacgcau

SEQ ID NO: 52501 - RNA, 20 nt, Artificial Sequence
  MKO10052501_A_Taar8a
  gRNA
guaagugcucuaaauugugu

SEQ ID NO: 52502 - RNA, 20 nt, Artificial Sequence
  MKO10052502_A_Taar8b
  gRNA
agucuugauugacaacgauu

SEQ ID NO: 52503 - RNA, 20 nt, Artificial Sequence
  MKO10052503_A_Taar8b
  gRNA
aaaucguugucaaucaagac

SEQ ID NO: 52504 - RNA, 20 nt, Artificial Sequence
  MKO10052504_A_Taar8b
  gRNA
cccauacacaauugacucau

SEQ ID NO: 52505 - RNA, 20 nt, Artificial Sequence
  MKO10052505_A_Taar8c
  gRNA
cccauacacaauugaugcau

SEQ ID NO: 52506 - RNA, 20 nt, Artificial Sequence
  MKO10052506_A_Taar8c
  gRNA
agucuugauugacaacaacu

SEQ ID NO: 52507 - RNA, 20 nt, Artificial Sequence
  MKO10052507_A_Taar8c
  gRNA
aaguuguugucaaucaagac

SEQ ID NO: 52508 - RNA, 20 nt, Artificial Sequence
  MKO10052508_A_Taar9
  gRNA
aauaucucauagacguacgc

SEQ ID NO: 52509 - RNA, 20 nt, Artificial Sequence
  MKO10052509_A_Taar9
  gRNA
gcugccauacauuauugaug

SEQ ID NO: 52510 - RNA, 20 nt, Artificial Sequence
  MKO10052510_A_Taar9
  gRNA
uuaaaagcucuuacgcaccc

SEQ ID NO: 52511 - RNA, 20 nt, Artificial Sequence
  MKO10052511_A_Tab1
  gRNA
caaccgcgugaccaacuuug

SEQ ID NO: 52512 - RNA, 20 nt, Artificial Sequence
  MKO10052512_A_Tab1
  gRNA
agccauugaagaccccguac

SEQ ID NO: 52513 - RNA, 20 nt, Artificial Sequence
  MKO10052513_A_Tab1
  gRNA
aguuguuuaccuccggcagc

SEQ ID NO: 52514 - RNA, 20 nt, Artificial Sequence
  MKO10052514_A_Tab2
  gRNA
uaacacuuacugacgguauc

SEQ ID NO: 52515 - RNA, 20 nt, Artificial Sequence
  MKO10052515_A_Tab2
  gRNA
ggaguaguuggcgaacugau

SEQ ID NO: 52516 - RNA, 20 nt, Artificial Sequence
  MKO10052516_A_Tab2
  gRNA
cucugcaacgucuccucgag

SEQ ID NO: 52517 - RNA, 20 nt, Artificial Sequence
  MKO10052517_A_Tab3
  gRNA
uucggugguacaacugggcc

SEQ ID NO: 52518 - RNA, 20 nt, Artificial Sequence
  MKO10052518_A_Tab3
  gRNA
ccaguguccgaccaccauua

SEQ ID NO: 52519 - RNA, 20 nt, Artificial Sequence
  MKO10052519_A_Tab3
  gRNA
uuugguaucacccgaggaga

SEQ ID NO: 52520 - RNA, 20 nt, Artificial Sequence
  MKO10052520_A_Tac1
  gRNA
uuaaugggcaagcgggaugc

SEQ ID NO: 52521 - RNA, 20 nt, Artificial Sequence
  MKO10052521_A_Tac1
  gRNA
uaccauaaagagccuuuaac

SEQ ID NO: 52522 - RNA, 20 nt, Artificial Sequence
  MKO10052522_A_Tac1
  gRNA
uuugcccauuaguccaacaa

SEQ ID NO: 52523 - RNA, 20 nt, Artificial Sequence
  MKO10052523_A_Tac2
  gRNA
ugucguagagucuccgaagc

SEQ ID NO: 52524 - RNA, 20 nt, Artificial Sequence
  MKO10052524_A_Tac2
  gRNA
cccagacacucccaccgacg

SEQ ID NO: 52525 - RNA, 20 nt, Artificial Sequence
  MKO10052525_A_Tac2
  gRNA
ugacaugcacgacuucuuug

SEQ ID NO: 52526 - RNA, 20 nt, Artificial Sequence
  MKO10052526_A_Tac4
  gRNA
uggacaaaccucucgugcca

SEQ ID NO: 52527 - RNA, 20 nt, Artificial Sequence
  MKO10052527_A_Tac4
  gRNA
ggcagagugcuacacguugc

SEQ ID NO: 52528 - RNA, 20 nt, Artificial Sequence
  MKO10052528_A_Tac4
  gRNA
uugacucgccgccugucugc

SEQ ID NO: 52529 - RNA, 20 nt, Artificial Sequence
  MKO10052529_A_Tacc1
  gRNA
gaacacgcguccaaaucgag

SEQ ID NO: 52530 - RNA, 20 nt, Artificial Sequence
  MKO10052530_A_Tacc1
  gRNA
cuucugagcacacgacgacg

SEQ ID NO: 52531 - RNA, 20 nt, Artificial Sequence
  MKO10052531_A_Tacc1
  gRNA
aggucccgagggcgaccccg

SEQ ID NO: 52532 - RNA, 20 nt, Artificial Sequence
  MKO10052532_A_Tacc2
  gRNA
gcuaagcgaacgggacagcg

SEQ ID NO: 52533 - RNA, 20 nt, Artificial Sequence
  MKO10052533_A_Tacc2
  gRNA
gucuucaucgaacaccgccg

SEQ ID NO: 52534 - RNA, 20 nt, Artificial Sequence
  MKO10052534_A_Tacc2
  gRNA
cguugacucgggggucucaa

SEQ ID NO: 52535 - RNA, 20 nt, Artificial Sequence
  MKO10052535_A_Tacc3
  gRNA
aaaaggagccucacgcuuau

SEQ ID NO: 52536 - RNA, 20 nt, Artificial Sequence
  MKO10052536_A_Tacc3
  gRNA
cccuccuaucgagccuuugc

SEQ ID NO: 52537 - RNA, 20 nt, Artificial Sequence
  MKO10052537_A_Tacc3
  gRNA
ucuuccuuuagauccacgac

SEQ ID NO: 52538 - RNA, 20 nt, Artificial Sequence
  MKO10052538_A_Taco1
  gRNA
ccuagagcgugcccuagaac

SEQ ID NO: 52539 - RNA, 20 nt, Artificial Sequence
  MKO10052539_A_Taco1
  gRNA
ccucauaguuguuaagcgcc

SEQ ID NO: 52540 - RNA, 20 nt, Artificial Sequence
  MKO10052540_A_Taco1
  gRNA
ccaguucuagggcacgcucu

SEQ ID NO: 52541 - RNA, 20 nt, Artificial Sequence
  MKO10052541_A_Tacr1
  gRNA
ggucuucgaguugcuucgag

SEQ ID NO: 52542 - RNA, 20 nt, Artificial Sequence
  MKO10052542_A_Tacr1
  gRNA
gucggccacugcuaccaaag

SEQ ID NO: 52543 - RNA, 20 nt, Artificial Sequence
  MKO10052543_A_Tacr1
  gRNA
ugaccuuguacacgcugcuc

SEQ ID NO: 52544 - RNA, 20 nt, Artificial Sequence
  MKO10052544_A_Tacr2
  gRNA
cuaccgcaaguuuauccagc

SEQ ID NO: 52545 - RNA, 20 nt, Artificial Sequence
  MKO10052545_A_Tacr2
  gRNA
acgcgccguacccagacacc

SEQ ID NO: 52546 - RNA, 20 nt, Artificial Sequence
  MKO10052546_A_Tacr2
  gRNA
acccucggcagguuucgcuc

SEQ ID NO: 52547 - RNA, 20 nt, Artificial Sequence
  MKO10052547_A_Tacr3
  gRNA
gagcuccagcucaucguagc

SEQ ID NO: 52548 - RNA, 20 nt, Artificial Sequence
  MKO10052548_A_Tacr3
  gRNA
acuuccgaugacaaucuuag

SEQ ID NO: 52549 - RNA, 20 nt, Artificial Sequence
  MKO10052549_A_Tacr3
  gRNA
cgagcuuaugaaacuugaug

SEQ ID NO: 52550 - RNA, 20 nt, Artificial Sequence
  MKO10052550_A_Tacstd2
  gRNA
gcaccacuucgucgcagcgc

SEQ ID NO: 52551 - RNA, 20 nt, Artificial Sequence
  MKO10052551_A_Tacstd2
  gRNA
gcggacgcucaucuacuacc

SEQ ID NO: 52552 - RNA, 20 nt, Artificial Sequence
  MKO10052552_A_Tacstd2
  gRNA
gccgagcgagcacgcgauac

SEQ ID NO: 52553 - RNA, 20 nt, Artificial Sequence
  MKO10052553_A_Tada1
  gRNA
gucugccguggucuaugccg

SEQ ID NO: 52554 - RNA, 20 nt, Artificial Sequence
  MKO10052554_A_Tada1
  gRNA
guuucaagucgucaucaccc

SEQ ID NO: 52555 - RNA, 20 nt, Artificial Sequence
  MKO10052555_A_Tada1
  gRNA
ccaaaaucugacaacgugug

SEQ ID NO: 52556 - RNA, 20 nt, Artificial Sequence
  MKO10052556_A_Tada2a
  gRNA
ucugauaagccgcccugcag

SEQ ID NO: 52557 - RNA, 20 nt, Artificial Sequence
  MKO10052557_A_Tada2a
  gRNA
ugaucacacuuacgaaauaa

SEQ ID NO: 52558 - RNA, 20 nt, Artificial Sequence
  MKO10052558_A_Tada2a
  gRNA
uggccgccucagcuugcuuc

SEQ ID NO: 52559 - RNA, 20 nt, Artificial Sequence
  MKO10052559_A_Tada2b
  gRNA
gccgaagccgaacugcucga

SEQ ID NO: 52560 - RNA, 20 nt, Artificial Sequence
  MKO10052560_A_Tada2b
  gRNA
cgcgccggccgagaagcacu

SEQ ID NO: 52561 - RNA, 20 nt, Artificial Sequence
  MKO10052561_A_Tada2b
  gRNA
uucgagagcugcagcgcuac

SEQ ID NO: 52562 - RNA, 20 nt, Artificial Sequence
  MKO10052562_A_Tada3
  gRNA
uugcugcagauucccccccu

SEQ ID NO: 52563 - RNA, 20 nt, Artificial Sequence
  MKO10052563_A_Tada3
  gRNA
uggggggagcaccgagcucg

SEQ ID NO: 52564 - RNA, 20 nt, Artificial Sequence
  MKO10052564_A_Tada3
  gRNA
cucggugcuccccccaaaca

SEQ ID NO: 52565 - RNA, 20 nt, Artificial Sequence
  MKO10052565_A_Taf10
  gRNA
gguuuacgcccuaccgagcg

SEQ ID NO: 52566 - RNA, 20 nt, Artificial Sequence
  MKO10052566_A_Taf10
  gRNA
uccuucagcuucgguggcag

SEQ ID NO: 52567 - RNA, 20 nt, Artificial Sequence
  MKO10052567_A_Taf10
  gRNA
cucacaccuugcucuugcuc

SEQ ID NO: 52568 - RNA, 20 nt, Artificial Sequence
  MKO10052568_A_Taf11
  gRNA
accguuaugaaauguaucgc

SEQ ID NO: 52569 - RNA, 20 nt, Artificial Sequence
  MKO10052569_A_Taf11
  gRNA
cccauuucucacacacgucc

SEQ ID NO: 52570 - RNA, 20 nt, Artificial Sequence
  MKO10052570_A_Taf11
  gRNA
accugcgauacauuucauaa

SEQ ID NO: 52571 - RNA, 20 nt, Artificial Sequence
  MKO10052571_A_Taf12
  gRNA
cccacauaccuagaugcagc

SEQ ID NO: 52572 - RNA, 20 nt, Artificial Sequence
  MKO10052572_A_Taf12
  gRNA
acuugcggugccgagcaagc

SEQ ID NO: 52573 - RNA, 20 nt, Artificial Sequence
  MKO10052573_A_Taf12
  gRNA
uucagagaauggcacugauc

SEQ ID NO: 52574 - RNA, 20 nt, Artificial Sequence
  MKO10052574_A_Taf13
  gRNA
auguccacggacuccgugua

SEQ ID NO: 52575 - RNA, 20 nt, Artificial Sequence
  MKO10052575_A_Taf13
  gRNA
ggacgaccagaauccuuaca

SEQ ID NO: 52576 - RNA, 20 nt, Artificial Sequence
  MKO10052576_A_Taf13
  gRNA
agcagcuagcauggcagaug

SEQ ID NO: 52577 - RNA, 20 nt, Artificial Sequence
  MKO10052577_A_Taf15
  gRNA
caaacgacugauucuucgua

SEQ ID NO: 52578 - RNA, 20 nt, Artificial Sequence
  MKO10052578_A_Taf15
  gRNA
uuagguuauucacagucgua

SEQ ID NO: 52579 - RNA, 20 nt, Artificial Sequence
  MKO10052579_A_Taf15
  gRNA
caacaaaacacggagucauc

SEQ ID NO: 52580 - RNA, 20 nt, Artificial Sequence
  MKO10052580_A_Taf1a
  gRNA
cuccacguuguucgccgccc

SEQ ID NO: 52581 - RNA, 20 nt, Artificial Sequence
  MKO10052581_A_Taf1a
  gRNA
uuagagagcaccgacguuuc

SEQ ID NO: 52582 - RNA, 20 nt, Artificial Sequence
  MKO10052582_A_Taf1a
  gRNA
ccuugcgcuuucagugaaac

SEQ ID NO: 52583 - RNA, 20 nt, Artificial Sequence
  MKO10052583_A_Taf1b
  gRNA
uacuuacaucugugacauug

SEQ ID NO: 52584 - RNA, 20 nt, Artificial Sequence
  MKO10052584_A_Taf1b
  gRNA
acaguaauauuugccuucau

SEQ ID NO: 52585 - RNA, 20 nt, Artificial Sequence
  MKO10052585_A_Taf1b
  gRNA
uagcuucuuaccuuuaguuc

SEQ ID NO: 52586 - RNA, 20 nt, Artificial Sequence
  MKO10052586_A_Taf1c
  gRNA
ggacauagccuucgcacccc

SEQ ID NO: 52587 - RNA, 20 nt, Artificial Sequence
  MKO10052587_A_Taf1c
  gRNA
accucggcggacaccaaccc

SEQ ID NO: 52588 - RNA, 20 nt, Artificial Sequence
  MKO10052588_A_Taf1c
  gRNA
gugcgaaggcuaugucccca

SEQ ID NO: 52589 - RNA, 20 nt, Artificial Sequence
  MKO10052589_A_Taf1d
  gRNA
cuagugauccucguucccga

SEQ ID NO: 52590 - RNA, 20 nt, Artificial Sequence
  MKO10052590_A_Taf1d
  gRNA
uugcagcaagcuguugcaag

SEQ ID NO: 52591 - RNA, 20 nt, Artificial Sequence
  MKO10052591_A_Taf1d
  gRNA
uugauaucacauucagccug

SEQ ID NO: 52592 - RNA, 20 nt, Artificial Sequence
  MKO10052592_A_Taf1
  gRNA
ggugcccugguaaaugauga

SEQ ID NO: 52593 - RNA, 20 nt, Artificial Sequence
  MKO10052593_A_Taf1
  gRNA
ggagugcaagaagcaucuug

SEQ ID NO: 52594 - RNA, 20 nt, Artificial Sequence
  MKO10052594_A_Taf1
  gRNA
gacacuuggcaacagcuucg

SEQ ID NO: 52595 - RNA, 20 nt, Artificial Sequence
  MKO10052595_A_Taf2
  gRNA
ccaagucauugauccggacu

SEQ ID NO: 52596 - RNA, 20 nt, Artificial Sequence
  MKO10052596_A_Taf2
  gRNA
aguguagaauauaccgaguc

SEQ ID NO: 52597 - RNA, 20 nt, Artificial Sequence
  MKO10052597_A_Taf2
  gRNA
aguucuccauuccccgcauc

SEQ ID NO: 52598 - RNA, 20 nt, Artificial Sequence
  MKO10052598_A_Taf3
  gRNA
gucuccuuccgauuccgauc

SEQ ID NO: 52599 - RNA, 20 nt, Artificial Sequence
  MKO10052599_A_Taf3
  gRNA
acgugcgaucacagcaucga

SEQ ID NO: 52600 - RNA, 20 nt, Artificial Sequence
  MKO10052600_A_Taf3
  gRNA
cucagucacgacgcuccuca

SEQ ID NO: 52601 - RNA, 20 nt, Artificial Sequence
  MKO10052601_A_Taf4a
  gRNA
gcccauucucacuccgcacg

SEQ ID NO: 52602 - RNA, 20 nt, Artificial Sequence
  MKO10052602_A_Taf4a
  gRNA
acaacccuacagcgaucucc

SEQ ID NO: 52603 - RNA, 20 nt, Artificial Sequence
  MKO10052603_A_Taf4a
  gRNA
ccccaggaaugguccucgug

SEQ ID NO: 52604 - RNA, 20 nt, Artificial Sequence
  MKO10052604_A_Taf4b
  gRNA
uuugagacgugcgucauuug

SEQ ID NO: 52605 - RNA, 20 nt, Artificial Sequence
  MKO10052605_A_Taf4b
  gRNA
acaguauucaccagcuuugc

SEQ ID NO: 52606 - RNA, 20 nt, Artificial Sequence
  MKO10052606_A_Taf4b
  gRNA
ucgccucagcaagcuguaac

SEQ ID NO: 52607 - RNA, 20 nt, Artificial Sequence
  MKO10052607_A_Taf5l
  gRNA
ggucaugaaacgagugcgca

SEQ ID NO: 52608 - RNA, 20 nt, Artificial Sequence
  MKO10052608_A_Taf5l
  gRNA
caaguaugucguccgucucc

SEQ ID NO: 52609 - RNA, 20 nt, Artificial Sequence
  MKO10052609_A_Taf5l
  gRNA
gguaauuguagcuaucuucc

SEQ ID NO: 52610 - RNA, 20 nt, Artificial Sequence
  MKO10052610_A_Taf5
  gRNA
acucguccgaaaguccagca

SEQ ID NO: 52611 - RNA, 20 nt, Artificial Sequence
  MKO10052611_A_Taf5
  gRNA
cgucgaagaugucgauguag

SEQ ID NO: 52612 - RNA, 20 nt, Artificial Sequence
  MKO10052612_A_Taf5
  gRNA
uggcccgaggcgcacucguu

SEQ ID NO: 52613 - RNA, 20 nt, Artificial Sequence
  MKO10052613_A_Taf6l
  gRNA
gggugaucucuacuucccgg

SEQ ID NO: 52614 - RNA, 20 nt, Artificial Sequence
  MKO10052614_A_Taf6l
  gRNA
ugugugcuaccgucuccgag

SEQ ID NO: 52615 - RNA, 20 nt, Artificial Sequence
  MKO10052615_A_Taf6l
  gRNA
uagagaucacccucccuugc

SEQ ID NO: 52616 - RNA, 20 nt, Artificial Sequence
  MKO10052616_A_Taf6
  gRNA
gcucauuggcuaagcaucga

SEQ ID NO: 52617 - RNA, 20 nt, Artificial Sequence
  MKO10052617_A_Taf6
  gRNA
ccgccagaggcaaaccggaa

SEQ ID NO: 52618 - RNA, 20 nt, Artificial Sequence
  MKO10052618_A_Taf6
  gRNA
uuaccuggggguggauucuc

SEQ ID NO: 52619 - RNA, 20 nt, Artificial Sequence
  MKO10052619_A_Taf7l
  gRNA
ugucuacuugaacaaccgca

SEQ ID NO: 52620 - RNA, 20 nt, Artificial Sequence
  MKO10052620_A_Taf7l
  gRNA
ggcagauuaaccaguuuagc

SEQ ID NO: 52621 - RNA, 20 nt, Artificial Sequence
  MKO10052621_A_Taf7l
  gRNA
guuuauauugcgucugccuc

SEQ ID NO: 52622 - RNA, 20 nt, Artificial Sequence
  MKO10052622_A_Taf7
  gRNA
acaaugccgugacgcccauc

SEQ ID NO: 52623 - RNA, 20 nt, Artificial Sequence
  MKO10052623_A_Taf7
  gRNA
ggggcagucguaagauaaac

SEQ ID NO: 52624 - RNA, 20 nt, Artificial Sequence
  MKO10052624_A_Taf7
  gRNA
gcgucacggcauugucagag

SEQ ID NO: 52625 - RNA, 20 nt, Artificial Sequence
  MKO10052625_A_Taf8
  gRNA
gaccacgauguccgacagug

SEQ ID NO: 52626 - RNA, 20 nt, Artificial Sequence
  MKO10052626_A_Taf8
  gRNA
gcccacacugucggacaucg

SEQ ID NO: 52627 - RNA, 20 nt, Artificial Sequence
  MKO10052627_A_Taf8
  gRNA
gagugccgagaaagcgucug

SEQ ID NO: 52628 - RNA, 20 nt, Artificial Sequence
  MKO10052628_A_Taf9b
  gRNA
ugaugccgaugacgugagac

SEQ ID NO: 52629 - RNA, 20 nt, Artificial Sequence
  MKO10052629_A_Taf9b
  gRNA
gcgcuuaccaaggcaucucu

SEQ ID NO: 52630 - RNA, 20 nt, Artificial Sequence
  MKO10052630_A_Taf9b
  gRNA
ccgcugauuaagccauaugc

SEQ ID NO: 52631 - RNA, 20 nt, Artificial Sequence
  MKO10052631_A_Taf9
  gRNA
agucagcaaaugcacugaaa

SEQ ID NO: 52632 - RNA, 20 nt, Artificial Sequence
  MKO10052632_A_Taf9
  gRNA
cuagaauuguugucacauau

SEQ ID NO: 52633 - RNA, 20 nt, Artificial Sequence
  MKO10052633_A_Taf9
  gRNA
auaucuaauaagaaaucucu

SEQ ID NO: 52634 - RNA, 20 nt, Artificial Sequence
  MKO10052634_A_Tagap1
  gRNA
agcuugacucacaggugucc

SEQ ID NO: 52635 - RNA, 20 nt, Artificial Sequence
  MKO10052635_A_Tagap1
  gRNA
acagggggcaccgcugugcu

SEQ ID NO: 52636 - RNA, 20 nt, Artificial Sequence
  MKO10052636_A_Tagap1
  gRNA
gauggcggcgacuaccgccg

SEQ ID NO: 52637 - RNA, 20 nt, Artificial Sequence
  MKO10052637_A_Tagap
  gRNA
cugaauaucccuuccguuga

SEQ ID NO: 52638 - RNA, 20 nt, Artificial Sequence
  MKO10052638_A_Tagap
  gRNA
cuucaacggaagggauauuc

SEQ ID NO: 52639 - RNA, 20 nt, Artificial Sequence
  MKO10052639_A_Tagap
  gRNA
caacccuugucgaucaucug

SEQ ID NO: 52640 - RNA, 20 nt, Artificial Sequence
  MKO10052640_A_Tagln2
  gRNA
gauugagaagcaguacgacg

SEQ ID NO: 52641 - RNA, 20 nt, Artificial Sequence
  MKO10052641_A_Tagln2
  gRNA
gcgcuauggcauuaacacca

SEQ ID NO: 52642 - RNA, 20 nt, Artificial Sequence
  MKO10052642_A_Tagln2
  gRNA
caccaaccguggagcaucuc

SEQ ID NO: 52643 - RNA, 20 nt, Artificial Sequence
  MKO10052643_A_Tagln3
  gRNA
cguaccccgucaugcccgcc

SEQ ID NO: 52644 - RNA, 20 nt, Artificial Sequence
  MKO10052644_A_Tagln3
  gRNA
ggauauagagcacccgcccc

SEQ ID NO: 52645 - RNA, 20 nt, Artificial Sequence
  MKO10052645_A_Tagln3
  gRNA
gagcuauggcuuaagccgag

SEQ ID NO: 52646 - RNA, 20 nt, Artificial Sequence
  MKO10052646_A_Tagln
  gRNA
ccgcccagaucgugggcgcc

SEQ ID NO: 52647 - RNA, 20 nt, Artificial Sequence
  MKO10052647_A_Tagln
  gRNA
acuaccguggagaucccaac

SEQ ID NO: 52648 - RNA, 20 nt, Artificial Sequence
  MKO10052648_A_Tagln
  gRNA
ugacaggcuaugggcgaccc

SEQ ID NO: 52649 - RNA, 20 nt, Artificial Sequence
  MKO10052649_A_Tal1
  gRNA
ccuuggcgacgccguugagc

SEQ ID NO: 52650 - RNA, 20 nt, Artificial Sequence
  MKO10052650_A_Tal1
  gRNA
uagcagccgaagcucgccuu

SEQ ID NO: 52651 - RNA, 20 nt, Artificial Sequence
  MKO10052651_A_Tal1
  gRNA
ucaccaacagccgggaacga

SEQ ID NO: 52652 - RNA, 20 nt, Artificial Sequence
  MKO10052652_A_Tal2
  gRNA
caagaacgagacgcuucgcu

SEQ ID NO: 52653 - RNA, 20 nt, Artificial Sequence
  MKO10052653_A_Tal2
  gRNA
cagcgacuccuguuugaugc

SEQ ID NO: 52654 - RNA, 20 nt, Artificial Sequence
  MKO10052654_A_Tal2
  gRNA
caccaccuuagggagccccg

SEQ ID NO: 52655 - RNA, 20 nt, Artificial Sequence
  MKO10052655_A_Taldo1
  gRNA
gcgcauccuugauuggcaug

SEQ ID NO: 52656 - RNA, 20 nt, Artificial Sequence
  MKO10052656_A_Taldo1
  gRNA
cgucacgcccgccucagcac

SEQ ID NO: 52657 - RNA, 20 nt, Artificial Sequence
  MKO10052657_A_Taldo1
  gRNA
cuucuuuguaaagcucgaug

SEQ ID NO: 52658 - RNA, 20 nt, Artificial Sequence
  MKO10052658_A_Tamm41
  gRNA
aacaucgugaagcccaacgu

SEQ ID NO: 52659 - RNA, 20 nt, Artificial Sequence
  MKO10052659_A_Tamm41
  gRNA
uaacuuaggugacuuccgca

SEQ ID NO: 52660 - RNA, 20 nt, Artificial Sequence
  MKO10052660_A_Tamm41
  gRNA
gcuaccugaaagcuucuccg

SEQ ID NO: 52661 - RNA, 20 nt, Artificial Sequence
  MKO10052661_A_Tanc1
  gRNA
gguacucuuaccagucgcac

SEQ ID NO: 52662 - RNA, 20 nt, Artificial Sequence
  MKO10052662_A_Tanc1
  gRNA
gauccaguuaugaucccguu

SEQ ID NO: 52663 - RNA, 20 nt, Artificial Sequence
  MKO10052663_A_Tanc1
  gRNA
ggggcugcuaauggucucgc

SEQ ID NO: 52664 - RNA, 20 nt, Artificial Sequence
  MKO10052664_A_Tanc2
  gRNA
acacucgacugucuucgauc

SEQ ID NO: 52665 - RNA, 20 nt, Artificial Sequence
  MKO10052665_A_Tanc2
  gRNA
gauucucgccaaagccgcuc

SEQ ID NO: 52666 - RNA, 20 nt, Artificial Sequence
  MKO10052666_A_Tanc2
  gRNA
aaacacacucaugacucguc

SEQ ID NO: 52667 - RNA, 20 nt, Artificial Sequence
  MKO10052667_A_Tango2
  gRNA
aucugcuguagggcucgaca

SEQ ID NO: 52668 - RNA, 20 nt, Artificial Sequence
  MKO10052668_A_Tango2
  gRNA
gagccagacgcccgugguag

SEQ ID NO: 52669 - RNA, 20 nt, Artificial Sequence
  MKO10052669_A_Tango2
  gRNA
ugauguuaaagccguuauac

SEQ ID NO: 52670 - RNA, 20 nt, Artificial Sequence
  MKO10052670_A_Tango6
  gRNA
cacuacugccugaacgccgu

SEQ ID NO: 52671 - RNA, 20 nt, Artificial Sequence
  MKO10052671_A_Tango6
  gRNA
gaugagacccaacggcguuc

SEQ ID NO: 52672 - RNA, 20 nt, Artificial Sequence
  MKO10052672_A_Tango6
  gRNA
guaccuggcgugguccuccc

SEQ ID NO: 52673 - RNA, 20 nt, Artificial Sequence
  MKO10052673_A_Tank
  gRNA
agcauaugaagccuuccgac

SEQ ID NO: 52674 - RNA, 20 nt, Artificial Sequence
  MKO10052674_A_Tank
  gRNA
aacgaccuuucgugaugcag

SEQ ID NO: 52675 - RNA, 20 nt, Artificial Sequence
  MKO10052675_A_Tank
  gRNA
acaaagaauacgcgagcaac

SEQ ID NO: 52676 - RNA, 20 nt, Artificial Sequence
  MKO10052676_A_Taok1
  gRNA
ucugcuucagauuuauuaga

SEQ ID NO: 52677 - RNA, 20 nt, Artificial Sequence
  MKO10052677_A_Taok1
  gRNA
gcuauuuccacuucuuguaa

SEQ ID NO: 52678 - RNA, 20 nt, Artificial Sequence
  MKO10052678_A_Taok1
  gRNA
aauuacacauggugcucucc

SEQ ID NO: 52679 - RNA, 20 nt, Artificial Sequence
  MKO10052679_A_Taok2
  gRNA
ccccgguacugaaugguauu

SEQ ID NO: 52680 - RNA, 20 nt, Artificial Sequence
  MKO10052680_A_Taok2
  gRNA
gagaucggccauggcagcuu

SEQ ID NO: 52681 - RNA, 20 nt, Artificial Sequence
  MKO10052681_A_Taok2
  gRNA
uccucuaggcccgggauguc

SEQ ID NO: 52682 - RNA, 20 nt, Artificial Sequence
  MKO10052682_A_Taok3
  gRNA
auaacagccuuuguacucga

SEQ ID NO: 52683 - RNA, 20 nt, Artificial Sequence
  MKO10052683_A_Taok3
  gRNA
gacaaaugcgcacaccaacg

SEQ ID NO: 52684 - RNA, 20 nt, Artificial Sequence
  MKO10052684_A_Taok3
  gRNA
ccuaacaccaucgaguacaa

SEQ ID NO: 52685 - RNA, 20 nt, Artificial Sequence
  MKO10052685_A_Tap1
  gRNA
acuaauggacucgcacacgu

SEQ ID NO: 52686 - RNA, 20 nt, Artificial Sequence
  MKO10052686_A_Tap1
  gRNA
gcucgauggcugcgcacguc

SEQ ID NO: 52687 - RNA, 20 nt, Artificial Sequence
  MKO10052687_A_Tap1
  gRNA
uccagcgucccuguugccgc

SEQ ID NO: 52688 - RNA, 20 nt, Artificial Sequence
  MKO10052688_A_Tap2
  gRNA
auuacacgacccgaauagcg

SEQ ID NO: 52689 - RNA, 20 nt, Artificial Sequence
  MKO10052689_A_Tap2
  gRNA
gacauuaaucccucgcuauu

SEQ ID NO: 52690 - RNA, 20 nt, Artificial Sequence
  MKO10052690_A_Tap2
  gRNA
ucuuuguugcgccaagaccu

SEQ ID NO: 52691 - RNA, 20 nt, Artificial Sequence
  MKO10052691_A_Tapbpl
  gRNA
ucccucgucugcagcauugc

SEQ ID NO: 52692 - RNA, 20 nt, Artificial Sequence
  MKO10052692_A_Tapbpl
  gRNA
cuguugagcuugauacagag

SEQ ID NO: 52693 - RNA, 20 nt, Artificial Sequence
  MKO10052693_A_Tapbpl
  gRNA
ggacuugguacagauucccc

SEQ ID NO: 52694 - RNA, 20 nt, Artificial Sequence
  MKO10052694_A_Tapbp
  gRNA
aaccagcacucgaucgccuc

SEQ ID NO: 52695 - RNA, 20 nt, Artificial Sequence
  MKO10052695_A_Tapbp
  gRNA
acuucuagcccacuucgccg

SEQ ID NO: 52696 - RNA, 20 nt, Artificial Sequence
  MKO10052696_A_Tapbp
  gRNA
gaccagaggcgaucgagugc

SEQ ID NO: 52697 - RNA, 20 nt, Artificial Sequence
  MKO10052697_A_Tapt1
  gRNA
gaucgucuguucuccucguu

SEQ ID NO: 52698 - RNA, 20 nt, Artificial Sequence
  MKO10052698_A_Tapt1
  gRNA
auaucuuagaugcucucuac

SEQ ID NO: 52699 - RNA, 20 nt, Artificial Sequence
  MKO10052699_A_Tapt1
  gRNA
cuguagaacugucauuauug

SEQ ID NO: 52700 - RNA, 20 nt, Artificial Sequence
  MKO10052700_A_Tarbp2
  gRNA
cagggcuccggcacuacuac

SEQ ID NO: 52701 - RNA, 20 nt, Artificial Sequence
  MKO10052701_A_Tarbp2
  gRNA
cagucugagugcaaccccgu

SEQ ID NO: 52702 - RNA, 20 nt, Artificial Sequence
  MKO10052702_A_Tarbp2
  gRNA
cccgcagccuguaguagugc

SEQ ID NO: 52703 - RNA, 20 nt, Artificial Sequence
  MKO10052703_A_Tardbp
  gRNA
uagcgcaggccgcaugcccc

SEQ ID NO: 52704 - RNA, 20 nt, Artificial Sequence
  MKO10052704_A_Tardbp
  gRNA
gggcaagauaccuuagaguu

SEQ ID NO: 52705 - RNA, 20 nt, Artificial Sequence
  MKO10052705_A_Tardbp
  gRNA
uauguugucaacuaucccaa

SEQ ID NO: 52706 - RNA, 20 nt, Artificial Sequence
  MKO10052706_A_Tarm1
  gRNA
accgaccuacgacagaauga

SEQ ID NO: 52707 - RNA, 20 nt, Artificial Sequence
  MKO10052707_A_Tarm1
  gRNA
guccgccaucauucugucgu

SEQ ID NO: 52708 - RNA, 20 nt, Artificial Sequence
  MKO10052708_A_Tarm1
  gRNA
aaggcucccuaucgggccuc

SEQ ID NO: 52709 - RNA, 20 nt, Artificial Sequence
  MKO10052709_A_Tars2
  gRNA
ggcguaccucacgcacggug

SEQ ID NO: 52710 - RNA, 20 nt, Artificial Sequence
  MKO10052710_A_Tars2
  gRNA
cgagcuccacaccgugcgug

SEQ ID NO: 52711 - RNA, 20 nt, Artificial Sequence
  MKO10052711_A_Tars2
  gRNA
ggcccaacggcaacagugua

SEQ ID NO: 52712 - RNA, 20 nt, Artificial Sequence
  MKO10052712_A_Tarsl2
  gRNA
gugggaucuggaccgcccgu

SEQ ID NO: 52713 - RNA, 20 nt, Artificial Sequence
  MKO10052713_A_Tarsl2
  gRNA
cgggccuuaccuaauuccag

SEQ ID NO: 52714 - RNA, 20 nt, Artificial Sequence
  MKO10052714_A_Tarsl2
  gRNA
ccacaauacaccguucacuu

SEQ ID NO: 52715 - RNA, 20 nt, Artificial Sequence
  MKO10052715_A_Tars
  gRNA
acgccguaucagauugcuug

SEQ ID NO: 52716 - RNA, 20 nt, Artificial Sequence
  MKO10052716_A_Tars
  gRNA
gaacaaagucguuugggacc

SEQ ID NO: 52717 - RNA, 20 nt, Artificial Sequence
  MKO10052717_A_Tars
  gRNA
uucuuuccgcuucuccucgc

SEQ ID NO: 52718 - RNA, 20 nt, Artificial Sequence
  MKO10052718_A_Tas1r1
  gRNA
agccaggaccaccguggucg

SEQ ID NO: 52719 - RNA, 20 nt, Artificial Sequence
  MKO10052719_A_Tas1r1
  gRNA
cuccucaacggugaaccgca

SEQ ID NO: 52720 - RNA, 20 nt, Artificial Sequence
  MKO10052720_A_Tas1r1
  gRNA
gacuguagcauucgaugaca

SEQ ID NO: 52721 - RNA, 20 nt, Artificial Sequence
  MKO10052721_A_Tas1r2
  gRNA
cgugcugcucggcuacgaga

SEQ ID NO: 52722 - RNA, 20 nt, Artificial Sequence
  MKO10052722_A_Tas1r2
  gRNA
uaucaccaccacacgcgccg

SEQ ID NO: 52723 - RNA, 20 nt, Artificial Sequence
  MKO10052723_A_Tas1r2
  gRNA
accuaccucaaccgaucagu

SEQ ID NO: 52724 - RNA, 20 nt, Artificial Sequence
  MKO10052724_A_Tas1r3
  gRNA
agcccuuuacucggcgaacc

SEQ ID NO: 52725 - RNA, 20 nt, Artificial Sequence
  MKO10052725_A_Tas1r3
  gRNA
gucacuuagccgauccaugc

SEQ ID NO: 52726 - RNA, 20 nt, Artificial Sequence
  MKO10052726_A_Tas1r3
  gRNA
guagugucaagucucgagca

SEQ ID NO: 52727 - RNA, 20 nt, Artificial Sequence
  MKO10052727_A_Tas2r102
  gRNA
auaacagcgucgccuguccc

SEQ ID NO: 52728 - RNA, 20 nt, Artificial Sequence
  MKO10052728_A_Tas2r102
  gRNA
cuccacguauauuaguacag

SEQ ID NO: 52729 - RNA, 20 nt, Artificial Sequence
  MKO10052729_A_Tas2r102
  gRNA
ugccacuguacuaauauacg

SEQ ID NO: 52730 - RNA, 20 nt, Artificial Sequence
  MKO10052730_A_Tas2r103
  gRNA
auuauuggacccagcuuuau

SEQ ID NO: 52731 - RNA, 20 nt, Artificial Sequence
  MKO10052731_A_Tas2r103
  gRNA
guuuccaagaaucaguacac

SEQ ID NO: 52732 - RNA, 20 nt, Artificial Sequence
  MKO10052732_A_Tas2r103
  gRNA
cucucgugaacaucauagac

SEQ ID NO: 52733 - RNA, 20 nt, Artificial Sequence
  MKO10052733_A_Tas2r104
  gRNA
uuauuaaccaucugagcguu

SEQ ID NO: 52734 - RNA, 20 nt, Artificial Sequence
  MKO10052734_A_Tas2r104
  gRNA
ugcuaaaccaaacgcucaga

SEQ ID NO: 52735 - RNA, 20 nt, Artificial Sequence
  MKO10052735_A_Tas2r104
  gRNA
gcucccugcuuguuagaauu

SEQ ID NO: 52736 - RNA, 20 nt, Artificial Sequence
  MKO10052736_A_Tas2r105
  gRNA
agggaacacauuuauugcac

SEQ ID NO: 52737 - RNA, 20 nt, Artificial Sequence
  MKO10052737_A_Tas2r105
  gRNA
uuucucccaguacaucuccg

SEQ ID NO: 52738 - RNA, 20 nt, Artificial Sequence
  MKO10052738_A_Tas2r105
  gRNA
ucaucggcuuagcaacuucc

SEQ ID NO: 52739 - RNA, 20 nt, Artificial Sequence
  MKO10052739_A_Tas2r106
  gRNA
gcaucagaggcaaccauaug

SEQ ID NO: 52740 - RNA, 20 nt, Artificial Sequence
  MKO10052740_A_Tas2r106
  gRNA
aguuaauguaguuugcaugc

SEQ ID NO: 52741 - RNA, 20 nt, Artificial Sequence
  MKO10052741_A_Tas2r106
  gRNA
aagccacauucuucucaacc

SEQ ID NO: 52742 - RNA, 20 nt, Artificial Sequence
  MKO10052742_A_Tas2r107
  gRNA
uacgaugauugagugaccgc

SEQ ID NO: 52743 - RNA, 20 nt, Artificial Sequence
  MKO10052743_A_Tas2r107
  gRNA
uauccauacaacaccaauuc

SEQ ID NO: 52744 - RNA, 20 nt, Artificial Sequence
  MKO10052744_A_Tas2r107
  gRNA
uuuccacacaugcuuaccuc

SEQ ID NO: 52745 - RNA, 20 nt, Artificial Sequence
  MKO10052745_A_Tas2r108
  gRNA
uagagauaguccguuucaac

SEQ ID NO: 52746 - RNA, 20 nt, Artificial Sequence
  MKO10052746_A_Tas2r108
  gRNA
cacccaugugagccuccguc

SEQ ID NO: 52747 - RNA, 20 nt, Artificial Sequence
  MKO10052747_A_Tas2r108
  gRNA
cagucgcagaauugccucuc

SEQ ID NO: 52748 - RNA, 20 nt, Artificial Sequence
  MKO10052748_A_Tas2r109
  gRNA
uagcuaaccauauuaguguc

SEQ ID NO: 52749 - RNA, 20 nt, Artificial Sequence
  MKO10052749_A_Tas2r109
  gRNA
uacaguucacuaguacucua

SEQ ID NO: 52750 - RNA, 20 nt, Artificial Sequence
  MKO10052750_A_Tas2r109
  gRNA
aguaguuucaguuacauuac

SEQ ID NO: 52751 - RNA, 20 nt, Artificial Sequence
  MKO10052751_A_Tas2r110
  gRNA
ugaauaaccauuucagcguu

SEQ ID NO: 52752 - RNA, 20 nt, Artificial Sequence
  MKO10052752_A_Tas2r110
  gRNA
auguugagccuuagguugau

SEQ ID NO: 52753 - RNA, 20 nt, Artificial Sequence
  MKO10052753_A_Tas2r110
  gRNA
uggcaagccaaacgcugaaa

SEQ ID NO: 52754 - RNA, 20 nt, Artificial Sequence
  MKO10052754_A_Tas2r113
  gRNA
uuagcagaaucgcucuaauu

SEQ ID NO: 52755 - RNA, 20 nt, Artificial Sequence
  MKO10052755_A_Tas2r113
  gRNA
acaaugauugaucaccgucc

SEQ ID NO: 52756 - RNA, 20 nt, Artificial Sequence
  MKO10052756_A_Tas2r113
  gRNA
gaacagacacccaccaaucu

SEQ ID NO: 52757 - RNA, 20 nt, Artificial Sequence
  MKO10052757_A_Tas2r114
  gRNA
uuaaccaucuucgcaacaac

SEQ ID NO: 52758 - RNA, 20 nt, Artificial Sequence
  MKO10052758_A_Tas2r114
  gRNA
uuucccaguuguugcgaaga

SEQ ID NO: 52759 - RNA, 20 nt, Artificial Sequence
  MKO10052759_A_Tas2r114
  gRNA
ccuuucaguuucaacuagug

SEQ ID NO: 52760 - RNA, 20 nt, Artificial Sequence
  MKO10052760_A_Tas2r115
  gRNA
auguucacauuaguacccuu

SEQ ID NO: 52761 - RNA, 20 nt, Artificial Sequence
  MKO10052761_A_Tas2r115
  gRNA
cauagcucugguacaaugca

SEQ ID NO: 52762 - RNA, 20 nt, Artificial Sequence
  MKO10052762_A_Tas2r115
  gRNA
aagaugcaguacuacaccaa

SEQ ID NO: 52763 - RNA, 20 nt, Artificial Sequence
  MKO10052763_A_Tas2r116
  gRNA
caaccugugugaucaaaagc

SEQ ID NO: 52764 - RNA, 20 nt, Artificial Sequence
  MKO10052764_A_Tas2r116
  gRNA
cauagcgguggugaacauaa

SEQ ID NO: 52765 - RNA, 20 nt, Artificial Sequence
  MKO10052765_A_Tas2r116
  gRNA
gaagaugaaugguguccuac

SEQ ID NO: 52766 - RNA, 20 nt, Artificial Sequence
  MKO10052766_A_Tas2r117
  gRNA
caugguccugguccacugua

SEQ ID NO: 52767 - RNA, 20 nt, Artificial Sequence
  MKO10052767_A_Tas2r117
  gRNA
ucuuaacccaguccauacag

SEQ ID NO: 52768 - RNA, 20 nt, Artificial Sequence
  MKO10052768_A_Tas2r117
  gRNA
uacaagucauguacaaugcu

SEQ ID NO: 52769 - RNA, 20 nt, Artificial Sequence
  MKO10052769_A_Tas2r118
  gRNA
cugaugagaaucgucuccac

SEQ ID NO: 52770 - RNA, 20 nt, Artificial Sequence
  MKO10052770_A_Tas2r118
  gRNA
ggagacgauucucaucagcc

SEQ ID NO: 52771 - RNA, 20 nt, Artificial Sequence
  MKO10052771_A_Tas2r118
  gRNA
gaugacuauagucagaaaau

SEQ ID NO: 52772 - RNA, 20 nt, Artificial Sequence
  MKO10052772_A_Tas2r119
  gRNA
cuuccacaugaucaagucga

SEQ ID NO: 52773 - RNA, 20 nt, Artificial Sequence
  MKO10052773_A_Tas2r119
  gRNA
augccaucgacuugaucaug

SEQ ID NO: 52774 - RNA, 20 nt, Artificial Sequence
  MKO10052774_A_Tas2r119
  gRNA
gaaugauucgagaaguugcc

SEQ ID NO: 52775 - RNA, 20 nt, Artificial Sequence
  MKO10052775_A_Tas2r120
  gRNA
aguuauaauucgaucagcug

SEQ ID NO: 52776 - RNA, 20 nt, Artificial Sequence
  MKO10052776_A_Tas2r120
  gRNA
ugugggcaauguuaacgaac

SEQ ID NO: 52777 - RNA, 20 nt, Artificial Sequence
  MKO10052777_A_Tas2r120
  gRNA
gucauucuuguaucuugauu

SEQ ID NO: 52778 - RNA, 20 nt, Artificial Sequence
  MKO10052778_A_Tas2r121
  gRNA
uacgggguaucauguuuacc

SEQ ID NO: 52779 - RNA, 20 nt, Artificial Sequence
  MKO10052779_A_Tas2r121
  gRNA
cuuauguuuagcauaacugu

SEQ ID NO: 52780 - RNA, 20 nt, Artificial Sequence
  MKO10052780_A_Tas2r121
  gRNA
auaugucaucacccaaagac

SEQ ID NO: 52781 - RNA, 20 nt, Artificial Sequence
  MKO10052781_A_Tas2r122
  gRNA
aaacgacaugucgagccuac

SEQ ID NO: 52782 - RNA, 20 nt, Artificial Sequence
  MKO10052782_A_Tas2r122
  gRNA
gacacugaugcacguuguac

SEQ ID NO: 52783 - RNA, 20 nt, Artificial Sequence
  MKO10052783_A_Tas2r122
  gRNA
gagaauucaugcaguacuuc

SEQ ID NO: 52784 - RNA, 20 nt, Artificial Sequence
  MKO10052784_A_Tas2r123
  gRNA
uuggacuggcaccuuagaca

SEQ ID NO: 52785 - RNA, 20 nt, Artificial Sequence
  MKO10052785_A_Tas2r123
  gRNA
guaacgggaaucuuaggaca

SEQ ID NO: 52786 - RNA, 20 nt, Artificial Sequence
  MKO10052786_A_Tas2r123
  gRNA
cguuacuauuuccacauaca

SEQ ID NO: 52787 - RNA, 20 nt, Artificial Sequence
  MKO10052787_A_Tas2r124
  gRNA
ucagaauaccuaauugcuac

SEQ ID NO: 52788 - RNA, 20 nt, Artificial Sequence
  MKO10052788_A_Tas2r124
  gRNA
guuuggcugccuuauguagu

SEQ ID NO: 52789 - RNA, 20 nt, Artificial Sequence
  MKO10052789_A_Tas2r124
  gRNA
cuaucuccucuagaauugag

SEQ ID NO: 52790 - RNA, 20 nt, Artificial Sequence
  MKO10052790_A_Tas2r125
  gRNA
aaccaacauccguacaucuu

SEQ ID NO: 52791 - RNA, 20 nt, Artificial Sequence
  MKO10052791_A_Tas2r125
  gRNA
agcugcccauaagauaucua

SEQ ID NO: 52792 - RNA, 20 nt, Artificial Sequence
  MKO10052792_A_Tas2r125
  gRNA
accaugcaauacuaugcuaa

SEQ ID NO: 52793 - RNA, 20 nt, Artificial Sequence
  MKO10052793_A_Tas2r126
  gRNA
ucccggaguacucaaccaga

SEQ ID NO: 52794 - RNA, 20 nt, Artificial Sequence
  MKO10052794_A_Tas2r126
  gRNA
cuugcaagaccccaacgucc

SEQ ID NO: 52795 - RNA, 20 nt, Artificial Sequence
  MKO10052795_A_Tas2r126
  gRNA
gccgcggaaccugagauuau

SEQ ID NO: 52796 - RNA, 20 nt, Artificial Sequence
  MKO10052796_A_Tas2r129
  gRNA
uacgcuauacacacacgugu

SEQ ID NO: 52797 - RNA, 20 nt, Artificial Sequence
  MKO10052797_A_Tas2r129
  gRNA
cucuggugaacugcauacac

SEQ ID NO: 52798 - RNA, 20 nt, Artificial Sequence
  MKO10052798_A_Tas2r129
  gRNA
ugaagaacauucuuuacguu

SEQ ID NO: 52799 - RNA, 20 nt, Artificial Sequence
  MKO10052799_A_Tas2r130
  gRNA
ugaggaccguugacuucuuc

SEQ ID NO: 52800 - RNA, 20 nt, Artificial Sequence
  MKO10052800_A_Tas2r130
  gRNA
auuacagcuaauucacucuc

SEQ ID NO: 52801 - RNA, 20 nt, Artificial Sequence
  MKO10052801_A_Tas2r130
  gRNA
ugucaagguaaaucucaacu

SEQ ID NO: 52802 - RNA, 20 nt, Artificial Sequence
  MKO10052802_A_Tas2r131
  gRNA
augaggcgcuaguucuugua

SEQ ID NO: 52803 - RNA, 20 nt, Artificial Sequence
  MKO10052803_A_Tas2r131
  gRNA
gucgaagauugcuauuuccc

SEQ ID NO: 52804 - RNA, 20 nt, Artificial Sequence
  MKO10052804_A_Tas2r131
  gRNA
gcuguuccucuaguaaagac

SEQ ID NO: 52805 - RNA, 20 nt, Artificial Sequence
  MKO10052805_A_Tas2r134
  gRNA
agccguccuaaacaacuuuc

SEQ ID NO: 52806 - RNA, 20 nt, Artificial Sequence
  MKO10052806_A_Tas2r134
  gRNA
caugugcaacagauaccgua

SEQ ID NO: 52807 - RNA, 20 nt, Artificial Sequence
  MKO10052807_A_Tas2r134
  gRNA
cugacaguccaccaaugauc

SEQ ID NO: 52808 - RNA, 20 nt, Artificial Sequence
  MKO10052808_A_Tas2r135
  gRNA
gaguuugcuccucguaucuu

SEQ ID NO: 52809 - RNA, 20 nt, Artificial Sequence
  MKO10052809_A_Tas2r135
  gRNA
ugugucuuaccaaagauacg

SEQ ID NO: 52810 - RNA, 20 nt, Artificial Sequence
  MKO10052810_A_Tas2r135
  gRNA
uuucagaacuucgggauguc

SEQ ID NO: 52811 - RNA, 20 nt, Artificial Sequence
  MKO10052811_A_Tas2r136
  gRNA
cauugcauccauugcaaugc

SEQ ID NO: 52812 - RNA, 20 nt, Artificial Sequence
  MKO10052812_A_Tas2r136
  gRNA
accaauccaccugauuugcc

SEQ ID NO: 52813 - RNA, 20 nt, Artificial Sequence
  MKO10052813_A_Tas2r136
  gRNA
gagugaaagucauagcuaua

SEQ ID NO: 52814 - RNA, 20 nt, Artificial Sequence
  MKO10052814_A_Tas2r137
  gRNA
gucguuuccuaccagaaacc

SEQ ID NO: 52815 - RNA, 20 nt, Artificial Sequence
  MKO10052815_A_Tas2r137
  gRNA
gguuucugguaggaaacgac

SEQ ID NO: 52816 - RNA, 20 nt, Artificial Sequence
  MKO10052816_A_Tas2r137
  gRNA
auucauugaagggguguucc

SEQ ID NO: 52817 - RNA, 20 nt, Artificial Sequence
  MKO10052817_A_Tas2r138
  gRNA
gugagagaagcggacaaucu

SEQ ID NO: 52818 - RNA, 20 nt, Artificial Sequence
  MKO10052818_A_Tas2r138
  gRNA
ggccaacgccuucauugucu

SEQ ID NO: 52819 - RNA, 20 nt, Artificial Sequence
  MKO10052819_A_Tas2r138
  gRNA
gcuuagcauugccugauauc

SEQ ID NO: 52820 - RNA, 20 nt, Artificial Sequence
  MKO10052820_A_Tas2r139
  gRNA
cugcauaugagccucuaugc

SEQ ID NO: 52821 - RNA, 20 nt, Artificial Sequence
  MKO10052821_A_Tas2r139
  gRNA
uuacguuguugagaccaaug

SEQ ID NO: 52822 - RNA, 20 nt, Artificial Sequence
  MKO10052822_A_Tas2r139
  gRNA
uagucgaugcuagucucuuc

SEQ ID NO: 52823 - RNA, 20 nt, Artificial Sequence
  MKO10052823_A_Tas2r140
  gRNA
ccacucuuguguccuaauuc

SEQ ID NO: 52824 - RNA, 20 nt, Artificial Sequence
  MKO10052824_A_Tas2r140
  gRNA
gaaaggugaccaucauuugc

SEQ ID NO: 52825 - RNA, 20 nt, Artificial Sequence
  MKO10052825_A_Tas2r140
  gRNA
gaguucugcagcauuaaaac

SEQ ID NO: 52826 - RNA, 20 nt, Artificial Sequence
  MKO10052826_A_Tas2r143
  gRNA
uguuaccaagcgaaccuuau

SEQ ID NO: 52827 - RNA, 20 nt, Artificial Sequence
  MKO10052827_A_Tas2r143
  gRNA
accggcagcugacaugauug

SEQ ID NO: 52828 - RNA, 20 nt, Artificial Sequence
  MKO10052828_A_Tas2r143
  gRNA
guuugggguugcuaaacagc

SEQ ID NO: 52829 - RNA, 20 nt, Artificial Sequence
  MKO10052829_A_Tas2r144
  gRNA
auggugcugaaaccgccucc

SEQ ID NO: 52830 - RNA, 20 nt, Artificial Sequence
  MKO10052830_A_Tas2r144
  gRNA
cauauuguagagaccacgaa

SEQ ID NO: 52831 - RNA, 20 nt, Artificial Sequence
  MKO10052831_A_Tas2r144
  gRNA
ugaagucauaaucccuuucg

SEQ ID NO: 52832 - RNA, 20 nt, Artificial Sequence
  MKO10052832_A_Tasp1
  gRNA
gaaacgagggggcuuugugc

SEQ ID NO: 52833 - RNA, 20 nt, Artificial Sequence
  MKO10052833_A_Tasp1
  gRNA
ggacuuuccauccauuaugc

SEQ ID NO: 52834 - RNA, 20 nt, Artificial Sequence
  MKO10052834_A_Tasp1
  gRNA
uccuuaaacuuuggagccgu

SEQ ID NO: 52835 - RNA, 20 nt, Artificial Sequence
  MKO10052835_A_Taudn1
  gRNA
cucaaacucaucacaucucg

SEQ ID NO: 52836 - RNA, 20 nt, Artificial Sequence
  MKO10052836_A_Taudn1
  gRNA
aauccugcuaaguacugauc

SEQ ID NO: 52837 - RNA, 20 nt, Artificial Sequence
  MKO10052837_A_Taudn1
  gRNA
ccauuucaguuuaugaucac

SEQ ID NO: 52838 - RNA, 20 nt, Artificial Sequence
  MKO10052838_A_Taudn2
  gRNA
agggacggaccguccaggag

SEQ ID NO: 52839 - RNA, 20 nt, Artificial Sequence
  MKO10052839_A_Taudn2
  gRNA
ugcugaccuacucuuccgcc

SEQ ID NO: 52840 - RNA, 20 nt, Artificial Sequence
  MKO10052840_A_Taudn2
  gRNA
agaacuggucaagagcguug

SEQ ID NO: 52841 - RNA, 20 nt, Artificial Sequence
  MKO10052841_A_Taudn3
  gRNA
accuuuaaugucacgcuucu

SEQ ID NO: 52842 - RNA, 20 nt, Artificial Sequence
  MKO10052842_A_Taudn3
  gRNA
acauacguugucaaaguccg

SEQ ID NO: 52843 - RNA, 20 nt, Artificial Sequence
  MKO10052843_A_Taudn3
  gRNA
accaagaagcgugacauuaa

SEQ ID NO: 52844 - RNA, 20 nt, Artificial Sequence
  MKO10052844_A_Tau
  gRNA
ggcaagcuuaccgauagaug

SEQ ID NO: 52845 - RNA, 20 nt, Artificial Sequence
  MKO10052845_A_Tau
  gRNA
cuggacuccgggaaguacaa

SEQ ID NO: 52846 - RNA, 20 nt, Artificial Sequence
  MKO10052846_A_Tau
  gRNA
cgaccuccucccgacuggau

SEQ ID NO: 52847 - RNA, 20 nt, Artificial Sequence
  MKO10052847_A_Tax1bp1
  gRNA
cuccacgaauuucacccuua

SEQ ID NO: 52848 - RNA, 20 nt, Artificial Sequence
  MKO10052848_A_Tax1bp1
  gRNA
ugaaggcaauuccgauaugu

SEQ ID NO: 52849 - RNA, 20 nt, Artificial Sequence
  MKO10052849_A_Tax1bp1
  gRNA
agggcggugugagcaauugc

SEQ ID NO: 52850 - RNA, 20 nt, Artificial Sequence
  MKO10052850_A_Tax1bp3
  gRNA
ccagccugucaccgccguag

SEQ ID NO: 52851 - RNA, 20 nt, Artificial Sequence
  MKO10052851_A_Tax1bp3
  gRNA
cucaccacuacggcggugac

SEQ ID NO: 52852 - RNA, 20 nt, Artificial Sequence
  MKO10052852_A_Tax1bp3
  gRNA
ccuugggcuaggugaauggc

SEQ ID NO: 52853 - RNA, 20 nt, Artificial Sequence
  MKO10052853_A_Taz
  gRNA
uccuaaaacuccgccacauc

SEQ ID NO: 52854 - RNA, 20 nt, Artificial Sequence
  MKO10052854_A_Taz
  gRNA
uaggcccaugacgacgcugc

SEQ ID NO: 52855 - RNA, 20 nt, Artificial Sequence
  MKO10052855_A_Taz
  gRNA
ucuagccagcagcgucguca

SEQ ID NO: 52856 - RNA, 20 nt, Artificial Sequence
  MKO10052856_A_Tbaua
  gRNA
aggggaguuuagcaccucgu

SEQ ID NO: 52857 - RNA, 20 nt, Artificial Sequence
  MKO10052857_A_Tbaua
  gRNA
ucgucccugaccacgcagac

SEQ ID NO: 52858 - RNA, 20 nt, Artificial Sequence
  MKO10052858_A_Tbaua
  gRNA
cuagucaccucaucccuacg

SEQ ID NO: 52859 - RNA, 20 nt, Artificial Sequence
  MKO10052859_A_Tbc1d10a
  gRNA
cuacacgcuguaccgcccug

SEQ ID NO: 52860 - RNA, 20 nt, Artificial Sequence
  MKO10052860_A_Tbc1d10a
  gRNA
caugagauguucgugucccg

SEQ ID NO: 52861 - RNA, 20 nt, Artificial Sequence
  MKO10052861_A_Tbc1d10a
  gRNA
gauucgucuucgaugccaga

SEQ ID NO: 52862 - RNA, 20 nt, Artificial Sequence
  MKO10052862_A_Tbc1d10b
  gRNA
ccagccacuugagcucccgc

SEQ ID NO: 52863 - RNA, 20 nt, Artificial Sequence
  MKO10052863_A_Tbc1d10b
  gRNA
gccugacaguagcccucguc

SEQ ID NO: 52864 - RNA, 20 nt, Artificial Sequence
  MKO10052864_A_Tbc1d10b
  gRNA
uaccaucuacaggccugacg

SEQ ID NO: 52865 - RNA, 20 nt, Artificial Sequence
  MKO10052865_A_Tbc1d10c
  gRNA
caugucccgacgauacaaga

SEQ ID NO: 52866 - RNA, 20 nt, Artificial Sequence
  MKO10052866_A_Tbc1d10c
  gRNA
acggugcaagucucugccaa

SEQ ID NO: 52867 - RNA, 20 nt, Artificial Sequence
  MKO10052867_A_Tbc1d10c
  gRNA
gguaaagauccagugccgca

SEQ ID NO: 52868 - RNA, 20 nt, Artificial Sequence
  MKO10052868_A_Tbc1d12
  gRNA
uaggaguacgaagcucgcac

SEQ ID NO: 52869 - RNA, 20 nt, Artificial Sequence
  MKO10052869_A_Tbc1d12
  gRNA
acgacgcaagagcuuugcgc

SEQ ID NO: 52870 - RNA, 20 nt, Artificial Sequence
  MKO10052870_A_Tbc1d12
  gRNA
agaagcgcugcgucaccggc

SEQ ID NO: 52871 - RNA, 20 nt, Artificial Sequence
  MKO10052871_A_Tbc1d13
  gRNA
agccucguggacuuccaucc

SEQ ID NO: 52872 - RNA, 20 nt, Artificial Sequence
  MKO10052872_A_Tbc1d13
  gRNA
aggccaacauggguguauuc

SEQ ID NO: 52873 - RNA, 20 nt, Artificial Sequence
  MKO10052873_A_Tbc1d13
  gRNA
cucccugaauacacccaugu

SEQ ID NO: 52874 - RNA, 20 nt, Artificial Sequence
  MKO10052874_A_Tbc1d14
  gRNA
gauguucaacucguugccaa

SEQ ID NO: 52875 - RNA, 20 nt, Artificial Sequence
  MKO10052875_A_Tbc1d14
  gRNA
cucacgcaggucuguccucg

SEQ ID NO: 52876 - RNA, 20 nt, Artificial Sequence
  MKO10052876_A_Tbc1d14
  gRNA
ugccacaguaccucguuucu

SEQ ID NO: 52877 - RNA, 20 nt, Artificial Sequence
  MKO10052877_A_Tbc1d15
  gRNA
gggcaugggcuggucguacc

SEQ ID NO: 52878 - RNA, 20 nt, Artificial Sequence
  MKO10052878_A_Tbc1d15
  gRNA
aguccacucuacgacugagc

SEQ ID NO: 52879 - RNA, 20 nt, Artificial Sequence
  MKO10052879_A_Tbc1d15
  gRNA
auggucguuccuguucagcc

SEQ ID NO: 52880 - RNA, 20 nt, Artificial Sequence
  MKO10052880_A_Tbc1d16
  gRNA
gcuaucccugcucacgccau

SEQ ID NO: 52881 - RNA, 20 nt, Artificial Sequence
  MKO10052881_A_Tbc1d16
  gRNA
cuuguggugcgccgccgccg

SEQ ID NO: 52882 - RNA, 20 nt, Artificial Sequence
  MKO10052882_A_Tbc1d16
  gRNA
acacguccagccuccgguac

SEQ ID NO: 52883 - RNA, 20 nt, Artificial Sequence
  MKO10052883_A_Tbc1d17
  gRNA
aucggcuaaggacucggagc

SEQ ID NO: 52884 - RNA, 20 nt, Artificial Sequence
  MKO10052884_A_Tbc1d17
  gRNA
cgaugagcgagucuggaucc

SEQ ID NO: 52885 - RNA, 20 nt, Artificial Sequence
  MKO10052885_A_Tbc1d17
  gRNA
acagcgacgucuuucugcac

SEQ ID NO: 52886 - RNA, 20 nt, Artificial Sequence
  MKO10052886_A_Tbc1d19
  gRNA
uaauguaccuuucgugcuag

SEQ ID NO: 52887 - RNA, 20 nt, Artificial Sequence
  MKO10052887_A_Tbc1d19
  gRNA
gaguaucccacuagcacgaa

SEQ ID NO: 52888 - RNA, 20 nt, Artificial Sequence
  MKO10052888_A_Tbc1d19
  gRNA
gagugauucgagucugaucu

SEQ ID NO: 52889 - RNA, 20 nt, Artificial Sequence
  MKO10052889_A_Tbc1d1
  gRNA
aaucuucccggccugccgga

SEQ ID NO: 52890 - RNA, 20 nt, Artificial Sequence
  MKO10052890_A_Tbc1d1
  gRNA
uaccuucgccaaaaaguucg

SEQ ID NO: 52891 - RNA, 20 nt, Artificial Sequence
  MKO10052891_A_Tbc1d1
  gRNA
auucaucugccgagagugcu

SEQ ID NO: 52892 - RNA, 20 nt, Artificial Sequence
  MKO10052892_A_Tbc1d20
  gRNA
gcucccuuacuugacacagg

SEQ ID NO: 52893 - RNA, 20 nt, Artificial Sequence
  MKO10052893_A_Tbc1d20
  gRNA
ccgacgaauggcuaucagug

SEQ ID NO: 52894 - RNA, 20 nt, Artificial Sequence
  MKO10052894_A_Tbc1d20
  gRNA
gaaaugugaccacgauguca

SEQ ID NO: 52895 - RNA, 20 nt, Artificial Sequence
  MKO10052895_A_Tbc1d21
  gRNA
gccacgaguaguagccugug

SEQ ID NO: 52896 - RNA, 20 nt, Artificial Sequence
  MKO10052896_A_Tbc1d21
  gRNA
gaucuuuaucauacagccuc

SEQ ID NO: 52897 - RNA, 20 nt, Artificial Sequence
  MKO10052897_A_Tbc1d21
  gRNA
agggacuacaccccuucgug

SEQ ID NO: 52898 - RNA, 20 nt, Artificial Sequence
  MKO10052898_A_Tbc1d22a
  gRNA
ccguuugauccgcuguuaca

SEQ ID NO: 52899 - RNA, 20 nt, Artificial Sequence
  MKO10052899_A_Tbc1d22a
  gRNA
acuuacgugccauguaacag

SEQ ID NO: 52900 - RNA, 20 nt, Artificial Sequence
  MKO10052900_A_Tbc1d22a
  gRNA
uuugaacuuguccagccgag

SEQ ID NO: 52901 - RNA, 20 nt, Artificial Sequence
  MKO10052901_A_Tbc1d22b
  gRNA
ugguauuccgcgcaaacucg

SEQ ID NO: 52902 - RNA, 20 nt, Artificial Sequence
  MKO10052902_A_Tbc1d22b
  gRNA
ccaguuuccacgaguuugcg

SEQ ID NO: 52903 - RNA, 20 nt, Artificial Sequence
  MKO10052903_A_Tbc1d22b
  gRNA
cgaacuucccugggaacgcc

SEQ ID NO: 52904 - RNA, 20 nt, Artificial Sequence
  MKO10052904_A_Tbc1d23
  gRNA
caguuguauaggucgcugcg

SEQ ID NO: 52905 - RNA, 20 nt, Artificial Sequence
  MKO10052905_A_Tbc1d23
  gRNA
cagauugcucugaacguugc

SEQ ID NO: 52906 - RNA, 20 nt, Artificial Sequence
  MKO10052906_A_Tbc1d23
  gRNA
gaugaaauggccuccccuuc

SEQ ID NO: 52907 - RNA, 20 nt, Artificial Sequence
  MKO10052907_A_Tbc1d24
  gRNA
agcgagaggacuaaauucgg

SEQ ID NO: 52908 - RNA, 20 nt, Artificial Sequence
  MKO10052908_A_Tbc1d24
  gRNA
aaguguaccagcgccugauc

SEQ ID NO: 52909 - RNA, 20 nt, Artificial Sequence
  MKO10052909_A_Tbc1d24
  gRNA
ggaugucccggaucaggcgc

SEQ ID NO: 52910 - RNA, 20 nt, Artificial Sequence
  MKO10052910_A_Tbc1d25
  gRNA
guccuagccggucucgagcc

SEQ ID NO: 52911 - RNA, 20 nt, Artificial Sequence
  MKO10052911_A_Tbc1d25
  gRNA
ggauccucagaucaccucgc

SEQ ID NO: 52912 - RNA, 20 nt, Artificial Sequence
  MKO10052912_A_Tbc1d25
  gRNA
gccugggcaccuccgacggg

SEQ ID NO: 52913 - RNA, 20 nt, Artificial Sequence
  MKO10052913_A_Tbc1d2b
  gRNA
uuuggacggaacccuuacaa

SEQ ID NO: 52914 - RNA, 20 nt, Artificial Sequence
  MKO10052914_A_Tbc1d2b
  gRNA
gucgccguucccucgagcaa

SEQ ID NO: 52915 - RNA, 20 nt, Artificial Sequence
  MKO10052915_A_Tbc1d2b
  gRNA
ccgaugccugagggcaguaa

SEQ ID NO: 52916 - RNA, 20 nt, Artificial Sequence
  MKO10052916_A_Tbc1d2
  gRNA
gccaguccaucggaaaagaa

SEQ ID NO: 52917 - RNA, 20 nt, Artificial Sequence
  MKO10052917_A_Tbc1d2
  gRNA
ugccgcacccacgaguccag

SEQ ID NO: 52918 - RNA, 20 nt, Artificial Sequence
  MKO10052918_A_Tbc1d2
  gRNA
gaagguguugcuuugccgcu

SEQ ID NO: 52919 - RNA, 20 nt, Artificial Sequence
  MKO10052919_A_Tbc1d30
  gRNA
ugcuauuggcuuacgcccgg

SEQ ID NO: 52920 - RNA, 20 nt, Artificial Sequence
  MKO10052920_A_Tbc1d30
  gRNA
gugcagauaaugauccgcca

SEQ ID NO: 52921 - RNA, 20 nt, Artificial Sequence
  MKO10052921_A_Tbc1d30
  gRNA
acccgacguucuuguuccac

SEQ ID NO: 52922 - RNA, 20 nt, Artificial Sequence
  MKO10052922_A_Tbc1d31
  gRNA
ccuucuguaugcccaccgac

SEQ ID NO: 52923 - RNA, 20 nt, Artificial Sequence
  MKO10052923_A_Tbc1d31
  gRNA
aauaaucagcuaacgccaca

SEQ ID NO: 52924 - RNA, 20 nt, Artificial Sequence
  MKO10052924_A_Tbc1d31
  gRNA
aaagcugaacauccgccagu

SEQ ID NO: 52925 - RNA, 20 nt, Artificial Sequence
  MKO10052925_A_Tbc1d32
  gRNA
gcauguuaccaaaagaacgc

SEQ ID NO: 52926 - RNA, 20 nt, Artificial Sequence
  MKO10052926_A_Tbc1d32
  gRNA
ggcgaugaucaacaaguuug

SEQ ID NO: 52927 - RNA, 20 nt, Artificial Sequence
  MKO10052927_A_Tbc1d32
  gRNA
acagcccaccugauugaagg

SEQ ID NO: 52928 - RNA, 20 nt, Artificial Sequence
  MKO10052928_A_Tbc1d4
  gRNA
cgacacuaaaucagucgugc

SEQ ID NO: 52929 - RNA, 20 nt, Artificial Sequence
  MKO10052929_A_Tbc1d4
  gRNA
ccagugcgccaacgaaucuc

SEQ ID NO: 52930 - RNA, 20 nt, Artificial Sequence
  MKO10052930_A_Tbc1d4
  gRNA
ugacgcugcugcaccgagau

SEQ ID NO: 52931 - RNA, 20 nt, Artificial Sequence
  MKO10052931_A_Tbc1d5
  gRNA
gaucaacaacccccuaucac

SEQ ID NO: 52932 - RNA, 20 nt, Artificial Sequence
  MKO10052932_A_Tbc1d5
  gRNA
gcagguuccgcagcauuugc

SEQ ID NO: 52933 - RNA, 20 nt, Artificial Sequence
  MKO10052933_A_Tbc1d5
  gRNA
guacuccuucauccugugau

SEQ ID NO: 52934 - RNA, 20 nt, Artificial Sequence
  MKO10052934_A_Tbc1d7
  gRNA
ccauaccaacgcgcgauaca

SEQ ID NO: 52935 - RNA, 20 nt, Artificial Sequence
  MKO10052935_A_Tbc1d7
  gRNA
cccauccauguaucgcgcgu

SEQ ID NO: 52936 - RNA, 20 nt, Artificial Sequence
  MKO10052936_A_Tbc1d7
  gRNA
gaaugagugucauggugcgg

SEQ ID NO: 52937 - RNA, 20 nt, Artificial Sequence
  MKO10052937_A_Tbc1d8b
  gRNA
cuagggacuaaucgcugaag

SEQ ID NO: 52938 - RNA, 20 nt, Artificial Sequence
  MKO10052938_A_Tbc1d8b
  gRNA
gucugguguaggaugcgaaa

SEQ ID NO: 52939 - RNA, 20 nt, Artificial Sequence
  MKO10052939_A_Tbc1d8b
  gRNA
ccguccucuccaguaacugc

SEQ ID NO: 52940 - RNA, 20 nt, Artificial Sequence
  MKO10052940_A_Tbc1d8
  gRNA
ugaucuugaccccgaccugc

SEQ ID NO: 52941 - RNA, 20 nt, Artificial Sequence
  MKO10052941_A_Tbc1d8
  gRNA
uggaauccagcaccgcgucc

SEQ ID NO: 52942 - RNA, 20 nt, Artificial Sequence
  MKO10052942_A_Tbc1d8
  gRNA
gacaucgccagcuuugucaa

SEQ ID NO: 52943 - RNA, 20 nt, Artificial Sequence
  MKO10052943_A_Tbc1d9b
  gRNA
aagggccgcgugccgcgcca

SEQ ID NO: 52944 - RNA, 20 nt, Artificial Sequence
  MKO10052944_A_Tbc1d9b
  gRNA
gcuguccagcaguugucgca

SEQ ID NO: 52945 - RNA, 20 nt, Artificial Sequence
  MKO10052945_A_Tbc1d9b
  gRNA
acuguccaucuucgacaacg

SEQ ID NO: 52946 - RNA, 20 nt, Artificial Sequence
  MKO10052946_A_Tbc1d9
  gRNA
ugucuuucaaguucgcgaac

SEQ ID NO: 52947 - RNA, 20 nt, Artificial Sequence
  MKO10052947_A_Tbc1d9
  gRNA
cucggugauccacagcgcgu

SEQ ID NO: 52948 - RNA, 20 nt, Artificial Sequence
  MKO10052948_A_Tbc1d9
  gRNA
guacggugcgacucgggcac

SEQ ID NO: 52949 - RNA, 20 nt, Artificial Sequence
  MKO10052949_A_Tbca
  gRNA
uccuuaccgccucacuacuc

SEQ ID NO: 52950 - RNA, 20 nt, Artificial Sequence
  MKO10052950_A_Tbca
  gRNA
aucuugaucugccucacgcg

SEQ ID NO: 52951 - RNA, 20 nt, Artificial Sequence
  MKO10052951_A_Tbca
  gRNA
cggcuuuaccugcuucuuaa

SEQ ID NO: 52952 - RNA, 20 nt, Artificial Sequence
  MKO10052952_A_Tbcb
  gRNA
cguccggcucggagaguaug

SEQ ID NO: 52953 - RNA, 20 nt, Artificial Sequence
  MKO10052953_A_Tbcb
  gRNA
ucucaccagaagcuuacgaa

SEQ ID NO: 52954 - RNA, 20 nt, Artificial Sequence
  MKO10052954_A_Tbcb
  gRNA
augcgacagccgucauccac

SEQ ID NO: 52955 - RNA, 20 nt, Artificial Sequence
  MKO10052955_A_Tbccd1
  gRNA
uccucgguugcaccgcaucg

SEQ ID NO: 52956 - RNA, 20 nt, Artificial Sequence
  MKO10052956_A_Tbccd1
  gRNA
accacgaugcggugcaaccg

SEQ ID NO: 52957 - RNA, 20 nt, Artificial Sequence
  MKO10052957_A_Tbccd1
  gRNA
ucuuugaccacaaauccguu

SEQ ID NO: 52958 - RNA, 20 nt, Artificial Sequence
  MKO10052958_A_Tbcc
  gRNA
uguccuaacggaacgucgcc

SEQ ID NO: 52959 - RNA, 20 nt, Artificial Sequence
  MKO10052959_A_Tbcc
  gRNA
caacaccuugcggcuugcga

SEQ ID NO: 52960 - RNA, 20 nt, Artificial Sequence
  MKO10052960_A_Tbcc
  gRNA
cgcucaaaaggacgucgcgc

SEQ ID NO: 52961 - RNA, 20 nt, Artificial Sequence
  MKO10052961_A_Tbcd
  gRNA
gcgucuguuuccucacgaag

SEQ ID NO: 52962 - RNA, 20 nt, Artificial Sequence
  MKO10052962_A_Tbcd
  gRNA
ucugcccgaccuuguccauc

SEQ ID NO: 52963 - RNA, 20 nt, Artificial Sequence
  MKO10052963_A_Tbcd
  gRNA
gcuuaccaagguguggaucc

SEQ ID NO: 52964 - RNA, 20 nt, Artificial Sequence
  MKO10052964_A_Tbcel
  gRNA
ucuacagccguauaccaccg

SEQ ID NO: 52965 - RNA, 20 nt, Artificial Sequence
  MKO10052965_A_Tbcel
  gRNA
cuguucaacacgagcacgcu

SEQ ID NO: 52966 - RNA, 20 nt, Artificial Sequence
  MKO10052966_A_Tbcel
  gRNA
gugcucguguugaacagcug

SEQ ID NO: 52967 - RNA, 20 nt, Artificial Sequence
  MKO10052967_A_Tbce
  gRNA
cgagcacauagcgcuucuua

SEQ ID NO: 52968 - RNA, 20 nt, Artificial Sequence
  MKO10052968_A_Tbce
  gRNA
aagcgcuaugugcucgaaga

SEQ ID NO: 52969 - RNA, 20 nt, Artificial Sequence
  MKO10052969_A_Tbce
  gRNA
aagcaugacgggagccacga

SEQ ID NO: 52970 - RNA, 20 nt, Artificial Sequence
  MKO10052970_A_Tbck
  gRNA
aaguuaccuuccgauccaac

SEQ ID NO: 52971 - RNA, 20 nt, Artificial Sequence
  MKO10052971_A_Tbck
  gRNA
ggagcacugugagcgcaguu

SEQ ID NO: 52972 - RNA, 20 nt, Artificial Sequence
  MKO10052972_A_Tbck
  gRNA
auuguagggccauauuaaac

SEQ ID NO: 52973 - RNA, 20 nt, Artificial Sequence
  MKO10052973_A_Tbk1
  gRNA
caacaucaugcgcgucauag

SEQ ID NO: 52974 - RNA, 20 nt, Artificial Sequence
  MKO10052974_A_Tbk1
  gRNA
ggugcacuaugccguucucu

SEQ ID NO: 52975 - RNA, 20 nt, Artificial Sequence
  MKO10052975_A_Tbk1
  gRNA
gcugccguuuagacccuucg

SEQ ID NO: 52976 - RNA, 20 nt, Artificial Sequence
  MKO10052976_A_Tbkbp1
  gRNA
gccguagaugagucucuacc

SEQ ID NO: 52977 - RNA, 20 nt, Artificial Sequence
  MKO10052977_A_Tbkbp1
  gRNA
gaagucucucgcauuccgcc

SEQ ID NO: 52978 - RNA, 20 nt, Artificial Sequence
  MKO10052978_A_Tbkbp1
  gRNA
gugcguggagaaaagcgacu

SEQ ID NO: 52979 - RNA, 20 nt, Artificial Sequence
  MKO10052979_A_Tbl1xr1
  gRNA
agacgugacauccuuguuac

SEQ ID NO: 52980 - RNA, 20 nt, Artificial Sequence
  MKO10052980_A_Tbl1xr1
  gRNA
ccgaagcacaaccgcuuuau

SEQ ID NO: 52981 - RNA, 20 nt, Artificial Sequence
  MKO10052981_A_Tbl1xr1
  gRNA
ugucuaagcacgagcugcgu

SEQ ID NO: 52982 - RNA, 20 nt, Artificial Sequence
  MKO10052982_A_Tbl1x
  gRNA
ucacagcaucaauuaacgau

SEQ ID NO: 52983 - RNA, 20 nt, Artificial Sequence
  MKO10052983_A_Tbl1x
  gRNA
acuuucgaucccaaacguga

SEQ ID NO: 52984 - RNA, 20 nt, Artificial Sequence
  MKO10052984_A_Tbl1x
  gRNA
cacuaguguaccauugaugu

SEQ ID NO: 52985 - RNA, 20 nt, Artificial Sequence
  MKO10052985_A_Tbl2
  gRNA
agugcggucauccgcacagg

SEQ ID NO: 52986 - RNA, 20 nt, Artificial Sequence
  MKO10052986_A_Tbl2
  gRNA
ugaagcguaccaagguggca

SEQ ID NO: 52987 - RNA, 20 nt, Artificial Sequence
  MKO10052987_A_Tbl2
  gRNA
aaagcccccaucuucccgcu

SEQ ID NO: 52988 - RNA, 20 nt, Artificial Sequence
  MKO10052988_A_Tbl3
  gRNA
aggggcuuugcuucggagcc

SEQ ID NO: 52989 - RNA, 20 nt, Artificial Sequence
  MKO10052989_A_Tbl3
  gRNA
agccagccgcgcacugcugc

SEQ ID NO: 52990 - RNA, 20 nt, Artificial Sequence
  MKO10052990_A_Tbl3
  gRNA
agugacagugccuucccgcc

SEQ ID NO: 52991 - RNA, 20 nt, Artificial Sequence
  MKO10052991_A_Tbpl1
  gRNA
gcccguagucugcagaaacu

SEQ ID NO: 52992 - RNA, 20 nt, Artificial Sequence
  MKO10052992_A_Tbpl1
  gRNA
agacuuuauccgauagcaca

SEQ ID NO: 52993 - RNA, 20 nt, Artificial Sequence
  MKO10052993_A_Tbpl1
  gRNA
uucauccugccgugugcuau

SEQ ID NO: 52994 - RNA, 20 nt, Artificial Sequence
  MKO10052994_A_Tbpl2
  gRNA
agcgagaaaguaugcucgug

SEQ ID NO: 52995 - RNA, 20 nt, Artificial Sequence
  MKO10052995_A_Tbpl2
  gRNA
cauaccuacugaacugccga

SEQ ID NO: 52996 - RNA, 20 nt, Artificial Sequence
  MKO10052996_A_Tbpl2
  gRNA
uguaguuuccacugcaaauc

SEQ ID NO: 52997 - RNA, 20 nt, Artificial Sequence
  MKO10052997_A_Tbp
  gRNA
ggaguaaguccugugccgua

SEQ ID NO: 52998 - RNA, 20 nt, Artificial Sequence
  MKO10052998_A_Tbp
  gRNA
aaaaucaacgcaguuguccg

SEQ ID NO: 52999 - RNA, 20 nt, Artificial Sequence
  MKO10052999_A_Tbp
  gRNA
auuguaucuaccgugaaucu

SEQ ID NO: 53000 - RNA, 20 nt, Artificial Sequence
  MKO10053000_A_Tbr1
  gRNA
gccuccuuacauccguguuc

SEQ ID NO: 53001 - RNA, 20 nt, Artificial Sequence
  MKO10053001_A_Tbr1
  gRNA
guaccagccccgucugcacg

SEQ ID NO: 53002 - RNA, 20 nt, Artificial Sequence
  MKO10053002_A_Tbr1
  gRNA
aaaccgggucuauaugcauc

SEQ ID NO: 53003 - RNA, 20 nt, Artificial Sequence
  MKO10053003_A_Tbrg1
  gRNA
accgccguccuugaucugac

SEQ ID NO: 53004 - RNA, 20 nt, Artificial Sequence
  MKO10053004_A_Tbrg1
  gRNA
ugucagacccccuaguccga

SEQ ID NO: 53005 - RNA, 20 nt, Artificial Sequence
  MKO10053005_A_Tbrg1
  gRNA
acugguucgacccauugccc

SEQ ID NO: 53006 - RNA, 20 nt, Artificial Sequence
  MKO10053006_A_Tbrg4
  gRNA
gaucaacgacagccguacau

SEQ ID NO: 53007 - RNA, 20 nt, Artificial Sequence
  MKO10053007_A_Tbrg4
  gRNA
cuggaccuggccuacgccua

SEQ ID NO: 53008 - RNA, 20 nt, Artificial Sequence
  MKO10053008_A_Tbrg4
  gRNA
gcagcaagggcaccgaccgc

SEQ ID NO: 53009 - RNA, 20 nt, Artificial Sequence
  MKO10053009_A_Tbx10
  gRNA
cguggccauugucguccauc

SEQ ID NO: 53010 - RNA, 20 nt, Artificial Sequence
  MKO10053010_A_Tbx10
  gRNA
guggguccacgaagaccacg

SEQ ID NO: 53011 - RNA, 20 nt, Artificial Sequence
  MKO10053011_A_Tbx10
  gRNA
uuaucagccccguuuccacg

SEQ ID NO: 53012 - RNA, 20 nt, Artificial Sequence
  MKO10053012_A_Tbx15
  gRNA
ucaucucuguuccgauauca

SEQ ID NO: 53013 - RNA, 20 nt, Artificial Sequence
  MKO10053013_A_Tbx15
  gRNA
gccaugagagugaaaaucac

SEQ ID NO: 53014 - RNA, 20 nt, Artificial Sequence
  MKO10053014_A_Tbx15
  gRNA
gguccgcucggugagcaccu

SEQ ID NO: 53015 - RNA, 20 nt, Artificial Sequence
  MKO10053015_A_Tbx18
  gRNA
cggucgugccaagccaggua

SEQ ID NO: 53016 - RNA, 20 nt, Artificial Sequence
  MKO10053016_A_Tbx18
  gRNA
ccaacggggaggcgcccugc

SEQ ID NO: 53017 - RNA, 20 nt, Artificial Sequence
  MKO10053017_A_Tbx18
  gRNA
gagaucuucacccgcauugc

SEQ ID NO: 53018 - RNA, 20 nt, Artificial Sequence
  MKO10053018_A_Tbx19
  gRNA
uccggaccgacagucaccgc

SEQ ID NO: 53019 - RNA, 20 nt, Artificial Sequence
  MKO10053019_A_Tbx19
  gRNA
cgguccggacgaaguccagu

SEQ ID NO: 53020 - RNA, 20 nt, Artificial Sequence
  MKO10053020_A_Tbx19
  gRNA
caaguacaacccuuucgcca

SEQ ID NO: 53021 - RNA, 20 nt, Artificial Sequence
  MKO10053021_A_Tbx1
  gRNA
ccguagaugacaagcgcuac

SEQ ID NO: 53022 - RNA, 20 nt, Artificial Sequence
  MKO10053022_A_Tbx1
  gRNA
ccgguagcgcuugucaucua

SEQ ID NO: 53023 - RNA, 20 nt, Artificial Sequence
  MKO10053023_A_Tbx1
  gRNA
acacuaccacccggacucgc

SEQ ID NO: 53024 - RNA, 20 nt, Artificial Sequence
  MKO10053024_A_Tbx20
  gRNA
aucgccgcgcuuauguccag

SEQ ID NO: 53025 - RNA, 20 nt, Artificial Sequence
  MKO10053025_A_Tbx20
  gRNA
ccaccgggacgauguccauc

SEQ ID NO: 53026 - RNA, 20 nt, Artificial Sequence
  MKO10053026_A_Tbx20
  gRNA
gccgccgcuggacauaagcg

SEQ ID NO: 53027 - RNA, 20 nt, Artificial Sequence
  MKO10053027_A_Tbx21
  gRNA
caccacuggcgguaccagag

SEQ ID NO: 53028 - RNA, 20 nt, Artificial Sequence
  MKO10053028_A_Tbx21
  gRNA
augcgccaggaaguuucauu

SEQ ID NO: 53029 - RNA, 20 nt, Artificial Sequence
  MKO10053029_A_Tbx21
  gRNA
ccgggcucaccucugcguuc

SEQ ID NO: 53030 - RNA, 20 nt, Artificial Sequence
  MKO10053030_A_Tbx22
  gRNA
ucgcgcgcacgccuucuccg

SEQ ID NO: 53031 - RNA, 20 nt, Artificial Sequence
  MKO10053031_A_Tbx22
  gRNA
accaaguuaccuauagcguu

SEQ ID NO: 53032 - RNA, 20 nt, Artificial Sequence
  MKO10053032_A_Tbx22
  gRNA
cgguggauuccaaacgcuau

SEQ ID NO: 53033 - RNA, 20 nt, Artificial Sequence
  MKO10053033_A_Tbx2
  gRNA
gagggcggugguucucgcgc

SEQ ID NO: 53034 - RNA, 20 nt, Artificial Sequence
  MKO10053034_A_Tbx2
  gRNA
cacuguaagccggagcguga

SEQ ID NO: 53035 - RNA, 20 nt, Artificial Sequence
  MKO10053035_A_Tbx2
  gRNA
aaacuuauagcggcagucau

SEQ ID NO: 53036 - RNA, 20 nt, Artificial Sequence
  MKO10053036_A_Tbx3
  gRNA
gccccgcuacgggggagcaa

SEQ ID NO: 53037 - RNA, 20 nt, Artificial Sequence
  MKO10053037_A_Tbx3
  gRNA
cauccauugcucccccguag

SEQ ID NO: 53038 - RNA, 20 nt, Artificial Sequence
  MKO10053038_A_Tbx3
  gRNA
cuguaccccgcuugugaaac

SEQ ID NO: 53039 - RNA, 20 nt, Artificial Sequence
  MKO10053039_A_Tbx4
  gRNA
gccaaaagcauuguucucgu

SEQ ID NO: 53040 - RNA, 20 nt, Artificial Sequence
  MKO10053040_A_Tbx4
  gRNA
gccgacgagaacaaugcuuu

SEQ ID NO: 53041 - RNA, 20 nt, Artificial Sequence
  MKO10053041_A_Tbx4
  gRNA
uucguuggcaggauggucgc

SEQ ID NO: 53042 - RNA, 20 nt, Artificial Sequence
  MKO10053042_A_Tbx5
  gRNA
cacguaaaggcgccccggca

SEQ ID NO: 53043 - RNA, 20 nt, Artificial Sequence
  MKO10053043_A_Tbx5
  gRNA
ccuucauguagguccguaac

SEQ ID NO: 53044 - RNA, 20 nt, Artificial Sequence
  MKO10053044_A_Tbx5
  gRNA
cugcuuucacgauguguaau

SEQ ID NO: 53045 - RNA, 20 nt, Artificial Sequence
  MKO10053045_A_Tbx6
  gRNA
uggauggggcccgauaccgc

SEQ ID NO: 53046 - RNA, 20 nt, Artificial Sequence
  MKO10053046_A_Tbx6
  gRNA
uguuggugagcuuaacacga

SEQ ID NO: 53047 - RNA, 20 nt, Artificial Sequence
  MKO10053047_A_Tbx6
  gRNA
guaccagccucgcauccacc

SEQ ID NO: 53048 - RNA, 20 nt, Artificial Sequence
  MKO10053048_A_Tbxa2r
  gRNA
agcguguugcgacgccacga

SEQ ID NO: 53049 - RNA, 20 nt, Artificial Sequence
  MKO10053049_A_Tbxa2r
  gRNA
agcgaaccauggcgacgcga

SEQ ID NO: 53050 - RNA, 20 nt, Artificial Sequence
  MKO10053050_A_Tbxa2r
  gRNA
ucuuucgccggucugugcuc

SEQ ID NO: 53051 - RNA, 20 nt, Artificial Sequence
  MKO10053051_A_Tbxas1
  gRNA
acagaggcccguaucgcucu

SEQ ID NO: 53052 - RNA, 20 nt, Artificial Sequence
  MKO10053052_A_Tbxas1
  gRNA
aucuucugucacguaacaac

SEQ ID NO: 53053 - RNA, 20 nt, Artificial Sequence
  MKO10053053_A_Tbxas1
  gRNA
gagcgauacgggccucugug

SEQ ID NO: 53054 - RNA, 20 nt, Artificial Sequence
  MKO10053054_A_Tc2n
  gRNA
agaaagcgccuacuuaaauc

SEQ ID NO: 53055 - RNA, 20 nt, Artificial Sequence
  MKO10053055_A_Tc2n
  gRNA
guucuaguaaagccucaagu

SEQ ID NO: 53056 - RNA, 20 nt, Artificial Sequence
  MKO10053056_A_Tc2n
  gRNA
uucaucucagcgauucaucc

SEQ ID NO: 53057 - RNA, 20 nt, Artificial Sequence
  MKO10053057_A_Tcaim
  gRNA
caggagccuaucaguacuac

SEQ ID NO: 53058 - RNA, 20 nt, Artificial Sequence
  MKO10053058_A_Tcaim
  gRNA
cgauccagcuccuuccgaag

SEQ ID NO: 53059 - RNA, 20 nt, Artificial Sequence
  MKO10053059_A_Tcaim
  gRNA
cacuacucucgagcuuuauc

SEQ ID NO: 53060 - RNA, 20 nt, Artificial Sequence
  MKO10053060_A_Tcam1
  gRNA
uaagaaggucucgauuccac

SEQ ID NO: 53061 - RNA, 20 nt, Artificial Sequence
  MKO10053061_A_Tcam1
  gRNA
cacgugucauguaccuagug

SEQ ID NO: 53062 - RNA, 20 nt, Artificial Sequence
  MKO10053062_A_Tcam1
  gRNA
uuaacguccgucccugccag

SEQ ID NO: 53063 - RNA, 20 nt, Artificial Sequence
  MKO10053063_A_Tcap
  gRNA
aucgagacaggguacggcgc

SEQ ID NO: 53064 - RNA, 20 nt, Artificial Sequence
  MKO10053064_A_Tcap
  gRNA
uuucagaugcuccuugcacg

SEQ ID NO: 53065 - RNA, 20 nt, Artificial Sequence
  MKO10053065_A_Tcap
  gRNA
acacucaccccucuuccggc

SEQ ID NO: 53066 - RNA, 20 nt, Artificial Sequence
  MKO10053066_A_Tcea1
  gRNA
gccuugcaguccacaagaau

SEQ ID NO: 53067 - RNA, 20 nt, Artificial Sequence
  MKO10053067_A_Tcea1
  gRNA
caucugugcucugcuugcga

SEQ ID NO: 53068 - RNA, 20 nt, Artificial Sequence
  MKO10053068_A_Tcea1
  gRNA
caugacccuagaauugcuac

SEQ ID NO: 53069 - RNA, 20 nt, Artificial Sequence
  MKO10053069_A_Tcea2
  gRNA
aacacucacggucaguuugc

SEQ ID NO: 53070 - RNA, 20 nt, Artificial Sequence
  MKO10053070_A_Tcea2
  gRNA
gucuugcaguccacccgugu

SEQ ID NO: 53071 - RNA, 20 nt, Artificial Sequence
  MKO10053071_A_Tcea2
  gRNA
ccugagauccguaguccuug

SEQ ID NO: 53072 - RNA, 20 nt, Artificial Sequence
  MKO10053072_A_Tcea3
  gRNA
guugacugccacuccgaucc

SEQ ID NO: 53073 - RNA, 20 nt, Artificial Sequence
  MKO10053073_A_Tcea3
  gRNA
gacucccccagaaccaccaa

SEQ ID NO: 53074 - RNA, 20 nt, Artificial Sequence
  MKO10053074_A_Tcea3
  gRNA
gagggggagagcccaaaacu

SEQ ID NO: 53075 - RNA, 20 nt, Artificial Sequence
  MKO10053075_A_Tceal1
  gRNA
cguauccgcccucaauucau

SEQ ID NO: 53076 - RNA, 20 nt, Artificial Sequence
  MKO10053076_A_Tceal1
  gRNA
guucgaagaccguauuccca

SEQ ID NO: 53077 - RNA, 20 nt, Artificial Sequence
  MKO10053077_A_Tceal1
  gRNA
gucugaagaucguccuccgc

SEQ ID NO: 53078 - RNA, 20 nt, Artificial Sequence
  MKO10053078_A_Tceal3
  gRNA
cuugacauggaagaaguucg

SEQ ID NO: 53079 - RNA, 20 nt, Artificial Sequence
  MKO10053079_A_Tceal3
  gRNA
cucaccccccugacuccccg

SEQ ID NO: 53080 - RNA, 20 nt, Artificial Sequence
  MKO10053080_A_Tceal3
  gRNA
ucaucuugcccuugcucauc

SEQ ID NO: 53081 - RNA, 20 nt, Artificial Sequence
  MKO10053081_A_Tceal5
  gRNA
agcacgccagggcaagcuag

SEQ ID NO: 53082 - RNA, 20 nt, Artificial Sequence
  MKO10053082_A_Tceal5
  gRNA
ccuccaccucuagcuugccc

SEQ ID NO: 53083 - RNA, 20 nt, Artificial Sequence
  MKO10053083_A_Tceal5
  gRNA
ggcugaaggcauuaaacaaa

SEQ ID NO: 53084 - RNA, 20 nt, Artificial Sequence
  MKO10053084_A_Tceal6
  gRNA
cuugacauggaagaaguccg

SEQ ID NO: 53085 - RNA, 20 nt, Artificial Sequence
  MKO10053085_A_Tceal6
  gRNA
ucaucuugccccugcucauc

SEQ ID NO: 53086 - RNA, 20 nt, Artificial Sequence
  MKO10053086_A_Tceal6
  gRNA
gagagugcacagauaugacu

SEQ ID NO: 53087 - RNA, 20 nt, Artificial Sequence
  MKO10053087_A_Tceal7
  gRNA
caacccugcggagcacuuga

SEQ ID NO: 53088 - RNA, 20 nt, Artificial Sequence
  MKO10053088_A_Tceal7
  gRNA
auucuaaccguacccauucu

SEQ ID NO: 53089 - RNA, 20 nt, Artificial Sequence
  MKO10053089_A_Tceal7
  gRNA
ugaaauugccuuccagucgc

SEQ ID NO: 53090 - RNA, 20 nt, Artificial Sequence
  MKO10053090_A_Tceal8
  gRNA
ccuugcgggaguguccucuu

SEQ ID NO: 53091 - RNA, 20 nt, Artificial Sequence
  MKO10053091_A_Tceal8
  gRNA
uacgccucuuaucacuucuu

SEQ ID NO: 53092 - RNA, 20 nt, Artificial Sequence
  MKO10053092_A_Tceal8
  gRNA
guccuuacccugugugcuuc

SEQ ID NO: 53093 - RNA, 20 nt, Artificial Sequence
  MKO10053093_A_Tceanc2
  gRNA
aauucgucauucgaacgccu

SEQ ID NO: 53094 - RNA, 20 nt, Artificial Sequence
  MKO10053094_A_Tceanc2
  gRNA
ucgcuccggacuucaauaga

SEQ ID NO: 53095 - RNA, 20 nt, Artificial Sequence
  MKO10053095_A_Tceanc2
  gRNA
ucauuaacgggcccuaccgg

SEQ ID NO: 53096 - RNA, 20 nt, Artificial Sequence
  MKO10053096_A_Tceanc
  gRNA
gaaugcacucgcaagagcuc

SEQ ID NO: 53097 - RNA, 20 nt, Artificial Sequence
  MKO10053097_A_Tceanc
  gRNA
cucuagccauagugagauca

SEQ ID NO: 53098 - RNA, 20 nt, Artificial Sequence
  MKO10053098_A_Tceanc
  gRNA
uccaugugccaucaacugau

SEQ ID NO: 53099 - RNA, 20 nt, Artificial Sequence
  MKO10053099_A_Tceb1
  gRNA
gauggagaggagaagaccua

SEQ ID NO: 53100 - RNA, 20 nt, Artificial Sequence
  MKO10053100_A_Tceb1
  gRNA
acaauaaaggcuauguugag

SEQ ID NO: 53101 - RNA, 20 nt, Artificial Sequence
  MKO10053101_A_Tceb1
  gRNA
ugcugagaaugaaaccaacg

SEQ ID NO: 53102 - RNA, 20 nt, Artificial Sequence
  MKO10053102_A_Tceb2
  gRNA
cgaacugaagcgcaucgucg

SEQ ID NO: 53103 - RNA, 20 nt, Artificial Sequence
  MKO10053103_A_Tceb2
  gRNA
agccaucuuaccugcucgga

SEQ ID NO: 53104 - RNA, 20 nt, Artificial Sequence
  MKO10053104_A_Tceb2
  gRNA
aggacguguuucucaugauc

SEQ ID NO: 53105 - RNA, 20 nt, Artificial Sequence
  MKO10053105_A_Tceb3
  gRNA
gggccgguaguuggcaugaa

SEQ ID NO: 53106 - RNA, 20 nt, Artificial Sequence
  MKO10053106_A_Tceb3
  gRNA
cagaguuaccuuucgaggcc

SEQ ID NO: 53107 - RNA, 20 nt, Artificial Sequence
  MKO10053107_A_Tceb3
  gRNA
cgaacccaccaggccucgaa

SEQ ID NO: 53108 - RNA, 20 nt, Artificial Sequence
  MKO10053108_A_Tcerg1l
  gRNA
uggaagaguaccgauuccuc

SEQ ID NO: 53109 - RNA, 20 nt, Artificial Sequence
  MKO10053109_A_Tcerg1l
  gRNA
ugaugcuacgugccccagag

SEQ ID NO: 53110 - RNA, 20 nt, Artificial Sequence
  MKO10053110_A_Tcerg1l
  gRNA
cuguagaccccgaggaacuc

SEQ ID NO: 53111 - RNA, 20 nt, Artificial Sequence
  MKO10053111_A_Tcerg1
  gRNA
ccaccaaaugccgugaugcg

SEQ ID NO: 53112 - RNA, 20 nt, Artificial Sequence
  MKO10053112_A_Tcerg1
  gRNA
ggcugggguacgguuugcac

SEQ ID NO: 53113 - RNA, 20 nt, Artificial Sequence
  MKO10053113_A_Tcerg1
  gRNA
uaugggcccaccucaccuac

SEQ ID NO: 53114 - RNA, 20 nt, Artificial Sequence
  MKO10053114_A_Tcf12
  gRNA
aguagucaguucagcggguc

SEQ ID NO: 53115 - RNA, 20 nt, Artificial Sequence
  MKO10053115_A_Tcf12
  gRNA
cacuugaaugacagucgauu

SEQ ID NO: 53116 - RNA, 20 nt, Artificial Sequence
  MKO10053116_A_Tcf12
  gRNA
uguuggggacaagccuucgu

SEQ ID NO: 53117 - RNA, 20 nt, Artificial Sequence
  MKO10053117_A_Tcf15
  gRNA
gcgcggcugacggccgucgg

SEQ ID NO: 53118 - RNA, 20 nt, Artificial Sequence
  MKO10053118_A_Tcf15
  gRNA
cagucguucggcugcugcga

SEQ ID NO: 53119 - RNA, 20 nt, Artificial Sequence
  MKO10053119_A_Tcf15
  gRNA
gcagggcagccgucgugacc

SEQ ID NO: 53120 - RNA, 20 nt, Artificial Sequence
  MKO10053120_A_Tcf19
  gRNA
cgcccccuauacgcagcagc

SEQ ID NO: 53121 - RNA, 20 nt, Artificial Sequence
  MKO10053121_A_Tcf19
  gRNA
gcaccuaucgauugggcugc

SEQ ID NO: 53122 - RNA, 20 nt, Artificial Sequence
  MKO10053122_A_Tcf19
  gRNA
uugcagccauaaccgucccu

SEQ ID NO: 53123 - RNA, 20 nt, Artificial Sequence
  MKO10053123_A_Tcf20
  gRNA
acccgccuucgcaugauuaa

SEQ ID NO: 53124 - RNA, 20 nt, Artificial Sequence
  MKO10053124_A_Tcf20
  gRNA
agccguaacaugacguuacu

SEQ ID NO: 53125 - RNA, 20 nt, Artificial Sequence
  MKO10053125_A_Tcf20
  gRNA
guccaacuuaccugcgucaa

SEQ ID NO: 53126 - RNA, 20 nt, Artificial Sequence
  MKO10053126_A_Tcf21
  gRNA
gagcauuggccgcguugcgc

SEQ ID NO: 53127 - RNA, 20 nt, Artificial Sequence
  MKO10053127_A_Tcf21
  gRNA
acgcggccaaugcucgugag

SEQ ID NO: 53128 - RNA, 20 nt, Artificial Sequence
  MKO10053128_A_Tcf21
  gRNA
gugaccgccaaccgcuugug

SEQ ID NO: 53129 - RNA, 20 nt, Artificial Sequence
  MKO10053129_A_Tcf23
  gRNA
uccaccacagcuaucacgac

SEQ ID NO: 53130 - RNA, 20 nt, Artificial Sequence
  MKO10053130_A_Tcf23
  gRNA
acgcagcacgggaacggacu

SEQ ID NO: 53131 - RNA, 20 nt, Artificial Sequence
  MKO10053131_A_Tcf23
  gRNA
gacgcuucgucaggccuuuc

SEQ ID NO: 53132 - RNA, 20 nt, Artificial Sequence
  MKO10053132_A_Tcf24
  gRNA
agcgggacggccgcgcucca

SEQ ID NO: 53133 - RNA, 20 nt, Artificial Sequence
  MKO10053133_A_Tcf24
  gRNA
accgacgcgcccggagaccc

SEQ ID NO: 53134 - RNA, 20 nt, Artificial Sequence
  MKO10053134_A_Tcf24
  gRNA
uucggacuaaguggaucauu

SEQ ID NO: 53135 - RNA, 20 nt, Artificial Sequence
  MKO10053135_A_Tcf25
  gRNA
ugucggguccuaugucgcgc

SEQ ID NO: 53136 - RNA, 20 nt, Artificial Sequence
  MKO10053136_A_Tcf25
  gRNA
acaucgaucgcaucuuagag

SEQ ID NO: 53137 - RNA, 20 nt, Artificial Sequence
  MKO10053137_A_Tcf25
  gRNA
aggacaaacuucaaggcguc

SEQ ID NO: 53138 - RNA, 20 nt, Artificial Sequence
  MKO10053138_A_Tcf3
  gRNA
uucccccgagggaggcgggc

SEQ ID NO: 53139 - RNA, 20 nt, Artificial Sequence
  MKO10053139_A_Tcf3
  gRNA
cugccgccuuccacguuccu

SEQ ID NO: 53140 - RNA, 20 nt, Artificial Sequence
  MKO10053140_A_Tcf3
  gRNA
acagauguucccgcuaccug

SEQ ID NO: 53141 - RNA, 20 nt, Artificial Sequence
  MKO10053141_A_Tcf4
  gRNA
uguccacucgccaaagaagu

SEQ ID NO: 53142 - RNA, 20 nt, Artificial Sequence
  MKO10053142_A_Tcf4
  gRNA
auacuuacccuggacgggcu

SEQ ID NO: 53143 - RNA, 20 nt, Artificial Sequence
  MKO10053143_A_Tcf4
  gRNA
ccuaugaccacaugacuagc

SEQ ID NO: 53144 - RNA, 20 nt, Artificial Sequence
  MKO10053144_A_Tcf7l1
  gRNA
ccuucggcgaaauagucgcg

SEQ ID NO: 53145 - RNA, 20 nt, Artificial Sequence
  MKO10053145_A_Tcf7l1
  gRNA
ccgcgcgacuauuucgccga

SEQ ID NO: 53146 - RNA, 20 nt, Artificial Sequence
  MKO10053146_A_Tcf7l1
  gRNA
ucagcucgucguucgcuccg

SEQ ID NO: 53147 - RNA, 20 nt, Artificial Sequence
  MKO10053147_A_Tcf7l2
  gRNA
aaacagcuccuccgauuccg

SEQ ID NO: 53148 - RNA, 20 nt, Artificial Sequence
  MKO10053148_A_Tcf7l2
  gRNA
gcgagagcgauccguugggg

SEQ ID NO: 53149 - RNA, 20 nt, Artificial Sequence
  MKO10053149_A_Tcf7l2
  gRNA
acggcgaacgagcauccuug

SEQ ID NO: 53150 - RNA, 20 nt, Artificial Sequence
  MKO10053150_A_Tcf7
  gRNA
cugcugaaauguucguagag

SEQ ID NO: 53151 - RNA, 20 nt, Artificial Sequence
  MKO10053151_A_Tcf7
  gRNA
gaagugcugucuauauccgc

SEQ ID NO: 53152 - RNA, 20 nt, Artificial Sequence
  MKO10053152_A_Tcf7
  gRNA
agcucccccauacugugagc

SEQ ID NO: 53153 - RNA, 20 nt, Artificial Sequence
  MKO10053153_A_Tcfl5
  gRNA
ucggaguagaauccgccagc

SEQ ID NO: 53154 - RNA, 20 nt, Artificial Sequence
  MKO10053154_A_Tcfl5
  gRNA
auaaccgaauggaacgagau

SEQ ID NO: 53155 - RNA, 20 nt, Artificial Sequence
  MKO10053155_A_Tcfl5
  gRNA
agcauuccugaaguacauuc

SEQ ID NO: 53156 - RNA, 20 nt, Artificial Sequence
  MKO10053156_A_Tchhl1
  gRNA
auuccacaaguacgccauug

SEQ ID NO: 53157 - RNA, 20 nt, Artificial Sequence
  MKO10053157_A_Tchhl1
  gRNA
cauccucaauggcguacuug

SEQ ID NO: 53158 - RNA, 20 nt, Artificial Sequence
  MKO10053158_A_Tchhl1
  gRNA
ugucaguaguagcugcuacc

SEQ ID NO: 53159 - RNA, 20 nt, Artificial Sequence
  MKO10053159_A_Tchh
  gRNA
gcgccgucaugaggaguucg

SEQ ID NO: 53160 - RNA, 20 nt, Artificial Sequence
  MKO10053160_A_Tchh
  gRNA
aggcgcgccagcgcaaccag

SEQ ID NO: 53161 - RNA, 20 nt, Artificial Sequence
  MKO10053161_A_Tchh
  gRNA
ucgacaaugcuucuuauaag

SEQ ID NO: 53162 - RNA, 20 nt, Artificial Sequence
  MKO10053162_A_Tchp
  gRNA
accaguacgcagcagcccgc

SEQ ID NO: 53163 - RNA, 20 nt, Artificial Sequence
  MKO10053163_A_Tchp
  gRNA
cguucucaccucucgaaguu

SEQ ID NO: 53164 - RNA, 20 nt, Artificial Sequence
  MKO10053164_A_Tchp
  gRNA
gaacaaccccaaacuucgag

SEQ ID NO: 53165 - RNA, 20 nt, Artificial Sequence
  MKO10053165_A_Tcirg1
  gRNA
cgccuuccagagacgcuucg

SEQ ID NO: 53166 - RNA, 20 nt, Artificial Sequence
  MKO10053166_A_Tcirg1
  gRNA
cgucuaccacgaagcgucuc

SEQ ID NO: 53167 - RNA, 20 nt, Artificial Sequence
  MKO10053167_A_Tcirg1
  gRNA
augcgcagcaggucucgggg

SEQ ID NO: 53168 - RNA, 20 nt, Artificial Sequence
  MKO10053168_A_Tcl1b1
  gRNA
cuaccuggucuccguuagac

SEQ ID NO: 53169 - RNA, 20 nt, Artificial Sequence
  MKO10053169_A_Tcl1b1
  gRNA
acgacuuucuacccacgacg

SEQ ID NO: 53170 - RNA, 20 nt, Artificial Sequence
  MKO10053170_A_Tcl1b1
  gRNA
uguugcccaguauauguucc

SEQ ID NO: 53171 - RNA, 20 nt, Artificial Sequence
  MKO10053171_A_Tcl1b2
  gRNA
gauuguagggagcaggcucc

SEQ ID NO: 53172 - RNA, 20 nt, Artificial Sequence
  MKO10053172_A_Tcl1b2
  gRNA
acaacuuucuacccaugacg

SEQ ID NO: 53173 - RNA, 20 nt, Artificial Sequence
  MKO10053173_A_Tcl1b2
  gRNA
ccacaaguucugaucuccac

SEQ ID NO: 53174 - RNA, 20 nt, Artificial Sequence
  MKO10053174_A_Tcl1b3
  gRNA
cgacacauugcaacugaucc

SEQ ID NO: 53175 - RNA, 20 nt, Artificial Sequence
  MKO10053175_A_Tcl1b3
  gRNA
gaaacuucucguucaccaua

SEQ ID NO: 53176 - RNA, 20 nt, Artificial Sequence
  MKO10053176_A_Tcl1b3
  gRNA
ccucgcauauuacuaugucc

SEQ ID NO: 53177 - RNA, 20 nt, Artificial Sequence
  MKO10053177_A_Tcl1b4
  gRNA
guuaccuugaauccagcauc

SEQ ID NO: 53178 - RNA, 20 nt, Artificial Sequence
  MKO10053178_A_Tcl1b4
  gRNA
ugguccugaugcuggauuca

SEQ ID NO: 53179 - RNA, 20 nt, Artificial Sequence
  MKO10053179_A_Tcl1b4
  gRNA
gcaaggugggaauggcauac

SEQ ID NO: 53180 - RNA, 20 nt, Artificial Sequence
  MKO10053180_A_Tcl1b5
  gRNA
ccucgccuauuauuaugucc

SEQ ID NO: 53181 - RNA, 20 nt, Artificial Sequence
  MKO10053181_A_Tcl1b5
  gRNA
cgacacagugcaacugaccc

SEQ ID NO: 53182 - RNA, 20 nt, Artificial Sequence
  MKO10053182_A_Tcl1b5
  gRNA
gcauaugaccacacuccccc

SEQ ID NO: 53183 - RNA, 20 nt, Artificial Sequence
  MKO10053183_A_Tcl1
  gRNA
aauacauggagucgcagcuu

SEQ ID NO: 53184 - RNA, 20 nt, Artificial Sequence
  MKO10053184_A_Tcl1
  gRNA
cuggcugcccguagucauca

SEQ ID NO: 53185 - RNA, 20 nt, Artificial Sequence
  MKO10053185_A_Tcl1
  gRNA
cugcacaccccaaccgccug

SEQ ID NO: 53186 - RNA, 20 nt, Artificial Sequence
  MKO10053186_A_Tcn2
  gRNA
cgaauucuucgggagccgaa

SEQ ID NO: 53187 - RNA, 20 nt, Artificial Sequence
  MKO10053187_A_Tcn2
  gRNA
gcaacuacuguuaucaucgc

SEQ ID NO: 53188 - RNA, 20 nt, Artificial Sequence
  MKO10053188_A_Tcn2
  gRNA
gaaauugaaucgcuccaaac

SEQ ID NO: 53189 - RNA, 20 nt, Artificial Sequence
  MKO10053189_A_Tcof1
  gRNA
ccuuuacuucccgcgccgcg

SEQ ID NO: 53190 - RNA, 20 nt, Artificial Sequence
  MKO10053190_A_Tcof1
  gRNA
ccgcgcggcgcgggaaguaa

SEQ ID NO: 53191 - RNA, 20 nt, Artificial Sequence
  MKO10053191_A_Tcof1
  gRNA
cucgagacuucuuagccuga

SEQ ID NO: 53192 - RNA, 20 nt, Artificial Sequence
  MKO10053192_A_Tcp10a
  gRNA
caaauuucugcaaagaagcu

SEQ ID NO: 53193 - RNA, 20 nt, Artificial Sequence
  MKO10053193_A_Tcp10a
  gRNA
caagcuucuuugcagaaauu

SEQ ID NO: 53194 - RNA, 20 nt, Artificial Sequence
  MKO10053194_A_Tcp10a
  gRNA
uaaaagacagcauuucaucc

SEQ ID NO: 53195 - RNA, 20 nt, Artificial Sequence
  MKO10053195_A_Tcp10b
  gRNA
cccucuaucuuuacguacac

SEQ ID NO: 53196 - RNA, 20 nt, Artificial Sequence
  MKO10053196_A_Tcp10b
  gRNA
gccaguguacguaaagauag

SEQ ID NO: 53197 - RNA, 20 nt, Artificial Sequence
  MKO10053197_A_Tcp10b
  gRNA
gggugagccuauacaggcuu

SEQ ID NO: 53198 - RNA, 20 nt, Artificial Sequence
  MKO10053198_A_Tcp10c
  gRNA
aguguugcuugcucuugccg

SEQ ID NO: 53199 - RNA, 20 nt, Artificial Sequence
  MKO10053199_A_Tcp10c
  gRNA
cagaagcagaucugugaccu

SEQ ID NO: 53200 - RNA, 20 nt, Artificial Sequence
  MKO10053200_A_Tcp10c
  gRNA
uaaaagacagccuuucaucc

SEQ ID NO: 53201 - RNA, 20 nt, Artificial Sequence
  MKO10053201_A_Tcp11l1
  gRNA
cuaauucaacagcguuaauc

SEQ ID NO: 53202 - RNA, 20 nt, Artificial Sequence
  MKO10053202_A_Tcp11l1
  gRNA
aacgcuguugaauuagccga

SEQ ID NO: 53203 - RNA, 20 nt, Artificial Sequence
  MKO10053203_A_Tcp11l1
  gRNA
gauccaagacuuccguuauc

SEQ ID NO: 53204 - RNA, 20 nt, Artificial Sequence
  MKO10053204_A_Tcp11l2
  gRNA
aaaaugcucuccccgagaac

SEQ ID NO: 53205 - RNA, 20 nt, Artificial Sequence
  MKO10053205_A_Tcp11l2
  gRNA
caacagguuaccuguucucg

SEQ ID NO: 53206 - RNA, 20 nt, Artificial Sequence
  MKO10053206_A_Tcp11l2
  gRNA
agugaagcguguuguccacc

SEQ ID NO: 53207 - RNA, 20 nt, Artificial Sequence
  MKO10053207_A_Tcp11
  gRNA
accuacacgaucggugcccc

SEQ ID NO: 53208 - RNA, 20 nt, Artificial Sequence
  MKO10053208_A_Tcp11
  gRNA
gugugcgccaauccgagacg

SEQ ID NO: 53209 - RNA, 20 nt, Artificial Sequence
  MKO10053209_A_Tcp11
  gRNA
agcgccucccgugaaucccg

SEQ ID NO: 53210 - RNA, 20 nt, Artificial Sequence
  MKO10053210_A_Tcp1
  gRNA
gguggcaccaucguuaguaa

SEQ ID NO: 53211 - RNA, 20 nt, Artificial Sequence
  MKO10053211_A_Tcp1
  gRNA
gauguaaccauuacuaacga

SEQ ID NO: 53212 - RNA, 20 nt, Artificial Sequence
  MKO10053212_A_Tcp1
  gRNA
auuauuaacacagacgaacu

SEQ ID NO: 53213 - RNA, 20 nt, Artificial Sequence
  MKO10053213_A_Tcstv1
  gRNA
agggcagucuccaccgucac

SEQ ID NO: 53214 - RNA, 20 nt, Artificial Sequence
  MKO10053214_A_Tcstv1
  gRNA
gcugcugggcaugguuucaa

SEQ ID NO: 53215 - RNA, 20 nt, Artificial Sequence
  MKO10053215_A_Tcstv1
  gRNA
aauucugaggcacuuuguuu

SEQ ID NO: 53216 - RNA, 20 nt, Artificial Sequence
  MKO10053216_A_Tcstv3
  gRNA
auccugcaucuuauagugcc

SEQ ID NO: 53217 - RNA, 20 nt, Artificial Sequence
  MKO10053217_A_Tcstv3
  gRNA
ugccuggcacuauaagaugc

SEQ ID NO: 53218 - RNA, 20 nt, Artificial Sequence
  MKO10053218_A_Tcstv3
  gRNA
ucaaucugcgguaggauuuc

SEQ ID NO: 53219 - RNA, 20 nt, Artificial Sequence
  MKO10053219_A_Tcua
  gRNA
gcagcgacuuucugcgggag

SEQ ID NO: 53220 - RNA, 20 nt, Artificial Sequence
  MKO10053220_A_Tcua
  gRNA
gcccagcgcuccgagcaccg

SEQ ID NO: 53221 - RNA, 20 nt, Artificial Sequence
  MKO10053221_A_Tcua
  gRNA
caucagguguggauccauuc

SEQ ID NO: 53222 - RNA, 20 nt, Artificial Sequence
  MKO10053222_A_Tcue1
  gRNA
caaauguccgucgcaugcgc

SEQ ID NO: 53223 - RNA, 20 nt, Artificial Sequence
  MKO10053223_A_Tcue1
  gRNA
agcggggucggcauccgcac

SEQ ID NO: 53224 - RNA, 20 nt, Artificial Sequence
  MKO10053224_A_Tcue1
  gRNA
gggauacaucugacagucgc

SEQ ID NO: 53225 - RNA, 20 nt, Artificial Sequence
  MKO10053225_A_Tcue2
  gRNA
gacaaucucagucgcuaacc

SEQ ID NO: 53226 - RNA, 20 nt, Artificial Sequence
  MKO10053226_A_Tcue2
  gRNA
agucacgucgaagccuuccc

SEQ ID NO: 53227 - RNA, 20 nt, Artificial Sequence
  MKO10053227_A_Tcue2
  gRNA
caguagcugcuaucuccuug

SEQ ID NO: 53228 - RNA, 20 nt, Artificial Sequence
  MKO10053228_A_Tcue3
  gRNA
ccgaucaagauggagcggcg

SEQ ID NO: 53229 - RNA, 20 nt, Artificial Sequence
  MKO10053229_A_Tcue3
  gRNA
gacuccuucucgaacaugcu

SEQ ID NO: 53230 - RNA, 20 nt, Artificial Sequence
  MKO10053230_A_Tcue3
  gRNA
uaauuaccuuuaauaucugc

SEQ ID NO: 53231 - RNA, 20 nt, Artificial Sequence
  MKO10053231_A_Tcuex1d1
  gRNA
aagcagcgcaccuaacuggu

SEQ ID NO: 53232 - RNA, 20 nt, Artificial Sequence
  MKO10053232_A_Tcuex1d1
  gRNA
uuucuagguuauuaagaccc

SEQ ID NO: 53233 - RNA, 20 nt, Artificial Sequence
  MKO10053233_A_Tcuex1d1
  gRNA
auggaaaacaccuaccaguu

SEQ ID NO: 53234 - RNA, 20 nt, Artificial Sequence
  MKO10053234_A_Tcuex1d2
  gRNA
gucuagaauugggauaugac

SEQ ID NO: 53235 - RNA, 20 nt, Artificial Sequence
  MKO10053235_A_Tcuex1d2
  gRNA
acuuagguuuagacccucug

SEQ ID NO: 53236 - RNA, 20 nt, Artificial Sequence
  MKO10053236_A_Tcuex1d2
  gRNA
guaggacagcuuauucugug

SEQ ID NO: 53237 - RNA, 20 nt, Artificial Sequence
  MKO10053237_A_Tcuex1d4
  gRNA
aucauucccaguagaccgcg

SEQ ID NO: 53238 - RNA, 20 nt, Artificial Sequence
  MKO10053238_A_Tcuex1d4
  gRNA
cgccgguucuaagcgguaug

SEQ ID NO: 53239 - RNA, 20 nt, Artificial Sequence
  MKO10053239_A_Tcuex1d4
  gRNA
acccucauaccgcuuagaac

SEQ ID NO: 53240 - RNA, 20 nt, Artificial Sequence
  MKO10053240_A_Tcun1
  gRNA
uuggcucaccucguauuuag

SEQ ID NO: 53241 - RNA, 20 nt, Artificial Sequence
  MKO10053241_A_Tcun1
  gRNA
cguaugcuuacgugacaacu

SEQ ID NO: 53242 - RNA, 20 nt, Artificial Sequence
  MKO10053242_A_Tcun1
  gRNA
ugugcagaucagaaccccgc

SEQ ID NO: 53243 - RNA, 20 nt, Artificial Sequence
  MKO10053243_A_Tcun2
  gRNA
cggccgccgcaaugagacag

SEQ ID NO: 53244 - RNA, 20 nt, Artificial Sequence
  MKO10053244_A_Tcun2
  gRNA
cggccgccacaaguaggaac

SEQ ID NO: 53245 - RNA, 20 nt, Artificial Sequence
  MKO10053245_A_Tcun2
  gRNA
ucuguaacccacaacgcauc

SEQ ID NO: 53246 - RNA, 20 nt, Artificial Sequence
  MKO10053246_A_Tcun3
  gRNA
uccugaccuacuacccgagc

SEQ ID NO: 53247 - RNA, 20 nt, Artificial Sequence
  MKO10053247_A_Tcun3
  gRNA
agccgccaguacuauucuau

SEQ ID NO: 53248 - RNA, 20 nt, Artificial Sequence
  MKO10053248_A_Tcun3
  gRNA
acagcagcaguuuaaaucgc

SEQ ID NO: 53249 - RNA, 20 nt, Artificial Sequence
  MKO10053249_A_Tdgf1
  gRNA
ggguccaaauucaaacgcac

SEQ ID NO: 53250 - RNA, 20 nt, Artificial Sequence
  MKO10053250_A_Tdgf1
  gRNA
cuuaccacagccagguagaa

SEQ ID NO: 53251 - RNA, 20 nt, Artificial Sequence
  MKO10053251_A_Tdgf1
  gRNA
auuuccagugcguuugaauu

SEQ ID NO: 53252 - RNA, 20 nt, Artificial Sequence
  MKO10053252_A_Tdg
  gRNA
uuucuagauuggcauuaacc

SEQ ID NO: 53253 - RNA, 20 nt, Artificial Sequence
  MKO10053253_A_Tdg
  gRNA
aacuaccuggugcagguucc

SEQ ID NO: 53254 - RNA, 20 nt, Artificial Sequence
  MKO10053254_A_Tdg
  gRNA
gcccgaagacgcuccugucc

SEQ ID NO: 53255 - RNA, 20 nt, Artificial Sequence
  MKO10053255_A_Tdh
  gRNA
uuguuugugcccagcacgau

SEQ ID NO: 53256 - RNA, 20 nt, Artificial Sequence
  MKO10053256_A_Tdh
  gRNA
uuucccuacaggaaacgauu

SEQ ID NO: 53257 - RNA, 20 nt, Artificial Sequence
  MKO10053257_A_Tdh
  gRNA
ccggggagagguagguccaa

SEQ ID NO: 53258 - RNA, 20 nt, Artificial Sequence
  MKO10053258_A_Tdo2
  gRNA
cacuuugaaaaacguaucua

SEQ ID NO: 53259 - RNA, 20 nt, Artificial Sequence
  MKO10053259_A_Tdo2
  gRNA
acaugcucaaggugauagcu

SEQ ID NO: 53260 - RNA, 20 nt, Artificial Sequence
  MKO10053260_A_Tdo2
  gRNA
uaucuauggcaauuacuugc

SEQ ID NO: 53261 - RNA, 20 nt, Artificial Sequence
  MKO10053261_A_Tdp1
  gRNA
guuuaacuacugcuuugacg

SEQ ID NO: 53262 - RNA, 20 nt, Artificial Sequence
  MKO10053262_A_Tdp1
  gRNA
aggacucaccugaauuccgg

SEQ ID NO: 53263 - RNA, 20 nt, Artificial Sequence
  MKO10053263_A_Tdp1
  gRNA
gcagagggaaauguucgcau

SEQ ID NO: 53264 - RNA, 20 nt, Artificial Sequence
  MKO10053264_A_Tdp2
  gRNA
auggaugcaaucugcccgag

SEQ ID NO: 53265 - RNA, 20 nt, Artificial Sequence
  MKO10053265_A_Tdp2
  gRNA
aacuuacauuuacgcauagc

SEQ ID NO: 53266 - RNA, 20 nt, Artificial Sequence
  MKO10053266_A_Tdp2
  gRNA
caguguugaucuaaccaacg

SEQ ID NO: 53267 - RNA, 20 nt, Artificial Sequence
  MKO10053267_A_Tdpoz1
  gRNA
cucagaguggaagucgauau

SEQ ID NO: 53268 - RNA, 20 nt, Artificial Sequence
  MKO10053268_A_Tdpoz1
  gRNA
ugucagaaagcauuccacag

SEQ ID NO: 53269 - RNA, 20 nt, Artificial Sequence
  MKO10053269_A_Tdpoz1
  gRNA
aaaaauaaagagccccacug

SEQ ID NO: 53270 - RNA, 20 nt, Artificial Sequence
  MKO10053270_A_Tdpoz2
  gRNA
cauucaagcucugcguauau

SEQ ID NO: 53271 - RNA, 20 nt, Artificial Sequence
  MKO10053271_A_Tdpoz2
  gRNA
cuuucuucaucaaacccguu

SEQ ID NO: 53272 - RNA, 20 nt, Artificial Sequence
  MKO10053272_A_Tdpoz2
  gRNA
gcuagucucucuuccauuug

SEQ ID NO: 53273 - RNA, 20 nt, Artificial Sequence
  MKO10053273_A_Tdpoz3
  gRNA
gcagguguccucuucuguac

SEQ ID NO: 53274 - RNA, 20 nt, Artificial Sequence
  MKO10053274_A_Tdpoz3
  gRNA
cucuaaugagaacacugggc

SEQ ID NO: 53275 - RNA, 20 nt, Artificial Sequence
  MKO10053275_A_Tdpoz3
  gRNA
uugacaugccuguacagaag

SEQ ID NO: 53276 - RNA, 20 nt, Artificial Sequence
  MKO10053276_A_Tdpoz4
  gRNA
ugcacauuggaaaaugacgu

SEQ ID NO: 53277 - RNA, 20 nt, Artificial Sequence
  MKO10053277_A_Tdpoz4
  gRNA
acaugaccaucaaguccucc

SEQ ID NO: 53278 - RNA, 20 nt, Artificial Sequence
  MKO10053278_A_Tdpoz4
  gRNA
agaaauaaugucaggggaac

SEQ ID NO: 53279 - RNA, 20 nt, Artificial Sequence
  MKO10053279_A_Tdpoz5
  gRNA
agcagaaaugucagaggaca

SEQ ID NO: 53280 - RNA, 20 nt, Artificial Sequence
  MKO10053280_A_Tdpoz5
  gRNA
gaaugcuucagccaaccaag

SEQ ID NO: 53281 - RNA, 20 nt, Artificial Sequence
  MKO10053281_A_Tdpoz5
  gRNA
auccaggucauggaucucag

SEQ ID NO: 53282 - RNA, 20 nt, Artificial Sequence
  MKO10053282_A_Tdrd12
  gRNA
uaaaagacucuacugcaacu

SEQ ID NO: 53283 - RNA, 20 nt, Artificial Sequence
  MKO10053283_A_Tdrd12
  gRNA
uauacuuggcaaaaucgacc

SEQ ID NO: 53284 - RNA, 20 nt, Artificial Sequence
  MKO10053284_A_Tdrd12
  gRNA
guuccagaccugccacaaaa

SEQ ID NO: 53285 - RNA, 20 nt, Artificial Sequence
  MKO10053285_A_Tdrd1
  gRNA
ccagcacucuucaacucguu

SEQ ID NO: 53286 - RNA, 20 nt, Artificial Sequence
  MKO10053286_A_Tdrd1
  gRNA
ccuaacgaguugaagagugc

SEQ ID NO: 53287 - RNA, 20 nt, Artificial Sequence
  MKO10053287_A_Tdrd1
  gRNA
aguaguacgucugcuugcac

SEQ ID NO: 53288 - RNA, 20 nt, Artificial Sequence
  MKO10053288_A_Tdrd3
  gRNA
ccgcguugucccaggcgggu

SEQ ID NO: 53289 - RNA, 20 nt, Artificial Sequence
  MKO10053289_A_Tdrd3
  gRNA
ccgcaauguugcugcgccaa

SEQ ID NO: 53290 - RNA, 20 nt, Artificial Sequence
  MKO10053290_A_Tdrd3
  gRNA
gcccauccgucaucugcacg

SEQ ID NO: 53291 - RNA, 20 nt, Artificial Sequence
  MKO10053291_A_Tdrd5
  gRNA
aaaugaucguccaaaacgcc

SEQ ID NO: 53292 - RNA, 20 nt, Artificial Sequence
  MKO10053292_A_Tdrd5
  gRNA
agccuccacagaauuaaacg

SEQ ID NO: 53293 - RNA, 20 nt, Artificial Sequence
  MKO10053293_A_Tdrd5
  gRNA
gguccgaaacuccaugccaa

SEQ ID NO: 53294 - RNA, 20 nt, Artificial Sequence
  MKO10053294_A_Tdrd6
  gRNA
cccgagcuucucguugauac

SEQ ID NO: 53295 - RNA, 20 nt, Artificial Sequence
  MKO10053295_A_Tdrd6
  gRNA
gcggguucaucgauagcgcu

SEQ ID NO: 53296 - RNA, 20 nt, Artificial Sequence
  MKO10053296_A_Tdrd6
  gRNA
ucggaucgaaaugcgucgug

SEQ ID NO: 53297 - RNA, 20 nt, Artificial Sequence
  MKO10053297_A_Tdrd7
  gRNA
ugagguucaaaaccgcauaa

SEQ ID NO: 53298 - RNA, 20 nt, Artificial Sequence
  MKO10053298_A_Tdrd7
  gRNA
aacauaccauugacuuccgu

SEQ ID NO: 53299 - RNA, 20 nt, Artificial Sequence
  MKO10053299_A_Tdrd7
  gRNA
cuugggaguuaaggcugacg

SEQ ID NO: 53300 - RNA, 20 nt, Artificial Sequence
  MKO10053300_A_Tdrd9
  gRNA
acaucguagucacccagccg

SEQ ID NO: 53301 - RNA, 20 nt, Artificial Sequence
  MKO10053301_A_Tdrd9
  gRNA
agaugugcgugaacuccauc

SEQ ID NO: 53302 - RNA, 20 nt, Artificial Sequence
  MKO10053302_A_Tdrd9
  gRNA
uaguggucuagcacguacug

SEQ ID NO: 53303 - RNA, 20 nt, Artificial Sequence
  MKO10053303_A_Tdrkh
  gRNA
gauagagaugcgaguccccc

SEQ ID NO: 53304 - RNA, 20 nt, Artificial Sequence
  MKO10053304_A_Tdrkh
  gRNA
gacgauucguucuaucugua

SEQ ID NO: 53305 - RNA, 20 nt, Artificial Sequence
  MKO10053305_A_Tdrkh
  gRNA
aagcucaucauuggucgaca

SEQ ID NO: 53306 - RNA, 20 nt, Artificial Sequence
  MKO10053306_A_Tdrp
  gRNA
cguccagaagcacucgacuu

SEQ ID NO: 53307 - RNA, 20 nt, Artificial Sequence
  MKO10053307_A_Tdrp
  gRNA
gagccgaagucgagugcuuc

SEQ ID NO: 53308 - RNA, 20 nt, Artificial Sequence
  MKO10053308_A_Tdrp
  gRNA
ugaccagcuuucccgcugac

SEQ ID NO: 53309 - RNA, 20 nt, Artificial Sequence
  MKO10053309_A_Tead1
  gRNA
cccuccgcgucguugucaau

SEQ ID NO: 53310 - RNA, 20 nt, Artificial Sequence
  MKO10053310_A_Tead1
  gRNA
cuggcuaucuauccgccgug

SEQ ID NO: 53311 - RNA, 20 nt, Artificial Sequence
  MKO10053311_A_Tead1
  gRNA
uaacuuacccccggaccccc

SEQ ID NO: 53312 - RNA, 20 nt, Artificial Sequence
  MKO10053312_A_Tead2
  gRNA
gaagacgagaacgcgaaagc

SEQ ID NO: 53313 - RNA, 20 nt, Artificial Sequence
  MKO10053313_A_Tead2
  gRNA
uucgagccaaaaccugaaua

SEQ ID NO: 53314 - RNA, 20 nt, Artificial Sequence
  MKO10053314_A_Tead2
  gRNA
gacgauggccaccaugucuu

SEQ ID NO: 53315 - RNA, 20 nt, Artificial Sequence
  MKO10053315_A_Tead3
  gRNA
augaucuugcgccguccgca

SEQ ID NO: 53316 - RNA, 20 nt, Artificial Sequence
  MKO10053316_A_Tead3
  gRNA
aacguaccuuaaugccaacc

SEQ ID NO: 53317 - RNA, 20 nt, Artificial Sequence
  MKO10053317_A_Tead3
  gRNA
caagggucuggacaacgaug

SEQ ID NO: 53318 - RNA, 20 nt, Artificial Sequence
  MKO10053318_A_Tead4
  gRNA
ugcuugcccgucgaaaagcc

SEQ ID NO: 53319 - RNA, 20 nt, Artificial Sequence
  MKO10053319_A_Tead4
  gRNA
gucgggagagcuccacucgu

SEQ ID NO: 53320 - RNA, 20 nt, Artificial Sequence
  MKO10053320_A_Tead4
  gRNA
cgaaauugagcgaagcuucc

SEQ ID NO: 53321 - RNA, 20 nt, Artificial Sequence
  MKO10053321_A_Tecpr1
  gRNA
guggcccauauaaggucgug

SEQ ID NO: 53322 - RNA, 20 nt, Artificial Sequence
  MKO10053322_A_Tecpr1
  gRNA
agcuccugccgagcgaccgc

SEQ ID NO: 53323 - RNA, 20 nt, Artificial Sequence
  MKO10053323_A_Tecpr1
  gRNA
ucagggguggacauacgcua

SEQ ID NO: 53324 - RNA, 20 nt, Artificial Sequence
  MKO10053324_A_Tecpr2
  gRNA
gccguccuccauugugcagc

SEQ ID NO: 53325 - RNA, 20 nt, Artificial Sequence
  MKO10053325_A_Tecpr2
  gRNA
ccacgccagcgcugugaugc

SEQ ID NO: 53326 - RNA, 20 nt, Artificial Sequence
  MKO10053326_A_Tecpr2
  gRNA
auguggcuugaacgguccca

SEQ ID NO: 53327 - RNA, 20 nt, Artificial Sequence
  MKO10053327_A_Tecrl
  gRNA
aagugguacccuucucgaau

SEQ ID NO: 53328 - RNA, 20 nt, Artificial Sequence
  MKO10053328_A_Tecrl
  gRNA
cuuuagguggcccauauuug

SEQ ID NO: 53329 - RNA, 20 nt, Artificial Sequence
  MKO10053329_A_Tecrl
  gRNA
auucgagaaggguaccacuu

SEQ ID NO: 53330 - RNA, 20 nt, Artificial Sequence
  MKO10053330_A_Tecr
  gRNA
gcuuaccucguagugcuuca

SEQ ID NO: 53331 - RNA, 20 nt, Artificial Sequence
  MKO10053331_A_Tecr
  gRNA
uuuccuuuagguagagccuc

SEQ ID NO: 53332 - RNA, 20 nt, Artificial Sequence
  MKO10053332_A_Tecr
  gRNA
acucacgugucuuggugaaa

SEQ ID NO: 53333 - RNA, 20 nt, Artificial Sequence
  MKO10053333_A_Tecua
  gRNA
uguuagagggucgccaccgc

SEQ ID NO: 53334 - RNA, 20 nt, Artificial Sequence
  MKO10053334_A_Tecua
  gRNA
ugaaggcccucccguccguc

SEQ ID NO: 53335 - RNA, 20 nt, Artificial Sequence
  MKO10053335_A_Tecua
  gRNA
aaggaaauugacccggccaa

SEQ ID NO: 53336 - RNA, 20 nt, Artificial Sequence
  MKO10053336_A_Tecub
  gRNA
cccguucuugacgugaacag

SEQ ID NO: 53337 - RNA, 20 nt, Artificial Sequence
  MKO10053337_A_Tecub
  gRNA
aaacagaucugagccgauuu

SEQ ID NO: 53338 - RNA, 20 nt, Artificial Sequence
  MKO10053338_A_Tecub
  gRNA
aagggacuuaccgaacgcuu

SEQ ID NO: 53339 - RNA, 20 nt, Artificial Sequence
  MKO10053339_A_Tec
  gRNA
auccguguugagcuacuaug

SEQ ID NO: 53340 - RNA, 20 nt, Artificial Sequence
  MKO10053340_A_Tec
  gRNA
uugcaccuaguccacaaagc

SEQ ID NO: 53341 - RNA, 20 nt, Artificial Sequence
  MKO10053341_A_Tec
  gRNA
aagauuguacuucucacauc

SEQ ID NO: 53342 - RNA, 20 nt, Artificial Sequence
  MKO10053342_A_Teddm1
  gRNA
ugaucucauaaacgaucaag

SEQ ID NO: 53343 - RNA, 20 nt, Artificial Sequence
  MKO10053343_A_Teddm1
  gRNA
uaacgugagacacuagcagc

SEQ ID NO: 53344 - RNA, 20 nt, Artificial Sequence
  MKO10053344_A_Teddm1
  gRNA
gguauucuaggcccggucac

SEQ ID NO: 53345 - RNA, 20 nt, Artificial Sequence
  MKO10053345_A_Tefm
  gRNA
uccucgugucgccgaucauc

SEQ ID NO: 53346 - RNA, 20 nt, Artificial Sequence
  MKO10053346_A_Tefm
  gRNA
uugcaugggcucaccuugac

SEQ ID NO: 53347 - RNA, 20 nt, Artificial Sequence
  MKO10053347_A_Tefm
  gRNA
uccugugggaagaacacccg

SEQ ID NO: 53348 - RNA, 20 nt, Artificial Sequence
  MKO10053348_A_Tef
  gRNA
uggaaggacucgccaucgua

SEQ ID NO: 53349 - RNA, 20 nt, Artificial Sequence
  MKO10053349_A_Tef
  gRNA
ggagguugccgagcuucgca

SEQ ID NO: 53350 - RNA, 20 nt, Artificial Sequence
  MKO10053350_A_Tef
  gRNA
gcagggcacgauguccgacg

SEQ ID NO: 53351 - RNA, 20 nt, Artificial Sequence
  MKO10053351_A_Tekt1
  gRNA
gcagacgucaucgauaguua

SEQ ID NO: 53352 - RNA, 20 nt, Artificial Sequence
  MKO10053352_A_Tekt1
  gRNA
gaaccugcuuauccgcacgc

SEQ ID NO: 53353 - RNA, 20 nt, Artificial Sequence
  MKO10053353_A_Tekt1
  gRNA
ccgcucugccaaguacaauc

SEQ ID NO: 53354 - RNA, 20 nt, Artificial Sequence
  MKO10053354_A_Tekt2
  gRNA
ucgcagagucaggcacucga

SEQ ID NO: 53355 - RNA, 20 nt, Artificial Sequence
  MKO10053355_A_Tekt2
  gRNA
ucaccacaucaaugucucgc

SEQ ID NO: 53356 - RNA, 20 nt, Artificial Sequence
  MKO10053356_A_Tekt2
  gRNA
cagugucgauccucucagcc

SEQ ID NO: 53357 - RNA, 20 nt, Artificial Sequence
  MKO10053357_A_Tekt3
  gRNA
cgcccucggaaguguugcgc

SEQ ID NO: 53358 - RNA, 20 nt, Artificial Sequence
  MKO10053358_A_Tekt3
  gRNA
gauucacacucacuuaacga

SEQ ID NO: 53359 - RNA, 20 nt, Artificial Sequence
  MKO10053359_A_Tekt3
  gRNA
aacauugucauccguaaacu

SEQ ID NO: 53360 - RNA, 20 nt, Artificial Sequence
  MKO10053360_A_Tekt4
  gRNA
ugcuucgagccgagcgcgag

SEQ ID NO: 53361 - RNA, 20 nt, Artificial Sequence
  MKO10053361_A_Tekt4
  gRNA
cgaggcuagccgcucgcgcu

SEQ ID NO: 53362 - RNA, 20 nt, Artificial Sequence
  MKO10053362_A_Tekt4
  gRNA
cauugggccggugugaccgc

SEQ ID NO: 53363 - RNA, 20 nt, Artificial Sequence
  MKO10053363_A_Tekt5
  gRNA
cgucaaacuucuccacgccg

SEQ ID NO: 53364 - RNA, 20 nt, Artificial Sequence
  MKO10053364_A_Tekt5
  gRNA
cuccauccggcugcgggaag

SEQ ID NO: 53365 - RNA, 20 nt, Artificial Sequence
  MKO10053365_A_Tekt5
  gRNA
cucagagaugcgagcguuga

SEQ ID NO: 53366 - RNA, 20 nt, Artificial Sequence
  MKO10053366_A_Tek
  gRNA
augcugguguguacucggcc

SEQ ID NO: 53367 - RNA, 20 nt, Artificial Sequence
  MKO10053367_A_Tek
  gRNA
cuuacuccgaacaaucagcc

SEQ ID NO: 53368 - RNA, 20 nt, Artificial Sequence
  MKO10053368_A_Tek
  gRNA
ucauaguuaaaguagcaggu

SEQ ID NO: 53369 - RNA, 20 nt, Artificial Sequence
  MKO10053369_A_Telo2
  gRNA
cccaagaacucgagauacga

SEQ ID NO: 53370 - RNA, 20 nt, Artificial Sequence
  MKO10053370_A_Telo2
  gRNA
gaaguccugucacgacuacu

SEQ ID NO: 53371 - RNA, 20 nt, Artificial Sequence
  MKO10053371_A_Telo2
  gRNA
acuacucacucuuucggccc

SEQ ID NO: 53372 - RNA, 20 nt, Artificial Sequence
  MKO10053372_A_Ten1
  gRNA
agugacggccauguccccga

SEQ ID NO: 53373 - RNA, 20 nt, Artificial Sequence
  MKO10053373_A_Ten1
  gRNA
aaggugcuggcgucuccuau

SEQ ID NO: 53374 - RNA, 20 nt, Artificial Sequence
  MKO10053374_A_Ten1
  gRNA
gcacacugcgaacauuuggc

SEQ ID NO: 53375 - RNA, 20 nt, Artificial Sequence
  MKO10053375_A_Tenc1
  gRNA
uuaccagguguucuaugcgc

SEQ ID NO: 53376 - RNA, 20 nt, Artificial Sequence
  MKO10053376_A_Tenc1
  gRNA
gggaccggugucuccugccg

SEQ ID NO: 53377 - RNA, 20 nt, Artificial Sequence
  MKO10053377_A_Tenc1
  gRNA
aacacacucaccagcuccgc

SEQ ID NO: 53378 - RNA, 20 nt, Artificial Sequence
  MKO10053378_A_Tenm1
  gRNA
ugaccgacacugaucaugaa

SEQ ID NO: 53379 - RNA, 20 nt, Artificial Sequence
  MKO10053379_A_Tenm1
  gRNA
uugccuugagccgaaucagc

SEQ ID NO: 53380 - RNA, 20 nt, Artificial Sequence
  MKO10053380_A_Tenm1
  gRNA
gcuccagcugauucggcuca

SEQ ID NO: 53381 - RNA, 20 nt, Artificial Sequence
  MKO10053381_A_Tenm2
  gRNA
agcuccugcgcccaacgacc

SEQ ID NO: 53382 - RNA, 20 nt, Artificial Sequence
  MKO10053382_A_Tenm2
  gRNA
aacaguaaccacuucggugu

SEQ ID NO: 53383 - RNA, 20 nt, Artificial Sequence
  MKO10053383_A_Tenm2
  gRNA
guggauuugacuccgccgau

SEQ ID NO: 53384 - RNA, 20 nt, Artificial Sequence
  MKO10053384_A_Tenm3
  gRNA
ugugaauccgcaacucgaag

SEQ ID NO: 53385 - RNA, 20 nt, Artificial Sequence
  MKO10053385_A_Tenm3
  gRNA
ugccacuccucuucgaguug

SEQ ID NO: 53386 - RNA, 20 nt, Artificial Sequence
  MKO10053386_A_Tenm3
  gRNA
uuucuaggaaguggccgggu

SEQ ID NO: 53387 - RNA, 20 nt, Artificial Sequence
  MKO10053387_A_Tenm4
  gRNA
ggcgcucagcaucgcgacgc

SEQ ID NO: 53388 - RNA, 20 nt, Artificial Sequence
  MKO10053388_A_Tenm4
  gRNA
agcccuaucgcucgcugacc

SEQ ID NO: 53389 - RNA, 20 nt, Artificial Sequence
  MKO10053389_A_Tenm4
  gRNA
ggagagaugacgcccccuca

SEQ ID NO: 53390 - RNA, 20 nt, Artificial Sequence
  MKO10053390_A_Tep1
  gRNA
cggaguaauaccgucguaca

SEQ ID NO: 53391 - RNA, 20 nt, Artificial Sequence
  MKO10053391_A_Tep1
  gRNA
ccugccgcccccauguacga

SEQ ID NO: 53392 - RNA, 20 nt, Artificial Sequence
  MKO10053392_A_Tep1
  gRNA
guggguuguacuuagcuagc

SEQ ID NO: 53393 - RNA, 20 nt, Artificial Sequence
  MKO10053393_A_Tepp
  gRNA
ucacgcgugccaucgaagau

SEQ ID NO: 53394 - RNA, 20 nt, Artificial Sequence
  MKO10053394_A_Tepp
  gRNA
cgcggugcgguacuugaagc

SEQ ID NO: 53395 - RNA, 20 nt, Artificial Sequence
  MKO10053395_A_Tepp
  gRNA
aagaugauucccaucgcgcc

SEQ ID NO: 53396 - RNA, 20 nt, Artificial Sequence
  MKO10053396_A_Terf1
  gRNA
ugaugagcguauuacacccu

SEQ ID NO: 53397 - RNA, 20 nt, Artificial Sequence
  MKO10053397_A_Terf1
  gRNA
gauuuggaacucaauugaaa

SEQ ID NO: 53398 - RNA, 20 nt, Artificial Sequence
  MKO10053398_A_Terf1
  gRNA
cuucagcuauagcugcauga

SEQ ID NO: 53399 - RNA, 20 nt, Artificial Sequence
  MKO10053399_A_Terf2ip
  gRNA
gcgcaucgccuacaccgacg

SEQ ID NO: 53400 - RNA, 20 nt, Artificial Sequence
  MKO10053400_A_Terf2ip
  gRNA
gcgguccuugagcgacugcc

SEQ ID NO: 53401 - RNA, 20 nt, Artificial Sequence
  MKO10053401_A_Terf2ip
  gRNA
gacccgacgguuaucccauu

SEQ ID NO: 53402 - RNA, 20 nt, Artificial Sequence
  MKO10053402_A_Terf2
  gRNA
cgccgcugcgcgaugcccgu

SEQ ID NO: 53403 - RNA, 20 nt, Artificial Sequence
  MKO10053403_A_Terf2
  gRNA
gucacgcacaacgcccgggc

SEQ ID NO: 53404 - RNA, 20 nt, Artificial Sequence
  MKO10053404_A_Terf2
  gRNA
ugucugucgcgcauugaaga

SEQ ID NO: 53405 - RNA, 20 nt, Artificial Sequence
  MKO10053405_A_Tert
  gRNA
gccaguaucgacgcgauaga

SEQ ID NO: 53406 - RNA, 20 nt, Artificial Sequence
  MKO10053406_A_Tert
  gRNA
gcgcaacgagagaaacgugc

SEQ ID NO: 53407 - RNA, 20 nt, Artificial Sequence
  MKO10053407_A_Tert
  gRNA
ccgcugcagagcaccgucug

SEQ ID NO: 53408 - RNA, 20 nt, Artificial Sequence
  MKO10053408_A_Tescl
  gRNA
uaaugaucccaucgccgucc

SEQ ID NO: 53409 - RNA, 20 nt, Artificial Sequence
  MKO10053409_A_Tescl
  gRNA
cggacgauccuggagcggau

SEQ ID NO: 53410 - RNA, 20 nt, Artificial Sequence
  MKO10053410_A_Tescl
  gRNA
aguucaauccgauccgcucc

SEQ ID NO: 53411 - RNA, 20 nt, Artificial Sequence
  MKO10053411_A_Tesc
  gRNA
ggugucgaugggccggaagu

SEQ ID NO: 53412 - RNA, 20 nt, Artificial Sequence
  MKO10053412_A_Tesc
  gRNA
gaccgcuggaucccuuucgc

SEQ ID NO: 53413 - RNA, 20 nt, Artificial Sequence
  MKO10053413_A_Tesc
  gRNA
agcacaccuguugucgaaga

SEQ ID NO: 53414 - RNA, 20 nt, Artificial Sequence
  MKO10053414_A_Tesk1
  gRNA
cuacgguaccuacacgccaa

SEQ ID NO: 53415 - RNA, 20 nt, Artificial Sequence
  MKO10053415_A_Tesk1
  gRNA
ccagguucggcaccgacagu

SEQ ID NO: 53416 - RNA, 20 nt, Artificial Sequence
  MKO10053416_A_Tesk1
  gRNA
guaggccuugugcaaugucc

SEQ ID NO: 53417 - RNA, 20 nt, Artificial Sequence
  MKO10053417_A_Tesk2
  gRNA
ggguuacucaccuagcguca

SEQ ID NO: 53418 - RNA, 20 nt, Artificial Sequence
  MKO10053418_A_Tesk2
  gRNA
acagugacuuguauuuaccg

SEQ ID NO: 53419 - RNA, 20 nt, Artificial Sequence
  MKO10053419_A_Tesk2
  gRNA
ccaucgggaccucacaucaa

SEQ ID NO: 53420 - RNA, 20 nt, Artificial Sequence
  MKO10053420_A_Tespa1
  gRNA
gaauccaaucaauaagauug

SEQ ID NO: 53421 - RNA, 20 nt, Artificial Sequence
  MKO10053421_A_Tespa1
  gRNA
ucagggcaaucuaacuacag

SEQ ID NO: 53422 - RNA, 20 nt, Artificial Sequence
  MKO10053422_A_Tespa1
  gRNA
caguccucaaucuuauugau

SEQ ID NO: 53423 - RNA, 20 nt, Artificial Sequence
  MKO10053423_A_Tes
  gRNA
acuucacgucacccacgccc

SEQ ID NO: 53424 - RNA, 20 nt, Artificial Sequence
  MKO10053424_A_Tes
  gRNA
cauaacguugcguuuguaca

SEQ ID NO: 53425 - RNA, 20 nt, Artificial Sequence
  MKO10053425_A_Tes
  gRNA
uaugaucuugaccaauccag

SEQ ID NO: 53426 - RNA, 20 nt, Artificial Sequence
  MKO10053426_A_Tet1
  gRNA
ucgaucccgauucauucggg

SEQ ID NO: 53427 - RNA, 20 nt, Artificial Sequence
  MKO10053427_A_Tet1
  gRNA
ccggcucgcgucagaaaacu

SEQ ID NO: 53428 - RNA, 20 nt, Artificial Sequence
  MKO10053428_A_Tet1
  gRNA
auaccaccaccgacguugcc

SEQ ID NO: 53429 - RNA, 20 nt, Artificial Sequence
  MKO10053429_A_Tet2
  gRNA
gguauaucggagaucgagug

SEQ ID NO: 53430 - RNA, 20 nt, Artificial Sequence
  MKO10053430_A_Tet2
  gRNA
aguucugaugcgaguagcuu

SEQ ID NO: 53431 - RNA, 20 nt, Artificial Sequence
  MKO10053431_A_Tet2
  gRNA
gcuccuagauggguauaaua

SEQ ID NO: 53432 - RNA, 20 nt, Artificial Sequence
  MKO10053432_A_Tet3
  gRNA
gccguugaaguacaugcucc

SEQ ID NO: 53433 - RNA, 20 nt, Artificial Sequence
  MKO10053433_A_Tet3
  gRNA
gccacgaaaguuccgccuca

SEQ ID NO: 53434 - RNA, 20 nt, Artificial Sequence
  MKO10053434_A_Tet3
  gRNA
gaaagcuauccggauugaga

SEQ ID NO: 53435 - RNA, 20 nt, Artificial Sequence
  MKO10053435_A_Tex101
  gRNA
cagucugcagccgaucguag

SEQ ID NO: 53436 - RNA, 20 nt, Artificial Sequence
  MKO10053436_A_Tex101
  gRNA
uggaaccaggaccgucguuu

SEQ ID NO: 53437 - RNA, 20 nt, Artificial Sequence
  MKO10053437_A_Tex101
  gRNA
gacgccaccgugcaaguuaa

SEQ ID NO: 53438 - RNA, 20 nt, Artificial Sequence
  MKO10053438_A_Tex10
  gRNA
ugagaagugacucuccgauu

SEQ ID NO: 53439 - RNA, 20 nt, Artificial Sequence
  MKO10053439_A_Tex10
  gRNA
aauguguucaguucguauuu

SEQ ID NO: 53440 - RNA, 20 nt, Artificial Sequence
  MKO10053440_A_Tex10
  gRNA
uaccucuguuugguugcauc

SEQ ID NO: 53441 - RNA, 20 nt, Artificial Sequence
  MKO10053441_A_Tex11
  gRNA
uauacguacguuuagcugcc

SEQ ID NO: 53442 - RNA, 20 nt, Artificial Sequence
  MKO10053442_A_Tex11
  gRNA
guguuauauugcuugcaagc

SEQ ID NO: 53443 - RNA, 20 nt, Artificial Sequence
  MKO10053443_A_Tex11
  gRNA
guuaaaacccugaucauaac

SEQ ID NO: 53444 - RNA, 20 nt, Artificial Sequence
  MKO10053444_A_Tex12
  gRNA
ucaggugucugauaguccac

SEQ ID NO: 53445 - RNA, 20 nt, Artificial Sequence
  MKO10053445_A_Tex12
  gRNA
cauaggcacauuacuugugu

SEQ ID NO: 53446 - RNA, 20 nt, Artificial Sequence
  MKO10053446_A_Tex12
  gRNA
ucuuacaucgaugagauaga

SEQ ID NO: 53447 - RNA, 20 nt, Artificial Sequence
  MKO10053447_A_Tex13a
  gRNA
ugggugugcgcuucgcucac

SEQ ID NO: 53448 - RNA, 20 nt, Artificial Sequence
  MKO10053448_A_Tex13a
  gRNA
acauugacaccuugcuaugc

SEQ ID NO: 53449 - RNA, 20 nt, Artificial Sequence
  MKO10053449_A_Tex13a
  gRNA
gucuuucuguggucgguagu

SEQ ID NO: 53450 - RNA, 20 nt, Artificial Sequence
  MKO10053450_A_Tex13
  gRNA
cgaggugccucgggauguuc

SEQ ID NO: 53451 - RNA, 20 nt, Artificial Sequence
  MKO10053451_A_Tex13
  gRNA
uggggguucgcuucgcuuuc

SEQ ID NO: 53452 - RNA, 20 nt, Artificial Sequence
  MKO10053452_A_Tex13
  gRNA
agucucgcacaacucucaua

SEQ ID NO: 53453 - RNA, 20 nt, Artificial Sequence
  MKO10053453_A_Tex14
  gRNA
cccaaccgacagcuuaaacc

SEQ ID NO: 53454 - RNA, 20 nt, Artificial Sequence
  MKO10053454_A_Tex14
  gRNA
gacucuccucagcgacucau

SEQ ID NO: 53455 - RNA, 20 nt, Artificial Sequence
  MKO10053455_A_Tex14
  gRNA
cugcaacaaagagcgcugac

SEQ ID NO: 53456 - RNA, 20 nt, Artificial Sequence
  MKO10053456_A_Tex15
  gRNA
cugcacaaccagagauuucg

SEQ ID NO: 53457 - RNA, 20 nt, Artificial Sequence
  MKO10053457_A_Tex15
  gRNA
uauccuuauccgccuaaccc

SEQ ID NO: 53458 - RNA, 20 nt, Artificial Sequence
  MKO10053458_A_Tex15
  gRNA
cccuaauacuauguguugua

SEQ ID NO: 53459 - RNA, 20 nt, Artificial Sequence
  MKO10053459_A_Tex16
  gRNA
agaccuaacagcacuaguac

SEQ ID NO: 53460 - RNA, 20 nt, Artificial Sequence
  MKO10053460_A_Tex16
  gRNA
auaguaccucaagagagcgu

SEQ ID NO: 53461 - RNA, 20 nt, Artificial Sequence
  MKO10053461_A_Tex16
  gRNA
cccuaguuucgauguuauag

SEQ ID NO: 53462 - RNA, 20 nt, Artificial Sequence
  MKO10053462_A_Tex19.1
  gRNA
ugcugucaaugcguguccgc

SEQ ID NO: 53463 - RNA, 20 nt, Artificial Sequence
  MKO10053463_A_Tex19.1
  gRNA
ccuauugaauaaacucuacc

SEQ ID NO: 53464 - RNA, 20 nt, Artificial Sequence
  MKO10053464_A_Tex19.1
  gRNA
ccugaguccuuacgacccag

SEQ ID NO: 53465 - RNA, 20 nt, Artificial Sequence
  MKO10053465_A_Tex19.2
  gRNA
ccagcauguucuuaacgacg

SEQ ID NO: 53466 - RNA, 20 nt, Artificial Sequence
  MKO10053466_A_Tex19.2
  gRNA
aggugcauucguauuugccc

SEQ ID NO: 53467 - RNA, 20 nt, Artificial Sequence
  MKO10053467_A_Tex19.2
  gRNA
gguacagccacgccccauag

SEQ ID NO: 53468 - RNA, 20 nt, Artificial Sequence
  MKO10053468_A_Tex21
  gRNA
ucgcccuauaugaaucugaa

SEQ ID NO: 53469 - RNA, 20 nt, Artificial Sequence
  MKO10053469_A_Tex21
  gRNA
uagaucuagagaaccguuua

SEQ ID NO: 53470 - RNA, 20 nt, Artificial Sequence
  MKO10053470_A_Tex21
  gRNA
aggugugguuucccagccgc

SEQ ID NO: 53471 - RNA, 20 nt, Artificial Sequence
  MKO10053471_A_Tex22
  gRNA
acacaugcgcgauguccugc

SEQ ID NO: 53472 - RNA, 20 nt, Artificial Sequence
  MKO10053472_A_Tex22
  gRNA
auggggagguuucggucugc

SEQ ID NO: 53473 - RNA, 20 nt, Artificial Sequence
  MKO10053473_A_Tex22
  gRNA
ugggucugcaagucguccug

SEQ ID NO: 53474 - RNA, 20 nt, Artificial Sequence
  MKO10053474_A_Tex24
  gRNA
aucugugaucaaagggcccg

SEQ ID NO: 53475 - RNA, 20 nt, Artificial Sequence
  MKO10053475_A_Tex24
  gRNA
agacguuugcagcaccugaa

SEQ ID NO: 53476 - RNA, 20 nt, Artificial Sequence
  MKO10053476_A_Tex24
  gRNA
ucuacaggcucagaaacauu

SEQ ID NO: 53477 - RNA, 20 nt, Artificial Sequence
  MKO10053477_A_Tex261
  gRNA
ggaaacgcucaaagacguag

SEQ ID NO: 53478 - RNA, 20 nt, Artificial Sequence
  MKO10053478_A_Tex261
  gRNA
uucaccaaccucgucuacuu

SEQ ID NO: 53479 - RNA, 20 nt, Artificial Sequence
  MKO10053479_A_Tex261
  gRNA
gaaucaucaaauacaugauc

SEQ ID NO: 53480 - RNA, 20 nt, Artificial Sequence
  MKO10053480_A_Tex264
  gRNA
caugccggaucuccuacuac

SEQ ID NO: 53481 - RNA, 20 nt, Artificial Sequence
  MKO10053481_A_Tex264
  gRNA
guugucauaguagacagcga

SEQ ID NO: 53482 - RNA, 20 nt, Artificial Sequence
  MKO10053482_A_Tex264
  gRNA
ugguaccugugccauccguc

SEQ ID NO: 53483 - RNA, 20 nt, Artificial Sequence
  MKO10053483_A_Tex26
  gRNA
cgacaccuaccguauuaaau

SEQ ID NO: 53484 - RNA, 20 nt, Artificial Sequence
  MKO10053484_A_Tex26
  gRNA
ccgggacuucaagaggagua

SEQ ID NO: 53485 - RNA, 20 nt, Artificial Sequence
  MKO10053485_A_Tex26
  gRNA
gcucuauccaagggagcuuu

SEQ ID NO: 53486 - RNA, 20 nt, Artificial Sequence
  MKO10053486_A_Tex28
  gRNA
auccaaagcugaccggcacc

SEQ ID NO: 53487 - RNA, 20 nt, Artificial Sequence
  MKO10053487_A_Tex28
  gRNA
uaaauacaaugaagaugcgc

SEQ ID NO: 53488 - RNA, 20 nt, Artificial Sequence
  MKO10053488_A_Tex28
  gRNA
ugagcuugcccgcaauguga

SEQ ID NO: 53489 - RNA, 20 nt, Artificial Sequence
  MKO10053489_A_Tex29
  gRNA
cuucacucugauuugguucg

SEQ ID NO: 53490 - RNA, 20 nt, Artificial Sequence
  MKO10053490_A_Tex29
  gRNA
gagcacccaccuauaaauga

SEQ ID NO: 53491 - RNA, 20 nt, Artificial Sequence
  MKO10053491_A_Tex29
  gRNA
gucucgacugcuguuucuac

SEQ ID NO: 53492 - RNA, 20 nt, Artificial Sequence
  MKO10053492_A_Tex2
  gRNA
cugagugcgucaaagucgcg

SEQ ID NO: 53493 - RNA, 20 nt, Artificial Sequence
  MKO10053493_A_Tex2
  gRNA
ugugggggcuucgguugucc

SEQ ID NO: 53494 - RNA, 20 nt, Artificial Sequence
  MKO10053494_A_Tex2
  gRNA
cagccccacagcuucgaaga

SEQ ID NO: 53495 - RNA, 20 nt, Artificial Sequence
  MKO10053495_A_Tex30
  gRNA
cgaagaucucuuucguauaa

SEQ ID NO: 53496 - RNA, 20 nt, Artificial Sequence
  MKO10053496_A_Tex30
  gRNA
agaccguccuuucacugcca

SEQ ID NO: 53497 - RNA, 20 nt, Artificial Sequence
  MKO10053497_A_Tex30
  gRNA
auuacuggaugccguuuguu

SEQ ID NO: 53498 - RNA, 20 nt, Artificial Sequence
  MKO10053498_A_Tex33
  gRNA
gagaacauccgccacaaauu

SEQ ID NO: 53499 - RNA, 20 nt, Artificial Sequence
  MKO10053499_A_Tex33
  gRNA
gaaggcuuccuacacgcccg

SEQ ID NO: 53500 - RNA, 20 nt, Artificial Sequence
  MKO10053500_A_Tex33
  gRNA
ccaaauuuaaguaccaugca

SEQ ID NO: 53501 - RNA, 20 nt, Artificial Sequence
  MKO10053501_A_Tex35
  gRNA
uauuuccccagaacgaacuc

SEQ ID NO: 53502 - RNA, 20 nt, Artificial Sequence
  MKO10053502_A_Tex35
  gRNA
ccacagauauaugauuucaa

SEQ ID NO: 53503 - RNA, 20 nt, Artificial Sequence
  MKO10053503_A_Tex35
  gRNA
cagcuuacuugugucagcuu

SEQ ID NO: 53504 - RNA, 20 nt, Artificial Sequence
  MKO10053504_A_Tex36
  gRNA
gagucuuuaugaccgccuga

SEQ ID NO: 53505 - RNA, 20 nt, Artificial Sequence
  MKO10053505_A_Tex36
  gRNA
caucacguguacuucccuga

SEQ ID NO: 53506 - RNA, 20 nt, Artificial Sequence
  MKO10053506_A_Tex36
  gRNA
cuucagggaaguacacguga

SEQ ID NO: 53507 - RNA, 20 nt, Artificial Sequence
  MKO10053507_A_Tex37
  gRNA
cuaguaguuacccguucuug

SEQ ID NO: 53508 - RNA, 20 nt, Artificial Sequence
  MKO10053508_A_Tex37
  gRNA
ucacacgucuacugguaaaa

SEQ ID NO: 53509 - RNA, 20 nt, Artificial Sequence
  MKO10053509_A_Tex37
  gRNA
gggucucaccacacgugcca

SEQ ID NO: 53510 - RNA, 20 nt, Artificial Sequence
  MKO10053510_A_Tex38
  gRNA
auaaacaagcggcguuacca

SEQ ID NO: 53511 - RNA, 20 nt, Artificial Sequence
  MKO10053511_A_Tex38
  gRNA
aacauuccuuucagggcggu

SEQ ID NO: 53512 - RNA, 20 nt, Artificial Sequence
  MKO10053512_A_Tex38
  gRNA
cauuaaagcaguuuguuccg

SEQ ID NO: 53513 - RNA, 20 nt, Artificial Sequence
  MKO10053513_A_Tex40
  gRNA
ggucacgaacaucuccguac

SEQ ID NO: 53514 - RNA, 20 nt, Artificial Sequence
  MKO10053514_A_Tex40
  gRNA
cugcgaggacuucgacgaag

SEQ ID NO: 53515 - RNA, 20 nt, Artificial Sequence
  MKO10053515_A_Tex40
  gRNA
cuagcauauagguccacgau

SEQ ID NO: 53516 - RNA, 20 nt, Artificial Sequence
  MKO10053516_A_Tex9
  gRNA
cugcaagcugcccgcgcgac

SEQ ID NO: 53517 - RNA, 20 nt, Artificial Sequence
  MKO10053517_A_Tex9
  gRNA
ugaucugguucgacaagcug

SEQ ID NO: 53518 - RNA, 20 nt, Artificial Sequence
  MKO10053518_A_Tex9
  gRNA
ucgcgcgggcagcuugcagc

SEQ ID NO: 53519 - RNA, 20 nt, Artificial Sequence
  MKO10053519_A_Tfam
  gRNA
uaaauguuauaugcugaacg

SEQ ID NO: 53520 - RNA, 20 nt, Artificial Sequence
  MKO10053520_A_Tfam
  gRNA
ggcaaaggaugauucggcuc

SEQ ID NO: 53521 - RNA, 20 nt, Artificial Sequence
  MKO10053521_A_Tfam
  gRNA
gcuguucuguggaaaaucga

SEQ ID NO: 53522 - RNA, 20 nt, Artificial Sequence
  MKO10053522_A_Tfap2a
  gRNA
caaccgugccgucccguugc

SEQ ID NO: 53523 - RNA, 20 nt, Artificial Sequence
  MKO10053523_A_Tfap2a
  gRNA
ugccgccgauagucccugcg

SEQ ID NO: 53524 - RNA, 20 nt, Artificial Sequence
  MKO10053524_A_Tfap2a
  gRNA
gugucuuaacgcgucgcucc

SEQ ID NO: 53525 - RNA, 20 nt, Artificial Sequence
  MKO10053525_A_Tfap2b
  gRNA
cagcggcggggcgcuugagu

SEQ ID NO: 53526 - RNA, 20 nt, Artificial Sequence
  MKO10053526_A_Tfap2b
  gRNA
ggcgacagccucucguugca

SEQ ID NO: 53527 - RNA, 20 nt, Artificial Sequence
  MKO10053527_A_Tfap2b
  gRNA
uagguucaugccgcuguuau

SEQ ID NO: 53528 - RNA, 20 nt, Artificial Sequence
  MKO10053528_A_Tfap2c
  gRNA
accggcgguagacuucccgc

SEQ ID NO: 53529 - RNA, 20 nt, Artificial Sequence
  MKO10053529_A_Tfap2c
  gRNA
cgccgaccauuacucgcauc

SEQ ID NO: 53530 - RNA, 20 nt, Artificial Sequence
  MKO10053530_A_Tfap2c
  gRNA
agcgaggcguuuaggcauuc

SEQ ID NO: 53531 - RNA, 20 nt, Artificial Sequence
  MKO10053531_A_Tfap2d
  gRNA
uaaagucggugggcuccccg

SEQ ID NO: 53532 - RNA, 20 nt, Artificial Sequence
  MKO10053532_A_Tfap2d
  gRNA
uccuuccagauacgucacga

SEQ ID NO: 53533 - RNA, 20 nt, Artificial Sequence
  MKO10053533_A_Tfap2d
  gRNA
gauuguucucaacggccaag

SEQ ID NO: 53534 - RNA, 20 nt, Artificial Sequence
  MKO10053534_A_Tfap2e
  gRNA
gcgccgagacuacgccgccg

SEQ ID NO: 53535 - RNA, 20 nt, Artificial Sequence
  MKO10053535_A_Tfap2e
  gRNA
ccaggauuggcggagccgcc

SEQ ID NO: 53536 - RNA, 20 nt, Artificial Sequence
  MKO10053536_A_Tfap2e
  gRNA
uaccuuucuugaucaccgau

SEQ ID NO: 53537 - RNA, 20 nt, Artificial Sequence
  MKO10053537_A_Tfap4
  gRNA
cgcgucgaauccgccuuucc

SEQ ID NO: 53538 - RNA, 20 nt, Artificial Sequence
  MKO10053538_A_Tfap4
  gRNA
gcgcuccgugcggaugaugc

SEQ ID NO: 53539 - RNA, 20 nt, Artificial Sequence
  MKO10053539_A_Tfap4
  gRNA
gcgccuccgcucguugcugu

SEQ ID NO: 53540 - RNA, 20 nt, Artificial Sequence
  MKO10053540_A_Tfb1m
  gRNA
gaugacguuaacguuucaaa

SEQ ID NO: 53541 - RNA, 20 nt, Artificial Sequence
  MKO10053541_A_Tfb1m
  gRNA
ugccaacguugcugagcuuc

SEQ ID NO: 53542 - RNA, 20 nt, Artificial Sequence
  MKO10053542_A_Tfb1m
  gRNA
gaacaccucuuuacaauccc

SEQ ID NO: 53543 - RNA, 20 nt, Artificial Sequence
  MKO10053543_A_Tfb2m
  gRNA
ugaaaauuaccugcugacca

SEQ ID NO: 53544 - RNA, 20 nt, Artificial Sequence
  MKO10053544_A_Tfb2m
  gRNA
uaaaaauauaccuccaaaug

SEQ ID NO: 53545 - RNA, 20 nt, Artificial Sequence
  MKO10053545_A_Tfb2m
  gRNA
ugucucuuuagcccuuacag

SEQ ID NO: 53546 - RNA, 20 nt, Artificial Sequence
  MKO10053546_A_Tfcp2l1
  gRNA
caggucagucguaugaaauc

SEQ ID NO: 53547 - RNA, 20 nt, Artificial Sequence
  MKO10053547_A_Tfcp2l1
  gRNA
acucuguguacugcagccgg

SEQ ID NO: 53548 - RNA, 20 nt, Artificial Sequence
  MKO10053548_A_Tfcp2l1
  gRNA
ucuucauguagcuucaccgc

SEQ ID NO: 53549 - RNA, 20 nt, Artificial Sequence
  MKO10053549_A_Tfcp2
  gRNA
uccgcguaguguuccacgac

SEQ ID NO: 53550 - RNA, 20 nt, Artificial Sequence
  MKO10053550_A_Tfcp2
  gRNA
uguacugcagucgccugucg

SEQ ID NO: 53551 - RNA, 20 nt, Artificial Sequence
  MKO10053551_A_Tfcp2
  gRNA
ucgucguggagcuucaccgc

SEQ ID NO: 53552 - RNA, 20 nt, Artificial Sequence
  MKO10053552_A_Tfdp1
  gRNA
gguguuuaaggaagcggaac

SEQ ID NO: 53553 - RNA, 20 nt, Artificial Sequence
  MKO10053553_A_Tfdp1
  gRNA
agaacacuuacugauucguu

SEQ ID NO: 53554 - RNA, 20 nt, Artificial Sequence
  MKO10053554_A_Tfdp1
  gRNA
ggugcucacccagcagacca

SEQ ID NO: 53555 - RNA, 20 nt, Artificial Sequence
  MKO10053555_A_Tfdp2
  gRNA
aggcacaacgucauacaaug

SEQ ID NO: 53556 - RNA, 20 nt, Artificial Sequence
  MKO10053556_A_Tfdp2
  gRNA
uaccaacucaaauaaccauc

SEQ ID NO: 53557 - RNA, 20 nt, Artificial Sequence
  MKO10053557_A_Tfdp2
  gRNA
gcuacaagaacuucuccuuc

SEQ ID NO: 53558 - RNA, 20 nt, Artificial Sequence
  MKO10053558_A_Tfe3
  gRNA
uacggcgucccgagcuggcu

SEQ ID NO: 53559 - RNA, 20 nt, Artificial Sequence
  MKO10053559_A_Tfe3
  gRNA
ucgagccguguuccugcuau

SEQ ID NO: 53560 - RNA, 20 nt, Artificial Sequence
  MKO10053560_A_Tfe3
  gRNA
gacagucguaccuggagcgg

SEQ ID NO: 53561 - RNA, 20 nt, Artificial Sequence
  MKO10053561_A_Tfeb
  gRNA
cagcccgaugcgugacgcca

SEQ ID NO: 53562 - RNA, 20 nt, Artificial Sequence
  MKO10053562_A_Tfeb
  gRNA
gcugccauggcgucacgcau

SEQ ID NO: 53563 - RNA, 20 nt, Artificial Sequence
  MKO10053563_A_Tfeb
  gRNA
cauugacaacauuaugcgcc

SEQ ID NO: 53564 - RNA, 20 nt, Artificial Sequence
  MKO10053564_A_Tfec
  gRNA
uaauauuaauuaccgaauca

SEQ ID NO: 53565 - RNA, 20 nt, Artificial Sequence
  MKO10053565_A_Tfec
  gRNA
ccuucuucagugauaugcgc

SEQ ID NO: 53566 - RNA, 20 nt, Artificial Sequence
  MKO10053566_A_Tfec
  gRNA
gaauccggagccuaagcuga

SEQ ID NO: 53567 - RNA, 20 nt, Artificial Sequence
  MKO10053567_A_Tff1
  gRNA
ccccgggagaggauaaauug

SEQ ID NO: 53568 - RNA, 20 nt, Artificial Sequence
  MKO10053568_A_Tff1
  gRNA
accuucuugaguguucucga

SEQ ID NO: 53569 - RNA, 20 nt, Artificial Sequence
  MKO10053569_A_Tff1
  gRNA
ccucgcugugguccucaugc

SEQ ID NO: 53570 - RNA, 20 nt, Artificial Sequence
  MKO10053570_A_Tff2
  gRNA
guacccgggcaucagucccg

SEQ ID NO: 53571 - RNA, 20 nt, Artificial Sequence
  MKO10053571_A_Tff2
  gRNA
ugcuuugacucuagcgucgc

SEQ ID NO: 53572 - RNA, 20 nt, Artificial Sequence
  MKO10053572_A_Tff2
  gRNA
ggagcagacaugcgaccucg

SEQ ID NO: 53573 - RNA, 20 nt, Artificial Sequence
  MKO10053573_A_Tff3
  gRNA
ucggagcaguguaacaaccg

SEQ ID NO: 53574 - RNA, 20 nt, Artificial Sequence
  MKO10053574_A_Tff3
  gRNA
gggauagcugcagauuacgu

SEQ ID NO: 53575 - RNA, 20 nt, Artificial Sequence
  MKO10053575_A_Tff3
  gRNA
ccaccaacagcauuagccag

SEQ ID NO: 53576 - RNA, 20 nt, Artificial Sequence
  MKO10053576_A_Tfg
  gRNA
gccccuacagaagaccgcuc

SEQ ID NO: 53577 - RNA, 20 nt, Artificial Sequence
  MKO10053577_A_Tfg
  gRNA
guuccggagcggucuucugu

SEQ ID NO: 53578 - RNA, 20 nt, Artificial Sequence
  MKO10053578_A_Tfg
  gRNA
aagaccccuugaaucaaguc

SEQ ID NO: 53579 - RNA, 20 nt, Artificial Sequence
  MKO10053579_A_Tfip11
  gRNA
ccccguggccgacucggaag

SEQ ID NO: 53580 - RNA, 20 nt, Artificial Sequence
  MKO10053580_A_Tfip11
  gRNA
cccgcacugaugaaguugac

SEQ ID NO: 53581 - RNA, 20 nt, Artificial Sequence
  MKO10053581_A_Tfip11
  gRNA
cuccgagccauaggccccca

SEQ ID NO: 53582 - RNA, 20 nt, Artificial Sequence
  MKO10053582_A_Tfpi2
  gRNA
cgauacuuccgcaagucugu

SEQ ID NO: 53583 - RNA, 20 nt, Artificial Sequence
  MKO10053583_A_Tfpi2
  gRNA
ugugagacuuucaccuauac

SEQ ID NO: 53584 - RNA, 20 nt, Artificial Sequence
  MKO10053584_A_Tfpi2
  gRNA
guugaagaaaaaccguauau

SEQ ID NO: 53585 - RNA, 20 nt, Artificial Sequence
  MKO10053585_A_Tfpi
  gRNA
cagugugaacgauucgugua

SEQ ID NO: 53586 - RNA, 20 nt, Artificial Sequence
  MKO10053586_A_Tfpi
  gRNA
cgagaaccgauuugauaccc

SEQ ID NO: 53587 - RNA, 20 nt, Artificial Sequence
  MKO10053587_A_Tfpi
  gRNA
gaggacccuggacucugccg

SEQ ID NO: 53588 - RNA, 20 nt, Artificial Sequence
  MKO10053588_A_Tfpt
  gRNA
uucuacgauuuaguucccgc

SEQ ID NO: 53589 - RNA, 20 nt, Artificial Sequence
  MKO10053589_A_Tfpt
  gRNA
gcgcugccgggagaucgagc

SEQ ID NO: 53590 - RNA, 20 nt, Artificial Sequence
  MKO10053590_A_Tfpt
  gRNA
aucucgguagucauccccgu

SEQ ID NO: 53591 - RNA, 20 nt, Artificial Sequence
  MKO10053591_A_Tfr2
  gRNA
ucuggcgcgagagcuuaucg

SEQ ID NO: 53592 - RNA, 20 nt, Artificial Sequence
  MKO10053592_A_Tfr2
  gRNA
cgcuccaguacaacgugguc

SEQ ID NO: 53593 - RNA, 20 nt, Artificial Sequence
  MKO10053593_A_Tfr2
  gRNA
ucagaccaucuacagacgcg

SEQ ID NO: 53594 - RNA, 20 nt, Artificial Sequence
  MKO10053594_A_Tfrc
  gRNA
cuacacgcuuacaauagccc

SEQ ID NO: 53595 - RNA, 20 nt, Artificial Sequence
  MKO10053595_A_Tfrc
  gRNA
gaauacauacacuccucgug

SEQ ID NO: 53596 - RNA, 20 nt, Artificial Sequence
  MKO10053596_A_Tfrc
  gRNA
cuaaaccggguguaugacaa

SEQ ID NO: 53597 - RNA, 20 nt, Artificial Sequence
  MKO10053597_A_Tgds
  gRNA
auugacguacguaaacucaa

SEQ ID NO: 53598 - RNA, 20 nt, Artificial Sequence
  MKO10053598_A_Tgds
  gRNA
uagauuuacgaucauauagu

SEQ ID NO: 53599 - RNA, 20 nt, Artificial Sequence
  MKO10053599_A_Tgds
  gRNA
uuuacguacgucaauguuua

SEQ ID NO: 53600 - RNA, 20 nt, Artificial Sequence
  MKO10053600_A_Tgfa
  gRNA
agcuccgcaaacacugugag

SEQ ID NO: 53601 - RNA, 20 nt, Artificial Sequence
  MKO10053601_A_Tgfa
  gRNA
gauggacucaccacucaggg

SEQ ID NO: 53602 - RNA, 20 nt, Artificial Sequence
  MKO10053602_A_Tgfa
  gRNA
aacagcacauccccccugag

SEQ ID NO: 53603 - RNA, 20 nt, Artificial Sequence
  MKO10053603_A_Tgfb1i1
  gRNA
cgggucccggcuuccauaca

SEQ ID NO: 53604 - RNA, 20 nt, Artificial Sequence
  MKO10053604_A_Tgfb1i1
  gRNA
cggugcgcuggcggacagcu

SEQ ID NO: 53605 - RNA, 20 nt, Artificial Sequence
  MKO10053605_A_Tgfb1i1
  gRNA
gggacaaggaucaucuauac

SEQ ID NO: 53606 - RNA, 20 nt, Artificial Sequence
  MKO10053606_A_Tgfb1
  gRNA
cucucccgcagacggaauac

SEQ ID NO: 53607 - RNA, 20 nt, Artificial Sequence
  MKO10053607_A_Tgfb1
  gRNA
cccccacugauacgccugag

SEQ ID NO: 53608 - RNA, 20 nt, Artificial Sequence
  MKO10053608_A_Tgfb1
  gRNA
gcaacauguggaacucuacc

SEQ ID NO: 53609 - RNA, 20 nt, Artificial Sequence
  MKO10053609_A_Tgfb2
  gRNA
ccaaagcgcgcuucuuccgc

SEQ ID NO: 53610 - RNA, 20 nt, Artificial Sequence
  MKO10053610_A_Tgfb2
  gRNA
gagccauucacccuccgcuc

SEQ ID NO: 53611 - RNA, 20 nt, Artificial Sequence
  MKO10053611_A_Tgfb2
  gRNA
auacaguucaauccgcugcu

SEQ ID NO: 53612 - RNA, 20 nt, Artificial Sequence
  MKO10053612_A_Tgfb3
  gRNA
ucacugacacugugcgcgag

SEQ ID NO: 53613 - RNA, 20 nt, Artificial Sequence
  MKO10053613_A_Tgfb3
  gRNA
ugccccacagauacuucgac

SEQ ID NO: 53614 - RNA, 20 nt, Artificial Sequence
  MKO10053614_A_Tgfb3
  gRNA
ccugggcuguccagucggug

SEQ ID NO: 53615 - RNA, 20 nt, Artificial Sequence
  MKO10053615_A_Tgfbi
  gRNA
cgauguugacguugcucacc

SEQ ID NO: 53616 - RNA, 20 nt, Artificial Sequence
  MKO10053616_A_Tgfbi
  gRNA
ggucgaucccacaacuccca

SEQ ID NO: 53617 - RNA, 20 nt, Artificial Sequence
  MKO10053617_A_Tgfbi
  gRNA
uuaccccauugggauaguga

SEQ ID NO: 53618 - RNA, 20 nt, Artificial Sequence
  MKO10053618_A_Tgfbr1
  gRNA
aucuauucaaguaaucgaaa

SEQ ID NO: 53619 - RNA, 20 nt, Artificial Sequence
  MKO10053619_A_Tgfbr1
  gRNA
cuucuagagaagagcguuca

SEQ ID NO: 53620 - RNA, 20 nt, Artificial Sequence
  MKO10053620_A_Tgfbr1
  gRNA
agugauggauccucuucauu

SEQ ID NO: 53621 - RNA, 20 nt, Artificial Sequence
  MKO10053621_A_Tgfbr2
  gRNA
gaccgcaccgccauugucgc

SEQ ID NO: 53622 - RNA, 20 nt, Artificial Sequence
  MKO10053622_A_Tgfbr2
  gRNA
ccuuguagaccucggcgaag

SEQ ID NO: 53623 - RNA, 20 nt, Artificial Sequence
  MKO10053623_A_Tgfbr2
  gRNA
ccacgcgaagggcaaccugc

SEQ ID NO: 53624 - RNA, 20 nt, Artificial Sequence
  MKO10053624_A_Tgfbr3
  gRNA
cuucaacccaaagccgccga

SEQ ID NO: 53625 - RNA, 20 nt, Artificial Sequence
  MKO10053625_A_Tgfbr3
  gRNA
ugacaguucacaccgggugc

SEQ ID NO: 53626 - RNA, 20 nt, Artificial Sequence
  MKO10053626_A_Tgfbr3
  gRNA
aaccuccgcaguacagacca

SEQ ID NO: 53627 - RNA, 20 nt, Artificial Sequence
  MKO10053627_A_Tgfbrap1
  gRNA
gucaucgagcgcuaugacau

SEQ ID NO: 53628 - RNA, 20 nt, Artificial Sequence
  MKO10053628_A_Tgfbrap1
  gRNA
acgcugggaaaucccggcca

SEQ ID NO: 53629 - RNA, 20 nt, Artificial Sequence
  MKO10053629_A_Tgfbrap1
  gRNA
ucugcguacucaugaagagg

SEQ ID NO: 53630 - RNA, 20 nt, Artificial Sequence
  MKO10053630_A_Tgif1
  gRNA
uggguuggguccaacuacgc

SEQ ID NO: 53631 - RNA, 20 nt, Artificial Sequence
  MKO10053631_A_Tgif1
  gRNA
ucacccgucccucuacgcgc

SEQ ID NO: 53632 - RNA, 20 nt, Artificial Sequence
  MKO10053632_A_Tgif1
  gRNA
caguccagauucugcgagac

SEQ ID NO: 53633 - RNA, 20 nt, Artificial Sequence
  MKO10053633_A_Tgif2lx1
  gRNA
cagaacauggaggaggcuga

SEQ ID NO: 53634 - RNA, 20 nt, Artificial Sequence
  MKO10053634_A_Tgif2lx1
  gRNA
cuggcuacaugaacuguugu

SEQ ID NO: 53635 - RNA, 20 nt, Artificial Sequence
  MKO10053635_A_Tgif2lx1
  gRNA
cgaagagaaagugccauauc

SEQ ID NO: 53636 - RNA, 20 nt, Artificial Sequence
  MKO10053636_A_Tgif2lx2
  gRNA
cuggcuacaugaacuguugu

SEQ ID NO: 53637 - RNA, 20 nt, Artificial Sequence
  MKO10053637_A_Tgif2lx2
  gRNA
cagaacauggaggaggcuga

SEQ ID NO: 53638 - RNA, 20 nt, Artificial Sequence
  MKO10053638_A_Tgif2lx2
  gRNA
ccuucgugacucaagcugua

SEQ ID NO: 53639 - RNA, 20 nt, Artificial Sequence
  MKO10053639_A_Tgif2
  gRNA
cucuuaccugcagcaccgag

SEQ ID NO: 53640 - RNA, 20 nt, Artificial Sequence
  MKO10053640_A_Tgif2
  gRNA
acucuuucuagauauguaac

SEQ ID NO: 53641 - RNA, 20 nt, Artificial Sequence
  MKO10053641_A_Tgif2
  gRNA
ccuggggagagccacaucag

SEQ ID NO: 53642 - RNA, 20 nt, Artificial Sequence
  MKO10053642_A_Tgm1
  gRNA
guccgcacccgcucugaagc

SEQ ID NO: 53643 - RNA, 20 nt, Artificial Sequence
  MKO10053643_A_Tgm1
  gRNA
cggagggggaugccauaugg

SEQ ID NO: 53644 - RNA, 20 nt, Artificial Sequence
  MKO10053644_A_Tgm1
  gRNA
gaaccgccgagagcaccaca

SEQ ID NO: 53645 - RNA, 20 nt, Artificial Sequence
  MKO10053645_A_Tgm2
  gRNA
cggucacagcaccgaacgug

SEQ ID NO: 53646 - RNA, 20 nt, Artificial Sequence
  MKO10053646_A_Tgm2
  gRNA
ggaauauguccuuacgcaac

SEQ ID NO: 53647 - RNA, 20 nt, Artificial Sequence
  MKO10053647_A_Tgm2
  gRNA
acucuguacuucgagggccg

SEQ ID NO: 53648 - RNA, 20 nt, Artificial Sequence
  MKO10053648_A_Tgm3
  gRNA
ugaugcgcccuucgauucau

SEQ ID NO: 53649 - RNA, 20 nt, Artificial Sequence
  MKO10053649_A_Tgm3
  gRNA
uacagauccaaaacgucaac

SEQ ID NO: 53650 - RNA, 20 nt, Artificial Sequence
  MKO10053650_A_Tgm3
  gRNA
acucaguguguacaauccga

SEQ ID NO: 53651 - RNA, 20 nt, Artificial Sequence
  MKO10053651_A_Tgm4
  gRNA
acgccucagcacgagcuucu

SEQ ID NO: 53652 - RNA, 20 nt, Artificial Sequence
  MKO10053652_A_Tgm4
  gRNA
gugaagauugccaaacaguc

SEQ ID NO: 53653 - RNA, 20 nt, Artificial Sequence
  MKO10053653_A_Tgm4
  gRNA
agugacauccuaccguucua

SEQ ID NO: 53654 - RNA, 20 nt, Artificial Sequence
  MKO10053654_A_Tgm5
  gRNA
uaucggcccacggcugcuau

SEQ ID NO: 53655 - RNA, 20 nt, Artificial Sequence
  MKO10053655_A_Tgm5
  gRNA
ccuaggacccuugcccgauc

SEQ ID NO: 53656 - RNA, 20 nt, Artificial Sequence
  MKO10053656_A_Tgm5
  gRNA
caacacugaucucuuccgug

SEQ ID NO: 53657 - RNA, 20 nt, Artificial Sequence
  MKO10053657_A_Tgm6
  gRNA
gaguacgugcuuaacgacag

SEQ ID NO: 53658 - RNA, 20 nt, Artificial Sequence
  MKO10053658_A_Tgm6
  gRNA
cgaaugcugccagucgaccu

SEQ ID NO: 53659 - RNA, 20 nt, Artificial Sequence
  MKO10053659_A_Tgm6
  gRNA
caucgguggcuggguccucc

SEQ ID NO: 53660 - RNA, 20 nt, Artificial Sequence
  MKO10053660_A_Tgm7
  gRNA
ggccgaccacugccgcaaga

SEQ ID NO: 53661 - RNA, 20 nt, Artificial Sequence
  MKO10053661_A_Tgm7
  gRNA
gaagcacuccagacguucuc

SEQ ID NO: 53662 - RNA, 20 nt, Artificial Sequence
  MKO10053662_A_Tgm7
  gRNA
agacccgaccugagaacguc

SEQ ID NO: 53663 - RNA, 20 nt, Artificial Sequence
  MKO10053663_A_Tgoln1
  gRNA
ucgccaccgcgacacucagc

SEQ ID NO: 53664 - RNA, 20 nt, Artificial Sequence
  MKO10053664_A_Tgoln1
  gRNA
ccgcgcaguuucguucaacu

SEQ ID NO: 53665 - RNA, 20 nt, Artificial Sequence
  MKO10053665_A_Tgoln1
  gRNA
cgccgcgaccgaucacaguu

SEQ ID NO: 53666 - RNA, 20 nt, Artificial Sequence
  MKO10053666_A_Tgoln2
  gRNA
ucgccaccgcgacacucagc

SEQ ID NO: 53667 - RNA, 20 nt, Artificial Sequence
  MKO10053667_A_Tgoln2
  gRNA
ccgcgcaguuucguucaacu

SEQ ID NO: 53668 - RNA, 20 nt, Artificial Sequence
  MKO10053668_A_Tgoln2
  gRNA
cgccgcgaccgaucacaguu

SEQ ID NO: 53669 - RNA, 20 nt, Artificial Sequence
  MKO10053669_A_Tgs1
  gRNA
uaauccuaccuuuagcuggu

SEQ ID NO: 53670 - RNA, 20 nt, Artificial Sequence
  MKO10053670_A_Tgs1
  gRNA
agcucagaccaaccagcuaa

SEQ ID NO: 53671 - RNA, 20 nt, Artificial Sequence
  MKO10053671_A_Tgs1
  gRNA
uuagaguugcaggagucuuc

SEQ ID NO: 53672 - RNA, 20 nt, Artificial Sequence
  MKO10053672_A_Tgup1
  gRNA
gcaaagacagugagaagacg

SEQ ID NO: 53673 - RNA, 20 nt, Artificial Sequence
  MKO10053673_A_Tgup1
  gRNA
uugucucuauugccccagug

SEQ ID NO: 53674 - RNA, 20 nt, Artificial Sequence
  MKO10053674_A_Tgup1
  gRNA
ccaaagccauugcacagaug

SEQ ID NO: 53675 - RNA, 20 nt, Artificial Sequence
  MKO10053675_A_Tgup2
  gRNA
gugagaauacgugacgcuug

SEQ ID NO: 53676 - RNA, 20 nt, Artificial Sequence
  MKO10053676_A_Tgup2
  gRNA
uugucucuauugcgccagug

SEQ ID NO: 53677 - RNA, 20 nt, Artificial Sequence
  MKO10053677_A_Tgup2
  gRNA
ccaaagccauugcacagaug

SEQ ID NO: 53678 - RNA, 20 nt, Artificial Sequence
  MKO10053678_A_Tg
  gRNA
accgaguuggccugcccugc

SEQ ID NO: 53679 - RNA, 20 nt, Artificial Sequence
  MKO10053679_A_Tg
  gRNA
accugcagagagugcaaugc

SEQ ID NO: 53680 - RNA, 20 nt, Artificial Sequence
  MKO10053680_A_Tg
  gRNA
uugacaaacuugcacuggac

SEQ ID NO: 53681 - RNA, 20 nt, Artificial Sequence
  MKO10053681_A_Tha1
  gRNA
cccugucgacuaccuccgcc

SEQ ID NO: 53682 - RNA, 20 nt, Artificial Sequence
  MKO10053682_A_Tha1
  gRNA
ccccgcccugcucauagacg

SEQ ID NO: 53683 - RNA, 20 nt, Artificial Sequence
  MKO10053683_A_Tha1
  gRNA
accuggcggagguagucgac

SEQ ID NO: 53684 - RNA, 20 nt, Artificial Sequence
  MKO10053684_A_Thada
  gRNA
gcuuuaccuguuuaauagag

SEQ ID NO: 53685 - RNA, 20 nt, Artificial Sequence
  MKO10053685_A_Thada
  gRNA
uuaucgaccuucuccaagag

SEQ ID NO: 53686 - RNA, 20 nt, Artificial Sequence
  MKO10053686_A_Thada
  gRNA
acaaauccacucuauuaaac

SEQ ID NO: 53687 - RNA, 20 nt, Artificial Sequence
  MKO10053687_A_Thap11
  gRNA
cgcucauugacgccacgcag

SEQ ID NO: 53688 - RNA, 20 nt, Artificial Sequence
  MKO10053688_A_Thap11
  gRNA
acgcugaguugcggcgccuc

SEQ ID NO: 53689 - RNA, 20 nt, Artificial Sequence
  MKO10053689_A_Thap11
  gRNA
cucaagaacgugucccgugc

SEQ ID NO: 53690 - RNA, 20 nt, Artificial Sequence
  MKO10053690_A_Thap1
  gRNA
cugcaagaaccgcuacgaca

SEQ ID NO: 53691 - RNA, 20 nt, Artificial Sequence
  MKO10053691_A_Thap1
  gRNA
guagcgguucuugcagccgu

SEQ ID NO: 53692 - RNA, 20 nt, Artificial Sequence
  MKO10053692_A_Thap1
  gRNA
cuauaucgagccacaugaga

SEQ ID NO: 53693 - RNA, 20 nt, Artificial Sequence
  MKO10053693_A_Thap2
  gRNA
aaugccgaccaauugcgccg

SEQ ID NO: 53694 - RNA, 20 nt, Artificial Sequence
  MKO10053694_A_Thap2
  gRNA
acaaacccgacgacuuaaaa

SEQ ID NO: 53695 - RNA, 20 nt, Artificial Sequence
  MKO10053695_A_Thap2
  gRNA
acagcccgccgcggcgcaau

SEQ ID NO: 53696 - RNA, 20 nt, Artificial Sequence
  MKO10053696_A_Thap3
  gRNA
cgagaugccgaagucuugcg

SEQ ID NO: 53697 - RNA, 20 nt, Artificial Sequence
  MKO10053697_A_Thap3
  gRNA
uguagcgguugcagcauugc

SEQ ID NO: 53698 - RNA, 20 nt, Artificial Sequence
  MKO10053698_A_Thap3
  gRNA
cccgagugcuucagcgccuu

SEQ ID NO: 53699 - RNA, 20 nt, Artificial Sequence
  MKO10053699_A_Thap4
  gRNA
cgacagaaugaccucguuga

SEQ ID NO: 53700 - RNA, 20 nt, Artificial Sequence
  MKO10053700_A_Thap4
  gRNA
aucggcugaccuucugccga

SEQ ID NO: 53701 - RNA, 20 nt, Artificial Sequence
  MKO10053701_A_Thap4
  gRNA
ggagccguuguccuggaugc

SEQ ID NO: 53702 - RNA, 20 nt, Artificial Sequence
  MKO10053702_A_Thap7
  gRNA
acgcgcgagacucgcaaccg

SEQ ID NO: 53703 - RNA, 20 nt, Artificial Sequence
  MKO10053703_A_Thap7
  gRNA
cauaccgcuuccugcaucgc

SEQ ID NO: 53704 - RNA, 20 nt, Artificial Sequence
  MKO10053704_A_Thap7
  gRNA
ucauccgccugagcaccuag

SEQ ID NO: 53705 - RNA, 20 nt, Artificial Sequence
  MKO10053705_A_Thbd
  gRNA
ucguugcacgauugaaccac

SEQ ID NO: 53706 - RNA, 20 nt, Artificial Sequence
  MKO10053706_A_Thbd
  gRNA
accgcggcggaacugccuac

SEQ ID NO: 53707 - RNA, 20 nt, Artificial Sequence
  MKO10053707_A_Thbd
  gRNA
agcgcagaugcaucgguagu

SEQ ID NO: 53708 - RNA, 20 nt, Artificial Sequence
  MKO10053708_A_Thbs1
  gRNA
aaggggccccggucgccgac

SEQ ID NO: 53709 - RNA, 20 nt, Artificial Sequence
  MKO10053709_A_Thbs1
  gRNA
cccuucaccagucggcgacc

SEQ ID NO: 53710 - RNA, 20 nt, Artificial Sequence
  MKO10053710_A_Thbs1
  gRNA
gcuauccgcaccaacuacau

SEQ ID NO: 53711 - RNA, 20 nt, Artificial Sequence
  MKO10053711_A_Thbs2
  gRNA
uaggcgggcaccccgggguc

SEQ ID NO: 53712 - RNA, 20 nt, Artificial Sequence
  MKO10053712_A_Thbs2
  gRNA
acuugcgguccugcuucagu

SEQ ID NO: 53713 - RNA, 20 nt, Artificial Sequence
  MKO10053713_A_Thbs2
  gRNA
cauguugcucaacuccucgc

SEQ ID NO: 53714 - RNA, 20 nt, Artificial Sequence
  MKO10053714_A_Thbs3
  gRNA
cucgccaagacaacacacga

SEQ ID NO: 53715 - RNA, 20 nt, Artificial Sequence
  MKO10053715_A_Thbs3
  gRNA
cagugcuggugcgguaccag

SEQ ID NO: 53716 - RNA, 20 nt, Artificial Sequence
  MKO10053716_A_Thbs3
  gRNA
guugugggcaagaucaacaa

SEQ ID NO: 53717 - RNA, 20 nt, Artificial Sequence
  MKO10053717_A_Thbs4
  gRNA
guccgcaauucaauggacuc

SEQ ID NO: 53718 - RNA, 20 nt, Artificial Sequence
  MKO10053718_A_Thbs4
  gRNA
aguccgccugagcgcagucc

SEQ ID NO: 53719 - RNA, 20 nt, Artificial Sequence
  MKO10053719_A_Thbs4
  gRNA
agaugagauagacuucgugc

SEQ ID NO: 53720 - RNA, 20 nt, Artificial Sequence
  MKO10053720_A_Theg
  gRNA
ucgaaagcuccuccaugcgc

SEQ ID NO: 53721 - RNA, 20 nt, Artificial Sequence
  MKO10053721_A_Theg
  gRNA
gguguccucgauaaaucgcu

SEQ ID NO: 53722 - RNA, 20 nt, Artificial Sequence
  MKO10053722_A_Theg
  gRNA
aggagcuuucgaggcccaag

SEQ ID NO: 53723 - RNA, 20 nt, Artificial Sequence
  MKO10053723_A_Them4
  gRNA
aacucuugaauagcucgagu

SEQ ID NO: 53724 - RNA, 20 nt, Artificial Sequence
  MKO10053724_A_Them4
  gRNA
ucugagguccuuaguccagc

SEQ ID NO: 53725 - RNA, 20 nt, Artificial Sequence
  MKO10053725_A_Them4
  gRNA
ggcagucauggcaacgccuu

SEQ ID NO: 53726 - RNA, 20 nt, Artificial Sequence
  MKO10053726_A_Them5
  gRNA
uuuaauccagccgccugauu

SEQ ID NO: 53727 - RNA, 20 nt, Artificial Sequence
  MKO10053727_A_Them5
  gRNA
cagcauaucugaacaccagc

SEQ ID NO: 53728 - RNA, 20 nt, Artificial Sequence
  MKO10053728_A_Them5
  gRNA
cgaauaugucucauccauca

SEQ ID NO: 53729 - RNA, 20 nt, Artificial Sequence
  MKO10053729_A_Them6
  gRNA
cgcacacgaaaccaucgcga

SEQ ID NO: 53730 - RNA, 20 nt, Artificial Sequence
  MKO10053730_A_Them6
  gRNA
agucgcguguguaccucgaa

SEQ ID NO: 53731 - RNA, 20 nt, Artificial Sequence
  MKO10053731_A_Them6
  gRNA
cgcucucagcacggagcagc

SEQ ID NO: 53732 - RNA, 20 nt, Artificial Sequence
  MKO10053732_A_Themis2
  gRNA
cgucaagaucccgucuacgc

SEQ ID NO: 53733 - RNA, 20 nt, Artificial Sequence
  MKO10053733_A_Themis2
  gRNA
cagccgacgcuauaaccuag

SEQ ID NO: 53734 - RNA, 20 nt, Artificial Sequence
  MKO10053734_A_Themis2
  gRNA
uccaacgucugacccgucuc

SEQ ID NO: 53735 - RNA, 20 nt, Artificial Sequence
  MKO10053735_A_Themis3
  gRNA
cggugaucaaguucuggacg

SEQ ID NO: 53736 - RNA, 20 nt, Artificial Sequence
  MKO10053736_A_Themis3
  gRNA
cccgccucgaucguaagccc

SEQ ID NO: 53737 - RNA, 20 nt, Artificial Sequence
  MKO10053737_A_Themis3
  gRNA
uagugguagaagagcguucg

SEQ ID NO: 53738 - RNA, 20 nt, Artificial Sequence
  MKO10053738_A_Themis
  gRNA
uaggccguggggaacucccg

SEQ ID NO: 53739 - RNA, 20 nt, Artificial Sequence
  MKO10053739_A_Themis
  gRNA
ucgacaacuucagcuacuac

SEQ ID NO: 53740 - RNA, 20 nt, Artificial Sequence
  MKO10053740_A_Themis
  gRNA
gcaaggaugaccuagucugc

SEQ ID NO: 53741 - RNA, 20 nt, Artificial Sequence
  MKO10053741_A_Thg1l
  gRNA
ccgccaguaaaauacguaac

SEQ ID NO: 53742 - RNA, 20 nt, Artificial Sequence
  MKO10053742_A_Thg1l
  gRNA
gaggacauugugauugcgua

SEQ ID NO: 53743 - RNA, 20 nt, Artificial Sequence
  MKO10053743_A_Thg1l
  gRNA
uugccaaaccuaaugacagu

SEQ ID NO: 53744 - RNA, 20 nt, Artificial Sequence
  MKO10053744_A_Thnsl1
  gRNA
agcaagaguuuguugccgac

SEQ ID NO: 53745 - RNA, 20 nt, Artificial Sequence
  MKO10053745_A_Thnsl1
  gRNA
ucaaguauaaaugucgcucc

SEQ ID NO: 53746 - RNA, 20 nt, Artificial Sequence
  MKO10053746_A_Thnsl1
  gRNA
acauaccgcuguugcaaaag

SEQ ID NO: 53747 - RNA, 20 nt, Artificial Sequence
  MKO10053747_A_Thnsl2
  gRNA
ccuuuaacaccguugucauc

SEQ ID NO: 53748 - RNA, 20 nt, Artificial Sequence
  MKO10053748_A_Thnsl2
  gRNA
gugguagugccgacgggagc

SEQ ID NO: 53749 - RNA, 20 nt, Artificial Sequence
  MKO10053749_A_Thnsl2
  gRNA
ugagcuugacgaacccauca

SEQ ID NO: 53750 - RNA, 20 nt, Artificial Sequence
  MKO10053750_A_Thoc1
  gRNA
agcuaaaacguucucacaug

SEQ ID NO: 53751 - RNA, 20 nt, Artificial Sequence
  MKO10053751_A_Thoc1
  gRNA
ccugccagguaacugacuga

SEQ ID NO: 53752 - RNA, 20 nt, Artificial Sequence
  MKO10053752_A_Thoc1
  gRNA
acccuugaccaagcuuucag

SEQ ID NO: 53753 - RNA, 20 nt, Artificial Sequence
  MKO10053753_A_Thoc2
  gRNA
caugacaguucgaccuacag

SEQ ID NO: 53754 - RNA, 20 nt, Artificial Sequence
  MKO10053754_A_Thoc2
  gRNA
auaugcagaacacgucagca

SEQ ID NO: 53755 - RNA, 20 nt, Artificial Sequence
  MKO10053755_A_Thoc2
  gRNA
uuuaauguaggaauuccgug

SEQ ID NO: 53756 - RNA, 20 nt, Artificial Sequence
  MKO10053756_A_Thoc3
  gRNA
aucgccacugugaauacgaa

SEQ ID NO: 53757 - RNA, 20 nt, Artificial Sequence
  MKO10053757_A_Thoc3
  gRNA
cuaacucgucaacgucccaa

SEQ ID NO: 53758 - RNA, 20 nt, Artificial Sequence
  MKO10053758_A_Thoc3
  gRNA
gauauagcugaagucgagac

SEQ ID NO: 53759 - RNA, 20 nt, Artificial Sequence
  MKO10053759_A_Thoc5
  gRNA
ccauugaaauugaagaacga

SEQ ID NO: 53760 - RNA, 20 nt, Artificial Sequence
  MKO10053760_A_Thoc5
  gRNA
ggugcaucacuucguagagc

SEQ ID NO: 53761 - RNA, 20 nt, Artificial Sequence
  MKO10053761_A_Thoc5
  gRNA
guaggcaucgacuuucugcu

SEQ ID NO: 53762 - RNA, 20 nt, Artificial Sequence
  MKO10053762_A_Thoc6
  gRNA
ugacgggccugucuacagca

SEQ ID NO: 53763 - RNA, 20 nt, Artificial Sequence
  MKO10053763_A_Thoc6
  gRNA
ccaccguggaagaccaccac

SEQ ID NO: 53764 - RNA, 20 nt, Artificial Sequence
  MKO10053764_A_Thoc6
  gRNA
cuggcagcuggcaacaauua

SEQ ID NO: 53765 - RNA, 20 nt, Artificial Sequence
  MKO10053765_A_Thoc7
  gRNA
cgaauacgaaaaaaucgaca

SEQ ID NO: 53766 - RNA, 20 nt, Artificial Sequence
  MKO10053766_A_Thoc7
  gRNA
uuccuccagacgaaguuaua

SEQ ID NO: 53767 - RNA, 20 nt, Artificial Sequence
  MKO10053767_A_Thoc7
  gRNA
acagagugcucagcaugcgu

SEQ ID NO: 53768 - RNA, 20 nt, Artificial Sequence
  MKO10053768_A_Thop1
  gRNA
caaguguguguacgaccgag

SEQ ID NO: 53769 - RNA, 20 nt, Artificial Sequence
  MKO10053769_A_Thop1
  gRNA
ggucugcucgaugagcugcg

SEQ ID NO: 53770 - RNA, 20 nt, Artificial Sequence
  MKO10053770_A_Thop1
  gRNA
ccaacacguguccccgugca

SEQ ID NO: 53771 - RNA, 20 nt, Artificial Sequence
  MKO10053771_A_Thpo
  gRNA
gauagacaaagggucgacgu

SEQ ID NO: 53772 - RNA, 20 nt, Artificial Sequence
  MKO10053772_A_Thpo
  gRNA
ucgcccggagcuuucaacaa

SEQ ID NO: 53773 - RNA, 20 nt, Artificial Sequence
  MKO10053773_A_Thpo
  gRNA
agucacgcagcaguuuauuu

SEQ ID NO: 53774 - RNA, 20 nt, Artificial Sequence
  MKO10053774_A_Thrap3
  gRNA
caagcauacagcccucgucg

SEQ ID NO: 53775 - RNA, 20 nt, Artificial Sequence
  MKO10053775_A_Thrap3
  gRNA
gaucgagaacggccccgacg

SEQ ID NO: 53776 - RNA, 20 nt, Artificial Sequence
  MKO10053776_A_Thrap3
  gRNA
ggaccccaccuguguaucuc

SEQ ID NO: 53777 - RNA, 20 nt, Artificial Sequence
  MKO10053777_A_Thra
  gRNA
ccugggcguuagugcugcga

SEQ ID NO: 53778 - RNA, 20 nt, Artificial Sequence
  MKO10053778_A_Thra
  gRNA
ccaucgcagcacuaacgccc

SEQ ID NO: 53779 - RNA, 20 nt, Artificial Sequence
  MKO10053779_A_Thra
  gRNA
cuaccgcuguaucacuugug

SEQ ID NO: 53780 - RNA, 20 nt, Artificial Sequence
  MKO10053780_A_Thrb
  gRNA
cccaucgugaaugccccaga

SEQ ID NO: 53781 - RNA, 20 nt, Artificial Sequence
  MKO10053781_A_Thrb
  gRNA
gcagcgauagugguacccug

SEQ ID NO: 53782 - RNA, 20 nt, Artificial Sequence
  MKO10053782_A_Thrb
  gRNA
aggucaaccuugccaccuuc

SEQ ID NO: 53783 - RNA, 20 nt, Artificial Sequence
  MKO10053783_A_Thrsp
  gRNA
ggcuggcaacgaaaccagcg

SEQ ID NO: 53784 - RNA, 20 nt, Artificial Sequence
  MKO10053784_A_Thrsp
  gRNA
agcgucguucucagccucgc

SEQ ID NO: 53785 - RNA, 20 nt, Artificial Sequence
  MKO10053785_A_Thrsp
  gRNA
aucgguacuccgcgguggug

SEQ ID NO: 53786 - RNA, 20 nt, Artificial Sequence
  MKO10053786_A_Thsd1
  gRNA
ucguuggagccgaaguaucc

SEQ ID NO: 53787 - RNA, 20 nt, Artificial Sequence
  MKO10053787_A_Thsd1
  gRNA
gcgaacgggcgugcugcauu

SEQ ID NO: 53788 - RNA, 20 nt, Artificial Sequence
  MKO10053788_A_Thsd1
  gRNA
cuuagugguaagaguccgau

SEQ ID NO: 53789 - RNA, 20 nt, Artificial Sequence
  MKO10053789_A_Thsd4
  gRNA
cgaucgcccggggaaguacg

SEQ ID NO: 53790 - RNA, 20 nt, Artificial Sequence
  MKO10053790_A_Thsd4
  gRNA
caccuacaaacgaccgaacg

SEQ ID NO: 53791 - RNA, 20 nt, Artificial Sequence
  MKO10053791_A_Thsd4
  gRNA
ucaugaucacguacucauag

SEQ ID NO: 53792 - RNA, 20 nt, Artificial Sequence
  MKO10053792_A_Thsd7a
  gRNA
uguuuaagcacgucacgucc

SEQ ID NO: 53793 - RNA, 20 nt, Artificial Sequence
  MKO10053793_A_Thsd7a
  gRNA
cgcauucucgcgauuucucg

SEQ ID NO: 53794 - RNA, 20 nt, Artificial Sequence
  MKO10053794_A_Thsd7a
  gRNA
cuuuggugaucacgcaggac

SEQ ID NO: 53795 - RNA, 20 nt, Artificial Sequence
  MKO10053795_A_Thsd7b
  gRNA
aucgcgcccccucuguaugg

SEQ ID NO: 53796 - RNA, 20 nt, Artificial Sequence
  MKO10053796_A_Thsd7b
  gRNA
gcuguuuccgcgugugugac

SEQ ID NO: 53797 - RNA, 20 nt, Artificial Sequence
  MKO10053797_A_Thsd7b
  gRNA
acuaugcaguccaucgagca

SEQ ID NO: 53798 - RNA, 20 nt, Artificial Sequence
  MKO10053798_A_Thtpa
  gRNA
uuauuacuacgcgaagcucc

SEQ ID NO: 53799 - RNA, 20 nt, Artificial Sequence
  MKO10053799_A_Thtpa
  gRNA
cugcgacaacgagaagguag

SEQ ID NO: 53800 - RNA, 20 nt, Artificial Sequence
  MKO10053800_A_Thtpa
  gRNA
ccuacagcgcuucaggccuc

SEQ ID NO: 53801 - RNA, 20 nt, Artificial Sequence
  MKO10053801_A_Thumpd1
  gRNA
cgucgccguacucguugagc

SEQ ID NO: 53802 - RNA, 20 nt, Artificial Sequence
  MKO10053802_A_Thumpd1
  gRNA
caugaacgagcgcaagugcg

SEQ ID NO: 53803 - RNA, 20 nt, Artificial Sequence
  MKO10053803_A_Thumpd1
  gRNA
agucagagugaucccccaga

SEQ ID NO: 53804 - RNA, 20 nt, Artificial Sequence
  MKO10053804_A_Thumpd2
  gRNA
cuugaggaauccaaauauag

SEQ ID NO: 53805 - RNA, 20 nt, Artificial Sequence
  MKO10053805_A_Thumpd2
  gRNA
aggguuuccugccgcugcac

SEQ ID NO: 53806 - RNA, 20 nt, Artificial Sequence
  MKO10053806_A_Thumpd2
  gRNA
ccugagugaugcuuacuccg

SEQ ID NO: 53807 - RNA, 20 nt, Artificial Sequence
  MKO10053807_A_Thumpd3
  gRNA
uuaccaguucaaagauacga

SEQ ID NO: 53808 - RNA, 20 nt, Artificial Sequence
  MKO10053808_A_Thumpd3
  gRNA
ucaccuucguaucuuugaac

SEQ ID NO: 53809 - RNA, 20 nt, Artificial Sequence
  MKO10053809_A_Thumpd3
  gRNA
aauguguaauauuucugcga

SEQ ID NO: 53810 - RNA, 20 nt, Artificial Sequence
  MKO10053810_A_Thy1
  gRNA
gcgggagcgguacgugugcu

SEQ ID NO: 53811 - RNA, 20 nt, Artificial Sequence
  MKO10053811_A_Thy1
  gRNA
aaaguagucgcccucauccu

SEQ ID NO: 53812 - RNA, 20 nt, Artificial Sequence
  MKO10053812_A_Thy1
  gRNA
agcgucgcucuccugcucuc

SEQ ID NO: 53813 - RNA, 20 nt, Artificial Sequence
  MKO10053813_A_Thyn1
  gRNA
cuuugcuggauggaucguaa

SEQ ID NO: 53814 - RNA, 20 nt, Artificial Sequence
  MKO10053814_A_Thyn1
  gRNA
ugucuauaccuuucucuagc

SEQ ID NO: 53815 - RNA, 20 nt, Artificial Sequence
  MKO10053815_A_Thyn1
  gRNA
uucauaaguccaacaaugcc

SEQ ID NO: 53816 - RNA, 20 nt, Artificial Sequence
  MKO10053816_A_Th
  gRNA
acggcggcagagucucaucg

SEQ ID NO: 53817 - RNA, 20 nt, Artificial Sequence
  MKO10053817_A_Th
  gRNA
ugccgccguccaaugaaccu

SEQ ID NO: 53818 - RNA, 20 nt, Artificial Sequence
  MKO10053818_A_Th
  gRNA
ggaguacuuugugcgcuucg

SEQ ID NO: 53819 - RNA, 20 nt, Artificial Sequence
  MKO10053819_A_Tia1
  gRNA
cauuaucuuccgcccauuca

SEQ ID NO: 53820 - RNA, 20 nt, Artificial Sequence
  MKO10053820_A_Tia1
  gRNA
cuucugucacaucucgagaa

SEQ ID NO: 53821 - RNA, 20 nt, Artificial Sequence
  MKO10053821_A_Tia1
  gRNA
caaucuggcuaaagagcugg

SEQ ID NO: 53822 - RNA, 20 nt, Artificial Sequence
  MKO10053822_A_Tial1
  gRNA
cucagcaacccgauagcaga

SEQ ID NO: 53823 - RNA, 20 nt, Artificial Sequence
  MKO10053823_A_Tial1
  gRNA
aaaucagcauuugcccccuu

SEQ ID NO: 53824 - RNA, 20 nt, Artificial Sequence
  MKO10053824_A_Tial1
  gRNA
gcugcauuagcugcuaugaa

SEQ ID NO: 53825 - RNA, 20 nt, Artificial Sequence
  MKO10053825_A_Tiam1
  gRNA
cgcauccgacagcugucgug

SEQ ID NO: 53826 - RNA, 20 nt, Artificial Sequence
  MKO10053826_A_Tiam1
  gRNA
ugaagcgguccgcguaguac

SEQ ID NO: 53827 - RNA, 20 nt, Artificial Sequence
  MKO10053827_A_Tiam1
  gRNA
gggauccuuccuguacuacg

SEQ ID NO: 53828 - RNA, 20 nt, Artificial Sequence
  MKO10053828_A_Tiam2
  gRNA
gaauagguagacguccccac

SEQ ID NO: 53829 - RNA, 20 nt, Artificial Sequence
  MKO10053829_A_Tiam2
  gRNA
guuccgcaugcgcugcuauu

SEQ ID NO: 53830 - RNA, 20 nt, Artificial Sequence
  MKO10053830_A_Tiam2
  gRNA
aucgacgcugauagcgugag

SEQ ID NO: 53831 - RNA, 20 nt, Artificial Sequence
  MKO10053831_A_Ticam1
  gRNA
acacgaaauuagcguuccag

SEQ ID NO: 53832 - RNA, 20 nt, Artificial Sequence
  MKO10053832_A_Ticam1
  gRNA
ccuacguauucgggagaagc

SEQ ID NO: 53833 - RNA, 20 nt, Artificial Sequence
  MKO10053833_A_Ticam1
  gRNA
ccagcuucucccgaauacgu

SEQ ID NO: 53834 - RNA, 20 nt, Artificial Sequence
  MKO10053834_A_Ticam2
  gRNA
gaucuacugcaaaacgacuu

SEQ ID NO: 53835 - RNA, 20 nt, Artificial Sequence
  MKO10053835_A_Ticam2
  gRNA
aucucggcgaaaacgauccc

SEQ ID NO: 53836 - RNA, 20 nt, Artificial Sequence
  MKO10053836_A_Ticam2
  gRNA
ugcagaagaugacaccgacg

SEQ ID NO: 53837 - RNA, 20 nt, Artificial Sequence
  MKO10053837_A_Ticrr
  gRNA
guccagcucuugucgaaaag

SEQ ID NO: 53838 - RNA, 20 nt, Artificial Sequence
  MKO10053838_A_Ticrr
  gRNA
uggggaaauaauucccguua

SEQ ID NO: 53839 - RNA, 20 nt, Artificial Sequence
  MKO10053839_A_Ticrr
  gRNA
ugugacagcucgccaccaca

SEQ ID NO: 53840 - RNA, 20 nt, Artificial Sequence
  MKO10053840_A_Tie1
  gRNA
aucgugcgcaccuucccgcc

SEQ ID NO: 53841 - RNA, 20 nt, Artificial Sequence
  MKO10053841_A_Tie1
  gRNA
ucgcacgaugagccgaaaga

SEQ ID NO: 53842 - RNA, 20 nt, Artificial Sequence
  MKO10053842_A_Tie1
  gRNA
caguugaaaacgcccgucau

SEQ ID NO: 53843 - RNA, 20 nt, Artificial Sequence
  MKO10053843_A_Tifab
  gRNA
ccagaugcuaguccgcaaag

SEQ ID NO: 53844 - RNA, 20 nt, Artificial Sequence
  MKO10053844_A_Tifab
  gRNA
guccucgcccaaccaacagc

SEQ ID NO: 53845 - RNA, 20 nt, Artificial Sequence
  MKO10053845_A_Tifab
  gRNA
gucucgcuaccauuuguccc

SEQ ID NO: 53846 - RNA, 20 nt, Artificial Sequence
  MKO10053846_A_Tifa
  gRNA
guuuguccugaaacguauac

SEQ ID NO: 53847 - RNA, 20 nt, Artificial Sequence
  MKO10053847_A_Tifa
  gRNA
uauugagguagccgagcucc

SEQ ID NO: 53848 - RNA, 20 nt, Artificial Sequence
  MKO10053848_A_Tifa
  gRNA
gcucggcuaccucaauaaaa

SEQ ID NO: 53849 - RNA, 20 nt, Artificial Sequence
  MKO10053849_A_Tigd2
  gRNA
cgcuuggacaccccacuagu

SEQ ID NO: 53850 - RNA, 20 nt, Artificial Sequence
  MKO10053850_A_Tigd2
  gRNA
gucaaaagauauuaccgagc

SEQ ID NO: 53851 - RNA, 20 nt, Artificial Sequence
  MKO10053851_A_Tigd2
  gRNA
cucauacguugacgacuuca

SEQ ID NO: 53852 - RNA, 20 nt, Artificial Sequence
  MKO10053852_A_Tigd3
  gRNA
caugggccccguuacauccc

SEQ ID NO: 53853 - RNA, 20 nt, Artificial Sequence
  MKO10053853_A_Tigd3
  gRNA
caaggaacuggccgauauca

SEQ ID NO: 53854 - RNA, 20 nt, Artificial Sequence
  MKO10053854_A_Tigd3
  gRNA
cauuguuucgacguuuccag

SEQ ID NO: 53855 - RNA, 20 nt, Artificial Sequence
  MKO10053855_A_Tigd4
  gRNA
cugcauccacugcucgaaua

SEQ ID NO: 53856 - RNA, 20 nt, Artificial Sequence
  MKO10053856_A_Tigd4
  gRNA
ccgcagccauauucgagcag

SEQ ID NO: 53857 - RNA, 20 nt, Artificial Sequence
  MKO10053857_A_Tigd4
  gRNA
ccgagccccgcguuguuuca

SEQ ID NO: 53858 - RNA, 20 nt, Artificial Sequence
  MKO10053858_A_Tigd5
  gRNA
cgcagguagcgcuugacgcc

SEQ ID NO: 53859 - RNA, 20 nt, Artificial Sequence
  MKO10053859_A_Tigd5
  gRNA
cggauagcggcacaccgugc

SEQ ID NO: 53860 - RNA, 20 nt, Artificial Sequence
  MKO10053860_A_Tigd5
  gRNA
accgcccuugacgcgcucga

SEQ ID NO: 53861 - RNA, 20 nt, Artificial Sequence
  MKO10053861_A_Tigit
  gRNA
uucauugcuguaucgaagac

SEQ ID NO: 53862 - RNA, 20 nt, Artificial Sequence
  MKO10053862_A_Tigit
  gRNA
cugaagugacccaagucgac

SEQ ID NO: 53863 - RNA, 20 nt, Artificial Sequence
  MKO10053863_A_Tigit
  gRNA
uguaccuaucauacguaucc

SEQ ID NO: 53864 - RNA, 20 nt, Artificial Sequence
  MKO10053864_A_Timd2
  gRNA
gugaccguauacaauaagaa

SEQ ID NO: 53865 - RNA, 20 nt, Artificial Sequence
  MKO10053865_A_Timd2
  gRNA
aggugugucgaauaaauaca

SEQ ID NO: 53866 - RNA, 20 nt, Artificial Sequence
  MKO10053866_A_Timd2
  gRNA
cuuacaguguuaucauccca

SEQ ID NO: 53867 - RNA, 20 nt, Artificial Sequence
  MKO10053867_A_Timd4
  gRNA
cuacagacauagccguacuc

SEQ ID NO: 53868 - RNA, 20 nt, Artificial Sequence
  MKO10053868_A_Timd4
  gRNA
gguguacugcugccguauag

SEQ ID NO: 53869 - RNA, 20 nt, Artificial Sequence
  MKO10053869_A_Timd4
  gRNA
caccccacugucaccucgau

SEQ ID NO: 53870 - RNA, 20 nt, Artificial Sequence
  MKO10053870_A_Timeless
  gRNA
cuagccacguguagcgcccu

SEQ ID NO: 53871 - RNA, 20 nt, Artificial Sequence
  MKO10053871_A_Timeless
  gRNA
gauccgauaccugaggcacg

SEQ ID NO: 53872 - RNA, 20 nt, Artificial Sequence
  MKO10053872_A_Timeless
  gRNA
cucucuucgaugccgugauc

SEQ ID NO: 53873 - RNA, 20 nt, Artificial Sequence
  MKO10053873_A_Timm10b
  gRNA
gcgccgcaucgcggacuacg

SEQ ID NO: 53874 - RNA, 20 nt, Artificial Sequence
  MKO10053874_A_Timm10b
  gRNA
cagccucguaguccgcgaug

SEQ ID NO: 53875 - RNA, 20 nt, Artificial Sequence
  MKO10053875_A_Timm10b
  gRNA
cagccugcaccaccgagcuc

SEQ ID NO: 53876 - RNA, 20 nt, Artificial Sequence
  MKO10053876_A_Timm10
  gRNA
aggcacgcacuuccgguggc

SEQ ID NO: 53877 - RNA, 20 nt, Artificial Sequence
  MKO10053877_A_Timm10
  gRNA
ccgauguguauccaaguacu

SEQ ID NO: 53878 - RNA, 20 nt, Artificial Sequence
  MKO10053878_A_Timm10
  gRNA
ccagcuccgcagccagcugc

SEQ ID NO: 53879 - RNA, 20 nt, Artificial Sequence
  MKO10053879_A_Timm13
  gRNA
cgagccgaagccgcugucca

SEQ ID NO: 53880 - RNA, 20 nt, Artificial Sequence
  MKO10053880_A_Timm13
  gRNA
cgggcuucccgaugcacuuc

SEQ ID NO: 53881 - RNA, 20 nt, Artificial Sequence
  MKO10053881_A_Timm13
  gRNA
ccuacaacucucgacugcag

SEQ ID NO: 53882 - RNA, 20 nt, Artificial Sequence
  MKO10053882_A_Timm17a
  gRNA
gcguuuaccaugggcaccau

SEQ ID NO: 53883 - RNA, 20 nt, Artificial Sequence
  MKO10053883_A_Timm17a
  gRNA
uucagauggaccgguagcca

SEQ ID NO: 53884 - RNA, 20 nt, Artificial Sequence
  MKO10053884_A_Timm17a
  gRNA
acagucaucuacaauucgcc

SEQ ID NO: 53885 - RNA, 20 nt, Artificial Sequence
  MKO10053885_A_Timm17b
  gRNA
uugcagcccauggcgaauug

SEQ ID NO: 53886 - RNA, 20 nt, Artificial Sequence
  MKO10053886_A_Timm17b
  gRNA
acugcccagcaguuccgaaa

SEQ ID NO: 53887 - RNA, 20 nt, Artificial Sequence
  MKO10053887_A_Timm17b
  gRNA
ccgccucccaggugguccgc

SEQ ID NO: 53888 - RNA, 20 nt, Artificial Sequence
  MKO10053888_A_Timm21
  gRNA
cucuuuggagucggccuuac

SEQ ID NO: 53889 - RNA, 20 nt, Artificial Sequence
  MKO10053889_A_Timm21
  gRNA
gugggcggagacagcauguc

SEQ ID NO: 53890 - RNA, 20 nt, Artificial Sequence
  MKO10053890_A_Timm21
  gRNA
cugcaggugauugguguauu

SEQ ID NO: 53891 - RNA, 20 nt, Artificial Sequence
  MKO10053891_A_Timm22
  gRNA
uuacuaaccucggaagccga

SEQ ID NO: 53892 - RNA, 20 nt, Artificial Sequence
  MKO10053892_A_Timm22
  gRNA
cugcaaucgauuauuaccua

SEQ ID NO: 53893 - RNA, 20 nt, Artificial Sequence
  MKO10053893_A_Timm22
  gRNA
cauggcggcuaccgccccca

SEQ ID NO: 53894 - RNA, 20 nt, Artificial Sequence
  MKO10053894_A_Timm23
  gRNA
uugccaccaggggccgcauu

SEQ ID NO: 53895 - RNA, 20 nt, Artificial Sequence
  MKO10053895_A_Timm23
  gRNA
gcuaauacucuaggcucccu

SEQ ID NO: 53896 - RNA, 20 nt, Artificial Sequence
  MKO10053896_A_Timm23
  gRNA
cuuaccugaacgagauagcg

SEQ ID NO: 53897 - RNA, 20 nt, Artificial Sequence
  MKO10053897_A_Timm44
  gRNA
acgcacaguuucugauucga

SEQ ID NO: 53898 - RNA, 20 nt, Artificial Sequence
  MKO10053898_A_Timm44
  gRNA
agcuaccagauaagccggcc

SEQ ID NO: 53899 - RNA, 20 nt, Artificial Sequence
  MKO10053899_A_Timm44
  gRNA
uauaaaaaaguuccgagaug

SEQ ID NO: 53900 - RNA, 20 nt, Artificial Sequence
  MKO10053900_A_Timm50
  gRNA
aucgccgguuugcucggagc

SEQ ID NO: 53901 - RNA, 20 nt, Artificial Sequence
  MKO10053901_A_Timm50
  gRNA
augccaaaaaaauugcgcuc

SEQ ID NO: 53902 - RNA, 20 nt, Artificial Sequence
  MKO10053902_A_Timm50
  gRNA
ucaccgcugucgaauucauc

SEQ ID NO: 53903 - RNA, 20 nt, Artificial Sequence
  MKO10053903_A_Timm8a1
  gRNA
uucugaacaggagaagugca

SEQ ID NO: 53904 - RNA, 20 nt, Artificial Sequence
  MKO10053904_A_Timm8a1
  gRNA
ggaguccuccacguccucuu

SEQ ID NO: 53905 - RNA, 20 nt, Artificial Sequence
  MKO10053905_A_Timm8a1
  gRNA
cccagcaaaguuccgucauc

SEQ ID NO: 53906 - RNA, 20 nt, Artificial Sequence
  MKO10053906_A_Timm8a2
  gRNA
ucaccaagcagagcuccgcc

SEQ ID NO: 53907 - RNA, 20 nt, Artificial Sequence
  MKO10053907_A_Timm8a2
  gRNA
ucgcugucauggaguccgcc

SEQ ID NO: 53908 - RNA, 20 nt, Artificial Sequence
  MKO10053908_A_Timm8a2
  gRNA
ucuucccgggggaccagccu

SEQ ID NO: 53909 - RNA, 20 nt, Artificial Sequence
  MKO10053909_A_Timm8b
  gRNA
cgaagcggaguuacaacgcc

SEQ ID NO: 53910 - RNA, 20 nt, Artificial Sequence
  MKO10053910_A_Timm8b
  gRNA
acuccgacaauggccgagcu

SEQ ID NO: 53911 - RNA, 20 nt, Artificial Sequence
  MKO10053911_A_Timm8b
  gRNA
gcccuccuuucuguacgauc

SEQ ID NO: 53912 - RNA, 20 nt, Artificial Sequence
  MKO10053912_A_Timm9
  gRNA
caggaccucucuaccguggc

SEQ ID NO: 53913 - RNA, 20 nt, Artificial Sequence
  MKO10053913_A_Timm9
  gRNA
uuuauaguuuaaggaguucc

SEQ ID NO: 53914 - RNA, 20 nt, Artificial Sequence
  MKO10053914_A_Timm9
  gRNA
uuuaacacaguccaaaaagc

SEQ ID NO: 53915 - RNA, 20 nt, Artificial Sequence
  MKO10053915_A_Timmdc1
  gRNA
ucauccgguauggcuggcgc

SEQ ID NO: 53916 - RNA, 20 nt, Artificial Sequence
  MKO10053916_A_Timmdc1
  gRNA
cugguggcugguaguauaau

SEQ ID NO: 53917 - RNA, 20 nt, Artificial Sequence
  MKO10053917_A_Timmdc1
  gRNA
aacuccagcgccagccauac

SEQ ID NO: 53918 - RNA, 20 nt, Artificial Sequence
  MKO10053918_A_Timp1
  gRNA
ugacugggguguaggcguac

SEQ ID NO: 53919 - RNA, 20 nt, Artificial Sequence
  MKO10053919_A_Timp1
  gRNA
ucaucuugaucuuauaacgc

SEQ ID NO: 53920 - RNA, 20 nt, Artificial Sequence
  MKO10053920_A_Timp1
  gRNA
aagguggucucguugauuuc

SEQ ID NO: 53921 - RNA, 20 nt, Artificial Sequence
  MKO10053921_A_Timp2
  gRNA
uucuugcgcgugguaccgcg

SEQ ID NO: 53922 - RNA, 20 nt, Artificial Sequence
  MKO10053922_A_Timp2
  gRNA
gauuccgggaaugacaucua

SEQ ID NO: 53923 - RNA, 20 nt, Artificial Sequence
  MKO10053923_A_Timp2
  gRNA
gcaagaguuucuugacaucg

SEQ ID NO: 53924 - RNA, 20 nt, Artificial Sequence
  MKO10053924_A_Timp3
  gRNA
gguaauugaggcccuugcgc

SEQ ID NO: 53925 - RNA, 20 nt, Artificial Sequence
  MKO10053925_A_Timp3
  gRNA
uacagugauccgggccaaag

SEQ ID NO: 53926 - RNA, 20 nt, Artificial Sequence
  MKO10053926_A_Timp3
  gRNA
ccgugugaauguacugcacg

SEQ ID NO: 53927 - RNA, 20 nt, Artificial Sequence
  MKO10053927_A_Timp4
  gRNA
ugaugucaacguacuccuuc

SEQ ID NO: 53928 - RNA, 20 nt, Artificial Sequence
  MKO10053928_A_Timp4
  gRNA
guccguccagagacacucau

SEQ ID NO: 53929 - RNA, 20 nt, Artificial Sequence
  MKO10053929_A_Timp4
  gRNA
aagauacugcuugugacugu

SEQ ID NO: 53930 - RNA, 20 nt, Artificial Sequence
  MKO10053930_A_Tinagl1
  gRNA
ugagggcauucgcuaccgcc

SEQ ID NO: 53931 - RNA, 20 nt, Artificial Sequence
  MKO10053931_A_Tinagl1
  gRNA
agggcauugggagugcgacc

SEQ ID NO: 53932 - RNA, 20 nt, Artificial Sequence
  MKO10053932_A_Tinagl1
  gRNA
ggccggaucuacccagucuu

SEQ ID NO: 53933 - RNA, 20 nt, Artificial Sequence
  MKO10053933_A_Tinag
  gRNA
gaaggauucaaauuccgccu

SEQ ID NO: 53934 - RNA, 20 nt, Artificial Sequence
  MKO10053934_A_Tinag
  gRNA
acuugcgguggaaaaagccc

SEQ ID NO: 53935 - RNA, 20 nt, Artificial Sequence
  MKO10053935_A_Tinag
  gRNA
cugauccuucuucauaaugc

SEQ ID NO: 53936 - RNA, 20 nt, Artificial Sequence
  MKO10053936_A_Tinf2
  gRNA
auucucaccugcaggcucga

SEQ ID NO: 53937 - RNA, 20 nt, Artificial Sequence
  MKO10053937_A_Tinf2
  gRNA
gggcucguucaucacuucuu

SEQ ID NO: 53938 - RNA, 20 nt, Artificial Sequence
  MKO10053938_A_Tinf2
  gRNA
ggucccagggucgcgccugc

SEQ ID NO: 53939 - RNA, 20 nt, Artificial Sequence
  MKO10053939_A_Tiparp
  gRNA
cugaauuugaccaacuacga

SEQ ID NO: 53940 - RNA, 20 nt, Artificial Sequence
  MKO10053940_A_Tiparp
  gRNA
aggcccccuccggucaaccc

SEQ ID NO: 53941 - RNA, 20 nt, Artificial Sequence
  MKO10053941_A_Tiparp
  gRNA
guguagacagccuucguagu

SEQ ID NO: 53942 - RNA, 20 nt, Artificial Sequence
  MKO10053942_A_Tipin
  gRNA
uaccuaagcuagaugcuacg

SEQ ID NO: 53943 - RNA, 20 nt, Artificial Sequence
  MKO10053943_A_Tipin
  gRNA
uaccucguagcaucuagcuu

SEQ ID NO: 53944 - RNA, 20 nt, Artificial Sequence
  MKO10053944_A_Tipin
  gRNA
guuugauaagacgaaauuca

SEQ ID NO: 53945 - RNA, 20 nt, Artificial Sequence
  MKO10053945_A_Tiprl
  gRNA
aacguucuaaggauccagca

SEQ ID NO: 53946 - RNA, 20 nt, Artificial Sequence
  MKO10053946_A_Tiprl
  gRNA
guaucuauaugaucuguugu

SEQ ID NO: 53947 - RNA, 20 nt, Artificial Sequence
  MKO10053947_A_Tiprl
  gRNA
ucaucagaaugaaugacacg

SEQ ID NO: 53948 - RNA, 20 nt, Artificial Sequence
  MKO10053948_A_Tirap
  gRNA
uccgaaacaauggcgccacc

SEQ ID NO: 53949 - RNA, 20 nt, Artificial Sequence
  MKO10053949_A_Tirap
  gRNA
acuccgauucauguacuaug

SEQ ID NO: 53950 - RNA, 20 nt, Artificial Sequence
  MKO10053950_A_Tirap
  gRNA
uuaccagcuaucuugucucg

SEQ ID NO: 53951 - RNA, 20 nt, Artificial Sequence
  MKO10053951_A_Tjap1
  gRNA
cucagcuaccagacgcacug

SEQ ID NO: 53952 - RNA, 20 nt, Artificial Sequence
  MKO10053952_A_Tjap1
  gRNA
cucagugcgucugguagcug

SEQ ID NO: 53953 - RNA, 20 nt, Artificial Sequence
  MKO10053953_A_Tjap1
  gRNA
ucauccgcucugcgucaguc

SEQ ID NO: 53954 - RNA, 20 nt, Artificial Sequence
  MKO10053954_A_Tjp1
  gRNA
gguucucaccuuagcggccg

SEQ ID NO: 53955 - RNA, 20 nt, Artificial Sequence
  MKO10053955_A_Tjp1
  gRNA
agagagacaagauguccgcc

SEQ ID NO: 53956 - RNA, 20 nt, Artificial Sequence
  MKO10053956_A_Tjp1
  gRNA
ggaaaaugaccgaguugcaa

SEQ ID NO: 53957 - RNA, 20 nt, Artificial Sequence
  MKO10053957_A_Tjp2
  gRNA
gaagcuuaugaacccgacua

SEQ ID NO: 53958 - RNA, 20 nt, Artificial Sequence
  MKO10053958_A_Tjp2
  gRNA
cgcagccgugagcgcagccg

SEQ ID NO: 53959 - RNA, 20 nt, Artificial Sequence
  MKO10053959_A_Tjp2
  gRNA
uuuggaauugccgugucggg

SEQ ID NO: 53960 - RNA, 20 nt, Artificial Sequence
  MKO10053960_A_Tjp3
  gRNA
gucccuuaggacccccgccg

SEQ ID NO: 53961 - RNA, 20 nt, Artificial Sequence
  MKO10053961_A_Tjp3
  gRNA
ugaccgagcuaguggauccg

SEQ ID NO: 53962 - RNA, 20 nt, Artificial Sequence
  MKO10053962_A_Tjp3
  gRNA
gaggccacuaaaguccgugc

SEQ ID NO: 53963 - RNA, 20 nt, Artificial Sequence
  MKO10053963_A_Tk1
  gRNA
uaggacugaccgaucaugug

SEQ ID NO: 53964 - RNA, 20 nt, Artificial Sequence
  MKO10053964_A_Tk1
  gRNA
gcaggcuggcaaugcgucca

SEQ ID NO: 53965 - RNA, 20 nt, Artificial Sequence
  MKO10053965_A_Tk1
  gRNA
uucccaguuuccugacauug

SEQ ID NO: 53966 - RNA, 20 nt, Artificial Sequence
  MKO10053966_A_Tk2
  gRNA
gcacguacgucugcagugug

SEQ ID NO: 53967 - RNA, 20 nt, Artificial Sequence
  MKO10053967_A_Tk2
  gRNA
cuccaauacaacagacgucg

SEQ ID NO: 53968 - RNA, 20 nt, Artificial Sequence
  MKO10053968_A_Tk2
  gRNA
auaccugagggcgcgugugc

SEQ ID NO: 53969 - RNA, 20 nt, Artificial Sequence
  MKO10053969_A_Tktl1
  gRNA
ugacagguggaauacuuacg

SEQ ID NO: 53970 - RNA, 20 nt, Artificial Sequence
  MKO10053970_A_Tktl1
  gRNA
caaaggcuucacaacgcuuc

SEQ ID NO: 53971 - RNA, 20 nt, Artificial Sequence
  MKO10053971_A_Tktl1
  gRNA
gggacuaccauuuguuaaug

SEQ ID NO: 53972 - RNA, 20 nt, Artificial Sequence
  MKO10053972_A_Tktl2
  gRNA
gcgaaaaauucacugcgacc

SEQ ID NO: 53973 - RNA, 20 nt, Artificial Sequence
  MKO10053973_A_Tktl2
  gRNA
aaucuuugacgugaaccgcu

SEQ ID NO: 53974 - RNA, 20 nt, Artificial Sequence
  MKO10053974_A_Tktl2
  gRNA
cgccgcgcccauccucuaug

SEQ ID NO: 53975 - RNA, 20 nt, Artificial Sequence
  MKO10053975_A_Tkt
  gRNA
gcuugcgggauggcauacac

SEQ ID NO: 53976 - RNA, 20 nt, Artificial Sequence
  MKO10053976_A_Tkt
  gRNA
cuaccgagucuauugcaugc

SEQ ID NO: 53977 - RNA, 20 nt, Artificial Sequence
  MKO10053977_A_Tkt
  gRNA
auccagggccuuguaacgca

SEQ ID NO: 53978 - RNA, 20 nt, Artificial Sequence
  MKO10053978_A_Tlcd1
  gRNA
aaaccgacccccugcgcacc

SEQ ID NO: 53979 - RNA, 20 nt, Artificial Sequence
  MKO10053979_A_Tlcd1
  gRNA
cccuacuguuccaccccgcc

SEQ ID NO: 53980 - RNA, 20 nt, Artificial Sequence
  MKO10053980_A_Tlcd1
  gRNA
ugguggcgucuuaacacuac

SEQ ID NO: 53981 - RNA, 20 nt, Artificial Sequence
  MKO10053981_A_Tlcd2
  gRNA
caauuaaugaucacccaccg

SEQ ID NO: 53982 - RNA, 20 nt, Artificial Sequence
  MKO10053982_A_Tlcd2
  gRNA
cacggugggugaucauuaau

SEQ ID NO: 53983 - RNA, 20 nt, Artificial Sequence
  MKO10053983_A_Tlcd2
  gRNA
ucagguuauuucgcugcaga

SEQ ID NO: 53984 - RNA, 20 nt, Artificial Sequence
  MKO10053984_A_Tldc1
  gRNA
cugcaugccguuauacaguc

SEQ ID NO: 53985 - RNA, 20 nt, Artificial Sequence
  MKO10053985_A_Tldc1
  gRNA
uggcgcacgugcugacccac

SEQ ID NO: 53986 - RNA, 20 nt, Artificial Sequence
  MKO10053986_A_Tldc1
  gRNA
cgccagcguugccgaugcuc

SEQ ID NO: 53987 - RNA, 20 nt, Artificial Sequence
  MKO10053987_A_Tldc2
  gRNA
gcggagacuauaccgacaga

SEQ ID NO: 53988 - RNA, 20 nt, Artificial Sequence
  MKO10053988_A_Tldc2
  gRNA
ccaaaccugcuuaaucuccg

SEQ ID NO: 53989 - RNA, 20 nt, Artificial Sequence
  MKO10053989_A_Tldc2
  gRNA
ucagcuauccgacucagcaa

SEQ ID NO: 53990 - RNA, 20 nt, Artificial Sequence
  MKO10053990_A_Tle1
  gRNA
accugugauacugcgccugc

SEQ ID NO: 53991 - RNA, 20 nt, Artificial Sequence
  MKO10053991_A_Tle1
  gRNA
gucucuggaccggauuaaag

SEQ ID NO: 53992 - RNA, 20 nt, Artificial Sequence
  MKO10053992_A_Tle1
  gRNA
uaaauuggagugugagaaac

SEQ ID NO: 53993 - RNA, 20 nt, Artificial Sequence
  MKO10053993_A_Tle2
  gRNA
caucagcaggauguacccuc

SEQ ID NO: 53994 - RNA, 20 nt, Artificial Sequence
  MKO10053994_A_Tle2
  gRNA
caucucaauguugaguccgu

SEQ ID NO: 53995 - RNA, 20 nt, Artificial Sequence
  MKO10053995_A_Tle2
  gRNA
gccuuucaaguucucaguac

SEQ ID NO: 53996 - RNA, 20 nt, Artificial Sequence
  MKO10053996_A_Tle3
  gRNA
cucccugccauguauccgca

SEQ ID NO: 53997 - RNA, 20 nt, Artificial Sequence
  MKO10053997_A_Tle3
  gRNA
cucaccggaugucugccuug

SEQ ID NO: 53998 - RNA, 20 nt, Artificial Sequence
  MKO10053998_A_Tle3
  gRNA
gcuugucauacuccacuuug

SEQ ID NO: 53999 - RNA, 20 nt, Artificial Sequence
  MKO10053999_A_Tle4
  gRNA
cauuucuauguucaacccau

SEQ ID NO: 54000 - RNA, 20 nt, Artificial Sequence
  MKO10054000_A_Tle4
  gRNA
acaaucuuaccucuugggac

SEQ ID NO: 54001 - RNA, 20 nt, Artificial Sequence
  MKO10054001_A_Tle4
  gRNA
cucuuccuuaauccgaucac

SEQ ID NO: 54002 - RNA, 20 nt, Artificial Sequence
  MKO10054002_A_Tle6
  gRNA
uacugaagcgcucuaucgcc

SEQ ID NO: 54003 - RNA, 20 nt, Artificial Sequence
  MKO10054003_A_Tle6
  gRNA
cacgauggacaaauaccgac

SEQ ID NO: 54004 - RNA, 20 nt, Artificial Sequence
  MKO10054004_A_Tle6
  gRNA
uccgcgucccagaccggcug

SEQ ID NO: 54005 - RNA, 20 nt, Artificial Sequence
  MKO10054005_A_Tlk1
  gRNA
caaaauagucgcugaucuua

SEQ ID NO: 54006 - RNA, 20 nt, Artificial Sequence
  MKO10054006_A_Tlk1
  gRNA
agauuuacuggaguugcuac

SEQ ID NO: 54007 - RNA, 20 nt, Artificial Sequence
  MKO10054007_A_Tlk1
  gRNA
aagucagaaugaaaguaguc

SEQ ID NO: 54008 - RNA, 20 nt, Artificial Sequence
  MKO10054008_A_Tlk2
  gRNA
guugagugauaaagaaguag

SEQ ID NO: 54009 - RNA, 20 nt, Artificial Sequence
  MKO10054009_A_Tlk2
  gRNA
cuaccuuggcuagugucaua

SEQ ID NO: 54010 - RNA, 20 nt, Artificial Sequence
  MKO10054010_A_Tlk2
  gRNA
uuucagggaaaggcacuccu

SEQ ID NO: 54011 - RNA, 20 nt, Artificial Sequence
  MKO10054011_A_Tll1
  gRNA
guuauauuguguucaccuac

SEQ ID NO: 54012 - RNA, 20 nt, Artificial Sequence
  MKO10054012_A_Tll1
  gRNA
cacucuaccaacuuauagag

SEQ ID NO: 54013 - RNA, 20 nt, Artificial Sequence
  MKO10054013_A_Tll1
  gRNA
ggagcaaaauaacacgauga

SEQ ID NO: 54014 - RNA, 20 nt, Artificial Sequence
  MKO10054014_A_Tll2
  gRNA
gcguuagaggcuguaucguu

SEQ ID NO: 54015 - RNA, 20 nt, Artificial Sequence
  MKO10054015_A_Tll2
  gRNA
caaguuauuucacaucgaca

SEQ ID NO: 54016 - RNA, 20 nt, Artificial Sequence
  MKO10054016_A_Tll2
  gRNA
ccugugugaccuucguagag

SEQ ID NO: 54017 - RNA, 20 nt, Artificial Sequence
  MKO10054017_A_Tln1
  gRNA
acuacuacaugcuccgaaau

SEQ ID NO: 54018 - RNA, 20 nt, Artificial Sequence
  MKO10054018_A_Tln1
  gRNA
ucaccguuccgucuaacauc

SEQ ID NO: 54019 - RNA, 20 nt, Artificial Sequence
  MKO10054019_A_Tln1
  gRNA
augaccauuugugcccgaau

SEQ ID NO: 54020 - RNA, 20 nt, Artificial Sequence
  MKO10054020_A_Tln2
  gRNA
augaaacauuguugcuccga

SEQ ID NO: 54021 - RNA, 20 nt, Artificial Sequence
  MKO10054021_A_Tln2
  gRNA
uccugcugcagaucgugacc

SEQ ID NO: 54022 - RNA, 20 nt, Artificial Sequence
  MKO10054022_A_Tln2
  gRNA
uaaauuggcuagaucacagc

SEQ ID NO: 54023 - RNA, 20 nt, Artificial Sequence
  MKO10054023_A_Tlr11
  gRNA
gugcaaucuagaguuacgac

SEQ ID NO: 54024 - RNA, 20 nt, Artificial Sequence
  MKO10054024_A_Tlr11
  gRNA
gaguagccagucaaacuugc

SEQ ID NO: 54025 - RNA, 20 nt, Artificial Sequence
  MKO10054025_A_Tlr11
  gRNA
acauuucuuaccuuugagca

SEQ ID NO: 54026 - RNA, 20 nt, Artificial Sequence
  MKO10054026_A_Tlr12
  gRNA
guguaacccccgaugccgcc

SEQ ID NO: 54027 - RNA, 20 nt, Artificial Sequence
  MKO10054027_A_Tlr12
  gRNA
ucccccgccgcuuauaguca

SEQ ID NO: 54028 - RNA, 20 nt, Artificial Sequence
  MKO10054028_A_Tlr12
  gRNA
ccagugcuccgucgugccug

SEQ ID NO: 54029 - RNA, 20 nt, Artificial Sequence
  MKO10054029_A_Tlr13
  gRNA
uguccagcuaccaccgacuc

SEQ ID NO: 54030 - RNA, 20 nt, Artificial Sequence
  MKO10054030_A_Tlr13
  gRNA
agaucgacgaaggugccuuu

SEQ ID NO: 54031 - RNA, 20 nt, Artificial Sequence
  MKO10054031_A_Tlr13
  gRNA
ucagaaugagugggcucuac

SEQ ID NO: 54032 - RNA, 20 nt, Artificial Sequence
  MKO10054032_A_Tlr1
  gRNA
guguccgucagcacuacgau

SEQ ID NO: 54033 - RNA, 20 nt, Artificial Sequence
  MKO10054033_A_Tlr1
  gRNA
caaaccgaucguagugcuga

SEQ ID NO: 54034 - RNA, 20 nt, Artificial Sequence
  MKO10054034_A_Tlr1
  gRNA
gcuaacgugccgaagagauu

SEQ ID NO: 54035 - RNA, 20 nt, Artificial Sequence
  MKO10054035_A_Tlr2
  gRNA
cgcggaucgacuuuagacuu

SEQ ID NO: 54036 - RNA, 20 nt, Artificial Sequence
  MKO10054036_A_Tlr2
  gRNA
ccgagcgugugcgaaccucc

SEQ ID NO: 54037 - RNA, 20 nt, Artificial Sequence
  MKO10054037_A_Tlr2
  gRNA
uucgacgacuguacccucaa

SEQ ID NO: 54038 - RNA, 20 nt, Artificial Sequence
  MKO10054038_A_Tlr3
  gRNA
ucaguugggcguuguucaag

SEQ ID NO: 54039 - RNA, 20 nt, Artificial Sequence
  MKO10054039_A_Tlr3
  gRNA
guucuucacuucgcaacgca

SEQ ID NO: 54040 - RNA, 20 nt, Artificial Sequence
  MKO10054040_A_Tlr3
  gRNA
aaguucuugaaaaccccgac

SEQ ID NO: 54041 - RNA, 20 nt, Artificial Sequence
  MKO10054041_A_Tlr4
  gRNA
acacguccaucgguugaucu

SEQ ID NO: 54042 - RNA, 20 nt, Artificial Sequence
  MKO10054042_A_Tlr4
  gRNA
gaucuacucgagucagaaug

SEQ ID NO: 54043 - RNA, 20 nt, Artificial Sequence
  MKO10054043_A_Tlr4
  gRNA
uaauauuaccuaccaaugca

SEQ ID NO: 54044 - RNA, 20 nt, Artificial Sequence
  MKO10054044_A_Tlr5
  gRNA
uuagcucgcuuagaccuauc

SEQ ID NO: 54045 - RNA, 20 nt, Artificial Sequence
  MKO10054045_A_Tlr5
  gRNA
ggaaaacuuuagggaccgca

SEQ ID NO: 54046 - RNA, 20 nt, Artificial Sequence
  MKO10054046_A_Tlr5
  gRNA
uacacccaccugcugaagug

SEQ ID NO: 54047 - RNA, 20 nt, Artificial Sequence
  MKO10054047_A_Tlr6
  gRNA
ccggucggggccaaaagaau

SEQ ID NO: 54048 - RNA, 20 nt, Artificial Sequence
  MKO10054048_A_Tlr6
  gRNA
ggucaugcuuccgacuauua

SEQ ID NO: 54049 - RNA, 20 nt, Artificial Sequence
  MKO10054049_A_Tlr6
  gRNA
agaugccucaggcucgccau

SEQ ID NO: 54050 - RNA, 20 nt, Artificial Sequence
  MKO10054050_A_Tlr7
  gRNA
uaugggacauuauaacaucg

SEQ ID NO: 54051 - RNA, 20 nt, Artificial Sequence
  MKO10054051_A_Tlr7
  gRNA
uccgugcauauucaucguau

SEQ ID NO: 54052 - RNA, 20 nt, Artificial Sequence
  MKO10054052_A_Tlr7
  gRNA
uguuagauucuccuucguga

SEQ ID NO: 54053 - RNA, 20 nt, Artificial Sequence
  MKO10054053_A_Tlr8
  gRNA
gaaaucgucuugaccguuug

SEQ ID NO: 54054 - RNA, 20 nt, Artificial Sequence
  MKO10054054_A_Tlr8
  gRNA
gcuauccuugugacgagaua

SEQ ID NO: 54055 - RNA, 20 nt, Artificial Sequence
  MKO10054055_A_Tlr8
  gRNA
uugugccuuaucucgucaca

SEQ ID NO: 54056 - RNA, 20 nt, Artificial Sequence
  MKO10054056_A_Tlr9
  gRNA
gggccguagcaucuucgcgc

SEQ ID NO: 54057 - RNA, 20 nt, Artificial Sequence
  MKO10054057_A_Tlr9
  gRNA
cucgaccgccagagcgaaga

SEQ ID NO: 54058 - RNA, 20 nt, Artificial Sequence
  MKO10054058_A_Tlr9
  gRNA
cguccaugaagagaacgcgc

SEQ ID NO: 54059 - RNA, 20 nt, Artificial Sequence
  MKO10054059_A_Tlx1
  gRNA
uucggcggagcgcgcugcuc

SEQ ID NO: 54060 - RNA, 20 nt, Artificial Sequence
  MKO10054060_A_Tlx1
  gRNA
ccgaugcgcaaguaaaaacc

SEQ ID NO: 54061 - RNA, 20 nt, Artificial Sequence
  MKO10054061_A_Tlx1
  gRNA
aaucaccagcgucacguccg

SEQ ID NO: 54062 - RNA, 20 nt, Artificial Sequence
  MKO10054062_A_Tlx2
  gRNA
ccugcgcguccgucaugcgc

SEQ ID NO: 54063 - RNA, 20 nt, Artificial Sequence
  MKO10054063_A_Tlx2
  gRNA
cgaagagcgacgaguugugc

SEQ ID NO: 54064 - RNA, 20 nt, Artificial Sequence
  MKO10054064_A_Tlx2
  gRNA
ccugcgcaugacggacgcgc

SEQ ID NO: 54065 - RNA, 20 nt, Artificial Sequence
  MKO10054065_A_Tlx3
  gRNA
cgugcgcggcuucuuacgcu

SEQ ID NO: 54066 - RNA, 20 nt, Artificial Sequence
  MKO10054066_A_Tlx3
  gRNA
agagacggguacgcggcgcc

SEQ ID NO: 54067 - RNA, 20 nt, Artificial Sequence
  MKO10054067_A_Tlx3
  gRNA
cgcgcugcccgcuaugcccu

SEQ ID NO: 54068 - RNA, 20 nt, Artificial Sequence
  MKO10054068_A_Tm2d1
  gRNA
uuacacauuucggcaagaua

SEQ ID NO: 54069 - RNA, 20 nt, Artificial Sequence
  MKO10054069_A_Tm2d1
  gRNA
uguacaaacuacacagcuca

SEQ ID NO: 54070 - RNA, 20 nt, Artificial Sequence
  MKO10054070_A_Tm2d1
  gRNA
caccuaaggcaggauauccg

SEQ ID NO: 54071 - RNA, 20 nt, Artificial Sequence
  MKO10054071_A_Tm2d2
  gRNA
guuuaaugcuacggccgaac

SEQ ID NO: 54072 - RNA, 20 nt, Artificial Sequence
  MKO10054072_A_Tm2d2
  gRNA
aucacagucuacgaacucgu

SEQ ID NO: 54073 - RNA, 20 nt, Artificial Sequence
  MKO10054073_A_Tm2d2
  gRNA
cgcgggacccucgaggugag

SEQ ID NO: 54074 - RNA, 20 nt, Artificial Sequence
  MKO10054074_A_Tm2d3
  gRNA
gaacacucguagucuguuuc

SEQ ID NO: 54075 - RNA, 20 nt, Artificial Sequence
  MKO10054075_A_Tm2d3
  gRNA
uuggcgaaauagcgcugccg

SEQ ID NO: 54076 - RNA, 20 nt, Artificial Sequence
  MKO10054076_A_Tm2d3
  gRNA
acugugcagucgaacgugac

SEQ ID NO: 54077 - RNA, 20 nt, Artificial Sequence
  MKO10054077_A_Tm4sf19
  gRNA
cgaggaugcuauugacaaga

SEQ ID NO: 54078 - RNA, 20 nt, Artificial Sequence
  MKO10054078_A_Tm4sf19
  gRNA
uccgugagcaguucaccaca

SEQ ID NO: 54079 - RNA, 20 nt, Artificial Sequence
  MKO10054079_A_Tm4sf19
  gRNA
aucuguaugaccguucacuu

SEQ ID NO: 54080 - RNA, 20 nt, Artificial Sequence
  MKO10054080_A_Tm4sf1
  gRNA
cuauugcugcucucgccaac

SEQ ID NO: 54081 - RNA, 20 nt, Artificial Sequence
  MKO10054081_A_Tm4sf1
  gRNA
ugcugcggcuacgaaaacua

SEQ ID NO: 54082 - RNA, 20 nt, Artificial Sequence
  MKO10054082_A_Tm4sf1
  gRNA
auagcacuuggaccacauag

SEQ ID NO: 54083 - RNA, 20 nt, Artificial Sequence
  MKO10054083_A_Tm4sf20
  gRNA
gcgugcugcaacaauaagac

SEQ ID NO: 54084 - RNA, 20 nt, Artificial Sequence
  MKO10054084_A_Tm4sf20
  gRNA
ccacccuucacagcacguca

SEQ ID NO: 54085 - RNA, 20 nt, Artificial Sequence
  MKO10054085_A_Tm4sf20
  gRNA
gguuaucaauuguauacccc

SEQ ID NO: 54086 - RNA, 20 nt, Artificial Sequence
  MKO10054086_A_Tm4sf4
  gRNA
cccuccgaugaccagcagaa

SEQ ID NO: 54087 - RNA, 20 nt, Artificial Sequence
  MKO10054087_A_Tm4sf4
  gRNA
ggagccuuacccaucgugga

SEQ ID NO: 54088 - RNA, 20 nt, Artificial Sequence
  MKO10054088_A_Tm4sf4
  gRNA
uggggauaccccuuccacga

SEQ ID NO: 54089 - RNA, 20 nt, Artificial Sequence
  MKO10054089_A_Tm4sf5
  gRNA
gugugaggcgccaccucacg

SEQ ID NO: 54090 - RNA, 20 nt, Artificial Sequence
  MKO10054090_A_Tm4sf5
  gRNA
aauugcagcgguccgggcag

SEQ ID NO: 54091 - RNA, 20 nt, Artificial Sequence
  MKO10054091_A_Tm4sf5
  gRNA
cagcuggugaaugcgaccuu

SEQ ID NO: 54092 - RNA, 20 nt, Artificial Sequence
  MKO10054092_A_Tm6sf1
  gRNA
uccgacccaguauaggccaa

SEQ ID NO: 54093 - RNA, 20 nt, Artificial Sequence
  MKO10054093_A_Tm6sf1
  gRNA
gccuaccuaccguagaacag

SEQ ID NO: 54094 - RNA, 20 nt, Artificial Sequence
  MKO10054094_A_Tm6sf1
  gRNA
aaccacgaugcucauuauaa

SEQ ID NO: 54095 - RNA, 20 nt, Artificial Sequence
  MKO10054095_A_Tm6sf2
  gRNA
aaugacaagguccaccaccg

SEQ ID NO: 54096 - RNA, 20 nt, Artificial Sequence
  MKO10054096_A_Tm6sf2
  gRNA
gcugacgagugcucugauac

SEQ ID NO: 54097 - RNA, 20 nt, Artificial Sequence
  MKO10054097_A_Tm6sf2
  gRNA
agaugccaugugcugugcgu

SEQ ID NO: 54098 - RNA, 20 nt, Artificial Sequence
  MKO10054098_A_Tm7sf2
  gRNA
caccauuaauaggguagcgc

SEQ ID NO: 54099 - RNA, 20 nt, Artificial Sequence
  MKO10054099_A_Tm7sf2
  gRNA
cgccugcgcuacccuauuaa

SEQ ID NO: 54100 - RNA, 20 nt, Artificial Sequence
  MKO10054100_A_Tm7sf2
  gRNA
cgggagcugaacccucgccu

SEQ ID NO: 54101 - RNA, 20 nt, Artificial Sequence
  MKO10054101_A_Tm7sf3
  gRNA
ggccucggugaggucgcccu

SEQ ID NO: 54102 - RNA, 20 nt, Artificial Sequence
  MKO10054102_A_Tm7sf3
  gRNA
guaccaguacuuccugcccg

SEQ ID NO: 54103 - RNA, 20 nt, Artificial Sequence
  MKO10054103_A_Tm7sf3
  gRNA
aaguucgcaccagcaaacau

SEQ ID NO: 54104 - RNA, 20 nt, Artificial Sequence
  MKO10054104_A_Tm9sf1
  gRNA
gacgucccgcaccgaaacau

SEQ ID NO: 54105 - RNA, 20 nt, Artificial Sequence
  MKO10054105_A_Tm9sf1
  gRNA
gucgcacaaagaauaucgcc

SEQ ID NO: 54106 - RNA, 20 nt, Artificial Sequence
  MKO10054106_A_Tm9sf1
  gRNA
cagcgccuguguugaaccgu

SEQ ID NO: 54107 - RNA, 20 nt, Artificial Sequence
  MKO10054107_A_Tm9sf2
  gRNA
aauacaaaccuuauacggug

SEQ ID NO: 54108 - RNA, 20 nt, Artificial Sequence
  MKO10054108_A_Tm9sf2
  gRNA
accucauagcaccacgugac

SEQ ID NO: 54109 - RNA, 20 nt, Artificial Sequence
  MKO10054109_A_Tm9sf2
  gRNA
aauugaacccucaccguaua

SEQ ID NO: 54110 - RNA, 20 nt, Artificial Sequence
  MKO10054110_A_Tm9sf3
  gRNA
acauagaugacuuaccaaua

SEQ ID NO: 54111 - RNA, 20 nt, Artificial Sequence
  MKO10054111_A_Tm9sf3
  gRNA
gauguuaaucuaacuaguga

SEQ ID NO: 54112 - RNA, 20 nt, Artificial Sequence
  MKO10054112_A_Tm9sf3
  gRNA
augcuaucaagaaucacuau

SEQ ID NO: 54113 - RNA, 20 nt, Artificial Sequence
  MKO10054113_A_Tm9sf4
  gRNA
guauucuucugugauucgcu

SEQ ID NO: 54114 - RNA, 20 nt, Artificial Sequence
  MKO10054114_A_Tm9sf4
  gRNA
aguaguacucguaaggaagc

SEQ ID NO: 54115 - RNA, 20 nt, Artificial Sequence
  MKO10054115_A_Tm9sf4
  gRNA
uggcuucacggaugucaaca

SEQ ID NO: 54116 - RNA, 20 nt, Artificial Sequence
  MKO10054116_A_Tma16
  gRNA
cgggagcggcagcaguacga

SEQ ID NO: 54117 - RNA, 20 nt, Artificial Sequence
  MKO10054117_A_Tma16
  gRNA
ccacaggugacaaacuucaa

SEQ ID NO: 54118 - RNA, 20 nt, Artificial Sequence
  MKO10054118_A_Tma16
  gRNA
acugcugccgcucccgcucc

SEQ ID NO: 54119 - RNA, 20 nt, Artificial Sequence
  MKO10054119_A_Tma7
  gRNA
cuuaccuucccggcccgaca

SEQ ID NO: 54120 - RNA, 20 nt, Artificial Sequence
  MKO10054120_A_Tma7
  gRNA
cuuacccagggggcccuucc

SEQ ID NO: 54121 - RNA, 20 nt, Artificial Sequence
  MKO10054121_A_Tma7
  gRNA
ccucaccucguccaucuccu

SEQ ID NO: 54122 - RNA, 20 nt, Artificial Sequence
  MKO10054122_A_Tmbim1
  gRNA
ggaagugacagcuuucgucc

SEQ ID NO: 54123 - RNA, 20 nt, Artificial Sequence
  MKO10054123_A_Tmbim1
  gRNA
uuccucacguauuugccgac

SEQ ID NO: 54124 - RNA, 20 nt, Artificial Sequence
  MKO10054124_A_Tmbim1
  gRNA
uuccggucaucccauucucc

SEQ ID NO: 54125 - RNA, 20 nt, Artificial Sequence
  MKO10054125_A_Tmbim4
  gRNA
uucuuacccugcuccgaauu

SEQ ID NO: 54126 - RNA, 20 nt, Artificial Sequence
  MKO10054126_A_Tmbim4
  gRNA
ggacaaauguccgcagagcu

SEQ ID NO: 54127 - RNA, 20 nt, Artificial Sequence
  MKO10054127_A_Tmbim4
  gRNA
uaccuucuaugauguauauc

SEQ ID NO: 54128 - RNA, 20 nt, Artificial Sequence
  MKO10054128_A_Tmbim6
  gRNA
uuugcuucuaggagucggcc

SEQ ID NO: 54129 - RNA, 20 nt, Artificial Sequence
  MKO10054129_A_Tmbim6
  gRNA
ugugcaucgcugucaacccc

SEQ ID NO: 54130 - RNA, 20 nt, Artificial Sequence
  MKO10054130_A_Tmbim6
  gRNA
ggcuggccuacucuccgccc

SEQ ID NO: 54131 - RNA, 20 nt, Artificial Sequence
  MKO10054131_A_Tmbim7
  gRNA
gcgaugacccacuuucuuac

SEQ ID NO: 54132 - RNA, 20 nt, Artificial Sequence
  MKO10054132_A_Tmbim7
  gRNA
gaaaacacgucuauucguaa

SEQ ID NO: 54133 - RNA, 20 nt, Artificial Sequence
  MKO10054133_A_Tmbim7
  gRNA
aguuacuuacaaagaacgcc

SEQ ID NO: 54134 - RNA, 20 nt, Artificial Sequence
  MKO10054134_A_Tmc1
  gRNA
auccucauugaugacaucuc

SEQ ID NO: 54135 - RNA, 20 nt, Artificial Sequence
  MKO10054135_A_Tmc1
  gRNA
ugacccagaaccggagccgg

SEQ ID NO: 54136 - RNA, 20 nt, Artificial Sequence
  MKO10054136_A_Tmc1
  gRNA
uucaacagugcaaauccaag

SEQ ID NO: 54137 - RNA, 20 nt, Artificial Sequence
  MKO10054137_A_Tmc2
  gRNA
gcaaacaccucuacgccuac

SEQ ID NO: 54138 - RNA, 20 nt, Artificial Sequence
  MKO10054138_A_Tmc2
  gRNA
ccgagcccaaucuagccgga

SEQ ID NO: 54139 - RNA, 20 nt, Artificial Sequence
  MKO10054139_A_Tmc2
  gRNA
ccuuccggcuagauugggcu

SEQ ID NO: 54140 - RNA, 20 nt, Artificial Sequence
  MKO10054140_A_Tmc3
  gRNA
cuggcggaaauucgcccguc

SEQ ID NO: 54141 - RNA, 20 nt, Artificial Sequence
  MKO10054141_A_Tmc3
  gRNA
uccguaggucacuucggguc

SEQ ID NO: 54142 - RNA, 20 nt, Artificial Sequence
  MKO10054142_A_Tmc3
  gRNA
gaccaggacucgaggcuacc

SEQ ID NO: 54143 - RNA, 20 nt, Artificial Sequence
  MKO10054143_A_Tmc4
  gRNA
cuacccaccccgaucgaacc

SEQ ID NO: 54144 - RNA, 20 nt, Artificial Sequence
  MKO10054144_A_Tmc4
  gRNA
gcugcuacgcugcgauaccg

SEQ ID NO: 54145 - RNA, 20 nt, Artificial Sequence
  MKO10054145_A_Tmc4
  gRNA
guaucgcagcguagcagcgc

SEQ ID NO: 54146 - RNA, 20 nt, Artificial Sequence
  MKO10054146_A_Tmc5
  gRNA
ccaauucuacaauccgacau

SEQ ID NO: 54147 - RNA, 20 nt, Artificial Sequence
  MKO10054147_A_Tmc5
  gRNA
cuucacgaucggagccugcc

SEQ ID NO: 54148 - RNA, 20 nt, Artificial Sequence
  MKO10054148_A_Tmc5
  gRNA
uuugcacccacggugaauug

SEQ ID NO: 54149 - RNA, 20 nt, Artificial Sequence
  MKO10054149_A_Tmc6
  gRNA
cggcucaccaaugguacggc

SEQ ID NO: 54150 - RNA, 20 nt, Artificial Sequence
  MKO10054150_A_Tmc6
  gRNA
cacuuacccuucgucucccg

SEQ ID NO: 54151 - RNA, 20 nt, Artificial Sequence
  MKO10054151_A_Tmc6
  gRNA
agcaugcccagccguaccau

SEQ ID NO: 54152 - RNA, 20 nt, Artificial Sequence
  MKO10054152_A_Tmc7
  gRNA
cgugccacugaccgauagcu

SEQ ID NO: 54153 - RNA, 20 nt, Artificial Sequence
  MKO10054153_A_Tmc7
  gRNA
cacuuugcuugucccgagag

SEQ ID NO: 54154 - RNA, 20 nt, Artificial Sequence
  MKO10054154_A_Tmc7
  gRNA
ucgagagaugacaacccacc

SEQ ID NO: 54155 - RNA, 20 nt, Artificial Sequence
  MKO10054155_A_Tmc8
  gRNA
cucguaggccucuucggaac

SEQ ID NO: 54156 - RNA, 20 nt, Artificial Sequence
  MKO10054156_A_Tmc8
  gRNA
uguugucgcgccacccgccu

SEQ ID NO: 54157 - RNA, 20 nt, Artificial Sequence
  MKO10054157_A_Tmc8
  gRNA
guccugacugcaccgaccac

SEQ ID NO: 54158 - RNA, 20 nt, Artificial Sequence
  MKO10054158_A_Tmcc1
  gRNA
gccgguccacguagcuaaag

SEQ ID NO: 54159 - RNA, 20 nt, Artificial Sequence
  MKO10054159_A_Tmcc1
  gRNA
gacaagcuugcauaguaggc

SEQ ID NO: 54160 - RNA, 20 nt, Artificial Sequence
  MKO10054160_A_Tmcc1
  gRNA
cccucuuuagcuacguggac

SEQ ID NO: 54161 - RNA, 20 nt, Artificial Sequence
  MKO10054161_A_Tmcc2
  gRNA
cccucaugaagacgcgccuc

SEQ ID NO: 54162 - RNA, 20 nt, Artificial Sequence
  MKO10054162_A_Tmcc2
  gRNA
accuguuucacagccgccgc

SEQ ID NO: 54163 - RNA, 20 nt, Artificial Sequence
  MKO10054163_A_Tmcc2
  gRNA
gcacuaccgucggcgccuga

SEQ ID NO: 54164 - RNA, 20 nt, Artificial Sequence
  MKO10054164_A_Tmcc3
  gRNA
gacggaugccgugaacgcca

SEQ ID NO: 54165 - RNA, 20 nt, Artificial Sequence
  MKO10054165_A_Tmcc3
  gRNA
cguucacggcauccgucugc

SEQ ID NO: 54166 - RNA, 20 nt, Artificial Sequence
  MKO10054166_A_Tmcc3
  gRNA
cuaccccugaacauacgccg

SEQ ID NO: 54167 - RNA, 20 nt, Artificial Sequence
  MKO10054167_A_Tmco1
  gRNA
augaaauccauguucgcgau

SEQ ID NO: 54168 - RNA, 20 nt, Artificial Sequence
  MKO10054168_A_Tmco1
  gRNA
acaaaagccaaucgcgaaca

SEQ ID NO: 54169 - RNA, 20 nt, Artificial Sequence
  MKO10054169_A_Tmco1
  gRNA
uuacuguuuaggcauaaccu

SEQ ID NO: 54170 - RNA, 20 nt, Artificial Sequence
  MKO10054170_A_Tmco2
  gRNA
gggcgacgauuauccccucc

SEQ ID NO: 54171 - RNA, 20 nt, Artificial Sequence
  MKO10054171_A_Tmco2
  gRNA
cccggaaaccugcuucgaag

SEQ ID NO: 54172 - RNA, 20 nt, Artificial Sequence
  MKO10054172_A_Tmco2
  gRNA
acgaagcauucggucaauuc

SEQ ID NO: 54173 - RNA, 20 nt, Artificial Sequence
  MKO10054173_A_Tmco3
  gRNA
uacugauuuauugucgucga

SEQ ID NO: 54174 - RNA, 20 nt, Artificial Sequence
  MKO10054174_A_Tmco3
  gRNA
ggucaaaggcgucaacuuug

SEQ ID NO: 54175 - RNA, 20 nt, Artificial Sequence
  MKO10054175_A_Tmco3
  gRNA
cggcuuuccucacaucuucg

SEQ ID NO: 54176 - RNA, 20 nt, Artificial Sequence
  MKO10054176_A_Tmco4
  gRNA
cacugucccgccuccaacug

SEQ ID NO: 54177 - RNA, 20 nt, Artificial Sequence
  MKO10054177_A_Tmco4
  gRNA
aaguguccucccaaccauaa

SEQ ID NO: 54178 - RNA, 20 nt, Artificial Sequence
  MKO10054178_A_Tmco4
  gRNA
acgcuaucuucugauaggcc

SEQ ID NO: 54179 - RNA, 20 nt, Artificial Sequence
  MKO10054179_A_Tmco5b
  gRNA
agagauauugcccuguccau

SEQ ID NO: 54180 - RNA, 20 nt, Artificial Sequence
  MKO10054180_A_Tmco5b
  gRNA
ucauugaagucaucccucuc

SEQ ID NO: 54181 - RNA, 20 nt, Artificial Sequence
  MKO10054181_A_Tmco5b
  gRNA
guuccaucacauucuugcuu

SEQ ID NO: 54182 - RNA, 20 nt, Artificial Sequence
  MKO10054182_A_Tmco5
  gRNA
gugcuuaccuuggacucuuc

SEQ ID NO: 54183 - RNA, 20 nt, Artificial Sequence
  MKO10054183_A_Tmco5
  gRNA
uucucugcauaucccuuucg

SEQ ID NO: 54184 - RNA, 20 nt, Artificial Sequence
  MKO10054184_A_Tmco5
  gRNA
guaucucgagaagcagcucc

SEQ ID NO: 54185 - RNA, 20 nt, Artificial Sequence
  MKO10054185_A_Tmco6
  gRNA
gcucuggucagccuucgucg

SEQ ID NO: 54186 - RNA, 20 nt, Artificial Sequence
  MKO10054186_A_Tmco6
  gRNA
cggccucacucuccacgaug

SEQ ID NO: 54187 - RNA, 20 nt, Artificial Sequence
  MKO10054187_A_Tmco6
  gRNA
gcucccuccgcgccuuccgc

SEQ ID NO: 54188 - RNA, 20 nt, Artificial Sequence
  MKO10054188_A_Tmed10
  gRNA
cuuuagaguccacgaacacc

SEQ ID NO: 54189 - RNA, 20 nt, Artificial Sequence
  MKO10054189_A_Tmed10
  gRNA
agaggcgaaaaauuaugaag

SEQ ID NO: 54190 - RNA, 20 nt, Artificial Sequence
  MKO10054190_A_Tmed10
  gRNA
cuuuagaucacagauucugc

SEQ ID NO: 54191 - RNA, 20 nt, Artificial Sequence
  MKO10054191_A_Tmed11
  gRNA
cuccaacucgaauaucuaag

SEQ ID NO: 54192 - RNA, 20 nt, Artificial Sequence
  MKO10054192_A_Tmed11
  gRNA
auccacuuagauauucgagu

SEQ ID NO: 54193 - RNA, 20 nt, Artificial Sequence
  MKO10054193_A_Tmed11
  gRNA
ucuacacaguuugugucauu

SEQ ID NO: 54194 - RNA, 20 nt, Artificial Sequence
  MKO10054194_A_Tmed1
  gRNA
guguuucuaucaguccgcac

SEQ ID NO: 54195 - RNA, 20 nt, Artificial Sequence
  MKO10054195_A_Tmed1
  gRNA
gaaaugugaacucgccgucc

SEQ ID NO: 54196 - RNA, 20 nt, Artificial Sequence
  MKO10054196_A_Tmed1
  gRNA
auuucgaucacgagccucaa

SEQ ID NO: 54197 - RNA, 20 nt, Artificial Sequence
  MKO10054197_A_Tmed2
  gRNA
gcaccuccacgucgaugucc

SEQ ID NO: 54198 - RNA, 20 nt, Artificial Sequence
  MKO10054198_A_Tmed2
  gRNA
ggugacgcucgccgagcugc

SEQ ID NO: 54199 - RNA, 20 nt, Artificial Sequence
  MKO10054199_A_Tmed2
  gRNA
ugucuccaugucuuguccuu

SEQ ID NO: 54200 - RNA, 20 nt, Artificial Sequence
  MKO10054200_A_Tmed3
  gRNA
cccgcagucgauaguguguc

SEQ ID NO: 54201 - RNA, 20 nt, Artificial Sequence
  MKO10054201_A_Tmed3
  gRNA
uuaauagucgaguguccuac

SEQ ID NO: 54202 - RNA, 20 nt, Artificial Sequence
  MKO10054202_A_Tmed3
  gRNA
cauagcaguccacaucguag

SEQ ID NO: 54203 - RNA, 20 nt, Artificial Sequence
  MKO10054203_A_Tmed4
  gRNA
guguuccugccgucgacccc

SEQ ID NO: 54204 - RNA, 20 nt, Artificial Sequence
  MKO10054204_A_Tmed4
  gRNA
cuaccccgagaucgcugcua

SEQ ID NO: 54205 - RNA, 20 nt, Artificial Sequence
  MKO10054205_A_Tmed4
  gRNA
cuuauccuuagcagcgaucu

SEQ ID NO: 54206 - RNA, 20 nt, Artificial Sequence
  MKO10054206_A_Tmed5
  gRNA
cgccccgcgcagcaacgcug

SEQ ID NO: 54207 - RNA, 20 nt, Artificial Sequence
  MKO10054207_A_Tmed5
  gRNA
gaucgacagggaugggcggc

SEQ ID NO: 54208 - RNA, 20 nt, Artificial Sequence
  MKO10054208_A_Tmed5
  gRNA
ccucuucucccauauuaucc

SEQ ID NO: 54209 - RNA, 20 nt, Artificial Sequence
  MKO10054209_A_Tmed6
  gRNA
agauccccuacacggcucca

SEQ ID NO: 54210 - RNA, 20 nt, Artificial Sequence
  MKO10054210_A_Tmed6
  gRNA
cgacacucuggaugcgauua

SEQ ID NO: 54211 - RNA, 20 nt, Artificial Sequence
  MKO10054211_A_Tmed6
  gRNA
uggcagguucagcgcauucu

SEQ ID NO: 54212 - RNA, 20 nt, Artificial Sequence
  MKO10054212_A_Tmed7
  gRNA
agcguaguuaggauccgacg

SEQ ID NO: 54213 - RNA, 20 nt, Artificial Sequence
  MKO10054213_A_Tmed7
  gRNA
ggcuucccccaccgaccaau

SEQ ID NO: 54214 - RNA, 20 nt, Artificial Sequence
  MKO10054214_A_Tmed7
  gRNA
cuacgauguugauugucgau

SEQ ID NO: 54215 - RNA, 20 nt, Artificial Sequence
  MKO10054215_A_Tmed8
  gRNA
cacguucuguagaucuuccg

SEQ ID NO: 54216 - RNA, 20 nt, Artificial Sequence
  MKO10054216_A_Tmed8
  gRNA
gaugguaucuccagcgagua

SEQ ID NO: 54217 - RNA, 20 nt, Artificial Sequence
  MKO10054217_A_Tmed8
  gRNA
cugcacgguuauaucagugc

SEQ ID NO: 54218 - RNA, 20 nt, Artificial Sequence
  MKO10054218_A_Tmed9
  gRNA
ccgcaucugccagacgccaa

SEQ ID NO: 54219 - RNA, 20 nt, Artificial Sequence
  MKO10054219_A_Tmed9
  gRNA
cguuugcauguucgcccacu

SEQ ID NO: 54220 - RNA, 20 nt, Artificial Sequence
  MKO10054220_A_Tmed9
  gRNA
uggaccaccauagcacucgc

SEQ ID NO: 54221 - RNA, 20 nt, Artificial Sequence
  MKO10054221_A_Tmeff1
  gRNA
gcgcguggaccuugcuacuc

SEQ ID NO: 54222 - RNA, 20 nt, Artificial Sequence
  MKO10054222_A_Tmeff1
  gRNA
cucuucucagauaacggcuc

SEQ ID NO: 54223 - RNA, 20 nt, Artificial Sequence
  MKO10054223_A_Tmeff1
  gRNA
gaaaugcgcaugccaguuuc

SEQ ID NO: 54224 - RNA, 20 nt, Artificial Sequence
  MKO10054224_A_Tmeff2
  gRNA
acauuccccgucaaauuuac

SEQ ID NO: 54225 - RNA, 20 nt, Artificial Sequence
  MKO10054225_A_Tmeff2
  gRNA
accagaaugagugcuaccug

SEQ ID NO: 54226 - RNA, 20 nt, Artificial Sequence
  MKO10054226_A_Tmeff2
  gRNA
gacuugcgucugucaguuca

SEQ ID NO: 54227 - RNA, 20 nt, Artificial Sequence
  MKO10054227_A_Tmem100
  gRNA
cgagagucagaccgcucuug

SEQ ID NO: 54228 - RNA, 20 nt, Artificial Sequence
  MKO10054228_A_Tmem100
  gRNA
gaguucggcacccccggugg

SEQ ID NO: 54229 - RNA, 20 nt, Artificial Sequence
  MKO10054229_A_Tmem100
  gRNA
uucagcugauggccgccacc

SEQ ID NO: 54230 - RNA, 20 nt, Artificial Sequence
  MKO10054230_A_Tmem101
  gRNA
ccgucgauaagcagcaugac

SEQ ID NO: 54231 - RNA, 20 nt, Artificial Sequence
  MKO10054231_A_Tmem101
  gRNA
acacacgacgcgucgaguuc

SEQ ID NO: 54232 - RNA, 20 nt, Artificial Sequence
  MKO10054232_A_Tmem101
  gRNA
aacggcuucggggcuuucga

SEQ ID NO: 54233 - RNA, 20 nt, Artificial Sequence
  MKO10054233_A_Tmem102
  gRNA
cgagcugcaugaacuagccg

SEQ ID NO: 54234 - RNA, 20 nt, Artificial Sequence
  MKO10054234_A_Tmem102
  gRNA
ucccggcgcucuacuuggcg

SEQ ID NO: 54235 - RNA, 20 nt, Artificial Sequence
  MKO10054235_A_Tmem102
  gRNA
ccagggggcacccccccaga

SEQ ID NO: 54236 - RNA, 20 nt, Artificial Sequence
  MKO10054236_A_Tmem104
  gRNA
gcucgucagccucguucugc

SEQ ID NO: 54237 - RNA, 20 nt, Artificial Sequence
  MKO10054237_A_Tmem104
  gRNA
ucagccaagacaacuacgag

SEQ ID NO: 54238 - RNA, 20 nt, Artificial Sequence
  MKO10054238_A_Tmem104
  gRNA
gcgcaccugugcccacgaug

SEQ ID NO: 54239 - RNA, 20 nt, Artificial Sequence
  MKO10054239_A_Tmem106a
  gRNA
ucacguacagcucaacacga

SEQ ID NO: 54240 - RNA, 20 nt, Artificial Sequence
  MKO10054240_A_Tmem106a
  gRNA
ugccuuacgaaguugccagc

SEQ ID NO: 54241 - RNA, 20 nt, Artificial Sequence
  MKO10054241_A_Tmem106a
  gRNA
cuguacgugagcgucuucaa

SEQ ID NO: 54242 - RNA, 20 nt, Artificial Sequence
  MKO10054242_A_Tmem106b
  gRNA
uacuucaccucaauagaucg

SEQ ID NO: 54243 - RNA, 20 nt, Artificial Sequence
  MKO10054243_A_Tmem106b
  gRNA
cguaaccgcugaucacuaua

SEQ ID NO: 54244 - RNA, 20 nt, Artificial Sequence
  MKO10054244_A_Tmem106b
  gRNA
uaaacgagccuuuccaauca

SEQ ID NO: 54245 - RNA, 20 nt, Artificial Sequence
  MKO10054245_A_Tmem106c
  gRNA
ugaugccguuaucguccacg

SEQ ID NO: 54246 - RNA, 20 nt, Artificial Sequence
  MKO10054246_A_Tmem106c
  gRNA
aacagguuggugaccgccac

SEQ ID NO: 54247 - RNA, 20 nt, Artificial Sequence
  MKO10054247_A_Tmem106c
  gRNA
cgaccacagccuucauguac

SEQ ID NO: 54248 - RNA, 20 nt, Artificial Sequence
  MKO10054248_A_Tmem107
  gRNA
cuuucuucguauucgagcga

SEQ ID NO: 54249 - RNA, 20 nt, Artificial Sequence
  MKO10054249_A_Tmem107
  gRNA
gcucgaauacgaagaaagac

SEQ ID NO: 54250 - RNA, 20 nt, Artificial Sequence
  MKO10054250_A_Tmem107
  gRNA
gagcccggagauccgaccca

SEQ ID NO: 54251 - RNA, 20 nt, Artificial Sequence
  MKO10054251_A_Tmem108
  gRNA
ccccacgggccaccacucgu

SEQ ID NO: 54252 - RNA, 20 nt, Artificial Sequence
  MKO10054252_A_Tmem108
  gRNA
ggccccugucgguugucgug

SEQ ID NO: 54253 - RNA, 20 nt, Artificial Sequence
  MKO10054253_A_Tmem108
  gRNA
agugucucgauagucgccau

SEQ ID NO: 54254 - RNA, 20 nt, Artificial Sequence
  MKO10054254_A_Tmem109
  gRNA
cugugcccgacccaucuacc

SEQ ID NO: 54255 - RNA, 20 nt, Artificial Sequence
  MKO10054255_A_Tmem109
  gRNA
gcgcacacagcacuccguua

SEQ ID NO: 54256 - RNA, 20 nt, Artificial Sequence
  MKO10054256_A_Tmem109
  gRNA
cgccagauagaagagcuuag

SEQ ID NO: 54257 - RNA, 20 nt, Artificial Sequence
  MKO10054257_A_Tmem110
  gRNA
cguacgcgccgucggugucu

SEQ ID NO: 54258 - RNA, 20 nt, Artificial Sequence
  MKO10054258_A_Tmem110
  gRNA
ccacuccaccaagacaccga

SEQ ID NO: 54259 - RNA, 20 nt, Artificial Sequence
  MKO10054259_A_Tmem110
  gRNA
gguacguaccauauccucca

SEQ ID NO: 54260 - RNA, 20 nt, Artificial Sequence
  MKO10054260_A_Tmem115
  gRNA
gaacgacgcugacgcggacc

SEQ ID NO: 54261 - RNA, 20 nt, Artificial Sequence
  MKO10054261_A_Tmem115
  gRNA
aagaugcaacgcgcccuacc

SEQ ID NO: 54262 - RNA, 20 nt, Artificial Sequence
  MKO10054262_A_Tmem115
  gRNA
uccgggacggucaccuuccc

SEQ ID NO: 54263 - RNA, 20 nt, Artificial Sequence
  MKO10054263_A_Tmem116
  gRNA
cugggaagaaacgcacucgc

SEQ ID NO: 54264 - RNA, 20 nt, Artificial Sequence
  MKO10054264_A_Tmem116
  gRNA
cugauggcggugagugcauu

SEQ ID NO: 54265 - RNA, 20 nt, Artificial Sequence
  MKO10054265_A_Tmem116
  gRNA
gaugacgccuguguuccuuu

SEQ ID NO: 54266 - RNA, 20 nt, Artificial Sequence
  MKO10054266_A_Tmem117
  gRNA
acaucgucauccacgaccca

SEQ ID NO: 54267 - RNA, 20 nt, Artificial Sequence
  MKO10054267_A_Tmem117
  gRNA
ugcuugucaucacgaccgac

SEQ ID NO: 54268 - RNA, 20 nt, Artificial Sequence
  MKO10054268_A_Tmem117
  gRNA
agcugggacaaacugaaccg

SEQ ID NO: 54269 - RNA, 20 nt, Artificial Sequence
  MKO10054269_A_Tmem119
  gRNA
cgaugagcaucacguacugc

SEQ ID NO: 54270 - RNA, 20 nt, Artificial Sequence
  MKO10054270_A_Tmem119
  gRNA
guacgugaugcucaucgcgg

SEQ ID NO: 54271 - RNA, 20 nt, Artificial Sequence
  MKO10054271_A_Tmem119
  gRNA
gggaccccguaccuucagcg

SEQ ID NO: 54272 - RNA, 20 nt, Artificial Sequence
  MKO10054272_A_Tmem11
  gRNA
acagcacgcuggaucaccgu

SEQ ID NO: 54273 - RNA, 20 nt, Artificial Sequence
  MKO10054273_A_Tmem11
  gRNA
auugugcacgaaaucuacag

SEQ ID NO: 54274 - RNA, 20 nt, Artificial Sequence
  MKO10054274_A_Tmem11
  gRNA
gagucuccaagauggccgcg

SEQ ID NO: 54275 - RNA, 20 nt, Artificial Sequence
  MKO10054275_A_Tmem120a
  gRNA
aggcuuccaugucgaagaag

SEQ ID NO: 54276 - RNA, 20 nt, Artificial Sequence
  MKO10054276_A_Tmem120a
  gRNA
cucucucccauccgagucca

SEQ ID NO: 54277 - RNA, 20 nt, Artificial Sequence
  MKO10054277_A_Tmem120a
  gRNA
ccgcuucuucugccguguga

SEQ ID NO: 54278 - RNA, 20 nt, Artificial Sequence
  MKO10054278_A_Tmem120b
  gRNA
ggaugagcgccgccuccuca

SEQ ID NO: 54279 - RNA, 20 nt, Artificial Sequence
  MKO10054279_A_Tmem120b
  gRNA
ggcucguacccauucuucuu

SEQ ID NO: 54280 - RNA, 20 nt, Artificial Sequence
  MKO10054280_A_Tmem120b
  gRNA
gucgauuuguccuucauuac

SEQ ID NO: 54281 - RNA, 20 nt, Artificial Sequence
  MKO10054281_A_Tmem121
  gRNA
gucaacgccuugcgagccac

SEQ ID NO: 54282 - RNA, 20 nt, Artificial Sequence
  MKO10054282_A_Tmem121
  gRNA
aggcacacguggcgccgguc

SEQ ID NO: 54283 - RNA, 20 nt, Artificial Sequence
  MKO10054283_A_Tmem121
  gRNA
gaccucgcugagcgcuacgc

SEQ ID NO: 54284 - RNA, 20 nt, Artificial Sequence
  MKO10054284_A_Tmem123
  gRNA
gaggcaguaggcgucacaug

SEQ ID NO: 54285 - RNA, 20 nt, Artificial Sequence
  MKO10054285_A_Tmem123
  gRNA
gcaacuacucaucccaccaa

SEQ ID NO: 54286 - RNA, 20 nt, Artificial Sequence
  MKO10054286_A_Tmem123
  gRNA
uugucauggaugcugacgug

SEQ ID NO: 54287 - RNA, 20 nt, Artificial Sequence
  MKO10054287_A_Tmem125
  gRNA
cuagucgccauucgccggau

SEQ ID NO: 54288 - RNA, 20 nt, Artificial Sequence
  MKO10054288_A_Tmem125
  gRNA
gccuccgccgcugcgcagca

SEQ ID NO: 54289 - RNA, 20 nt, Artificial Sequence
  MKO10054289_A_Tmem125
  gRNA
cugcccuccgaucuguacag

SEQ ID NO: 54290 - RNA, 20 nt, Artificial Sequence
  MKO10054290_A_Tmem126a
  gRNA
cauugacggguauagccaaa

SEQ ID NO: 54291 - RNA, 20 nt, Artificial Sequence
  MKO10054291_A_Tmem126a
  gRNA
aacuagugcaccccguguug

SEQ ID NO: 54292 - RNA, 20 nt, Artificial Sequence
  MKO10054292_A_Tmem126a
  gRNA
auauugucuagacccaagau

SEQ ID NO: 54293 - RNA, 20 nt, Artificial Sequence
  MKO10054293_A_Tmem126b
  gRNA
ccgucuaggugacauaagca

SEQ ID NO: 54294 - RNA, 20 nt, Artificial Sequence
  MKO10054294_A_Tmem126b
  gRNA
uaugugaaaaaccacgugca

SEQ ID NO: 54295 - RNA, 20 nt, Artificial Sequence
  MKO10054295_A_Tmem126b
  gRNA
guucugaggagcgcacuaau

SEQ ID NO: 54296 - RNA, 20 nt, Artificial Sequence
  MKO10054296_A_Tmem127
  gRNA
cuacagugugcuaccgucau

SEQ ID NO: 54297 - RNA, 20 nt, Artificial Sequence
  MKO10054297_A_Tmem127
  gRNA
uccauggaugugcaaccaag

SEQ ID NO: 54298 - RNA, 20 nt, Artificial Sequence
  MKO10054298_A_Tmem127
  gRNA
cagcucugaagauuacucgu

SEQ ID NO: 54299 - RNA, 20 nt, Artificial Sequence
  MKO10054299_A_Tmem128
  gRNA
gcgccaagauggacgcuccg

SEQ ID NO: 54300 - RNA, 20 nt, Artificial Sequence
  MKO10054300_A_Tmem128
  gRNA
cguagcugcucccgagccca

SEQ ID NO: 54301 - RNA, 20 nt, Artificial Sequence
  MKO10054301_A_Tmem128
  gRNA
acaucacgacccccauaaac

SEQ ID NO: 54302 - RNA, 20 nt, Artificial Sequence
  MKO10054302_A_Tmem129
  gRNA
ugcuggcacucgccgaccgc

SEQ ID NO: 54303 - RNA, 20 nt, Artificial Sequence
  MKO10054303_A_Tmem129
  gRNA
cacgcccaacgaguucuacu

SEQ ID NO: 54304 - RNA, 20 nt, Artificial Sequence
  MKO10054304_A_Tmem129
  gRNA
uagcaaacuugucaauccgu

SEQ ID NO: 54305 - RNA, 20 nt, Artificial Sequence
  MKO10054305_A_Tmem130
  gRNA
ucuaaccucgaccauccacg

SEQ ID NO: 54306 - RNA, 20 nt, Artificial Sequence
  MKO10054306_A_Tmem130
  gRNA
uauuacaacuacucgagccc

SEQ ID NO: 54307 - RNA, 20 nt, Artificial Sequence
  MKO10054307_A_Tmem130
  gRNA
caggcacgccgcccaccacg

SEQ ID NO: 54308 - RNA, 20 nt, Artificial Sequence
  MKO10054308_A_Tmem131
  gRNA
gcccuccgucgucaaagcgc

SEQ ID NO: 54309 - RNA, 20 nt, Artificial Sequence
  MKO10054309_A_Tmem131
  gRNA
acgauucgaaccgcccaugc

SEQ ID NO: 54310 - RNA, 20 nt, Artificial Sequence
  MKO10054310_A_Tmem131
  gRNA
guaugggccugcaauuaccc

SEQ ID NO: 54311 - RNA, 20 nt, Artificial Sequence
  MKO10054311_A_Tmem132a
  gRNA
ugcuaaguuagaccgcuuca

SEQ ID NO: 54312 - RNA, 20 nt, Artificial Sequence
  MKO10054312_A_Tmem132a
  gRNA
uagcaguaaccaugauaccc

SEQ ID NO: 54313 - RNA, 20 nt, Artificial Sequence
  MKO10054313_A_Tmem132a
  gRNA
ccagggcacagccgcuucuc

SEQ ID NO: 54314 - RNA, 20 nt, Artificial Sequence
  MKO10054314_A_Tmem132b
  gRNA
gcccgucucgguucccguca

SEQ ID NO: 54315 - RNA, 20 nt, Artificial Sequence
  MKO10054315_A_Tmem132b
  gRNA
ugugaagauaacggcugugc

SEQ ID NO: 54316 - RNA, 20 nt, Artificial Sequence
  MKO10054316_A_Tmem132b
  gRNA
caaugcccacaaaggucguc

SEQ ID NO: 54317 - RNA, 20 nt, Artificial Sequence
  MKO10054317_A_Tmem132c
  gRNA
cauuagccuuuaccgcgccc

SEQ ID NO: 54318 - RNA, 20 nt, Artificial Sequence
  MKO10054318_A_Tmem132c
  gRNA
uccuuagugaccgaaagccg

SEQ ID NO: 54319 - RNA, 20 nt, Artificial Sequence
  MKO10054319_A_Tmem132c
  gRNA
cgauggcaacuagguccuuc

SEQ ID NO: 54320 - RNA, 20 nt, Artificial Sequence
  MKO10054320_A_Tmem132d
  gRNA
aggacucgacccgcgacugc

SEQ ID NO: 54321 - RNA, 20 nt, Artificial Sequence
  MKO10054321_A_Tmem132d
  gRNA
aagagcggugguacuccagc

SEQ ID NO: 54322 - RNA, 20 nt, Artificial Sequence
  MKO10054322_A_Tmem132d
  gRNA
aucugacgaagacgugguua

SEQ ID NO: 54323 - RNA, 20 nt, Artificial Sequence
  MKO10054323_A_Tmem132e
  gRNA
ccgagcgcuugacgguuaac

SEQ ID NO: 54324 - RNA, 20 nt, Artificial Sequence
  MKO10054324_A_Tmem132e
  gRNA
cgguagcuaaccgguaguau

SEQ ID NO: 54325 - RNA, 20 nt, Artificial Sequence
  MKO10054325_A_Tmem132e
  gRNA
auguggcacaucgauuaccg

SEQ ID NO: 54326 - RNA, 20 nt, Artificial Sequence
  MKO10054326_A_Tmem134
  gRNA
ggccgcugcacuucgaacgc

SEQ ID NO: 54327 - RNA, 20 nt, Artificial Sequence
  MKO10054327_A_Tmem134
  gRNA
gccguggcgggcucaaaugg

SEQ ID NO: 54328 - RNA, 20 nt, Artificial Sequence
  MKO10054328_A_Tmem134
  gRNA
gccgccauuugagcccgcca

SEQ ID NO: 54329 - RNA, 20 nt, Artificial Sequence
  MKO10054329_A_Tmem135
  gRNA
uccauuucuuaacgucguga

SEQ ID NO: 54330 - RNA, 20 nt, Artificial Sequence
  MKO10054330_A_Tmem135
  gRNA
agggcugcucacaauuuaua

SEQ ID NO: 54331 - RNA, 20 nt, Artificial Sequence
  MKO10054331_A_Tmem135
  gRNA
accaucacgacguuaagaaa

SEQ ID NO: 54332 - RNA, 20 nt, Artificial Sequence
  MKO10054332_A_Tmem136
  gRNA
cccggagaaaccaucgcauc

SEQ ID NO: 54333 - RNA, 20 nt, Artificial Sequence
  MKO10054333_A_Tmem136
  gRNA
gcaucaagaaguaccaugcg

SEQ ID NO: 54334 - RNA, 20 nt, Artificial Sequence
  MKO10054334_A_Tmem136
  gRNA
cggcuggugaccuucaccca

SEQ ID NO: 54335 - RNA, 20 nt, Artificial Sequence
  MKO10054335_A_Tmem138
  gRNA
guuuccucuagaacgugcga

SEQ ID NO: 54336 - RNA, 20 nt, Artificial Sequence
  MKO10054336_A_Tmem138
  gRNA
cuucucagagcuacuccgaa

SEQ ID NO: 54337 - RNA, 20 nt, Artificial Sequence
  MKO10054337_A_Tmem138
  gRNA
gcgggggucacccagucuca

SEQ ID NO: 54338 - RNA, 20 nt, Artificial Sequence
  MKO10054338_A_Tmem139
  gRNA
ggagcaucguuccauaacac

SEQ ID NO: 54339 - RNA, 20 nt, Artificial Sequence
  MKO10054339_A_Tmem139
  gRNA
cccgaucgaugccaagcucc

SEQ ID NO: 54340 - RNA, 20 nt, Artificial Sequence
  MKO10054340_A_Tmem139
  gRNA
uggaguacuaggcuccaguu

SEQ ID NO: 54341 - RNA, 20 nt, Artificial Sequence
  MKO10054341_A_Tmem140
  gRNA
ccugagccacuuccacacga

SEQ ID NO: 54342 - RNA, 20 nt, Artificial Sequence
  MKO10054342_A_Tmem140
  gRNA
ccacgguuagguucccgcca

SEQ ID NO: 54343 - RNA, 20 nt, Artificial Sequence
  MKO10054343_A_Tmem140
  gRNA
ggcuccauacacaccgagcc

SEQ ID NO: 54344 - RNA, 20 nt, Artificial Sequence
  MKO10054344_A_Tmem141
  gRNA
ccagagcgcuucuagucgug

SEQ ID NO: 54345 - RNA, 20 nt, Artificial Sequence
  MKO10054345_A_Tmem141
  gRNA
ccagucgcacgccuucauga

SEQ ID NO: 54346 - RNA, 20 nt, Artificial Sequence
  MKO10054346_A_Tmem141
  gRNA
agugaaaacgcccuucauga

SEQ ID NO: 54347 - RNA, 20 nt, Artificial Sequence
  MKO10054347_A_Tmem143
  gRNA
ugaagcgcucgcgguacugc

SEQ ID NO: 54348 - RNA, 20 nt, Artificial Sequence
  MKO10054348_A_Tmem143
  gRNA
cgagcgccuguccagugaga

SEQ ID NO: 54349 - RNA, 20 nt, Artificial Sequence
  MKO10054349_A_Tmem143
  gRNA
augaccccaucaaccccgac

SEQ ID NO: 54350 - RNA, 20 nt, Artificial Sequence
  MKO10054350_A_Tmem144
  gRNA
cgaugcuuggcggcugcauu

SEQ ID NO: 54351 - RNA, 20 nt, Artificial Sequence
  MKO10054351_A_Tmem144
  gRNA
uaggacuuggaauccuaauc

SEQ ID NO: 54352 - RNA, 20 nt, Artificial Sequence
  MKO10054352_A_Tmem144
  gRNA
aagccaaugcugaauuacgu

SEQ ID NO: 54353 - RNA, 20 nt, Artificial Sequence
  MKO10054353_A_Tmem145
  gRNA
ucgcaccugacagcccgacc

SEQ ID NO: 54354 - RNA, 20 nt, Artificial Sequence
  MKO10054354_A_Tmem145
  gRNA
cuuccgauuccgauaccccg

SEQ ID NO: 54355 - RNA, 20 nt, Artificial Sequence
  MKO10054355_A_Tmem145
  gRNA
ccagucguccauaauccgaa

SEQ ID NO: 54356 - RNA, 20 nt, Artificial Sequence
  MKO10054356_A_Tmem147
  gRNA
ggucugaauacaacgccuuc

SEQ ID NO: 54357 - RNA, 20 nt, Artificial Sequence
  MKO10054357_A_Tmem147
  gRNA
ggccuggacgcauuuccaga

SEQ ID NO: 54358 - RNA, 20 nt, Artificial Sequence
  MKO10054358_A_Tmem147
  gRNA
cuugucaugucucggaaugc

SEQ ID NO: 54359 - RNA, 20 nt, Artificial Sequence
  MKO10054359_A_Tmem14a
  gRNA
uuugacaucccgucugucau

SEQ ID NO: 54360 - RNA, 20 nt, Artificial Sequence
  MKO10054360_A_Tmem14a
  gRNA
uaugcagcccuugugacaau

SEQ ID NO: 54361 - RNA, 20 nt, Artificial Sequence
  MKO10054361_A_Tmem14a
  gRNA
aagccugcaacuagaccagc

SEQ ID NO: 54362 - RNA, 20 nt, Artificial Sequence
  MKO10054362_A_Tmem14c
  gRNA
augccugcaggguuaaucgc

SEQ ID NO: 54363 - RNA, 20 nt, Artificial Sequence
  MKO10054363_A_Tmem14c
  gRNA
uggacucuucuucgggggcc

SEQ ID NO: 54364 - RNA, 20 nt, Artificial Sequence
  MKO10054364_A_Tmem14c
  gRNA
gguuacagcuguuacggaug

SEQ ID NO: 54365 - RNA, 20 nt, Artificial Sequence
  MKO10054365_A_Tmem150a
  gRNA
gcacacguggcgguucauca

SEQ ID NO: 54366 - RNA, 20 nt, Artificial Sequence
  MKO10054366_A_Tmem150a
  gRNA
caaguguggcacauaccccc

SEQ ID NO: 54367 - RNA, 20 nt, Artificial Sequence
  MKO10054367_A_Tmem150a
  gRNA
gaaaauugccgaccaccacg

SEQ ID NO: 54368 - RNA, 20 nt, Artificial Sequence
  MKO10054368_A_Tmem150b
  gRNA
cuccauaguaggcaacuucc

SEQ ID NO: 54369 - RNA, 20 nt, Artificial Sequence
  MKO10054369_A_Tmem150b
  gRNA
caccuggaaguugccuacua

SEQ ID NO: 54370 - RNA, 20 nt, Artificial Sequence
  MKO10054370_A_Tmem150b
  gRNA
gguucuguggaccucaacga

SEQ ID NO: 54371 - RNA, 20 nt, Artificial Sequence
  MKO10054371_A_Tmem150c
  gRNA
ugcuagguacuuuauagccg

SEQ ID NO: 54372 - RNA, 20 nt, Artificial Sequence
  MKO10054372_A_Tmem150c
  gRNA
agcgcagaacagcuaccacg

SEQ ID NO: 54373 - RNA, 20 nt, Artificial Sequence
  MKO10054373_A_Tmem150c
  gRNA
agaccgcugauauucagcca

SEQ ID NO: 54374 - RNA, 20 nt, Artificial Sequence
  MKO10054374_A_Tmem151a
  gRNA
cucgccguccggaacgagcg

SEQ ID NO: 54375 - RNA, 20 nt, Artificial Sequence
  MKO10054375_A_Tmem151a
  gRNA
ggaggugcccgcgcucguuc

SEQ ID NO: 54376 - RNA, 20 nt, Artificial Sequence
  MKO10054376_A_Tmem151a
  gRNA
cggaccaccacucucucgcg

SEQ ID NO: 54377 - RNA, 20 nt, Artificial Sequence
  MKO10054377_A_Tmem151b
  gRNA
gggugaccugucgaguucgu

SEQ ID NO: 54378 - RNA, 20 nt, Artificial Sequence
  MKO10054378_A_Tmem151b
  gRNA
cuacguccgacgaacucgac

SEQ ID NO: 54379 - RNA, 20 nt, Artificial Sequence
  MKO10054379_A_Tmem151b
  gRNA
gcgcuucuucgccgagaacg

SEQ ID NO: 54380 - RNA, 20 nt, Artificial Sequence
  MKO10054380_A_Tmem154
  gRNA
cgagacgacgagaagugcuc

SEQ ID NO: 54381 - RNA, 20 nt, Artificial Sequence
  MKO10054381_A_Tmem154
  gRNA
ugacuacucacgugucugca

SEQ ID NO: 54382 - RNA, 20 nt, Artificial Sequence
  MKO10054382_A_Tmem154
  gRNA
auuaaugguggcgaucccac

SEQ ID NO: 54383 - RNA, 20 nt, Artificial Sequence
  MKO10054383_A_Tmem158
  gRNA
aucggcgcccccagagcgcg

SEQ ID NO: 54384 - RNA, 20 nt, Artificial Sequence
  MKO10054384_A_Tmem158
  gRNA
gagcagcgccggaccaccgc

SEQ ID NO: 54385 - RNA, 20 nt, Artificial Sequence
  MKO10054385_A_Tmem158
  gRNA
ugagcucgcugcucgugcgc

SEQ ID NO: 54386 - RNA, 20 nt, Artificial Sequence
  MKO10054386_A_Tmem159
  gRNA
caucguggugcucaccucgc

SEQ ID NO: 54387 - RNA, 20 nt, Artificial Sequence
  MKO10054387_A_Tmem159
  gRNA
agccagcugacagucgacgu

SEQ ID NO: 54388 - RNA, 20 nt, Artificial Sequence
  MKO10054388_A_Tmem159
  gRNA
gacacucgggggcucuucuu

SEQ ID NO: 54389 - RNA, 20 nt, Artificial Sequence
  MKO10054389_A_Tmem160
  gRNA
agcguccgcgcgauccagcu

SEQ ID NO: 54390 - RNA, 20 nt, Artificial Sequence
  MKO10054390_A_Tmem160
  gRNA
gccgccuccaguguccgagc

SEQ ID NO: 54391 - RNA, 20 nt, Artificial Sequence
  MKO10054391_A_Tmem160
  gRNA
agccuccuaugcgguggguc

SEQ ID NO: 54392 - RNA, 20 nt, Artificial Sequence
  MKO10054392_A_Tmem161a
  gRNA
cugcgaagucgacgaaccac

SEQ ID NO: 54393 - RNA, 20 nt, Artificial Sequence
  MKO10054393_A_Tmem161a
  gRNA
gacuucgcaguguacuccgu

SEQ ID NO: 54394 - RNA, 20 nt, Artificial Sequence
  MKO10054394_A_Tmem161a
  gRNA
ccgguacauacacccgucag

SEQ ID NO: 54395 - RNA, 20 nt, Artificial Sequence
  MKO10054395_A_Tmem161b
  gRNA
auucuuaauucuucuucgga

SEQ ID NO: 54396 - RNA, 20 nt, Artificial Sequence
  MKO10054396_A_Tmem161b
  gRNA
caucgagcaagagaauagug

SEQ ID NO: 54397 - RNA, 20 nt, Artificial Sequence
  MKO10054397_A_Tmem161b
  gRNA
gggugugauagguauacagc

SEQ ID NO: 54398 - RNA, 20 nt, Artificial Sequence
  MKO10054398_A_Tmem163
  gRNA
ccgcauugcuguaacgccag

SEQ ID NO: 54399 - RNA, 20 nt, Artificial Sequence
  MKO10054399_A_Tmem163
  gRNA
gcuacuuacugcaaacccga

SEQ ID NO: 54400 - RNA, 20 nt, Artificial Sequence
  MKO10054400_A_Tmem163
  gRNA
agaggcgcuguaccucauga

SEQ ID NO: 54401 - RNA, 20 nt, Artificial Sequence
  MKO10054401_A_Tmem164
  gRNA
uaccagccggguauuuacca

SEQ ID NO: 54402 - RNA, 20 nt, Artificial Sequence
  MKO10054402_A_Tmem164
  gRNA
cgauaccaggggccguagaa

SEQ ID NO: 54403 - RNA, 20 nt, Artificial Sequence
  MKO10054403_A_Tmem164
  gRNA
cagacccauucuacggcccc

SEQ ID NO: 54404 - RNA, 20 nt, Artificial Sequence
  MKO10054404_A_Tmem165
  gRNA
cuauaaccggcugacugugc

SEQ ID NO: 54405 - RNA, 20 nt, Artificial Sequence
  MKO10054405_A_Tmem165
  gRNA
gucaucauaguguccgaacu

SEQ ID NO: 54406 - RNA, 20 nt, Artificial Sequence
  MKO10054406_A_Tmem165
  gRNA
agcgcucacauuaacguucu

SEQ ID NO: 54407 - RNA, 20 nt, Artificial Sequence
  MKO10054407_A_Tmem167b
  gRNA
ccagcucucaccguucguca

SEQ ID NO: 54408 - RNA, 20 nt, Artificial Sequence
  MKO10054408_A_Tmem167b
  gRNA
acgagguacuuucuugaagu

SEQ ID NO: 54409 - RNA, 20 nt, Artificial Sequence
  MKO10054409_A_Tmem167b
  gRNA
aaguaccucgucucaaaacc

SEQ ID NO: 54410 - RNA, 20 nt, Artificial Sequence
  MKO10054410_A_Tmem167
  gRNA
gcagacuauugggaauauuu

SEQ ID NO: 54411 - RNA, 20 nt, Artificial Sequence
  MKO10054411_A_Tmem167
  gRNA
augugcuuauauccgauccc

SEQ ID NO: 54412 - RNA, 20 nt, Artificial Sequence
  MKO10054412_A_Tmem167
  gRNA
cagacucugaaaauugaaaa

SEQ ID NO: 54413 - RNA, 20 nt, Artificial Sequence
  MKO10054413_A_Tmem168
  gRNA
uacacgcugcaccugccgac

SEQ ID NO: 54414 - RNA, 20 nt, Artificial Sequence
  MKO10054414_A_Tmem168
  gRNA
uagauagccgagguaccgca

SEQ ID NO: 54415 - RNA, 20 nt, Artificial Sequence
  MKO10054415_A_Tmem168
  gRNA
gcgcuuugacacgccauaca

SEQ ID NO: 54416 - RNA, 20 nt, Artificial Sequence
  MKO10054416_A_Tmem169
  gRNA
agccgcuaugucacacuaac

SEQ ID NO: 54417 - RNA, 20 nt, Artificial Sequence
  MKO10054417_A_Tmem169
  gRNA
ccaauguggauuccccaucc

SEQ ID NO: 54418 - RNA, 20 nt, Artificial Sequence
  MKO10054418_A_Tmem169
  gRNA
ucccgguuagugugacauag

SEQ ID NO: 54419 - RNA, 20 nt, Artificial Sequence
  MKO10054419_A_Tmem170b
  gRNA
ccacucgaugaucaaccugu

SEQ ID NO: 54420 - RNA, 20 nt, Artificial Sequence
  MKO10054420_A_Tmem170b
  gRNA
cgcggggacgaugagggcgg

SEQ ID NO: 54421 - RNA, 20 nt, Artificial Sequence
  MKO10054421_A_Tmem170b
  gRNA
cccgaugcugacagcaauga

SEQ ID NO: 54422 - RNA, 20 nt, Artificial Sequence
  MKO10054422_A_Tmem170
  gRNA
cgucuaccgagcggcaggga

SEQ ID NO: 54423 - RNA, 20 nt, Artificial Sequence
  MKO10054423_A_Tmem170
  gRNA
ucagccugaagcucgugccg

SEQ ID NO: 54424 - RNA, 20 nt, Artificial Sequence
  MKO10054424_A_Tmem170
  gRNA
cacuacacagaacgucugcc

SEQ ID NO: 54425 - RNA, 20 nt, Artificial Sequence
  MKO10054425_A_Tmem171
  gRNA
ugcaucuacgggagcgacag

SEQ ID NO: 54426 - RNA, 20 nt, Artificial Sequence
  MKO10054426_A_Tmem171
  gRNA
cuucuuacccguaguuaaaa

SEQ ID NO: 54427 - RNA, 20 nt, Artificial Sequence
  MKO10054427_A_Tmem171
  gRNA
cauggcggggaugcaucaga

SEQ ID NO: 54428 - RNA, 20 nt, Artificial Sequence
  MKO10054428_A_Tmem173
  gRNA
cggcaguuauuucgagacuc

SEQ ID NO: 54429 - RNA, 20 nt, Artificial Sequence
  MKO10054429_A_Tmem173
  gRNA
uacuugcgguugaucuuacc

SEQ ID NO: 54430 - RNA, 20 nt, Artificial Sequence
  MKO10054430_A_Tmem173
  gRNA
cagcaaaacaucgaccgugc

SEQ ID NO: 54431 - RNA, 20 nt, Artificial Sequence
  MKO10054431_A_Tmem174
  gRNA
ccuugucgucgucggacacc

SEQ ID NO: 54432 - RNA, 20 nt, Artificial Sequence
  MKO10054432_A_Tmem174
  gRNA
acccaguaccgccgacaucc

SEQ ID NO: 54433 - RNA, 20 nt, Artificial Sequence
  MKO10054433_A_Tmem174
  gRNA
agagcguauaucuccucaua

SEQ ID NO: 54434 - RNA, 20 nt, Artificial Sequence
  MKO10054434_A_Tmem175
  gRNA
uacacuugccuugcucaacc

SEQ ID NO: 54435 - RNA, 20 nt, Artificial Sequence
  MKO10054435_A_Tmem175
  gRNA
gacauuucuaaucguaacug

SEQ ID NO: 54436 - RNA, 20 nt, Artificial Sequence
  MKO10054436_A_Tmem175
  gRNA
agacagcgauccuaguugcu

SEQ ID NO: 54437 - RNA, 20 nt, Artificial Sequence
  MKO10054437_A_Tmem176a
  gRNA
cucacgagacccaauaacga

SEQ ID NO: 54438 - RNA, 20 nt, Artificial Sequence
  MKO10054438_A_Tmem176a
  gRNA
uauuuagccauguauuccga

SEQ ID NO: 54439 - RNA, 20 nt, Artificial Sequence
  MKO10054439_A_Tmem176a
  gRNA
uaccaccccguuucuuguga

SEQ ID NO: 54440 - RNA, 20 nt, Artificial Sequence
  MKO10054440_A_Tmem176b
  gRNA
cucgacguaguagggaacac

SEQ ID NO: 54441 - RNA, 20 nt, Artificial Sequence
  MKO10054441_A_Tmem176b
  gRNA
uaucgcacugucccauaccc

SEQ ID NO: 54442 - RNA, 20 nt, Artificial Sequence
  MKO10054442_A_Tmem176b
  gRNA
uggacugagcugugcgccuu

SEQ ID NO: 54443 - RNA, 20 nt, Artificial Sequence
  MKO10054443_A_Tmem177
  gRNA
guugaugcgaaaccaguguc

SEQ ID NO: 54444 - RNA, 20 nt, Artificial Sequence
  MKO10054444_A_Tmem177
  gRNA
aggcuggcuggaccgccgca

SEQ ID NO: 54445 - RNA, 20 nt, Artificial Sequence
  MKO10054445_A_Tmem177
  gRNA
gucugcccaaaagacugcgu

SEQ ID NO: 54446 - RNA, 20 nt, Artificial Sequence
  MKO10054446_A_Tmem178b
  gRNA
gaucuucguagaaugacagc

SEQ ID NO: 54447 - RNA, 20 nt, Artificial Sequence
  MKO10054447_A_Tmem178b
  gRNA
cguuacccacgcuaccuaua

SEQ ID NO: 54448 - RNA, 20 nt, Artificial Sequence
  MKO10054448_A_Tmem178b
  gRNA
cgccgaugauccagccaaag

SEQ ID NO: 54449 - RNA, 20 nt, Artificial Sequence
  MKO10054449_A_Tmem178
  gRNA
ucgcuuauccguuuauuagc

SEQ ID NO: 54450 - RNA, 20 nt, Artificial Sequence
  MKO10054450_A_Tmem178
  gRNA
gggggucggucucguaccag

SEQ ID NO: 54451 - RNA, 20 nt, Artificial Sequence
  MKO10054451_A_Tmem178
  gRNA
acugguacgagaccgacccc

SEQ ID NO: 54452 - RNA, 20 nt, Artificial Sequence
  MKO10054452_A_Tmem179b
  gRNA
gcugcaucgaagacucccac

SEQ ID NO: 54453 - RNA, 20 nt, Artificial Sequence
  MKO10054453_A_Tmem179b
  gRNA
ucucccguuaccuaauugua

SEQ ID NO: 54454 - RNA, 20 nt, Artificial Sequence
  MKO10054454_A_Tmem179b
  gRNA
ucugccuguauacuucgauu

SEQ ID NO: 54455 - RNA, 20 nt, Artificial Sequence
  MKO10054455_A_Tmem179
  gRNA
gguuuaucacaacuaccgcc

SEQ ID NO: 54456 - RNA, 20 nt, Artificial Sequence
  MKO10054456_A_Tmem179
  gRNA
gagaacggccacgacuuucg

SEQ ID NO: 54457 - RNA, 20 nt, Artificial Sequence
  MKO10054457_A_Tmem179
  gRNA
aacagacgcacugcgcgaag

SEQ ID NO: 54458 - RNA, 20 nt, Artificial Sequence
  MKO10054458_A_Tmem17
  gRNA
gcggcuggagucgccgaaca

SEQ ID NO: 54459 - RNA, 20 nt, Artificial Sequence
  MKO10054459_A_Tmem17
  gRNA
ccacucaccggccgcaucac

SEQ ID NO: 54460 - RNA, 20 nt, Artificial Sequence
  MKO10054460_A_Tmem17
  gRNA
uaaccuugauugaagcgauc

SEQ ID NO: 54461 - RNA, 20 nt, Artificial Sequence
  MKO10054461_A_Tmem180
  gRNA
ucuucgccuccuacgccuuu

SEQ ID NO: 54462 - RNA, 20 nt, Artificial Sequence
  MKO10054462_A_Tmem180
  gRNA
ccgggucagcaccacgucuc

SEQ ID NO: 54463 - RNA, 20 nt, Artificial Sequence
  MKO10054463_A_Tmem180
  gRNA
cgugggcauggaccugguac

SEQ ID NO: 54464 - RNA, 20 nt, Artificial Sequence
  MKO10054464_A_Tmem181a
  gRNA
cgcacaucagccauaguugu

SEQ ID NO: 54465 - RNA, 20 nt, Artificial Sequence
  MKO10054465_A_Tmem181a
  gRNA
acccucgaugccgacgaaga

SEQ ID NO: 54466 - RNA, 20 nt, Artificial Sequence
  MKO10054466_A_Tmem181a
  gRNA
ccuacagguuggcacccaug

SEQ ID NO: 54467 - RNA, 20 nt, Artificial Sequence
  MKO10054467_A_Tmem182
  gRNA
cuuacuaauugcggagucgu

SEQ ID NO: 54468 - RNA, 20 nt, Artificial Sequence
  MKO10054468_A_Tmem182
  gRNA
gaaaaaacgaccagccguac

SEQ ID NO: 54469 - RNA, 20 nt, Artificial Sequence
  MKO10054469_A_Tmem182
  gRNA
guugugcucuccccucauga

SEQ ID NO: 54470 - RNA, 20 nt, Artificial Sequence
  MKO10054470_A_Tmem183a
  gRNA
gucgcaccuucgguacaacc

SEQ ID NO: 54471 - RNA, 20 nt, Artificial Sequence
  MKO10054471_A_Tmem183a
  gRNA
auguuucaggcacuacacgc

SEQ ID NO: 54472 - RNA, 20 nt, Artificial Sequence
  MKO10054472_A_Tmem183a
  gRNA
cuuguuucagaagacccgga

SEQ ID NO: 54473 - RNA, 20 nt, Artificial Sequence
  MKO10054473_A_Tmem184a
  gRNA
augacgaagcgcugcucucg

SEQ ID NO: 54474 - RNA, 20 nt, Artificial Sequence
  MKO10054474_A_Tmem184a
  gRNA
ucugugcgagacugcuacga

SEQ ID NO: 54475 - RNA, 20 nt, Artificial Sequence
  MKO10054475_A_Tmem184a
  gRNA
caaacacgccugaaacgccu

SEQ ID NO: 54476 - RNA, 20 nt, Artificial Sequence
  MKO10054476_A_Tmem184b
  gRNA
cgucagcaccguuauacucc

SEQ ID NO: 54477 - RNA, 20 nt, Artificial Sequence
  MKO10054477_A_Tmem184b
  gRNA
ugccgaaguacacguaguac

SEQ ID NO: 54478 - RNA, 20 nt, Artificial Sequence
  MKO10054478_A_Tmem184b
  gRNA
cguagaugggcacgaugaag

SEQ ID NO: 54479 - RNA, 20 nt, Artificial Sequence
  MKO10054479_A_Tmem184c
  gRNA
ucccaaaauugcaauauacg

SEQ ID NO: 54480 - RNA, 20 nt, Artificial Sequence
  MKO10054480_A_Tmem184c
  gRNA
cguuaugcugcuguccaccg

SEQ ID NO: 54481 - RNA, 20 nt, Artificial Sequence
  MKO10054481_A_Tmem184c
  gRNA
uccccacaaugacacgggua

SEQ ID NO: 54482 - RNA, 20 nt, Artificial Sequence
  MKO10054482_A_Tmem185b
  gRNA
caacccacgcuaccguacag

SEQ ID NO: 54483 - RNA, 20 nt, Artificial Sequence
  MKO10054483_A_Tmem185b
  gRNA
auccgcccgcugcguguuag

SEQ ID NO: 54484 - RNA, 20 nt, Artificial Sequence
  MKO10054484_A_Tmem185b
  gRNA
cagcgugcgcuggccgcgaa

SEQ ID NO: 54485 - RNA, 20 nt, Artificial Sequence
  MKO10054485_A_Tmem186
  gRNA
uucggccauagcguaaggug

SEQ ID NO: 54486 - RNA, 20 nt, Artificial Sequence
  MKO10054486_A_Tmem186
  gRNA
gugcgaaccguucccugucc

SEQ ID NO: 54487 - RNA, 20 nt, Artificial Sequence
  MKO10054487_A_Tmem186
  gRNA
acacauccugaacccguucc

SEQ ID NO: 54488 - RNA, 20 nt, Artificial Sequence
  MKO10054488_A_Tmem189
  gRNA
cauacgcaccuucccgacaa

SEQ ID NO: 54489 - RNA, 20 nt, Artificial Sequence
  MKO10054489_A_Tmem189
  gRNA
aaguuccggacccagagccc

SEQ ID NO: 54490 - RNA, 20 nt, Artificial Sequence
  MKO10054490_A_Tmem189
  gRNA
cagucucaucgcccacaacu

SEQ ID NO: 54491 - RNA, 20 nt, Artificial Sequence
  MKO10054491_A_Tmem18
  gRNA
ugccgaguacaucaacgaag

SEQ ID NO: 54492 - RNA, 20 nt, Artificial Sequence
  MKO10054492_A_Tmem18
  gRNA
agccacuucguugauguacu

SEQ ID NO: 54493 - RNA, 20 nt, Artificial Sequence
  MKO10054493_A_Tmem18
  gRNA
gaucgggcacuuccuguguc

SEQ ID NO: 54494 - RNA, 20 nt, Artificial Sequence
  MKO10054494_A_Tmem190
  gRNA
gugcagcaugucuuggcgcc

SEQ ID NO: 54495 - RNA, 20 nt, Artificial Sequence
  MKO10054495_A_Tmem190
  gRNA
ucgucgguccuuagacagug

SEQ ID NO: 54496 - RNA, 20 nt, Artificial Sequence
  MKO10054496_A_Tmem190
  gRNA
gaugauagcacacaccgucc

SEQ ID NO: 54497 - RNA, 20 nt, Artificial Sequence
  MKO10054497_A_Tmem191c
  gRNA
agcgugcggagcgggcucgu

SEQ ID NO: 54498 - RNA, 20 nt, Artificial Sequence
  MKO10054498_A_Tmem191c
  gRNA
cucacaugccucgccucgaa

SEQ ID NO: 54499 - RNA, 20 nt, Artificial Sequence
  MKO10054499_A_Tmem191c
  gRNA
guaccugcagcgccacaagc

SEQ ID NO: 54500 - RNA, 20 nt, Artificial Sequence
  MKO10054500_A_Tmem192
  gRNA
cccagaucuaccgcucuacg

SEQ ID NO: 54501 - RNA, 20 nt, Artificial Sequence
  MKO10054501_A_Tmem192
  gRNA
gcuacguccaguaucaccac

SEQ ID NO: 54502 - RNA, 20 nt, Artificial Sequence
  MKO10054502_A_Tmem192
  gRNA
ggucgucauccauacuuugu

SEQ ID NO: 54503 - RNA, 20 nt, Artificial Sequence
  MKO10054503_A_Tmem194b
  gRNA
ucgacucacgcuuacuaugu

SEQ ID NO: 54504 - RNA, 20 nt, Artificial Sequence
  MKO10054504_A_Tmem194b
  gRNA
guaggugacaguaaccagcc

SEQ ID NO: 54505 - RNA, 20 nt, Artificial Sequence
  MKO10054505_A_Tmem194b
  gRNA
aucaacauucgcaaauccag

SEQ ID NO: 54506 - RNA, 20 nt, Artificial Sequence
  MKO10054506_A_Tmem194
  gRNA
uguggucggcgguuggucca

SEQ ID NO: 54507 - RNA, 20 nt, Artificial Sequence
  MKO10054507_A_Tmem194
  gRNA
gucgccggcugcguggucug

SEQ ID NO: 54508 - RNA, 20 nt, Artificial Sequence
  MKO10054508_A_Tmem194
  gRNA
ugauauauggacacggauac

SEQ ID NO: 54509 - RNA, 20 nt, Artificial Sequence
  MKO10054509_A_Tmem196
  gRNA
ggggacgagucuccgagcug

SEQ ID NO: 54510 - RNA, 20 nt, Artificial Sequence
  MKO10054510_A_Tmem196
  gRNA
gcaccgcaacugauguuuaa

SEQ ID NO: 54511 - RNA, 20 nt, Artificial Sequence
  MKO10054511_A_Tmem196
  gRNA
cgagagcacacgccgcagcu

SEQ ID NO: 54512 - RNA, 20 nt, Artificial Sequence
  MKO10054512_A_Tmem198b
  gRNA
agccccaucaguccgccgac

SEQ ID NO: 54513 - RNA, 20 nt, Artificial Sequence
  MKO10054513_A_Tmem198b
  gRNA
uuucugaccggucuccugcu

SEQ ID NO: 54514 - RNA, 20 nt, Artificial Sequence
  MKO10054514_A_Tmem198b
  gRNA
uccggauauuggggguaagc

SEQ ID NO: 54515 - RNA, 20 nt, Artificial Sequence
  MKO10054515_A_Tmem198
  gRNA
cggcgcuaugccggguacua

SEQ ID NO: 54516 - RNA, 20 nt, Artificial Sequence
  MKO10054516_A_Tmem198
  gRNA
gcaagcgcgggcaucgcacu

SEQ ID NO: 54517 - RNA, 20 nt, Artificial Sequence
  MKO10054517_A_Tmem198
  gRNA
ggacaugacuacacccguac

SEQ ID NO: 54518 - RNA, 20 nt, Artificial Sequence
  MKO10054518_A_Tmem199
  gRNA
cacucgcaaugucacuuguc

SEQ ID NO: 54519 - RNA, 20 nt, Artificial Sequence
  MKO10054519_A_Tmem199
  gRNA
gauccgcuuauacuccucau

SEQ ID NO: 54520 - RNA, 20 nt, Artificial Sequence
  MKO10054520_A_Tmem199
  gRNA
cggggaggcuucacaaucuc

SEQ ID NO: 54521 - RNA, 20 nt, Artificial Sequence
  MKO10054521_A_Tmem19
  gRNA
ggcccacaaagguaccgccg

SEQ ID NO: 54522 - RNA, 20 nt, Artificial Sequence
  MKO10054522_A_Tmem19
  gRNA
gaucacaacaggaacgacga

SEQ ID NO: 54523 - RNA, 20 nt, Artificial Sequence
  MKO10054523_A_Tmem19
  gRNA
ggggcgacgaugcaguucuc

SEQ ID NO: 54524 - RNA, 20 nt, Artificial Sequence
  MKO10054524_A_Tmem200a
  gRNA
ggaacgagcaaccgauccau

SEQ ID NO: 54525 - RNA, 20 nt, Artificial Sequence
  MKO10054525_A_Tmem200a
  gRNA
gcgcccacgagcagauguug

SEQ ID NO: 54526 - RNA, 20 nt, Artificial Sequence
  MKO10054526_A_Tmem200a
  gRNA
caggcaaauggccuauacgc

SEQ ID NO: 54527 - RNA, 20 nt, Artificial Sequence
  MKO10054527_A_Tmem200b
  gRNA
acgggccgcacgagcgccug

SEQ ID NO: 54528 - RNA, 20 nt, Artificial Sequence
  MKO10054528_A_Tmem200b
  gRNA
gcucuacgagaaccgcgacc

SEQ ID NO: 54529 - RNA, 20 nt, Artificial Sequence
  MKO10054529_A_Tmem200b
  gRNA
ggcggcccaggcgcgaaacg

SEQ ID NO: 54530 - RNA, 20 nt, Artificial Sequence
  MKO10054530_A_Tmem200c
  gRNA
ucuaccgcgagcgcuccagu

SEQ ID NO: 54531 - RNA, 20 nt, Artificial Sequence
  MKO10054531_A_Tmem200c
  gRNA
ccgcguuggcgcaaaugaag

SEQ ID NO: 54532 - RNA, 20 nt, Artificial Sequence
  MKO10054532_A_Tmem200c
  gRNA
ucgccggaccacaguugccg

SEQ ID NO: 54533 - RNA, 20 nt, Artificial Sequence
  MKO10054533_A_Tmem201
  gRNA
cagccucccgacgccggaac

SEQ ID NO: 54534 - RNA, 20 nt, Artificial Sequence
  MKO10054534_A_Tmem201
  gRNA
accccagggccgcuacgaug

SEQ ID NO: 54535 - RNA, 20 nt, Artificial Sequence
  MKO10054535_A_Tmem201
  gRNA
guucugcaaccacgauacac

SEQ ID NO: 54536 - RNA, 20 nt, Artificial Sequence
  MKO10054536_A_Tmem202
  gRNA
ucacauacugcugucgcuuc

SEQ ID NO: 54537 - RNA, 20 nt, Artificial Sequence
  MKO10054537_A_Tmem202
  gRNA
accacagaacauccggaugu

SEQ ID NO: 54538 - RNA, 20 nt, Artificial Sequence
  MKO10054538_A_Tmem202
  gRNA
acugcaccaacuaagauagu

SEQ ID NO: 54539 - RNA, 20 nt, Artificial Sequence
  MKO10054539_A_Tmem203
  gRNA
gcuaguugacgcgacaagcc

SEQ ID NO: 54540 - RNA, 20 nt, Artificial Sequence
  MKO10054540_A_Tmem203
  gRNA
gcgcgauguuauucucgcug

SEQ ID NO: 54541 - RNA, 20 nt, Artificial Sequence
  MKO10054541_A_Tmem203
  gRNA
gagucgaacggaaacgaugg

SEQ ID NO: 54542 - RNA, 20 nt, Artificial Sequence
  MKO10054542_A_Tmem204
  gRNA
ugcguccguccuccagcguc

SEQ ID NO: 54543 - RNA, 20 nt, Artificial Sequence
  MKO10054543_A_Tmem204
  gRNA
acuuacguuugacggugccu

SEQ ID NO: 54544 - RNA, 20 nt, Artificial Sequence
  MKO10054544_A_Tmem204
  gRNA
caugaugcgugccugcaacc

SEQ ID NO: 54545 - RNA, 20 nt, Artificial Sequence
  MKO10054545_A_Tmem205
  gRNA
accaguccaaaugugugccg

SEQ ID NO: 54546 - RNA, 20 nt, Artificial Sequence
  MKO10054546_A_Tmem205
  gRNA
ccaaguacagugcucuacgc

SEQ ID NO: 54547 - RNA, 20 nt, Artificial Sequence
  MKO10054547_A_Tmem205
  gRNA
cucaagccagcgagcauuga

SEQ ID NO: 54548 - RNA, 20 nt, Artificial Sequence
  MKO10054548_A_Tmem206
  gRNA
guggaucgcuacgacgcucc

SEQ ID NO: 54549 - RNA, 20 nt, Artificial Sequence
  MKO10054549_A_Tmem206
  gRNA
cacucaccuggcacgacacc

SEQ ID NO: 54550 - RNA, 20 nt, Artificial Sequence
  MKO10054550_A_Tmem206
  gRNA
ucgccugaaccagagcaaug

SEQ ID NO: 54551 - RNA, 20 nt, Artificial Sequence
  MKO10054551_A_Tmem207
  gRNA
uaugacgagcgauauccuga

SEQ ID NO: 54552 - RNA, 20 nt, Artificial Sequence
  MKO10054552_A_Tmem207
  gRNA
caauccucccagacgcacca

SEQ ID NO: 54553 - RNA, 20 nt, Artificial Sequence
  MKO10054553_A_Tmem207
  gRNA
aggaccuaaagcaccaaagc

SEQ ID NO: 54554 - RNA, 20 nt, Artificial Sequence
  MKO10054554_A_Tmem208
  gRNA
uggcucccaguaugauccga

SEQ ID NO: 54555 - RNA, 20 nt, Artificial Sequence
  MKO10054555_A_Tmem208
  gRNA
cuaccacucuaugagcucga

SEQ ID NO: 54556 - RNA, 20 nt, Artificial Sequence
  MKO10054556_A_Tmem208
  gRNA
acacggccaagcuaaagccc

SEQ ID NO: 54557 - RNA, 20 nt, Artificial Sequence
  MKO10054557_A_Tmem209
  gRNA
uaccguagcaccaacaaguc

SEQ ID NO: 54558 - RNA, 20 nt, Artificial Sequence
  MKO10054558_A_Tmem209
  gRNA
gacuacaccuccccgugauu

SEQ ID NO: 54559 - RNA, 20 nt, Artificial Sequence
  MKO10054559_A_Tmem209
  gRNA
auuacuuaccgauauaccag

SEQ ID NO: 54560 - RNA, 20 nt, Artificial Sequence
  MKO10054560_A_Tmem210
  gRNA
caauaagggccucacggcug

SEQ ID NO: 54561 - RNA, 20 nt, Artificial Sequence
  MKO10054561_A_Tmem210
  gRNA
caccaaucgccacaacaacg

SEQ ID NO: 54562 - RNA, 20 nt, Artificial Sequence
  MKO10054562_A_Tmem210
  gRNA
aucauggauacguccagauc

SEQ ID NO: 54563 - RNA, 20 nt, Artificial Sequence
  MKO10054563_A_Tmem211
  gRNA
ccccccgaagguuguuugcc

SEQ ID NO: 54564 - RNA, 20 nt, Artificial Sequence
  MKO10054564_A_Tmem211
  gRNA
ugucggaccaaagcccgucc

SEQ ID NO: 54565 - RNA, 20 nt, Artificial Sequence
  MKO10054565_A_Tmem211
  gRNA
ucagccggcaugcuccgcug

SEQ ID NO: 54566 - RNA, 20 nt, Artificial Sequence
  MKO10054566_A_Tmem212
  gRNA
accgacgggaacuucgugua

SEQ ID NO: 54567 - RNA, 20 nt, Artificial Sequence
  MKO10054567_A_Tmem212
  gRNA
uccguacacgaaguucccgu

SEQ ID NO: 54568 - RNA, 20 nt, Artificial Sequence
  MKO10054568_A_Tmem212
  gRNA
ugaggccccccagaguaacc

SEQ ID NO: 54569 - RNA, 20 nt, Artificial Sequence
  MKO10054569_A_Tmem213
  gRNA
acuacuguuaccuguaccgc

SEQ ID NO: 54570 - RNA, 20 nt, Artificial Sequence
  MKO10054570_A_Tmem213
  gRNA
cuuccguagaugaauauggc

SEQ ID NO: 54571 - RNA, 20 nt, Artificial Sequence
  MKO10054571_A_Tmem213
  gRNA
auccuugggcucaugccgcc

SEQ ID NO: 54572 - RNA, 20 nt, Artificial Sequence
  MKO10054572_A_Tmem214
  gRNA
ucucuaggggagucgcuaca

SEQ ID NO: 54573 - RNA, 20 nt, Artificial Sequence
  MKO10054573_A_Tmem214
  gRNA
cucagagugggcuccauccg

SEQ ID NO: 54574 - RNA, 20 nt, Artificial Sequence
  MKO10054574_A_Tmem214
  gRNA
ggaugaucccacguagcucu

SEQ ID NO: 54575 - RNA, 20 nt, Artificial Sequence
  MKO10054575_A_Tmem215
  gRNA
caggucagacuauugucucg

SEQ ID NO: 54576 - RNA, 20 nt, Artificial Sequence
  MKO10054576_A_Tmem215
  gRNA
aguggggguaguaacggagc

SEQ ID NO: 54577 - RNA, 20 nt, Artificial Sequence
  MKO10054577_A_Tmem215
  gRNA
agagcaauggcggcgaugcc

SEQ ID NO: 54578 - RNA, 20 nt, Artificial Sequence
  MKO10054578_A_Tmem216
  gRNA
gaccuucccauccgcuauga

SEQ ID NO: 54579 - RNA, 20 nt, Artificial Sequence
  MKO10054579_A_Tmem216
  gRNA
ugccagcgaaagaugccccu

SEQ ID NO: 54580 - RNA, 20 nt, Artificial Sequence
  MKO10054580_A_Tmem216
  gRNA
gugaugcugcugcucuaucu

SEQ ID NO: 54581 - RNA, 20 nt, Artificial Sequence
  MKO10054581_A_Tmem217
  gRNA
gccucaugagcuacgucauc

SEQ ID NO: 54582 - RNA, 20 nt, Artificial Sequence
  MKO10054582_A_Tmem217
  gRNA
ccucaccgacgaguucagug

SEQ ID NO: 54583 - RNA, 20 nt, Artificial Sequence
  MKO10054583_A_Tmem217
  gRNA
uucccaaagagauacgucua

SEQ ID NO: 54584 - RNA, 20 nt, Artificial Sequence
  MKO10054584_A_Tmem218
  gRNA
gcugggaauucacuggcucg

SEQ ID NO: 54585 - RNA, 20 nt, Artificial Sequence
  MKO10054585_A_Tmem218
  gRNA
uaguaaugaucagagcuccg

SEQ ID NO: 54586 - RNA, 20 nt, Artificial Sequence
  MKO10054586_A_Tmem218
  gRNA
gccuuaccuagcuaucccag

SEQ ID NO: 54587 - RNA, 20 nt, Artificial Sequence
  MKO10054587_A_Tmem219
  gRNA
uggcaagggccucacgucgu

SEQ ID NO: 54588 - RNA, 20 nt, Artificial Sequence
  MKO10054588_A_Tmem219
  gRNA
auccgcgcccagaguuccac

SEQ ID NO: 54589 - RNA, 20 nt, Artificial Sequence
  MKO10054589_A_Tmem219
  gRNA
guacuuaccuggggaauguc

SEQ ID NO: 54590 - RNA, 20 nt, Artificial Sequence
  MKO10054590_A_Tmem220
  gRNA
cguuuguaggcaacuucauc

SEQ ID NO: 54591 - RNA, 20 nt, Artificial Sequence
  MKO10054591_A_Tmem220
  gRNA
ucaugggaagugggagucgc

SEQ ID NO: 54592 - RNA, 20 nt, Artificial Sequence
  MKO10054592_A_Tmem220
  gRNA
gcuuugcgugaagcaagaag

SEQ ID NO: 54593 - RNA, 20 nt, Artificial Sequence
  MKO10054593_A_Tmem221
  gRNA
cgcgccaugggccguuccua

SEQ ID NO: 54594 - RNA, 20 nt, Artificial Sequence
  MKO10054594_A_Tmem221
  gRNA
cuucggcgcguacgcaccga

SEQ ID NO: 54595 - RNA, 20 nt, Artificial Sequence
  MKO10054595_A_Tmem221
  gRNA
cucccggagaccccgacgag

SEQ ID NO: 54596 - RNA, 20 nt, Artificial Sequence
  MKO10054596_A_Tmem222
  gRNA
cccggacagguguaugcgag

SEQ ID NO: 54597 - RNA, 20 nt, Artificial Sequence
  MKO10054597_A_Tmem222
  gRNA
cgaagaguauaagcaccgaa

SEQ ID NO: 54598 - RNA, 20 nt, Artificial Sequence
  MKO10054598_A_Tmem222
  gRNA
gggacucaccgaaacaaaau

SEQ ID NO: 54599 - RNA, 20 nt, Artificial Sequence
  MKO10054599_A_Tmem223
  gRNA
ggcuguugguugcggcacga

SEQ ID NO: 54600 - RNA, 20 nt, Artificial Sequence
  MKO10054600_A_Tmem223
  gRNA
agaagcggccccgcucgugc

SEQ ID NO: 54601 - RNA, 20 nt, Artificial Sequence
  MKO10054601_A_Tmem223
  gRNA
ccugcaggagucuugguccu

SEQ ID NO: 54602 - RNA, 20 nt, Artificial Sequence
  MKO10054602_A_Tmem225
  gRNA
ugcacauggacgaugcuucg

SEQ ID NO: 54603 - RNA, 20 nt, Artificial Sequence
  MKO10054603_A_Tmem225
  gRNA
uuauccgccugaccaccucc

SEQ ID NO: 54604 - RNA, 20 nt, Artificial Sequence
  MKO10054604_A_Tmem225
  gRNA
gaaacaacuucgauuguacu

SEQ ID NO: 54605 - RNA, 20 nt, Artificial Sequence
  MKO10054605_A_Tmem229a
  gRNA
cugcacccgccacaacacgu

SEQ ID NO: 54606 - RNA, 20 nt, Artificial Sequence
  MKO10054606_A_Tmem229a
  gRNA
caccggcggacugcguagcc

SEQ ID NO: 54607 - RNA, 20 nt, Artificial Sequence
  MKO10054607_A_Tmem229a
  gRNA
gccaauggcgggcagcgaug

SEQ ID NO: 54608 - RNA, 20 nt, Artificial Sequence
  MKO10054608_A_Tmem229b
  gRNA
cguauguaccuucgucugcg

SEQ ID NO: 54609 - RNA, 20 nt, Artificial Sequence
  MKO10054609_A_Tmem229b
  gRNA
cccagggacaggcguugaac

SEQ ID NO: 54610 - RNA, 20 nt, Artificial Sequence
  MKO10054610_A_Tmem229b
  gRNA
gguacauacgcuccacgauc

SEQ ID NO: 54611 - RNA, 20 nt, Artificial Sequence
  MKO10054611_A_Tmem230
  gRNA
cgauggcuacauugaccuuc

SEQ ID NO: 54612 - RNA, 20 nt, Artificial Sequence
  MKO10054612_A_Tmem230
  gRNA
guugccagguugguacgaga

SEQ ID NO: 54613 - RNA, 20 nt, Artificial Sequence
  MKO10054613_A_Tmem230
  gRNA
ucaaaaacagcacgguagca

SEQ ID NO: 54614 - RNA, 20 nt, Artificial Sequence
  MKO10054614_A_Tmem231
  gRNA
gaaccacgcaccgacacgag

SEQ ID NO: 54615 - RNA, 20 nt, Artificial Sequence
  MKO10054615_A_Tmem231
  gRNA
ccacauuguugccgccuauc

SEQ ID NO: 54616 - RNA, 20 nt, Artificial Sequence
  MKO10054616_A_Tmem231
  gRNA
ccugcgcgucccgcucgugu

SEQ ID NO: 54617 - RNA, 20 nt, Artificial Sequence
  MKO10054617_A_Tmem232
  gRNA
aaauaugcuccacgccuccu

SEQ ID NO: 54618 - RNA, 20 nt, Artificial Sequence
  MKO10054618_A_Tmem232
  gRNA
augugcaucuuccgaccgca

SEQ ID NO: 54619 - RNA, 20 nt, Artificial Sequence
  MKO10054619_A_Tmem232
  gRNA
cuguugcgaugcauucauga

SEQ ID NO: 54620 - RNA, 20 nt, Artificial Sequence
  MKO10054620_A_Tmem233
  gRNA
guguuucugcccagcguacc

SEQ ID NO: 54621 - RNA, 20 nt, Artificial Sequence
  MKO10054621_A_Tmem233
  gRNA
ccuggagaagugcaccgcac

SEQ ID NO: 54622 - RNA, 20 nt, Artificial Sequence
  MKO10054622_A_Tmem233
  gRNA
gggcucuggcugucgacuca

SEQ ID NO: 54623 - RNA, 20 nt, Artificial Sequence
  MKO10054623_A_Tmem234
  gRNA
agcaagugcgugagcggacg

SEQ ID NO: 54624 - RNA, 20 nt, Artificial Sequence
  MKO10054624_A_Tmem234
  gRNA
uggcccacucaggagugcga

SEQ ID NO: 54625 - RNA, 20 nt, Artificial Sequence
  MKO10054625_A_Tmem234
  gRNA
uccgcucacgcacuugcucc

SEQ ID NO: 54626 - RNA, 20 nt, Artificial Sequence
  MKO10054626_A_Tmem235
  gRNA
cgugcgucacgccguacgug

SEQ ID NO: 54627 - RNA, 20 nt, Artificial Sequence
  MKO10054627_A_Tmem235
  gRNA
guggaggcggcccgcacgua

SEQ ID NO: 54628 - RNA, 20 nt, Artificial Sequence
  MKO10054628_A_Tmem235
  gRNA
agccucguccucaucguaug

SEQ ID NO: 54629 - RNA, 20 nt, Artificial Sequence
  MKO10054629_A_Tmem236
  gRNA
gcauaccucggugacugcua

SEQ ID NO: 54630 - RNA, 20 nt, Artificial Sequence
  MKO10054630_A_Tmem236
  gRNA
guacuggcgugaucguuccc

SEQ ID NO: 54631 - RNA, 20 nt, Artificial Sequence
  MKO10054631_A_Tmem236
  gRNA
aggcugacuuguacaccgcc

SEQ ID NO: 54632 - RNA, 20 nt, Artificial Sequence
  MKO10054632_A_Tmem237
  gRNA
gucacgugaagugcuaucca

SEQ ID NO: 54633 - RNA, 20 nt, Artificial Sequence
  MKO10054633_A_Tmem237
  gRNA
augcugagcccguuguuaac

SEQ ID NO: 54634 - RNA, 20 nt, Artificial Sequence
  MKO10054634_A_Tmem237
  gRNA
uccagaacaaaaagcucgcu

SEQ ID NO: 54635 - RNA, 20 nt, Artificial Sequence
  MKO10054635_A_Tmem238
  gRNA
caacaucgagaucucgcgcc

SEQ ID NO: 54636 - RNA, 20 nt, Artificial Sequence
  MKO10054636_A_Tmem238
  gRNA
ugacuacggccuacgacccu

SEQ ID NO: 54637 - RNA, 20 nt, Artificial Sequence
  MKO10054637_A_Tmem238
  gRNA
uggcgggcgccgaccagcga

SEQ ID NO: 54638 - RNA, 20 nt, Artificial Sequence
  MKO10054638_A_Tmem239
  gRNA
augauauccgacuccacucg

SEQ ID NO: 54639 - RNA, 20 nt, Artificial Sequence
  MKO10054639_A_Tmem239
  gRNA
acccagugguggaauacauc

SEQ ID NO: 54640 - RNA, 20 nt, Artificial Sequence
  MKO10054640_A_Tmem239
  gRNA
uccaaguccugagcguagcc

SEQ ID NO: 54641 - RNA, 20 nt, Artificial Sequence
  MKO10054641_A_Tmem240
  gRNA
accgacugguccccgucgua

SEQ ID NO: 54642 - RNA, 20 nt, Artificial Sequence
  MKO10054642_A_Tmem240
  gRNA
cacuacgugaucccauacga

SEQ ID NO: 54643 - RNA, 20 nt, Artificial Sequence
  MKO10054643_A_Tmem240
  gRNA
agacgcgguccucgccccgc

SEQ ID NO: 54644 - RNA, 20 nt, Artificial Sequence
  MKO10054644_A_Tmem241
  gRNA
gcugagcagagcgucguguc

SEQ ID NO: 54645 - RNA, 20 nt, Artificial Sequence
  MKO10054645_A_Tmem241
  gRNA
acucacccuuggaauaaugu

SEQ ID NO: 54646 - RNA, 20 nt, Artificial Sequence
  MKO10054646_A_Tmem241
  gRNA
caucgcucucaaagaucugu

SEQ ID NO: 54647 - RNA, 20 nt, Artificial Sequence
  MKO10054647_A_Tmem242
  gRNA
uccggacgaucgguuguuuc

SEQ ID NO: 54648 - RNA, 20 nt, Artificial Sequence
  MKO10054648_A_Tmem242
  gRNA
accagaaacaaccgaucguc

SEQ ID NO: 54649 - RNA, 20 nt, Artificial Sequence
  MKO10054649_A_Tmem242
  gRNA
gccgcagcgggaaugcuagc

SEQ ID NO: 54650 - RNA, 20 nt, Artificial Sequence
  MKO10054650_A_Tmem243
  gRNA
uagaucuacugguaucgaca

SEQ ID NO: 54651 - RNA, 20 nt, Artificial Sequence
  MKO10054651_A_Tmem243
  gRNA
gcagacgucuccccgaacag

SEQ ID NO: 54652 - RNA, 20 nt, Artificial Sequence
  MKO10054652_A_Tmem243
  gRNA
cgaaucaucaauuuaguugu

SEQ ID NO: 54653 - RNA, 20 nt, Artificial Sequence
  MKO10054653_A_Tmem245
  gRNA
gagcaguuucgauuccugug

SEQ ID NO: 54654 - RNA, 20 nt, Artificial Sequence
  MKO10054654_A_Tmem245
  gRNA
ugcugaugguuucauucaag

SEQ ID NO: 54655 - RNA, 20 nt, Artificial Sequence
  MKO10054655_A_Tmem245
  gRNA
cagcccucugacccuccgac

SEQ ID NO: 54656 - RNA, 20 nt, Artificial Sequence
  MKO10054656_A_Tmem246
  gRNA
cccucguagcgguuggccac

SEQ ID NO: 54657 - RNA, 20 nt, Artificial Sequence
  MKO10054657_A_Tmem246
  gRNA
gcagcucuucauucuaaccg

SEQ ID NO: 54658 - RNA, 20 nt, Artificial Sequence
  MKO10054658_A_Tmem246
  gRNA
augaaaauuguaccguaggc

SEQ ID NO: 54659 - RNA, 20 nt, Artificial Sequence
  MKO10054659_A_Tmem247
  gRNA
gacagaacaccgcaacgcga

SEQ ID NO: 54660 - RNA, 20 nt, Artificial Sequence
  MKO10054660_A_Tmem247
  gRNA
ucuccagcuccaucgcguug

SEQ ID NO: 54661 - RNA, 20 nt, Artificial Sequence
  MKO10054661_A_Tmem247
  gRNA
uccgcagcacggugguuauc

SEQ ID NO: 54662 - RNA, 20 nt, Artificial Sequence
  MKO10054662_A_Tmem248
  gRNA
ggcacagucaucggcguucc

SEQ ID NO: 54663 - RNA, 20 nt, Artificial Sequence
  MKO10054663_A_Tmem248
  gRNA
gaagaucuuguaccagagcg

SEQ ID NO: 54664 - RNA, 20 nt, Artificial Sequence
  MKO10054664_A_Tmem248
  gRNA
cauacagcaacgccacgcuc

SEQ ID NO: 54665 - RNA, 20 nt, Artificial Sequence
  MKO10054665_A_Tmem251
  gRNA
ccgcucucguacaagaauaa

SEQ ID NO: 54666 - RNA, 20 nt, Artificial Sequence
  MKO10054666_A_Tmem251
  gRNA
ccuuuauucuuguacgagag

SEQ ID NO: 54667 - RNA, 20 nt, Artificial Sequence
  MKO10054667_A_Tmem251
  gRNA
agugacucuugcucgcuugc

SEQ ID NO: 54668 - RNA, 20 nt, Artificial Sequence
  MKO10054668_A_Tmem252
  gRNA
cagcacguaccugucuacag

SEQ ID NO: 54669 - RNA, 20 nt, Artificial Sequence
  MKO10054669_A_Tmem252
  gRNA
cccgccuuuagcacccugcu

SEQ ID NO: 54670 - RNA, 20 nt, Artificial Sequence
  MKO10054670_A_Tmem252
  gRNA
aaaucaucaggaagccggug

SEQ ID NO: 54671 - RNA, 20 nt, Artificial Sequence
  MKO10054671_A_Tmem253
  gRNA
cgcggaggccuucacccuag

SEQ ID NO: 54672 - RNA, 20 nt, Artificial Sequence
  MKO10054672_A_Tmem253
  gRNA
ccgcaacgaagcccaagauc

SEQ ID NO: 54673 - RNA, 20 nt, Artificial Sequence
  MKO10054673_A_Tmem253
  gRNA
uggagaccagcacucccgcu

SEQ ID NO: 54674 - RNA, 20 nt, Artificial Sequence
  MKO10054674_A_Tmem254a
  gRNA
cgagauggugguggcgaagu

SEQ ID NO: 54675 - RNA, 20 nt, Artificial Sequence
  MKO10054675_A_Tmem254a
  gRNA
ccgcgaaguagcccagcccu

SEQ ID NO: 54676 - RNA, 20 nt, Artificial Sequence
  MKO10054676_A_Tmem254a
  gRNA
ucuugcagugggcugucuuc

SEQ ID NO: 54677 - RNA, 20 nt, Artificial Sequence
  MKO10054677_A_Tmem254b
  gRNA
cgagauggugguggcgaagu

SEQ ID NO: 54678 - RNA, 20 nt, Artificial Sequence
  MKO10054678_A_Tmem254b
  gRNA
ccgcgaaguagcccagcccu

SEQ ID NO: 54679 - RNA, 20 nt, Artificial Sequence
  MKO10054679_A_Tmem254b
  gRNA
ucuugcagugggcugucuuc

SEQ ID NO: 54680 - RNA, 20 nt, Artificial Sequence
  MKO10054680_A_Tmem254c
  gRNA
cgagauggugguggcgaagu

SEQ ID NO: 54681 - RNA, 20 nt, Artificial Sequence
  MKO10054681_A_Tmem254c
  gRNA
ccgcgaaguagcccagcccu

SEQ ID NO: 54682 - RNA, 20 nt, Artificial Sequence
  MKO10054682_A_Tmem254c
  gRNA
ucuugcagugggcugucuuc

SEQ ID NO: 54683 - RNA, 20 nt, Artificial Sequence
  MKO10054683_A_Tmem255a
  gRNA
caaaguaacggugacguaga

SEQ ID NO: 54684 - RNA, 20 nt, Artificial Sequence
  MKO10054684_A_Tmem255a
  gRNA
ucugccgcuuguucucaauc

SEQ ID NO: 54685 - RNA, 20 nt, Artificial Sequence
  MKO10054685_A_Tmem255a
  gRNA
guuccgcuuccuccuauuga

SEQ ID NO: 54686 - RNA, 20 nt, Artificial Sequence
  MKO10054686_A_Tmem255b
  gRNA
ugcgaacacgcugucgacua

SEQ ID NO: 54687 - RNA, 20 nt, Artificial Sequence
  MKO10054687_A_Tmem255b
  gRNA
ucgacagcguguucgcagcg

SEQ ID NO: 54688 - RNA, 20 nt, Artificial Sequence
  MKO10054688_A_Tmem255b
  gRNA
ccgcucccaccgcccgugcc

SEQ ID NO: 54689 - RNA, 20 nt, Artificial Sequence
  MKO10054689_A_Tmem256
  gRNA
cgccgccuaggugccuuguc

SEQ ID NO: 54690 - RNA, 20 nt, Artificial Sequence
  MKO10054690_A_Tmem256
  gRNA
gccuuggguuuggccuccua

SEQ ID NO: 54691 - RNA, 20 nt, Artificial Sequence
  MKO10054691_A_Tmem256
  gRNA
cucuacaggcgcucaguuuc

SEQ ID NO: 54692 - RNA, 20 nt, Artificial Sequence
  MKO10054692_A_Tmem258
  gRNA
gggaagacagccggguucac

SEQ ID NO: 54693 - RNA, 20 nt, Artificial Sequence
  MKO10054693_A_Tmem258
  gRNA
guacaccagcccagugaacc

SEQ ID NO: 54694 - RNA, 20 nt, Artificial Sequence
  MKO10054694_A_Tmem258
  gRNA
guaaauaucgcguguguacu

SEQ ID NO: 54695 - RNA, 20 nt, Artificial Sequence
  MKO10054695_A_Tmem259
  gRNA
aggugcgccacaacucgagc

SEQ ID NO: 54696 - RNA, 20 nt, Artificial Sequence
  MKO10054696_A_Tmem259
  gRNA
uagagcauguucgagaucga

SEQ ID NO: 54697 - RNA, 20 nt, Artificial Sequence
  MKO10054697_A_Tmem259
  gRNA
cccaaagcacuggucccgcg

SEQ ID NO: 54698 - RNA, 20 nt, Artificial Sequence
  MKO10054698_A_Tmem25
  gRNA
agaaccuccugcaacccgac

SEQ ID NO: 54699 - RNA, 20 nt, Artificial Sequence
  MKO10054699_A_Tmem25
  gRNA
cugccacuccccgauuagcc

SEQ ID NO: 54700 - RNA, 20 nt, Artificial Sequence
  MKO10054700_A_Tmem25
  gRNA
cuuggcacacaaccucucgg

SEQ ID NO: 54701 - RNA, 20 nt, Artificial Sequence
  MKO10054701_A_Tmem260
  gRNA
cgguaggcgacggagccaaa

SEQ ID NO: 54702 - RNA, 20 nt, Artificial Sequence
  MKO10054702_A_Tmem260
  gRNA
cuuucucagauagcggccau

SEQ ID NO: 54703 - RNA, 20 nt, Artificial Sequence
  MKO10054703_A_Tmem260
  gRNA
uaccgcgucaaucuccucug

SEQ ID NO: 54704 - RNA, 20 nt, Artificial Sequence
  MKO10054704_A_Tmem261
  gRNA
cucgguacuccccgaaaaag

SEQ ID NO: 54705 - RNA, 20 nt, Artificial Sequence
  MKO10054705_A_Tmem261
  gRNA
ggccggcacggcggauuucg

SEQ ID NO: 54706 - RNA, 20 nt, Artificial Sequence
  MKO10054706_A_Tmem261
  gRNA
guuguucugguagaccccaa

SEQ ID NO: 54707 - RNA, 20 nt, Artificial Sequence
  MKO10054707_A_Tmem26
  gRNA
ucaacaucaugccgucccug

SEQ ID NO: 54708 - RNA, 20 nt, Artificial Sequence
  MKO10054708_A_Tmem26
  gRNA
cgguggcuucuccccauugg

SEQ ID NO: 54709 - RNA, 20 nt, Artificial Sequence
  MKO10054709_A_Tmem26
  gRNA
guccaaugauuaauauuagc

SEQ ID NO: 54710 - RNA, 20 nt, Artificial Sequence
  MKO10054710_A_Tmem27
  gRNA
cuggaauccggcaacgcaga

SEQ ID NO: 54711 - RNA, 20 nt, Artificial Sequence
  MKO10054711_A_Tmem27
  gRNA
cccgucuggauuauuguauu

SEQ ID NO: 54712 - RNA, 20 nt, Artificial Sequence
  MKO10054712_A_Tmem27
  gRNA
gucguucugguuugugguca

SEQ ID NO: 54713 - RNA, 20 nt, Artificial Sequence
  MKO10054713_A_Tmem28
  gRNA
cgacaaaccuugcgccgauu

SEQ ID NO: 54714 - RNA, 20 nt, Artificial Sequence
  MKO10054714_A_Tmem28
  gRNA
agcaccgcgcgaggagguac

SEQ ID NO: 54715 - RNA, 20 nt, Artificial Sequence
  MKO10054715_A_Tmem28
  gRNA
uggagaaggacacuacggua

SEQ ID NO: 54716 - RNA, 20 nt, Artificial Sequence
  MKO10054716_A_Tmem29
  gRNA
accgucccccucguucgaag

SEQ ID NO: 54717 - RNA, 20 nt, Artificial Sequence
  MKO10054717_A_Tmem29
  gRNA
aucggaggaucguccaucuu

SEQ ID NO: 54718 - RNA, 20 nt, Artificial Sequence
  MKO10054718_A_Tmem29
  gRNA
uucuuaauccucuucgaacg

SEQ ID NO: 54719 - RNA, 20 nt, Artificial Sequence
  MKO10054719_A_Tmem2
  gRNA
guuuacuccccaaccgaucc

SEQ ID NO: 54720 - RNA, 20 nt, Artificial Sequence
  MKO10054720_A_Tmem2
  gRNA
aagugcugacgucguccaac

SEQ ID NO: 54721 - RNA, 20 nt, Artificial Sequence
  MKO10054721_A_Tmem2
  gRNA
uuccggguggacauugcgga

SEQ ID NO: 54722 - RNA, 20 nt, Artificial Sequence
  MKO10054722_A_Tmem30a
  gRNA
auagcgccacauggcgcaau

SEQ ID NO: 54723 - RNA, 20 nt, Artificial Sequence
  MKO10054723_A_Tmem30a
  gRNA
gacagaccaauugcgccaug

SEQ ID NO: 54724 - RNA, 20 nt, Artificial Sequence
  MKO10054724_A_Tmem30a
  gRNA
aggcuugggaucagauucau

SEQ ID NO: 54725 - RNA, 20 nt, Artificial Sequence
  MKO10054725_A_Tmem30b
  gRNA
cggugcgauaggcagaccgu

SEQ ID NO: 54726 - RNA, 20 nt, Artificial Sequence
  MKO10054726_A_Tmem30b
  gRNA
gcucuaugcgcgcauccgcc

SEQ ID NO: 54727 - RNA, 20 nt, Artificial Sequence
  MKO10054727_A_Tmem30b
  gRNA
cgcugagcugcgcgucgucg

SEQ ID NO: 54728 - RNA, 20 nt, Artificial Sequence
  MKO10054728_A_Tmem30c
  gRNA
gugcgaauugcgcucagcuc

SEQ ID NO: 54729 - RNA, 20 nt, Artificial Sequence
  MKO10054729_A_Tmem30c
  gRNA
guaagcccacucuuuagcau

SEQ ID NO: 54730 - RNA, 20 nt, Artificial Sequence
  MKO10054730_A_Tmem30c
  gRNA
gaucauaccugcaaauguac

SEQ ID NO: 54731 - RNA, 20 nt, Artificial Sequence
  MKO10054731_A_Tmem33
  gRNA
auggcggauacgaccccgaa

SEQ ID NO: 54732 - RNA, 20 nt, Artificial Sequence
  MKO10054732_A_Tmem33
  gRNA
guucggggucguauccgcca

SEQ ID NO: 54733 - RNA, 20 nt, Artificial Sequence
  MKO10054733_A_Tmem33
  gRNA
augcucugaccagcgcucug

SEQ ID NO: 54734 - RNA, 20 nt, Artificial Sequence
  MKO10054734_A_Tmem35
  gRNA
acccggucgucccaaagaug

SEQ ID NO: 54735 - RNA, 20 nt, Artificial Sequence
  MKO10054735_A_Tmem35
  gRNA
ggaccaucaaguugaccccc

SEQ ID NO: 54736 - RNA, 20 nt, Artificial Sequence
  MKO10054736_A_Tmem35
  gRNA
cccacgaaccauaacuauca

SEQ ID NO: 54737 - RNA, 20 nt, Artificial Sequence
  MKO10054737_A_Tmem37
  gRNA
ucagguuaccugcgcgccga

SEQ ID NO: 54738 - RNA, 20 nt, Artificial Sequence
  MKO10054738_A_Tmem37
  gRNA
gagcgcagcaugacggccau

SEQ ID NO: 54739 - RNA, 20 nt, Artificial Sequence
  MKO10054739_A_Tmem37
  gRNA
uggcccacuugcgccgugag

SEQ ID NO: 54740 - RNA, 20 nt, Artificial Sequence
  MKO10054740_A_Tmem38a
  gRNA
ucgaagcaacuguuccacgu

SEQ ID NO: 54741 - RNA, 20 nt, Artificial Sequence
  MKO10054741_A_Tmem38a
  gRNA
cgaucaugaugaaccacccg

SEQ ID NO: 54742 - RNA, 20 nt, Artificial Sequence
  MKO10054742_A_Tmem38a
  gRNA
gaggguccgaaagaucgcug

SEQ ID NO: 54743 - RNA, 20 nt, Artificial Sequence
  MKO10054743_A_Tmem38b
  gRNA
gaucaugcuuugagaucgcc

SEQ ID NO: 54744 - RNA, 20 nt, Artificial Sequence
  MKO10054744_A_Tmem38b
  gRNA
uaucuuccucgugaccauaa

SEQ ID NO: 54745 - RNA, 20 nt, Artificial Sequence
  MKO10054745_A_Tmem38b
  gRNA
uagguugauaugaauaaccc

SEQ ID NO: 54746 - RNA, 20 nt, Artificial Sequence
  MKO10054746_A_Tmem39a
  gRNA
gccgccgaccaacgucugua

SEQ ID NO: 54747 - RNA, 20 nt, Artificial Sequence
  MKO10054747_A_Tmem39a
  gRNA
gccaguauaccucggaaaug

SEQ ID NO: 54748 - RNA, 20 nt, Artificial Sequence
  MKO10054748_A_Tmem39a
  gRNA
gaaauacucacggauagcca

SEQ ID NO: 54749 - RNA, 20 nt, Artificial Sequence
  MKO10054749_A_Tmem39b
  gRNA
gcagcguccguucucgaagc

SEQ ID NO: 54750 - RNA, 20 nt, Artificial Sequence
  MKO10054750_A_Tmem39b
  gRNA
guucugggccgccgauucau

SEQ ID NO: 54751 - RNA, 20 nt, Artificial Sequence
  MKO10054751_A_Tmem39b
  gRNA
uguugauguagugcacgaac

SEQ ID NO: 54752 - RNA, 20 nt, Artificial Sequence
  MKO10054752_A_Tmem40
  gRNA
guguguuaccacuacuaugc

SEQ ID NO: 54753 - RNA, 20 nt, Artificial Sequence
  MKO10054753_A_Tmem40
  gRNA
auauuuacccuccgcugagc

SEQ ID NO: 54754 - RNA, 20 nt, Artificial Sequence
  MKO10054754_A_Tmem40
  gRNA
aggccucaccugcauaguag

SEQ ID NO: 54755 - RNA, 20 nt, Artificial Sequence
  MKO10054755_A_Tmem41a
  gRNA
aaccaaagcgaccagggcga

SEQ ID NO: 54756 - RNA, 20 nt, Artificial Sequence
  MKO10054756_A_Tmem41a
  gRNA
cugaaguucuucgagaguac

SEQ ID NO: 54757 - RNA, 20 nt, Artificial Sequence
  MKO10054757_A_Tmem41a
  gRNA
aaaauuuagccagaagcgcc

SEQ ID NO: 54758 - RNA, 20 nt, Artificial Sequence
  MKO10054758_A_Tmem41b
  gRNA
aaccaauacuuguacauaaa

SEQ ID NO: 54759 - RNA, 20 nt, Artificial Sequence
  MKO10054759_A_Tmem41b
  gRNA
uauacuuacucacuaagcug

SEQ ID NO: 54760 - RNA, 20 nt, Artificial Sequence
  MKO10054760_A_Tmem41b
  gRNA
ugccuuauuccuuguuuguu

SEQ ID NO: 54761 - RNA, 20 nt, Artificial Sequence
  MKO10054761_A_Tmem42
  gRNA
cgcgaugcggcgccgcuucu

SEQ ID NO: 54762 - RNA, 20 nt, Artificial Sequence
  MKO10054762_A_Tmem42
  gRNA
uuacccgcucgccuacagaa

SEQ ID NO: 54763 - RNA, 20 nt, Artificial Sequence
  MKO10054763_A_Tmem42
  gRNA
cuccccaccauaagaucucc

SEQ ID NO: 54764 - RNA, 20 nt, Artificial Sequence
  MKO10054764_A_Tmem43
  gRNA
agccuaccuuggaaguccgc

SEQ ID NO: 54765 - RNA, 20 nt, Artificial Sequence
  MKO10054765_A_Tmem43
  gRNA
uaccagcugugaaacugcga

SEQ ID NO: 54766 - RNA, 20 nt, Artificial Sequence
  MKO10054766_A_Tmem43
  gRNA
cagccccucugcaagcgaug

SEQ ID NO: 54767 - RNA, 20 nt, Artificial Sequence
  MKO10054767_A_Tmem44
  gRNA
acgcagcgcacagugucgac

SEQ ID NO: 54768 - RNA, 20 nt, Artificial Sequence
  MKO10054768_A_Tmem44
  gRNA
cggugucacacagacucguu

SEQ ID NO: 54769 - RNA, 20 nt, Artificial Sequence
  MKO10054769_A_Tmem44
  gRNA
cuccguuguggcccacggac

SEQ ID NO: 54770 - RNA, 20 nt, Artificial Sequence
  MKO10054770_A_Tmem45a
  gRNA
ucauuucccgaccgugugug

SEQ ID NO: 54771 - RNA, 20 nt, Artificial Sequence
  MKO10054771_A_Tmem45a
  gRNA
gaagugcguuguucuuuacg

SEQ ID NO: 54772 - RNA, 20 nt, Artificial Sequence
  MKO10054772_A_Tmem45a
  gRNA
uuugugcuguaccccccuag

SEQ ID NO: 54773 - RNA, 20 nt, Artificial Sequence
  MKO10054773_A_Tmem45b
  gRNA
ccuucgggauaacaucgugc

SEQ ID NO: 54774 - RNA, 20 nt, Artificial Sequence
  MKO10054774_A_Tmem45b
  gRNA
gucccgagacaccgaagaau

SEQ ID NO: 54775 - RNA, 20 nt, Artificial Sequence
  MKO10054775_A_Tmem45b
  gRNA
uuacuuccacaucgugcccc

SEQ ID NO: 54776 - RNA, 20 nt, Artificial Sequence
  MKO10054776_A_Tmem47
  gRNA
cauaaccccaauugaacucg

SEQ ID NO: 54777 - RNA, 20 nt, Artificial Sequence
  MKO10054777_A_Tmem47
  gRNA
aaauuuaccacgaguucaau

SEQ ID NO: 54778 - RNA, 20 nt, Artificial Sequence
  MKO10054778_A_Tmem47
  gRNA
cgcccgggcauggcuucggc

SEQ ID NO: 54779 - RNA, 20 nt, Artificial Sequence
  MKO10054779_A_Tmem50a
  gRNA
aggauuaacgcaguaucgaa

SEQ ID NO: 54780 - RNA, 20 nt, Artificial Sequence
  MKO10054780_A_Tmem50a
  gRNA
acgcggcugucauguacccc

SEQ ID NO: 54781 - RNA, 20 nt, Artificial Sequence
  MKO10054781_A_Tmem50a
  gRNA
cgaggcgacagcuacagcga

SEQ ID NO: 54782 - RNA, 20 nt, Artificial Sequence
  MKO10054782_A_Tmem50b
  gRNA
gauaaugauugacgcggcag

SEQ ID NO: 54783 - RNA, 20 nt, Artificial Sequence
  MKO10054783_A_Tmem50b
  gRNA
aaccacgcuuuccacacgug

SEQ ID NO: 54784 - RNA, 20 nt, Artificial Sequence
  MKO10054784_A_Tmem50b
  gRNA
cccccgcaggugcucggguc

SEQ ID NO: 54785 - RNA, 20 nt, Artificial Sequence
  MKO10054785_A_Tmem51
  gRNA
ugcggauaagccaacgucuc

SEQ ID NO: 54786 - RNA, 20 nt, Artificial Sequence
  MKO10054786_A_Tmem51
  gRNA
guacuacguaccgagcuacg

SEQ ID NO: 54787 - RNA, 20 nt, Artificial Sequence
  MKO10054787_A_Tmem51
  gRNA
uccuccgccccuguacgaug

SEQ ID NO: 54788 - RNA, 20 nt, Artificial Sequence
  MKO10054788_A_Tmem52b
  gRNA
cgaagagcuuccucguagcc

SEQ ID NO: 54789 - RNA, 20 nt, Artificial Sequence
  MKO10054789_A_Tmem52b
  gRNA
ugauuuacccuccguuccag

SEQ ID NO: 54790 - RNA, 20 nt, Artificial Sequence
  MKO10054790_A_Tmem52b
  gRNA
gaugcacccagucaguaguc

SEQ ID NO: 54791 - RNA, 20 nt, Artificial Sequence
  MKO10054791_A_Tmem52
  gRNA
ugggaugacugucccgucac

SEQ ID NO: 54792 - RNA, 20 nt, Artificial Sequence
  MKO10054792_A_Tmem52
  gRNA
cagcuacuuacugauccgag

SEQ ID NO: 54793 - RNA, 20 nt, Artificial Sequence
  MKO10054793_A_Tmem52
  gRNA
guggcagcucagacgcauag

SEQ ID NO: 54794 - RNA, 20 nt, Artificial Sequence
  MKO10054794_A_Tmem53
  gRNA
ugggcuaucacgcgaaguga

SEQ ID NO: 54795 - RNA, 20 nt, Artificial Sequence
  MKO10054795_A_Tmem53
  gRNA
caugcucuaccgcuacgugc

SEQ ID NO: 54796 - RNA, 20 nt, Artificial Sequence
  MKO10054796_A_Tmem53
  gRNA
caccauggccucggccgagc

SEQ ID NO: 54797 - RNA, 20 nt, Artificial Sequence
  MKO10054797_A_Tmem54
  gRNA
gcacucacauaaauucgagu

SEQ ID NO: 54798 - RNA, 20 nt, Artificial Sequence
  MKO10054798_A_Tmem54
  gRNA
cgccaauagugcucuacccu

SEQ ID NO: 54799 - RNA, 20 nt, Artificial Sequence
  MKO10054799_A_Tmem54
  gRNA
auugcagccgccgugcucca

SEQ ID NO: 54800 - RNA, 20 nt, Artificial Sequence
  MKO10054800_A_Tmem55a
  gRNA
cuggaucggcaaugcagguu

SEQ ID NO: 54801 - RNA, 20 nt, Artificial Sequence
  MKO10054801_A_Tmem55a
  gRNA
agucgacgcauaauuaaccu

SEQ ID NO: 54802 - RNA, 20 nt, Artificial Sequence
  MKO10054802_A_Tmem55a
  gRNA
cacacacgacaguugaucac

SEQ ID NO: 54803 - RNA, 20 nt, Artificial Sequence
  MKO10054803_A_Tmem55b
  gRNA
cccacuauccgggcuaguca

SEQ ID NO: 54804 - RNA, 20 nt, Artificial Sequence
  MKO10054804_A_Tmem55b
  gRNA
acagacgcgacagguaauca

SEQ ID NO: 54805 - RNA, 20 nt, Artificial Sequence
  MKO10054805_A_Tmem55b
  gRNA
gucucuuaccaguagggccg

SEQ ID NO: 54806 - RNA, 20 nt, Artificial Sequence
  MKO10054806_A_Tmem56
  gRNA
augcaguuaguccugcgcaa

SEQ ID NO: 54807 - RNA, 20 nt, Artificial Sequence
  MKO10054807_A_Tmem56
  gRNA
ggcuggaaagcucggcaagc

SEQ ID NO: 54808 - RNA, 20 nt, Artificial Sequence
  MKO10054808_A_Tmem56
  gRNA
ccacuauaacugauccgcuc

SEQ ID NO: 54809 - RNA, 20 nt, Artificial Sequence
  MKO10054809_A_Tmem57
  gRNA
guccaguacguauggcacac

SEQ ID NO: 54810 - RNA, 20 nt, Artificial Sequence
  MKO10054810_A_Tmem57
  gRNA
caccugugugccauacguac

SEQ ID NO: 54811 - RNA, 20 nt, Artificial Sequence
  MKO10054811_A_Tmem57
  gRNA
gucgaccguuugcugcucac

SEQ ID NO: 54812 - RNA, 20 nt, Artificial Sequence
  MKO10054812_A_Tmem59l
  gRNA
ccgaagggagaggcgccccc

SEQ ID NO: 54813 - RNA, 20 nt, Artificial Sequence
  MKO10054813_A_Tmem59l
  gRNA
cgcuacagagcauggaaaac

SEQ ID NO: 54814 - RNA, 20 nt, Artificial Sequence
  MKO10054814_A_Tmem59l
  gRNA
cugcacagaagcuuacguga

SEQ ID NO: 54815 - RNA, 20 nt, Artificial Sequence
  MKO10054815_A_Tmem59
  gRNA
aauucaguaugcaccgcagu

SEQ ID NO: 54816 - RNA, 20 nt, Artificial Sequence
  MKO10054816_A_Tmem59
  gRNA
accagauucacauuccagcu

SEQ ID NO: 54817 - RNA, 20 nt, Artificial Sequence
  MKO10054817_A_Tmem59
  gRNA
ugacaagcauacugcucauc

SEQ ID NO: 54818 - RNA, 20 nt, Artificial Sequence
  MKO10054818_A_Tmem5
  gRNA
uaaaacagagcaguccgcuu

SEQ ID NO: 54819 - RNA, 20 nt, Artificial Sequence
  MKO10054819_A_Tmem5
  gRNA
acuuacguugcuacaccuaa

SEQ ID NO: 54820 - RNA, 20 nt, Artificial Sequence
  MKO10054820_A_Tmem5
  gRNA
ucauaacauaugacagcccc

SEQ ID NO: 54821 - RNA, 20 nt, Artificial Sequence
  MKO10054821_A_Tmem60
  gRNA
auauugugcgauccaugucg

SEQ ID NO: 54822 - RNA, 20 nt, Artificial Sequence
  MKO10054822_A_Tmem60
  gRNA
aaagccagacuuacaccguc

SEQ ID NO: 54823 - RNA, 20 nt, Artificial Sequence
  MKO10054823_A_Tmem60
  gRNA
ucuggcuuugacccucgaca

SEQ ID NO: 54824 - RNA, 20 nt, Artificial Sequence
  MKO10054824_A_Tmem62
  gRNA
agagcaucgccaauuauuac

SEQ ID NO: 54825 - RNA, 20 nt, Artificial Sequence
  MKO10054825_A_Tmem62
  gRNA
uuccgaacagaacuucucua

SEQ ID NO: 54826 - RNA, 20 nt, Artificial Sequence
  MKO10054826_A_Tmem62
  gRNA
ugcauauaacaucccaaguc

SEQ ID NO: 54827 - RNA, 20 nt, Artificial Sequence
  MKO10054827_A_Tmem63a
  gRNA
ggccagugacgaccagaucc

SEQ ID NO: 54828 - RNA, 20 nt, Artificial Sequence
  MKO10054828_A_Tmem63a
  gRNA
uacucacugcaggcggaaga

SEQ ID NO: 54829 - RNA, 20 nt, Artificial Sequence
  MKO10054829_A_Tmem63a
  gRNA
acaagacuuugaaaacgagc

SEQ ID NO: 54830 - RNA, 20 nt, Artificial Sequence
  MKO10054830_A_Tmem63b
  gRNA
uguccccaggcuucgccggc

SEQ ID NO: 54831 - RNA, 20 nt, Artificial Sequence
  MKO10054831_A_Tmem63b
  gRNA
gcucugucgacuuugaccaa

SEQ ID NO: 54832 - RNA, 20 nt, Artificial Sequence
  MKO10054832_A_Tmem63b
  gRNA
agguggccugggacuacggg

SEQ ID NO: 54833 - RNA, 20 nt, Artificial Sequence
  MKO10054833_A_Tmem63c
  gRNA
uuuccuuggaggcggaacgc

SEQ ID NO: 54834 - RNA, 20 nt, Artificial Sequence
  MKO10054834_A_Tmem63c
  gRNA
acaguuccaauguaguuaac

SEQ ID NO: 54835 - RNA, 20 nt, Artificial Sequence
  MKO10054835_A_Tmem63c
  gRNA
aagcugcgugggacuacggg

SEQ ID NO: 54836 - RNA, 20 nt, Artificial Sequence
  MKO10054836_A_Tmem64
  gRNA
gagcgccguuauccgcgucg

SEQ ID NO: 54837 - RNA, 20 nt, Artificial Sequence
  MKO10054837_A_Tmem64
  gRNA
uguaguccaucgcgcucaag

SEQ ID NO: 54838 - RNA, 20 nt, Artificial Sequence
  MKO10054838_A_Tmem64
  gRNA
cgcccugcucggcgccuauc

SEQ ID NO: 54839 - RNA, 20 nt, Artificial Sequence
  MKO10054839_A_Tmem65
  gRNA
cacaaugcgauaccuuucgu

SEQ ID NO: 54840 - RNA, 20 nt, Artificial Sequence
  MKO10054840_A_Tmem65
  gRNA
aaaaagccaaacccuacgaa

SEQ ID NO: 54841 - RNA, 20 nt, Artificial Sequence
  MKO10054841_A_Tmem65
  gRNA
aaucuuguuucagauuuagc

SEQ ID NO: 54842 - RNA, 20 nt, Artificial Sequence
  MKO10054842_A_Tmem66
  gRNA
guugugaggccuauaccccc

SEQ ID NO: 54843 - RNA, 20 nt, Artificial Sequence
  MKO10054843_A_Tmem66
  gRNA
ccgaccgcuacaccaccucc

SEQ ID NO: 54844 - RNA, 20 nt, Artificial Sequence
  MKO10054844_A_Tmem66
  gRNA
gugggaauguaagaccgacu

SEQ ID NO: 54845 - RNA, 20 nt, Artificial Sequence
  MKO10054845_A_Tmem67
  gRNA
auuguccuuacuaaagugug

SEQ ID NO: 54846 - RNA, 20 nt, Artificial Sequence
  MKO10054846_A_Tmem67
  gRNA
uuagagaucauaugauaucc

SEQ ID NO: 54847 - RNA, 20 nt, Artificial Sequence
  MKO10054847_A_Tmem67
  gRNA
cacaaagcucgcaaguugcu

SEQ ID NO: 54848 - RNA, 20 nt, Artificial Sequence
  MKO10054848_A_Tmem68
  gRNA
aaggcuucucgaacuccgcc

SEQ ID NO: 54849 - RNA, 20 nt, Artificial Sequence
  MKO10054849_A_Tmem68
  gRNA
agcagaagaauuagccgaaa

SEQ ID NO: 54850 - RNA, 20 nt, Artificial Sequence
  MKO10054850_A_Tmem68
  gRNA
guaaaguugcggaccuucuu

SEQ ID NO: 54851 - RNA, 20 nt, Artificial Sequence
  MKO10054851_A_Tmem69
  gRNA
uucuauuuaaucgggucucu

SEQ ID NO: 54852 - RNA, 20 nt, Artificial Sequence
  MKO10054852_A_Tmem69
  gRNA
gcuaucgaguagguaaguga

SEQ ID NO: 54853 - RNA, 20 nt, Artificial Sequence
  MKO10054853_A_Tmem69
  gRNA
aagaugcuccagaaacuuuc

SEQ ID NO: 54854 - RNA, 20 nt, Artificial Sequence
  MKO10054854_A_Tmem70
  gRNA
gcgcuagaugcccgccgcuc

SEQ ID NO: 54855 - RNA, 20 nt, Artificial Sequence
  MKO10054855_A_Tmem70
  gRNA
cuagcgcuagccgagucuug

SEQ ID NO: 54856 - RNA, 20 nt, Artificial Sequence
  MKO10054856_A_Tmem70
  gRNA
cuggaauugucacgucgucu

SEQ ID NO: 54857 - RNA, 20 nt, Artificial Sequence
  MKO10054857_A_Tmem71
  gRNA
ugcuccauagacccccugac

SEQ ID NO: 54858 - RNA, 20 nt, Artificial Sequence
  MKO10054858_A_Tmem71
  gRNA
gaugacuccaggucagacga

SEQ ID NO: 54859 - RNA, 20 nt, Artificial Sequence
  MKO10054859_A_Tmem71
  gRNA
acccccgagccucuaagucu

SEQ ID NO: 54860 - RNA, 20 nt, Artificial Sequence
  MKO10054860_A_Tmem72
  gRNA
gcagacccaagauacccuaa

SEQ ID NO: 54861 - RNA, 20 nt, Artificial Sequence
  MKO10054861_A_Tmem72
  gRNA
agcagcgucgugagcaccac

SEQ ID NO: 54862 - RNA, 20 nt, Artificial Sequence
  MKO10054862_A_Tmem72
  gRNA
gaauggucacaugccagacc

SEQ ID NO: 54863 - RNA, 20 nt, Artificial Sequence
  MKO10054863_A_Tmem74b
  gRNA
ggagauguacuacgcccgcu

SEQ ID NO: 54864 - RNA, 20 nt, Artificial Sequence
  MKO10054864_A_Tmem74b
  gRNA
acugggggcguuacccaguc

SEQ ID NO: 54865 - RNA, 20 nt, Artificial Sequence
  MKO10054865_A_Tmem74b
  gRNA
gcaaagaaagaucaucccgc

SEQ ID NO: 54866 - RNA, 20 nt, Artificial Sequence
  MKO10054866_A_Tmem74
  gRNA
cuuugcgaucagccauuacu

SEQ ID NO: 54867 - RNA, 20 nt, Artificial Sequence
  MKO10054867_A_Tmem74
  gRNA
ucauuucuuauaucgucccu

SEQ ID NO: 54868 - RNA, 20 nt, Artificial Sequence
  MKO10054868_A_Tmem74
  gRNA
caucagcgcuaucuuguucu

SEQ ID NO: 54869 - RNA, 20 nt, Artificial Sequence
  MKO10054869_A_Tmem79
  gRNA
cgcauccugcaucgcgacgc

SEQ ID NO: 54870 - RNA, 20 nt, Artificial Sequence
  MKO10054870_A_Tmem79
  gRNA
gccagacucaccgaguacga

SEQ ID NO: 54871 - RNA, 20 nt, Artificial Sequence
  MKO10054871_A_Tmem79
  gRNA
cucggucuguuuccgacuac

SEQ ID NO: 54872 - RNA, 20 nt, Artificial Sequence
  MKO10054872_A_Tmem80
  gRNA
caccgacugcugugaaugcc

SEQ ID NO: 54873 - RNA, 20 nt, Artificial Sequence
  MKO10054873_A_Tmem80
  gRNA
cagcuauccuuguaacuguc

SEQ ID NO: 54874 - RNA, 20 nt, Artificial Sequence
  MKO10054874_A_Tmem80
  gRNA
cagcaaugaccaccacuugc

SEQ ID NO: 54875 - RNA, 20 nt, Artificial Sequence
  MKO10054875_A_Tmem81
  gRNA
acuugcaucauaagcgggug

SEQ ID NO: 54876 - RNA, 20 nt, Artificial Sequence
  MKO10054876_A_Tmem81
  gRNA
cgucccagcguuauacucau

SEQ ID NO: 54877 - RNA, 20 nt, Artificial Sequence
  MKO10054877_A_Tmem81
  gRNA
ccagccuaugaguauaacgc

SEQ ID NO: 54878 - RNA, 20 nt, Artificial Sequence
  MKO10054878_A_Tmem82
  gRNA
gguagccgcccucgucgucu

SEQ ID NO: 54879 - RNA, 20 nt, Artificial Sequence
  MKO10054879_A_Tmem82
  gRNA
agcagcggcugagcgcgcaa

SEQ ID NO: 54880 - RNA, 20 nt, Artificial Sequence
  MKO10054880_A_Tmem82
  gRNA
gagcgggguccagaaucgca

SEQ ID NO: 54881 - RNA, 20 nt, Artificial Sequence
  MKO10054881_A_Tmem86a
  gRNA
auccucuacgccgcggccuu

SEQ ID NO: 54882 - RNA, 20 nt, Artificial Sequence
  MKO10054882_A_Tmem86a
  gRNA
cugacagcacuccgaucacc

SEQ ID NO: 54883 - RNA, 20 nt, Artificial Sequence
  MKO10054883_A_Tmem86a
  gRNA
cuuaaagaagggcaccaguu

SEQ ID NO: 54884 - RNA, 20 nt, Artificial Sequence
  MKO10054884_A_Tmem86b
  gRNA
ugaaguacccacagguccgc

SEQ ID NO: 54885 - RNA, 20 nt, Artificial Sequence
  MKO10054885_A_Tmem86b
  gRNA
gggucaggccaaaagccccg

SEQ ID NO: 54886 - RNA, 20 nt, Artificial Sequence
  MKO10054886_A_Tmem86b
  gRNA
acccaagauggcugguccac

SEQ ID NO: 54887 - RNA, 20 nt, Artificial Sequence
  MKO10054887_A_Tmem87a
  gRNA
ccaacacucaccgacggcau

SEQ ID NO: 54888 - RNA, 20 nt, Artificial Sequence
  MKO10054888_A_Tmem87a
  gRNA
ccguucccauuaucguuucu

SEQ ID NO: 54889 - RNA, 20 nt, Artificial Sequence
  MKO10054889_A_Tmem87a
  gRNA
gaaauaaucuugaugauguu

SEQ ID NO: 54890 - RNA, 20 nt, Artificial Sequence
  MKO10054890_A_Tmem87b
  gRNA
ggcuuaccguugauccuucc

SEQ ID NO: 54891 - RNA, 20 nt, Artificial Sequence
  MKO10054891_A_Tmem87b
  gRNA
ucacaaugauuacccugauc

SEQ ID NO: 54892 - RNA, 20 nt, Artificial Sequence
  MKO10054892_A_Tmem87b
  gRNA
ggauugcagcagugauucac

SEQ ID NO: 54893 - RNA, 20 nt, Artificial Sequence
  MKO10054893_A_Tmem88b
  gRNA
cgagcaccacgagcggcggc

SEQ ID NO: 54894 - RNA, 20 nt, Artificial Sequence
  MKO10054894_A_Tmem88b
  gRNA
cugcgcugccugaucccgcg

SEQ ID NO: 54895 - RNA, 20 nt, Artificial Sequence
  MKO10054895_A_Tmem88b
  gRNA
cacccaugcuaccccgaaga

SEQ ID NO: 54896 - RNA, 20 nt, Artificial Sequence
  MKO10054896_A_Tmem88
  gRNA
gcccagcgccccguucucgc

SEQ ID NO: 54897 - RNA, 20 nt, Artificial Sequence
  MKO10054897_A_Tmem88
  gRNA
cagcaaucuaggggaucccg

SEQ ID NO: 54898 - RNA, 20 nt, Artificial Sequence
  MKO10054898_A_Tmem88
  gRNA
caagcaacggcacgagcagu

SEQ ID NO: 54899 - RNA, 20 nt, Artificial Sequence
  MKO10054899_A_Tmem89
  gRNA
gccgugugauagugcaccga

SEQ ID NO: 54900 - RNA, 20 nt, Artificial Sequence
  MKO10054900_A_Tmem89
  gRNA
cacugucucagaccgcacgc

SEQ ID NO: 54901 - RNA, 20 nt, Artificial Sequence
  MKO10054901_A_Tmem89
  gRNA
aggaaaucgcaucuaccccg

SEQ ID NO: 54902 - RNA, 20 nt, Artificial Sequence
  MKO10054902_A_Tmem8b
  gRNA
cauucggagccgauacgugc

SEQ ID NO: 54903 - RNA, 20 nt, Artificial Sequence
  MKO10054903_A_Tmem8b
  gRNA
agugccgacgcgcucaccua

SEQ ID NO: 54904 - RNA, 20 nt, Artificial Sequence
  MKO10054904_A_Tmem8b
  gRNA
gcacuucugccguugcauug

SEQ ID NO: 54905 - RNA, 20 nt, Artificial Sequence
  MKO10054905_A_Tmem8c
  gRNA
cuucaugcgccgugacauuc

SEQ ID NO: 54906 - RNA, 20 nt, Artificial Sequence
  MKO10054906_A_Tmem8c
  gRNA
gggguauacuccggucccau

SEQ ID NO: 54907 - RNA, 20 nt, Artificial Sequence
  MKO10054907_A_Tmem8c
  gRNA
augaaaaguccgcacagcga

SEQ ID NO: 54908 - RNA, 20 nt, Artificial Sequence
  MKO10054908_A_Tmem8
  gRNA
gcccccacugugacacguac

SEQ ID NO: 54909 - RNA, 20 nt, Artificial Sequence
  MKO10054909_A_Tmem8
  gRNA
gcguggcucaagguguuguc

SEQ ID NO: 54910 - RNA, 20 nt, Artificial Sequence
  MKO10054910_A_Tmem8
  gRNA
gcaguuccaaccgaagcucc

SEQ ID NO: 54911 - RNA, 20 nt, Artificial Sequence
  MKO10054911_A_Tmem91
  gRNA
agggcaacuagggcgggucu

SEQ ID NO: 54912 - RNA, 20 nt, Artificial Sequence
  MKO10054912_A_Tmem91
  gRNA
acagcacagagaauaccgcc

SEQ ID NO: 54913 - RNA, 20 nt, Artificial Sequence
  MKO10054913_A_Tmem91
  gRNA
cucccgccgagcuuuccugc

SEQ ID NO: 54914 - RNA, 20 nt, Artificial Sequence
  MKO10054914_A_Tmem92
  gRNA
uaccuaaagcggucauuugc

SEQ ID NO: 54915 - RNA, 20 nt, Artificial Sequence
  MKO10054915_A_Tmem92
  gRNA
auccugcaaaugaccgcuuu

SEQ ID NO: 54916 - RNA, 20 nt, Artificial Sequence
  MKO10054916_A_Tmem92
  gRNA
uagggcacagaugaacaaaa

SEQ ID NO: 54917 - RNA, 20 nt, Artificial Sequence
  MKO10054917_A_Tmem95
  gRNA
agacuccuccuugcccucgc

SEQ ID NO: 54918 - RNA, 20 nt, Artificial Sequence
  MKO10054918_A_Tmem95
  gRNA
guacaacugcuccaccugcg

SEQ ID NO: 54919 - RNA, 20 nt, Artificial Sequence
  MKO10054919_A_Tmem95
  gRNA
caauaccuucccugguguac

SEQ ID NO: 54920 - RNA, 20 nt, Artificial Sequence
  MKO10054920_A_Tmem97
  gRNA
caccuccugcggguauaguu

SEQ ID NO: 54921 - RNA, 20 nt, Artificial Sequence
  MKO10054921_A_Tmem97
  gRNA
ccuuugaguaccaccgcaac

SEQ ID NO: 54922 - RNA, 20 nt, Artificial Sequence
  MKO10054922_A_Tmem97
  gRNA
acuguaccaaccuuugaaga

SEQ ID NO: 54923 - RNA, 20 nt, Artificial Sequence
  MKO10054923_A_Tmem98
  gRNA
uggccaaacggauuagcccc

SEQ ID NO: 54924 - RNA, 20 nt, Artificial Sequence
  MKO10054924_A_Tmem98
  gRNA
gcagucugaacccuccgagc

SEQ ID NO: 54925 - RNA, 20 nt, Artificial Sequence
  MKO10054925_A_Tmem98
  gRNA
ucaccuggggcuaauccguu

SEQ ID NO: 54926 - RNA, 20 nt, Artificial Sequence
  MKO10054926_A_Tmem9b
  gRNA
gcaugggcuccacgacauga

SEQ ID NO: 54927 - RNA, 20 nt, Artificial Sequence
  MKO10054927_A_Tmem9b
  gRNA
cagugauugccuucaugucg

SEQ ID NO: 54928 - RNA, 20 nt, Artificial Sequence
  MKO10054928_A_Tmem9b
  gRNA
guccaaagaggcgccucuuc

SEQ ID NO: 54929 - RNA, 20 nt, Artificial Sequence
  MKO10054929_A_Tmem9
  gRNA
ugcugguggacccgcucauc

SEQ ID NO: 54930 - RNA, 20 nt, Artificial Sequence
  MKO10054930_A_Tmem9
  gRNA
cguaccuacacucgcagagc

SEQ ID NO: 54931 - RNA, 20 nt, Artificial Sequence
  MKO10054931_A_Tmem9
  gRNA
gagcgccuuccacccgcucc

SEQ ID NO: 54932 - RNA, 20 nt, Artificial Sequence
  MKO10054932_A_Tmf1
  gRNA
cgaagucucuugccucgaac

SEQ ID NO: 54933 - RNA, 20 nt, Artificial Sequence
  MKO10054933_A_Tmf1
  gRNA
ugaaugguaugggcauccga

SEQ ID NO: 54934 - RNA, 20 nt, Artificial Sequence
  MKO10054934_A_Tmf1
  gRNA
ggaagcguaugauaaccuga

SEQ ID NO: 54935 - RNA, 20 nt, Artificial Sequence
  MKO10054935_A_Tmie
  gRNA
ucgaucuccuuccgcguccg

SEQ ID NO: 54936 - RNA, 20 nt, Artificial Sequence
  MKO10054936_A_Tmie
  gRNA
acggacgcggaaggagaucg

SEQ ID NO: 54937 - RNA, 20 nt, Artificial Sequence
  MKO10054937_A_Tmie
  gRNA
ggcgggugucgccacgcagc

SEQ ID NO: 54938 - RNA, 20 nt, Artificial Sequence
  MKO10054938_A_Tmigd1
  gRNA
cugaucgcgcuguagcuugc

SEQ ID NO: 54939 - RNA, 20 nt, Artificial Sequence
  MKO10054939_A_Tmigd1
  gRNA
caagcuacagcgcgaucaga

SEQ ID NO: 54940 - RNA, 20 nt, Artificial Sequence
  MKO10054940_A_Tmigd1
  gRNA
uaccacaucauuugcgcuug

SEQ ID NO: 54941 - RNA, 20 nt, Artificial Sequence
  MKO10054941_A_Tmlhe
  gRNA
cuccguaauuugaugaagag

SEQ ID NO: 54942 - RNA, 20 nt, Artificial Sequence
  MKO10054942_A_Tmlhe
  gRNA
ugaugcgcuuugauuauguc

SEQ ID NO: 54943 - RNA, 20 nt, Artificial Sequence
  MKO10054943_A_Tmlhe
  gRNA
ccccuagaacugcaauaugc

SEQ ID NO: 54944 - RNA, 20 nt, Artificial Sequence
  MKO10054944_A_Tmod1
  gRNA
gcagaacugugugacaucgc

SEQ ID NO: 54945 - RNA, 20 nt, Artificial Sequence
  MKO10054945_A_Tmod1
  gRNA
gaagccaauggaucccgugc

SEQ ID NO: 54946 - RNA, 20 nt, Artificial Sequence
  MKO10054946_A_Tmod1
  gRNA
gagccccuccuuguucacga

SEQ ID NO: 54947 - RNA, 20 nt, Artificial Sequence
  MKO10054947_A_Tmod2
  gRNA
acugaacucuacgaccuugc

SEQ ID NO: 54948 - RNA, 20 nt, Artificial Sequence
  MKO10054948_A_Tmod2
  gRNA
ccccuugcgaccuucgccgu

SEQ ID NO: 54949 - RNA, 20 nt, Artificial Sequence
  MKO10054949_A_Tmod2
  gRNA
agcagguguucucggucaaa

SEQ ID NO: 54950 - RNA, 20 nt, Artificial Sequence
  MKO10054950_A_Tmod3
  gRNA
acucacugggaaaacgcucu

SEQ ID NO: 54951 - RNA, 20 nt, Artificial Sequence
  MKO10054951_A_Tmod3
  gRNA
cuuuaaacucucuucaacgu

SEQ ID NO: 54952 - RNA, 20 nt, Artificial Sequence
  MKO10054952_A_Tmod3
  gRNA
cacaccguucugugaugugc

SEQ ID NO: 54953 - RNA, 20 nt, Artificial Sequence
  MKO10054953_A_Tmod4
  gRNA
ggugaaccucaauaauaucc

SEQ ID NO: 54954 - RNA, 20 nt, Artificial Sequence
  MKO10054954_A_Tmod4
  gRNA
agaugcccuauugcaguacc

SEQ ID NO: 54955 - RNA, 20 nt, Artificial Sequence
  MKO10054955_A_Tmod4
  gRNA
agcguaaucuguuccugugc

SEQ ID NO: 54956 - RNA, 20 nt, Artificial Sequence
  MKO10054956_A_Tmpo
  gRNA
uuacccugccgacggcgccg

SEQ ID NO: 54957 - RNA, 20 nt, Artificial Sequence
  MKO10054957_A_Tmpo
  gRNA
gcccgacuucucgagcgacg

SEQ ID NO: 54958 - RNA, 20 nt, Artificial Sequence
  MKO10054958_A_Tmpo
  gRNA
uaauauccgugcugccucga

SEQ ID NO: 54959 - RNA, 20 nt, Artificial Sequence
  MKO10054959_A_Tmppe
  gRNA
gugauuacccgugacgaagu

SEQ ID NO: 54960 - RNA, 20 nt, Artificial Sequence
  MKO10054960_A_Tmppe
  gRNA
caaacgucgccuugcccacu

SEQ ID NO: 54961 - RNA, 20 nt, Artificial Sequence
  MKO10054961_A_Tmppe
  gRNA
ccuacuaugggauacccaug

SEQ ID NO: 54962 - RNA, 20 nt, Artificial Sequence
  MKO10054962_A_Tmprss11a
  gRNA
cauacguuaguccgacuacg

SEQ ID NO: 54963 - RNA, 20 nt, Artificial Sequence
  MKO10054963_A_Tmprss11a
  gRNA
uacgguucuucgcccuguag

SEQ ID NO: 54964 - RNA, 20 nt, Artificial Sequence
  MKO10054964_A_Tmprss11a
  gRNA
uacaucaaaaaccacguagu

SEQ ID NO: 54965 - RNA, 20 nt, Artificial Sequence
  MKO10054965_A_Tmprss11bnl
  gRNA
gcugucacgcuguuguuauc

SEQ ID NO: 54966 - RNA, 20 nt, Artificial Sequence
  MKO10054966_A_Tmprss11bnl
  gRNA
aacaagaucuacuacuauca

SEQ ID NO: 54967 - RNA, 20 nt, Artificial Sequence
  MKO10054967_A_Tmprss11bnl
  gRNA
aagcaucuuacgucagaugc

SEQ ID NO: 54968 - RNA, 20 nt, Artificial Sequence
  MKO10054968_A_Tmprss11c
  gRNA
cuuaccacaggcggcaaaau

SEQ ID NO: 54969 - RNA, 20 nt, Artificial Sequence
  MKO10054969_A_Tmprss11c
  gRNA
gcaccgccguuaagaugccc

SEQ ID NO: 54970 - RNA, 20 nt, Artificial Sequence
  MKO10054970_A_Tmprss11c
  gRNA
agucuauaaguaauccaguu

SEQ ID NO: 54971 - RNA, 20 nt, Artificial Sequence
  MKO10054971_A_Tmprss11d
  gRNA
ccuaaacguugaauacacug

SEQ ID NO: 54972 - RNA, 20 nt, Artificial Sequence
  MKO10054972_A_Tmprss11d
  gRNA
ccucaguguauucaacguuu

SEQ ID NO: 54973 - RNA, 20 nt, Artificial Sequence
  MKO10054973_A_Tmprss11d
  gRNA
cagauuacugaugaauuucg

SEQ ID NO: 54974 - RNA, 20 nt, Artificial Sequence
  MKO10054974_A_Tmprss11e
  gRNA
uugacaaguuguccccguag

SEQ ID NO: 54975 - RNA, 20 nt, Artificial Sequence
  MKO10054975_A_Tmprss11e
  gRNA
caacgugcuguaguaauugu

SEQ ID NO: 54976 - RNA, 20 nt, Artificial Sequence
  MKO10054976_A_Tmprss11e
  gRNA
ugcacacugccaagacaauc

SEQ ID NO: 54977 - RNA, 20 nt, Artificial Sequence
  MKO10054977_A_Tmprss11f
  gRNA
aggauauuccgacguucuuc

SEQ ID NO: 54978 - RNA, 20 nt, Artificial Sequence
  MKO10054978_A_Tmprss11f
  gRNA
gugaacagagcuagucguau

SEQ ID NO: 54979 - RNA, 20 nt, Artificial Sequence
  MKO10054979_A_Tmprss11f
  gRNA
gcaaucguaggaaucacaau

SEQ ID NO: 54980 - RNA, 20 nt, Artificial Sequence
  MKO10054980_A_Tmprss11g
  gRNA
ugccuuuaccccaucguuac

SEQ ID NO: 54981 - RNA, 20 nt, Artificial Sequence
  MKO10054981_A_Tmprss11g
  gRNA
ucagauuccccguaagaaug

SEQ ID NO: 54982 - RNA, 20 nt, Artificial Sequence
  MKO10054982_A_Tmprss11g
  gRNA
ccgaaauuucgacugcucuu

SEQ ID NO: 54983 - RNA, 20 nt, Artificial Sequence
  MKO10054983_A_Tmprss12
  gRNA
caucaaccgccuguuuaaua

SEQ ID NO: 54984 - RNA, 20 nt, Artificial Sequence
  MKO10054984_A_Tmprss12
  gRNA
uaucgccaucuugaaccugc

SEQ ID NO: 54985 - RNA, 20 nt, Artificial Sequence
  MKO10054985_A_Tmprss12
  gRNA
guggaagggucucggauuau

SEQ ID NO: 54986 - RNA, 20 nt, Artificial Sequence
  MKO10054986_A_Tmprss13
  gRNA
aggaugacacacccgaugag

SEQ ID NO: 54987 - RNA, 20 nt, Artificial Sequence
  MKO10054987_A_Tmprss13
  gRNA
cuaacaagguacacucucgu

SEQ ID NO: 54988 - RNA, 20 nt, Artificial Sequence
  MKO10054988_A_Tmprss13
  gRNA
guucugcagucagguucgac

SEQ ID NO: 54989 - RNA, 20 nt, Artificial Sequence
  MKO10054989_A_Tmprss15
  gRNA
aauucaucuagaugcagccc

SEQ ID NO: 54990 - RNA, 20 nt, Artificial Sequence
  MKO10054990_A_Tmprss15
  gRNA
uuggauuaauugcagugucc

SEQ ID NO: 54991 - RNA, 20 nt, Artificial Sequence
  MKO10054991_A_Tmprss15
  gRNA
agauuccuugacugcaagcc

SEQ ID NO: 54992 - RNA, 20 nt, Artificial Sequence
  MKO10054992_A_Tmprss2
  gRNA
ucauagcaagguccgauucc

SEQ ID NO: 54993 - RNA, 20 nt, Artificial Sequence
  MKO10054993_A_Tmprss2
  gRNA
ccuucaacaguucgucucua

SEQ ID NO: 54994 - RNA, 20 nt, Artificial Sequence
  MKO10054994_A_Tmprss2
  gRNA
gcuguguuuagcccucgccc

SEQ ID NO: 54995 - RNA, 20 nt, Artificial Sequence
  MKO10054995_A_Tmprss3
  gRNA
gaacuaacagcucgaugcga

SEQ ID NO: 54996 - RNA, 20 nt, Artificial Sequence
  MKO10054996_A_Tmprss3
  gRNA
caucgccuugauacuggcgc

SEQ ID NO: 54997 - RNA, 20 nt, Artificial Sequence
  MKO10054997_A_Tmprss3
  gRNA
acuucccagagcagucgaag

SEQ ID NO: 54998 - RNA, 20 nt, Artificial Sequence
  MKO10054998_A_Tmprss4
  gRNA
ggccuucgggguuugcgaaa

SEQ ID NO: 54999 - RNA, 20 nt, Artificial Sequence
  MKO10054999_A_Tmprss4
  gRNA
ccugauagcccucgugauug

SEQ ID NO: 55000 - RNA, 20 nt, Artificial Sequence
  MKO10055000_A_Tmprss4
  gRNA
ggccaccuugacugcgccuc

SEQ ID NO: 55001 - RNA, 20 nt, Artificial Sequence
  MKO10055001_A_Tmprss5
  gRNA
guauaacacagccacguugc

SEQ ID NO: 55002 - RNA, 20 nt, Artificial Sequence
  MKO10055002_A_Tmprss5
  gRNA
gcaacguggcuguguuauac

SEQ ID NO: 55003 - RNA, 20 nt, Artificial Sequence
  MKO10055003_A_Tmprss5
  gRNA
uccagcccucguggcagacc

SEQ ID NO: 55004 - RNA, 20 nt, Artificial Sequence
  MKO10055004_A_Tmprss6
  gRNA
aggagcucgcgcacuacuuc

SEQ ID NO: 55005 - RNA, 20 nt, Artificial Sequence
  MKO10055005_A_Tmprss6
  gRNA
uuccggguccaccucauauu

SEQ ID NO: 55006 - RNA, 20 nt, Artificial Sequence
  MKO10055006_A_Tmprss6
  gRNA
agucguacugaauuccacgc

SEQ ID NO: 55007 - RNA, 20 nt, Artificial Sequence
  MKO10055007_A_Tmprss7
  gRNA
agaccaccucgaaaacccau

SEQ ID NO: 55008 - RNA, 20 nt, Artificial Sequence
  MKO10055008_A_Tmprss7
  gRNA
uaucauaaaccgcacuucug

SEQ ID NO: 55009 - RNA, 20 nt, Artificial Sequence
  MKO10055009_A_Tmprss7
  gRNA
guagagccauagaagugucc

SEQ ID NO: 55010 - RNA, 20 nt, Artificial Sequence
  MKO10055010_A_Tmprss9
  gRNA
aucgugucagucgagcugac

SEQ ID NO: 55011 - RNA, 20 nt, Artificial Sequence
  MKO10055011_A_Tmprss9
  gRNA
gaguuagagucgagcugcgc

SEQ ID NO: 55012 - RNA, 20 nt, Artificial Sequence
  MKO10055012_A_Tmprss9
  gRNA
ugucagcucgacugacacga

SEQ ID NO: 55013 - RNA, 20 nt, Artificial Sequence
  MKO10055013_A_Tmsb10
  gRNA
ucccuucgcagccauugaac

SEQ ID NO: 55014 - RNA, 20 nt, Artificial Sequence
  MKO10055014_A_Tmsb10
  gRNA
gcacacuuacucucuuuggu

SEQ ID NO: 55015 - RNA, 20 nt, Artificial Sequence
  MKO10055015_A_Tmsb10
  gRNA
uaagaaaauggcagacaagc

SEQ ID NO: 55016 - RNA, 20 nt, Artificial Sequence
  MKO10055016_A_Tmsb15a
  gRNA
aaacuccuucucuugcucga

SEQ ID NO: 55017 - RNA, 20 nt, Artificial Sequence
  MKO10055017_A_Tmsb15a
  gRNA
gggugauagaccagacuugu

SEQ ID NO: 55018 - RNA, 20 nt, Artificial Sequence
  MKO10055018_A_Tmsb15a
  gRNA
aaaaaauacucugcccucga

SEQ ID NO: 55019 - RNA, 20 nt, Artificial Sequence
  MKO10055019_A_Tmsb15b1
  gRNA
caugacuuacuuucauucga

SEQ ID NO: 55020 - RNA, 20 nt, Artificial Sequence
  MKO10055020_A_Tmsb15b1
  gRNA
cauuauguucuuucucuugc

SEQ ID NO: 55021 - RNA, 20 nt, Artificial Sequence
  MKO10055021_A_Tmsb15b2
  gRNA
aaaaaauacucuuccgucga

SEQ ID NO: 55022 - RNA, 20 nt, Artificial Sequence
  MKO10055022_A_Tmsb15b2
  gRNA
caugacuuacuuuccuucga

SEQ ID NO: 55023 - RNA, 20 nt, Artificial Sequence
  MKO10055023_A_Tmsb15l
  gRNA
aaaaaauacucuuccgucga

SEQ ID NO: 55024 - RNA, 20 nt, Artificial Sequence
  MKO10055024_A_Tmsb15l
  gRNA
caugacuuacuuucauucga

SEQ ID NO: 55025 - RNA, 20 nt, Artificial Sequence
  MKO10055025_A_Tmsb15l
  gRNA
caugacuuacuuuccuucga

SEQ ID NO: 55026 - RNA, 20 nt, Artificial Sequence
  MKO10055026_A_Tmsb4x
  gRNA
caugucugacaaacccgaua

SEQ ID NO: 55027 - RNA, 20 nt, Artificial Sequence
  MKO10055027_A_Tmsb4x
  gRNA
uuucucgaucucagccauau

SEQ ID NO: 55028 - RNA, 20 nt, Artificial Sequence
  MKO10055028_A_Tmuc1
  gRNA
guagaaugacauugaccgcg

SEQ ID NO: 55029 - RNA, 20 nt, Artificial Sequence
  MKO10055029_A_Tmuc1
  gRNA
uuauacucaccgccucagug

SEQ ID NO: 55030 - RNA, 20 nt, Artificial Sequence
  MKO10055030_A_Tmuc1
  gRNA
ccaugucgccgagagcuaug

SEQ ID NO: 55031 - RNA, 20 nt, Artificial Sequence
  MKO10055031_A_Tmuc2
  gRNA
aggacuuguggcuaccgcug

SEQ ID NO: 55032 - RNA, 20 nt, Artificial Sequence
  MKO10055032_A_Tmuc2
  gRNA
cccuccuuggggacggauac

SEQ ID NO: 55033 - RNA, 20 nt, Artificial Sequence
  MKO10055033_A_Tmuc2
  gRNA
cuccaacuccgacaaccccg

SEQ ID NO: 55034 - RNA, 20 nt, Artificial Sequence
  MKO10055034_A_Tmuc3
  gRNA
ccguacuuacugccucggua

SEQ ID NO: 55035 - RNA, 20 nt, Artificial Sequence
  MKO10055035_A_Tmuc3
  gRNA
agugacuuuaauagucagcg

SEQ ID NO: 55036 - RNA, 20 nt, Artificial Sequence
  MKO10055036_A_Tmuc3
  gRNA
agugcacccaauccauaccg

SEQ ID NO: 55037 - RNA, 20 nt, Artificial Sequence
  MKO10055037_A_Tmuc4
  gRNA
ggccuuuaccgguguacugu

SEQ ID NO: 55038 - RNA, 20 nt, Artificial Sequence
  MKO10055038_A_Tmuc4
  gRNA
aggauuaacuacuaccuguc

SEQ ID NO: 55039 - RNA, 20 nt, Artificial Sequence
  MKO10055039_A_Tmuc4
  gRNA
ccccaaggggcgugucugac

SEQ ID NO: 55040 - RNA, 20 nt, Artificial Sequence
  MKO10055040_A_Tmub1
  gRNA
gaggcacuacggccgauaca

SEQ ID NO: 55041 - RNA, 20 nt, Artificial Sequence
  MKO10055041_A_Tmub1
  gRNA
ugccacguguccacgagagu

SEQ ID NO: 55042 - RNA, 20 nt, Artificial Sequence
  MKO10055042_A_Tmub1
  gRNA
aacaccuccagacucuccgc

SEQ ID NO: 55043 - RNA, 20 nt, Artificial Sequence
  MKO10055043_A_Tmub2
  gRNA
gguuuaccagcugguccaca

SEQ ID NO: 55044 - RNA, 20 nt, Artificial Sequence
  MKO10055044_A_Tmub2
  gRNA
cagucgcccagaagccccgc

SEQ ID NO: 55045 - RNA, 20 nt, Artificial Sequence
  MKO10055045_A_Tmub2
  gRNA
ggcugcccacguugacacca

SEQ ID NO: 55046 - RNA, 20 nt, Artificial Sequence
  MKO10055046_A_Tmx1
  gRNA
uuaggcgcuaugugggccca

SEQ ID NO: 55047 - RNA, 20 nt, Artificial Sequence
  MKO10055047_A_Tmx1
  gRNA
cauuuguaggacuaagugga

SEQ ID NO: 55048 - RNA, 20 nt, Artificial Sequence
  MKO10055048_A_Tmx1
  gRNA
ggcugaagauucugacaagc

SEQ ID NO: 55049 - RNA, 20 nt, Artificial Sequence
  MKO10055049_A_Tmx2
  gRNA
gucacuguggagcaacaugu

SEQ ID NO: 55050 - RNA, 20 nt, Artificial Sequence
  MKO10055050_A_Tmx2
  gRNA
cuauaccucacacucugcau

SEQ ID NO: 55051 - RNA, 20 nt, Artificial Sequence
  MKO10055051_A_Tmx2
  gRNA
uuggcaaucauuagaccagu

SEQ ID NO: 55052 - RNA, 20 nt, Artificial Sequence
  MKO10055052_A_Tmx3
  gRNA
uuguguaguucuaugcaccc

SEQ ID NO: 55053 - RNA, 20 nt, Artificial Sequence
  MKO10055053_A_Tmx3
  gRNA
auaaucgaaaagaugacauu

SEQ ID NO: 55054 - RNA, 20 nt, Artificial Sequence
  MKO10055054_A_Tmx3
  gRNA
agcccaacuucauuccaaau

SEQ ID NO: 55055 - RNA, 20 nt, Artificial Sequence
  MKO10055055_A_Tmx4
  gRNA
uuccgccguuaccguggucc

SEQ ID NO: 55056 - RNA, 20 nt, Artificial Sequence
  MKO10055056_A_Tmx4
  gRNA
cccauucagaaucagucugc

SEQ ID NO: 55057 - RNA, 20 nt, Artificial Sequence
  MKO10055057_A_Tmx4
  gRNA
auaacuuacguuagagaggc

SEQ ID NO: 55058 - RNA, 20 nt, Artificial Sequence
  MKO10055058_A_Tnc
  gRNA
cccaacgacugcuucgaccg

SEQ ID NO: 55059 - RNA, 20 nt, Artificial Sequence
  MKO10055059_A_Tnc
  gRNA
cccgccgauugucaccaccg

SEQ ID NO: 55060 - RNA, 20 nt, Artificial Sequence
  MKO10055060_A_Tnc
  gRNA
gagaccuccuaccgccaaac

SEQ ID NO: 55061 - RNA, 20 nt, Artificial Sequence
  MKO10055061_A_Tnfaip1
  gRNA
uggauucucauagaccgaug

SEQ ID NO: 55062 - RNA, 20 nt, Artificial Sequence
  MKO10055062_A_Tnfaip1
  gRNA
aucucggagguaauucaaga

SEQ ID NO: 55063 - RNA, 20 nt, Artificial Sequence
  MKO10055063_A_Tnfaip1
  gRNA
cauccuugaugaagagcacg

SEQ ID NO: 55064 - RNA, 20 nt, Artificial Sequence
  MKO10055064_A_Tnfaip2
  gRNA
gcgcacgacguugaacucgu

SEQ ID NO: 55065 - RNA, 20 nt, Artificial Sequence
  MKO10055065_A_Tnfaip2
  gRNA
gcuagccguggugucgcagg

SEQ ID NO: 55066 - RNA, 20 nt, Artificial Sequence
  MKO10055066_A_Tnfaip2
  gRNA
ugguaccuggagaaugucga

SEQ ID NO: 55067 - RNA, 20 nt, Artificial Sequence
  MKO10055067_A_Tnfaip3
  gRNA
cugucauagccuaggacgau

SEQ ID NO: 55068 - RNA, 20 nt, Artificial Sequence
  MKO10055068_A_Tnfaip3
  gRNA
uacagauaucccaucguccu

SEQ ID NO: 55069 - RNA, 20 nt, Artificial Sequence
  MKO10055069_A_Tnfaip3
  gRNA
ccguggucccagccuugcac

SEQ ID NO: 55070 - RNA, 20 nt, Artificial Sequence
  MKO10055070_A_Tnfaip6
  gRNA
gcucaccuacgccgaagcca

SEQ ID NO: 55071 - RNA, 20 nt, Artificial Sequence
  MKO10055071_A_Tnfaip6
  gRNA
aaaacggguaucaucgauua

SEQ ID NO: 55072 - RNA, 20 nt, Artificial Sequence
  MKO10055072_A_Tnfaip6
  gRNA
gggguauccgacucuacccu

SEQ ID NO: 55073 - RNA, 20 nt, Artificial Sequence
  MKO10055073_A_Tnfaip8l1
  gRNA
ccucguccaacauccucccg

SEQ ID NO: 55074 - RNA, 20 nt, Artificial Sequence
  MKO10055074_A_Tnfaip8l1
  gRNA
gcgugaacuccuucguggcc

SEQ ID NO: 55075 - RNA, 20 nt, Artificial Sequence
  MKO10055075_A_Tnfaip8l1
  gRNA
caccuuugaccggcgugugc

SEQ ID NO: 55076 - RNA, 20 nt, Artificial Sequence
  MKO10055076_A_Tnfaip8l2
  gRNA
caggucugcucgucgagugc

SEQ ID NO: 55077 - RNA, 20 nt, Artificial Sequence
  MKO10055077_A_Tnfaip8l2
  gRNA
gucgauaaagagaugcgcca

SEQ ID NO: 55078 - RNA, 20 nt, Artificial Sequence
  MKO10055078_A_Tnfaip8l2
  gRNA
ccaagucacaugaccgcauc

SEQ ID NO: 55079 - RNA, 20 nt, Artificial Sequence
  MKO10055079_A_Tnfaip8l3
  gRNA
agagagcacauucguaucaa

SEQ ID NO: 55080 - RNA, 20 nt, Artificial Sequence
  MKO10055080_A_Tnfaip8l3
  gRNA
uccacucucuaugguccgca

SEQ ID NO: 55081 - RNA, 20 nt, Artificial Sequence
  MKO10055081_A_Tnfaip8l3
  gRNA
gagcagagcgagggcgagcc

SEQ ID NO: 55082 - RNA, 20 nt, Artificial Sequence
  MKO10055082_A_Tnfaip8
  gRNA
gcuugaugaccgucuugaug

SEQ ID NO: 55083 - RNA, 20 nt, Artificial Sequence
  MKO10055083_A_Tnfaip8
  gRNA
gucgaucagcgugguggcga

SEQ ID NO: 55084 - RNA, 20 nt, Artificial Sequence
  MKO10055084_A_Tnfaip8
  gRNA
cgacagcaugcucuccgaag

SEQ ID NO: 55085 - RNA, 20 nt, Artificial Sequence
  MKO10055085_A_Tnfrsf10b
  gRNA
guaggccagcuggacgauua

SEQ ID NO: 55086 - RNA, 20 nt, Artificial Sequence
  MKO10055086_A_Tnfrsf10b
  gRNA
ccagcccauaaucguccagc

SEQ ID NO: 55087 - RNA, 20 nt, Artificial Sequence
  MKO10055087_A_Tnfrsf10b
  gRNA
gcaucgacacaccguauuug

SEQ ID NO: 55088 - RNA, 20 nt, Artificial Sequence
  MKO10055088_A_Tnfrsf11a
  gRNA
caaguacucaucggggccac

SEQ ID NO: 55089 - RNA, 20 nt, Artificial Sequence
  MKO10055089_A_Tnfrsf11a
  gRNA
ccgaugaguacuuggacacc

SEQ ID NO: 55090 - RNA, 20 nt, Artificial Sequence
  MKO10055090_A_Tnfrsf11a
  gRNA
gccgugcaagcacagcgacg

SEQ ID NO: 55091 - RNA, 20 nt, Artificial Sequence
  MKO10055091_A_Tnfrsf11b
  gRNA
cuuaccagcuugcaccacgc

SEQ ID NO: 55092 - RNA, 20 nt, Artificial Sequence
  MKO10055092_A_Tnfrsf11b
  gRNA
gcgguugcacuccugcuuca

SEQ ID NO: 55093 - RNA, 20 nt, Artificial Sequence
  MKO10055093_A_Tnfrsf11b
  gRNA
cacacgaacugcagcacauu

SEQ ID NO: 55094 - RNA, 20 nt, Artificial Sequence
  MKO10055094_A_Tnfrsf12a
  gRNA
cgcaguccaugcacuugucg

SEQ ID NO: 55095 - RNA, 20 nt, Artificial Sequence
  MKO10055095_A_Tnfrsf12a
  gRNA
cggcaaucauggcuucggcu

SEQ ID NO: 55096 - RNA, 20 nt, Artificial Sequence
  MKO10055096_A_Tnfrsf12a
  gRNA
cuugguguugaugcgcgccg

SEQ ID NO: 55097 - RNA, 20 nt, Artificial Sequence
  MKO10055097_A_Tnfrsf13b
  gRNA
gagagcgcgccgcguucgcu

SEQ ID NO: 55098 - RNA, 20 nt, Artificial Sequence
  MKO10055098_A_Tnfrsf13b
  gRNA
ccguguaucccgagcgaacg

SEQ ID NO: 55099 - RNA, 20 nt, Artificial Sequence
  MKO10055099_A_Tnfrsf13b
  gRNA
uccauacuuacggugggcgu

SEQ ID NO: 55100 - RNA, 20 nt, Artificial Sequence
  MKO10055100_A_Tnfrsf13c
  gRNA
accgacgagcagcgccacgu

SEQ ID NO: 55101 - RNA, 20 nt, Artificial Sequence
  MKO10055101_A_Tnfrsf13c
  gRNA
gaccgagugcuucgacccuc

SEQ ID NO: 55102 - RNA, 20 nt, Artificial Sequence
  MKO10055102_A_Tnfrsf13c
  gRNA
cuccgcgcugagacccgacg

SEQ ID NO: 55103 - RNA, 20 nt, Artificial Sequence
  MKO10055103_A_Tnfrsf14
  gRNA
ugcgcugcagcaaguucaaa

SEQ ID NO: 55104 - RNA, 20 nt, Artificial Sequence
  MKO10055104_A_Tnfrsf14
  gRNA
cuucccagggacucacgacc

SEQ ID NO: 55105 - RNA, 20 nt, Artificial Sequence
  MKO10055105_A_Tnfrsf14
  gRNA
accuggaucacagacuccgc

SEQ ID NO: 55106 - RNA, 20 nt, Artificial Sequence
  MKO10055106_A_Tnfrsf17
  gRNA
aggccgacaccgagcugacu

SEQ ID NO: 55107 - RNA, 20 nt, Artificial Sequence
  MKO10055107_A_Tnfrsf17
  gRNA
gaaauggucagaaucccccu

SEQ ID NO: 55108 - RNA, 20 nt, Artificial Sequence
  MKO10055108_A_Tnfrsf17
  gRNA
ggcgugaccaguucagugaa

SEQ ID NO: 55109 - RNA, 20 nt, Artificial Sequence
  MKO10055109_A_Tnfrsf18
  gRNA
gacaacugcaccuccgcgaa

SEQ ID NO: 55110 - RNA, 20 nt, Artificial Sequence
  MKO10055110_A_Tnfrsf18
  gRNA
accuucuccgcaggucguga

SEQ ID NO: 55111 - RNA, 20 nt, Artificial Sequence
  MKO10055111_A_Tnfrsf18
  gRNA
gcagugaccgucacgaccug

SEQ ID NO: 55112 - RNA, 20 nt, Artificial Sequence
  MKO10055112_A_Tnfrsf19
  gRNA
accagcgcacaguccgcaca

SEQ ID NO: 55113 - RNA, 20 nt, Artificial Sequence
  MKO10055113_A_Tnfrsf19
  gRNA
cgcuggugaaccgcuuucag

SEQ ID NO: 55114 - RNA, 20 nt, Artificial Sequence
  MKO10055114_A_Tnfrsf19
  gRNA
uguaaagugaguugcgaaac

SEQ ID NO: 55115 - RNA, 20 nt, Artificial Sequence
  MKO10055115_A_Tnfrsf1a
  gRNA
cugcagacuguaucccgccc

SEQ ID NO: 55116 - RNA, 20 nt, Artificial Sequence
  MKO10055116_A_Tnfrsf1a
  gRNA
gugucucacucagguagcgu

SEQ ID NO: 55117 - RNA, 20 nt, Artificial Sequence
  MKO10055117_A_Tnfrsf1a
  gRNA
accguguguaacugccaugc

SEQ ID NO: 55118 - RNA, 20 nt, Artificial Sequence
  MKO10055118_A_Tnfrsf1b
  gRNA
caccgugugugcggacugug

SEQ ID NO: 55119 - RNA, 20 nt, Artificial Sequence
  MKO10055119_A_Tnfrsf1b
  gRNA
cgagugugugcuugcgaagc

SEQ ID NO: 55120 - RNA, 20 nt, Artificial Sequence
  MKO10055120_A_Tnfrsf1b
  gRNA
guacccagguuccgguuugu

SEQ ID NO: 55121 - RNA, 20 nt, Artificial Sequence
  MKO10055121_A_Tnfrsf21
  gRNA
acuugucgcagguuagcacc

SEQ ID NO: 55122 - RNA, 20 nt, Artificial Sequence
  MKO10055122_A_Tnfrsf21
  gRNA
cgccauguugaccguaccac

SEQ ID NO: 55123 - RNA, 20 nt, Artificial Sequence
  MKO10055123_A_Tnfrsf21
  gRNA
ucuccacaacaucauugcgu

SEQ ID NO: 55124 - RNA, 20 nt, Artificial Sequence
  MKO10055124_A_Tnfrsf22
  gRNA
cacuccuucaaaugucccgc

SEQ ID NO: 55125 - RNA, 20 nt, Artificial Sequence
  MKO10055125_A_Tnfrsf22
  gRNA
cggcacgauucuggaaauuu

SEQ ID NO: 55126 - RNA, 20 nt, Artificial Sequence
  MKO10055126_A_Tnfrsf22
  gRNA
cauaguaguaaagaccuguu

SEQ ID NO: 55127 - RNA, 20 nt, Artificial Sequence
  MKO10055127_A_Tnfrsf23
  gRNA
ugcaacagacaucauuagac

SEQ ID NO: 55128 - RNA, 20 nt, Artificial Sequence
  MKO10055128_A_Tnfrsf23
  gRNA
uacuccuucaacugucccga

SEQ ID NO: 55129 - RNA, 20 nt, Artificial Sequence
  MKO10055129_A_Tnfrsf23
  gRNA
cggcaugauuccggaaauuu

SEQ ID NO: 55130 - RNA, 20 nt, Artificial Sequence
  MKO10055130_A_Tnfrsf25
  gRNA
ccuuguaaggccguggucac

SEQ ID NO: 55131 - RNA, 20 nt, Artificial Sequence
  MKO10055131_A_Tnfrsf25
  gRNA
acugguguuguagccccgca

SEQ ID NO: 55132 - RNA, 20 nt, Artificial Sequence
  MKO10055132_A_Tnfrsf25
  gRNA
ugaucugugcauauugucga

SEQ ID NO: 55133 - RNA, 20 nt, Artificial Sequence
  MKO10055133_A_Tnfrsf26
  gRNA
uuccugacgacucugccguc

SEQ ID NO: 55134 - RNA, 20 nt, Artificial Sequence
  MKO10055134_A_Tnfrsf26
  gRNA
ugaacucaccaaucuuacac

SEQ ID NO: 55135 - RNA, 20 nt, Artificial Sequence
  MKO10055135_A_Tnfrsf26
  gRNA
ggcacacacgaucagcugua

SEQ ID NO: 55136 - RNA, 20 nt, Artificial Sequence
  MKO10055136_A_Tnfrsf4
  gRNA
gacugcguccaagcugucac

SEQ ID NO: 55137 - RNA, 20 nt, Artificial Sequence
  MKO10055137_A_Tnfrsf4
  gRNA
uuggccugaauguagggcgc

SEQ ID NO: 55138 - RNA, 20 nt, Artificial Sequence
  MKO10055138_A_Tnfrsf4
  gRNA
cuaugucauccgugugagac

SEQ ID NO: 55139 - RNA, 20 nt, Artificial Sequence
  MKO10055139_A_Tnfrsf8
  gRNA
ucuucauugacguaguaguc

SEQ ID NO: 55140 - RNA, 20 nt, Artificial Sequence
  MKO10055140_A_Tnfrsf8
  gRNA
ucacccggauuggagcaauu

SEQ ID NO: 55141 - RNA, 20 nt, Artificial Sequence
  MKO10055141_A_Tnfrsf8
  gRNA
gugaccgcaagacacuuacu

SEQ ID NO: 55142 - RNA, 20 nt, Artificial Sequence
  MKO10055142_A_Tnfrsf9
  gRNA
ugcacucacacuccgcguug

SEQ ID NO: 55143 - RNA, 20 nt, Artificial Sequence
  MKO10055143_A_Tnfrsf9
  gRNA
uuuaaugaccagaacgguac

SEQ ID NO: 55144 - RNA, 20 nt, Artificial Sequence
  MKO10055144_A_Tnfrsf9
  gRNA
accaggcugacaguuaucac

SEQ ID NO: 55145 - RNA, 20 nt, Artificial Sequence
  MKO10055145_A_Tnfsf10
  gRNA
caguccguacucggcaucuc

SEQ ID NO: 55146 - RNA, 20 nt, Artificial Sequence
  MKO10055146_A_Tnfsf10
  gRNA
cuacaaguacaccagcuauc

SEQ ID NO: 55147 - RNA, 20 nt, Artificial Sequence
  MKO10055147_A_Tnfsf10
  gRNA
guucaagaucucuccaucag

SEQ ID NO: 55148 - RNA, 20 nt, Artificial Sequence
  MKO10055148_A_Tnfsf11
  gRNA
aaguacgucgcaucuugauc

SEQ ID NO: 55149 - RNA, 20 nt, Artificial Sequence
  MKO10055149_A_Tnfsf11
  gRNA
gccucgaucgugguaccaag

SEQ ID NO: 55150 - RNA, 20 nt, Artificial Sequence
  MKO10055150_A_Tnfsf11
  gRNA
uaacuuacccgaugggaugc

SEQ ID NO: 55151 - RNA, 20 nt, Artificial Sequence
  MKO10055151_A_Tnfsf12Tnfsf13
  gRNA
gggcuaccuacccucauaau

SEQ ID NO: 55152 - RNA, 20 nt, Artificial Sequence
  MKO10055152_A_Tnfsf12Tnfsf13
  gRNA
cuaguccggccucgaagaag

SEQ ID NO: 55153 - RNA, 20 nt, Artificial Sequence
  MKO10055153_A_Tnfsf12Tnfsf13
  gRNA
ccgcccccauggccgcccgu

SEQ ID NO: 55154 - RNA, 20 nt, Artificial Sequence
  MKO10055154_A_Tnfsf12
  gRNA
gggcuaccuacccucauaau

SEQ ID NO: 55155 - RNA, 20 nt, Artificial Sequence
  MKO10055155_A_Tnfsf12
  gRNA
cuaguccggccucgaagaag

SEQ ID NO: 55156 - RNA, 20 nt, Artificial Sequence
  MKO10055156_A_Tnfsf12
  gRNA
cuuacaguucauccucggcc

SEQ ID NO: 55157 - RNA, 20 nt, Artificial Sequence
  MKO10055157_A_Tnfsf13b
  gRNA
gacacgccgacuauacgaaa

SEQ ID NO: 55158 - RNA, 20 nt, Artificial Sequence
  MKO10055158_A_Tnfsf13b
  gRNA
caggaacagacgcgcuuucc

SEQ ID NO: 55159 - RNA, 20 nt, Artificial Sequence
  MKO10055159_A_Tnfsf13b
  gRNA
cggcuggaguuguggggucg

SEQ ID NO: 55160 - RNA, 20 nt, Artificial Sequence
  MKO10055160_A_Tnfsf13
  gRNA
ccucucccacgccuaaguac

SEQ ID NO: 55161 - RNA, 20 nt, Artificial Sequence
  MKO10055161_A_Tnfsf13
  gRNA
agacucguacaaugucuccc

SEQ ID NO: 55162 - RNA, 20 nt, Artificial Sequence
  MKO10055162_A_Tnfsf13
  gRNA
cccuuggagguaauguuaac

SEQ ID NO: 55163 - RNA, 20 nt, Artificial Sequence
  MKO10055163_A_Tnfsf14
  gRNA
gcgcacaucccgcuacccga

SEQ ID NO: 55164 - RNA, 20 nt, Artificial Sequence
  MKO10055164_A_Tnfsf14
  gRNA
cagugccacagcgccgucuc

SEQ ID NO: 55165 - RNA, 20 nt, Artificial Sequence
  MKO10055165_A_Tnfsf14
  gRNA
gggccaacagcucccgaguc

SEQ ID NO: 55166 - RNA, 20 nt, Artificial Sequence
  MKO10055166_A_Tnfsf15
  gRNA
gagccugcccgccuacuaac

SEQ ID NO: 55167 - RNA, 20 nt, Artificial Sequence
  MKO10055167_A_Tnfsf15
  gRNA
agaacguggccccaagguag

SEQ ID NO: 55168 - RNA, 20 nt, Artificial Sequence
  MKO10055168_A_Tnfsf15
  gRNA
ggugcuaaguccugcgagga

SEQ ID NO: 55169 - RNA, 20 nt, Artificial Sequence
  MKO10055169_A_Tnfsf18
  gRNA
aguucauaaaccccuccuau

SEQ ID NO: 55170 - RNA, 20 nt, Artificial Sequence
  MKO10055170_A_Tnfsf18
  gRNA
cucaccaaacuuaaccaugc

SEQ ID NO: 55171 - RNA, 20 nt, Artificial Sequence
  MKO10055171_A_Tnfsf18
  gRNA
ugugugaauacgacaucuga

SEQ ID NO: 55172 - RNA, 20 nt, Artificial Sequence
  MKO10055172_A_Tnfsf4
  gRNA
ucuauuccaaugcugaacga

SEQ ID NO: 55173 - RNA, 20 nt, Artificial Sequence
  MKO10055173_A_Tnfsf4
  gRNA
cuucgaccaucguucagcau

SEQ ID NO: 55174 - RNA, 20 nt, Artificial Sequence
  MKO10055174_A_Tnfsf4
  gRNA
ucaaccccuggaugagaauc

SEQ ID NO: 55175 - RNA, 20 nt, Artificial Sequence
  MKO10055175_A_Tnfsf8
  gRNA
ucaacucuaccauaucaguc

SEQ ID NO: 55176 - RNA, 20 nt, Artificial Sequence
  MKO10055176_A_Tnfsf8
  gRNA
ggacuaucagguucccgucc

SEQ ID NO: 55177 - RNA, 20 nt, Artificial Sequence
  MKO10055177_A_Tnfsf8
  gRNA
uguggcaguggcgaucauuc

SEQ ID NO: 55178 - RNA, 20 nt, Artificial Sequence
  MKO10055178_A_Tnfsf9
  gRNA
ucugaggagcgccgcauccg

SEQ ID NO: 55179 - RNA, 20 nt, Artificial Sequence
  MKO10055179_A_Tnfsf9
  gRNA
ccuacccugcgguuaauguu

SEQ ID NO: 55180 - RNA, 20 nt, Artificial Sequence
  MKO10055180_A_Tnfsf9
  gRNA
cguaccucagaccuugagau

SEQ ID NO: 55181 - RNA, 20 nt, Artificial Sequence
  MKO10055181_A_Tnf
  gRNA
agaaagcaugauccgcgacg

SEQ ID NO: 55182 - RNA, 20 nt, Artificial Sequence
  MKO10055182_A_Tnf
  gRNA
aagccuguagcccacgucgu

SEQ ID NO: 55183 - RNA, 20 nt, Artificial Sequence
  MKO10055183_A_Tnf
  gRNA
agaaaucuuaccuacgacgu

SEQ ID NO: 55184 - RNA, 20 nt, Artificial Sequence
  MKO10055184_A_Tnik
  gRNA
cggagagaucgauuucaucc

SEQ ID NO: 55185 - RNA, 20 nt, Artificial Sequence
  MKO10055185_A_Tnik
  gRNA
aaaucgaucucuccgcccug

SEQ ID NO: 55186 - RNA, 20 nt, Artificial Sequence
  MKO10055186_A_Tnik
  gRNA
gcagggucgucaugucaaaa

SEQ ID NO: 55187 - RNA, 20 nt, Artificial Sequence
  MKO10055187_A_Tnip1
  gRNA
uucuaccuagggcgccuccu

SEQ ID NO: 55188 - RNA, 20 nt, Artificial Sequence
  MKO10055188_A_Tnip1
  gRNA
cagccacccuacgaacauga

SEQ ID NO: 55189 - RNA, 20 nt, Artificial Sequence
  MKO10055189_A_Tnip1
  gRNA
aggccaaccuguugaacucg

SEQ ID NO: 55190 - RNA, 20 nt, Artificial Sequence
  MKO10055190_A_Tnip2
  gRNA
augagacccaccaacugcgc

SEQ ID NO: 55191 - RNA, 20 nt, Artificial Sequence
  MKO10055191_A_Tnip2
  gRNA
agucuugcuucggcgaagug

SEQ ID NO: 55192 - RNA, 20 nt, Artificial Sequence
  MKO10055192_A_Tnip2
  gRNA
gguugcaugcccagcuaaag

SEQ ID NO: 55193 - RNA, 20 nt, Artificial Sequence
  MKO10055193_A_Tnip3
  gRNA
ugaaauuaaacgccucaaua

SEQ ID NO: 55194 - RNA, 20 nt, Artificial Sequence
  MKO10055194_A_Tnip3
  gRNA
guugaaagaaaacaacgcuc

SEQ ID NO: 55195 - RNA, 20 nt, Artificial Sequence
  MKO10055195_A_Tnip3
  gRNA
aaacacucacacccuaguga

SEQ ID NO: 55196 - RNA, 20 nt, Artificial Sequence
  MKO10055196_A_Tnk1
  gRNA
cgcccaugacguagcguccc

SEQ ID NO: 55197 - RNA, 20 nt, Artificial Sequence
  MKO10055197_A_Tnk1
  gRNA
uccgccaccuugaucauucg

SEQ ID NO: 55198 - RNA, 20 nt, Artificial Sequence
  MKO10055198_A_Tnk1
  gRNA
ccccugaccgguaccucuuc

SEQ ID NO: 55199 - RNA, 20 nt, Artificial Sequence
  MKO10055199_A_Tnk2
  gRNA
cgaaaccucauucgcuugua

SEQ ID NO: 55200 - RNA, 20 nt, Artificial Sequence
  MKO10055200_A_Tnk2
  gRNA
ggagaaagaccuacgccugc

SEQ ID NO: 55201 - RNA, 20 nt, Artificial Sequence
  MKO10055201_A_Tnk2
  gRNA
accccugcgcaccacgccaa

SEQ ID NO: 55202 - RNA, 20 nt, Artificial Sequence
  MKO10055202_A_Tnks1bp1
  gRNA
cauaucgagagcugccaucg

SEQ ID NO: 55203 - RNA, 20 nt, Artificial Sequence
  MKO10055203_A_Tnks1bp1
  gRNA
agacucugucccgcuuccga

SEQ ID NO: 55204 - RNA, 20 nt, Artificial Sequence
  MKO10055204_A_Tnks1bp1
  gRNA
guucgggaagcgagauuccu

SEQ ID NO: 55205 - RNA, 20 nt, Artificial Sequence
  MKO10055205_A_Tnks2
  gRNA
aaugugcaagcgcgugauga

SEQ ID NO: 55206 - RNA, 20 nt, Artificial Sequence
  MKO10055206_A_Tnks2
  gRNA
uuccaauuaucccgagcauu

SEQ ID NO: 55207 - RNA, 20 nt, Artificial Sequence
  MKO10055207_A_Tnks2
  gRNA
ugacauucaaugguguaagc

SEQ ID NO: 55208 - RNA, 20 nt, Artificial Sequence
  MKO10055208_A_Tnks
  gRNA
ccaaacauccggaacaccga

SEQ ID NO: 55209 - RNA, 20 nt, Artificial Sequence
  MKO10055209_A_Tnks
  gRNA
aauguccacgcccgugauga

SEQ ID NO: 55210 - RNA, 20 nt, Artificial Sequence
  MKO10055210_A_Tnks
  gRNA
gaugagacccccgucaucac

SEQ ID NO: 55211 - RNA, 20 nt, Artificial Sequence
  MKO10055211_A_Tnmd
  gRNA
gcgauaaugugaccauguac

SEQ ID NO: 55212 - RNA, 20 nt, Artificial Sequence
  MKO10055212_A_Tnmd
  gRNA
cggcucccagaccuaugaca

SEQ ID NO: 55213 - RNA, 20 nt, Artificial Sequence
  MKO10055213_A_Tnmd
  gRNA
aucaaucccacucuaauagc

SEQ ID NO: 55214 - RNA, 20 nt, Artificial Sequence
  MKO10055214_A_Tnnc1
  gRNA
gaugauugacgaaguagacg

SEQ ID NO: 55215 - RNA, 20 nt, Artificial Sequence
  MKO10055215_A_Tnnc1
  gRNA
acucaccgucauagucaauu

SEQ ID NO: 55216 - RNA, 20 nt, Artificial Sequence
  MKO10055216_A_Tnnc1
  gRNA
ugcagccauccuccgcgccc

SEQ ID NO: 55217 - RNA, 20 nt, Artificial Sequence
  MKO10055217_A_Tnnc2
  gRNA
cuuucuacagacggaccaac

SEQ ID NO: 55218 - RNA, 20 nt, Artificial Sequence
  MKO10055218_A_Tnnc2
  gRNA
ccuucgcauccucuuucauc

SEQ ID NO: 55219 - RNA, 20 nt, Artificial Sequence
  MKO10055219_A_Tnnc2
  gRNA
ggccagguccuaccucagcg

SEQ ID NO: 55220 - RNA, 20 nt, Artificial Sequence
  MKO10055220_A_Tnni1
  gRNA
ugagaaggugcguuaccucu

SEQ ID NO: 55221 - RNA, 20 nt, Artificial Sequence
  MKO10055221_A_Tnni1
  gRNA
gugugggaaugcgcuccgag

SEQ ID NO: 55222 - RNA, 20 nt, Artificial Sequence
  MKO10055222_A_Tnni1
  gRNA
ggccuaccucucugguguug

SEQ ID NO: 55223 - RNA, 20 nt, Artificial Sequence
  MKO10055223_A_Tnni2
  gRNA
acugcaugcgaagaucgacg

SEQ ID NO: 55224 - RNA, 20 nt, Artificial Sequence
  MKO10055224_A_Tnni2
  gRNA
cuguccugcagaagcgcaac

SEQ ID NO: 55225 - RNA, 20 nt, Artificial Sequence
  MKO10055225_A_Tnni2
  gRNA
ugcccgccacugcacauccc

SEQ ID NO: 55226 - RNA, 20 nt, Artificial Sequence
  MKO10055226_A_Tnni3k
  gRNA
gauguucagcaagcgggaua

SEQ ID NO: 55227 - RNA, 20 nt, Artificial Sequence
  MKO10055227_A_Tnni3k
  gRNA
gcccagcuauugcagcgaug

SEQ ID NO: 55228 - RNA, 20 nt, Artificial Sequence
  MKO10055228_A_Tnni3k
  gRNA
uuaaauuaccgcacagagcg

SEQ ID NO: 55229 - RNA, 20 nt, Artificial Sequence
  MKO10055229_A_Tnni3
  gRNA
gguggcauaggcucgguagu

SEQ ID NO: 55230 - RNA, 20 nt, Artificial Sequence
  MKO10055230_A_Tnni3
  gRNA
gaugcugcagauugcgaagc

SEQ ID NO: 55231 - RNA, 20 nt, Artificial Sequence
  MKO10055231_A_Tnni3
  gRNA
gaggacucguugccagccuu

SEQ ID NO: 55232 - RNA, 20 nt, Artificial Sequence
  MKO10055232_A_Tnnt1
  gRNA
ugguuaccucgcucugccac

SEQ ID NO: 55233 - RNA, 20 nt, Artificial Sequence
  MKO10055233_A_Tnnt1
  gRNA
uagcaccucaccuggguuug

SEQ ID NO: 55234 - RNA, 20 nt, Artificial Sequence
  MKO10055234_A_Tnnt1
  gRNA
aagaagagcgccccaaaccc

SEQ ID NO: 55235 - RNA, 20 nt, Artificial Sequence
  MKO10055235_A_Tnnt2
  gRNA
cgagagcaugucugacgccg

SEQ ID NO: 55236 - RNA, 20 nt, Artificial Sequence
  MKO10055236_A_Tnnt2
  gRNA
cugggcuguaccuucuacgu

SEQ ID NO: 55237 - RNA, 20 nt, Artificial Sequence
  MKO10055237_A_Tnnt2
  gRNA
acagaggaggccaacguaga

SEQ ID NO: 55238 - RNA, 20 nt, Artificial Sequence
  MKO10055238_A_Tnnt3
  gRNA
caccgccacuaugucugacg

SEQ ID NO: 55239 - RNA, 20 nt, Artificial Sequence
  MKO10055239_A_Tnnt3
  gRNA
cuaugacagugaacaaguug

SEQ ID NO: 55240 - RNA, 20 nt, Artificial Sequence
  MKO10055240_A_Tnnt3
  gRNA
auucucagaggaggcccaag

SEQ ID NO: 55241 - RNA, 20 nt, Artificial Sequence
  MKO10055241_A_Tnn
  gRNA
ccauugccacuacagucgcc

SEQ ID NO: 55242 - RNA, 20 nt, Artificial Sequence
  MKO10055242_A_Tnn
  gRNA
caacggccacgggcgcugug

SEQ ID NO: 55243 - RNA, 20 nt, Artificial Sequence
  MKO10055243_A_Tnn
  gRNA
ugucuuucuucacguugcgc

SEQ ID NO: 55244 - RNA, 20 nt, Artificial Sequence
  MKO10055244_A_Tnp1
  gRNA
ugccgcaucacaagugggau

SEQ ID NO: 55245 - RNA, 20 nt, Artificial Sequence
  MKO10055245_A_Tnp1
  gRNA
ccucucuugacgcccuugug

SEQ ID NO: 55246 - RNA, 20 nt, Artificial Sequence
  MKO10055246_A_Tnp1
  gRNA
caagaaccgagcuccucaca

SEQ ID NO: 55247 - RNA, 20 nt, Artificial Sequence
  MKO10055247_A_Tnp2
  gRNA
uguucuuggggcagcucccg

SEQ ID NO: 55248 - RNA, 20 nt, Artificial Sequence
  MKO10055248_A_Tnp2
  gRNA
aguccguuuccgccuccuga

SEQ ID NO: 55249 - RNA, 20 nt, Artificial Sequence
  MKO10055249_A_Tnp2
  gRNA
ggugugacuuugaggccgcg

SEQ ID NO: 55250 - RNA, 20 nt, Artificial Sequence
  MKO10055250_A_Tnpo1
  gRNA
auacuuguugcacgguccuc

SEQ ID NO: 55251 - RNA, 20 nt, Artificial Sequence
  MKO10055251_A_Tnpo1
  gRNA
ugcugaagcccuugcucguc

SEQ ID NO: 55252 - RNA, 20 nt, Artificial Sequence
  MKO10055252_A_Tnpo1
  gRNA
uccagcaggcuacagaguuu

SEQ ID NO: 55253 - RNA, 20 nt, Artificial Sequence
  MKO10055253_A_Tnpo2
  gRNA
acaucacguaccggaucuua

SEQ ID NO: 55254 - RNA, 20 nt, Artificial Sequence
  MKO10055254_A_Tnpo2
  gRNA
caggagugucucaacaacau

SEQ ID NO: 55255 - RNA, 20 nt, Artificial Sequence
  MKO10055255_A_Tnpo2
  gRNA
gugcaaccugcucaacucag

SEQ ID NO: 55256 - RNA, 20 nt, Artificial Sequence
  MKO10055256_A_Tnpo3
  gRNA
ucaauuguuacagauccgac

SEQ ID NO: 55257 - RNA, 20 nt, Artificial Sequence
  MKO10055257_A_Tnpo3
  gRNA
agccuucuacucuaguaccg

SEQ ID NO: 55258 - RNA, 20 nt, Artificial Sequence
  MKO10055258_A_Tnpo3
  gRNA
aaguacauagucguuccuug

SEQ ID NO: 55259 - RNA, 20 nt, Artificial Sequence
  MKO10055259_A_Tnrc18
  gRNA
ucuagggggacccgccgacg

SEQ ID NO: 55260 - RNA, 20 nt, Artificial Sequence
  MKO10055260_A_Tnrc18
  gRNA
uacaccguguuccgugaacc

SEQ ID NO: 55261 - RNA, 20 nt, Artificial Sequence
  MKO10055261_A_Tnrc18
  gRNA
auggauguacuacccgagcg

SEQ ID NO: 55262 - RNA, 20 nt, Artificial Sequence
  MKO10055262_A_Tnrc6a
  gRNA
accuccacgauuucgccacc

SEQ ID NO: 55263 - RNA, 20 nt, Artificial Sequence
  MKO10055263_A_Tnrc6a
  gRNA
aaucguggagguacuucacg

SEQ ID NO: 55264 - RNA, 20 nt, Artificial Sequence
  MKO10055264_A_Tnrc6a
  gRNA
aagauuucucucuacgucuu

SEQ ID NO: 55265 - RNA, 20 nt, Artificial Sequence
  MKO10055265_A_Tnrc6b
  gRNA
gcgccgcccgcuacaugccu

SEQ ID NO: 55266 - RNA, 20 nt, Artificial Sequence
  MKO10055266_A_Tnrc6b
  gRNA
gcgcuuggcgguuguccguu

SEQ ID NO: 55267 - RNA, 20 nt, Artificial Sequence
  MKO10055267_A_Tnrc6b
  gRNA
gucacggaacaaaaaaccaa

SEQ ID NO: 55268 - RNA, 20 nt, Artificial Sequence
  MKO10055268_A_Tnrc6c
  gRNA
gacccaccccgauacugaag

SEQ ID NO: 55269 - RNA, 20 nt, Artificial Sequence
  MKO10055269_A_Tnrc6c
  gRNA
gaaccccuuugucucgccuc

SEQ ID NO: 55270 - RNA, 20 nt, Artificial Sequence
  MKO10055270_A_Tnrc6c
  gRNA
cauucccaguuucauccggc

SEQ ID NO: 55271 - RNA, 20 nt, Artificial Sequence
  MKO10055271_A_Tnr
  gRNA
aggcauucagacaccgucgc

SEQ ID NO: 55272 - RNA, 20 nt, Artificial Sequence
  MKO10055272_A_Tnr
  gRNA
gcugaucucccacccgucga

SEQ ID NO: 55273 - RNA, 20 nt, Artificial Sequence
  MKO10055273_A_Tnr
  gRNA
gacgaucacagagaccaccg

SEQ ID NO: 55274 - RNA, 20 nt, Artificial Sequence
  MKO10055274_A_Tns1
  gRNA
gugcggcgcccgacccgagg

SEQ ID NO: 55275 - RNA, 20 nt, Artificial Sequence
  MKO10055275_A_Tns1
  gRNA
cgagcgccucgcagcacacc

SEQ ID NO: 55276 - RNA, 20 nt, Artificial Sequence
  MKO10055276_A_Tns1
  gRNA
ucugccggcaggccaucacu

SEQ ID NO: 55277 - RNA, 20 nt, Artificial Sequence
  MKO10055277_A_Tns3
  gRNA
aucuuaccuggcugagacgu

SEQ ID NO: 55278 - RNA, 20 nt, Artificial Sequence
  MKO10055278_A_Tns3
  gRNA
agauacauaccgcuucuggg

SEQ ID NO: 55279 - RNA, 20 nt, Artificial Sequence
  MKO10055279_A_Tns3
  gRNA
aguggaugacgaccacaugc

SEQ ID NO: 55280 - RNA, 20 nt, Artificial Sequence
  MKO10055280_A_Tns4
  gRNA
acauagcugacauccgauac

SEQ ID NO: 55281 - RNA, 20 nt, Artificial Sequence
  MKO10055281_A_Tns4
  gRNA
acauacauaccuggucgguu

SEQ ID NO: 55282 - RNA, 20 nt, Artificial Sequence
  MKO10055282_A_Tns4
  gRNA
ccaagcaucacucgagagca

SEQ ID NO: 55283 - RNA, 20 nt, Artificial Sequence
  MKO10055283_A_Tnxb
  gRNA
ccacgccggcgacagucggc

SEQ ID NO: 55284 - RNA, 20 nt, Artificial Sequence
  MKO10055284_A_Tnxb
  gRNA
gggcucugcgagugcgacga

SEQ ID NO: 55285 - RNA, 20 nt, Artificial Sequence
  MKO10055285_A_Tnxb
  gRNA
ucacuguucgugcucuacga

SEQ ID NO: 55286 - RNA, 20 nt, Artificial Sequence
  MKO10055286_A_Tob1
  gRNA
ucgcacuucuccgaucaacc

SEQ ID NO: 55287 - RNA, 20 nt, Artificial Sequence
  MKO10055287_A_Tob1
  gRNA
gguagaccccgugaucgagc

SEQ ID NO: 55288 - RNA, 20 nt, Artificial Sequence
  MKO10055288_A_Tob1
  gRNA
ggaggaggccgggucgcuua

SEQ ID NO: 55289 - RNA, 20 nt, Artificial Sequence
  MKO10055289_A_Tob2
  gRNA
guacccggagaagccguuga

SEQ ID NO: 55290 - RNA, 20 nt, Artificial Sequence
  MKO10055290_A_Tob2
  gRNA
acaacaagcugccccgccgc

SEQ ID NO: 55291 - RNA, 20 nt, Artificial Sequence
  MKO10055291_A_Tob2
  gRNA
cgacucccuucucgccaauc

SEQ ID NO: 55292 - RNA, 20 nt, Artificial Sequence
  MKO10055292_A_Toe1
  gRNA
ggauacccugggcguacugc

SEQ ID NO: 55293 - RNA, 20 nt, Artificial Sequence
  MKO10055293_A_Toe1
  gRNA
cguacuccucuaugcauagc

SEQ ID NO: 55294 - RNA, 20 nt, Artificial Sequence
  MKO10055294_A_Toe1
  gRNA
gugcauugaggaacguuaca

SEQ ID NO: 55295 - RNA, 20 nt, Artificial Sequence
  MKO10055295_A_Tollip
  gRNA
guacauuggugaacuccccc

SEQ ID NO: 55296 - RNA, 20 nt, Artificial Sequence
  MKO10055296_A_Tollip
  gRNA
guguuauacggaggaagucc

SEQ ID NO: 55297 - RNA, 20 nt, Artificial Sequence
  MKO10055297_A_Tollip
  gRNA
cccuuacugccgucugcguc

SEQ ID NO: 55298 - RNA, 20 nt, Artificial Sequence
  MKO10055298_A_Tom1l1
  gRNA
gggacagaugucggucgauu

SEQ ID NO: 55299 - RNA, 20 nt, Artificial Sequence
  MKO10055299_A_Tom1l1
  gRNA
gaucugaauaaugccguccu

SEQ ID NO: 55300 - RNA, 20 nt, Artificial Sequence
  MKO10055300_A_Tom1l1
  gRNA
guucaauucccgcccucgga

SEQ ID NO: 55301 - RNA, 20 nt, Artificial Sequence
  MKO10055301_A_Tom1l2
  gRNA
uaacccucccacuaucgucc

SEQ ID NO: 55302 - RNA, 20 nt, Artificial Sequence
  MKO10055302_A_Tom1l2
  gRNA
gcucuaaagaagcggcuuag

SEQ ID NO: 55303 - RNA, 20 nt, Artificial Sequence
  MKO10055303_A_Tom1l2
  gRNA
agacuucaucgacagcguuc

SEQ ID NO: 55304 - RNA, 20 nt, Artificial Sequence
  MKO10055304_A_Tom1
  gRNA
ucaccgauccguugucccac

SEQ ID NO: 55305 - RNA, 20 nt, Artificial Sequence
  MKO10055305_A_Tom1
  gRNA
uucacagagaaagcuacaga

SEQ ID NO: 55306 - RNA, 20 nt, Artificial Sequence
  MKO10055306_A_Tom1
  gRNA
cgcggcaauggacuuucucc

SEQ ID NO: 55307 - RNA, 20 nt, Artificial Sequence
  MKO10055307_A_Tomm20l
  gRNA
uguuucaggggagcgcggaa

SEQ ID NO: 55308 - RNA, 20 nt, Artificial Sequence
  MKO10055308_A_Tomm20l
  gRNA
guuaugggauccaguaaaga

SEQ ID NO: 55309 - RNA, 20 nt, Artificial Sequence
  MKO10055309_A_Tomm20l
  gRNA
agcaacucgaggagacaugc

SEQ ID NO: 55310 - RNA, 20 nt, Artificial Sequence
  MKO10055310_A_Tomm20
  gRNA
gucugcaggugacuacgaga

SEQ ID NO: 55311 - RNA, 20 nt, Artificial Sequence
  MKO10055311_A_Tomm20
  gRNA
caagcuuccgaccauuaguc

SEQ ID NO: 55312 - RNA, 20 nt, Artificial Sequence
  MKO10055312_A_Tomm20
  gRNA
aaagaaacagaagcuugcua

SEQ ID NO: 55313 - RNA, 20 nt, Artificial Sequence
  MKO10055313_A_Tomm22
  gRNA
cccagcgccggcugcagcga

SEQ ID NO: 55314 - RNA, 20 nt, Artificial Sequence
  MKO10055314_A_Tomm22
  gRNA
cccaauccacaaagcugccc

SEQ ID NO: 55315 - RNA, 20 nt, Artificial Sequence
  MKO10055315_A_Tomm22
  gRNA
acagcuagacgagacccugu

SEQ ID NO: 55316 - RNA, 20 nt, Artificial Sequence
  MKO10055316_A_Tomm34
  gRNA
ccuucaaguagcacgcugca

SEQ ID NO: 55317 - RNA, 20 nt, Artificial Sequence
  MKO10055317_A_Tomm34
  gRNA
ccgugcagcgugcuacuuga

SEQ ID NO: 55318 - RNA, 20 nt, Artificial Sequence
  MKO10055318_A_Tomm34
  gRNA
cucccguagcgcgcuggccu

SEQ ID NO: 55319 - RNA, 20 nt, Artificial Sequence
  MKO10055319_A_Tomm40l
  gRNA
caguggcagucucaacgccc

SEQ ID NO: 55320 - RNA, 20 nt, Artificial Sequence
  MKO10055320_A_Tomm40l
  gRNA
caguuugauggcgaguaucg

SEQ ID NO: 55321 - RNA, 20 nt, Artificial Sequence
  MKO10055321_A_Tomm40l
  gRNA
cgccaucaaacugccauguc

SEQ ID NO: 55322 - RNA, 20 nt, Artificial Sequence
  MKO10055322_A_Tomm40
  gRNA
cagguggauggcgaguaccg

SEQ ID NO: 55323 - RNA, 20 nt, Artificial Sequence
  MKO10055323_A_Tomm40
  gRNA
cccgcaggcguuccccgugc

SEQ ID NO: 55324 - RNA, 20 nt, Artificial Sequence
  MKO10055324_A_Tomm40
  gRNA
uggacuccccaauugugccg

SEQ ID NO: 55325 - RNA, 20 nt, Artificial Sequence
  MKO10055325_A_Tomm5
  gRNA
gacacucacugacucgcagc

SEQ ID NO: 55326 - RNA, 20 nt, Artificial Sequence
  MKO10055326_A_Tomm5
  gRNA
gaugaagcggaagaugcgug

SEQ ID NO: 55327 - RNA, 20 nt, Artificial Sequence
  MKO10055327_A_Tomm5
  gRNA
uaccucugccuucugagugc

SEQ ID NO: 55328 - RNA, 20 nt, Artificial Sequence
  MKO10055328_A_Tomm6
  gRNA
ccuccggaagucguuucgau

SEQ ID NO: 55329 - RNA, 20 nt, Artificial Sequence
  MKO10055329_A_Tomm6
  gRNA
ccaccgaucgaaacgacuuc

SEQ ID NO: 55330 - RNA, 20 nt, Artificial Sequence
  MKO10055330_A_Tomm6
  gRNA
gacucuuugcugcgggaguc

SEQ ID NO: 55331 - RNA, 20 nt, Artificial Sequence
  MKO10055331_A_Tomm70a
  gRNA
aguacauaccaauuguucaa

SEQ ID NO: 55332 - RNA, 20 nt, Artificial Sequence
  MKO10055332_A_Tomm70a
  gRNA
aauuucucaaccaaugcuua

SEQ ID NO: 55333 - RNA, 20 nt, Artificial Sequence
  MKO10055333_A_Tomm70a
  gRNA
gauaaaguucuuaaacuucu

SEQ ID NO: 55334 - RNA, 20 nt, Artificial Sequence
  MKO10055334_A_Tomm7
  gRNA
gagcauuaccuuaaaaccga

SEQ ID NO: 55335 - RNA, 20 nt, Artificial Sequence
  MKO10055335_A_Tomm7
  gRNA
uccuggaaugccugaaccgu

SEQ ID NO: 55336 - RNA, 20 nt, Artificial Sequence
  MKO10055336_A_Tomm7
  gRNA
ugacccagguaaaucacgag

SEQ ID NO: 55337 - RNA, 20 nt, Artificial Sequence
  MKO10055337_A_Tomt
  gRNA
gcucaucgaagccugccagc

SEQ ID NO: 55338 - RNA, 20 nt, Artificial Sequence
  MKO10055338_A_Tomt
  gRNA
ccagcugaaucgugcagauc

SEQ ID NO: 55339 - RNA, 20 nt, Artificial Sequence
  MKO10055339_A_Tomt
  gRNA
auagcccaacucaccuauac

SEQ ID NO: 55340 - RNA, 20 nt, Artificial Sequence
  MKO10055340_A_Tonsl
  gRNA
ucuuccggcaggccgcuuca

SEQ ID NO: 55341 - RNA, 20 nt, Artificial Sequence
  MKO10055341_A_Tonsl
  gRNA
acaucugcuagagagcgucc

SEQ ID NO: 55342 - RNA, 20 nt, Artificial Sequence
  MKO10055342_A_Tonsl
  gRNA
gacccgucucuaccucaauc

SEQ ID NO: 55343 - RNA, 20 nt, Artificial Sequence
  MKO10055343_A_Top1mt
  gRNA
uagaggaagugcacuccguc

SEQ ID NO: 55344 - RNA, 20 nt, Artificial Sequence
  MKO10055344_A_Top1mt
  gRNA
gcaucuugaguguacgagca

SEQ ID NO: 55345 - RNA, 20 nt, Artificial Sequence
  MKO10055345_A_Top1mt
  gRNA
gaggaggucgcuaccuucua

SEQ ID NO: 55346 - RNA, 20 nt, Artificial Sequence
  MKO10055346_A_Top1
  gRNA
gaagcggauuuccgauugaa

SEQ ID NO: 55347 - RNA, 20 nt, Artificial Sequence
  MKO10055347_A_Top1
  gRNA
accuugcagauuagagcugc

SEQ ID NO: 55348 - RNA, 20 nt, Artificial Sequence
  MKO10055348_A_Top1
  gRNA
aaaagucuaagcauagcaac

SEQ ID NO: 55349 - RNA, 20 nt, Artificial Sequence
  MKO10055349_A_Top2a
  gRNA
cucaucgucgucauaguuac

SEQ ID NO: 55350 - RNA, 20 nt, Artificial Sequence
  MKO10055350_A_Top2a
  gRNA
cuccgcccagauaccuacau

SEQ ID NO: 55351 - RNA, 20 nt, Artificial Sequence
  MKO10055351_A_Top2a
  gRNA
uggguuuacgaugaagaugu

SEQ ID NO: 55352 - RNA, 20 nt, Artificial Sequence
  MKO10055352_A_Top2b
  gRNA
cuucguccugauacauacau

SEQ ID NO: 55353 - RNA, 20 nt, Artificial Sequence
  MKO10055353_A_Top2b
  gRNA
acugauccaauguauguauc

SEQ ID NO: 55354 - RNA, 20 nt, Artificial Sequence
  MKO10055354_A_Top2b
  gRNA
ucuacuuuguguucuacuac

SEQ ID NO: 55355 - RNA, 20 nt, Artificial Sequence
  MKO10055355_A_Top3a
  gRNA
ugaucuggacggacugugau

SEQ ID NO: 55356 - RNA, 20 nt, Artificial Sequence
  MKO10055356_A_Top3a
  gRNA
acucaccagccuugcauacg

SEQ ID NO: 55357 - RNA, 20 nt, Artificial Sequence
  MKO10055357_A_Top3a
  gRNA
accauuuccgaaacugcauc

SEQ ID NO: 55358 - RNA, 20 nt, Artificial Sequence
  MKO10055358_A_Top3b
  gRNA
uggcucgcucaggcggguca

SEQ ID NO: 55359 - RNA, 20 nt, Artificial Sequence
  MKO10055359_A_Top3b
  gRNA
acucucaguggaugcccgcc

SEQ ID NO: 55360 - RNA, 20 nt, Artificial Sequence
  MKO10055360_A_Top3b
  gRNA
cccauucagcccuuugugug

SEQ ID NO: 55361 - RNA, 20 nt, Artificial Sequence
  MKO10055361_A_Topaz1
  gRNA
ucuucgagcuuuaccaagaa

SEQ ID NO: 55362 - RNA, 20 nt, Artificial Sequence
  MKO10055362_A_Topaz1
  gRNA
caugcauaccucaaaucgcc

SEQ ID NO: 55363 - RNA, 20 nt, Artificial Sequence
  MKO10055363_A_Topaz1
  gRNA
ggcuucagacucagacgcga

SEQ ID NO: 55364 - RNA, 20 nt, Artificial Sequence
  MKO10055364_A_Topbp1
  gRNA
cgugcuuagccgugaguugc

SEQ ID NO: 55365 - RNA, 20 nt, Artificial Sequence
  MKO10055365_A_Topbp1
  gRNA
ucagucacucaccuuauugc

SEQ ID NO: 55366 - RNA, 20 nt, Artificial Sequence
  MKO10055366_A_Topbp1
  gRNA
uauaucugugaccguuucag

SEQ ID NO: 55367 - RNA, 20 nt, Artificial Sequence
  MKO10055367_A_Topors
  gRNA
cuacauccgccgggcccgac

SEQ ID NO: 55368 - RNA, 20 nt, Artificial Sequence
  MKO10055368_A_Topors
  gRNA
agauaauacuucacggucgc

SEQ ID NO: 55369 - RNA, 20 nt, Artificial Sequence
  MKO10055369_A_Topors
  gRNA
gucuccgcugucucgcgagg

SEQ ID NO: 55370 - RNA, 20 nt, Artificial Sequence
  MKO10055370_A_Tor1aip1
  gRNA
ucuugacucaagagaaucgc

SEQ ID NO: 55371 - RNA, 20 nt, Artificial Sequence
  MKO10055371_A_Tor1aip1
  gRNA
agcgauucucuugagucaag

SEQ ID NO: 55372 - RNA, 20 nt, Artificial Sequence
  MKO10055372_A_Tor1aip1
  gRNA
ggucugcauaaguugcuuau

SEQ ID NO: 55373 - RNA, 20 nt, Artificial Sequence
  MKO10055373_A_Tor1aip2
  gRNA
acuuacguccucgcugccac

SEQ ID NO: 55374 - RNA, 20 nt, Artificial Sequence
  MKO10055374_A_Tor1aip2
  gRNA
uucggcuccgucuauggaga

SEQ ID NO: 55375 - RNA, 20 nt, Artificial Sequence
  MKO10055375_A_Tor1aip2
  gRNA
uaacugcucucaaagcgacu

SEQ ID NO: 55376 - RNA, 20 nt, Artificial Sequence
  MKO10055376_A_Tor1a
  gRNA
gucauccuaaacgccguguc

SEQ ID NO: 55377 - RNA, 20 nt, Artificial Sequence
  MKO10055377_A_Tor1a
  gRNA
auucuccgcgaugaucuugc

SEQ ID NO: 55378 - RNA, 20 nt, Artificial Sequence
  MKO10055378_A_Tor1a
  gRNA
aaggcuugauggcgucgaug

SEQ ID NO: 55379 - RNA, 20 nt, Artificial Sequence
  MKO10055379_A_Tor1b
  gRNA
ccugaucacuaagacggccc

SEQ ID NO: 55380 - RNA, 20 nt, Artificial Sequence
  MKO10055380_A_Tor1b
  gRNA
ccgaggggcugccgucgaug

SEQ ID NO: 55381 - RNA, 20 nt, Artificial Sequence
  MKO10055381_A_Tor1b
  gRNA
cgaggcaaugugagugcgug

SEQ ID NO: 55382 - RNA, 20 nt, Artificial Sequence
  MKO10055382_A_Tor2a
  gRNA
cgccugaaccaccuccucgc

SEQ ID NO: 55383 - RNA, 20 nt, Artificial Sequence
  MKO10055383_A_Tor2a
  gRNA
gauggacgugagggcugcga

SEQ ID NO: 55384 - RNA, 20 nt, Artificial Sequence
  MKO10055384_A_Tor2a
  gRNA
ccacugcguacucaaugagc

SEQ ID NO: 55385 - RNA, 20 nt, Artificial Sequence
  MKO10055385_A_Tor3a
  gRNA
cgucaaagacgaacgugcuc

SEQ ID NO: 55386 - RNA, 20 nt, Artificial Sequence
  MKO10055386_A_Tor3a
  gRNA
ggaaauuacgacgcagcacu

SEQ ID NO: 55387 - RNA, 20 nt, Artificial Sequence
  MKO10055387_A_Tor3a
  gRNA
uccucaugccgucccgauac

SEQ ID NO: 55388 - RNA, 20 nt, Artificial Sequence
  MKO10055388_A_Tor4a
  gRNA
cgcacuggcgcuaucacaca

SEQ ID NO: 55389 - RNA, 20 nt, Artificial Sequence
  MKO10055389_A_Tor4a
  gRNA
gcacaacguuacgaccucga

SEQ ID NO: 55390 - RNA, 20 nt, Artificial Sequence
  MKO10055390_A_Tor4a
  gRNA
gagucugcguccugcgcaag

SEQ ID NO: 55391 - RNA, 20 nt, Artificial Sequence
  MKO10055391_A_Tox2
  gRNA
ccaaaauaguggcguccaug

SEQ ID NO: 55392 - RNA, 20 nt, Artificial Sequence
  MKO10055392_A_Tox2
  gRNA
auccauugcuugguacgagu

SEQ ID NO: 55393 - RNA, 20 nt, Artificial Sequence
  MKO10055393_A_Tox2
  gRNA
agucuucguuacucucgccc

SEQ ID NO: 55394 - RNA, 20 nt, Artificial Sequence
  MKO10055394_A_Tox3
  gRNA
aucgagcaccauccgucaua

SEQ ID NO: 55395 - RNA, 20 nt, Artificial Sequence
  MKO10055395_A_Tox3
  gRNA
cgaaaaucguagcaucuaug

SEQ ID NO: 55396 - RNA, 20 nt, Artificial Sequence
  MKO10055396_A_Tox3
  gRNA
acaagugucacaguaccgcc

SEQ ID NO: 55397 - RNA, 20 nt, Artificial Sequence
  MKO10055397_A_Tox4
  gRNA
auuguucuuucgagauacgc

SEQ ID NO: 55398 - RNA, 20 nt, Artificial Sequence
  MKO10055398_A_Tox4
  gRNA
gacaauuaccugacgaucac

SEQ ID NO: 55399 - RNA, 20 nt, Artificial Sequence
  MKO10055399_A_Tox4
  gRNA
gcgagggcccagugaucguc

SEQ ID NO: 55400 - RNA, 20 nt, Artificial Sequence
  MKO10055400_A_Tox
  gRNA
aaccggauucuaccucauuc

SEQ ID NO: 55401 - RNA, 20 nt, Artificial Sequence
  MKO10055401_A_Tox
  gRNA
cccguuccauccacaaacca

SEQ ID NO: 55402 - RNA, 20 nt, Artificial Sequence
  MKO10055402_A_Tox
  gRNA
uuuguucuuucgugauaccc

SEQ ID NO: 55403 - RNA, 20 nt, Artificial Sequence
  MKO10055403_A_Tpbg
  gRNA
aggaaaagguugcgcacgua

SEQ ID NO: 55404 - RNA, 20 nt, Artificial Sequence
  MKO10055404_A_Tpbg
  gRNA
ccgccgggagcacggucauc

SEQ ID NO: 55405 - RNA, 20 nt, Artificial Sequence
  MKO10055405_A_Tpbg
  gRNA
agacgaggguaccgaagagc

SEQ ID NO: 55406 - RNA, 20 nt, Artificial Sequence
  MKO10055406_A_Tpbpa
  gRNA
caaacuuacuagcugaccgg

SEQ ID NO: 55407 - RNA, 20 nt, Artificial Sequence
  MKO10055407_A_Tpbpa
  gRNA
uguuggagccuuccgucucc

SEQ ID NO: 55408 - RNA, 20 nt, Artificial Sequence
  MKO10055408_A_Tpbpa
  gRNA
uauagucccugaagcgcagu

SEQ ID NO: 55409 - RNA, 20 nt, Artificial Sequence
  MKO10055409_A_Tpbpb
  gRNA
uauaaucccugaaccaacuu

SEQ ID NO: 55410 - RNA, 20 nt, Artificial Sequence
  MKO10055410_A_Tpbpb
  gRNA
ugcacuucaguauccaaagu

SEQ ID NO: 55411 - RNA, 20 nt, Artificial Sequence
  MKO10055411_A_Tpbpb
  gRNA
aaggacucaaaaaagcaacg

SEQ ID NO: 55412 - RNA, 20 nt, Artificial Sequence
  MKO10055412_A_Tpcn1
  gRNA
ugggcuuccacacguucguc

SEQ ID NO: 55413 - RNA, 20 nt, Artificial Sequence
  MKO10055413_A_Tpcn1
  gRNA
gucgcuacuguggcggugua

SEQ ID NO: 55414 - RNA, 20 nt, Artificial Sequence
  MKO10055414_A_Tpcn1
  gRNA
gcugcagguccacgccacgc

SEQ ID NO: 55415 - RNA, 20 nt, Artificial Sequence
  MKO10055415_A_Tpcn2
  gRNA
auuacucgaacgucugccaa

SEQ ID NO: 55416 - RNA, 20 nt, Artificial Sequence
  MKO10055416_A_Tpcn2
  gRNA
gcagaacgccucgaucgucu

SEQ ID NO: 55417 - RNA, 20 nt, Artificial Sequence
  MKO10055417_A_Tpcn2
  gRNA
uggccugaccgagacgaucg

SEQ ID NO: 55418 - RNA, 20 nt, Artificial Sequence
  MKO10055418_A_Tpd52l1
  gRNA
cacgaaacccugagccacgc

SEQ ID NO: 55419 - RNA, 20 nt, Artificial Sequence
  MKO10055419_A_Tpd52l1
  gRNA
aacagcagcuuucaauaacg

SEQ ID NO: 55420 - RNA, 20 nt, Artificial Sequence
  MKO10055420_A_Tpd52l1
  gRNA
ccucauggcaggcauacuua

SEQ ID NO: 55421 - RNA, 20 nt, Artificial Sequence
  MKO10055421_A_Tpd52l2
  gRNA
agaaauugucacucugcgcc

SEQ ID NO: 55422 - RNA, 20 nt, Artificial Sequence
  MKO10055422_A_Tpd52l2
  gRNA
cuucuacaacuggaguccgg

SEQ ID NO: 55423 - RNA, 20 nt, Artificial Sequence
  MKO10055423_A_Tpd52l2
  gRNA
aaccugaauucuccuaacaa

SEQ ID NO: 55424 - RNA, 20 nt, Artificial Sequence
  MKO10055424_A_Tpd52
  gRNA
cgucacgucuugccacccuu

SEQ ID NO: 55425 - RNA, 20 nt, Artificial Sequence
  MKO10055425_A_Tpd52
  gRNA
agcaucucgccgagcucaag

SEQ ID NO: 55426 - RNA, 20 nt, Artificial Sequence
  MKO10055426_A_Tpd52
  gRNA
gcugaggcgggagcuuacua

SEQ ID NO: 55427 - RNA, 20 nt, Artificial Sequence
  MKO10055427_A_Tpgs1
  gRNA
ggucuacgcucgccgaccaa

SEQ ID NO: 55428 - RNA, 20 nt, Artificial Sequence
  MKO10055428_A_Tpgs1
  gRNA
cuggucaagcgguggccgau

SEQ ID NO: 55429 - RNA, 20 nt, Artificial Sequence
  MKO10055429_A_Tpgs1
  gRNA
cgcgcuguggcaccuucgcc

SEQ ID NO: 55430 - RNA, 20 nt, Artificial Sequence
  MKO10055430_A_Tpgs2
  gRNA
gaaaucauaugacgcucagc

SEQ ID NO: 55431 - RNA, 20 nt, Artificial Sequence
  MKO10055431_A_Tpgs2
  gRNA
ccaggaugcgagugacgccu

SEQ ID NO: 55432 - RNA, 20 nt, Artificial Sequence
  MKO10055432_A_Tpgs2
  gRNA
acaacgcccccacugcaagc

SEQ ID NO: 55433 - RNA, 20 nt, Artificial Sequence
  MKO10055433_A_Tph1
  gRNA
gcccgaucagcucacugcga

SEQ ID NO: 55434 - RNA, 20 nt, Artificial Sequence
  MKO10055434_A_Tph1
  gRNA
aggguggucggcgucaaguu

SEQ ID NO: 55435 - RNA, 20 nt, Artificial Sequence
  MKO10055435_A_Tph1
  gRNA
cgaguccaccgagaggacgg

SEQ ID NO: 55436 - RNA, 20 nt, Artificial Sequence
  MKO10055436_A_Tph2
  gRNA
cgacuucagaacuucuucgu

SEQ ID NO: 55437 - RNA, 20 nt, Artificial Sequence
  MKO10055437_A_Tph2
  gRNA
uucugaagucgaaaucuucg

SEQ ID NO: 55438 - RNA, 20 nt, Artificial Sequence
  MKO10055438_A_Tph2
  gRNA
cagaucucgaggaugugccg

SEQ ID NO: 55439 - RNA, 20 nt, Artificial Sequence
  MKO10055439_A_Tpi1
  gRNA
agagauaccugcgaugaccu

SEQ ID NO: 55440 - RNA, 20 nt, Artificial Sequence
  MKO10055440_A_Tpi1
  gRNA
aagucgauguaagcgguggg

SEQ ID NO: 55441 - RNA, 20 nt, Artificial Sequence
  MKO10055441_A_Tpi1
  gRNA
agugagccacgcccuagcag

SEQ ID NO: 55442 - RNA, 20 nt, Artificial Sequence
  MKO10055442_A_Tpk1
  gRNA
augcacgauuucgccaucuu

SEQ ID NO: 55443 - RNA, 20 nt, Artificial Sequence
  MKO10055443_A_Tpk1
  gRNA
aaguccccacugacgaauuc

SEQ ID NO: 55444 - RNA, 20 nt, Artificial Sequence
  MKO10055444_A_Tpk1
  gRNA
uucuugccugaauucgucag

SEQ ID NO: 55445 - RNA, 20 nt, Artificial Sequence
  MKO10055445_A_Tpm1
  gRNA
ucucgaugaugaccagcuua

SEQ ID NO: 55446 - RNA, 20 nt, Artificial Sequence
  MKO10055446_A_Tpm1
  gRNA
gcugcagguggcccguaagc

SEQ ID NO: 55447 - RNA, 20 nt, Artificial Sequence
  MKO10055447_A_Tpm1
  gRNA
ggaggaguuggaucgugcuc

SEQ ID NO: 55448 - RNA, 20 nt, Artificial Sequence
  MKO10055448_A_Tpm2
  gRNA
ccgccgcauucagcucguag

SEQ ID NO: 55449 - RNA, 20 nt, Artificial Sequence
  MKO10055449_A_Tpm2
  gRNA
aagccgcggaugagagcgag

SEQ ID NO: 55450 - RNA, 20 nt, Artificial Sequence
  MKO10055450_A_Tpm2
  gRNA
aaaguauuccgaguccguga

SEQ ID NO: 55451 - RNA, 20 nt, Artificial Sequence
  MKO10055451_A_Tpm3
  gRNA
uaacagccguugccgagaga

SEQ ID NO: 55452 - RNA, 20 nt, Artificial Sequence
  MKO10055452_A_Tpm3
  gRNA
cuucuagguggcucguaagu

SEQ ID NO: 55453 - RNA, 20 nt, Artificial Sequence
  MKO10055453_A_Tpm3
  gRNA
ucugagugcugcugaagaaa

SEQ ID NO: 55454 - RNA, 20 nt, Artificial Sequence
  MKO10055454_A_Tpm4
  gRNA
cgaagccgaccgcaaguaug

SEQ ID NO: 55455 - RNA, 20 nt, Artificial Sequence
  MKO10055455_A_Tpm4
  gRNA
uuuguagguugcucguaagu

SEQ ID NO: 55456 - RNA, 20 nt, Artificial Sequence
  MKO10055456_A_Tpm4
  gRNA
ggaggaacuggaccgggcuc

SEQ ID NO: 55457 - RNA, 20 nt, Artificial Sequence
  MKO10055457_A_Tpmt
  gRNA
acuuaccgaucaugaucgcc

SEQ ID NO: 55458 - RNA, 20 nt, Artificial Sequence
  MKO10055458_A_Tpmt
  gRNA
aaaacacucgcaguccacuc

SEQ ID NO: 55459 - RNA, 20 nt, Artificial Sequence
  MKO10055459_A_Tpmt
  gRNA
aaugcgaaccuuaaauacuu

SEQ ID NO: 55460 - RNA, 20 nt, Artificial Sequence
  MKO10055460_A_Tpo
  gRNA
aauaaguaccggcccaucac

SEQ ID NO: 55461 - RNA, 20 nt, Artificial Sequence
  MKO10055461_A_Tpo
  gRNA
ccgguacuuauuugccaggc

SEQ ID NO: 55462 - RNA, 20 nt, Artificial Sequence
  MKO10055462_A_Tpo
  gRNA
aagcugcccgaguccaccag

SEQ ID NO: 55463 - RNA, 20 nt, Artificial Sequence
  MKO10055463_A_Tpp1
  gRNA
gauccuagcucuccucaaua

SEQ ID NO: 55464 - RNA, 20 nt, Artificial Sequence
  MKO10055464_A_Tpp1
  gRNA
aaucaacucacauccaccgc

SEQ ID NO: 55465 - RNA, 20 nt, Artificial Sequence
  MKO10055465_A_Tpp1
  gRNA
cuccuugcucucgucaucgc

SEQ ID NO: 55466 - RNA, 20 nt, Artificial Sequence
  MKO10055466_A_Tpp2
  gRNA
cacaccaagcagucauauac

SEQ ID NO: 55467 - RNA, 20 nt, Artificial Sequence
  MKO10055467_A_Tpp2
  gRNA
auugauaucauugauacaac

SEQ ID NO: 55468 - RNA, 20 nt, Artificial Sequence
  MKO10055468_A_Tpp2
  gRNA
auaggccaauaaacuaauca

SEQ ID NO: 55469 - RNA, 20 nt, Artificial Sequence
  MKO10055469_A_Tppp2
  gRNA
gcugggccaaaagcgcuuca

SEQ ID NO: 55470 - RNA, 20 nt, Artificial Sequence
  MKO10055470_A_Tppp2
  gRNA
cuccaaagacagcgaaucga

SEQ ID NO: 55471 - RNA, 20 nt, Artificial Sequence
  MKO10055471_A_Tppp2
  gRNA
acuacucacagugacaccgg

SEQ ID NO: 55472 - RNA, 20 nt, Artificial Sequence
  MKO10055472_A_Tppp3
  gRNA
ggccgacggaaaggccguaa

SEQ ID NO: 55473 - RNA, 20 nt, Artificial Sequence
  MKO10055473_A_Tppp3
  gRNA
cgccauggauggcaaacuuc

SEQ ID NO: 55474 - RNA, 20 nt, Artificial Sequence
  MKO10055474_A_Tppp3
  gRNA
ucacguagccacugucgucc

SEQ ID NO: 55475 - RNA, 20 nt, Artificial Sequence
  MKO10055475_A_Tppp
  gRNA
uuccggcgguuugcaguaca

SEQ ID NO: 55476 - RNA, 20 nt, Artificial Sequence
  MKO10055476_A_Tppp
  gRNA
aaggagcguuucgaccaauc

SEQ ID NO: 55477 - RNA, 20 nt, Artificial Sequence
  MKO10055477_A_Tppp
  gRNA
cauucuucccaucgaucacg

SEQ ID NO: 55478 - RNA, 20 nt, Artificial Sequence
  MKO10055478_A_Tpra1
  gRNA
agccagcacccgcuugaugc

SEQ ID NO: 55479 - RNA, 20 nt, Artificial Sequence
  MKO10055479_A_Tpra1
  gRNA
cccccugcaggguccgguac

SEQ ID NO: 55480 - RNA, 20 nt, Artificial Sequence
  MKO10055480_A_Tpra1
  gRNA
uaucaccacaguauugucuc

SEQ ID NO: 55481 - RNA, 20 nt, Artificial Sequence
  MKO10055481_A_Tprgl
  gRNA
ggucgaggagauccgcgccg

SEQ ID NO: 55482 - RNA, 20 nt, Artificial Sequence
  MKO10055482_A_Tprgl
  gRNA
uacacgccgcgcccgcguca

SEQ ID NO: 55483 - RNA, 20 nt, Artificial Sequence
  MKO10055483_A_Tprgl
  gRNA
ccuccucaucgagaccuacg

SEQ ID NO: 55484 - RNA, 20 nt, Artificial Sequence
  MKO10055484_A_Tprg
  gRNA
auacugauugagaccuacac

SEQ ID NO: 55485 - RNA, 20 nt, Artificial Sequence
  MKO10055485_A_Tprg
  gRNA
agucguauuugcagaucaag

SEQ ID NO: 55486 - RNA, 20 nt, Artificial Sequence
  MKO10055486_A_Tprg
  gRNA
agccaauacucccacgagca

SEQ ID NO: 55487 - RNA, 20 nt, Artificial Sequence
  MKO10055487_A_Tprkb
  gRNA
ggaacaccuaguaucucaag

SEQ ID NO: 55488 - RNA, 20 nt, Artificial Sequence
  MKO10055488_A_Tprkb
  gRNA
cauuuguagaaugucaacga

SEQ ID NO: 55489 - RNA, 20 nt, Artificial Sequence
  MKO10055489_A_Tprkb
  gRNA
cgauccauuucagauacuug

SEQ ID NO: 55490 - RNA, 20 nt, Artificial Sequence
  MKO10055490_A_Tprn
  gRNA
cgcgaaccgugaugcccgcc

SEQ ID NO: 55491 - RNA, 20 nt, Artificial Sequence
  MKO10055491_A_Tprn
  gRNA
ugccgagguaguaguguacg

SEQ ID NO: 55492 - RNA, 20 nt, Artificial Sequence
  MKO10055492_A_Tprn
  gRNA
ugccagucagaacgaccucu

SEQ ID NO: 55493 - RNA, 20 nt, Artificial Sequence
  MKO10055493_A_Tpr
  gRNA
guccgagaucgacugccuga

SEQ ID NO: 55494 - RNA, 20 nt, Artificial Sequence
  MKO10055494_A_Tpr
  gRNA
aguuuguucugcgucgacuu

SEQ ID NO: 55495 - RNA, 20 nt, Artificial Sequence
  MKO10055495_A_Tpr
  gRNA
aacugcucaagaccguaauc

SEQ ID NO: 55496 - RNA, 20 nt, Artificial Sequence
  MKO10055496_A_Tpsab1
  gRNA
uauccucucuagggcgacuc

SEQ ID NO: 55497 - RNA, 20 nt, Artificial Sequence
  MKO10055497_A_Tpsab1
  gRNA
ccccgacuucuacaucgucc

SEQ ID NO: 55498 - RNA, 20 nt, Artificial Sequence
  MKO10055498_A_Tpsab1
  gRNA
cucaaguagcuacacugcgc

SEQ ID NO: 55499 - RNA, 20 nt, Artificial Sequence
  MKO10055499_A_Tpsb2
  gRNA
cacccucggccguguaauag

SEQ ID NO: 55500 - RNA, 20 nt, Artificial Sequence
  MKO10055500_A_Tpsb2
  gRNA
ugugguacuuccggucacac

SEQ ID NO: 55501 - RNA, 20 nt, Artificial Sequence
  MKO10055501_A_Tpsb2
  gRNA
cacgaugcccacucgcugau

SEQ ID NO: 55502 - RNA, 20 nt, Artificial Sequence
  MKO10055502_A_Tpsg1
  gRNA
aaacucgggaagucgaaucg

SEQ ID NO: 55503 - RNA, 20 nt, Artificial Sequence
  MKO10055503_A_Tpsg1
  gRNA
agccagacaugcuaugcgcc

SEQ ID NO: 55504 - RNA, 20 nt, Artificial Sequence
  MKO10055504_A_Tpsg1
  gRNA
agcaggccggcguugucagc

SEQ ID NO: 55505 - RNA, 20 nt, Artificial Sequence
  MKO10055505_A_Tpst1
  gRNA
agucaucaaacccgucaacg

SEQ ID NO: 55506 - RNA, 20 nt, Artificial Sequence
  MKO10055506_A_Tpst1
  gRNA
ggagugccaucaccgaauag

SEQ ID NO: 55507 - RNA, 20 nt, Artificial Sequence
  MKO10055507_A_Tpst1
  gRNA
agcguucucauccaccguuc

SEQ ID NO: 55508 - RNA, 20 nt, Artificial Sequence
  MKO10055508_A_Tpst2
  gRNA
cacgcucaugcgcgccaugu

SEQ ID NO: 55509 - RNA, 20 nt, Artificial Sequence
  MKO10055509_A_Tpst2
  gRNA
gaugcucggcgccgaccacg

SEQ ID NO: 55510 - RNA, 20 nt, Artificial Sequence
  MKO10055510_A_Tpst2
  gRNA
cauacgggucauagccaagc

SEQ ID NO: 55511 - RNA, 20 nt, Artificial Sequence
  MKO10055511_A_Tpt1
  gRNA
ugcuaauuucaauaacuacc

SEQ ID NO: 55512 - RNA, 20 nt, Artificial Sequence
  MKO10055512_A_Tpt1
  gRNA
guagauggucaguagaacag

SEQ ID NO: 55513 - RNA, 20 nt, Artificial Sequence
  MKO10055513_A_Tpt1
  gRNA
ucaccuugcccuccaccucc

SEQ ID NO: 55514 - RNA, 20 nt, Artificial Sequence
  MKO10055514_A_Tpte
  gRNA
auuaaacuaaauggcagcac

SEQ ID NO: 55515 - RNA, 20 nt, Artificial Sequence
  MKO10055515_A_Tpte
  gRNA
agugcugccauuuaguuuaa

SEQ ID NO: 55516 - RNA, 20 nt, Artificial Sequence
  MKO10055516_A_Tpte
  gRNA
uucucagcccuccagaaaaa

SEQ ID NO: 55517 - RNA, 20 nt, Artificial Sequence
  MKO10055517_A_Tpx2
  gRNA
agaacaaguuucuucgacag

SEQ ID NO: 55518 - RNA, 20 nt, Artificial Sequence
  MKO10055518_A_Tpx2
  gRNA
uucgucacaccguugaaggc

SEQ ID NO: 55519 - RNA, 20 nt, Artificial Sequence
  MKO10055519_A_Tpx2
  gRNA
uaccuugcagguggcacacc

SEQ ID NO: 55520 - RNA, 20 nt, Artificial Sequence
  MKO10055520_A_Tra2a
  gRNA
gcuccuccgccgccuauacu

SEQ ID NO: 55521 - RNA, 20 nt, Artificial Sequence
  MKO10055521_A_Tra2a
  gRNA
ggacgguagaagaauccgug

SEQ ID NO: 55522 - RNA, 20 nt, Artificial Sequence
  MKO10055522_A_Tra2a
  gRNA
gguccuauacacccgaguau

SEQ ID NO: 55523 - RNA, 20 nt, Artificial Sequence
  MKO10055523_A_Tra2b
  gRNA
uucuuaccuagauucagacc

SEQ ID NO: 55524 - RNA, 20 nt, Artificial Sequence
  MKO10055524_A_Tra2b
  gRNA
ugaaaauguagacgaugcca

SEQ ID NO: 55525 - RNA, 20 nt, Artificial Sequence
  MKO10055525_A_Tra2b
  gRNA
aaggcuaaagaacgugccaa

SEQ ID NO: 55526 - RNA, 20 nt, Artificial Sequence
  MKO10055526_A_Trabd2b
  gRNA
acguucccuauacccgaguc

SEQ ID NO: 55527 - RNA, 20 nt, Artificial Sequence
  MKO10055527_A_Trabd2b
  gRNA
gauggcgccgaauaguccac

SEQ ID NO: 55528 - RNA, 20 nt, Artificial Sequence
  MKO10055528_A_Trabd2b
  gRNA
ugcugcagcacgaaagugug

SEQ ID NO: 55529 - RNA, 20 nt, Artificial Sequence
  MKO10055529_A_Trabd
  gRNA
ugcuuuccagacuauccggg

SEQ ID NO: 55530 - RNA, 20 nt, Artificial Sequence
  MKO10055530_A_Trabd
  gRNA
acuagcugggucacuguacg

SEQ ID NO: 55531 - RNA, 20 nt, Artificial Sequence
  MKO10055531_A_Trabd
  gRNA
uggccccugguggcgaguuc

SEQ ID NO: 55532 - RNA, 20 nt, Artificial Sequence
  MKO10055532_A_Tradd
  gRNA
ccagcagacguuugcgcgcu

SEQ ID NO: 55533 - RNA, 20 nt, Artificial Sequence
  MKO10055533_A_Tradd
  gRNA
cccaucacgcucauacucgu

SEQ ID NO: 55534 - RNA, 20 nt, Artificial Sequence
  MKO10055534_A_Tradd
  gRNA
uucugcgggcgcgugcugug

SEQ ID NO: 55535 - RNA, 20 nt, Artificial Sequence
  MKO10055535_A_Traf1
  gRNA
ugagcacagucugcgacuca

SEQ ID NO: 55536 - RNA, 20 nt, Artificial Sequence
  MKO10055536_A_Traf1
  gRNA
gcucucgguccaacuggcuc

SEQ ID NO: 55537 - RNA, 20 nt, Artificial Sequence
  MKO10055537_A_Traf1
  gRNA
caaccuagggucugcaccca

SEQ ID NO: 55538 - RNA, 20 nt, Artificial Sequence
  MKO10055538_A_Traf2
  gRNA
augcaggacacuccgucagc

SEQ ID NO: 55539 - RNA, 20 nt, Artificial Sequence
  MKO10055539_A_Traf2
  gRNA
aaaugcuuuaccgucucccg

SEQ ID NO: 55540 - RNA, 20 nt, Artificial Sequence
  MKO10055540_A_Traf2
  gRNA
agauaacgcugcccgcagag

SEQ ID NO: 55541 - RNA, 20 nt, Artificial Sequence
  MKO10055541_A_Traf3ip1
  gRNA
cuugugcuuucgacguccgc

SEQ ID NO: 55542 - RNA, 20 nt, Artificial Sequence
  MKO10055542_A_Traf3ip1
  gRNA
ucuucgauuuccgccguucc

SEQ ID NO: 55543 - RNA, 20 nt, Artificial Sequence
  MKO10055543_A_Traf3ip1
  gRNA
gaacggcggaaaucgaagaa

SEQ ID NO: 55544 - RNA, 20 nt, Artificial Sequence
  MKO10055544_A_Traf3ip2
  gRNA
ccuagcaaccccuuagcccg

SEQ ID NO: 55545 - RNA, 20 nt, Artificial Sequence
  MKO10055545_A_Traf3ip2
  gRNA
aacaacucacguaauucuuc

SEQ ID NO: 55546 - RNA, 20 nt, Artificial Sequence
  MKO10055546_A_Traf3ip2
  gRNA
auuuaaugauaucaauaccc

SEQ ID NO: 55547 - RNA, 20 nt, Artificial Sequence
  MKO10055547_A_Traf3ip3
  gRNA
aacucacuugguuugcugac

SEQ ID NO: 55548 - RNA, 20 nt, Artificial Sequence
  MKO10055548_A_Traf3ip3
  gRNA
cuaggacaucauucaacucu

SEQ ID NO: 55549 - RNA, 20 nt, Artificial Sequence
  MKO10055549_A_Traf3ip3
  gRNA
gccugaggaggaaugaugua

SEQ ID NO: 55550 - RNA, 20 nt, Artificial Sequence
  MKO10055550_A_Traf3
  gRNA
acggacccugcgccgcgauc

SEQ ID NO: 55551 - RNA, 20 nt, Artificial Sequence
  MKO10055551_A_Traf3
  gRNA
aaaggccuguaaauaccgcg

SEQ ID NO: 55552 - RNA, 20 nt, Artificial Sequence
  MKO10055552_A_Traf3
  gRNA
cgcaggguccgugcucgugc

SEQ ID NO: 55553 - RNA, 20 nt, Artificial Sequence
  MKO10055553_A_Traf4
  gRNA
cuucaguggggaggccuacg

SEQ ID NO: 55554 - RNA, 20 nt, Artificial Sequence
  MKO10055554_A_Traf4
  gRNA
gcuuagggcagucgugcugc

SEQ ID NO: 55555 - RNA, 20 nt, Artificial Sequence
  MKO10055555_A_Traf4
  gRNA
cucaccuguagaugacgaag

SEQ ID NO: 55556 - RNA, 20 nt, Artificial Sequence
  MKO10055556_A_Traf5
  gRNA
gucuacugcaaaaacgcccc

SEQ ID NO: 55557 - RNA, 20 nt, Artificial Sequence
  MKO10055557_A_Traf5
  gRNA
cuucccggcagcucucguua

SEQ ID NO: 55558 - RNA, 20 nt, Artificial Sequence
  MKO10055558_A_Traf5
  gRNA
gccgaucugcccgguagaca

SEQ ID NO: 55559 - RNA, 20 nt, Artificial Sequence
  MKO10055559_A_Traf6
  gRNA
acauuauugaggauuguccc

SEQ ID NO: 55560 - RNA, 20 nt, Artificial Sequence
  MKO10055560_A_Traf6
  gRNA
agcaguauuucauugucaac

SEQ ID NO: 55561 - RNA, 20 nt, Artificial Sequence
  MKO10055561_A_Traf6
  gRNA
ucuggaaaggacguuggcac

SEQ ID NO: 55562 - RNA, 20 nt, Artificial Sequence
  MKO10055562_A_Traf7
  gRNA
gcccgcuacgaccgcuucuc

SEQ ID NO: 55563 - RNA, 20 nt, Artificial Sequence
  MKO10055563_A_Traf7
  gRNA
gcggucguagcgggcacucu

SEQ ID NO: 55564 - RNA, 20 nt, Artificial Sequence
  MKO10055564_A_Traf7
  gRNA
ggucgaaaagguaggcccaa

SEQ ID NO: 55565 - RNA, 20 nt, Artificial Sequence
  MKO10055565_A_Trafd1
  gRNA
gcucgucguaagccuccgga

SEQ ID NO: 55566 - RNA, 20 nt, Artificial Sequence
  MKO10055566_A_Trafd1
  gRNA
ggccgaguuucgagaugacc

SEQ ID NO: 55567 - RNA, 20 nt, Artificial Sequence
  MKO10055567_A_Trafd1
  gRNA
cggaggcuuacgacgagccc

SEQ ID NO: 55568 - RNA, 20 nt, Artificial Sequence
  MKO10055568_A_Traip
  gRNA
uucacuguagccuaauccag

SEQ ID NO: 55569 - RNA, 20 nt, Artificial Sequence
  MKO10055569_A_Traip
  gRNA
ggaagaacgcaaugcuaccg

SEQ ID NO: 55570 - RNA, 20 nt, Artificial Sequence
  MKO10055570_A_Traip
  gRNA
cuuaccuggauucuacacug

SEQ ID NO: 55571 - RNA, 20 nt, Artificial Sequence
  MKO10055571_A_Trak1
  gRNA
augguuacgaccacgaugac

SEQ ID NO: 55572 - RNA, 20 nt, Artificial Sequence
  MKO10055572_A_Trak1
  gRNA
guucuaugugccgaaagagu

SEQ ID NO: 55573 - RNA, 20 nt, Artificial Sequence
  MKO10055573_A_Trak1
  gRNA
uguccgcucuuagcuuguaa

SEQ ID NO: 55574 - RNA, 20 nt, Artificial Sequence
  MKO10055574_A_Trak2
  gRNA
cuagcugcuccacgccccuu

SEQ ID NO: 55575 - RNA, 20 nt, Artificial Sequence
  MKO10055575_A_Trak2
  gRNA
cuagagcuagcugcccgaau

SEQ ID NO: 55576 - RNA, 20 nt, Artificial Sequence
  MKO10055576_A_Trak2
  gRNA
cuuagaugucugcuccaacg

SEQ ID NO: 55577 - RNA, 20 nt, Artificial Sequence
  MKO10055577_A_Tram1l1
  gRNA
ggcuccgcaagaagaacgcc

SEQ ID NO: 55578 - RNA, 20 nt, Artificial Sequence
  MKO10055578_A_Tram1l1
  gRNA
cgcggauauggucuccugcg

SEQ ID NO: 55579 - RNA, 20 nt, Artificial Sequence
  MKO10055579_A_Tram1l1
  gRNA
ccgggucagcucaucuacau

SEQ ID NO: 55580 - RNA, 20 nt, Artificial Sequence
  MKO10055580_A_Tram1
  gRNA
cacagcaaguuuaacgaguc

SEQ ID NO: 55581 - RNA, 20 nt, Artificial Sequence
  MKO10055581_A_Tram1
  gRNA
aauguuacccgcccugcaac

SEQ ID NO: 55582 - RNA, 20 nt, Artificial Sequence
  MKO10055582_A_Tram1
  gRNA
aaugaacgugccccacacac

SEQ ID NO: 55583 - RNA, 20 nt, Artificial Sequence
  MKO10055583_A_Tram2
  gRNA
uuacgucuaagauguacucc

SEQ ID NO: 55584 - RNA, 20 nt, Artificial Sequence
  MKO10055584_A_Tram2
  gRNA
ggcacacuaauguuauacug

SEQ ID NO: 55585 - RNA, 20 nt, Artificial Sequence
  MKO10055585_A_Tram2
  gRNA
aacauuagugugccuacagc

SEQ ID NO: 55586 - RNA, 20 nt, Artificial Sequence
  MKO10055586_A_Trank1
  gRNA
aagccucguuccauuucccg

SEQ ID NO: 55587 - RNA, 20 nt, Artificial Sequence
  MKO10055587_A_Trank1
  gRNA
uuccagggauacuaccgagc

SEQ ID NO: 55588 - RNA, 20 nt, Artificial Sequence
  MKO10055588_A_Trank1
  gRNA
agcagcauagccaguucccg

SEQ ID NO: 55589 - RNA, 20 nt, Artificial Sequence
  MKO10055589_A_Trap1a
  gRNA
uuuauugcaccgguacuccc

SEQ ID NO: 55590 - RNA, 20 nt, Artificial Sequence
  MKO10055590_A_Trap1a
  gRNA
gcgcauguccucugucgaug

SEQ ID NO: 55591 - RNA, 20 nt, Artificial Sequence
  MKO10055591_A_Trap1a
  gRNA
cuuccacgacccuaauuucc

SEQ ID NO: 55592 - RNA, 20 nt, Artificial Sequence
  MKO10055592_A_Trap1
  gRNA
accuaccuuugaccccgauc

SEQ ID NO: 55593 - RNA, 20 nt, Artificial Sequence
  MKO10055593_A_Trap1
  gRNA
gaagggcacuauuaccauuc

SEQ ID NO: 55594 - RNA, 20 nt, Artificial Sequence
  MKO10055594_A_Trap1
  gRNA
aauugccagaucggggucaa

SEQ ID NO: 55595 - RNA, 20 nt, Artificial Sequence
  MKO10055595_A_Trappc10
  gRNA
aggaugacaugcggacuuug

SEQ ID NO: 55596 - RNA, 20 nt, Artificial Sequence
  MKO10055596_A_Trappc10
  gRNA
cugcgaauacuucaugguuc

SEQ ID NO: 55597 - RNA, 20 nt, Artificial Sequence
  MKO10055597_A_Trappc10
  gRNA
uacugaaguguacaaagcua

SEQ ID NO: 55598 - RNA, 20 nt, Artificial Sequence
  MKO10055598_A_Trappc11
  gRNA
ggcagagaacgucguacgag

SEQ ID NO: 55599 - RNA, 20 nt, Artificial Sequence
  MKO10055599_A_Trappc11
  gRNA
gucugagugcgcuaccagag

SEQ ID NO: 55600 - RNA, 20 nt, Artificial Sequence
  MKO10055600_A_Trappc11
  gRNA
aagaaaacgccuuuaccgcc

SEQ ID NO: 55601 - RNA, 20 nt, Artificial Sequence
  MKO10055601_A_Trappc12
  gRNA
cuuaggcccgacuuccuccg

SEQ ID NO: 55602 - RNA, 20 nt, Artificial Sequence
  MKO10055602_A_Trappc12
  gRNA
acgucccccucgcuguuguu

SEQ ID NO: 55603 - RNA, 20 nt, Artificial Sequence
  MKO10055603_A_Trappc12
  gRNA
uacuacccacacguguaccc

SEQ ID NO: 55604 - RNA, 20 nt, Artificial Sequence
  MKO10055604_A_Trappc13
  gRNA
aucauucuuacccgaaauuu

SEQ ID NO: 55605 - RNA, 20 nt, Artificial Sequence
  MKO10055605_A_Trappc13
  gRNA
uccuucucuucacacguuac

SEQ ID NO: 55606 - RNA, 20 nt, Artificial Sequence
  MKO10055606_A_Trappc13
  gRNA
gaugauccuucaacuguaaa

SEQ ID NO: 55607 - RNA, 20 nt, Artificial Sequence
  MKO10055607_A_Trappc1
  gRNA
gaagaauccucugugcccgc

SEQ ID NO: 55608 - RNA, 20 nt, Artificial Sequence
  MKO10055608_A_Trappc1
  gRNA
cuugcugacaaacgaacgaa

SEQ ID NO: 55609 - RNA, 20 nt, Artificial Sequence
  MKO10055609_A_Trappc1
  gRNA
cauuacuacgagacucccac

SEQ ID NO: 55610 - RNA, 20 nt, Artificial Sequence
  MKO10055610_A_Trappc2l
  gRNA
ugcggaucucguugucccga

SEQ ID NO: 55611 - RNA, 20 nt, Artificial Sequence
  MKO10055611_A_Trappc2l
  gRNA
gagacgugugcaccauguag

SEQ ID NO: 55612 - RNA, 20 nt, Artificial Sequence
  MKO10055612_A_Trappc2l
  gRNA
gugcaaccccuucuacaacc

SEQ ID NO: 55613 - RNA, 20 nt, Artificial Sequence
  MKO10055613_A_Trappc2
  gRNA
guaucagccuuugucacugc

SEQ ID NO: 55614 - RNA, 20 nt, Artificial Sequence
  MKO10055614_A_Trappc2
  gRNA
gauaugcccugcagugacaa

SEQ ID NO: 55615 - RNA, 20 nt, Artificial Sequence
  MKO10055615_A_Trappc2
  gRNA
ugucuaugaucuguauauaa

SEQ ID NO: 55616 - RNA, 20 nt, Artificial Sequence
  MKO10055616_A_Trappc3l
  gRNA
auccacagggguuacaacau

SEQ ID NO: 55617 - RNA, 20 nt, Artificial Sequence
  MKO10055617_A_Trappc3l
  gRNA
uucgucgaagagcugccugc

SEQ ID NO: 55618 - RNA, 20 nt, Artificial Sequence
  MKO10055618_A_Trappc3l
  gRNA
ucuucgacgaacucugccag

SEQ ID NO: 55619 - RNA, 20 nt, Artificial Sequence
  MKO10055619_A_Trappc3
  gRNA
gguggcguucaagauguacc

SEQ ID NO: 55620 - RNA, 20 nt, Artificial Sequence
  MKO10055620_A_Trappc3
  gRNA
gagcuguucacgcugaccua

SEQ ID NO: 55621 - RNA, 20 nt, Artificial Sequence
  MKO10055621_A_Trappc3
  gRNA
cgaagacgugaacaagcagc

SEQ ID NO: 55622 - RNA, 20 nt, Artificial Sequence
  MKO10055622_A_Trappc4
  gRNA
uaaggcggggccggccgaau

SEQ ID NO: 55623 - RNA, 20 nt, Artificial Sequence
  MKO10055623_A_Trappc4
  gRNA
ggguaacccugcgaauuacc

SEQ ID NO: 55624 - RNA, 20 nt, Artificial Sequence
  MKO10055624_A_Trappc4
  gRNA
uucccagcuaucuccggaac

SEQ ID NO: 55625 - RNA, 20 nt, Artificial Sequence
  MKO10055625_A_Trappc5
  gRNA
auggaggcgcguuucacacg

SEQ ID NO: 55626 - RNA, 20 nt, Artificial Sequence
  MKO10055626_A_Trappc5
  gRNA
gggcgcauugcucuucguca

SEQ ID NO: 55627 - RNA, 20 nt, Artificial Sequence
  MKO10055627_A_Trappc5
  gRNA
cugccaagguuacggcgcac

SEQ ID NO: 55628 - RNA, 20 nt, Artificial Sequence
  MKO10055628_A_Trappc6a
  gRNA
gugcggcgcccuccauacac

SEQ ID NO: 55629 - RNA, 20 nt, Artificial Sequence
  MKO10055629_A_Trappc6a
  gRNA
cggacuccgcaccaaccacc

SEQ ID NO: 55630 - RNA, 20 nt, Artificial Sequence
  MKO10055630_A_Trappc6a
  gRNA
augccacggaggcggugacc

SEQ ID NO: 55631 - RNA, 20 nt, Artificial Sequence
  MKO10055631_A_Trappc6b
  gRNA
guauuuagaacaugcgucca

SEQ ID NO: 55632 - RNA, 20 nt, Artificial Sequence
  MKO10055632_A_Trappc6b
  gRNA
cagaggugguuugucgaacu

SEQ ID NO: 55633 - RNA, 20 nt, Artificial Sequence
  MKO10055633_A_Trappc6b
  gRNA
gguuuacgaaagauacugca

SEQ ID NO: 55634 - RNA, 20 nt, Artificial Sequence
  MKO10055634_A_Trappc8
  gRNA
uuagcgacuaauccuucugc

SEQ ID NO: 55635 - RNA, 20 nt, Artificial Sequence
  MKO10055635_A_Trappc8
  gRNA
cauggcccagugcgugcagu

SEQ ID NO: 55636 - RNA, 20 nt, Artificial Sequence
  MKO10055636_A_Trappc8
  gRNA
ggcuucgucgcugcacagcg

SEQ ID NO: 55637 - RNA, 20 nt, Artificial Sequence
  MKO10055637_A_Trappc9
  gRNA
ggacgcaugcggaaacacgu

SEQ ID NO: 55638 - RNA, 20 nt, Artificial Sequence
  MKO10055638_A_Trappc9
  gRNA
gguacacuaccacauguccg

SEQ ID NO: 55639 - RNA, 20 nt, Artificial Sequence
  MKO10055639_A_Trappc9
  gRNA
guccuagcgauucagaagcg

SEQ ID NO: 55640 - RNA, 20 nt, Artificial Sequence
  MKO10055640_A_Trau1
  gRNA
gagaucugcaagcgauccgc

SEQ ID NO: 55641 - RNA, 20 nt, Artificial Sequence
  MKO10055641_A_Trau1
  gRNA
ucauagcaguucucauccag

SEQ ID NO: 55642 - RNA, 20 nt, Artificial Sequence
  MKO10055642_A_Trau1
  gRNA
acucugaugacuacauucca

SEQ ID NO: 55643 - RNA, 20 nt, Artificial Sequence
  MKO10055643_A_Trcg1
  gRNA
uaccaccagugacgucuguc

SEQ ID NO: 55644 - RNA, 20 nt, Artificial Sequence
  MKO10055644_A_Trcg1
  gRNA
uaccugucccuggccgacca

SEQ ID NO: 55645 - RNA, 20 nt, Artificial Sequence
  MKO10055645_A_Trcg1
  gRNA
auuucuauggacgagggauc

SEQ ID NO: 55646 - RNA, 20 nt, Artificial Sequence
  MKO10055646_A_Trdmt1
  gRNA
uacaagaagcuaguuguccu

SEQ ID NO: 55647 - RNA, 20 nt, Artificial Sequence
  MKO10055647_A_Trdmt1
  gRNA
uuugacaguaagugaguaug

SEQ ID NO: 55648 - RNA, 20 nt, Artificial Sequence
  MKO10055648_A_Trdmt1
  gRNA
auagcagccaccacaugugc

SEQ ID NO: 55649 - RNA, 20 nt, Artificial Sequence
  MKO10055649_A_Trdn
  gRNA
uuuguugucuaucaccguug

SEQ ID NO: 55650 - RNA, 20 nt, Artificial Sequence
  MKO10055650_A_Trdn
  gRNA
gcaagcuccauugccaagau

SEQ ID NO: 55651 - RNA, 20 nt, Artificial Sequence
  MKO10055651_A_Trdn
  gRNA
ggauguauuccuaaaucccc

SEQ ID NO: 55652 - RNA, 20 nt, Artificial Sequence
  MKO10055652_A_Treh
  gRNA
aaguccucagcuaccccgag

SEQ ID NO: 55653 - RNA, 20 nt, Artificial Sequence
  MKO10055653_A_Treh
  gRNA
uagcauccgagaucuucugc

SEQ ID NO: 55654 - RNA, 20 nt, Artificial Sequence
  MKO10055654_A_Treh
  gRNA
gaauucaacaaagcgccccc

SEQ ID NO: 55655 - RNA, 20 nt, Artificial Sequence
  MKO10055655_A_Trem1
  gRNA
cuuggagucacuaucauaaa

SEQ ID NO: 55656 - RNA, 20 nt, Artificial Sequence
  MKO10055656_A_Trem1
  gRNA
gcucuuccauccuguccgcc

SEQ ID NO: 55657 - RNA, 20 nt, Artificial Sequence
  MKO10055657_A_Trem1
  gRNA
agucauuugaacuuguagca

SEQ ID NO: 55658 - RNA, 20 nt, Artificial Sequence
  MKO10055658_A_Trem2
  gRNA
agaggcccgcgucaccggcu

SEQ ID NO: 55659 - RNA, 20 nt, Artificial Sequence
  MKO10055659_A_Trem2
  gRNA
cgaggagucaucgaguuucg

SEQ ID NO: 55660 - RNA, 20 nt, Artificial Sequence
  MKO10055660_A_Trem2
  gRNA
agaauucucucacguaccuc

SEQ ID NO: 55661 - RNA, 20 nt, Artificial Sequence
  MKO10055661_A_Trem3
  gRNA
auguuaucauucugcgucaa

SEQ ID NO: 55662 - RNA, 20 nt, Artificial Sequence
  MKO10055662_A_Trem3
  gRNA
ucccaccgaaucugucguca

SEQ ID NO: 55663 - RNA, 20 nt, Artificial Sequence
  MKO10055663_A_Trem3
  gRNA
gucagaacgaucaccaucac

SEQ ID NO: 55664 - RNA, 20 nt, Artificial Sequence
  MKO10055664_A_Treml1
  gRNA
aggaauaugcgcccguuucc

SEQ ID NO: 55665 - RNA, 20 nt, Artificial Sequence
  MKO10055665_A_Treml1
  gRNA
uucuagugcagugccacuac

SEQ ID NO: 55666 - RNA, 20 nt, Artificial Sequence
  MKO10055666_A_Treml1
  gRNA
gggguccucgagcagacuuc

SEQ ID NO: 55667 - RNA, 20 nt, Artificial Sequence
  MKO10055667_A_Treml2
  gRNA
uggucguagccuacggguuu

SEQ ID NO: 55668 - RNA, 20 nt, Artificial Sequence
  MKO10055668_A_Treml2
  gRNA
auacugguguaugcguaaca

SEQ ID NO: 55669 - RNA, 20 nt, Artificial Sequence
  MKO10055669_A_Treml2
  gRNA
gccacccguuaacucccaac

SEQ ID NO: 55670 - RNA, 20 nt, Artificial Sequence
  MKO10055670_A_Treml4
  gRNA
agcggagcaaucgucugcga

SEQ ID NO: 55671 - RNA, 20 nt, Artificial Sequence
  MKO10055671_A_Treml4
  gRNA
ccuuaccuggcgacaccacc

SEQ ID NO: 55672 - RNA, 20 nt, Artificial Sequence
  MKO10055672_A_Treml4
  gRNA
cccaaguaaauguacgagag

SEQ ID NO: 55673 - RNA, 20 nt, Artificial Sequence
  MKO10055673_A_Trerf1
  gRNA
uuucuggguccggaucucgc

SEQ ID NO: 55674 - RNA, 20 nt, Artificial Sequence
  MKO10055674_A_Trerf1
  gRNA
uauuguugaccugaauccgc

SEQ ID NO: 55675 - RNA, 20 nt, Artificial Sequence
  MKO10055675_A_Trerf1
  gRNA
ggguggcugugucgcggucc

SEQ ID NO: 55676 - RNA, 20 nt, Artificial Sequence
  MKO10055676_A_Trex1
  gRNA
ucaacgcuucgaugacaacc

SEQ ID NO: 55677 - RNA, 20 nt, Artificial Sequence
  MKO10055677_A_Trex1
  gRNA
agcaccgucaagcccaugua

SEQ ID NO: 55678 - RNA, 20 nt, Artificial Sequence
  MKO10055678_A_Trex1
  gRNA
gcaucuacacccgccuguac

SEQ ID NO: 55679 - RNA, 20 nt, Artificial Sequence
  MKO10055679_A_Trex2
  gRNA
uuggcaguaaaggggcgcuc

SEQ ID NO: 55680 - RNA, 20 nt, Artificial Sequence
  MKO10055680_A_Trex2
  gRNA
gcagggcuuccuaagccgcc

SEQ ID NO: 55681 - RNA, 20 nt, Artificial Sequence
  MKO10055681_A_Trex2
  gRNA
gcacuggcauucaggcuucg

SEQ ID NO: 55682 - RNA, 20 nt, Artificial Sequence
  MKO10055682_A_Trf
  gRNA
uccauaaaacuccgccgcca

SEQ ID NO: 55683 - RNA, 20 nt, Artificial Sequence
  MKO10055683_A_Trf
  gRNA
acagaccuacuacuacgcug

SEQ ID NO: 55684 - RNA, 20 nt, Artificial Sequence
  MKO10055684_A_Trf
  gRNA
ggggguuggguguacgaugc

SEQ ID NO: 55685 - RNA, 20 nt, Artificial Sequence
  MKO10055685_A_Trhde
  gRNA
ggauccucuucugauagcgu

SEQ ID NO: 55686 - RNA, 20 nt, Artificial Sequence
  MKO10055686_A_Trhde
  gRNA
agacccgacgcuaucagaag

SEQ ID NO: 55687 - RNA, 20 nt, Artificial Sequence
  MKO10055687_A_Trhde
  gRNA
ugugaaguugcaaaucgccc

SEQ ID NO: 55688 - RNA, 20 nt, Artificial Sequence
  MKO10055688_A_Trhr2
  gRNA
cgggccagacggaucaucgc

SEQ ID NO: 55689 - RNA, 20 nt, Artificial Sequence
  MKO10055689_A_Trhr2
  gRNA
gggcgcaugcugcacgucuc

SEQ ID NO: 55690 - RNA, 20 nt, Artificial Sequence
  MKO10055690_A_Trhr2
  gRNA
accgagacuacuuuguacuc

SEQ ID NO: 55691 - RNA, 20 nt, Artificial Sequence
  MKO10055691_A_Trhr
  gRNA
ugacacauacguaucgguga

SEQ ID NO: 55692 - RNA, 20 nt, Artificial Sequence
  MKO10055692_A_Trhr
  gRNA
caccuacaaaaacgcuguug

SEQ ID NO: 55693 - RNA, 20 nt, Artificial Sequence
  MKO10055693_A_Trhr
  gRNA
ggucaccaagaugcucgcag

SEQ ID NO: 55694 - RNA, 20 nt, Artificial Sequence
  MKO10055694_A_Trh
  gRNA
ggccagaacgucgauucuug

SEQ ID NO: 55695 - RNA, 20 nt, Artificial Sequence
  MKO10055695_A_Trh
  gRNA
aaagaccuccagcgugugcg

SEQ ID NO: 55696 - RNA, 20 nt, Artificial Sequence
  MKO10055696_A_Trh
  gRNA
cagggugcugccgcuugacu

SEQ ID NO: 55697 - RNA, 20 nt, Artificial Sequence
  MKO10055697_A_Triap1
  gRNA
gacucaccugcacgcacugc

SEQ ID NO: 55698 - RNA, 20 nt, Artificial Sequence
  MKO10055698_A_Triap1
  gRNA
ccccggagccguccccuuug

SEQ ID NO: 55699 - RNA, 20 nt, Artificial Sequence
  MKO10055699_A_Triap1
  gRNA
agagauuccuauugaaggcc

SEQ ID NO: 55700 - RNA, 20 nt, Artificial Sequence
  MKO10055700_A_Trib1
  gRNA
gcagcagguagucggcgauu

SEQ ID NO: 55701 - RNA, 20 nt, Artificial Sequence
  MKO10055701_A_Trib1
  gRNA
gcguauagagcaucaccccg

SEQ ID NO: 55702 - RNA, 20 nt, Artificial Sequence
  MKO10055702_A_Trib1
  gRNA
uuaccuugcagcgcagcucg

SEQ ID NO: 55703 - RNA, 20 nt, Artificial Sequence
  MKO10055703_A_Trib2
  gRNA
gcucugacggcucccgucgc

SEQ ID NO: 55704 - RNA, 20 nt, Artificial Sequence
  MKO10055704_A_Trib2
  gRNA
cuugcccgaauaacugccgc

SEQ ID NO: 55705 - RNA, 20 nt, Artificial Sequence
  MKO10055705_A_Trib2
  gRNA
gaaacgcaaugcgacaaguu

SEQ ID NO: 55706 - RNA, 20 nt, Artificial Sequence
  MKO10055706_A_Trib3
  gRNA
ccggcagauggcuagugccg

SEQ ID NO: 55707 - RNA, 20 nt, Artificial Sequence
  MKO10055707_A_Trib3
  gRNA
cuagaugcgagcuacaccuc

SEQ ID NO: 55708 - RNA, 20 nt, Artificial Sequence
  MKO10055708_A_Trib3
  gRNA
agcccggcagccucggacuc

SEQ ID NO: 55709 - RNA, 20 nt, Artificial Sequence
  MKO10055709_A_Tril
  gRNA
gcgaaccgcccagcgcaccg

SEQ ID NO: 55710 - RNA, 20 nt, Artificial Sequence
  MKO10055710_A_Tril
  gRNA
ucucguugccguuggcguaa

SEQ ID NO: 55711 - RNA, 20 nt, Artificial Sequence
  MKO10055711_A_Tril
  gRNA
uugcgcauccuuuacgccaa

SEQ ID NO: 55712 - RNA, 20 nt, Artificial Sequence
  MKO10055712_A_Trim10
  gRNA
gauccgggacuucccccaac

SEQ ID NO: 55713 - RNA, 20 nt, Artificial Sequence
  MKO10055713_A_Trim10
  gRNA
ccgguucagcacccugauug

SEQ ID NO: 55714 - RNA, 20 nt, Artificial Sequence
  MKO10055714_A_Trim10
  gRNA
gacugcccucuuagcacaac

SEQ ID NO: 55715 - RNA, 20 nt, Artificial Sequence
  MKO10055715_A_Trim11
  gRNA
acauuaaggacgcccugugc

SEQ ID NO: 55716 - RNA, 20 nt, Artificial Sequence
  MKO10055716_A_Trim11
  gRNA
guucugccgcgccugcguga

SEQ ID NO: 55717 - RNA, 20 nt, Artificial Sequence
  MKO10055717_A_Trim11
  gRNA
cgcccagcacauucugccgc

SEQ ID NO: 55718 - RNA, 20 nt, Artificial Sequence
  MKO10055718_A_Trim12a
  gRNA
agaaagaugugcagaauguu

SEQ ID NO: 55719 - RNA, 20 nt, Artificial Sequence
  MKO10055719_A_Trim12a
  gRNA
guguggagaacaucauagaa

SEQ ID NO: 55720 - RNA, 20 nt, Artificial Sequence
  MKO10055720_A_Trim12a
  gRNA
auaagaaaaaauuugaaaac

SEQ ID NO: 55721 - RNA, 20 nt, Artificial Sequence
  MKO10055721_A_Trim12c
  gRNA
agaagacuucauuucagaug

SEQ ID NO: 55722 - RNA, 20 nt, Artificial Sequence
  MKO10055722_A_Trim12c
  gRNA
caugaacucugaagagaaga

SEQ ID NO: 55723 - RNA, 20 nt, Artificial Sequence
  MKO10055723_A_Trim12c
  gRNA
acaagaaagaauuugaaaac

SEQ ID NO: 55724 - RNA, 20 nt, Artificial Sequence
  MKO10055724_A_Trim13
  gRNA
ggaaugugcggaauucccug

SEQ ID NO: 55725 - RNA, 20 nt, Artificial Sequence
  MKO10055725_A_Trim13
  gRNA
cugaauccuucgugaguaac

SEQ ID NO: 55726 - RNA, 20 nt, Artificial Sequence
  MKO10055726_A_Trim13
  gRNA
uuacucccuaaaggguaucg

SEQ ID NO: 55727 - RNA, 20 nt, Artificial Sequence
  MKO10055727_A_Trim14
  gRNA
acgcagacucaaguaaagcc

SEQ ID NO: 55728 - RNA, 20 nt, Artificial Sequence
  MKO10055728_A_Trim14
  gRNA
cgggagcaagccgagacuug

SEQ ID NO: 55729 - RNA, 20 nt, Artificial Sequence
  MKO10055729_A_Trim14
  gRNA
ugcggacaacauagcccauu

SEQ ID NO: 55730 - RNA, 20 nt, Artificial Sequence
  MKO10055730_A_Trim15
  gRNA
uccccgcagggaccggguug

SEQ ID NO: 55731 - RNA, 20 nt, Artificial Sequence
  MKO10055731_A_Trim15
  gRNA
gcacggugaugcccucaacc

SEQ ID NO: 55732 - RNA, 20 nt, Artificial Sequence
  MKO10055732_A_Trim15
  gRNA
ggucgaccggcugaguaccc

SEQ ID NO: 55733 - RNA, 20 nt, Artificial Sequence
  MKO10055733_A_Trim16
  gRNA
ucgagguccuauacuugcgc

SEQ ID NO: 55734 - RNA, 20 nt, Artificial Sequence
  MKO10055734_A_Trim16
  gRNA
ccauuguccagcgcaaguau

SEQ ID NO: 55735 - RNA, 20 nt, Artificial Sequence
  MKO10055735_A_Trim16
  gRNA
gggccuuccguacagcugcg

SEQ ID NO: 55736 - RNA, 20 nt, Artificial Sequence
  MKO10055736_A_Trim17
  gRNA
accuaccugccacucaguua

SEQ ID NO: 55737 - RNA, 20 nt, Artificial Sequence
  MKO10055737_A_Trim17
  gRNA
ggacauaaaauaucuacggg

SEQ ID NO: 55738 - RNA, 20 nt, Artificial Sequence
  MKO10055738_A_Trim17
  gRNA
ggaccaccaaagccgcuccc

SEQ ID NO: 55739 - RNA, 20 nt, Artificial Sequence
  MKO10055739_A_Trim21
  gRNA
cugcgugaauccucgacuuc

SEQ ID NO: 55740 - RNA, 20 nt, Artificial Sequence
  MKO10055740_A_Trim21
  gRNA
cgcacuucagaauagcuugc

SEQ ID NO: 55741 - RNA, 20 nt, Artificial Sequence
  MKO10055741_A_Trim21
  gRNA
gggcaugugcuuguuagguc

SEQ ID NO: 55742 - RNA, 20 nt, Artificial Sequence
  MKO10055742_A_Trim23
  gRNA
cugcauacggaccuucacug

SEQ ID NO: 55743 - RNA, 20 nt, Artificial Sequence
  MKO10055743_A_Trim23
  gRNA
auguucgagaaaaacugauu

SEQ ID NO: 55744 - RNA, 20 nt, Artificial Sequence
  MKO10055744_A_Trim23
  gRNA
guauuuauagcauucaguac

SEQ ID NO: 55745 - RNA, 20 nt, Artificial Sequence
  MKO10055745_A_Trim24
  gRNA
acaaaacacuggucgcugac

SEQ ID NO: 55746 - RNA, 20 nt, Artificial Sequence
  MKO10055746_A_Trim24
  gRNA
cauguauuagagcucaccag

SEQ ID NO: 55747 - RNA, 20 nt, Artificial Sequence
  MKO10055747_A_Trim24
  gRNA
uacaguagaaaagucuaauc

SEQ ID NO: 55748 - RNA, 20 nt, Artificial Sequence
  MKO10055748_A_Trim25
  gRNA
cagcuccuugcgcaaguuaa

SEQ ID NO: 55749 - RNA, 20 nt, Artificial Sequence
  MKO10055749_A_Trim25
  gRNA
ccucguaggauucuaugaag

SEQ ID NO: 55750 - RNA, 20 nt, Artificial Sequence
  MKO10055750_A_Trim25
  gRNA
uuacgaauggucuucuucga

SEQ ID NO: 55751 - RNA, 20 nt, Artificial Sequence
  MKO10055751_A_Trim26
  gRNA
ugagcuugaccgguugacuc

SEQ ID NO: 55752 - RNA, 20 nt, Artificial Sequence
  MKO10055752_A_Trim26
  gRNA
ggucaagcucacugacgccc

SEQ ID NO: 55753 - RNA, 20 nt, Artificial Sequence
  MKO10055753_A_Trim26
  gRNA
ugaaccacuugaacacccua

SEQ ID NO: 55754 - RNA, 20 nt, Artificial Sequence
  MKO10055754_A_Trim27
  gRNA
gcagcucuaucacucguuga

SEQ ID NO: 55755 - RNA, 20 nt, Artificial Sequence
  MKO10055755_A_Trim27
  gRNA
uaccuguaagagcucccgcg

SEQ ID NO: 55756 - RNA, 20 nt, Artificial Sequence
  MKO10055756_A_Trim27
  gRNA
ggagcaaauccagaaccgac

SEQ ID NO: 55757 - RNA, 20 nt, Artificial Sequence
  MKO10055757_A_Trim28
  gRNA
ggaccugcuaagacucgaga

SEQ ID NO: 55758 - RNA, 20 nt, Artificial Sequence
  MKO10055758_A_Trim28
  gRNA
auaauucuccacgaugucuu

SEQ ID NO: 55759 - RNA, 20 nt, Artificial Sequence
  MKO10055759_A_Trim28
  gRNA
uuacgagcuucgaaccuccu

SEQ ID NO: 55760 - RNA, 20 nt, Artificial Sequence
  MKO10055760_A_Trim29
  gRNA
gagcuuuaccaccaacgaga

SEQ ID NO: 55761 - RNA, 20 nt, Artificial Sequence
  MKO10055761_A_Trim29
  gRNA
aaugaaguugcggcucaaau

SEQ ID NO: 55762 - RNA, 20 nt, Artificial Sequence
  MKO10055762_A_Trim29
  gRNA
gacgcaugcacacauugagc

SEQ ID NO: 55763 - RNA, 20 nt, Artificial Sequence
  MKO10055763_A_Trim2
  gRNA
ugggguucuuguaccguucc

SEQ ID NO: 55764 - RNA, 20 nt, Artificial Sequence
  MKO10055764_A_Trim2
  gRNA
cagccggccccccaugucag

SEQ ID NO: 55765 - RNA, 20 nt, Artificial Sequence
  MKO10055765_A_Trim2
  gRNA
ugucuggcgacacaccgggc

SEQ ID NO: 55766 - RNA, 20 nt, Artificial Sequence
  MKO10055766_A_Trim30a
  gRNA
agucaacucucugcaguuga

SEQ ID NO: 55767 - RNA, 20 nt, Artificial Sequence
  MKO10055767_A_Trim30a
  gRNA
uucaacugcagagaguugac

SEQ ID NO: 55768 - RNA, 20 nt, Artificial Sequence
  MKO10055768_A_Trim30a
  gRNA
uuucuacauugaucuguauu

SEQ ID NO: 55769 - RNA, 20 nt, Artificial Sequence
  MKO10055769_A_Trim30b
  gRNA
auuaaaauauugaccguauc

SEQ ID NO: 55770 - RNA, 20 nt, Artificial Sequence
  MKO10055770_A_Trim30b
  gRNA
ugagagaguccuagcuuccc

SEQ ID NO: 55771 - RNA, 20 nt, Artificial Sequence
  MKO10055771_A_Trim30b
  gRNA
ggauuauagggaugaaguau

SEQ ID NO: 55772 - RNA, 20 nt, Artificial Sequence
  MKO10055772_A_Trim30d
  gRNA
cucauauguucagcaucagu

SEQ ID NO: 55773 - RNA, 20 nt, Artificial Sequence
  MKO10055773_A_Trim30d
  gRNA
uguagcaugccuuucaaaug

SEQ ID NO: 55774 - RNA, 20 nt, Artificial Sequence
  MKO10055774_A_Trim30d
  gRNA
gacauucagauagaguuuaa

SEQ ID NO: 55775 - RNA, 20 nt, Artificial Sequence
  MKO10055775_A_Trim31
  gRNA
aaggggcaaucugggcguuc

SEQ ID NO: 55776 - RNA, 20 nt, Artificial Sequence
  MKO10055776_A_Trim31
  gRNA
acauuaaagacgccuugagc

SEQ ID NO: 55777 - RNA, 20 nt, Artificial Sequence
  MKO10055777_A_Trim31
  gRNA
ccugcgccagagacuagaug

SEQ ID NO: 55778 - RNA, 20 nt, Artificial Sequence
  MKO10055778_A_Trim32
  gRNA
gaagauuuccgcugcaucgc

SEQ ID NO: 55779 - RNA, 20 nt, Artificial Sequence
  MKO10055779_A_Trim32
  gRNA
ugcucggggcgaccucauug

SEQ ID NO: 55780 - RNA, 20 nt, Artificial Sequence
  MKO10055780_A_Trim32
  gRNA
cuacagcguccuuauucgag

SEQ ID NO: 55781 - RNA, 20 nt, Artificial Sequence
  MKO10055781_A_Trim33
  gRNA
ccggcggccccggcgguuac

SEQ ID NO: 55782 - RNA, 20 nt, Artificial Sequence
  MKO10055782_A_Trim33
  gRNA
cuacauucuugacgacauac

SEQ ID NO: 55783 - RNA, 20 nt, Artificial Sequence
  MKO10055783_A_Trim33
  gRNA
ggugcggcugggcccgacga

SEQ ID NO: 55784 - RNA, 20 nt, Artificial Sequence
  MKO10055784_A_Trim34a
  gRNA
gucagauacagaguugcugc

SEQ ID NO: 55785 - RNA, 20 nt, Artificial Sequence
  MKO10055785_A_Trim34a
  gRNA
ucagccucgugagagcuuuc

SEQ ID NO: 55786 - RNA, 20 nt, Artificial Sequence
  MKO10055786_A_Trim34a
  gRNA
aucuccagaaagcucucacg

SEQ ID NO: 55787 - RNA, 20 nt, Artificial Sequence
  MKO10055787_A_Trim34b
  gRNA
gucagauacagagcugcugc

SEQ ID NO: 55788 - RNA, 20 nt, Artificial Sequence
  MKO10055788_A_Trim34b
  gRNA
ucagccucgugagagcuuuc

SEQ ID NO: 55789 - RNA, 20 nt, Artificial Sequence
  MKO10055789_A_Trim34b
  gRNA
aucuccagaaagcucucacg

SEQ ID NO: 55790 - RNA, 20 nt, Artificial Sequence
  MKO10055790_A_Trim35
  gRNA
augcuuggauccguugaguc

SEQ ID NO: 55791 - RNA, 20 nt, Artificial Sequence
  MKO10055791_A_Trim35
  gRNA
ugguguaggugcaaacgacu

SEQ ID NO: 55792 - RNA, 20 nt, Artificial Sequence
  MKO10055792_A_Trim35
  gRNA
aacacaagagccgaaaacgc

SEQ ID NO: 55793 - RNA, 20 nt, Artificial Sequence
  MKO10055793_A_Trim36
  gRNA
aaacgauugucgagagauac

SEQ ID NO: 55794 - RNA, 20 nt, Artificial Sequence
  MKO10055794_A_Trim36
  gRNA
gcuuauuugcccagcgugca

SEQ ID NO: 55795 - RNA, 20 nt, Artificial Sequence
  MKO10055795_A_Trim36
  gRNA
aucgacaagauuaacagacc

SEQ ID NO: 55796 - RNA, 20 nt, Artificial Sequence
  MKO10055796_A_Trim37
  gRNA
acuggugaacugucguuggg

SEQ ID NO: 55797 - RNA, 20 nt, Artificial Sequence
  MKO10055797_A_Trim37
  gRNA
aguucaccaguucccguagc

SEQ ID NO: 55798 - RNA, 20 nt, Artificial Sequence
  MKO10055798_A_Trim37
  gRNA
ucugccaucagugugcacuu

SEQ ID NO: 55799 - RNA, 20 nt, Artificial Sequence
  MKO10055799_A_Trim38
  gRNA
acgauauuacgacgucacca

SEQ ID NO: 55800 - RNA, 20 nt, Artificial Sequence
  MKO10055800_A_Trim38
  gRNA
caugaagcgaaacccacuga

SEQ ID NO: 55801 - RNA, 20 nt, Artificial Sequence
  MKO10055801_A_Trim38
  gRNA
cucaaacgucugcuguagau

SEQ ID NO: 55802 - RNA, 20 nt, Artificial Sequence
  MKO10055802_A_Trim39
  gRNA
gcagacacugcuuucacgac

SEQ ID NO: 55803 - RNA, 20 nt, Artificial Sequence
  MKO10055803_A_Trim39
  gRNA
agagacugguggagagccgc

SEQ ID NO: 55804 - RNA, 20 nt, Artificial Sequence
  MKO10055804_A_Trim39
  gRNA
gacuucaguauccauagagc

SEQ ID NO: 55805 - RNA, 20 nt, Artificial Sequence
  MKO10055805_A_Trim3
  gRNA
gacgaacucgucuuucgugu

SEQ ID NO: 55806 - RNA, 20 nt, Artificial Sequence
  MKO10055806_A_Trim3
  gRNA
uacugcaaggcgcacaccau

SEQ ID NO: 55807 - RNA, 20 nt, Artificial Sequence
  MKO10055807_A_Trim3
  gRNA
auguguggugagugccgcgc

SEQ ID NO: 55808 - RNA, 20 nt, Artificial Sequence
  MKO10055808_A_Trim40
  gRNA
ccauguuccgaggggguccu

SEQ ID NO: 55809 - RNA, 20 nt, Artificial Sequence
  MKO10055809_A_Trim40
  gRNA
agaaccugcgcacccucuuc

SEQ ID NO: 55810 - RNA, 20 nt, Artificial Sequence
  MKO10055810_A_Trim40
  gRNA
cucucuaggaaagacucaac

SEQ ID NO: 55811 - RNA, 20 nt, Artificial Sequence
  MKO10055811_A_Trim41
  gRNA
cgcucacuugcaguagccgc

SEQ ID NO: 55812 - RNA, 20 nt, Artificial Sequence
  MKO10055812_A_Trim41
  gRNA
uguuagccgcccaaacucug

SEQ ID NO: 55813 - RNA, 20 nt, Artificial Sequence
  MKO10055813_A_Trim41
  gRNA
uccugacagacgccaucgug

SEQ ID NO: 55814 - RNA, 20 nt, Artificial Sequence
  MKO10055814_A_Trim42
  gRNA
ugcgccgggugcggcacacc

SEQ ID NO: 55815 - RNA, 20 nt, Artificial Sequence
  MKO10055815_A_Trim42
  gRNA
ugcggcaguacucguugaug

SEQ ID NO: 55816 - RNA, 20 nt, Artificial Sequence
  MKO10055816_A_Trim42
  gRNA
gcgcccgccaagacgacuga

SEQ ID NO: 55817 - RNA, 20 nt, Artificial Sequence
  MKO10055817_A_Trim43a
  gRNA
cgagagaaaucaacuaauag

SEQ ID NO: 55818 - RNA, 20 nt, Artificial Sequence
  MKO10055818_A_Trim43a
  gRNA
guugaucccuuucuucacag

SEQ ID NO: 55819 - RNA, 20 nt, Artificial Sequence
  MKO10055819_A_Trim43a
  gRNA
auggaaugggcauggagucu

SEQ ID NO: 55820 - RNA, 20 nt, Artificial Sequence
  MKO10055820_A_Trim43b
  gRNA
uucagaaguccaugaagcua

SEQ ID NO: 55821 - RNA, 20 nt, Artificial Sequence
  MKO10055821_A_Trim43b
  gRNA
ggaggaacuucuaaagcaca

SEQ ID NO: 55822 - RNA, 20 nt, Artificial Sequence
  MKO10055822_A_Trim43b
  gRNA
cauacccaccaaccaccaca

SEQ ID NO: 55823 - RNA, 20 nt, Artificial Sequence
  MKO10055823_A_Trim43c
  gRNA
cauacccaccaaccaccaca

SEQ ID NO: 55824 - RNA, 20 nt, Artificial Sequence
  MKO10055824_A_Trim43c
  gRNA
ggaggaacuucuaaagcaca

SEQ ID NO: 55825 - RNA, 20 nt, Artificial Sequence
  MKO10055825_A_Trim43c
  gRNA
ucaccugcaccagcagcucc

SEQ ID NO: 55826 - RNA, 20 nt, Artificial Sequence
  MKO10055826_A_Trim44
  gRNA
uagcggugccagugaagaag

SEQ ID NO: 55827 - RNA, 20 nt, Artificial Sequence
  MKO10055827_A_Trim44
  gRNA
ucaugugacugagauauugg

SEQ ID NO: 55828 - RNA, 20 nt, Artificial Sequence
  MKO10055828_A_Trim44
  gRNA
agagguaucaaguuguuccu

SEQ ID NO: 55829 - RNA, 20 nt, Artificial Sequence
  MKO10055829_A_Trim45
  gRNA
cuccaagaugcgaacgcguc

SEQ ID NO: 55830 - RNA, 20 nt, Artificial Sequence
  MKO10055830_A_Trim45
  gRNA
uuccagacgcguucgcaucu

SEQ ID NO: 55831 - RNA, 20 nt, Artificial Sequence
  MKO10055831_A_Trim45
  gRNA
guugaauacagugcccgccc

SEQ ID NO: 55832 - RNA, 20 nt, Artificial Sequence
  MKO10055832_A_Trim46
  gRNA
ggcacgggaauaggaucguc

SEQ ID NO: 55833 - RNA, 20 nt, Artificial Sequence
  MKO10055833_A_Trim46
  gRNA
ggagaagugggcuccgaacu

SEQ ID NO: 55834 - RNA, 20 nt, Artificial Sequence
  MKO10055834_A_Trim46
  gRNA
gguuucggaaaagcccggaa

SEQ ID NO: 55835 - RNA, 20 nt, Artificial Sequence
  MKO10055835_A_Trim47
  gRNA
ucuggagcgcuacugucgcg

SEQ ID NO: 55836 - RNA, 20 nt, Artificial Sequence
  MKO10055836_A_Trim47
  gRNA
ucucuggccgcaccggagcg

SEQ ID NO: 55837 - RNA, 20 nt, Artificial Sequence
  MKO10055837_A_Trim47
  gRNA
cgcacagucccgccguacug

SEQ ID NO: 55838 - RNA, 20 nt, Artificial Sequence
  MKO10055838_A_Trim50
  gRNA
gggcuugagggccauacgcg

SEQ ID NO: 55839 - RNA, 20 nt, Artificial Sequence
  MKO10055839_A_Trim50
  gRNA
ucaggguacacaagagcgac

SEQ ID NO: 55840 - RNA, 20 nt, Artificial Sequence
  MKO10055840_A_Trim50
  gRNA
cuuccaaaggccgagccugc

SEQ ID NO: 55841 - RNA, 20 nt, Artificial Sequence
  MKO10055841_A_Trim52
  gRNA
ggcgguagcgaccaaaccga

SEQ ID NO: 55842 - RNA, 20 nt, Artificial Sequence
  MKO10055842_A_Trim52
  gRNA
uugggucgaaaacugcgacu

SEQ ID NO: 55843 - RNA, 20 nt, Artificial Sequence
  MKO10055843_A_Trim52
  gRNA
ggauagagcugccgacgcac

SEQ ID NO: 55844 - RNA, 20 nt, Artificial Sequence
  MKO10055844_A_Trim54
  gRNA
gcuccuccaaaaccgcgcac

SEQ ID NO: 55845 - RNA, 20 nt, Artificial Sequence
  MKO10055845_A_Trim54
  gRNA
cgagacccugugcgcgguuu

SEQ ID NO: 55846 - RNA, 20 nt, Artificial Sequence
  MKO10055846_A_Trim54
  gRNA
caccauuuacaaacgccaga

SEQ ID NO: 55847 - RNA, 20 nt, Artificial Sequence
  MKO10055847_A_Trim55
  gRNA
cuccuccuguguucgaguga

SEQ ID NO: 55848 - RNA, 20 nt, Artificial Sequence
  MKO10055848_A_Trim55
  gRNA
ggacaccuguaaaacuauug

SEQ ID NO: 55849 - RNA, 20 nt, Artificial Sequence
  MKO10055849_A_Trim55
  gRNA
aacccguacuuacccacaag

SEQ ID NO: 55850 - RNA, 20 nt, Artificial Sequence
  MKO10055850_A_Trim56
  gRNA
agaggccgagauccuuucgc

SEQ ID NO: 55851 - RNA, 20 nt, Artificial Sequence
  MKO10055851_A_Trim56
  gRNA
guugaccaaaauagagcgcc

SEQ ID NO: 55852 - RNA, 20 nt, Artificial Sequence
  MKO10055852_A_Trim56
  gRNA
aagcgcuccccucgcaucac

SEQ ID NO: 55853 - RNA, 20 nt, Artificial Sequence
  MKO10055853_A_Trim58
  gRNA
gaggaugcuccgagcgucuu

SEQ ID NO: 55854 - RNA, 20 nt, Artificial Sequence
  MKO10055854_A_Trim58
  gRNA
ucacaaguuccaaagacgcu

SEQ ID NO: 55855 - RNA, 20 nt, Artificial Sequence
  MKO10055855_A_Trim58
  gRNA
aagacugugugccgcauccc

SEQ ID NO: 55856 - RNA, 20 nt, Artificial Sequence
  MKO10055856_A_Trim59
  gRNA
auuucaacaggcuggaccuc

SEQ ID NO: 55857 - RNA, 20 nt, Artificial Sequence
  MKO10055857_A_Trim59
  gRNA
uuuaauacauugcuuacucg

SEQ ID NO: 55858 - RNA, 20 nt, Artificial Sequence
  MKO10055858_A_Trim59
  gRNA
aacaguuaacugacacacau

SEQ ID NO: 55859 - RNA, 20 nt, Artificial Sequence
  MKO10055859_A_Trim60
  gRNA
ucgauucuggucgacaguac

SEQ ID NO: 55860 - RNA, 20 nt, Artificial Sequence
  MKO10055860_A_Trim60
  gRNA
uccgaacuuuaacguugcaa

SEQ ID NO: 55861 - RNA, 20 nt, Artificial Sequence
  MKO10055861_A_Trim60
  gRNA
gcgcuucguacucacuuugu

SEQ ID NO: 55862 - RNA, 20 nt, Artificial Sequence
  MKO10055862_A_Trim61
  gRNA
uccccccgaaucacuuuguu

SEQ ID NO: 55863 - RNA, 20 nt, Artificial Sequence
  MKO10055863_A_Trim61
  gRNA
gaaucuucuuccguucaacc

SEQ ID NO: 55864 - RNA, 20 nt, Artificial Sequence
  MKO10055864_A_Trim61
  gRNA
cuguucaucagagaaccguu

SEQ ID NO: 55865 - RNA, 20 nt, Artificial Sequence
  MKO10055865_A_Trim62
  gRNA
ucugucgcucucgaaguagc

SEQ ID NO: 55866 - RNA, 20 nt, Artificial Sequence
  MKO10055866_A_Trim62
  gRNA
cuugcaccuuucguaguugc

SEQ ID NO: 55867 - RNA, 20 nt, Artificial Sequence
  MKO10055867_A_Trim62
  gRNA
caugaggcugccagucgcaa

SEQ ID NO: 55868 - RNA, 20 nt, Artificial Sequence
  MKO10055868_A_Trim63
  gRNA
gcaggccguacaccccgugc

SEQ ID NO: 55869 - RNA, 20 nt, Artificial Sequence
  MKO10055869_A_Trim63
  gRNA
gccaccgcgguugguccagu

SEQ ID NO: 55870 - RNA, 20 nt, Artificial Sequence
  MKO10055870_A_Trim63
  gRNA
ugacacccucuacgccaucc

SEQ ID NO: 55871 - RNA, 20 nt, Artificial Sequence
  MKO10055871_A_Trim65
  gRNA
cucaacacugagugauauag

SEQ ID NO: 55872 - RNA, 20 nt, Artificial Sequence
  MKO10055872_A_Trim65
  gRNA
ugcagucauccgccugugcc

SEQ ID NO: 55873 - RNA, 20 nt, Artificial Sequence
  MKO10055873_A_Trim65
  gRNA
uacccagcagcagguugccc

SEQ ID NO: 55874 - RNA, 20 nt, Artificial Sequence
  MKO10055874_A_Trim66
  gRNA
cggggggcccacucuuugca

SEQ ID NO: 55875 - RNA, 20 nt, Artificial Sequence
  MKO10055875_A_Trim66
  gRNA
ucugcacauacugcaaccgc

SEQ ID NO: 55876 - RNA, 20 nt, Artificial Sequence
  MKO10055876_A_Trim66
  gRNA
uggauuucuuaugugccacc

SEQ ID NO: 55877 - RNA, 20 nt, Artificial Sequence
  MKO10055877_A_Trim67
  gRNA
aucaaggaggacgaccccuc

SEQ ID NO: 55878 - RNA, 20 nt, Artificial Sequence
  MKO10055878_A_Trim67
  gRNA
ccugaagcuacgccagucca

SEQ ID NO: 55879 - RNA, 20 nt, Artificial Sequence
  MKO10055879_A_Trim67
  gRNA
uuugacccacugcucuugcg

SEQ ID NO: 55880 - RNA, 20 nt, Artificial Sequence
  MKO10055880_A_Trim68
  gRNA
ugaggcgcgaggcgaucauc

SEQ ID NO: 55881 - RNA, 20 nt, Artificial Sequence
  MKO10055881_A_Trim68
  gRNA
ucuucugcaggagcgagucu

SEQ ID NO: 55882 - RNA, 20 nt, Artificial Sequence
  MKO10055882_A_Trim68
  gRNA
accugcagcauccagcgcac

SEQ ID NO: 55883 - RNA, 20 nt, Artificial Sequence
  MKO10055883_A_Trim69
  gRNA
cuguacauucaaccucgugc

SEQ ID NO: 55884 - RNA, 20 nt, Artificial Sequence
  MKO10055884_A_Trim69
  gRNA
ucuaaaugaccuccgggaug

SEQ ID NO: 55885 - RNA, 20 nt, Artificial Sequence
  MKO10055885_A_Trim69
  gRNA
acugcccucuguguaacgac

SEQ ID NO: 55886 - RNA, 20 nt, Artificial Sequence
  MKO10055886_A_Trim6
  gRNA
guccaccguagaacugcugc

SEQ ID NO: 55887 - RNA, 20 nt, Artificial Sequence
  MKO10055887_A_Trim6
  gRNA
gaaaaguuuguuucgagcac

SEQ ID NO: 55888 - RNA, 20 nt, Artificial Sequence
  MKO10055888_A_Trim6
  gRNA
caauaccugcagcaguucua

SEQ ID NO: 55889 - RNA, 20 nt, Artificial Sequence
  MKO10055889_A_Trim71
  gRNA
ccccguccgguccgaacaac

SEQ ID NO: 55890 - RNA, 20 nt, Artificial Sequence
  MKO10055890_A_Trim71
  gRNA
ccagcgcguccgccucacca

SEQ ID NO: 55891 - RNA, 20 nt, Artificial Sequence
  MKO10055891_A_Trim71
  gRNA
agucugcgaggacgacgacg

SEQ ID NO: 55892 - RNA, 20 nt, Artificial Sequence
  MKO10055892_A_Trim72
  gRNA
gcuugacagcucccgacgca

SEQ ID NO: 55893 - RNA, 20 nt, Artificial Sequence
  MKO10055893_A_Trim72
  gRNA
augcugggguugccuugcgu

SEQ ID NO: 55894 - RNA, 20 nt, Artificial Sequence
  MKO10055894_A_Trim72
  gRNA
auguuccgggcucugaugcc

SEQ ID NO: 55895 - RNA, 20 nt, Artificial Sequence
  MKO10055895_A_Trim75
  gRNA
ggacugccuuuccccgauag

SEQ ID NO: 55896 - RNA, 20 nt, Artificial Sequence
  MKO10055896_A_Trim75
  gRNA
gaucccgucaccgucgagug

SEQ ID NO: 55897 - RNA, 20 nt, Artificial Sequence
  MKO10055897_A_Trim75
  gRNA
cugguugugccucucgcaac

SEQ ID NO: 55898 - RNA, 20 nt, Artificial Sequence
  MKO10055898_A_Trim7
  gRNA
acgucuaggacagcgcgccc

SEQ ID NO: 55899 - RNA, 20 nt, Artificial Sequence
  MKO10055899_A_Trim7
  gRNA
ugauaccaacacccgcguuc

SEQ ID NO: 55900 - RNA, 20 nt, Artificial Sequence
  MKO10055900_A_Trim7
  gRNA
cucaagaguuucgucuuaaa

SEQ ID NO: 55901 - RNA, 20 nt, Artificial Sequence
  MKO10055901_A_Trim8
  gRNA
aguucagguggccgaucuua

SEQ ID NO: 55902 - RNA, 20 nt, Artificial Sequence
  MKO10055902_A_Trim8
  gRNA
cgcguucucgcugcagaacu

SEQ ID NO: 55903 - RNA, 20 nt, Artificial Sequence
  MKO10055903_A_Trim8
  gRNA
gcgucucuucgacaagacag

SEQ ID NO: 55904 - RNA, 20 nt, Artificial Sequence
  MKO10055904_A_Trim9
  gRNA
ggcgcuggcgaaaccuccgu

SEQ ID NO: 55905 - RNA, 20 nt, Artificial Sequence
  MKO10055905_A_Trim9
  gRNA
cccugaauggauugucggac

SEQ ID NO: 55906 - RNA, 20 nt, Artificial Sequence
  MKO10055906_A_Trim9
  gRNA
ggggaaaacgcggacgccgu

SEQ ID NO: 55907 - RNA, 20 nt, Artificial Sequence
  MKO10055907_A_Triml1
  gRNA
acccagcaaauccgccgccu

SEQ ID NO: 55908 - RNA, 20 nt, Artificial Sequence
  MKO10055908_A_Triml1
  gRNA
aguuccgugaugguggucuc

SEQ ID NO: 55909 - RNA, 20 nt, Artificial Sequence
  MKO10055909_A_Triml1
  gRNA
ggcggauuugcugggucagc

SEQ ID NO: 55910 - RNA, 20 nt, Artificial Sequence
  MKO10055910_A_Triml2
  gRNA
ugaugcagcuacgagcuuac

SEQ ID NO: 55911 - RNA, 20 nt, Artificial Sequence
  MKO10055911_A_Triml2
  gRNA
uugucuguagacguuacucc

SEQ ID NO: 55912 - RNA, 20 nt, Artificial Sequence
  MKO10055912_A_Triml2
  gRNA
ucaucgucuggaggcugcgc

SEQ ID NO: 55913 - RNA, 20 nt, Artificial Sequence
  MKO10055913_A_Triobp
  gRNA
ggacgccguuuauacccugu

SEQ ID NO: 55914 - RNA, 20 nt, Artificial Sequence
  MKO10055914_A_Triobp
  gRNA
ccaugaccucgggcauccgg

SEQ ID NO: 55915 - RNA, 20 nt, Artificial Sequence
  MKO10055915_A_Triobp
  gRNA
ucuggaagccauaguugcgc

SEQ ID NO: 55916 - RNA, 20 nt, Artificial Sequence
  MKO10055916_A_Trio
  gRNA
ucaggauguucucgccaaaa

SEQ ID NO: 55917 - RNA, 20 nt, Artificial Sequence
  MKO10055917_A_Trio
  gRNA
ccucuagccgugacagcaua

SEQ ID NO: 55918 - RNA, 20 nt, Artificial Sequence
  MKO10055918_A_Trio
  gRNA
guaggugguagagauaagcg

SEQ ID NO: 55919 - RNA, 20 nt, Artificial Sequence
  MKO10055919_A_Trip10
  gRNA
gaaguucgugaaagaacgcg

SEQ ID NO: 55920 - RNA, 20 nt, Artificial Sequence
  MKO10055920_A_Trip10
  gRNA
ccucgguauccgaguguguc

SEQ ID NO: 55921 - RNA, 20 nt, Artificial Sequence
  MKO10055921_A_Trip10
  gRNA
ugcuggaacgccacacgcag

SEQ ID NO: 55922 - RNA, 20 nt, Artificial Sequence
  MKO10055922_A_Trip11
  gRNA
gugcgcugccagauccuaag

SEQ ID NO: 55923 - RNA, 20 nt, Artificial Sequence
  MKO10055923_A_Trip11
  gRNA
aaagcuuuacacugaucuag

SEQ ID NO: 55924 - RNA, 20 nt, Artificial Sequence
  MKO10055924_A_Trip11
  gRNA
agccuuccaugaagacgaca

SEQ ID NO: 55925 - RNA, 20 nt, Artificial Sequence
  MKO10055925_A_Trip12
  gRNA
uguuacagucggcgaggcuc

SEQ ID NO: 55926 - RNA, 20 nt, Artificial Sequence
  MKO10055926_A_Trip12
  gRNA
gaauuaccugguacuagcac

SEQ ID NO: 55927 - RNA, 20 nt, Artificial Sequence
  MKO10055927_A_Trip12
  gRNA
uggggacucacugcguuucu

SEQ ID NO: 55928 - RNA, 20 nt, Artificial Sequence
  MKO10055928_A_Trip13
  gRNA
cuccaaacacaauauuaugc

SEQ ID NO: 55929 - RNA, 20 nt, Artificial Sequence
  MKO10055929_A_Trip13
  gRNA
ggauagccucguguaugaug

SEQ ID NO: 55930 - RNA, 20 nt, Artificial Sequence
  MKO10055930_A_Trip13
  gRNA
aaccggcauaauauuguguu

SEQ ID NO: 55931 - RNA, 20 nt, Artificial Sequence
  MKO10055931_A_Trip4
  gRNA
guugcaaaaaacuuucgccc

SEQ ID NO: 55932 - RNA, 20 nt, Artificial Sequence
  MKO10055932_A_Trip4
  gRNA
caaucacacgggugacgacc

SEQ ID NO: 55933 - RNA, 20 nt, Artificial Sequence
  MKO10055933_A_Trip4
  gRNA
ucgucacccgugugauugcc

SEQ ID NO: 55934 - RNA, 20 nt, Artificial Sequence
  MKO10055934_A_Trip6
  gRNA
ccccgaucuuccgguacccc

SEQ ID NO: 55935 - RNA, 20 nt, Artificial Sequence
  MKO10055935_A_Trip6
  gRNA
cggaugaucccccugucugg

SEQ ID NO: 55936 - RNA, 20 nt, Artificial Sequence
  MKO10055936_A_Trip6
  gRNA
acuucaccacgaccugucag

SEQ ID NO: 55937 - RNA, 20 nt, Artificial Sequence
  MKO10055937_A_Triqk
  gRNA
cacccggccggacccgcagu

SEQ ID NO: 55938 - RNA, 20 nt, Artificial Sequence
  MKO10055938_A_Triqk
  gRNA
cgcuuuccagaguuucgacu

SEQ ID NO: 55939 - RNA, 20 nt, Artificial Sequence
  MKO10055939_A_Triqk
  gRNA
ggcccaacugcggguccggc

SEQ ID NO: 55940 - RNA, 20 nt, Artificial Sequence
  MKO10055940_A_Trit1
  gRNA
acuugugaccagcuacaccg

SEQ ID NO: 55941 - RNA, 20 nt, Artificial Sequence
  MKO10055941_A_Trit1
  gRNA
cccgcaugacaaacgcaaag

SEQ ID NO: 55942 - RNA, 20 nt, Artificial Sequence
  MKO10055942_A_Trit1
  gRNA
ccaccuggcuuagccguuua

SEQ ID NO: 55943 - RNA, 20 nt, Artificial Sequence
  MKO10055943_A_Trmt10a
  gRNA
ccaacucagauggcaacgac

SEQ ID NO: 55944 - RNA, 20 nt, Artificial Sequence
  MKO10055944_A_Trmt10a
  gRNA
gaaauuagaacgacgccagc

SEQ ID NO: 55945 - RNA, 20 nt, Artificial Sequence
  MKO10055945_A_Trmt10a
  gRNA
acaguaccuugugaugguug

SEQ ID NO: 55946 - RNA, 20 nt, Artificial Sequence
  MKO10055946_A_Trmt10b
  gRNA
gacucacaguguucggaguc

SEQ ID NO: 55947 - RNA, 20 nt, Artificial Sequence
  MKO10055947_A_Trmt10b
  gRNA
aacugccagcccccucuaug

SEQ ID NO: 55948 - RNA, 20 nt, Artificial Sequence
  MKO10055948_A_Trmt10b
  gRNA
ggacagauucgaagguugua

SEQ ID NO: 55949 - RNA, 20 nt, Artificial Sequence
  MKO10055949_A_Trmt10c
  gRNA
acuucauguuucuucgacua

SEQ ID NO: 55950 - RNA, 20 nt, Artificial Sequence
  MKO10055950_A_Trmt10c
  gRNA
uuuccacgugcgcacauuua

SEQ ID NO: 55951 - RNA, 20 nt, Artificial Sequence
  MKO10055951_A_Trmt10c
  gRNA
aauucggaucaucugaucua

SEQ ID NO: 55952 - RNA, 20 nt, Artificial Sequence
  MKO10055952_A_Trmt112
  gRNA
uccacaguuaaacuuggccg

SEQ ID NO: 55953 - RNA, 20 nt, Artificial Sequence
  MKO10055953_A_Trmt112
  gRNA
gcaguuaccugcaggcgcag

SEQ ID NO: 55954 - RNA, 20 nt, Artificial Sequence
  MKO10055954_A_Trmt112
  gRNA
uucucaccucaagcaacacg

SEQ ID NO: 55955 - RNA, 20 nt, Artificial Sequence
  MKO10055955_A_Trmt11
  gRNA
acuacgcaccaucuucucca

SEQ ID NO: 55956 - RNA, 20 nt, Artificial Sequence
  MKO10055956_A_Trmt11
  gRNA
uucucuuaaaaguuaccccg

SEQ ID NO: 55957 - RNA, 20 nt, Artificial Sequence
  MKO10055957_A_Trmt11
  gRNA
agggcaguucacuaacaguc

SEQ ID NO: 55958 - RNA, 20 nt, Artificial Sequence
  MKO10055958_A_Trmt12
  gRNA
ggggccggcauucuagaucu

SEQ ID NO: 55959 - RNA, 20 nt, Artificial Sequence
  MKO10055959_A_Trmt12
  gRNA
agugacgugguccgcugagu

SEQ ID NO: 55960 - RNA, 20 nt, Artificial Sequence
  MKO10055960_A_Trmt12
  gRNA
uugugugcugacgcggcucc

SEQ ID NO: 55961 - RNA, 20 nt, Artificial Sequence
  MKO10055961_A_Trmt13
  gRNA
aauacacuuacuaauugcuc

SEQ ID NO: 55962 - RNA, 20 nt, Artificial Sequence
  MKO10055962_A_Trmt13
  gRNA
uucucuaucugaagagcagu

SEQ ID NO: 55963 - RNA, 20 nt, Artificial Sequence
  MKO10055963_A_Trmt13
  gRNA
uuuauucaagauauaaaugc

SEQ ID NO: 55964 - RNA, 20 nt, Artificial Sequence
  MKO10055964_A_Trmt1l
  gRNA
gccaaccaucguuggagaac

SEQ ID NO: 55965 - RNA, 20 nt, Artificial Sequence
  MKO10055965_A_Trmt1l
  gRNA
ucgauagauauccaguaaac

SEQ ID NO: 55966 - RNA, 20 nt, Artificial Sequence
  MKO10055966_A_Trmt1l
  gRNA
gguuaccuguucuccaacga

SEQ ID NO: 55967 - RNA, 20 nt, Artificial Sequence
  MKO10055967_A_Trmt1
  gRNA
cgcgggugggcgcucuuccc

SEQ ID NO: 55968 - RNA, 20 nt, Artificial Sequence
  MKO10055968_A_Trmt1
  gRNA
auaggaaggucuacgagugc

SEQ ID NO: 55969 - RNA, 20 nt, Artificial Sequence
  MKO10055969_A_Trmt1
  gRNA
cugggaagagcgcccacccg

SEQ ID NO: 55970 - RNA, 20 nt, Artificial Sequence
  MKO10055970_A_Trmt2a
  gRNA
cuguccgcucagcguacgcc

SEQ ID NO: 55971 - RNA, 20 nt, Artificial Sequence
  MKO10055971_A_Trmt2a
  gRNA
ugucucguucagcagcgcuu

SEQ ID NO: 55972 - RNA, 20 nt, Artificial Sequence
  MKO10055972_A_Trmt2a
  gRNA
acuguucguaccagcagccg

SEQ ID NO: 55973 - RNA, 20 nt, Artificial Sequence
  MKO10055973_A_Trmt2b
  gRNA
gugcuucuuagcuaucacgc

SEQ ID NO: 55974 - RNA, 20 nt, Artificial Sequence
  MKO10055974_A_Trmt2b
  gRNA
ucucaccuaaaagugcucca

SEQ ID NO: 55975 - RNA, 20 nt, Artificial Sequence
  MKO10055975_A_Trmt2b
  gRNA
uuuggagaagaaacccgcuc

SEQ ID NO: 55976 - RNA, 20 nt, Artificial Sequence
  MKO10055976_A_Trmt44
  gRNA
ugucuauccugcgcuauagc

SEQ ID NO: 55977 - RNA, 20 nt, Artificial Sequence
  MKO10055977_A_Trmt44
  gRNA
uauagcgcaggauagacacc

SEQ ID NO: 55978 - RNA, 20 nt, Artificial Sequence
  MKO10055978_A_Trmt44
  gRNA
caaguccacgaaagacugcu

SEQ ID NO: 55979 - RNA, 20 nt, Artificial Sequence
  MKO10055979_A_Trmt5
  gRNA
aagacaggugacccguucuc

SEQ ID NO: 55980 - RNA, 20 nt, Artificial Sequence
  MKO10055980_A_Trmt5
  gRNA
ucucauuccucgaacgucag

SEQ ID NO: 55981 - RNA, 20 nt, Artificial Sequence
  MKO10055981_A_Trmt5
  gRNA
guaguucaguucaucucgua

SEQ ID NO: 55982 - RNA, 20 nt, Artificial Sequence
  MKO10055982_A_Trmt61a
  gRNA
gggccuuguccgcccguugc

SEQ ID NO: 55983 - RNA, 20 nt, Artificial Sequence
  MKO10055983_A_Trmt61a
  gRNA
caacgcugcggaugauugcg

SEQ ID NO: 55984 - RNA, 20 nt, Artificial Sequence
  MKO10055984_A_Trmt61a
  gRNA
agccaaaugggcggccaaug

SEQ ID NO: 55985 - RNA, 20 nt, Artificial Sequence
  MKO10055985_A_Trmt6
  gRNA
uucuaccuggauaacgccau

SEQ ID NO: 55986 - RNA, 20 nt, Artificial Sequence
  MKO10055986_A_Trmt6
  gRNA
caaacgcugagccguaacua

SEQ ID NO: 55987 - RNA, 20 nt, Artificial Sequence
  MKO10055987_A_Trmt6
  gRNA
uggcuucaagauaguaacga

SEQ ID NO: 55988 - RNA, 20 nt, Artificial Sequence
  MKO10055988_A_Trmu
  gRNA
cgauuucugaacagcccguc

SEQ ID NO: 55989 - RNA, 20 nt, Artificial Sequence
  MKO10055989_A_Trmu
  gRNA
uaugaagaacugggacucgc

SEQ ID NO: 55990 - RNA, 20 nt, Artificial Sequence
  MKO10055990_A_Trmu
  gRNA
ggagcagaugccguugccac

SEQ ID NO: 55991 - RNA, 20 nt, Artificial Sequence
  MKO10055991_A_Trnau1ap
  gRNA
auuauccgaaaccgccucac

SEQ ID NO: 55992 - RNA, 20 nt, Artificial Sequence
  MKO10055992_A_Trnau1ap
  gRNA
ucaaagucuacccguccugc

SEQ ID NO: 55993 - RNA, 20 nt, Artificial Sequence
  MKO10055993_A_Trnau1ap
  gRNA
cugacccccgacguggacga

SEQ ID NO: 55994 - RNA, 20 nt, Artificial Sequence
  MKO10055994_A_Trnp1
  gRNA
uagcagucgccgccgcgcuu

SEQ ID NO: 55995 - RNA, 20 nt, Artificial Sequence
  MKO10055995_A_Trnp1
  gRNA
cugggccgcaggcgcugauu

SEQ ID NO: 55996 - RNA, 20 nt, Artificial Sequence
  MKO10055996_A_Trnp1
  gRNA
cuuagugggggucggagucg

SEQ ID NO: 55997 - RNA, 20 nt, Artificial Sequence
  MKO10055997_A_Trnt1
  gRNA
guggcgaaauccacaucuug

SEQ ID NO: 55998 - RNA, 20 nt, Artificial Sequence
  MKO10055998_A_Trnt1
  gRNA
ucaugcgaaugccagcugac

SEQ ID NO: 55999 - RNA, 20 nt, Artificial Sequence
  MKO10055999_A_Trnt1
  gRNA
cgaauugauguuaccacuga

SEQ ID NO: 56000 - RNA, 20 nt, Artificial Sequence
  MKO10056000_A_Troap
  gRNA
cguugacguugaguacugcg

SEQ ID NO: 56001 - RNA, 20 nt, Artificial Sequence
  MKO10056001_A_Troap
  gRNA
guuccuccagaggguuccgc

SEQ ID NO: 56002 - RNA, 20 nt, Artificial Sequence
  MKO10056002_A_Troap
  gRNA
uacucaccagagccucuaac

SEQ ID NO: 56003 - RNA, 20 nt, Artificial Sequence
  MKO10056003_A_Trove2
  gRNA
gaagcgcacgaaagacgacc

SEQ ID NO: 56004 - RNA, 20 nt, Artificial Sequence
  MKO10056004_A_Trove2
  gRNA
acuucaagugauuugucagc

SEQ ID NO: 56005 - RNA, 20 nt, Artificial Sequence
  MKO10056005_A_Trove2
  gRNA
ugccccuuacugcgcuccug

SEQ ID NO: 56006 - RNA, 20 nt, Artificial Sequence
  MKO10056006_A_Tro
  gRNA
uggauagucggugugguaac

SEQ ID NO: 56007 - RNA, 20 nt, Artificial Sequence
  MKO10056007_A_Tro
  gRNA
gacaaugagaguuacuccca

SEQ ID NO: 56008 - RNA, 20 nt, Artificial Sequence
  MKO10056008_A_Tro
  gRNA
aagaucccaaucaagcgcuc

SEQ ID NO: 56009 - RNA, 20 nt, Artificial Sequence
  MKO10056009_A_Trp53bp1
  gRNA
gcugagaaucuucuauuauc

SEQ ID NO: 56010 - RNA, 20 nt, Artificial Sequence
  MKO10056010_A_Trp53bp1
  gRNA
gcacaaagagaaccccgugu

SEQ ID NO: 56011 - RNA, 20 nt, Artificial Sequence
  MKO10056011_A_Trp53bp1
  gRNA
aacgguuaccucagccaaac

SEQ ID NO: 56012 - RNA, 20 nt, Artificial Sequence
  MKO10056012_A_Trp53bp2
  gRNA
auccguucguuaucagcaac

SEQ ID NO: 56013 - RNA, 20 nt, Artificial Sequence
  MKO10056013_A_Trp53bp2
  gRNA
gucaugaacgccccccuaac

SEQ ID NO: 56014 - RNA, 20 nt, Artificial Sequence
  MKO10056014_A_Trp53bp2
  gRNA
ucaaaguucccggcgagcau

SEQ ID NO: 56015 - RNA, 20 nt, Artificial Sequence
  MKO10056015_A_Trp53i11
  gRNA
aagacccccauccgccucua

SEQ ID NO: 56016 - RNA, 20 nt, Artificial Sequence
  MKO10056016_A_Trp53i11
  gRNA
uaaggagggcaccaccguag

SEQ ID NO: 56017 - RNA, 20 nt, Artificial Sequence
  MKO10056017_A_Trp53i11
  gRNA
cgcacucuacacagccgaga

SEQ ID NO: 56018 - RNA, 20 nt, Artificial Sequence
  MKO10056018_A_Trp53i13
  gRNA
gcgugggcuuagccacauac

SEQ ID NO: 56019 - RNA, 20 nt, Artificial Sequence
  MKO10056019_A_Trp53i13
  gRNA
ucccacgugagacugaaguc

SEQ ID NO: 56020 - RNA, 20 nt, Artificial Sequence
  MKO10056020_A_Trp53i13
  gRNA
gcaggaaccccuuguccuga

SEQ ID NO: 56021 - RNA, 20 nt, Artificial Sequence
  MKO10056021_A_Trp53inp1
  gRNA
uccgucgccagaaccuuacc

SEQ ID NO: 56022 - RNA, 20 nt, Artificial Sequence
  MKO10056022_A_Trp53inp1
  gRNA
uggauuaaccacuaucaagg

SEQ ID NO: 56023 - RNA, 20 nt, Artificial Sequence
  MKO10056023_A_Trp53inp1
  gRNA
cccugguaagguucuggcga

SEQ ID NO: 56024 - RNA, 20 nt, Artificial Sequence
  MKO10056024_A_Trp53inp2
  gRNA
ggggcgcucaguaguugaac

SEQ ID NO: 56025 - RNA, 20 nt, Artificial Sequence
  MKO10056025_A_Trp53inp2
  gRNA
cccgggagagccguucgcgc

SEQ ID NO: 56026 - RNA, 20 nt, Artificial Sequence
  MKO10056026_A_Trp53inp2
  gRNA
ccgccuccagagcaauccgc

SEQ ID NO: 56027 - RNA, 20 nt, Artificial Sequence
  MKO10056027_A_Trp53rk
  gRNA
ccuccugcaccguccgccga

SEQ ID NO: 56028 - RNA, 20 nt, Artificial Sequence
  MKO10056028_A_Trp53rk
  gRNA
ccgucggcggacggugcagg

SEQ ID NO: 56029 - RNA, 20 nt, Artificial Sequence
  MKO10056029_A_Trp53rk
  gRNA
cuucaaacgcggucucggug

SEQ ID NO: 56030 - RNA, 20 nt, Artificial Sequence
  MKO10056030_A_Trp53ug5
  gRNA
agaucgugcuaucagcuuag

SEQ ID NO: 56031 - RNA, 20 nt, Artificial Sequence
  MKO10056031_A_Trp53ug5
  gRNA
uguguagaucgucuaccuac

SEQ ID NO: 56032 - RNA, 20 nt, Artificial Sequence
  MKO10056032_A_Trp53ug5
  gRNA
uagacgaucuacacaugauc

SEQ ID NO: 56033 - RNA, 20 nt, Artificial Sequence
  MKO10056033_A_Trp53
  gRNA
agugaagcccuccgaguguc

SEQ ID NO: 56034 - RNA, 20 nt, Artificial Sequence
  MKO10056034_A_Trp53
  gRNA
aacagaucguccaugcagug

SEQ ID NO: 56035 - RNA, 20 nt, Artificial Sequence
  MKO10056035_A_Trp53
  gRNA
ugagggcuuaccaucaccau

SEQ ID NO: 56036 - RNA, 20 nt, Artificial Sequence
  MKO10056036_A_Trp63
  gRNA
ccgucacgcuauucugugcg

SEQ ID NO: 56037 - RNA, 20 nt, Artificial Sequence
  MKO10056037_A_Trp63
  gRNA
gcacggauaacagcgcccug

SEQ ID NO: 56038 - RNA, 20 nt, Artificial Sequence
  MKO10056038_A_Trp63
  gRNA
ccacgcacagaauagcguga

SEQ ID NO: 56039 - RNA, 20 nt, Artificial Sequence
  MKO10056039_A_Trp73
  gRNA
cgcugccccaaccacgagcu

SEQ ID NO: 56040 - RNA, 20 nt, Artificial Sequence
  MKO10056040_A_Trp73
  gRNA
caacaaccucgcccaguacg

SEQ ID NO: 56041 - RNA, 20 nt, Artificial Sequence
  MKO10056041_A_Trp73
  gRNA
ccuuccaauaccgacuaccc

SEQ ID NO: 56042 - RNA, 20 nt, Artificial Sequence
  MKO10056042_A_Trpa1
  gRNA
uuccucuagguggacauuga

SEQ ID NO: 56043 - RNA, 20 nt, Artificial Sequence
  MKO10056043_A_Trpa1
  gRNA
cugauggaacugaucaucaa

SEQ ID NO: 56044 - RNA, 20 nt, Artificial Sequence
  MKO10056044_A_Trpa1
  gRNA
cauguacaacgaagugauca

SEQ ID NO: 56045 - RNA, 20 nt, Artificial Sequence
  MKO10056045_A_Trpc1
  gRNA
uccaucguuguugaauauuc

SEQ ID NO: 56046 - RNA, 20 nt, Artificial Sequence
  MKO10056046_A_Trpc1
  gRNA
auaaauugcguagaugugcu

SEQ ID NO: 56047 - RNA, 20 nt, Artificial Sequence
  MKO10056047_A_Trpc1
  gRNA
uccagaauauucaacaacga

SEQ ID NO: 56048 - RNA, 20 nt, Artificial Sequence
  MKO10056048_A_Trpc2
  gRNA
ggacuauggcuucgaguugc

SEQ ID NO: 56049 - RNA, 20 nt, Artificial Sequence
  MKO10056049_A_Trpc2
  gRNA
ucccgaaucaacaccuaccg

SEQ ID NO: 56050 - RNA, 20 nt, Artificial Sequence
  MKO10056050_A_Trpc2
  gRNA
ggcgggcauugcugcacucg

SEQ ID NO: 56051 - RNA, 20 nt, Artificial Sequence
  MKO10056051_A_Trpc3
  gRNA
ccacugaucaggucgucgga

SEQ ID NO: 56052 - RNA, 20 nt, Artificial Sequence
  MKO10056052_A_Trpc3
  gRNA
gcgugacaagggccggcgcc

SEQ ID NO: 56053 - RNA, 20 nt, Artificial Sequence
  MKO10056053_A_Trpc3
  gRNA
acauuuccguccacgugaac

SEQ ID NO: 56054 - RNA, 20 nt, Artificial Sequence
  MKO10056054_A_Trpc4ap
  gRNA
ggccucguaccugcaccgcc

SEQ ID NO: 56055 - RNA, 20 nt, Artificial Sequence
  MKO10056055_A_Trpc4ap
  gRNA
gcgguuggcagcuaccgcgg

SEQ ID NO: 56056 - RNA, 20 nt, Artificial Sequence
  MKO10056056_A_Trpc4ap
  gRNA
uggcguuuguaacugaagac

SEQ ID NO: 56057 - RNA, 20 nt, Artificial Sequence
  MKO10056057_A_Trpc4
  gRNA
gaugauauuaccgugggucc

SEQ ID NO: 56058 - RNA, 20 nt, Artificial Sequence
  MKO10056058_A_Trpc4
  gRNA
ggaaagggucuucgcuugac

SEQ ID NO: 56059 - RNA, 20 nt, Artificial Sequence
  MKO10056059_A_Trpc4
  gRNA
uacaaacgcgacaaucuuca

SEQ ID NO: 56060 - RNA, 20 nt, Artificial Sequence
  MKO10056060_A_Trpc5
  gRNA
gaugggguccucgcuugaua

SEQ ID NO: 56061 - RNA, 20 nt, Artificial Sequence
  MKO10056061_A_Trpc5
  gRNA
uagacuaucuaccuccgaac

SEQ ID NO: 56062 - RNA, 20 nt, Artificial Sequence
  MKO10056062_A_Trpc5
  gRNA
guuagguucaucaauagcuc

SEQ ID NO: 56063 - RNA, 20 nt, Artificial Sequence
  MKO10056063_A_Trpc6
  gRNA
cacgaagaaucgucugccgc

SEQ ID NO: 56064 - RNA, 20 nt, Artificial Sequence
  MKO10056064_A_Trpc6
  gRNA
cagugcaaggauuucguugu

SEQ ID NO: 56065 - RNA, 20 nt, Artificial Sequence
  MKO10056065_A_Trpc6
  gRNA
auuuggacggccgaaguccc

SEQ ID NO: 56066 - RNA, 20 nt, Artificial Sequence
  MKO10056066_A_Trpc7
  gRNA
uaguugugaacgccuccgac

SEQ ID NO: 56067 - RNA, 20 nt, Artificial Sequence
  MKO10056067_A_Trpc7
  gRNA
aagcaacgaguuagcccgac

SEQ ID NO: 56068 - RNA, 20 nt, Artificial Sequence
  MKO10056068_A_Trpc7
  gRNA
gagucuuaacgcccucaaac

SEQ ID NO: 56069 - RNA, 20 nt, Artificial Sequence
  MKO10056069_A_Trpd52l3
  gRNA
ggacuccgucuaccaagacc

SEQ ID NO: 56070 - RNA, 20 nt, Artificial Sequence
  MKO10056070_A_Trpd52l3
  gRNA
cagugauccacacucggcuc

SEQ ID NO: 56071 - RNA, 20 nt, Artificial Sequence
  MKO10056071_A_Trpd52l3
  gRNA
cccuucaagagaucugaacg

SEQ ID NO: 56072 - RNA, 20 nt, Artificial Sequence
  MKO10056072_A_Trpm1
  gRNA
gauccacgcccccgugguca

SEQ ID NO: 56073 - RNA, 20 nt, Artificial Sequence
  MKO10056073_A_Trpm1
  gRNA
gugcuauaggaauugcuccc

SEQ ID NO: 56074 - RNA, 20 nt, Artificial Sequence
  MKO10056074_A_Trpm1
  gRNA
gcugcaucucgaagcuuugg

SEQ ID NO: 56075 - RNA, 20 nt, Artificial Sequence
  MKO10056075_A_Trpm2
  gRNA
ucacuauuggcguagccacg

SEQ ID NO: 56076 - RNA, 20 nt, Artificial Sequence
  MKO10056076_A_Trpm2
  gRNA
ggcaccauccacaaccgcga

SEQ ID NO: 56077 - RNA, 20 nt, Artificial Sequence
  MKO10056077_A_Trpm2
  gRNA
ccccaccggucacggagaug

SEQ ID NO: 56078 - RNA, 20 nt, Artificial Sequence
  MKO10056078_A_Trpm3
  gRNA
guaccauagguaucgccccc

SEQ ID NO: 56079 - RNA, 20 nt, Artificial Sequence
  MKO10056079_A_Trpm3
  gRNA
gaccaugcaucuaagucucg

SEQ ID NO: 56080 - RNA, 20 nt, Artificial Sequence
  MKO10056080_A_Trpm3
  gRNA
ggugaaacuccgcagacaac

SEQ ID NO: 56081 - RNA, 20 nt, Artificial Sequence
  MKO10056081_A_Trpm4
  gRNA
acagucucguuacccgcucu

SEQ ID NO: 56082 - RNA, 20 nt, Artificial Sequence
  MKO10056082_A_Trpm4
  gRNA
ucuccggcugucugaccgca

SEQ ID NO: 56083 - RNA, 20 nt, Artificial Sequence
  MKO10056083_A_Trpm4
  gRNA
ggugugcacgacguucauag

SEQ ID NO: 56084 - RNA, 20 nt, Artificial Sequence
  MKO10056084_A_Trpm5
  gRNA
auccaccaagauccguguag

SEQ ID NO: 56085 - RNA, 20 nt, Artificial Sequence
  MKO10056085_A_Trpm5
  gRNA
gcuucgggauguccugcgca

SEQ ID NO: 56086 - RNA, 20 nt, Artificial Sequence
  MKO10056086_A_Trpm5
  gRNA
agcuguacgugaucacucuc

SEQ ID NO: 56087 - RNA, 20 nt, Artificial Sequence
  MKO10056087_A_Trpm6
  gRNA
aagcuugugaucuccgucca

SEQ ID NO: 56088 - RNA, 20 nt, Artificial Sequence
  MKO10056088_A_Trpm6
  gRNA
agucucaccugacuaaauug

SEQ ID NO: 56089 - RNA, 20 nt, Artificial Sequence
  MKO10056089_A_Trpm6
  gRNA
aaaucugccacaauuuaguc

SEQ ID NO: 56090 - RNA, 20 nt, Artificial Sequence
  MKO10056090_A_Trpm7
  gRNA
cagaccauucuucuauugcc

SEQ ID NO: 56091 - RNA, 20 nt, Artificial Sequence
  MKO10056091_A_Trpm7
  gRNA
guggcauaccuuagcucugu

SEQ ID NO: 56092 - RNA, 20 nt, Artificial Sequence
  MKO10056092_A_Trpm7
  gRNA
uagagagcacuuugaccaag

SEQ ID NO: 56093 - RNA, 20 nt, Artificial Sequence
  MKO10056093_A_Trpm8
  gRNA
ccucgccuauguacuucauc

SEQ ID NO: 56094 - RNA, 20 nt, Artificial Sequence
  MKO10056094_A_Trpm8
  gRNA
cucaaacugaauguccccga

SEQ ID NO: 56095 - RNA, 20 nt, Artificial Sequence
  MKO10056095_A_Trpm8
  gRNA
gcaugcgcaagaucuucagc

SEQ ID NO: 56096 - RNA, 20 nt, Artificial Sequence
  MKO10056096_A_Trps1
  gRNA
ccuguuugacauccgaugcu

SEQ ID NO: 56097 - RNA, 20 nt, Artificial Sequence
  MKO10056097_A_Trps1
  gRNA
aauaguucauccguaucuga

SEQ ID NO: 56098 - RNA, 20 nt, Artificial Sequence
  MKO10056098_A_Trps1
  gRNA
cucgauuccucacgacaaaa

SEQ ID NO: 56099 - RNA, 20 nt, Artificial Sequence
  MKO10056099_A_Trpt1
  gRNA
cuggccaucuauucuacuaa

SEQ ID NO: 56100 - RNA, 20 nt, Artificial Sequence
  MKO10056100_A_Trpt1
  gRNA
cuguccuaugcccuucgcca

SEQ ID NO: 56101 - RNA, 20 nt, Artificial Sequence
  MKO10056101_A_Trpt1
  gRNA
aacaccgccaccucacaauu

SEQ ID NO: 56102 - RNA, 20 nt, Artificial Sequence
  MKO10056102_A_Trpv1
  gRNA
cgguguaagccccuucuugu

SEQ ID NO: 56103 - RNA, 20 nt, Artificial Sequence
  MKO10056103_A_Trpv1
  gRNA
gcugguuggugcacgcagcc

SEQ ID NO: 56104 - RNA, 20 nt, Artificial Sequence
  MKO10056104_A_Trpv1
  gRNA
caggagcaucuucgacgcug

SEQ ID NO: 56105 - RNA, 20 nt, Artificial Sequence
  MKO10056105_A_Trpv2
  gRNA
ugcaccgaugaguucuaccg

SEQ ID NO: 56106 - RNA, 20 nt, Artificial Sequence
  MKO10056106_A_Trpv2
  gRNA
gguagaacucaucggugcac

SEQ ID NO: 56107 - RNA, 20 nt, Artificial Sequence
  MKO10056107_A_Trpv2
  gRNA
uuucccgaaaguucaccgag

SEQ ID NO: 56108 - RNA, 20 nt, Artificial Sequence
  MKO10056108_A_Trpv3
  gRNA
gcacacuuaccucggacugu

SEQ ID NO: 56109 - RNA, 20 nt, Artificial Sequence
  MKO10056109_A_Trpv3
  gRNA
cagaauccgcacgaucucuu

SEQ ID NO: 56110 - RNA, 20 nt, Artificial Sequence
  MKO10056110_A_Trpv3
  gRNA
acugaagaagcgcaucuucg

SEQ ID NO: 56111 - RNA, 20 nt, Artificial Sequence
  MKO10056111_A_Trpv4
  gRNA
ugucguugcgcccguugcuu

SEQ ID NO: 56112 - RNA, 20 nt, Artificial Sequence
  MKO10056112_A_Trpv4
  gRNA
cucucggguguugucggcga

SEQ ID NO: 56113 - RNA, 20 nt, Artificial Sequence
  MKO10056113_A_Trpv4
  gRNA
gugcuugcagcgccguucga

SEQ ID NO: 56114 - RNA, 20 nt, Artificial Sequence
  MKO10056114_A_Trpv5
  gRNA
gaaccuaguccgugcccugu

SEQ ID NO: 56115 - RNA, 20 nt, Artificial Sequence
  MKO10056115_A_Trpv5
  gRNA
uuugccggaagucacaguuc

SEQ ID NO: 56116 - RNA, 20 nt, Artificial Sequence
  MKO10056116_A_Trpv5
  gRNA
ggaucucaccauaguagaug

SEQ ID NO: 56117 - RNA, 20 nt, Artificial Sequence
  MKO10056117_A_Trpv6
  gRNA
uucauauagcuccgaaguca

SEQ ID NO: 56118 - RNA, 20 nt, Artificial Sequence
  MKO10056118_A_Trpv6
  gRNA
uccgugcucugcuugcccga

SEQ ID NO: 56119 - RNA, 20 nt, Artificial Sequence
  MKO10056119_A_Trpv6
  gRNA
ugccaaagaaaacgaugucc

SEQ ID NO: 56120 - RNA, 20 nt, Artificial Sequence
  MKO10056120_A_Trrap
  gRNA
caacucaccucuugcgugau

SEQ ID NO: 56121 - RNA, 20 nt, Artificial Sequence
  MKO10056121_A_Trrap
  gRNA
cuggcagcaacuacggaagc

SEQ ID NO: 56122 - RNA, 20 nt, Artificial Sequence
  MKO10056122_A_Trrap
  gRNA
acguucugucugucauguuu

SEQ ID NO: 56123 - RNA, 20 nt, Artificial Sequence
  MKO10056123_A_Trub1
  gRNA
cuuggaccccgacaacauac

SEQ ID NO: 56124 - RNA, 20 nt, Artificial Sequence
  MKO10056124_A_Trub1
  gRNA
guaacggaagagaagccgua

SEQ ID NO: 56125 - RNA, 20 nt, Artificial Sequence
  MKO10056125_A_Trub1
  gRNA
uucgccgugcacaagcccaa

SEQ ID NO: 56126 - RNA, 20 nt, Artificial Sequence
  MKO10056126_A_Trub2
  gRNA
gaugucccacaccgaucuuc

SEQ ID NO: 56127 - RNA, 20 nt, Artificial Sequence
  MKO10056127_A_Trub2
  gRNA
aagaagcgaacacgcugauc

SEQ ID NO: 56128 - RNA, 20 nt, Artificial Sequence
  MKO10056128_A_Trub2
  gRNA
uugccuuucagugcucgccg

SEQ ID NO: 56129 - RNA, 20 nt, Artificial Sequence
  MKO10056129_A_Try10
  gRNA
gaugaugacaagauaguugg

SEQ ID NO: 56130 - RNA, 20 nt, Artificial Sequence
  MKO10056130_A_Try10
  gRNA
cccagcuccugugcagcugc

SEQ ID NO: 56131 - RNA, 20 nt, Artificial Sequence
  MKO10056131_A_Try10
  gRNA
gccaacacagaucauguucu

SEQ ID NO: 56132 - RNA, 20 nt, Artificial Sequence
  MKO10056132_A_Try4
  gRNA
ggggacagaauucucucggc

SEQ ID NO: 56133 - RNA, 20 nt, Artificial Sequence
  MKO10056133_A_Try4
  gRNA
aggaaucuuugccucccucu

SEQ ID NO: 56134 - RNA, 20 nt, Artificial Sequence
  MKO10056134_A_Try4
  gRNA
gagcugcagacaccacccac

SEQ ID NO: 56135 - RNA, 20 nt, Artificial Sequence
  MKO10056135_A_Try5
  gRNA
ggaugcuuaguuugcggcaa

SEQ ID NO: 56136 - RNA, 20 nt, Artificial Sequence
  MKO10056136_A_Try5
  gRNA
gggcauccaggcauugaagc

SEQ ID NO: 56137 - RNA, 20 nt, Artificial Sequence
  MKO10056137_A_Try5
  gRNA
cccagaccugcuucaaugcc

SEQ ID NO: 56138 - RNA, 20 nt, Artificial Sequence
  MKO10056138_A_Tsacc
  gRNA
cgcaacgcuaucuuccucuu

SEQ ID NO: 56139 - RNA, 20 nt, Artificial Sequence
  MKO10056139_A_Tsacc
  gRNA
gguuggcauacaugcacucg

SEQ ID NO: 56140 - RNA, 20 nt, Artificial Sequence
  MKO10056140_A_Tsacc
  gRNA
gcacacuaguaacccuacua

SEQ ID NO: 56141 - RNA, 20 nt, Artificial Sequence
  MKO10056141_A_Tsc1
  gRNA
cucccgaugaucccgcaguc

SEQ ID NO: 56142 - RNA, 20 nt, Artificial Sequence
  MKO10056142_A_Tsc1
  gRNA
gcccucuuucaccgccuuua

SEQ ID NO: 56143 - RNA, 20 nt, Artificial Sequence
  MKO10056143_A_Tsc1
  gRNA
accaacguguugacaagcau

SEQ ID NO: 56144 - RNA, 20 nt, Artificial Sequence
  MKO10056144_A_Tsc22d1
  gRNA
acuccuagauccaucgccac

SEQ ID NO: 56145 - RNA, 20 nt, Artificial Sequence
  MKO10056145_A_Tsc22d1
  gRNA
cuuccgugagacuugacaau

SEQ ID NO: 56146 - RNA, 20 nt, Artificial Sequence
  MKO10056146_A_Tsc22d1
  gRNA
gaacaaucugcugaagacgc

SEQ ID NO: 56147 - RNA, 20 nt, Artificial Sequence
  MKO10056147_A_Tsc22d2
  gRNA
gccaaauguacccgcgccuc

SEQ ID NO: 56148 - RNA, 20 nt, Artificial Sequence
  MKO10056148_A_Tsc22d2
  gRNA
ccgagaucuucgacguuucc

SEQ ID NO: 56149 - RNA, 20 nt, Artificial Sequence
  MKO10056149_A_Tsc22d2
  gRNA
auuccugacacguguucaaa

SEQ ID NO: 56150 - RNA, 20 nt, Artificial Sequence
  MKO10056150_A_Tsc22d3
  gRNA
cgcagcgguuggccaggucg

SEQ ID NO: 56151 - RNA, 20 nt, Artificial Sequence
  MKO10056151_A_Tsc22d3
  gRNA
cugccgaaaguugcucacga

SEQ ID NO: 56152 - RNA, 20 nt, Artificial Sequence
  MKO10056152_A_Tsc22d3
  gRNA
ccucucucacagcguacauc

SEQ ID NO: 56153 - RNA, 20 nt, Artificial Sequence
  MKO10056153_A_Tsc22d4
  gRNA
gaauggauugcugcgcgccc

SEQ ID NO: 56154 - RNA, 20 nt, Artificial Sequence
  MKO10056154_A_Tsc22d4
  gRNA
accuaucgucaucgcugucc

SEQ ID NO: 56155 - RNA, 20 nt, Artificial Sequence
  MKO10056155_A_Tsc22d4
  gRNA
gagagccuuaucgucgaggu

SEQ ID NO: 56156 - RNA, 20 nt, Artificial Sequence
  MKO10056156_A_Tsc2
  gRNA
aacaaucgcauccgaaugau

SEQ ID NO: 56157 - RNA, 20 nt, Artificial Sequence
  MKO10056157_A_Tsc2
  gRNA
aacagcuguugaacuugacc

SEQ ID NO: 56158 - RNA, 20 nt, Artificial Sequence
  MKO10056158_A_Tsc2
  gRNA
cacagaucugcccuaucauu

SEQ ID NO: 56159 - RNA, 20 nt, Artificial Sequence
  MKO10056159_A_Tsen15
  gRNA
auuuaugcugccagacccuc

SEQ ID NO: 56160 - RNA, 20 nt, Artificial Sequence
  MKO10056160_A_Tsen15
  gRNA
ucgcucaccuauuauggcug

SEQ ID NO: 56161 - RNA, 20 nt, Artificial Sequence
  MKO10056161_A_Tsen15
  gRNA
acuuacucuccaugagaucc

SEQ ID NO: 56162 - RNA, 20 nt, Artificial Sequence
  MKO10056162_A_Tsen2
  gRNA
ggcggcggcaucagacgaga

SEQ ID NO: 56163 - RNA, 20 nt, Artificial Sequence
  MKO10056163_A_Tsen2
  gRNA
uggacuagccgcagcgagug

SEQ ID NO: 56164 - RNA, 20 nt, Artificial Sequence
  MKO10056164_A_Tsen2
  gRNA
cacaaucgccaaccccacgc

SEQ ID NO: 56165 - RNA, 20 nt, Artificial Sequence
  MKO10056165_A_Tsen34
  gRNA
ccuagucagcgccccgcgcc

SEQ ID NO: 56166 - RNA, 20 nt, Artificial Sequence
  MKO10056166_A_Tsen34
  gRNA
uucuuaccaagccaugguug

SEQ ID NO: 56167 - RNA, 20 nt, Artificial Sequence
  MKO10056167_A_Tsen34
  gRNA
gcuucuagagaagaucguag

SEQ ID NO: 56168 - RNA, 20 nt, Artificial Sequence
  MKO10056168_A_Tsen54
  gRNA
aagcuaccacagcggucgca

SEQ ID NO: 56169 - RNA, 20 nt, Artificial Sequence
  MKO10056169_A_Tsen54
  gRNA
gcgaccgcugugguagcuuc

SEQ ID NO: 56170 - RNA, 20 nt, Artificial Sequence
  MKO10056170_A_Tsen54
  gRNA
gcagcgacuucaccccgaag

SEQ ID NO: 56171 - RNA, 20 nt, Artificial Sequence
  MKO10056171_A_Tsfm
  gRNA
ccggcgugaaacgugagcca

SEQ ID NO: 56172 - RNA, 20 nt, Artificial Sequence
  MKO10056172_A_Tsfm
  gRNA
cagauacucaccaaucgcua

SEQ ID NO: 56173 - RNA, 20 nt, Artificial Sequence
  MKO10056173_A_Tsfm
  gRNA
cacgcucaccuuacuguacg

SEQ ID NO: 56174 - RNA, 20 nt, Artificial Sequence
  MKO10056174_A_Tsg101
  gRNA
uauuuaccucgauaacgcac

SEQ ID NO: 56175 - RNA, 20 nt, Artificial Sequence
  MKO10056175_A_Tsg101
  gRNA
uuaccauaugaauccaauac

SEQ ID NO: 56176 - RNA, 20 nt, Artificial Sequence
  MKO10056176_A_Tsg101
  gRNA
uuagccacggucagaguugc

SEQ ID NO: 56177 - RNA, 20 nt, Artificial Sequence
  MKO10056177_A_Tsga10
  gRNA
ugagaaccuugacguugccc

SEQ ID NO: 56178 - RNA, 20 nt, Artificial Sequence
  MKO10056178_A_Tsga10
  gRNA
auagcuugaugaugagcgca

SEQ ID NO: 56179 - RNA, 20 nt, Artificial Sequence
  MKO10056179_A_Tsga10
  gRNA
ucacuuggaacagcggauag

SEQ ID NO: 56180 - RNA, 20 nt, Artificial Sequence
  MKO10056180_A_Tsga13
  gRNA
ggaucaucuagccguuucau

SEQ ID NO: 56181 - RNA, 20 nt, Artificial Sequence
  MKO10056181_A_Tsga13
  gRNA
ucuuguuggguuugcaccga

SEQ ID NO: 56182 - RNA, 20 nt, Artificial Sequence
  MKO10056182_A_Tsga13
  gRNA
ugcuccaauauacuuccccc

SEQ ID NO: 56183 - RNA, 20 nt, Artificial Sequence
  MKO10056183_A_Tsga8
  gRNA
gaaacgcgguggcgcccaaa

SEQ ID NO: 56184 - RNA, 20 nt, Artificial Sequence
  MKO10056184_A_Tsga8
  gRNA
ggugcgaagaccaacaagcg

SEQ ID NO: 56185 - RNA, 20 nt, Artificial Sequence
  MKO10056185_A_Tsga8
  gRNA
gacuucauccaccgauucuc

SEQ ID NO: 56186 - RNA, 20 nt, Artificial Sequence
  MKO10056186_A_Tshb
  gRNA
caagccgcagucuuucuauc

SEQ ID NO: 56187 - RNA, 20 nt, Artificial Sequence
  MKO10056187_A_Tshb
  gRNA
cacugaguauacaauguacg

SEQ ID NO: 56188 - RNA, 20 nt, Artificial Sequence
  MKO10056188_A_Tshb
  gRNA
cuugccacacuugcagcuua

SEQ ID NO: 56189 - RNA, 20 nt, Artificial Sequence
  MKO10056189_A_Tshr
  gRNA
acgcacacucuuugccccgc

SEQ ID NO: 56190 - RNA, 20 nt, Artificial Sequence
  MKO10056190_A_Tshr
  gRNA
cgagucugcccaauauuucc

SEQ ID NO: 56191 - RNA, 20 nt, Artificial Sequence
  MKO10056191_A_Tshr
  gRNA
agguuaagcuucugguguuc

SEQ ID NO: 56192 - RNA, 20 nt, Artificial Sequence
  MKO10056192_A_Tshz1
  gRNA
cgguuguucggagucacgua

SEQ ID NO: 56193 - RNA, 20 nt, Artificial Sequence
  MKO10056193_A_Tshz1
  gRNA
cgacgucugcugcagcgucu

SEQ ID NO: 56194 - RNA, 20 nt, Artificial Sequence
  MKO10056194_A_Tshz1
  gRNA
cgccguuaccugccgagcgc

SEQ ID NO: 56195 - RNA, 20 nt, Artificial Sequence
  MKO10056195_A_Tshz2
  gRNA
aaucgacgucagacgcuucg

SEQ ID NO: 56196 - RNA, 20 nt, Artificial Sequence
  MKO10056196_A_Tshz2
  gRNA
ugcggccuacgacacucucg

SEQ ID NO: 56197 - RNA, 20 nt, Artificial Sequence
  MKO10056197_A_Tshz2
  gRNA
ucucuuaccugccgcccgcu

SEQ ID NO: 56198 - RNA, 20 nt, Artificial Sequence
  MKO10056198_A_Tshz3
  gRNA
ggagacacucgcgggcguau

SEQ ID NO: 56199 - RNA, 20 nt, Artificial Sequence
  MKO10056199_A_Tshz3
  gRNA
cgacggcagcuucaaaaguc

SEQ ID NO: 56200 - RNA, 20 nt, Artificial Sequence
  MKO10056200_A_Tshz3
  gRNA
ggagaagcaucaugccgagg

SEQ ID NO: 56201 - RNA, 20 nt, Artificial Sequence
  MKO10056201_A_Tsks
  gRNA
aacgugcugauuaacccgcg

SEQ ID NO: 56202 - RNA, 20 nt, Artificial Sequence
  MKO10056202_A_Tsks
  gRNA
gcacggcuuucuacccccgc

SEQ ID NO: 56203 - RNA, 20 nt, Artificial Sequence
  MKO10056203_A_Tsks
  gRNA
ugucccacgagccgaugcac

SEQ ID NO: 56204 - RNA, 20 nt, Artificial Sequence
  MKO10056204_A_Tsku
  gRNA
auaucgagaccucucguagu

SEQ ID NO: 56205 - RNA, 20 nt, Artificial Sequence
  MKO10056205_A_Tsku
  gRNA
gagccauaaccgacuacgag

SEQ ID NO: 56206 - RNA, 20 nt, Artificial Sequence
  MKO10056206_A_Tsku
  gRNA
cuucucccgacugcgcuacc

SEQ ID NO: 56207 - RNA, 20 nt, Artificial Sequence
  MKO10056207_A_Tslp
  gRNA
ggcuaaguucgagcaaaucg

SEQ ID NO: 56208 - RNA, 20 nt, Artificial Sequence
  MKO10056208_A_Tslp
  gRNA
ucauccugcaaguacuagua

SEQ ID NO: 56209 - RNA, 20 nt, Artificial Sequence
  MKO10056209_A_Tslp
  gRNA
ccauccguacuaguacuugc

SEQ ID NO: 56210 - RNA, 20 nt, Artificial Sequence
  MKO10056210_A_Tsnaxip1
  gRNA
ucgcuuacuuggcucgauuc

SEQ ID NO: 56211 - RNA, 20 nt, Artificial Sequence
  MKO10056211_A_Tsnaxip1
  gRNA
cuccaucaagaaugcguacg

SEQ ID NO: 56212 - RNA, 20 nt, Artificial Sequence
  MKO10056212_A_Tsnaxip1
  gRNA
caccucguacgcauucuuga

SEQ ID NO: 56213 - RNA, 20 nt, Artificial Sequence
  MKO10056213_A_Tsnax
  gRNA
uuacccaccuuguaauccua

SEQ ID NO: 56214 - RNA, 20 nt, Artificial Sequence
  MKO10056214_A_Tsnax
  gRNA
uuuaggacugcaggaauacg

SEQ ID NO: 56215 - RNA, 20 nt, Artificial Sequence
  MKO10056215_A_Tsnax
  gRNA
ucuuucuagugcuccugaua

SEQ ID NO: 56216 - RNA, 20 nt, Artificial Sequence
  MKO10056216_A_Tsn
  gRNA
uccccgcugagcaguauuac

SEQ ID NO: 56217 - RNA, 20 nt, Artificial Sequence
  MKO10056217_A_Tsn
  gRNA
cucgcuuucaagcaccucuu

SEQ ID NO: 56218 - RNA, 20 nt, Artificial Sequence
  MKO10056218_A_Tsn
  gRNA
gcuucagcgccuggucuucc

SEQ ID NO: 56219 - RNA, 20 nt, Artificial Sequence
  MKO10056219_A_Tspan10
  gRNA
cgcagccauucuugcagcgc

SEQ ID NO: 56220 - RNA, 20 nt, Artificial Sequence
  MKO10056220_A_Tspan10
  gRNA
guggccguugucaugaucca

SEQ ID NO: 56221 - RNA, 20 nt, Artificial Sequence
  MKO10056221_A_Tspan10
  gRNA
ccccacaguaccagugcaac

SEQ ID NO: 56222 - RNA, 20 nt, Artificial Sequence
  MKO10056222_A_Tspan11
  gRNA
guacgcgcugugcugccagu

SEQ ID NO: 56223 - RNA, 20 nt, Artificial Sequence
  MKO10056223_A_Tspan11
  gRNA
ggcagaggcagcgaacgugc

SEQ ID NO: 56224 - RNA, 20 nt, Artificial Sequence
  MKO10056224_A_Tspan11
  gRNA
gcuguccguagugcucaguc

SEQ ID NO: 56225 - RNA, 20 nt, Artificial Sequence
  MKO10056225_A_Tspan12
  gRNA
cgguguguggacauacgagc

SEQ ID NO: 56226 - RNA, 20 nt, Artificial Sequence
  MKO10056226_A_Tspan12
  gRNA
uaagccguaauuugucauuc

SEQ ID NO: 56227 - RNA, 20 nt, Artificial Sequence
  MKO10056227_A_Tspan12
  gRNA
cugcugcuuccuuaucaucg

SEQ ID NO: 56228 - RNA, 20 nt, Artificial Sequence
  MKO10056228_A_Tspan13
  gRNA
uccucgugcgcccccauaau

SEQ ID NO: 56229 - RNA, 20 nt, Artificial Sequence
  MKO10056229_A_Tspan13
  gRNA
uccagcauacucuccgauua

SEQ ID NO: 56230 - RNA, 20 nt, Artificial Sequence
  MKO10056230_A_Tspan13
  gRNA
gugcucgaaaugacauccag

SEQ ID NO: 56231 - RNA, 20 nt, Artificial Sequence
  MKO10056231_A_Tspan14
  gRNA
uggaaucgaccccgucgugc

SEQ ID NO: 56232 - RNA, 20 nt, Artificial Sequence
  MKO10056232_A_Tspan14
  gRNA
caggucgaugucaucccgau

SEQ ID NO: 56233 - RNA, 20 nt, Artificial Sequence
  MKO10056233_A_Tspan14
  gRNA
caccaucaagaccagcacga

SEQ ID NO: 56234 - RNA, 20 nt, Artificial Sequence
  MKO10056234_A_Tspan15
  gRNA
cgagaauuacuacgaugauc

SEQ ID NO: 56235 - RNA, 20 nt, Artificial Sequence
  MKO10056235_A_Tspan15
  gRNA
cugcguagauccccacugac

SEQ ID NO: 56236 - RNA, 20 nt, Artificial Sequence
  MKO10056236_A_Tspan15
  gRNA
uaccaugacugcagcgcccc

SEQ ID NO: 56237 - RNA, 20 nt, Artificial Sequence
  MKO10056237_A_Tspan17
  gRNA
auuccugagcaaagucgaua

SEQ ID NO: 56238 - RNA, 20 nt, Artificial Sequence
  MKO10056238_A_Tspan17
  gRNA
ugggcggucuugaccccgug

SEQ ID NO: 56239 - RNA, 20 nt, Artificial Sequence
  MKO10056239_A_Tspan17
  gRNA
ccggagggccccaaugcagc

SEQ ID NO: 56240 - RNA, 20 nt, Artificial Sequence
  MKO10056240_A_Tspan18
  gRNA
cguguuucggcugcugacgc

SEQ ID NO: 56241 - RNA, 20 nt, Artificial Sequence
  MKO10056241_A_Tspan18
  gRNA
cuaccaaggcgauaacgaua

SEQ ID NO: 56242 - RNA, 20 nt, Artificial Sequence
  MKO10056242_A_Tspan18
  gRNA
cauccguaucguuaucgccu

SEQ ID NO: 56243 - RNA, 20 nt, Artificial Sequence
  MKO10056243_A_Tspan1
  gRNA
ggaaucuggguguccgucga

SEQ ID NO: 56244 - RNA, 20 nt, Artificial Sequence
  MKO10056244_A_Tspan1
  gRNA
auucucuuugacgaaacgug

SEQ ID NO: 56245 - RNA, 20 nt, Artificial Sequence
  MKO10056245_A_Tspan1
  gRNA
auagugauccgaagaccuuc

SEQ ID NO: 56246 - RNA, 20 nt, Artificial Sequence
  MKO10056246_A_Tspan2
  gRNA
ggaucagccguuauugcauu

SEQ ID NO: 56247 - RNA, 20 nt, Artificial Sequence
  MKO10056247_A_Tspan2
  gRNA
ucgauuuggagguaccauga

SEQ ID NO: 56248 - RNA, 20 nt, Artificial Sequence
  MKO10056248_A_Tspan2
  gRNA
cacacacugugacucacgca

SEQ ID NO: 56249 - RNA, 20 nt, Artificial Sequence
  MKO10056249_A_Tspan31
  gRNA
ccaguccugccaccgcgaug

SEQ ID NO: 56250 - RNA, 20 nt, Artificial Sequence
  MKO10056250_A_Tspan31
  gRNA
ucucaguauaugaucauccu

SEQ ID NO: 56251 - RNA, 20 nt, Artificial Sequence
  MKO10056251_A_Tspan31
  gRNA
cagaugucaucaaugcuucg

SEQ ID NO: 56252 - RNA, 20 nt, Artificial Sequence
  MKO10056252_A_Tspan32
  gRNA
ccuaugaaacacugcgcuau

SEQ ID NO: 56253 - RNA, 20 nt, Artificial Sequence
  MKO10056253_A_Tspan32
  gRNA
gguuccucuccaacgaugca

SEQ ID NO: 56254 - RNA, 20 nt, Artificial Sequence
  MKO10056254_A_Tspan32
  gRNA
uggaacuuaccgcagccaug

SEQ ID NO: 56255 - RNA, 20 nt, Artificial Sequence
  MKO10056255_A_Tspan33
  gRNA
cgugcauuaucgagaugacc

SEQ ID NO: 56256 - RNA, 20 nt, Artificial Sequence
  MKO10056256_A_Tspan33
  gRNA
cugcagaaccucaucgacuu

SEQ ID NO: 56257 - RNA, 20 nt, Artificial Sequence
  MKO10056257_A_Tspan33
  gRNA
accugcgugcuucauuagcc

SEQ ID NO: 56258 - RNA, 20 nt, Artificial Sequence
  MKO10056258_A_Tspan3
  gRNA
cgacuaugaccacuucuucg

SEQ ID NO: 56259 - RNA, 20 nt, Artificial Sequence
  MKO10056259_A_Tspan3
  gRNA
ucacacucaccucggcguag

SEQ ID NO: 56260 - RNA, 20 nt, Artificial Sequence
  MKO10056260_A_Tspan3
  gRNA
gucggaguuggucccguugu

SEQ ID NO: 56261 - RNA, 20 nt, Artificial Sequence
  MKO10056261_A_Tspan4
  gRNA
aaugcagcccacgaagccga

SEQ ID NO: 56262 - RNA, 20 nt, Artificial Sequence
  MKO10056262_A_Tspan4
  gRNA
aggucccggugacgaugagc

SEQ ID NO: 56263 - RNA, 20 nt, Artificial Sequence
  MKO10056263_A_Tspan4
  gRNA
ugcuucuaguuccgaugcug

SEQ ID NO: 56264 - RNA, 20 nt, Artificial Sequence
  MKO10056264_A_Tspan5
  gRNA
aucucguccaucaccgaccu

SEQ ID NO: 56265 - RNA, 20 nt, Artificial Sequence
  MKO10056265_A_Tspan5
  gRNA
auggcacaccgcaucgcucu

SEQ ID NO: 56266 - RNA, 20 nt, Artificial Sequence
  MKO10056266_A_Tspan5
  gRNA
aaugcaagccgagagcgaug

SEQ ID NO: 56267 - RNA, 20 nt, Artificial Sequence
  MKO10056267_A_Tspan6
  gRNA
cuaccugucgagccuccgcc

SEQ ID NO: 56268 - RNA, 20 nt, Artificial Sequence
  MKO10056268_A_Tspan6
  gRNA
acgaacuauuacucagaaac

SEQ ID NO: 56269 - RNA, 20 nt, Artificial Sequence
  MKO10056269_A_Tspan6
  gRNA
accuuuccaaucuccguaau

SEQ ID NO: 56270 - RNA, 20 nt, Artificial Sequence
  MKO10056270_A_Tspan7
  gRNA
aguuucguucaugcagcaac

SEQ ID NO: 56271 - RNA, 20 nt, Artificial Sequence
  MKO10056271_A_Tspan7
  gRNA
cgccaccaaaguuaaucaga

SEQ ID NO: 56272 - RNA, 20 nt, Artificial Sequence
  MKO10056272_A_Tspan7
  gRNA
uggauuuguguuucgucaug

SEQ ID NO: 56273 - RNA, 20 nt, Artificial Sequence
  MKO10056273_A_Tspan8
  gRNA
acguaccucagguuugaaag

SEQ ID NO: 56274 - RNA, 20 nt, Artificial Sequence
  MKO10056274_A_Tspan8
  gRNA
caugauuguguuucagucgg

SEQ ID NO: 56275 - RNA, 20 nt, Artificial Sequence
  MKO10056275_A_Tspan8
  gRNA
gguaugugguacacugaucu

SEQ ID NO: 56276 - RNA, 20 nt, Artificial Sequence
  MKO10056276_A_Tspan9
  gRNA
gccaaccucgucaucgccau

SEQ ID NO: 56277 - RNA, 20 nt, Artificial Sequence
  MKO10056277_A_Tspan9
  gRNA
gccccacagaugcgguguug

SEQ ID NO: 56278 - RNA, 20 nt, Artificial Sequence
  MKO10056278_A_Tspan9
  gRNA
gccgauggcgaugacgaggu

SEQ ID NO: 56279 - RNA, 20 nt, Artificial Sequence
  MKO10056279_A_Tspear
  gRNA
gagagggacacgcuacugcu

SEQ ID NO: 56280 - RNA, 20 nt, Artificial Sequence
  MKO10056280_A_Tspear
  gRNA
cuggccucauggacagccga

SEQ ID NO: 56281 - RNA, 20 nt, Artificial Sequence
  MKO10056281_A_Tspear
  gRNA
agcuacaagugggauccgga

SEQ ID NO: 56282 - RNA, 20 nt, Artificial Sequence
  MKO10056282_A_Tspo2
  gRNA
gauggcuaaggcugguacgu

SEQ ID NO: 56283 - RNA, 20 nt, Artificial Sequence
  MKO10056283_A_Tspo2
  gRNA
gaugaaugagcauacaaauc

SEQ ID NO: 56284 - RNA, 20 nt, Artificial Sequence
  MKO10056284_A_Tspo2
  gRNA
uggccccuagcacugccccu

SEQ ID NO: 56285 - RNA, 20 nt, Artificial Sequence
  MKO10056285_A_Tspo
  gRNA
gcccucgccacguacaaagu

SEQ ID NO: 56286 - RNA, 20 nt, Artificial Sequence
  MKO10056286_A_Tspo
  gRNA
uuggcaccgagugagcccgc

SEQ ID NO: 56287 - RNA, 20 nt, Artificial Sequence
  MKO10056287_A_Tspo
  gRNA
agccuacuuuguacguggcg

SEQ ID NO: 56288 - RNA, 20 nt, Artificial Sequence
  MKO10056288_A_Tspyl1
  gRNA
gaccccgacgucgcccaaua

SEQ ID NO: 56289 - RNA, 20 nt, Artificial Sequence
  MKO10056289_A_Tspyl1
  gRNA
ccgguuccgucuucacguca

SEQ ID NO: 56290 - RNA, 20 nt, Artificial Sequence
  MKO10056290_A_Tspyl1
  gRNA
ugucacgaacaccgcugccg

SEQ ID NO: 56291 - RNA, 20 nt, Artificial Sequence
  MKO10056291_A_Tspyl2
  gRNA
cgucucauauaguagcguac

SEQ ID NO: 56292 - RNA, 20 nt, Artificial Sequence
  MKO10056292_A_Tspyl2
  gRNA
uggccccggugccaacguau

SEQ ID NO: 56293 - RNA, 20 nt, Artificial Sequence
  MKO10056293_A_Tspyl2
  gRNA
ccgcuacuugaccaaucuuc

SEQ ID NO: 56294 - RNA, 20 nt, Artificial Sequence
  MKO10056294_A_Tspyl3
  gRNA
gccugccgcccauacaagag

SEQ ID NO: 56295 - RNA, 20 nt, Artificial Sequence
  MKO10056295_A_Tspyl3
  gRNA
gcgggguugcagggccuaag

SEQ ID NO: 56296 - RNA, 20 nt, Artificial Sequence
  MKO10056296_A_Tspyl3
  gRNA
ugcgagaagggcucggguaa

SEQ ID NO: 56297 - RNA, 20 nt, Artificial Sequence
  MKO10056297_A_Tspyl4
  gRNA
ggugcguccccgcccuuuga

SEQ ID NO: 56298 - RNA, 20 nt, Artificial Sequence
  MKO10056298_A_Tspyl4
  gRNA
cacucucuacgccaauccgc

SEQ ID NO: 56299 - RNA, 20 nt, Artificial Sequence
  MKO10056299_A_Tspyl4
  gRNA
gcccaaauuugcguuccagc

SEQ ID NO: 56300 - RNA, 20 nt, Artificial Sequence
  MKO10056300_A_Tspyl5
  gRNA
cuuccgcagcggcccggacc

SEQ ID NO: 56301 - RNA, 20 nt, Artificial Sequence
  MKO10056301_A_Tspyl5
  gRNA
gccuuggcgaagcugcgacg

SEQ ID NO: 56302 - RNA, 20 nt, Artificial Sequence
  MKO10056302_A_Tspyl5
  gRNA
ggacucgccgauuuccaaug

SEQ ID NO: 56303 - RNA, 20 nt, Artificial Sequence
  MKO10056303_A_Tsr1
  gRNA
agcucagccgaauagaccag

SEQ ID NO: 56304 - RNA, 20 nt, Artificial Sequence
  MKO10056304_A_Tsr1
  gRNA
aauagcuugcugcauaucgu

SEQ ID NO: 56305 - RNA, 20 nt, Artificial Sequence
  MKO10056305_A_Tsr1
  gRNA
gcuagguucuggccgagaag

SEQ ID NO: 56306 - RNA, 20 nt, Artificial Sequence
  MKO10056306_A_Tsr2
  gRNA
cuucgggggcgugcacagcc

SEQ ID NO: 56307 - RNA, 20 nt, Artificial Sequence
  MKO10056307_A_Tsr2
  gRNA
cacugcacccccuagccacu

SEQ ID NO: 56308 - RNA, 20 nt, Artificial Sequence
  MKO10056308_A_Tsr2
  gRNA
gagcacacgcacaucuucag

SEQ ID NO: 56309 - RNA, 20 nt, Artificial Sequence
  MKO10056309_A_Tsr3
  gRNA
aguacgugucuccggcagac

SEQ ID NO: 56310 - RNA, 20 nt, Artificial Sequence
  MKO10056310_A_Tsr3
  gRNA
gaccuaccgggugcuggcca

SEQ ID NO: 56311 - RNA, 20 nt, Artificial Sequence
  MKO10056311_A_Tsr3
  gRNA
cugcgaccccaagcgcugca

SEQ ID NO: 56312 - RNA, 20 nt, Artificial Sequence
  MKO10056312_A_Tssc1
  gRNA
gccagaucucacccgcuuga

SEQ ID NO: 56313 - RNA, 20 nt, Artificial Sequence
  MKO10056313_A_Tssc1
  gRNA
ccuaccaggccacguugccu

SEQ ID NO: 56314 - RNA, 20 nt, Artificial Sequence
  MKO10056314_A_Tssc1
  gRNA
gcagugcuugcagggucguc

SEQ ID NO: 56315 - RNA, 20 nt, Artificial Sequence
  MKO10056315_A_Tssc4
  gRNA
gguccgaguccgagucgcug

SEQ ID NO: 56316 - RNA, 20 nt, Artificial Sequence
  MKO10056316_A_Tssc4
  gRNA
ucggaccuuagcuuaccuag

SEQ ID NO: 56317 - RNA, 20 nt, Artificial Sequence
  MKO10056317_A_Tssc4
  gRNA
gugcagccauuccaccuccg

SEQ ID NO: 56318 - RNA, 20 nt, Artificial Sequence
  MKO10056318_A_Tssk1
  gRNA
gcugccguccucaagcgacg

SEQ ID NO: 56319 - RNA, 20 nt, Artificial Sequence
  MKO10056319_A_Tssk1
  gRNA
ugauguagccucgucgcuug

SEQ ID NO: 56320 - RNA, 20 nt, Artificial Sequence
  MKO10056320_A_Tssk1
  gRNA
aucaucccgcaagcagcgcu

SEQ ID NO: 56321 - RNA, 20 nt, Artificial Sequence
  MKO10056321_A_Tssk2
  gRNA
aacggugguugacggucgcc

SEQ ID NO: 56322 - RNA, 20 nt, Artificial Sequence
  MKO10056322_A_Tssk2
  gRNA
cucgaguucaucaagugccg

SEQ ID NO: 56323 - RNA, 20 nt, Artificial Sequence
  MKO10056323_A_Tssk2
  gRNA
gugucaccagcauccguugc

SEQ ID NO: 56324 - RNA, 20 nt, Artificial Sequence
  MKO10056324_A_Tssk3
  gRNA
gcuccagauuguccguaccc

SEQ ID NO: 56325 - RNA, 20 nt, Artificial Sequence
  MKO10056325_A_Tssk3
  gRNA
cuugcccagcugauacccau

SEQ ID NO: 56326 - RNA, 20 nt, Artificial Sequence
  MKO10056326_A_Tssk3
  gRNA
caacuaacuucuucgauuga

SEQ ID NO: 56327 - RNA, 20 nt, Artificial Sequence
  MKO10056327_A_Tssk4
  gRNA
cauaucguuggauccauucg

SEQ ID NO: 56328 - RNA, 20 nt, Artificial Sequence
  MKO10056328_A_Tssk4
  gRNA
cagcuuugcuuacgccugcc

SEQ ID NO: 56329 - RNA, 20 nt, Artificial Sequence
  MKO10056329_A_Tssk4
  gRNA
cuccuccaugacagagcgau

SEQ ID NO: 56330 - RNA, 20 nt, Artificial Sequence
  MKO10056330_A_Tssk5
  gRNA
cugcguugauaugcuccaac

SEQ ID NO: 56331 - RNA, 20 nt, Artificial Sequence
  MKO10056331_A_Tssk5
  gRNA
aacuuucuggaguauuccgc

SEQ ID NO: 56332 - RNA, 20 nt, Artificial Sequence
  MKO10056332_A_Tssk5
  gRNA
ucagaccuccgauguugccc

SEQ ID NO: 56333 - RNA, 20 nt, Artificial Sequence
  MKO10056333_A_Tssk6
  gRNA
auacgcggccgagccgcagu

SEQ ID NO: 56334 - RNA, 20 nt, Artificial Sequence
  MKO10056334_A_Tssk6
  gRNA
cgagcgccgcgucaagauca

SEQ ID NO: 56335 - RNA, 20 nt, Artificial Sequence
  MKO10056335_A_Tssk6
  gRNA
ggccgcguaugcgucaccug

SEQ ID NO: 56336 - RNA, 20 nt, Artificial Sequence
  MKO10056336_A_Tsua3
  gRNA
gcuacccggccucauccaua

SEQ ID NO: 56337 - RNA, 20 nt, Artificial Sequence
  MKO10056337_A_Tsua3
  gRNA
cgccuaccauugcagcgaga

SEQ ID NO: 56338 - RNA, 20 nt, Artificial Sequence
  MKO10056338_A_Tsua3
  gRNA
cuugcgagcgcccaccucga

SEQ ID NO: 56339 - RNA, 20 nt, Artificial Sequence
  MKO10056339_A_Tstd1
  gRNA
cuucgacguucgaucuccag

SEQ ID NO: 56340 - RNA, 20 nt, Artificial Sequence
  MKO10056340_A_Tstd1
  gRNA
agaucgaacgucgaagagcc

SEQ ID NO: 56341 - RNA, 20 nt, Artificial Sequence
  MKO10056341_A_Tstd1
  gRNA
cacagggcucggaacuaugc

SEQ ID NO: 56342 - RNA, 20 nt, Artificial Sequence
  MKO10056342_A_Tstd2
  gRNA
aacacaccgacucgcaauuc

SEQ ID NO: 56343 - RNA, 20 nt, Artificial Sequence
  MKO10056343_A_Tstd2
  gRNA
ugcuucccggaauugcgagu

SEQ ID NO: 56344 - RNA, 20 nt, Artificial Sequence
  MKO10056344_A_Tstd2
  gRNA
cagauucggauugcuacuga

SEQ ID NO: 56345 - RNA, 20 nt, Artificial Sequence
  MKO10056345_A_Tstd3
  gRNA
caugguauguugauugaucc

SEQ ID NO: 56346 - RNA, 20 nt, Artificial Sequence
  MKO10056346_A_Tstd3
  gRNA
gccauccaaaucugaccguc

SEQ ID NO: 56347 - RNA, 20 nt, Artificial Sequence
  MKO10056347_A_Tstd3
  gRNA
ucaagcucaccgccaagcgc

SEQ ID NO: 56348 - RNA, 20 nt, Artificial Sequence
  MKO10056348_A_Tst
  gRNA
gacgcgucuugguacucacc

SEQ ID NO: 56349 - RNA, 20 nt, Artificial Sequence
  MKO10056349_A_Tst
  gRNA
cuggcggaauccauucgguc

SEQ ID NO: 56350 - RNA, 20 nt, Artificial Sequence
  MKO10056350_A_Tst
  gRNA
ccucauugccacgugccgca

SEQ ID NO: 56351 - RNA, 20 nt, Artificial Sequence
  MKO10056351_A_Tsx
  gRNA
agucagcaguaccgaugaug

SEQ ID NO: 56352 - RNA, 20 nt, Artificial Sequence
  MKO10056352_A_Tsx
  gRNA
agaugaugacaccgacgauc

SEQ ID NO: 56353 - RNA, 20 nt, Artificial Sequence
  MKO10056353_A_Tsx
  gRNA
uggcucaucugccugaucgu

SEQ ID NO: 56354 - RNA, 20 nt, Artificial Sequence
  MKO10056354_A_Ttbk1
  gRNA
gccggcugcccucgaccuac

SEQ ID NO: 56355 - RNA, 20 nt, Artificial Sequence
  MKO10056355_A_Ttbk1
  gRNA
guugaguaccacacugcgcc

SEQ ID NO: 56356 - RNA, 20 nt, Artificial Sequence
  MKO10056356_A_Ttbk1
  gRNA
cucaacgugaaagugccccu

SEQ ID NO: 56357 - RNA, 20 nt, Artificial Sequence
  MKO10056357_A_Ttbk2
  gRNA
gauuccacagggacggaauc

SEQ ID NO: 56358 - RNA, 20 nt, Artificial Sequence
  MKO10056358_A_Ttbk2
  gRNA
aucuccgccguagccaaucc

SEQ ID NO: 56359 - RNA, 20 nt, Artificial Sequence
  MKO10056359_A_Ttbk2
  gRNA
aaaugaucguuucaacuacg

SEQ ID NO: 56360 - RNA, 20 nt, Artificial Sequence
  MKO10056360_A_Tuc12
  gRNA
uucauagucgccccugacaa

SEQ ID NO: 56361 - RNA, 20 nt, Artificial Sequence
  MKO10056361_A_Tuc12
  gRNA
guuacccaccugggcucggu

SEQ ID NO: 56362 - RNA, 20 nt, Artificial Sequence
  MKO10056362_A_Tuc12
  gRNA
auccguggagaaggacgcca

SEQ ID NO: 56363 - RNA, 20 nt, Artificial Sequence
  MKO10056363_A_Tuc13
  gRNA
ucaguucgcagucagacucg

SEQ ID NO: 56364 - RNA, 20 nt, Artificial Sequence
  MKO10056364_A_Tuc13
  gRNA
cugucauugucgguagcaaa

SEQ ID NO: 56365 - RNA, 20 nt, Artificial Sequence
  MKO10056365_A_Tuc13
  gRNA
gaacauuaccuggagcaucg

SEQ ID NO: 56366 - RNA, 20 nt, Artificial Sequence
  MKO10056366_A_Tuc14
  gRNA
gcgacugccgcagcaagucg

SEQ ID NO: 56367 - RNA, 20 nt, Artificial Sequence
  MKO10056367_A_Tuc14
  gRNA
ccauggaccgcgacuugcug

SEQ ID NO: 56368 - RNA, 20 nt, Artificial Sequence
  MKO10056368_A_Tuc14
  gRNA
uucuuccgagauauugaacg

SEQ ID NO: 56369 - RNA, 20 nt, Artificial Sequence
  MKO10056369_A_Tuc16
  gRNA
aagauccugcgacgcaucuu

SEQ ID NO: 56370 - RNA, 20 nt, Artificial Sequence
  MKO10056370_A_Tuc16
  gRNA
uaaccccguucuagagcuag

SEQ ID NO: 56371 - RNA, 20 nt, Artificial Sequence
  MKO10056371_A_Tuc16
  gRNA
cuucuauguauuccgugcug

SEQ ID NO: 56372 - RNA, 20 nt, Artificial Sequence
  MKO10056372_A_Tuc17
  gRNA
cuugucucauuaauaugacu

SEQ ID NO: 56373 - RNA, 20 nt, Artificial Sequence
  MKO10056373_A_Tuc17
  gRNA
auaggucaucucauucacga

SEQ ID NO: 56374 - RNA, 20 nt, Artificial Sequence
  MKO10056374_A_Tuc17
  gRNA
caaagugccuuugggagacc

SEQ ID NO: 56375 - RNA, 20 nt, Artificial Sequence
  MKO10056375_A_Tuc18
  gRNA
cccuuggaaacuccuuugcc

SEQ ID NO: 56376 - RNA, 20 nt, Artificial Sequence
  MKO10056376_A_Tuc18
  gRNA
guuguacuuugcaguuccuu

SEQ ID NO: 56377 - RNA, 20 nt, Artificial Sequence
  MKO10056377_A_Tuc18
  gRNA
acucggguuaccuuagagcc

SEQ ID NO: 56378 - RNA, 20 nt, Artificial Sequence
  MKO10056378_A_Tuc19
  gRNA
caucacguacacuuaugacc

SEQ ID NO: 56379 - RNA, 20 nt, Artificial Sequence
  MKO10056379_A_Tuc19
  gRNA
gcaacgaugaguuaucugcu

SEQ ID NO: 56380 - RNA, 20 nt, Artificial Sequence
  MKO10056380_A_Tuc19
  gRNA
ccguacaacccccacaccgc

SEQ ID NO: 56381 - RNA, 20 nt, Artificial Sequence
  MKO10056381_A_Tuc1
  gRNA
ccuauauccgugcaauacug

SEQ ID NO: 56382 - RNA, 20 nt, Artificial Sequence
  MKO10056382_A_Tuc1
  gRNA
acagaacagaucgaucuuuc

SEQ ID NO: 56383 - RNA, 20 nt, Artificial Sequence
  MKO10056383_A_Tuc1
  gRNA
ucucuugcuugauguacuga

SEQ ID NO: 56384 - RNA, 20 nt, Artificial Sequence
  MKO10056384_A_Tuc21a
  gRNA
acgcucaccgauggugucgc

SEQ ID NO: 56385 - RNA, 20 nt, Artificial Sequence
  MKO10056385_A_Tuc21a
  gRNA
gcagggcgaugaccgcgcac

SEQ ID NO: 56386 - RNA, 20 nt, Artificial Sequence
  MKO10056386_A_Tuc21a
  gRNA
cuguaccucuuuggagccgc

SEQ ID NO: 56387 - RNA, 20 nt, Artificial Sequence
  MKO10056387_A_Tuc21b
  gRNA
gcacauuggucgucaugaca

SEQ ID NO: 56388 - RNA, 20 nt, Artificial Sequence
  MKO10056388_A_Tuc21b
  gRNA
aucccuccucaaaauaccgc

SEQ ID NO: 56389 - RNA, 20 nt, Artificial Sequence
  MKO10056389_A_Tuc21b
  gRNA
gucaccucauugcuaucaug

SEQ ID NO: 56390 - RNA, 20 nt, Artificial Sequence
  MKO10056390_A_Tuc22
  gRNA
ugcccgaguacccguauuca

SEQ ID NO: 56391 - RNA, 20 nt, Artificial Sequence
  MKO10056391_A_Tuc22
  gRNA
accucccauucugaaucgcc

SEQ ID NO: 56392 - RNA, 20 nt, Artificial Sequence
  MKO10056392_A_Tuc22
  gRNA
uguccaugaauacggguacu

SEQ ID NO: 56393 - RNA, 20 nt, Artificial Sequence
  MKO10056393_A_Tuc23l
  gRNA
ugaaguuguauuucgcuucc

SEQ ID NO: 56394 - RNA, 20 nt, Artificial Sequence
  MKO10056394_A_Tuc23l
  gRNA
uuaggucuuucuccgagacu

SEQ ID NO: 56395 - RNA, 20 nt, Artificial Sequence
  MKO10056395_A_Tuc23l
  gRNA
gaaagaccuaaccauugcuu

SEQ ID NO: 56396 - RNA, 20 nt, Artificial Sequence
  MKO10056396_A_Tuc23
  gRNA
cgacuggcacuggaaacuag

SEQ ID NO: 56397 - RNA, 20 nt, Artificial Sequence
  MKO10056397_A_Tuc23
  gRNA
gacucucgauggaguuggcc

SEQ ID NO: 56398 - RNA, 20 nt, Artificial Sequence
  MKO10056398_A_Tuc23
  gRNA
ggcguauguuaaucuggcuc

SEQ ID NO: 56399 - RNA, 20 nt, Artificial Sequence
  MKO10056399_A_Tuc24
  gRNA
cucguccuuaggagacguga

SEQ ID NO: 56400 - RNA, 20 nt, Artificial Sequence
  MKO10056400_A_Tuc24
  gRNA
gggcuucccaauaguugcca

SEQ ID NO: 56401 - RNA, 20 nt, Artificial Sequence
  MKO10056401_A_Tuc24
  gRNA
aaccaaguucuguacgagag

SEQ ID NO: 56402 - RNA, 20 nt, Artificial Sequence
  MKO10056402_A_Tuc25
  gRNA
gaacgacccgacuuucugca

SEQ ID NO: 56403 - RNA, 20 nt, Artificial Sequence
  MKO10056403_A_Tuc25
  gRNA
ugaggccucagcaucguuca

SEQ ID NO: 56404 - RNA, 20 nt, Artificial Sequence
  MKO10056404_A_Tuc25
  gRNA
cuguacgagaguugcuuuau

SEQ ID NO: 56405 - RNA, 20 nt, Artificial Sequence
  MKO10056405_A_Tuc26
  gRNA
gugaaguucaagcgccacgu

SEQ ID NO: 56406 - RNA, 20 nt, Artificial Sequence
  MKO10056406_A_Tuc26
  gRNA
aagcucucuuguagucaccc

SEQ ID NO: 56407 - RNA, 20 nt, Artificial Sequence
  MKO10056407_A_Tuc26
  gRNA
cuccccgcccacagcggguu

SEQ ID NO: 56408 - RNA, 20 nt, Artificial Sequence
  MKO10056408_A_Tuc27
  gRNA
gcgugcuauuagcagcagua

SEQ ID NO: 56409 - RNA, 20 nt, Artificial Sequence
  MKO10056409_A_Tuc27
  gRNA
acauaucucaacguccacca

SEQ ID NO: 56410 - RNA, 20 nt, Artificial Sequence
  MKO10056410_A_Tuc27
  gRNA
aaauaguuugugucguugaa

SEQ ID NO: 56411 - RNA, 20 nt, Artificial Sequence
  MKO10056411_A_Tuc28
  gRNA
ccaguaccuuggacgucacg

SEQ ID NO: 56412 - RNA, 20 nt, Artificial Sequence
  MKO10056412_A_Tuc28
  gRNA
gggcauccgcgugacgucca

SEQ ID NO: 56413 - RNA, 20 nt, Artificial Sequence
  MKO10056413_A_Tuc28
  gRNA
gaaaguucgucagaguaacc

SEQ ID NO: 56414 - RNA, 20 nt, Artificial Sequence
  MKO10056414_A_Tuc29
  gRNA
uaagcuccgggaagcugcga

SEQ ID NO: 56415 - RNA, 20 nt, Artificial Sequence
  MKO10056415_A_Tuc29
  gRNA
auuucuaccacuaccugacc

SEQ ID NO: 56416 - RNA, 20 nt, Artificial Sequence
  MKO10056416_A_Tuc29
  gRNA
ugaggaaucacuucuacgaa

SEQ ID NO: 56417 - RNA, 20 nt, Artificial Sequence
  MKO10056417_A_Tuc30a1
  gRNA
agcagcucuaaaguucccga

SEQ ID NO: 56418 - RNA, 20 nt, Artificial Sequence
  MKO10056418_A_Tuc30a1
  gRNA
cacaugauagugcuuuguga

SEQ ID NO: 56419 - RNA, 20 nt, Artificial Sequence
  MKO10056419_A_Tuc30a1
  gRNA
guaucagcugagaaacuuug

SEQ ID NO: 56420 - RNA, 20 nt, Artificial Sequence
  MKO10056420_A_Tuc30a2
  gRNA
ugauagcagcuuguaaacga

SEQ ID NO: 56421 - RNA, 20 nt, Artificial Sequence
  MKO10056421_A_Tuc30a2
  gRNA
auugccaauaucauugagcg

SEQ ID NO: 56422 - RNA, 20 nt, Artificial Sequence
  MKO10056422_A_Tuc30a2
  gRNA
cugcaaagccgcaaagaauu

SEQ ID NO: 56423 - RNA, 20 nt, Artificial Sequence
  MKO10056423_A_Tuc30b
  gRNA
ccauacaaguacaggauuca

SEQ ID NO: 56424 - RNA, 20 nt, Artificial Sequence
  MKO10056424_A_Tuc30b
  gRNA
uaugauggucagaucaaccu

SEQ ID NO: 56425 - RNA, 20 nt, Artificial Sequence
  MKO10056425_A_Tuc30b
  gRNA
ccuugaauccuguacuugua

SEQ ID NO: 56426 - RNA, 20 nt, Artificial Sequence
  MKO10056426_A_Tuc32
  gRNA
accucccgugacgcgcgcac

SEQ ID NO: 56427 - RNA, 20 nt, Artificial Sequence
  MKO10056427_A_Tuc32
  gRNA
uacccagccuguagcguauc

SEQ ID NO: 56428 - RNA, 20 nt, Artificial Sequence
  MKO10056428_A_Tuc32
  gRNA
cggcgcaggcucgcuucucc

SEQ ID NO: 56429 - RNA, 20 nt, Artificial Sequence
  MKO10056429_A_Tuc33
  gRNA
ucaagcguaacccacacucg

SEQ ID NO: 56430 - RNA, 20 nt, Artificial Sequence
  MKO10056430_A_Tuc33
  gRNA
guucaucggauauaugugca

SEQ ID NO: 56431 - RNA, 20 nt, Artificial Sequence
  MKO10056431_A_Tuc33
  gRNA
ucaccgggcuuugauaaaga

SEQ ID NO: 56432 - RNA, 20 nt, Artificial Sequence
  MKO10056432_A_Tuc34
  gRNA
cucguccgagcccgcuguua

SEQ ID NO: 56433 - RNA, 20 nt, Artificial Sequence
  MKO10056433_A_Tuc34
  gRNA
ggacccggcagcgcguguac

SEQ ID NO: 56434 - RNA, 20 nt, Artificial Sequence
  MKO10056434_A_Tuc34
  gRNA
ugugagaagcaggcgccaac

SEQ ID NO: 56435 - RNA, 20 nt, Artificial Sequence
  MKO10056435_A_Tuc36
  gRNA
uccgcccgcaggcgcccugg

SEQ ID NO: 56436 - RNA, 20 nt, Artificial Sequence
  MKO10056436_A_Tuc36
  gRNA
ccacgcucagcgcccguugc

SEQ ID NO: 56437 - RNA, 20 nt, Artificial Sequence
  MKO10056437_A_Tuc36
  gRNA
ggcuugggcucgguuguugu

SEQ ID NO: 56438 - RNA, 20 nt, Artificial Sequence
  MKO10056438_A_Tuc37
  gRNA
ugacguguguaagaaacucg

SEQ ID NO: 56439 - RNA, 20 nt, Artificial Sequence
  MKO10056439_A_Tuc37
  gRNA
gugcaaucaaguaaaugcua

SEQ ID NO: 56440 - RNA, 20 nt, Artificial Sequence
  MKO10056440_A_Tuc37
  gRNA
uagauugauaaagacacggc

SEQ ID NO: 56441 - RNA, 20 nt, Artificial Sequence
  MKO10056441_A_Tuc38
  gRNA
cguuggcacgggaaccuccg

SEQ ID NO: 56442 - RNA, 20 nt, Artificial Sequence
  MKO10056442_A_Tuc38
  gRNA
cgccugacaucccccuuaac

SEQ ID NO: 56443 - RNA, 20 nt, Artificial Sequence
  MKO10056443_A_Tuc38
  gRNA
aaagggguaaacucgagcca

SEQ ID NO: 56444 - RNA, 20 nt, Artificial Sequence
  MKO10056444_A_Tuc39a
  gRNA
ccaggaugguggcauacguc

SEQ ID NO: 56445 - RNA, 20 nt, Artificial Sequence
  MKO10056445_A_Tuc39a
  gRNA
caugaugaccuucgaccccc

SEQ ID NO: 56446 - RNA, 20 nt, Artificial Sequence
  MKO10056446_A_Tuc39a
  gRNA
caaugguaggacggugcacc

SEQ ID NO: 56447 - RNA, 20 nt, Artificial Sequence
  MKO10056447_A_Tuc39b
  gRNA
cccuagaguugcuacgucca

SEQ ID NO: 56448 - RNA, 20 nt, Artificial Sequence
  MKO10056448_A_Tuc39b
  gRNA
ccacagaucuccaucggaca

SEQ ID NO: 56449 - RNA, 20 nt, Artificial Sequence
  MKO10056449_A_Tuc39b
  gRNA
cuggauguccugcugcucga

SEQ ID NO: 56450 - RNA, 20 nt, Artificial Sequence
  MKO10056450_A_Tuc39c
  gRNA
gacguaugcgagcgaaagua

SEQ ID NO: 56451 - RNA, 20 nt, Artificial Sequence
  MKO10056451_A_Tuc39c
  gRNA
cgacaacucuuguuucacaa

SEQ ID NO: 56452 - RNA, 20 nt, Artificial Sequence
  MKO10056452_A_Tuc39c
  gRNA
cuuuccuggagaccgccuac

SEQ ID NO: 56453 - RNA, 20 nt, Artificial Sequence
  MKO10056453_A_Tuc39d
  gRNA
ucuaugccguacuccucguu

SEQ ID NO: 56454 - RNA, 20 nt, Artificial Sequence
  MKO10056454_A_Tuc39d
  gRNA
gagcucuuacuucuuacgcg

SEQ ID NO: 56455 - RNA, 20 nt, Artificial Sequence
  MKO10056455_A_Tuc39d
  gRNA
aucucgccuaaugaguagac

SEQ ID NO: 56456 - RNA, 20 nt, Artificial Sequence
  MKO10056456_A_Tuc3
  gRNA
aucacaguaaucuugcagga

SEQ ID NO: 56457 - RNA, 20 nt, Artificial Sequence
  MKO10056457_A_Tuc3
  gRNA
aauaugacaucugcaauauc

SEQ ID NO: 56458 - RNA, 20 nt, Artificial Sequence
  MKO10056458_A_Tuc3
  gRNA
gcccaaagugagaaaaauuu

SEQ ID NO: 56459 - RNA, 20 nt, Artificial Sequence
  MKO10056459_A_Tuc4
  gRNA
caucaucaaaaaucaucgac

SEQ ID NO: 56460 - RNA, 20 nt, Artificial Sequence
  MKO10056460_A_Tuc4
  gRNA
gugaccgggcuuuagcuucu

SEQ ID NO: 56461 - RNA, 20 nt, Artificial Sequence
  MKO10056461_A_Tuc4
  gRNA
gauaguacugugcugcugcc

SEQ ID NO: 56462 - RNA, 20 nt, Artificial Sequence
  MKO10056462_A_Tuc5
  gRNA
ugaacauucucgccacguca

SEQ ID NO: 56463 - RNA, 20 nt, Artificial Sequence
  MKO10056463_A_Tuc5
  gRNA
accagcugggugagguguac

SEQ ID NO: 56464 - RNA, 20 nt, Artificial Sequence
  MKO10056464_A_Tuc5
  gRNA
uccaguacaccucacccagc

SEQ ID NO: 56465 - RNA, 20 nt, Artificial Sequence
  MKO10056465_A_Tuc7b
  gRNA
ccacccgggcguagauguuc

SEQ ID NO: 56466 - RNA, 20 nt, Artificial Sequence
  MKO10056466_A_Tuc7b
  gRNA
cugucagcggcaagucaucg

SEQ ID NO: 56467 - RNA, 20 nt, Artificial Sequence
  MKO10056467_A_Tuc7b
  gRNA
caagcaucugaccgcugccc

SEQ ID NO: 56468 - RNA, 20 nt, Artificial Sequence
  MKO10056468_A_Tuc7
  gRNA
acuauguggagggcucguac

SEQ ID NO: 56469 - RNA, 20 nt, Artificial Sequence
  MKO10056469_A_Tuc7
  gRNA
ugggaucgaugacauauccg

SEQ ID NO: 56470 - RNA, 20 nt, Artificial Sequence
  MKO10056470_A_Tuc7
  gRNA
ccggcaguuucccauuguug

SEQ ID NO: 56471 - RNA, 20 nt, Artificial Sequence
  MKO10056471_A_Tuc8
  gRNA
cgaucuaugcacgcagaugc

SEQ ID NO: 56472 - RNA, 20 nt, Artificial Sequence
  MKO10056472_A_Tuc8
  gRNA
cgaccuaucacuagcucauc

SEQ ID NO: 56473 - RNA, 20 nt, Artificial Sequence
  MKO10056473_A_Tuc8
  gRNA
cggccagguaccugaucaua

SEQ ID NO: 56474 - RNA, 20 nt, Artificial Sequence
  MKO10056474_A_Tuc9b
  gRNA
ugccguggcguucaaggcgg

SEQ ID NO: 56475 - RNA, 20 nt, Artificial Sequence
  MKO10056475_A_Tuc9b
  gRNA
ugcugucgagcgccgcagcc

SEQ ID NO: 56476 - RNA, 20 nt, Artificial Sequence
  MKO10056476_A_Tuc9b
  gRNA
gaaggcaaugccggcacgau

SEQ ID NO: 56477 - RNA, 20 nt, Artificial Sequence
  MKO10056477_A_Tuc9c
  gRNA
cauuaucggguugucguucu

SEQ ID NO: 56478 - RNA, 20 nt, Artificial Sequence
  MKO10056478_A_Tuc9c
  gRNA
ggcuacuccagcccgauaca

SEQ ID NO: 56479 - RNA, 20 nt, Artificial Sequence
  MKO10056479_A_Tuc9c
  gRNA
ugaguucugacugcgucaac

SEQ ID NO: 56480 - RNA, 20 nt, Artificial Sequence
  MKO10056480_A_Tuc9
  gRNA
gcuuggcggcccgauccucg

SEQ ID NO: 56481 - RNA, 20 nt, Artificial Sequence
  MKO10056481_A_Tuc9
  gRNA
ucuugaacucgugugcgcgc

SEQ ID NO: 56482 - RNA, 20 nt, Artificial Sequence
  MKO10056482_A_Tuc9
  gRNA
ucgcucauaauuuaccagcu

SEQ ID NO: 56483 - RNA, 20 nt, Artificial Sequence
  MKO10056483_A_Ttf1
  gRNA
aucccgauacaugcgucuga

SEQ ID NO: 56484 - RNA, 20 nt, Artificial Sequence
  MKO10056484_A_Ttf1
  gRNA
uaaauucuuugaagcgcccu

SEQ ID NO: 56485 - RNA, 20 nt, Artificial Sequence
  MKO10056485_A_Ttf1
  gRNA
cugcagggaagggcaucgcu

SEQ ID NO: 56486 - RNA, 20 nt, Artificial Sequence
  MKO10056486_A_Ttf2
  gRNA
cguccgcgauggcccgaaua

SEQ ID NO: 56487 - RNA, 20 nt, Artificial Sequence
  MKO10056487_A_Ttf2
  gRNA
cgaagccgcauguguucguc

SEQ ID NO: 56488 - RNA, 20 nt, Artificial Sequence
  MKO10056488_A_Ttf2
  gRNA
cagacugucuaguugccacc

SEQ ID NO: 56489 - RNA, 20 nt, Artificial Sequence
  MKO10056489_A_Tti1
  gRNA
ugcccaguagaacccgaguc

SEQ ID NO: 56490 - RNA, 20 nt, Artificial Sequence
  MKO10056490_A_Tti1
  gRNA
guaagucgguguacgaguga

SEQ ID NO: 56491 - RNA, 20 nt, Artificial Sequence
  MKO10056491_A_Tti1
  gRNA
cgaggcuagcaccacagccg

SEQ ID NO: 56492 - RNA, 20 nt, Artificial Sequence
  MKO10056492_A_Tti2
  gRNA
gucuggcauagguccuccgu

SEQ ID NO: 56493 - RNA, 20 nt, Artificial Sequence
  MKO10056493_A_Tti2
  gRNA
accugccagccuucgugaag

SEQ ID NO: 56494 - RNA, 20 nt, Artificial Sequence
  MKO10056494_A_Tti2
  gRNA
gguuggggauccuaacuguc

SEQ ID NO: 56495 - RNA, 20 nt, Artificial Sequence
  MKO10056495_A_Ttk
  gRNA
cuggagguguaaguuacgca

SEQ ID NO: 56496 - RNA, 20 nt, Artificial Sequence
  MKO10056496_A_Ttk
  gRNA
aaguagucacgggcaucauc

SEQ ID NO: 56497 - RNA, 20 nt, Artificial Sequence
  MKO10056497_A_Ttk
  gRNA
ugcccgugacuacuuccaga

SEQ ID NO: 56498 - RNA, 20 nt, Artificial Sequence
  MKO10056498_A_Ttll10
  gRNA
cggauggauucuggaccguu

SEQ ID NO: 56499 - RNA, 20 nt, Artificial Sequence
  MKO10056499_A_Ttll10
  gRNA
uuggagcugacacggguucg

SEQ ID NO: 56500 - RNA, 20 nt, Artificial Sequence
  MKO10056500_A_Ttll10
  gRNA
uacucacauugaugcuccgu

SEQ ID NO: 56501 - RNA, 20 nt, Artificial Sequence
  MKO10056501_A_Ttll11
  gRNA
cgaacuugaguuugucgaug

SEQ ID NO: 56502 - RNA, 20 nt, Artificial Sequence
  MKO10056502_A_Ttll11
  gRNA
uucaugcucaauucgcaugc

SEQ ID NO: 56503 - RNA, 20 nt, Artificial Sequence
  MKO10056503_A_Ttll11
  gRNA
ggggcuugcggauguacucc

SEQ ID NO: 56504 - RNA, 20 nt, Artificial Sequence
  MKO10056504_A_Ttll12
  gRNA
uuguagcacagcucgccccc

SEQ ID NO: 56505 - RNA, 20 nt, Artificial Sequence
  MKO10056505_A_Ttll12
  gRNA
ugaccagugagagcggcguc

SEQ ID NO: 56506 - RNA, 20 nt, Artificial Sequence
  MKO10056506_A_Ttll12
  gRNA
ugguacaucauggacgaguu

SEQ ID NO: 56507 - RNA, 20 nt, Artificial Sequence
  MKO10056507_A_Ttll13
  gRNA
agagcuucugcaugcgguug

SEQ ID NO: 56508 - RNA, 20 nt, Artificial Sequence
  MKO10056508_A_Ttll13
  gRNA
cgccgggcagcccaaaugug

SEQ ID NO: 56509 - RNA, 20 nt, Artificial Sequence
  MKO10056509_A_Ttll13
  gRNA
uccgagccagcagaucuuug

SEQ ID NO: 56510 - RNA, 20 nt, Artificial Sequence
  MKO10056510_A_Ttll1
  gRNA
uacgcugaacacguugcgaa

SEQ ID NO: 56511 - RNA, 20 nt, Artificial Sequence
  MKO10056511_A_Ttll1
  gRNA
cgccgacuacaaccuguuug

SEQ ID NO: 56512 - RNA, 20 nt, Artificial Sequence
  MKO10056512_A_Ttll1
  gRNA
ccacuacgagcugacccgca

SEQ ID NO: 56513 - RNA, 20 nt, Artificial Sequence
  MKO10056513_A_Ttll2
  gRNA
ugggggucgcacaaaacuca

SEQ ID NO: 56514 - RNA, 20 nt, Artificial Sequence
  MKO10056514_A_Ttll2
  gRNA
cacugacuacaccaaguuug

SEQ ID NO: 56515 - RNA, 20 nt, Artificial Sequence
  MKO10056515_A_Ttll2
  gRNA
aauggauggucugcagaguu

SEQ ID NO: 56516 - RNA, 20 nt, Artificial Sequence
  MKO10056516_A_Ttll3
  gRNA
auccagcacaucccgccgag

SEQ ID NO: 56517 - RNA, 20 nt, Artificial Sequence
  MKO10056517_A_Ttll3
  gRNA
cguuucugagucggcccaug

SEQ ID NO: 56518 - RNA, 20 nt, Artificial Sequence
  MKO10056518_A_Ttll3
  gRNA
uccggugucucuugcgucag

SEQ ID NO: 56519 - RNA, 20 nt, Artificial Sequence
  MKO10056519_A_Ttll4
  gRNA
uuugaagugugaccgaccga

SEQ ID NO: 56520 - RNA, 20 nt, Artificial Sequence
  MKO10056520_A_Ttll4
  gRNA
uauuaaugccacugacucgc

SEQ ID NO: 56521 - RNA, 20 nt, Artificial Sequence
  MKO10056521_A_Ttll4
  gRNA
ugucucccccagcgagucag

SEQ ID NO: 56522 - RNA, 20 nt, Artificial Sequence
  MKO10056522_A_Ttll5
  gRNA
cugucagaaugcuucgcacc

SEQ ID NO: 56523 - RNA, 20 nt, Artificial Sequence
  MKO10056523_A_Ttll5
  gRNA
gucuuaugaacuaacccgca

SEQ ID NO: 56524 - RNA, 20 nt, Artificial Sequence
  MKO10056524_A_Ttll5
  gRNA
gggaucacccauguauuaug

SEQ ID NO: 56525 - RNA, 20 nt, Artificial Sequence
  MKO10056525_A_Ttll6
  gRNA
ggagaggcauauucauuacc

SEQ ID NO: 56526 - RNA, 20 nt, Artificial Sequence
  MKO10056526_A_Ttll6
  gRNA
cauugucacccgccucucga

SEQ ID NO: 56527 - RNA, 20 nt, Artificial Sequence
  MKO10056527_A_Ttll6
  gRNA
cgcagggccgcccagcaaua

SEQ ID NO: 56528 - RNA, 20 nt, Artificial Sequence
  MKO10056528_A_Ttll7
  gRNA
ugacccauugcaccauuagc

SEQ ID NO: 56529 - RNA, 20 nt, Artificial Sequence
  MKO10056529_A_Ttll7
  gRNA
ucguuuaguaauagaugaga

SEQ ID NO: 56530 - RNA, 20 nt, Artificial Sequence
  MKO10056530_A_Ttll7
  gRNA
auaccuuuguuccgagaacg

SEQ ID NO: 56531 - RNA, 20 nt, Artificial Sequence
  MKO10056531_A_Ttll8
  gRNA
gaccagaugcuaaaucacua

SEQ ID NO: 56532 - RNA, 20 nt, Artificial Sequence
  MKO10056532_A_Ttll8
  gRNA
cgcggccuaccaucacaucg

SEQ ID NO: 56533 - RNA, 20 nt, Artificial Sequence
  MKO10056533_A_Ttll8
  gRNA
ccgggccaccuugcgaagaa

SEQ ID NO: 56534 - RNA, 20 nt, Artificial Sequence
  MKO10056534_A_Ttll9
  gRNA
ccaacucaugucgcgacaga

SEQ ID NO: 56535 - RNA, 20 nt, Artificial Sequence
  MKO10056535_A_Ttll9
  gRNA
acgugcgcauaagccacuuc

SEQ ID NO: 56536 - RNA, 20 nt, Artificial Sequence
  MKO10056536_A_Ttll9
  gRNA
uucugcgccacaggcccgga

SEQ ID NO: 56537 - RNA, 20 nt, Artificial Sequence
  MKO10056537_A_Ttl
  gRNA
uuccuuguaggucacgagcc

SEQ ID NO: 56538 - RNA, 20 nt, Artificial Sequence
  MKO10056538_A_Ttl
  gRNA
ccucaagacgccagucgcuc

SEQ ID NO: 56539 - RNA, 20 nt, Artificial Sequence
  MKO10056539_A_Ttl
  gRNA
cgacucggggaaccaugagc

SEQ ID NO: 56540 - RNA, 20 nt, Artificial Sequence
  MKO10056540_A_Ttn
  gRNA
cggggaucaucaaucuagcg

SEQ ID NO: 56541 - RNA, 20 nt, Artificial Sequence
  MKO10056541_A_Ttn
  gRNA
cucaacuguugcgauugauc

SEQ ID NO: 56542 - RNA, 20 nt, Artificial Sequence
  MKO10056542_A_Ttn
  gRNA
gcuaaaggagaucugcacgc

SEQ ID NO: 56543 - RNA, 20 nt, Artificial Sequence
  MKO10056543_A_Ttpal
  gRNA
ggauaacaaucccguucacc

SEQ ID NO: 56544 - RNA, 20 nt, Artificial Sequence
  MKO10056544_A_Ttpal
  gRNA
caucguccagcgacgugcuc

SEQ ID NO: 56545 - RNA, 20 nt, Artificial Sequence
  MKO10056545_A_Ttpal
  gRNA
cucggauguucucgguaauu

SEQ ID NO: 56546 - RNA, 20 nt, Artificial Sequence
  MKO10056546_A_Ttpa
  gRNA
cguagaucugcacuuaauuc

SEQ ID NO: 56547 - RNA, 20 nt, Artificial Sequence
  MKO10056547_A_Ttpa
  gRNA
ucuuuaccgccauauucccg

SEQ ID NO: 56548 - RNA, 20 nt, Artificial Sequence
  MKO10056548_A_Ttpa
  gRNA
uggcgguaaagaguucucca

SEQ ID NO: 56549 - RNA, 20 nt, Artificial Sequence
  MKO10056549_A_Ttr
  gRNA
cacuuacauccgcgaauuca

SEQ ID NO: 56550 - RNA, 20 nt, Artificial Sequence
  MKO10056550_A_Ttr
  gRNA
aacuggacaccaaaucguac

SEQ ID NO: 56551 - RNA, 20 nt, Artificial Sequence
  MKO10056551_A_Ttr
  gRNA
guggcgauggccagagucgu

SEQ ID NO: 56552 - RNA, 20 nt, Artificial Sequence
  MKO10056552_A_Ttyh1
  gRNA
gcucagcaccaucgaugacg

SEQ ID NO: 56553 - RNA, 20 nt, Artificial Sequence
  MKO10056553_A_Ttyh1
  gRNA
ccgcgaccaagaguaccagc

SEQ ID NO: 56554 - RNA, 20 nt, Artificial Sequence
  MKO10056554_A_Ttyh1
  gRNA
ucgcggggagcaaagccgcu

SEQ ID NO: 56555 - RNA, 20 nt, Artificial Sequence
  MKO10056555_A_Ttyh2
  gRNA
aucaugcugcgugaccugga

SEQ ID NO: 56556 - RNA, 20 nt, Artificial Sequence
  MKO10056556_A_Ttyh2
  gRNA
uuugcccguagugcugcggu

SEQ ID NO: 56557 - RNA, 20 nt, Artificial Sequence
  MKO10056557_A_Ttyh2
  gRNA
cagcaaugaucucgcugagc

SEQ ID NO: 56558 - RNA, 20 nt, Artificial Sequence
  MKO10056558_A_Ttyh3
  gRNA
uagcaccuccagcgauacuc

SEQ ID NO: 56559 - RNA, 20 nt, Artificial Sequence
  MKO10056559_A_Ttyh3
  gRNA
cgcaccuguaccagucauag

SEQ ID NO: 56560 - RNA, 20 nt, Artificial Sequence
  MKO10056560_A_Ttyh3
  gRNA
acgccaugccaaccgcacag

SEQ ID NO: 56561 - RNA, 20 nt, Artificial Sequence
  MKO10056561_A_Tuba1a
  gRNA
gcugccaauaacuaugcucg

SEQ ID NO: 56562 - RNA, 20 nt, Artificial Sequence
  MKO10056562_A_Tuba1a
  gRNA
caaccuacacuaaccuaaac

SEQ ID NO: 56563 - RNA, 20 nt, Artificial Sequence
  MKO10056563_A_Tuba1a
  gRNA
gagugcaucuccauccaugu

SEQ ID NO: 56564 - RNA, 20 nt, Artificial Sequence
  MKO10056564_A_Tuba1b
  gRNA
ccacaucaccacgguauagc

SEQ ID NO: 56565 - RNA, 20 nt, Artificial Sequence
  MKO10056565_A_Tuba1b
  gRNA
ccugcuauaccguggugaug

SEQ ID NO: 56566 - RNA, 20 nt, Artificial Sequence
  MKO10056566_A_Tuba1b
  gRNA
gagugcaucuccauccacgu

SEQ ID NO: 56567 - RNA, 20 nt, Artificial Sequence
  MKO10056567_A_Tuba1c
  gRNA
cugcuacuguaagcugcuca

SEQ ID NO: 56568 - RNA, 20 nt, Artificial Sequence
  MKO10056568_A_Tuba1c
  gRNA
agccagcuuaccgaugaccg

SEQ ID NO: 56569 - RNA, 20 nt, Artificial Sequence
  MKO10056569_A_Tuba1c
  gRNA
gagugcaucuccauccacgu

SEQ ID NO: 56570 - RNA, 20 nt, Artificial Sequence
  MKO10056570_A_Tuba3a
  gRNA
gucgacaaucucuuugccga

SEQ ID NO: 56571 - RNA, 20 nt, Artificial Sequence
  MKO10056571_A_Tuba3a
  gRNA
cggcaaagagauugucgacc

SEQ ID NO: 56572 - RNA, 20 nt, Artificial Sequence
  MKO10056572_A_Tuba3a
  gRNA
cguccauuacagccucccug

SEQ ID NO: 56573 - RNA, 20 nt, Artificial Sequence
  MKO10056573_A_Tuba3b
  gRNA
ccuggaccggauccgaaaac

SEQ ID NO: 56574 - RNA, 20 nt, Artificial Sequence
  MKO10056574_A_Tuba3b
  gRNA
ucucuagaugaaguacgcac

SEQ ID NO: 56575 - RNA, 20 nt, Artificial Sequence
  MKO10056575_A_Tuba3b
  gRNA
caagcaccuaccgaccacag

SEQ ID NO: 56576 - RNA, 20 nt, Artificial Sequence
  MKO10056576_A_Tuba4a
  gRNA
gucucaccagcuugcggauc

SEQ ID NO: 56577 - RNA, 20 nt, Artificial Sequence
  MKO10056577_A_Tuba4a
  gRNA
ccacuacagccguggacacu

SEQ ID NO: 56578 - RNA, 20 nt, Artificial Sequence
  MKO10056578_A_Tuba4a
  gRNA
gcucaauaucuagguuacgg

SEQ ID NO: 56579 - RNA, 20 nt, Artificial Sequence
  MKO10056579_A_Tuba8
  gRNA
aauggcgacauucacguccu

SEQ ID NO: 56580 - RNA, 20 nt, Artificial Sequence
  MKO10056580_A_Tuba8
  gRNA
gcagcuaacaauuacgcccg

SEQ ID NO: 56581 - RNA, 20 nt, Artificial Sequence
  MKO10056581_A_Tuba8
  gRNA
gcuggaccgaauccguaaac

SEQ ID NO: 56582 - RNA, 20 nt, Artificial Sequence
  MKO10056582_A_Tubal3
  gRNA
agaguagcgaccucgugcgu

SEQ ID NO: 56583 - RNA, 20 nt, Artificial Sequence
  MKO10056583_A_Tubal3
  gRNA
gcugccaacaccuacgcacg

SEQ ID NO: 56584 - RNA, 20 nt, Artificial Sequence
  MKO10056584_A_Tubal3
  gRNA
cagccuguugauacuagcau

SEQ ID NO: 56585 - RNA, 20 nt, Artificial Sequence
  MKO10056585_A_Tubb1
  gRNA
ugugccgcgagccguccuug

SEQ ID NO: 56586 - RNA, 20 nt, Artificial Sequence
  MKO10056586_A_Tubb1
  gRNA
gccuuaccuuggcuccgauc

SEQ ID NO: 56587 - RNA, 20 nt, Artificial Sequence
  MKO10056587_A_Tubb1
  gRNA
gauggauagcacggcauugu

SEQ ID NO: 56588 - RNA, 20 nt, Artificial Sequence
  MKO10056588_A_Tubb2a
  gRNA
agcccaccuuagcgccgauc

SEQ ID NO: 56589 - RNA, 20 nt, Artificial Sequence
  MKO10056589_A_Tubb2a
  gRNA
gaugugcacgaucucgcgca

SEQ ID NO: 56590 - RNA, 20 nt, Artificial Sequence
  MKO10056590_A_Tubb2a
  gRNA
aaccuauuccauugacaaug

SEQ ID NO: 56591 - RNA, 20 nt, Artificial Sequence
  MKO10056591_A_Tubb2b
  gRNA
aaccuacugcaucgauaaug

SEQ ID NO: 56592 - RNA, 20 nt, Artificial Sequence
  MKO10056592_A_Tubb2b
  gRNA
aacccaccuuggcaccgauc

SEQ ID NO: 56593 - RNA, 20 nt, Artificial Sequence
  MKO10056593_A_Tubb2b
  gRNA
agcaguucacugcuauguuc

SEQ ID NO: 56594 - RNA, 20 nt, Artificial Sequence
  MKO10056594_A_Tubb3
  gRNA
guccccuacauaguugccgc

SEQ ID NO: 56595 - RNA, 20 nt, Artificial Sequence
  MKO10056595_A_Tubb3
  gRNA
caucagcguauacuacaaug

SEQ ID NO: 56596 - RNA, 20 nt, Artificial Sequence
  MKO10056596_A_Tubb3
  gRNA
gccucaccuuggccccuauc

SEQ ID NO: 56597 - RNA, 20 nt, Artificial Sequence
  MKO10056597_A_Tubb4a
  gRNA
ggaguuaguggaugccgucc

SEQ ID NO: 56598 - RNA, 20 nt, Artificial Sequence
  MKO10056598_A_Tubb4a
  gRNA
ucuguccgcuccggcccuuu

SEQ ID NO: 56599 - RNA, 20 nt, Artificial Sequence
  MKO10056599_A_Tubb4a
  gRNA
ucaaugcgguaaccagaucg

SEQ ID NO: 56600 - RNA, 20 nt, Artificial Sequence
  MKO10056600_A_Tubb4b
  gRNA
cuccuaccuuggcgccaauc

SEQ ID NO: 56601 - RNA, 20 nt, Artificial Sequence
  MKO10056601_A_Tubb4b
  gRNA
uucucuuacaggucagagug

SEQ ID NO: 56602 - RNA, 20 nt, Artificial Sequence
  MKO10056602_A_Tubb4b
  gRNA
cacagccauguuccgacgca

SEQ ID NO: 56603 - RNA, 20 nt, Artificial Sequence
  MKO10056603_A_Tubb5
  gRNA
acaguugccgccgucuuccg

SEQ ID NO: 56604 - RNA, 20 nt, Artificial Sequence
  MKO10056604_A_Tubb5
  gRNA
uccuuaccuuagcaccgauc

SEQ ID NO: 56605 - RNA, 20 nt, Artificial Sequence
  MKO10056605_A_Tubb5
  gRNA
caacugugagguaccggccg

SEQ ID NO: 56606 - RNA, 20 nt, Artificial Sequence
  MKO10056606_A_Tubb6
  gRNA
ugagucgcccacguagccuc

SEQ ID NO: 56607 - RNA, 20 nt, Artificial Sequence
  MKO10056607_A_Tubb6
  gRNA
cagcuaagaaguacguaccc

SEQ ID NO: 56608 - RNA, 20 nt, Artificial Sequence
  MKO10056608_A_Tubb6
  gRNA
cgaccaggccggaggcuacg

SEQ ID NO: 56609 - RNA, 20 nt, Artificial Sequence
  MKO10056609_A_Tubd1
  gRNA
cgucauucucgugaaugaga

SEQ ID NO: 56610 - RNA, 20 nt, Artificial Sequence
  MKO10056610_A_Tubd1
  gRNA
cauaccucacccguuccaua

SEQ ID NO: 56611 - RNA, 20 nt, Artificial Sequence
  MKO10056611_A_Tubd1
  gRNA
cacuaccgcagaaauccacu

SEQ ID NO: 56612 - RNA, 20 nt, Artificial Sequence
  MKO10056612_A_Tube1
  gRNA
cccagaagcagcagccgauc

SEQ ID NO: 56613 - RNA, 20 nt, Artificial Sequence
  MKO10056613_A_Tube1
  gRNA
cagcucaucacugauaucuc

SEQ ID NO: 56614 - RNA, 20 nt, Artificial Sequence
  MKO10056614_A_Tube1
  gRNA
cuggcugcagucggacagug

SEQ ID NO: 56615 - RNA, 20 nt, Artificial Sequence
  MKO10056615_A_Tubg1
  gRNA
caucguagaagaguucgcca

SEQ ID NO: 56616 - RNA, 20 nt, Artificial Sequence
  MKO10056616_A_Tubg1
  gRNA
aaugaccugggagaauccgc

SEQ ID NO: 56617 - RNA, 20 nt, Artificial Sequence
  MKO10056617_A_Tubg1
  gRNA
accugucauuuagccguucc

SEQ ID NO: 56618 - RNA, 20 nt, Artificial Sequence
  MKO10056618_A_Tubg2
  gRNA
ucuuagagcgacugaacgac

SEQ ID NO: 56619 - RNA, 20 nt, Artificial Sequence
  MKO10056619_A_Tubg2
  gRNA
ugucguucagucgcucuaag

SEQ ID NO: 56620 - RNA, 20 nt, Artificial Sequence
  MKO10056620_A_Tubg2
  gRNA
ccccaguuggguucgaguuc

SEQ ID NO: 56621 - RNA, 20 nt, Artificial Sequence
  MKO10056621_A_Tubgcp2
  gRNA
gguccagguuggggucgaca

SEQ ID NO: 56622 - RNA, 20 nt, Artificial Sequence
  MKO10056622_A_Tubgcp2
  gRNA
agcucaagcccgagccaauc

SEQ ID NO: 56623 - RNA, 20 nt, Artificial Sequence
  MKO10056623_A_Tubgcp2
  gRNA
ggauucuguuuacuagcucc

SEQ ID NO: 56624 - RNA, 20 nt, Artificial Sequence
  MKO10056624_A_Tubgcp3
  gRNA
ggcgucgagugagcgucucu

SEQ ID NO: 56625 - RNA, 20 nt, Artificial Sequence
  MKO10056625_A_Tubgcp3
  gRNA
cgacgccuuacuacuaugcc

SEQ ID NO: 56626 - RNA, 20 nt, Artificial Sequence
  MKO10056626_A_Tubgcp3
  gRNA
aacuuccaguuauucgacaa

SEQ ID NO: 56627 - RNA, 20 nt, Artificial Sequence
  MKO10056627_A_Tubgcp4
  gRNA
guguccugaaucgacucugc

SEQ ID NO: 56628 - RNA, 20 nt, Artificial Sequence
  MKO10056628_A_Tubgcp4
  gRNA
ucgccaagcacugcuugauu

SEQ ID NO: 56629 - RNA, 20 nt, Artificial Sequence
  MKO10056629_A_Tubgcp4
  gRNA
ggaguaauugacaugugaua

SEQ ID NO: 56630 - RNA, 20 nt, Artificial Sequence
  MKO10056630_A_Tubgcp5
  gRNA
ugguccaaauauugauacgc

SEQ ID NO: 56631 - RNA, 20 nt, Artificial Sequence
  MKO10056631_A_Tubgcp5
  gRNA
cuuaccggcguaucaauauu

SEQ ID NO: 56632 - RNA, 20 nt, Artificial Sequence
  MKO10056632_A_Tubgcp5
  gRNA
uaccagauuucaucguuucu

SEQ ID NO: 56633 - RNA, 20 nt, Artificial Sequence
  MKO10056633_A_Tubgcp6
  gRNA
gccgacucaagccuuuguag

SEQ ID NO: 56634 - RNA, 20 nt, Artificial Sequence
  MKO10056634_A_Tubgcp6
  gRNA
accaagcaugacccccgauu

SEQ ID NO: 56635 - RNA, 20 nt, Artificial Sequence
  MKO10056635_A_Tubgcp6
  gRNA
uagggcuccucucggugacc

SEQ ID NO: 56636 - RNA, 20 nt, Artificial Sequence
  MKO10056636_A_Tub
  gRNA
ucggcgagcccggcagucag

SEQ ID NO: 56637 - RNA, 20 nt, Artificial Sequence
  MKO10056637_A_Tub
  gRNA
cucgauugccaguguacagc

SEQ ID NO: 56638 - RNA, 20 nt, Artificial Sequence
  MKO10056638_A_Tub
  gRNA
accuccgugccacgaugcag

SEQ ID NO: 56639 - RNA, 20 nt, Artificial Sequence
  MKO10056639_A_Tufm
  gRNA
uccuccgguaguucuagccg

SEQ ID NO: 56640 - RNA, 20 nt, Artificial Sequence
  MKO10056640_A_Tufm
  gRNA
gcacuuacugcuagcuaaac

SEQ ID NO: 56641 - RNA, 20 nt, Artificial Sequence
  MKO10056641_A_Tufm
  gRNA
cgcccccucaccgcugaagc

SEQ ID NO: 56642 - RNA, 20 nt, Artificial Sequence
  MKO10056642_A_Tuft1
  gRNA
uuacugcagguuuacuugaa

SEQ ID NO: 56643 - RNA, 20 nt, Artificial Sequence
  MKO10056643_A_Tuft1
  gRNA
gcuugcuacuuauauccucc

SEQ ID NO: 56644 - RNA, 20 nt, Artificial Sequence
  MKO10056644_A_Tuft1
  gRNA
guggccaggcaucauggcau

SEQ ID NO: 56645 - RNA, 20 nt, Artificial Sequence
  MKO10056645_A_Tulp1
  gRNA
uagacugucugcgcagcgcg

SEQ ID NO: 56646 - RNA, 20 nt, Artificial Sequence
  MKO10056646_A_Tulp1
  gRNA
uauuccgcagcgacccgccc

SEQ ID NO: 56647 - RNA, 20 nt, Artificial Sequence
  MKO10056647_A_Tulp1
  gRNA
aauccaaaccccguaaagcu

SEQ ID NO: 56648 - RNA, 20 nt, Artificial Sequence
  MKO10056648_A_Tulp2
  gRNA
ucuguuggacauggaccgug

SEQ ID NO: 56649 - RNA, 20 nt, Artificial Sequence
  MKO10056649_A_Tulp2
  gRNA
aagcgcuccuccccgcgccu

SEQ ID NO: 56650 - RNA, 20 nt, Artificial Sequence
  MKO10056650_A_Tulp2
  gRNA
ccggcgaccaaggcgcgggg

SEQ ID NO: 56651 - RNA, 20 nt, Artificial Sequence
  MKO10056651_A_Tulp3
  gRNA
uguaggaugacgucgcugcg

SEQ ID NO: 56652 - RNA, 20 nt, Artificial Sequence
  MKO10056652_A_Tulp3
  gRNA
gaguagugugaacuaugacg

SEQ ID NO: 56653 - RNA, 20 nt, Artificial Sequence
  MKO10056653_A_Tulp3
  gRNA
cgcagcgacgucauccuaca

SEQ ID NO: 56654 - RNA, 20 nt, Artificial Sequence
  MKO10056654_A_Tulp4
  gRNA
agucucccugcguacaccac

SEQ ID NO: 56655 - RNA, 20 nt, Artificial Sequence
  MKO10056655_A_Tulp4
  gRNA
gcccuaucaucucuaucugu

SEQ ID NO: 56656 - RNA, 20 nt, Artificial Sequence
  MKO10056656_A_Tulp4
  gRNA
gugaucgucauggacugcca

SEQ ID NO: 56657 - RNA, 20 nt, Artificial Sequence
  MKO10056657_A_Tusc1
  gRNA
ccucggaacguccggaucau

SEQ ID NO: 56658 - RNA, 20 nt, Artificial Sequence
  MKO10056658_A_Tusc1
  gRNA
gguucucgcgccugagccga

SEQ ID NO: 56659 - RNA, 20 nt, Artificial Sequence
  MKO10056659_A_Tusc1
  gRNA
cgcgcagccgcgcguucugc

SEQ ID NO: 56660 - RNA, 20 nt, Artificial Sequence
  MKO10056660_A_Tusc2
  gRNA
cccgcggcgcgugaauacga

SEQ ID NO: 56661 - RNA, 20 nt, Artificial Sequence
  MKO10056661_A_Tusc2
  gRNA
auggcagggcaucgugaagc

SEQ ID NO: 56662 - RNA, 20 nt, Artificial Sequence
  MKO10056662_A_Tusc2
  gRNA
cccuucguauucacgcgccg

SEQ ID NO: 56663 - RNA, 20 nt, Artificial Sequence
  MKO10056663_A_Tusc3
  gRNA
cgcucgaucuucagaaugaa

SEQ ID NO: 56664 - RNA, 20 nt, Artificial Sequence
  MKO10056664_A_Tusc3
  gRNA
cugcaaauccaauucguuga

SEQ ID NO: 56665 - RNA, 20 nt, Artificial Sequence
  MKO10056665_A_Tusc3
  gRNA
uacaugaacauccguccugu

SEQ ID NO: 56666 - RNA, 20 nt, Artificial Sequence
  MKO10056666_A_Tusc5
  gRNA
gucucgaaguagugugcagc

SEQ ID NO: 56667 - RNA, 20 nt, Artificial Sequence
  MKO10056667_A_Tusc5
  gRNA
augcucgccgagagcugacc

SEQ ID NO: 56668 - RNA, 20 nt, Artificial Sequence
  MKO10056668_A_Tusc5
  gRNA
ugaugcugaguagccgugcc

SEQ ID NO: 56669 - RNA, 20 nt, Artificial Sequence
  MKO10056669_A_Tuu1
  gRNA
auggacuucgaguccggcca

SEQ ID NO: 56670 - RNA, 20 nt, Artificial Sequence
  MKO10056670_A_Tuu1
  gRNA
uggugcaacuccgagcuacc

SEQ ID NO: 56671 - RNA, 20 nt, Artificial Sequence
  MKO10056671_A_Tuu1
  gRNA
ccaggggguguuugccaucg

SEQ ID NO: 56672 - RNA, 20 nt, Artificial Sequence
  MKO10056672_A_Tvp23a
  gRNA
agccguagagguucgcagcu

SEQ ID NO: 56673 - RNA, 20 nt, Artificial Sequence
  MKO10056673_A_Tvp23a
  gRNA
augguggaaccagauagacg

SEQ ID NO: 56674 - RNA, 20 nt, Artificial Sequence
  MKO10056674_A_Tvp23a
  gRNA
cgucgccucccaucuuacag

SEQ ID NO: 56675 - RNA, 20 nt, Artificial Sequence
  MKO10056675_A_Tvp23b
  gRNA
ucaucgccugccccguccug

SEQ ID NO: 56676 - RNA, 20 nt, Artificial Sequence
  MKO10056676_A_Tvp23b
  gRNA
uagcagcuuuaucgccugca

SEQ ID NO: 56677 - RNA, 20 nt, Artificial Sequence
  MKO10056677_A_Tvp23b
  gRNA
caauaugauuccaccaacgc

SEQ ID NO: 56678 - RNA, 20 nt, Artificial Sequence
  MKO10056678_A_Twf1
  gRNA
ugccccgcugaccgccgcug

SEQ ID NO: 56679 - RNA, 20 nt, Artificial Sequence
  MKO10056679_A_Twf1
  gRNA
uccuuucauagagcaacugg

SEQ ID NO: 56680 - RNA, 20 nt, Artificial Sequence
  MKO10056680_A_Twf1
  gRNA
acggcagauuaaaaucaacg

SEQ ID NO: 56681 - RNA, 20 nt, Artificial Sequence
  MKO10056681_A_Twf2
  gRNA
agacucaccggcgaauuguc

SEQ ID NO: 56682 - RNA, 20 nt, Artificial Sequence
  MKO10056682_A_Twf2
  gRNA
uucuuugccaaggcccgggc

SEQ ID NO: 56683 - RNA, 20 nt, Artificial Sequence
  MKO10056683_A_Twf2
  gRNA
caggugcggcacacgaugac

SEQ ID NO: 56684 - RNA, 20 nt, Artificial Sequence
  MKO10056684_A_Twist1
  gRNA
cgggagcccgcagucguacg

SEQ ID NO: 56685 - RNA, 20 nt, Artificial Sequence
  MKO10056685_A_Twist1
  gRNA
gcguggggaugaucuugcgc

SEQ ID NO: 56686 - RNA, 20 nt, Artificial Sequence
  MKO10056686_A_Twist1
  gRNA
aguccagcucgucgcucugc

SEQ ID NO: 56687 - RNA, 20 nt, Artificial Sequence
  MKO10056687_A_Twist2
  gRNA
uccucgaaagacugcgcgcu

SEQ ID NO: 56688 - RNA, 20 nt, Artificial Sequence
  MKO10056688_A_Twist2
  gRNA
uauuguccaucucgucgcuc

SEQ ID NO: 56689 - RNA, 20 nt, Artificial Sequence
  MKO10056689_A_Twist2
  gRNA
cccgagcgcgcagucuuucg

SEQ ID NO: 56690 - RNA, 20 nt, Artificial Sequence
  MKO10056690_A_Twistnb
  gRNA
cuuaccucucggaguagcgc

SEQ ID NO: 56691 - RNA, 20 nt, Artificial Sequence
  MKO10056691_A_Twistnb
  gRNA
gcgcacgccgccgcguagcu

SEQ ID NO: 56692 - RNA, 20 nt, Artificial Sequence
  MKO10056692_A_Twistnb
  gRNA
cauaccauuaacgucugccc

SEQ ID NO: 56693 - RNA, 20 nt, Artificial Sequence
  MKO10056693_A_Twsg1
  gRNA
agucgcagcacucgucccac

SEQ ID NO: 56694 - RNA, 20 nt, Artificial Sequence
  MKO10056694_A_Twsg1
  gRNA
uaagauauccugcgaaucca

SEQ ID NO: 56695 - RNA, 20 nt, Artificial Sequence
  MKO10056695_A_Twsg1
  gRNA
agaacggguaccuuugucgc

SEQ ID NO: 56696 - RNA, 20 nt, Artificial Sequence
  MKO10056696_A_Txk
  gRNA
ccgugguucgccaaacugau

SEQ ID NO: 56697 - RNA, 20 nt, Artificial Sequence
  MKO10056697_A_Txk
  gRNA
aucuuacccgaagcggucuc

SEQ ID NO: 56698 - RNA, 20 nt, Artificial Sequence
  MKO10056698_A_Txk
  gRNA
gggcagcggcuugcgcuucg

SEQ ID NO: 56699 - RNA, 20 nt, Artificial Sequence
  MKO10056699_A_Txlna
  gRNA
uccuucucgccguugacgac

SEQ ID NO: 56700 - RNA, 20 nt, Artificial Sequence
  MKO10056700_A_Txlna
  gRNA
acggcacaaccggucccuga

SEQ ID NO: 56701 - RNA, 20 nt, Artificial Sequence
  MKO10056701_A_Txlna
  gRNA
gcgaaacuccaagcugcgcc

SEQ ID NO: 56702 - RNA, 20 nt, Artificial Sequence
  MKO10056702_A_Txlnb
  gRNA
cuucuuccucgcgcgcccgu

SEQ ID NO: 56703 - RNA, 20 nt, Artificial Sequence
  MKO10056703_A_Txlnb
  gRNA
ucucgaguuugcuucgagca

SEQ ID NO: 56704 - RNA, 20 nt, Artificial Sequence
  MKO10056704_A_Txlnb
  gRNA
gcgcaauaugaagcucugcc

SEQ ID NO: 56705 - RNA, 20 nt, Artificial Sequence
  MKO10056705_A_Txlng
  gRNA
caacaucaagaccccaguug

SEQ ID NO: 56706 - RNA, 20 nt, Artificial Sequence
  MKO10056706_A_Txlng
  gRNA
gagcucaguauucuguacac

SEQ ID NO: 56707 - RNA, 20 nt, Artificial Sequence
  MKO10056707_A_Txlng
  gRNA
cauguuguuccaacugagcu

SEQ ID NO: 56708 - RNA, 20 nt, Artificial Sequence
  MKO10056708_A_Txn1
  gRNA
cgcgggagacaagcuugucg

SEQ ID NO: 56709 - RNA, 20 nt, Artificial Sequence
  MKO10056709_A_Txn1
  gRNA
cacgacaagcuugucucccg

SEQ ID NO: 56710 - RNA, 20 nt, Artificial Sequence
  MKO10056710_A_Txn1
  gRNA
uuaggcauauucaguaauag

SEQ ID NO: 56711 - RNA, 20 nt, Artificial Sequence
  MKO10056711_A_Txn2
  gRNA
uuugacgaccuuuaacgucc

SEQ ID NO: 56712 - RNA, 20 nt, Artificial Sequence
  MKO10056712_A_Txn2
  gRNA
ucuucucuagccgcgguccu

SEQ ID NO: 56713 - RNA, 20 nt, Artificial Sequence
  MKO10056713_A_Txn2
  gRNA
gugaucgucaauguccacuu

SEQ ID NO: 56714 - RNA, 20 nt, Artificial Sequence
  MKO10056714_A_Txndc11
  gRNA
gucaaggaccggagaucucg

SEQ ID NO: 56715 - RNA, 20 nt, Artificial Sequence
  MKO10056715_A_Txndc11
  gRNA
guggccaguccaucgcugcc

SEQ ID NO: 56716 - RNA, 20 nt, Artificial Sequence
  MKO10056716_A_Txndc11
  gRNA
acauugagaaguuuguccgc

SEQ ID NO: 56717 - RNA, 20 nt, Artificial Sequence
  MKO10056717_A_Txndc12
  gRNA
uucaaguggcuugccgcuga

SEQ ID NO: 56718 - RNA, 20 nt, Artificial Sequence
  MKO10056718_A_Txndc12
  gRNA
aucauccauaaaucuuggug

SEQ ID NO: 56719 - RNA, 20 nt, Artificial Sequence
  MKO10056719_A_Txndc12
  gRNA
uuacccaagaaaaggaugcg

SEQ ID NO: 56720 - RNA, 20 nt, Artificial Sequence
  MKO10056720_A_Txndc15
  gRNA
aagagcggcggaacccaugg

SEQ ID NO: 56721 - RNA, 20 nt, Artificial Sequence
  MKO10056721_A_Txndc15
  gRNA
aucuccgcgcggacccagag

SEQ ID NO: 56722 - RNA, 20 nt, Artificial Sequence
  MKO10056722_A_Txndc15
  gRNA
uaaccauacagaucgcaccc

SEQ ID NO: 56723 - RNA, 20 nt, Artificial Sequence
  MKO10056723_A_Txndc16
  gRNA
caccauaccugguguuccga

SEQ ID NO: 56724 - RNA, 20 nt, Artificial Sequence
  MKO10056724_A_Txndc16
  gRNA
ugaugaaagcguauuuauuc

SEQ ID NO: 56725 - RNA, 20 nt, Artificial Sequence
  MKO10056725_A_Txndc16
  gRNA
guguugaagaagaagcguca

SEQ ID NO: 56726 - RNA, 20 nt, Artificial Sequence
  MKO10056726_A_Txndc17
  gRNA
uucagccccucucgaaugac

SEQ ID NO: 56727 - RNA, 20 nt, Artificial Sequence
  MKO10056727_A_Txndc17
  gRNA
agcugagccagucauucgag

SEQ ID NO: 56728 - RNA, 20 nt, Artificial Sequence
  MKO10056728_A_Txndc17
  gRNA
cagcacgcucaccuccucga

SEQ ID NO: 56729 - RNA, 20 nt, Artificial Sequence
  MKO10056729_A_Txndc2
  gRNA
ucggacaugacacucaacaa

SEQ ID NO: 56730 - RNA, 20 nt, Artificial Sequence
  MKO10056730_A_Txndc2
  gRNA
gauggugucuucuucggacg

SEQ ID NO: 56731 - RNA, 20 nt, Artificial Sequence
  MKO10056731_A_Txndc2
  gRNA
gacagcgucccauccaagaa

SEQ ID NO: 56732 - RNA, 20 nt, Artificial Sequence
  MKO10056732_A_Txndc5
  gRNA
uuaucaaguucuucgcuccg

SEQ ID NO: 56733 - RNA, 20 nt, Artificial Sequence
  MKO10056733_A_Txndc5
  gRNA
cuuccauuagacaccggagc

SEQ ID NO: 56734 - RNA, 20 nt, Artificial Sequence
  MKO10056734_A_Txndc5
  gRNA
ugggguauccucgcacuccc

SEQ ID NO: 56735 - RNA, 20 nt, Artificial Sequence
  MKO10056735_A_Txndc8
  gRNA
ccaaaaugucacguuugcuc

SEQ ID NO: 56736 - RNA, 20 nt, Artificial Sequence
  MKO10056736_A_Txndc8
  gRNA
aaagaauuguucagcgaugc

SEQ ID NO: 56737 - RNA, 20 nt, Artificial Sequence
  MKO10056737_A_Txndc8
  gRNA
uuuggguguacuugaacauc

SEQ ID NO: 56738 - RNA, 20 nt, Artificial Sequence
  MKO10056738_A_Txndc9
  gRNA
gugauucuccaccagcuuag

SEQ ID NO: 56739 - RNA, 20 nt, Artificial Sequence
  MKO10056739_A_Txndc9
  gRNA
guucugauguuaucaauuac

SEQ ID NO: 56740 - RNA, 20 nt, Artificial Sequence
  MKO10056740_A_Txndc9
  gRNA
aauuaggaguggcuuuccaa

SEQ ID NO: 56741 - RNA, 20 nt, Artificial Sequence
  MKO10056741_A_Txnip
  gRNA
aauaugguugcguagacuac

SEQ ID NO: 56742 - RNA, 20 nt, Artificial Sequence
  MKO10056742_A_Txnip
  gRNA
uuacccgagucaaagccguc

SEQ ID NO: 56743 - RNA, 20 nt, Artificial Sequence
  MKO10056743_A_Txnip
  gRNA
ccuggcuugcggcguggcca

SEQ ID NO: 56744 - RNA, 20 nt, Artificial Sequence
  MKO10056744_A_Txnl1
  gRNA
uuacucauagagcugaacgc

SEQ ID NO: 56745 - RNA, 20 nt, Artificial Sequence
  MKO10056745_A_Txnl1
  gRNA
gugagaaucgaucaguauca

SEQ ID NO: 56746 - RNA, 20 nt, Artificial Sequence
  MKO10056746_A_Txnl1
  gRNA
acagguguggaccgugucuu

SEQ ID NO: 56747 - RNA, 20 nt, Artificial Sequence
  MKO10056747_A_Txnl4a
  gRNA
cgcguggucgucauucguuu

SEQ ID NO: 56748 - RNA, 20 nt, Artificial Sequence
  MKO10056748_A_Txnl4a
  gRNA
ucuguacagcaucgccgaaa

SEQ ID NO: 56749 - RNA, 20 nt, Artificial Sequence
  MKO10056749_A_Txnl4a
  gRNA
aucauagagaccguguaccg

SEQ ID NO: 56750 - RNA, 20 nt, Artificial Sequence
  MKO10056750_A_Txnl4b
  gRNA
ugcuauuuaccugguggacg

SEQ ID NO: 56751 - RNA, 20 nt, Artificial Sequence
  MKO10056751_A_Txnl4b
  gRNA
gucauauuugggcacguucu

SEQ ID NO: 56752 - RNA, 20 nt, Artificial Sequence
  MKO10056752_A_Txnl4b
  gRNA
gaucaaaagcacugcggaga

SEQ ID NO: 56753 - RNA, 20 nt, Artificial Sequence
  MKO10056753_A_Txnrd1
  gRNA
ggggcuaccgcguagcucuc

SEQ ID NO: 56754 - RNA, 20 nt, Artificial Sequence
  MKO10056754_A_Txnrd1
  gRNA
cugaaagacucgcgcaacua

SEQ ID NO: 56755 - RNA, 20 nt, Artificial Sequence
  MKO10056755_A_Txnrd1
  gRNA
uuugucacaccgacuccucu

SEQ ID NO: 56756 - RNA, 20 nt, Artificial Sequence
  MKO10056756_A_Txnrd2
  gRNA
aucgcguccaacugcaggac

SEQ ID NO: 56757 - RNA, 20 nt, Artificial Sequence
  MKO10056757_A_Txnrd2
  gRNA
ugguggcaccugugucaacg

SEQ ID NO: 56758 - RNA, 20 nt, Artificial Sequence
  MKO10056758_A_Txnrd2
  gRNA
uaugcaacccacguugacac

SEQ ID NO: 56759 - RNA, 20 nt, Artificial Sequence
  MKO10056759_A_Txnrd3
  gRNA
ccgccuacccgcgugcugug

SEQ ID NO: 56760 - RNA, 20 nt, Artificial Sequence
  MKO10056760_A_Txnrd3
  gRNA
aacccccgccgaugaugaug

SEQ ID NO: 56761 - RNA, 20 nt, Artificial Sequence
  MKO10056761_A_Txnrd3
  gRNA
ggccucaugucgucgccacc

SEQ ID NO: 56762 - RNA, 20 nt, Artificial Sequence
  MKO10056762_A_Tyk2
  gRNA
ggaucuccuccucgcuagac

SEQ ID NO: 56763 - RNA, 20 nt, Artificial Sequence
  MKO10056763_A_Tyk2
  gRNA
aaaccacaccgguauacagc

SEQ ID NO: 56764 - RNA, 20 nt, Artificial Sequence
  MKO10056764_A_Tyk2
  gRNA
ucugcgggaccugucuagcg

SEQ ID NO: 56765 - RNA, 20 nt, Artificial Sequence
  MKO10056765_A_Tymp
  gRNA
ucacaucucgugcagcauac

SEQ ID NO: 56766 - RNA, 20 nt, Artificial Sequence
  MKO10056766_A_Tymp
  gRNA
gauaagcuggaaucgauucc

SEQ ID NO: 56767 - RNA, 20 nt, Artificial Sequence
  MKO10056767_A_Tymp
  gRNA
cuuguugacaaacacuccac

SEQ ID NO: 56768 - RNA, 20 nt, Artificial Sequence
  MKO10056768_A_Tyms
  gRNA
ucacaaccaaacgaguguuc

SEQ ID NO: 56769 - RNA, 20 nt, Artificial Sequence
  MKO10056769_A_Tyms
  gRNA
acccuuccagaacacucguu

SEQ ID NO: 56770 - RNA, 20 nt, Artificial Sequence
  MKO10056770_A_Tyms
  gRNA
ucuacagauuacucgggaca

SEQ ID NO: 56771 - RNA, 20 nt, Artificial Sequence
  MKO10056771_A_Tyro3
  gRNA
gguggcaccgccagaucuuu

SEQ ID NO: 56772 - RNA, 20 nt, Artificial Sequence
  MKO10056772_A_Tyro3
  gRNA
ccuaccuugaaggcgaacaa

SEQ ID NO: 56773 - RNA, 20 nt, Artificial Sequence
  MKO10056773_A_Tyro3
  gRNA
ccagccauuguucgccuuca

SEQ ID NO: 56774 - RNA, 20 nt, Artificial Sequence
  MKO10056774_A_Tyrobp
  gRNA
cuuaggauuaagucccguac

SEQ ID NO: 56775 - RNA, 20 nt, Artificial Sequence
  MKO10056775_A_Tyrobp
  gRNA
acggaagaacagucgcaucu

SEQ ID NO: 56776 - RNA, 20 nt, Artificial Sequence
  MKO10056776_A_Tyrobp
  gRNA
uguguacucucugggccgcc

SEQ ID NO: 56777 - RNA, 20 nt, Artificial Sequence
  MKO10056777_A_Tyrp1
  gRNA
ugugcgcuucgccauaucca

SEQ ID NO: 56778 - RNA, 20 nt, Artificial Sequence
  MKO10056778_A_Tyrp1
  gRNA
uguucgaagccuucacaacc

SEQ ID NO: 56779 - RNA, 20 nt, Artificial Sequence
  MKO10056779_A_Tyrp1
  gRNA
ucuuugacgaauggcuaagg

SEQ ID NO: 56780 - RNA, 20 nt, Artificial Sequence
  MKO10056780_A_Tyr
  gRNA
uuuccaggauuacguaauag

SEQ ID NO: 56781 - RNA, 20 nt, Artificial Sequence
  MKO10056781_A_Tyr
  gRNA
ccgauaggugcauuggcuuc

SEQ ID NO: 56782 - RNA, 20 nt, Artificial Sequence
  MKO10056782_A_Tyr
  gRNA
uucauaccgcucuauagaaa

SEQ ID NO: 56783 - RNA, 20 nt, Artificial Sequence
  MKO10056783_A_Tysnd1
  gRNA
gggccgaugcggucgaucaa

SEQ ID NO: 56784 - RNA, 20 nt, Artificial Sequence
  MKO10056784_A_Tysnd1
  gRNA
aguggucguggcgccucgcc

SEQ ID NO: 56785 - RNA, 20 nt, Artificial Sequence
  MKO10056785_A_Tysnd1
  gRNA
ccugucggccguggugcgug

SEQ ID NO: 56786 - RNA, 20 nt, Artificial Sequence
  MKO10056786_A_Tyw1
  gRNA
cguccguguacguagcgacc

SEQ ID NO: 56787 - RNA, 20 nt, Artificial Sequence
  MKO10056787_A_Tyw1
  gRNA
ucagcuaaugauuuccgcuu

SEQ ID NO: 56788 - RNA, 20 nt, Artificial Sequence
  MKO10056788_A_Tyw1
  gRNA
cuucaaggucacucguuccc

SEQ ID NO: 56789 - RNA, 20 nt, Artificial Sequence
  MKO10056789_A_Tyw3
  gRNA
cucgcucauggaccguagcg

SEQ ID NO: 56790 - RNA, 20 nt, Artificial Sequence
  MKO10056790_A_Tyw3
  gRNA
aaaacucuucccgcgaguuc

SEQ ID NO: 56791 - RNA, 20 nt, Artificial Sequence
  MKO10056791_A_Tyw3
  gRNA
accgugugcgagagacgaug

SEQ ID NO: 56792 - RNA, 20 nt, Artificial Sequence
  MKO10056792_A_Tyw5
  gRNA
cccggcugcggggcgucucc

SEQ ID NO: 56793 - RNA, 20 nt, Artificial Sequence
  MKO10056793_A_Tyw5
  gRNA
guggauuaccugagucaagu

SEQ ID NO: 56794 - RNA, 20 nt, Artificial Sequence
  MKO10056794_A_Tyw5
  gRNA
acgccccgcagccgggguac

SEQ ID NO: 56795 - RNA, 20 nt, Artificial Sequence
  MKO10056795_A_T
  gRNA
acucucacgaugugaauccg

SEQ ID NO: 56796 - RNA, 20 nt, Artificial Sequence
  MKO10056796_A_T
  gRNA
uggcuggugaucaugcguug

SEQ ID NO: 56797 - RNA, 20 nt, Artificial Sequence
  MKO10056797_A_T
  gRNA
cacccagacucgcccaauuu

SEQ ID NO: 56798 - RNA, 20 nt, Artificial Sequence
  MKO10056798_A_U2af1l4
  gRNA
uccaggucacgugagcgacg

SEQ ID NO: 56799 - RNA, 20 nt, Artificial Sequence
  MKO10056799_A_U2af1l4
  gRNA
cgugggcaaugucuacguua

SEQ ID NO: 56800 - RNA, 20 nt, Artificial Sequence
  MKO10056800_A_U2af1l4
  gRNA
caacaaaccgacuuucagcc

SEQ ID NO: 56801 - RNA, 20 nt, Artificial Sequence
  MKO10056801_A_U2af1
  gRNA
ugcaggugcugugagcgacg

SEQ ID NO: 56802 - RNA, 20 nt, Artificial Sequence
  MKO10056802_A_U2af1
  gRNA
gguggggaacguguauguca

SEQ ID NO: 56803 - RNA, 20 nt, Artificial Sequence
  MKO10056803_A_U2af1
  gRNA
acacaaaccuggcuaaaggu

SEQ ID NO: 56804 - RNA, 20 nt, Artificial Sequence
  MKO10056804_A_U2af2
  gRNA
ucgucgucuccuaucccgag

SEQ ID NO: 56805 - RNA, 20 nt, Artificial Sequence
  MKO10056805_A_U2af2
  gRNA
aguaccucaguaaugccaaa

SEQ ID NO: 56806 - RNA, 20 nt, Artificial Sequence
  MKO10056806_A_U2af2
  gRNA
ugcuccugcgcuuucgaucu

SEQ ID NO: 56807 - RNA, 20 nt, Artificial Sequence
  MKO10056807_A_U2surp
  gRNA
aagauggccgacaaaacgcc

SEQ ID NO: 56808 - RNA, 20 nt, Artificial Sequence
  MKO10056808_A_U2surp
  gRNA
gggguuguuaaugcagcuaa

SEQ ID NO: 56809 - RNA, 20 nt, Artificial Sequence
  MKO10056809_A_U2surp
  gRNA
aaagugaaaacguuuguucg

SEQ ID NO: 56810 - RNA, 20 nt, Artificial Sequence
  MKO10056810_A_Uaca
  gRNA
uucauucagcuuccacgucg

SEQ ID NO: 56811 - RNA, 20 nt, Artificial Sequence
  MKO10056811_A_Uaca
  gRNA
guacgaugaccgguugauga

SEQ ID NO: 56812 - RNA, 20 nt, Artificial Sequence
  MKO10056812_A_Uaca
  gRNA
ccaucccggcaagcuagaug

SEQ ID NO: 56813 - RNA, 20 nt, Artificial Sequence
  MKO10056813_A_Uap1l1
  gRNA
cucgaacagcacuacguuag

SEQ ID NO: 56814 - RNA, 20 nt, Artificial Sequence
  MKO10056814_A_Uap1l1
  gRNA
guacugcguagacaacaucu

SEQ ID NO: 56815 - RNA, 20 nt, Artificial Sequence
  MKO10056815_A_Uap1l1
  gRNA
ccugggcgucacauacccaa

SEQ ID NO: 56816 - RNA, 20 nt, Artificial Sequence
  MKO10056816_A_Uap1
  gRNA
ugguaaaaguggcugacccg

SEQ ID NO: 56817 - RNA, 20 nt, Artificial Sequence
  MKO10056817_A_Uap1
  gRNA
acccggcaaaccacuccaac

SEQ ID NO: 56818 - RNA, 20 nt, Artificial Sequence
  MKO10056818_A_Uap1
  gRNA
gaaucugaaaaagcgucuug

SEQ ID NO: 56819 - RNA, 20 nt, Artificial Sequence
  MKO10056819_A_Uba1y
  gRNA
uucauaguucugccuacgug

SEQ ID NO: 56820 - RNA, 20 nt, Artificial Sequence
  MKO10056820_A_Uba1y
  gRNA
gugguugggauaucucagcu

SEQ ID NO: 56821 - RNA, 20 nt, Artificial Sequence
  MKO10056821_A_Uba1y
  gRNA
cucacagcuggcgggaguaa

SEQ ID NO: 56822 - RNA, 20 nt, Artificial Sequence
  MKO10056822_A_Uba1
  gRNA
ggggaguucugucauagccg

SEQ ID NO: 56823 - RNA, 20 nt, Artificial Sequence
  MKO10056823_A_Uba1
  gRNA
agaacucccccacucgcagc

SEQ ID NO: 56824 - RNA, 20 nt, Artificial Sequence
  MKO10056824_A_Uba1
  gRNA
caaguaccuggaagcuacua

SEQ ID NO: 56825 - RNA, 20 nt, Artificial Sequence
  MKO10056825_A_Uba2
  gRNA
ucgaugucagcaaccucaac

SEQ ID NO: 56826 - RNA, 20 nt, Artificial Sequence
  MKO10056826_A_Uba2
  gRNA
ccagacacauccuauucacg

SEQ ID NO: 56827 - RNA, 20 nt, Artificial Sequence
  MKO10056827_A_Uba2
  gRNA
gacugcuggguaucucggac

SEQ ID NO: 56828 - RNA, 20 nt, Artificial Sequence
  MKO10056828_A_Uba3
  gRNA
gaacaauauggcggauggcg

SEQ ID NO: 56829 - RNA, 20 nt, Artificial Sequence
  MKO10056829_A_Uba3
  gRNA
auguaaagaaguuccucgag

SEQ ID NO: 56830 - RNA, 20 nt, Artificial Sequence
  MKO10056830_A_Uba3
  gRNA
cugugcagaauggcuguuga

SEQ ID NO: 56831 - RNA, 20 nt, Artificial Sequence
  MKO10056831_A_Uba52
  gRNA
uccgacuacaacauccagaa

SEQ ID NO: 56832 - RNA, 20 nt, Artificial Sequence
  MKO10056832_A_Uba52
  gRNA
acagcccaccuuccuugucu

SEQ ID NO: 56833 - RNA, 20 nt, Artificial Sequence
  MKO10056833_A_Uba52
  gRNA
cccagaguccaccuugcacc

SEQ ID NO: 56834 - RNA, 20 nt, Artificial Sequence
  MKO10056834_A_Uba5
  gRNA
accuacgcuguagcaauagu

SEQ ID NO: 56835 - RNA, 20 nt, Artificial Sequence
  MKO10056835_A_Uba5
  gRNA
accuacuauugcuacagcgu

SEQ ID NO: 56836 - RNA, 20 nt, Artificial Sequence
  MKO10056836_A_Uba5
  gRNA
gaagaaaagccgauucaugu

SEQ ID NO: 56837 - RNA, 20 nt, Artificial Sequence
  MKO10056837_A_Uba6
  gRNA
aaaucgaugauggauuauac

SEQ ID NO: 56838 - RNA, 20 nt, Artificial Sequence
  MKO10056838_A_Uba6
  gRNA
agucgccagagauauguucu

SEQ ID NO: 56839 - RNA, 20 nt, Artificial Sequence
  MKO10056839_A_Uba6
  gRNA
aaguccugugucuucuuaag

SEQ ID NO: 56840 - RNA, 20 nt, Artificial Sequence
  MKO10056840_A_Uba7
  gRNA
cugagccaauugcgccugag

SEQ ID NO: 56841 - RNA, 20 nt, Artificial Sequence
  MKO10056841_A_Uba7
  gRNA
ggugcugacugacuccaagc

SEQ ID NO: 56842 - RNA, 20 nt, Artificial Sequence
  MKO10056842_A_Uba7
  gRNA
gccaagaaccuaguccuuac

SEQ ID NO: 56843 - RNA, 20 nt, Artificial Sequence
  MKO10056843_A_Ubac1
  gRNA
gguacucacgucucucaugg

SEQ ID NO: 56844 - RNA, 20 nt, Artificial Sequence
  MKO10056844_A_Ubac1
  gRNA
gagugacagcaaaacgaucu

SEQ ID NO: 56845 - RNA, 20 nt, Artificial Sequence
  MKO10056845_A_Ubac1
  gRNA
uaauacaugcugcuucagag

SEQ ID NO: 56846 - RNA, 20 nt, Artificial Sequence
  MKO10056846_A_Ubac2
  gRNA
ugcugucaagcacgacuugc

SEQ ID NO: 56847 - RNA, 20 nt, Artificial Sequence
  MKO10056847_A_Ubac2
  gRNA
guauucgcuuggugucacag

SEQ ID NO: 56848 - RNA, 20 nt, Artificial Sequence
  MKO10056848_A_Ubac2
  gRNA
gacaccaagcgaauacugca

SEQ ID NO: 56849 - RNA, 20 nt, Artificial Sequence
  MKO10056849_A_Ubald1
  gRNA
gaucaaccaguucgugcuga

SEQ ID NO: 56850 - RNA, 20 nt, Artificial Sequence
  MKO10056850_A_Ubald1
  gRNA
uacgcaccucgaacugccag

SEQ ID NO: 56851 - RNA, 20 nt, Artificial Sequence
  MKO10056851_A_Ubald1
  gRNA
ggacacuuaccaucuggugg

SEQ ID NO: 56852 - RNA, 20 nt, Artificial Sequence
  MKO10056852_A_Ubald2
  gRNA
gaacacuuaccaucugcggg

SEQ ID NO: 56853 - RNA, 20 nt, Artificial Sequence
  MKO10056853_A_Ubald2
  gRNA
cagccaccaccacccgcaga

SEQ ID NO: 56854 - RNA, 20 nt, Artificial Sequence
  MKO10056854_A_Ubald2
  gRNA
ccccccggagcaucgcaggg

SEQ ID NO: 56855 - RNA, 20 nt, Artificial Sequence
  MKO10056855_A_Ubap1
  gRNA
ugcugacuucgagugugaag

SEQ ID NO: 56856 - RNA, 20 nt, Artificial Sequence
  MKO10056856_A_Ubap1
  gRNA
ucuucacacucgaagucagc

SEQ ID NO: 56857 - RNA, 20 nt, Artificial Sequence
  MKO10056857_A_Ubap1
  gRNA
ucuacacauugccgcucacu

SEQ ID NO: 56858 - RNA, 20 nt, Artificial Sequence
  MKO10056858_A_Ubap2l
  gRNA
cuggcaccucucccccgucu

SEQ ID NO: 56859 - RNA, 20 nt, Artificial Sequence
  MKO10056859_A_Ubap2l
  gRNA
cuaaccgagcccggggaaac

SEQ ID NO: 56860 - RNA, 20 nt, Artificial Sequence
  MKO10056860_A_Ubap2l
  gRNA
gccgacuauagucucugucc

SEQ ID NO: 56861 - RNA, 20 nt, Artificial Sequence
  MKO10056861_A_Ubap2
  gRNA
acggggaaccaacaaccgca

SEQ ID NO: 56862 - RNA, 20 nt, Artificial Sequence
  MKO10056862_A_Ubap2
  gRNA
acggagagagaagcgagucg

SEQ ID NO: 56863 - RNA, 20 nt, Artificial Sequence
  MKO10056863_A_Ubap2
  gRNA
aaaucaggaugaaugcaucg

SEQ ID NO: 56864 - RNA, 20 nt, Artificial Sequence
  MKO10056864_A_Ubash3a
  gRNA
acagccccgcugacgccauc

SEQ ID NO: 56865 - RNA, 20 nt, Artificial Sequence
  MKO10056865_A_Ubash3a
  gRNA
caaacgccauggcgaauucc

SEQ ID NO: 56866 - RNA, 20 nt, Artificial Sequence
  MKO10056866_A_Ubash3a
  gRNA
uuaccagucugcugccgccu

SEQ ID NO: 56867 - RNA, 20 nt, Artificial Sequence
  MKO10056867_A_Ubash3b
  gRNA
aucgacugacaguagucugc

SEQ ID NO: 56868 - RNA, 20 nt, Artificial Sequence
  MKO10056868_A_Ubash3b
  gRNA
agucagccgcgaacuucuug

SEQ ID NO: 56869 - RNA, 20 nt, Artificial Sequence
  MKO10056869_A_Ubash3b
  gRNA
cuagcuugacgucaauguuc

SEQ ID NO: 56870 - RNA, 20 nt, Artificial Sequence
  MKO10056870_A_Ubb
  gRNA
caagaccaucaccuuggagg

SEQ ID NO: 56871 - RNA, 20 nt, Artificial Sequence
  MKO10056871_A_Ubb
  gRNA
ugacaccaucgagaauguga

SEQ ID NO: 56872 - RNA, 20 nt, Artificial Sequence
  MKO10056872_A_Ubb
  gRNA
auuaauagccaccccucaga

SEQ ID NO: 56873 - RNA, 20 nt, Artificial Sequence
  MKO10056873_A_Ubc
  gRNA
aucuuugugaaaaccuuaac

SEQ ID NO: 56874 - RNA, 20 nt, Artificial Sequence
  MKO10056874_A_Ubc
  gRNA
gcccuccuugugcuuguucu

SEQ ID NO: 56875 - RNA, 20 nt, Artificial Sequence
  MKO10056875_A_Ubc
  gRNA
gcccaguguuaccaccaaga

SEQ ID NO: 56876 - RNA, 20 nt, Artificial Sequence
  MKO10056876_A_Ubd
  gRNA
caucgaaaauugucauccua

SEQ ID NO: 56877 - RNA, 20 nt, Artificial Sequence
  MKO10056877_A_Ubd
  gRNA
agguuguccguucagaccaa

SEQ ID NO: 56878 - RNA, 20 nt, Artificial Sequence
  MKO10056878_A_Ubd
  gRNA
cugagcuggaucuucgaacu

SEQ ID NO: 56879 - RNA, 20 nt, Artificial Sequence
  MKO10056879_A_Ube2a
  gRNA
accauuauguuguucuccga

SEQ ID NO: 56880 - RNA, 20 nt, Artificial Sequence
  MKO10056880_A_Ube2a
  gRNA
gcccgaagggaccccguuug

SEQ ID NO: 56881 - RNA, 20 nt, Artificial Sequence
  MKO10056881_A_Ube2a
  gRNA
uggauauacuucagaaccgu

SEQ ID NO: 56882 - RNA, 20 nt, Artificial Sequence
  MKO10056882_A_Ube2b
  gRNA
gcgccacugacccccacagg

SEQ ID NO: 56883 - RNA, 20 nt, Artificial Sequence
  MKO10056883_A_Ube2b
  gRNA
uagauauccugcagaaucga

SEQ ID NO: 56884 - RNA, 20 nt, Artificial Sequence
  MKO10056884_A_Ube2b
  gRNA
cuaacgguuggugguuuauu

SEQ ID NO: 56885 - RNA, 20 nt, Artificial Sequence
  MKO10056885_A_Ube2cbp
  gRNA
accgagauccgacuuccagc

SEQ ID NO: 56886 - RNA, 20 nt, Artificial Sequence
  MKO10056886_A_Ube2cbp
  gRNA
cugcaguauaucaguggcga

SEQ ID NO: 56887 - RNA, 20 nt, Artificial Sequence
  MKO10056887_A_Ube2cbp
  gRNA
agucauuuguaagcguugca

SEQ ID NO: 56888 - RNA, 20 nt, Artificial Sequence
  MKO10056888_A_Ube2c
  gRNA
uuacggugccggcugcuccg

SEQ ID NO: 56889 - RNA, 20 nt, Artificial Sequence
  MKO10056889_A_Ube2c
  gRNA
aguuaccuccuagcaggcuc

SEQ ID NO: 56890 - RNA, 20 nt, Artificial Sequence
  MKO10056890_A_Ube2c
  gRNA
ugguccccacccacuugaac

SEQ ID NO: 56891 - RNA, 20 nt, Artificial Sequence
  MKO10056891_A_Ube2d1
  gRNA
uguacuuacgggccccauga

SEQ ID NO: 56892 - RNA, 20 nt, Artificial Sequence
  MKO10056892_A_Ube2d1
  gRNA
cccgcuuugacuguaucgaa

SEQ ID NO: 56893 - RNA, 20 nt, Artificial Sequence
  MKO10056893_A_Ube2d1
  gRNA
ccaccuugauaggcgcuguc

SEQ ID NO: 56894 - RNA, 20 nt, Artificial Sequence
  MKO10056894_A_Ube2d2a
  gRNA
auuuaccuuaggcgguuuga

SEQ ID NO: 56895 - RNA, 20 nt, Artificial Sequence
  MKO10056895_A_Ube2d2a
  gRNA
ccagcacuaacuauuucaaa

SEQ ID NO: 56896 - RNA, 20 nt, Artificial Sequence
  MKO10056896_A_Ube2d2a
  gRNA
acagaaugacagccccuauc

SEQ ID NO: 56897 - RNA, 20 nt, Artificial Sequence
  MKO10056897_A_Ube2d2b
  gRNA
ucggucugugauaccgcuac

SEQ ID NO: 56898 - RNA, 20 nt, Artificial Sequence
  MKO10056898_A_Ube2d2b
  gRNA
cuggagaacgcucgucugcu

SEQ ID NO: 56899 - RNA, 20 nt, Artificial Sequence
  MKO10056899_A_Ube2d2b
  gRNA
acaaaaauagauuggcgcua

SEQ ID NO: 56900 - RNA, 20 nt, Artificial Sequence
  MKO10056900_A_Ube2d3
  gRNA
acuuacaggucccauaauug

SEQ ID NO: 56901 - RNA, 20 nt, Artificial Sequence
  MKO10056901_A_Ube2d3
  gRNA
gguuuaggaacuuagugauu

SEQ ID NO: 56902 - RNA, 20 nt, Artificial Sequence
  MKO10056902_A_Ube2d3
  gRNA
acuugccuuaggugguuuga

SEQ ID NO: 56903 - RNA, 20 nt, Artificial Sequence
  MKO10056903_A_Ube2dnl1
  gRNA
gggaauccuuguagcccuac

SEQ ID NO: 56904 - RNA, 20 nt, Artificial Sequence
  MKO10056904_A_Ube2dnl1
  gRNA
gaaggcuguuaugcaguugc

SEQ ID NO: 56905 - RNA, 20 nt, Artificial Sequence
  MKO10056905_A_Ube2dnl1
  gRNA
ucggguuaugaacgaaacuu

SEQ ID NO: 56906 - RNA, 20 nt, Artificial Sequence
  MKO10056906_A_Ube2dnl2
  gRNA
aauugcaaaggucuaccgca

SEQ ID NO: 56907 - RNA, 20 nt, Artificial Sequence
  MKO10056907_A_Ube2dnl2
  gRNA
ucggguuaugaacguaacuu

SEQ ID NO: 56908 - RNA, 20 nt, Artificial Sequence
  MKO10056908_A_Ube2dnl2
  gRNA
gaagauggaucaaucuacuu

SEQ ID NO: 56909 - RNA, 20 nt, Artificial Sequence
  MKO10056909_A_Ube2e1
  gRNA
uagacccuccgccaaacugc

SEQ ID NO: 56910 - RNA, 20 nt, Artificial Sequence
  MKO10056910_A_Ube2e1
  gRNA
cuccuuacagacugcaaucc

SEQ ID NO: 56911 - RNA, 20 nt, Artificial Sequence
  MKO10056911_A_Ube2e1
  gRNA
gcagcuuaccugcaguuugg

SEQ ID NO: 56912 - RNA, 20 nt, Artificial Sequence
  MKO10056912_A_Ube2e2
  gRNA
ccccuagguggcguaccgcu

SEQ ID NO: 56913 - RNA, 20 nt, Artificial Sequence
  MKO10056913_A_Ube2e2
  gRNA
accaagcgguacgccaccua

SEQ ID NO: 56914 - RNA, 20 nt, Artificial Sequence
  MKO10056914_A_Ube2e2
  gRNA
uuauccguuuaaacccccua

SEQ ID NO: 56915 - RNA, 20 nt, Artificial Sequence
  MKO10056915_A_Ube2e3
  gRNA
guggcuaugcuuccgaccag

SEQ ID NO: 56916 - RNA, 20 nt, Artificial Sequence
  MKO10056916_A_Ube2e3
  gRNA
uuaaauagugcugggccuaa

SEQ ID NO: 56917 - RNA, 20 nt, Artificial Sequence
  MKO10056917_A_Ube2e3
  gRNA
gauguugcagugauagauuc

SEQ ID NO: 56918 - RNA, 20 nt, Artificial Sequence
  MKO10056918_A_Ube2f
  gRNA
gcuacucaccaccauguugu

SEQ ID NO: 56919 - RNA, 20 nt, Artificial Sequence
  MKO10056919_A_Ube2f
  gRNA
aauagaugaggguuacuacc

SEQ ID NO: 56920 - RNA, 20 nt, Artificial Sequence
  MKO10056920_A_Ube2f
  gRNA
uuucagcugacuguaagccc

SEQ ID NO: 56921 - RNA, 20 nt, Artificial Sequence
  MKO10056921_A_Ube2g1
  gRNA
acgacaaugaucucuaucgu

SEQ ID NO: 56922 - RNA, 20 nt, Artificial Sequence
  MKO10056922_A_Ube2g1
  gRNA
auagguaaccagcguuccuc

SEQ ID NO: 56923 - RNA, 20 nt, Artificial Sequence
  MKO10056923_A_Ube2g1
  gRNA
cugguuaccuauccauacug

SEQ ID NO: 56924 - RNA, 20 nt, Artificial Sequence
  MKO10056924_A_Ube2g2
  gRNA
gcuuucuguugugagcaugc

SEQ ID NO: 56925 - RNA, 20 nt, Artificial Sequence
  MKO10056925_A_Ube2g2
  gRNA
gagaugcagacucugccauc

SEQ ID NO: 56926 - RNA, 20 nt, Artificial Sequence
  MKO10056926_A_Ube2g2
  gRNA
ucucaucuucggagggcuca

SEQ ID NO: 56927 - RNA, 20 nt, Artificial Sequence
  MKO10056927_A_Ube2h
  gRNA
ucuguuacagcaccauauga

SEQ ID NO: 56928 - RNA, 20 nt, Artificial Sequence
  MKO10056928_A_Ube2h
  gRNA
gaguacaagcagaaaauuaa

SEQ ID NO: 56929 - RNA, 20 nt, Artificial Sequence
  MKO10056929_A_Ube2h
  gRNA
cagcauugaaagcaaacaug

SEQ ID NO: 56930 - RNA, 20 nt, Artificial Sequence
  MKO10056930_A_Ube2i
  gRNA
gccagcuaucaccaucaaac

SEQ ID NO: 56931 - RNA, 20 nt, Artificial Sequence
  MKO10056931_A_Ube2i
  gRNA
uacuaaccaguaaauugugu

SEQ ID NO: 56932 - RNA, 20 nt, Artificial Sequence
  MKO10056932_A_Ube2i
  gRNA
uccccacagacuccauggga

SEQ ID NO: 56933 - RNA, 20 nt, Artificial Sequence
  MKO10056933_A_Ube2j1
  gRNA
agucggcauaaacccgauga

SEQ ID NO: 56934 - RNA, 20 nt, Artificial Sequence
  MKO10056934_A_Ube2j1
  gRNA
aucggguuuaugccgacuaa

SEQ ID NO: 56935 - RNA, 20 nt, Artificial Sequence
  MKO10056935_A_Ube2j1
  gRNA
uucuuucaucaaucgcuuaa

SEQ ID NO: 56936 - RNA, 20 nt, Artificial Sequence
  MKO10056936_A_Ube2j2
  gRNA
guuaggcauuauguuguccg

SEQ ID NO: 56937 - RNA, 20 nt, Artificial Sequence
  MKO10056937_A_Ube2j2
  gRNA
ccgacgucucuaugcucccc

SEQ ID NO: 56938 - RNA, 20 nt, Artificial Sequence
  MKO10056938_A_Ube2j2
  gRNA
gguguagguggcuauuauca

SEQ ID NO: 56939 - RNA, 20 nt, Artificial Sequence
  MKO10056939_A_Ube2k
  gRNA
ccuaauauuaguuccgucac

SEQ ID NO: 56940 - RNA, 20 nt, Artificial Sequence
  MKO10056940_A_Ube2k
  gRNA
uugccuucauacgguguguc

SEQ ID NO: 56941 - RNA, 20 nt, Artificial Sequence
  MKO10056941_A_Ube2k
  gRNA
agaugcaguaguagcgaauc

SEQ ID NO: 56942 - RNA, 20 nt, Artificial Sequence
  MKO10056942_A_Ube2l3
  gRNA
ccucucaccuuggucagucu

SEQ ID NO: 56943 - RNA, 20 nt, Artificial Sequence
  MKO10056943_A_Ube2l3
  gRNA
ccagccaccaagacugacca

SEQ ID NO: 56944 - RNA, 20 nt, Artificial Sequence
  MKO10056944_A_Ube2l3
  gRNA
uaccuucaucagccuccugc

SEQ ID NO: 56945 - RNA, 20 nt, Artificial Sequence
  MKO10056945_A_Ube2l6
  gRNA
cgucacuagacaguuggcga

SEQ ID NO: 56946 - RNA, 20 nt, Artificial Sequence
  MKO10056946_A_Ube2l6
  gRNA
uacuuucgccacucgcuugc

SEQ ID NO: 56947 - RNA, 20 nt, Artificial Sequence
  MKO10056947_A_Ube2l6
  gRNA
cgcccuaccuugauaaggcu

SEQ ID NO: 56948 - RNA, 20 nt, Artificial Sequence
  MKO10056948_A_Ube2m
  gRNA
uuucaggcagcgcucgaagu

SEQ ID NO: 56949 - RNA, 20 nt, Artificial Sequence
  MKO10056949_A_Ube2m
  gRNA
ucaucccaacauugaccucg

SEQ ID NO: 56950 - RNA, 20 nt, Artificial Sequence
  MKO10056950_A_Ube2m
  gRNA
guugcccucgaggucaaugu

SEQ ID NO: 56951 - RNA, 20 nt, Artificial Sequence
  MKO10056951_A_Ube2n
  gRNA
gaagcccaagccauagaaac

SEQ ID NO: 56952 - RNA, 20 nt, Artificial Sequence
  MKO10056952_A_Ube2n
  gRNA
cgguuaccuugaugauccug

SEQ ID NO: 56953 - RNA, 20 nt, Artificial Sequence
  MKO10056953_A_Ube2n
  gRNA
cuacagcgagagcauggacu

SEQ ID NO: 56954 - RNA, 20 nt, Artificial Sequence
  MKO10056954_A_Ube2o
  gRNA
acuauaucgccuaugacugc

SEQ ID NO: 56955 - RNA, 20 nt, Artificial Sequence
  MKO10056955_A_Ube2o
  gRNA
uguaccgagucgcugacgug

SEQ ID NO: 56956 - RNA, 20 nt, Artificial Sequence
  MKO10056956_A_Ube2o
  gRNA
cugcccucacgucagcgacu

SEQ ID NO: 56957 - RNA, 20 nt, Artificial Sequence
  MKO10056957_A_Ube2q1
  gRNA
aucggacuccaccgaccaga

SEQ ID NO: 56958 - RNA, 20 nt, Artificial Sequence
  MKO10056958_A_Ube2q1
  gRNA
cauuuaaguaaucuugccuc

SEQ ID NO: 56959 - RNA, 20 nt, Artificial Sequence
  MKO10056959_A_Ube2q1
  gRNA
ggagguuguagaguuuacac

SEQ ID NO: 56960 - RNA, 20 nt, Artificial Sequence
  MKO10056960_A_Ube2q2
  gRNA
guuuacuuuaccugacccgu

SEQ ID NO: 56961 - RNA, 20 nt, Artificial Sequence
  MKO10056961_A_Ube2q2
  gRNA
gcuagaucaaccacuaccca

SEQ ID NO: 56962 - RNA, 20 nt, Artificial Sequence
  MKO10056962_A_Ube2q2
  gRNA
agauacuaagaacaacaguu

SEQ ID NO: 56963 - RNA, 20 nt, Artificial Sequence
  MKO10056963_A_Ube2ql1
  gRNA
cgcgcagcgaugcgcucugc

SEQ ID NO: 56964 - RNA, 20 nt, Artificial Sequence
  MKO10056964_A_Ube2ql1
  gRNA
gccacgcugcuccguaaaau

SEQ ID NO: 56965 - RNA, 20 nt, Artificial Sequence
  MKO10056965_A_Ube2ql1
  gRNA
aaaaaaguccuucagccgca

SEQ ID NO: 56966 - RNA, 20 nt, Artificial Sequence
  MKO10056966_A_Ube2r2
  gRNA
ggaacccuacucagaacguu

SEQ ID NO: 56967 - RNA, 20 nt, Artificial Sequence
  MKO10056967_A_Ube2r2
  gRNA
ccuguagaugacccgcagag

SEQ ID NO: 56968 - RNA, 20 nt, Artificial Sequence
  MKO10056968_A_Ube2r2
  gRNA
gcagugagaucacacuuaac

SEQ ID NO: 56969 - RNA, 20 nt, Artificial Sequence
  MKO10056969_A_Ube2s
  gRNA
gggcauacgacaugugcugc

SEQ ID NO: 56970 - RNA, 20 nt, Artificial Sequence
  MKO10056970_A_Ube2s
  gRNA
acacucaccagggcccucga

SEQ ID NO: 56971 - RNA, 20 nt, Artificial Sequence
  MKO10056971_A_Ube2s
  gRNA
ccgugccuagaacuccaaug

SEQ ID NO: 56972 - RNA, 20 nt, Artificial Sequence
  MKO10056972_A_Ube2t
  gRNA
gcuaauacaccuuaugagaa

SEQ ID NO: 56973 - RNA, 20 nt, Artificial Sequence
  MKO10056973_A_Ube2t
  gRNA
cguacaaugucagccauuag

SEQ ID NO: 56974 - RNA, 20 nt, Artificial Sequence
  MKO10056974_A_Ube2t
  gRNA
caauccugaugacccacuaa

SEQ ID NO: 56975 - RNA, 20 nt, Artificial Sequence
  MKO10056975_A_Ube2u
  gRNA
aauacaguagacccauauac

SEQ ID NO: 56976 - RNA, 20 nt, Artificial Sequence
  MKO10056976_A_Ube2u
  gRNA
cuuguccaaaaagucuauac

SEQ ID NO: 56977 - RNA, 20 nt, Artificial Sequence
  MKO10056977_A_Ube2u
  gRNA
aaaugcgucuacguauaaaa

SEQ ID NO: 56978 - RNA, 20 nt, Artificial Sequence
  MKO10056978_A_Ube2v1
  gRNA
cccccgcucacccgagccug

SEQ ID NO: 56979 - RNA, 20 nt, Artificial Sequence
  MKO10056979_A_Ube2v1
  gRNA
gcagguggauccgagagcca

SEQ ID NO: 56980 - RNA, 20 nt, Artificial Sequence
  MKO10056980_A_Ube2v1
  gRNA
cgcaagauggcagccaccac

SEQ ID NO: 56981 - RNA, 20 nt, Artificial Sequence
  MKO10056981_A_Ube2v2
  gRNA
uccucucucagguggaugca

SEQ ID NO: 56982 - RNA, 20 nt, Artificial Sequence
  MKO10056982_A_Ube2v2
  gRNA
gagaagauggcggucuccac

SEQ ID NO: 56983 - RNA, 20 nt, Artificial Sequence
  MKO10056983_A_Ube2v2
  gRNA
ucaugucuucaucaucuuca

SEQ ID NO: 56984 - RNA, 20 nt, Artificial Sequence
  MKO10056984_A_Ube2w
  gRNA
ccuuagguggaucguagaca

SEQ ID NO: 56985 - RNA, 20 nt, Artificial Sequence
  MKO10056985_A_Ube2w
  gRNA
guuacauguucgcacauaaa

SEQ ID NO: 56986 - RNA, 20 nt, Artificial Sequence
  MKO10056986_A_Ube2w
  gRNA
gcaccaggaaccuuauauga

SEQ ID NO: 56987 - RNA, 20 nt, Artificial Sequence
  MKO10056987_A_Ube2z
  gRNA
gacacauaccguagggguuc

SEQ ID NO: 56988 - RNA, 20 nt, Artificial Sequence
  MKO10056988_A_Ube2z
  gRNA
guugucaucaguuugacccg

SEQ ID NO: 56989 - RNA, 20 nt, Artificial Sequence
  MKO10056989_A_Ube2z
  gRNA
uguguuugcaguacguggac

SEQ ID NO: 56990 - RNA, 20 nt, Artificial Sequence
  MKO10056990_A_Ube3a
  gRNA
cuccugaaguguuaauucgc

SEQ ID NO: 56991 - RNA, 20 nt, Artificial Sequence
  MKO10056991_A_Ube3a
  gRNA
agcacaaaacucauucgugc

SEQ ID NO: 56992 - RNA, 20 nt, Artificial Sequence
  MKO10056992_A_Ube3a
  gRNA
gauccacuagaaaccgaacu

SEQ ID NO: 56993 - RNA, 20 nt, Artificial Sequence
  MKO10056993_A_Ube3b
  gRNA
guaggugugguacguguccc

SEQ ID NO: 56994 - RNA, 20 nt, Artificial Sequence
  MKO10056994_A_Ube3b
  gRNA
ccaaggaccucacgcugcug

SEQ ID NO: 56995 - RNA, 20 nt, Artificial Sequence
  MKO10056995_A_Ube3b
  gRNA
gagguacagcgugaugagcc

SEQ ID NO: 56996 - RNA, 20 nt, Artificial Sequence
  MKO10056996_A_Ube3c
  gRNA
ccaaccuuacccucuuggua

SEQ ID NO: 56997 - RNA, 20 nt, Artificial Sequence
  MKO10056997_A_Ube3c
  gRNA
guuugaccaaugcacugacu

SEQ ID NO: 56998 - RNA, 20 nt, Artificial Sequence
  MKO10056998_A_Ube3c
  gRNA
acacaacuuaccugcaacag

SEQ ID NO: 56999 - RNA, 20 nt, Artificial Sequence
  MKO10056999_A_Ube4a
  gRNA
acacuauuauccgagucauc

SEQ ID NO: 57000 - RNA, 20 nt, Artificial Sequence
  MKO10057000_A_Ube4a
  gRNA
ggugauccaagcuugaaaag

SEQ ID NO: 57001 - RNA, 20 nt, Artificial Sequence
  MKO10057001_A_Ube4a
  gRNA
gaggagaacuguucgagugu

SEQ ID NO: 57002 - RNA, 20 nt, Artificial Sequence
  MKO10057002_A_Ube4b
  gRNA
cucuucuguagauucgacgg

SEQ ID NO: 57003 - RNA, 20 nt, Artificial Sequence
  MKO10057003_A_Ube4b
  gRNA
guccaccagcaagucgugcc

SEQ ID NO: 57004 - RNA, 20 nt, Artificial Sequence
  MKO10057004_A_Ube4b
  gRNA
aacugacgccuucgcugcuc

SEQ ID NO: 57005 - RNA, 20 nt, Artificial Sequence
  MKO10057005_A_Ubfd1
  gRNA
agggaccuucacgucguguu

SEQ ID NO: 57006 - RNA, 20 nt, Artificial Sequence
  MKO10057006_A_Ubfd1
  gRNA
cuucggccuccacgcaguug

SEQ ID NO: 57007 - RNA, 20 nt, Artificial Sequence
  MKO10057007_A_Ubfd1
  gRNA
cuuuagugccgauccacagc

SEQ ID NO: 57008 - RNA, 20 nt, Artificial Sequence
  MKO10057008_A_Ubiad1
  gRNA
uguacacggggccggcaauu

SEQ ID NO: 57009 - RNA, 20 nt, Artificial Sequence
  MKO10057009_A_Ubiad1
  gRNA
acaggcuucccgaacgaucc

SEQ ID NO: 57010 - RNA, 20 nt, Artificial Sequence
  MKO10057010_A_Ubiad1
  gRNA
gcgugacgaugccagccucu

SEQ ID NO: 57011 - RNA, 20 nt, Artificial Sequence
  MKO10057011_A_Ubl3
  gRNA
gauuaauuugcgccucaucu

SEQ ID NO: 57012 - RNA, 20 nt, Artificial Sequence
  MKO10057012_A_Ubl3
  gRNA
cacgugcuuugcgaugucag

SEQ ID NO: 57013 - RNA, 20 nt, Artificial Sequence
  MKO10057013_A_Ubl3
  gRNA
cuacauggaaacgucacccu

SEQ ID NO: 57014 - RNA, 20 nt, Artificial Sequence
  MKO10057014_A_Ubl4a
  gRNA
uugcguuggccguaguggac

SEQ ID NO: 57015 - RNA, 20 nt, Artificial Sequence
  MKO10057015_A_Ubl4a
  gRNA
ggcgcgcggcaggggaccgu

SEQ ID NO: 57016 - RNA, 20 nt, Artificial Sequence
  MKO10057016_A_Ubl4a
  gRNA
ccggcaaacgccggcaagug

SEQ ID NO: 57017 - RNA, 20 nt, Artificial Sequence
  MKO10057017_A_Ubl4b
  gRNA
ucgaguuccgaugcaacagc

SEQ ID NO: 57018 - RNA, 20 nt, Artificial Sequence
  MKO10057018_A_Ubl4b
  gRNA
ucagcaccuacaggugcccg

SEQ ID NO: 57019 - RNA, 20 nt, Artificial Sequence
  MKO10057019_A_Ubl4b
  gRNA
acaacagcagcuugacgagc

SEQ ID NO: 57020 - RNA, 20 nt, Artificial Sequence
  MKO10057020_A_Ubl4
  gRNA
acuggaugacaucgaacguu

SEQ ID NO: 57021 - RNA, 20 nt, Artificial Sequence
  MKO10057021_A_Ubl4
  gRNA
cgacugucagauuacaacau

SEQ ID NO: 57022 - RNA, 20 nt, Artificial Sequence
  MKO10057022_A_Ubl4
  gRNA
cauucagcuuauccgagacc

SEQ ID NO: 57023 - RNA, 20 nt, Artificial Sequence
  MKO10057023_A_Ubl5
  gRNA
guggauacuugcacuuaacg

SEQ ID NO: 57024 - RNA, 20 nt, Artificial Sequence
  MKO10057024_A_Ubl5
  gRNA
ccuucagaugaaauccacga

SEQ ID NO: 57025 - RNA, 20 nt, Artificial Sequence
  MKO10057025_A_Ubl5
  gRNA
uaagaacgaucuuguuccag

SEQ ID NO: 57026 - RNA, 20 nt, Artificial Sequence
  MKO10057026_A_Ubl7
  gRNA
uccauguucuccgaaaaucu

SEQ ID NO: 57027 - RNA, 20 nt, Artificial Sequence
  MKO10057027_A_Ubl7
  gRNA
cacuuacguaucuagcaugu

SEQ ID NO: 57028 - RNA, 20 nt, Artificial Sequence
  MKO10057028_A_Ubl7
  gRNA
cuuguacuuaccuagagcaa

SEQ ID NO: 57029 - RNA, 20 nt, Artificial Sequence
  MKO10057029_A_Ublcp1
  gRNA
uauagucaacauccagcacc

SEQ ID NO: 57030 - RNA, 20 nt, Artificial Sequence
  MKO10057030_A_Ublcp1
  gRNA
gcagaaaaugauguuaagcu

SEQ ID NO: 57031 - RNA, 20 nt, Artificial Sequence
  MKO10057031_A_Ublcp1
  gRNA
aaauacuaaaaucaugauga

SEQ ID NO: 57032 - RNA, 20 nt, Artificial Sequence
  MKO10057032_A_Ubn1
  gRNA
uuucuucaaauuuccgugca

SEQ ID NO: 57033 - RNA, 20 nt, Artificial Sequence
  MKO10057033_A_Ubn1
  gRNA
aaaagaugacacuuacgaca

SEQ ID NO: 57034 - RNA, 20 nt, Artificial Sequence
  MKO10057034_A_Ubn1
  gRNA
uaucaaucaaguccuguauu

SEQ ID NO: 57035 - RNA, 20 nt, Artificial Sequence
  MKO10057035_A_Ubn2
  gRNA
gugggaaagcccguaaacac

SEQ ID NO: 57036 - RNA, 20 nt, Artificial Sequence
  MKO10057036_A_Ubn2
  gRNA
aaucuuguagccgauccuuc

SEQ ID NO: 57037 - RNA, 20 nt, Artificial Sequence
  MKO10057037_A_Ubn2
  gRNA
uggcacucugcaguuccgcc

SEQ ID NO: 57038 - RNA, 20 nt, Artificial Sequence
  MKO10057038_A_Ubox5
  gRNA
accggucgauccgggcuuuc

SEQ ID NO: 57039 - RNA, 20 nt, Artificial Sequence
  MKO10057039_A_Ubox5
  gRNA
cucuugcaucaagcguuuag

SEQ ID NO: 57040 - RNA, 20 nt, Artificial Sequence
  MKO10057040_A_Ubox5
  gRNA
aauggacccgcagcacaucc

SEQ ID NO: 57041 - RNA, 20 nt, Artificial Sequence
  MKO10057041_A_Ubp1
  gRNA
ugucucgucgugcagcuuaa

SEQ ID NO: 57042 - RNA, 20 nt, Artificial Sequence
  MKO10057042_A_Ubp1
  gRNA
gcauccgaauuucauaagac

SEQ ID NO: 57043 - RNA, 20 nt, Artificial Sequence
  MKO10057043_A_Ubp1
  gRNA
cgaggugaucgaguccgggc

SEQ ID NO: 57044 - RNA, 20 nt, Artificial Sequence
  MKO10057044_A_Ubqln1
  gRNA
cccgauagcaaccccacguc

SEQ ID NO: 57045 - RNA, 20 nt, Artificial Sequence
  MKO10057045_A_Ubqln1
  gRNA
gcacaacuuaccuacgccaa

SEQ ID NO: 57046 - RNA, 20 nt, Artificial Sequence
  MKO10057046_A_Ubqln1
  gRNA
ccauaaucaauugccgcauc

SEQ ID NO: 57047 - RNA, 20 nt, Artificial Sequence
  MKO10057047_A_Ubqln2
  gRNA
gccggcggcgacgacaucau

SEQ ID NO: 57048 - RNA, 20 nt, Artificial Sequence
  MKO10057048_A_Ubqln2
  gRNA
auuagcgcuugcaucgcucu

SEQ ID NO: 57049 - RNA, 20 nt, Artificial Sequence
  MKO10057049_A_Ubqln2
  gRNA
accuaugcugaaugccgcac

SEQ ID NO: 57050 - RNA, 20 nt, Artificial Sequence
  MKO10057050_A_Ubqln3
  gRNA
cacgggccuagugcgccagu

SEQ ID NO: 57051 - RNA, 20 nt, Artificial Sequence
  MKO10057051_A_Ubqln3
  gRNA
ggcucacuuccggguacaac

SEQ ID NO: 57052 - RNA, 20 nt, Artificial Sequence
  MKO10057052_A_Ubqln3
  gRNA
caagaaccaacuggcgcacu

SEQ ID NO: 57053 - RNA, 20 nt, Artificial Sequence
  MKO10057053_A_Ubqln4
  gRNA
ccugggcuccgccaacuuua

SEQ ID NO: 57054 - RNA, 20 nt, Artificial Sequence
  MKO10057054_A_Ubqln4
  gRNA
ugcccuccgccgcauguaca

SEQ ID NO: 57055 - RNA, 20 nt, Artificial Sequence
  MKO10057055_A_Ubqln4
  gRNA
ucugaugcgccacaugauca

SEQ ID NO: 57056 - RNA, 20 nt, Artificial Sequence
  MKO10057056_A_Ubqlnl
  gRNA
ggugaucgagagauaauacg

SEQ ID NO: 57057 - RNA, 20 nt, Artificial Sequence
  MKO10057057_A_Ubqlnl
  gRNA
acaaucacucgaaugacacc

SEQ ID NO: 57058 - RNA, 20 nt, Artificial Sequence
  MKO10057058_A_Ubqlnl
  gRNA
ucuuugcugaaacgaaccuc

SEQ ID NO: 57059 - RNA, 20 nt, Artificial Sequence
  MKO10057059_A_Ubr1
  gRNA
ucauaaaaaccaucguuaca

SEQ ID NO: 57060 - RNA, 20 nt, Artificial Sequence
  MKO10057060_A_Ubr1
  gRNA
ccaaauaaguaccacuccaa

SEQ ID NO: 57061 - RNA, 20 nt, Artificial Sequence
  MKO10057061_A_Ubr1
  gRNA
uccauacagagcacacacgu

SEQ ID NO: 57062 - RNA, 20 nt, Artificial Sequence
  MKO10057062_A_Ubr2
  gRNA
cguuacugacccuauaucga

SEQ ID NO: 57063 - RNA, 20 nt, Artificial Sequence
  MKO10057063_A_Ubr2
  gRNA
gcgcagauguaccacuccau

SEQ ID NO: 57064 - RNA, 20 nt, Artificial Sequence
  MKO10057064_A_Ubr2
  gRNA
uccauagagaccaucgauau

SEQ ID NO: 57065 - RNA, 20 nt, Artificial Sequence
  MKO10057065_A_Ubr3
  gRNA
agagugcuaguaccagcagc

SEQ ID NO: 57066 - RNA, 20 nt, Artificial Sequence
  MKO10057066_A_Ubr3
  gRNA
gacauaucccgaggauaagc

SEQ ID NO: 57067 - RNA, 20 nt, Artificial Sequence
  MKO10057067_A_Ubr3
  gRNA
gaacuacaaagaccugacug

SEQ ID NO: 57068 - RNA, 20 nt, Artificial Sequence
  MKO10057068_A_Ubr4
  gRNA
gauacagcacaugccucguc

SEQ ID NO: 57069 - RNA, 20 nt, Artificial Sequence
  MKO10057069_A_Ubr4
  gRNA
gugcguggacagugcgacaa

SEQ ID NO: 57070 - RNA, 20 nt, Artificial Sequence
  MKO10057070_A_Ubr4
  gRNA
acggcucguacugcuucucg

SEQ ID NO: 57071 - RNA, 20 nt, Artificial Sequence
  MKO10057071_A_Ubr5
  gRNA
uuacccaauuccagucuguc

SEQ ID NO: 57072 - RNA, 20 nt, Artificial Sequence
  MKO10057072_A_Ubr5
  gRNA
ucacgccgcguuucuucuug

SEQ ID NO: 57073 - RNA, 20 nt, Artificial Sequence
  MKO10057073_A_Ubr5
  gRNA
gccugcuccaguacauucag

SEQ ID NO: 57074 - RNA, 20 nt, Artificial Sequence
  MKO10057074_A_Ubr7
  gRNA
gcuugcaguuacgaauguca

SEQ ID NO: 57075 - RNA, 20 nt, Artificial Sequence
  MKO10057075_A_Ubr7
  gRNA
cugcagcaccugcacgccag

SEQ ID NO: 57076 - RNA, 20 nt, Artificial Sequence
  MKO10057076_A_Ubr7
  gRNA
gugaagacugguuccauggc

SEQ ID NO: 57077 - RNA, 20 nt, Artificial Sequence
  MKO10057077_A_Ubtd1
  gRNA
uggcguuaccugcucgcuug

SEQ ID NO: 57078 - RNA, 20 nt, Artificial Sequence
  MKO10057078_A_Ubtd1
  gRNA
ggacacccccgcaagcgagc

SEQ ID NO: 57079 - RNA, 20 nt, Artificial Sequence
  MKO10057079_A_Ubtd1
  gRNA
ucaaaaagacuucgucaucc

SEQ ID NO: 57080 - RNA, 20 nt, Artificial Sequence
  MKO10057080_A_Ubtd2
  gRNA
ugccguccgaguucucguug

SEQ ID NO: 57081 - RNA, 20 nt, Artificial Sequence
  MKO10057081_A_Ubtd2
  gRNA
cugagauucguguccagaau

SEQ ID NO: 57082 - RNA, 20 nt, Artificial Sequence
  MKO10057082_A_Ubtd2
  gRNA
cuuacacgccacagagggcg

SEQ ID NO: 57083 - RNA, 20 nt, Artificial Sequence
  MKO10057083_A_Ubtfl1
  gRNA
uucaacccagcgcuuccuaa

SEQ ID NO: 57084 - RNA, 20 nt, Artificial Sequence
  MKO10057084_A_Ubtfl1
  gRNA
uuccuuguaaaagcgcagau

SEQ ID NO: 57085 - RNA, 20 nt, Artificial Sequence
  MKO10057085_A_Ubtfl1
  gRNA
cgcacagcugaccaaaaucc

SEQ ID NO: 57086 - RNA, 20 nt, Artificial Sequence
  MKO10057086_A_Ubtf
  gRNA
caaguacgcgaagcuccacc

SEQ ID NO: 57087 - RNA, 20 nt, Artificial Sequence
  MKO10057087_A_Ubtf
  gRNA
uugggaaaaaguugcguuua

SEQ ID NO: 57088 - RNA, 20 nt, Artificial Sequence
  MKO10057088_A_Ubtf
  gRNA
ugucacagaccgcugguccc

SEQ ID NO: 57089 - RNA, 20 nt, Artificial Sequence
  MKO10057089_A_Ubxn10
  gRNA
gaggucggagaaccgucucc

SEQ ID NO: 57090 - RNA, 20 nt, Artificial Sequence
  MKO10057090_A_Ubxn10
  gRNA
cuccaacaucgaggagccgu

SEQ ID NO: 57091 - RNA, 20 nt, Artificial Sequence
  MKO10057091_A_Ubxn10
  gRNA
ugugcaaauucggccgcuuc

SEQ ID NO: 57092 - RNA, 20 nt, Artificial Sequence
  MKO10057092_A_Ubxn11
  gRNA
uggacagcaucucgucguuc

SEQ ID NO: 57093 - RNA, 20 nt, Artificial Sequence
  MKO10057093_A_Ubxn11
  gRNA
gcuucaggagcggaagaucc

SEQ ID NO: 57094 - RNA, 20 nt, Artificial Sequence
  MKO10057094_A_Ubxn11
  gRNA
gggucuguaccaaauccucc

SEQ ID NO: 57095 - RNA, 20 nt, Artificial Sequence
  MKO10057095_A_Ubxn1
  gRNA
gcaugaagacgaccccgaug

SEQ ID NO: 57096 - RNA, 20 nt, Artificial Sequence
  MKO10057096_A_Ubxn1
  gRNA
agaugagaugcgccgggcug

SEQ ID NO: 57097 - RNA, 20 nt, Artificial Sequence
  MKO10057097_A_Ubxn1
  gRNA
aguugcacgacagaaacugc

SEQ ID NO: 57098 - RNA, 20 nt, Artificial Sequence
  MKO10057098_A_Ubxn2a
  gRNA
augcuuaccuuccuagucug

SEQ ID NO: 57099 - RNA, 20 nt, Artificial Sequence
  MKO10057099_A_Ubxn2a
  gRNA
ugcuguuucacugaacaacu

SEQ ID NO: 57100 - RNA, 20 nt, Artificial Sequence
  MKO10057100_A_Ubxn2a
  gRNA
aaaauuccccauaauucuga

SEQ ID NO: 57101 - RNA, 20 nt, Artificial Sequence
  MKO10057101_A_Ubxn2b
  gRNA
gcccacgaacaccgccacau

SEQ ID NO: 57102 - RNA, 20 nt, Artificial Sequence
  MKO10057102_A_Ubxn2b
  gRNA
caccgauguggcgguguucg

SEQ ID NO: 57103 - RNA, 20 nt, Artificial Sequence
  MKO10057103_A_Ubxn2b
  gRNA
aagcgaucagaguauaucua

SEQ ID NO: 57104 - RNA, 20 nt, Artificial Sequence
  MKO10057104_A_Ubxn4
  gRNA
cccgagaugcacucgucaaa

SEQ ID NO: 57105 - RNA, 20 nt, Artificial Sequence
  MKO10057105_A_Ubxn4
  gRNA
cuccccgcuauuacuuccaa

SEQ ID NO: 57106 - RNA, 20 nt, Artificial Sequence
  MKO10057106_A_Ubxn4
  gRNA
aaucccuuuggaaguaauag

SEQ ID NO: 57107 - RNA, 20 nt, Artificial Sequence
  MKO10057107_A_Ubxn6
  gRNA
aaccuuaccgaguugguccc

SEQ ID NO: 57108 - RNA, 20 nt, Artificial Sequence
  MKO10057108_A_Ubxn6
  gRNA
gaacucacccugguuccgga

SEQ ID NO: 57109 - RNA, 20 nt, Artificial Sequence
  MKO10057109_A_Ubxn6
  gRNA
uucuucaucuguccgcucac

SEQ ID NO: 57110 - RNA, 20 nt, Artificial Sequence
  MKO10057110_A_Ubxn7
  gRNA
gggccgaaauagaucugcaa

SEQ ID NO: 57111 - RNA, 20 nt, Artificial Sequence
  MKO10057111_A_Ubxn7
  gRNA
cccuugugcaucaagucgau

SEQ ID NO: 57112 - RNA, 20 nt, Artificial Sequence
  MKO10057112_A_Ubxn7
  gRNA
ccaucaaauauugaacgugc

SEQ ID NO: 57113 - RNA, 20 nt, Artificial Sequence
  MKO10057113_A_Ubxn8
  gRNA
aacucacugaaaccuucgca

SEQ ID NO: 57114 - RNA, 20 nt, Artificial Sequence
  MKO10057114_A_Ubxn8
  gRNA
ucauuuccgugaccaccucc

SEQ ID NO: 57115 - RNA, 20 nt, Artificial Sequence
  MKO10057115_A_Ubxn8
  gRNA
aacaacgaaccuccuuccuc

SEQ ID NO: 57116 - RNA, 20 nt, Artificial Sequence
  MKO10057116_A_Uchl1
  gRNA
uggcgcuucgccgacgugcu

SEQ ID NO: 57117 - RNA, 20 nt, Artificial Sequence
  MKO10057117_A_Uchl1
  gRNA
caucggguugauccacgcag

SEQ ID NO: 57118 - RNA, 20 nt, Artificial Sequence
  MKO10057118_A_Uchl1
  gRNA
cacugcguggaucaacccga

SEQ ID NO: 57119 - RNA, 20 nt, Artificial Sequence
  MKO10057119_A_Uchl3
  gRNA
gauuaguccaaucguuccac

SEQ ID NO: 57120 - RNA, 20 nt, Artificial Sequence
  MKO10057120_A_Uchl3
  gRNA
cucguuucaggucaccaacc

SEQ ID NO: 57121 - RNA, 20 nt, Artificial Sequence
  MKO10057121_A_Uchl3
  gRNA
aggaguaacacugcgcauac

SEQ ID NO: 57122 - RNA, 20 nt, Artificial Sequence
  MKO10057122_A_Uchl4
  gRNA
aaucguuccaaucguuccac

SEQ ID NO: 57123 - RNA, 20 nt, Artificial Sequence
  MKO10057123_A_Uchl4
  gRNA
gaauagcgucauaguucucc

SEQ ID NO: 57124 - RNA, 20 nt, Artificial Sequence
  MKO10057124_A_Uchl4
  gRNA
aaccaguuucucaagcaauu

SEQ ID NO: 57125 - RNA, 20 nt, Artificial Sequence
  MKO10057125_A_Uchl5
  gRNA
uacacuuacgauagccugag

SEQ ID NO: 57126 - RNA, 20 nt, Artificial Sequence
  MKO10057126_A_Uchl5
  gRNA
acgcaucaagaugugcauuu

SEQ ID NO: 57127 - RNA, 20 nt, Artificial Sequence
  MKO10057127_A_Uchl5
  gRNA
ucuuguuucagguugccgag

SEQ ID NO: 57128 - RNA, 20 nt, Artificial Sequence
  MKO10057128_A_Uck1
  gRNA
gauguuaggcugucucgaag

SEQ ID NO: 57129 - RNA, 20 nt, Artificial Sequence
  MKO10057129_A_Uck1
  gRNA
caaaggcgguguacugaguc

SEQ ID NO: 57130 - RNA, 20 nt, Artificial Sequence
  MKO10057130_A_Uck1
  gRNA
cagguuaccagagaccacug

SEQ ID NO: 57131 - RNA, 20 nt, Artificial Sequence
  MKO10057131_A_Uck2
  gRNA
gauacccgucugucucgccg

SEQ ID NO: 57132 - RNA, 20 nt, Artificial Sequence
  MKO10057132_A_Uck2
  gRNA
caccaucuaccccgccgacg

SEQ ID NO: 57133 - RNA, 20 nt, Artificial Sequence
  MKO10057133_A_Uck2
  gRNA
ccgggugaucaaaguugaau

SEQ ID NO: 57134 - RNA, 20 nt, Artificial Sequence
  MKO10057134_A_Uckl1
  gRNA
uacguuugcuugugcgaagc

SEQ ID NO: 57135 - RNA, 20 nt, Artificial Sequence
  MKO10057135_A_Uckl1
  gRNA
aaacguaccaucuacacagc

SEQ ID NO: 57136 - RNA, 20 nt, Artificial Sequence
  MKO10057136_A_Uckl1
  gRNA
ugaugacauucgcaccauac

SEQ ID NO: 57137 - RNA, 20 nt, Artificial Sequence
  MKO10057137_A_Ucma
  gRNA
caggagaaugacccgucucc

SEQ ID NO: 57138 - RNA, 20 nt, Artificial Sequence
  MKO10057138_A_Ucma
  gRNA
accgcuugccacgccucuug

SEQ ID NO: 57139 - RNA, 20 nt, Artificial Sequence
  MKO10057139_A_Ucma
  gRNA
aagucccgagaugaaguuaa

SEQ ID NO: 57140 - RNA, 20 nt, Artificial Sequence
  MKO10057140_A_Ucn2
  gRNA
ccuguuccaguaagauccgu

SEQ ID NO: 57141 - RNA, 20 nt, Artificial Sequence
  MKO10057141_A_Ucn2
  gRNA
acuggaacaggcucguuaca

SEQ ID NO: 57142 - RNA, 20 nt, Artificial Sequence
  MKO10057142_A_Ucn2
  gRNA
gcucaaauacuagcccaugu

SEQ ID NO: 57143 - RNA, 20 nt, Artificial Sequence
  MKO10057143_A_Ucn3
  gRNA
cagacaagcccaaaagcgac

SEQ ID NO: 57144 - RNA, 20 nt, Artificial Sequence
  MKO10057144_A_Ucn3
  gRNA
cauccucuucaacaucgaca

SEQ ID NO: 57145 - RNA, 20 nt, Artificial Sequence
  MKO10057145_A_Ucn3
  gRNA
ccgguacagauaccaauccc

SEQ ID NO: 57146 - RNA, 20 nt, Artificial Sequence
  MKO10057146_A_Ucn
  gRNA
gaaccgcaucauauucgauu

SEQ ID NO: 57147 - RNA, 20 nt, Artificial Sequence
  MKO10057147_A_Ucn
  gRNA
uccaggauccgaaucugcga

SEQ ID NO: 57148 - RNA, 20 nt, Artificial Sequence
  MKO10057148_A_Ucn
  gRNA
uccaucgcagauucggaucc

SEQ ID NO: 57149 - RNA, 20 nt, Artificial Sequence
  MKO10057149_A_Ucp1
  gRNA
aucgcacagcuugguacgcu

SEQ ID NO: 57150 - RNA, 20 nt, Artificial Sequence
  MKO10057150_A_Ucp1
  gRNA
auuugccucugaaugcccgc

SEQ ID NO: 57151 - RNA, 20 nt, Artificial Sequence
  MKO10057151_A_Ucp1
  gRNA
cgguccuuccuugguguaca

SEQ ID NO: 57152 - RNA, 20 nt, Artificial Sequence
  MKO10057152_A_Ucp2
  gRNA
cggcgaccagcccauuguag

SEQ ID NO: 57153 - RNA, 20 nt, Artificial Sequence
  MKO10057153_A_Ucp2
  gRNA
cuacaagaccauugcacgag

SEQ ID NO: 57154 - RNA, 20 nt, Artificial Sequence
  MKO10057154_A_Ucp2
  gRNA
agcuuugccuccguccgcau

SEQ ID NO: 57155 - RNA, 20 nt, Artificial Sequence
  MKO10057155_A_Ucp3
  gRNA
auuucaagccaugauacgcc

SEQ ID NO: 57156 - RNA, 20 nt, Artificial Sequence
  MKO10057156_A_Ucp3
  gRNA
cagacuccagcgucgccauc

SEQ ID NO: 57157 - RNA, 20 nt, Artificial Sequence
  MKO10057157_A_Ucp3
  gRNA
cuaggggagcguucauguau

SEQ ID NO: 57158 - RNA, 20 nt, Artificial Sequence
  MKO10057158_A_Uevld
  gRNA
ucucauuucaguacaaguuc

SEQ ID NO: 57159 - RNA, 20 nt, Artificial Sequence
  MKO10057159_A_Uevld
  gRNA
auucauaccauaggugucca

SEQ ID NO: 57160 - RNA, 20 nt, Artificial Sequence
  MKO10057160_A_Uevld
  gRNA
aucuuacguggcuccaguuu

SEQ ID NO: 57161 - RNA, 20 nt, Artificial Sequence
  MKO10057161_A_Ufc1
  gRNA
uuaccgggucccuuccuugu

SEQ ID NO: 57162 - RNA, 20 nt, Artificial Sequence
  MKO10057162_A_Ufc1
  gRNA
cacauaucccacuacugcuc

SEQ ID NO: 57163 - RNA, 20 nt, Artificial Sequence
  MKO10057163_A_Ufc1
  gRNA
ugcaauuuccggagcaguag

SEQ ID NO: 57164 - RNA, 20 nt, Artificial Sequence
  MKO10057164_A_Ufd1l
  gRNA
acugcguggagaagcgguuc

SEQ ID NO: 57165 - RNA, 20 nt, Artificial Sequence
  MKO10057165_A_Ufd1l
  gRNA
ccaaaggauacaccgcuuua

SEQ ID NO: 57166 - RNA, 20 nt, Artificial Sequence
  MKO10057166_A_Ufd1l
  gRNA
uucuccguguccaugcuagc

SEQ ID NO: 57167 - RNA, 20 nt, Artificial Sequence
  MKO10057167_A_Ufl1
  gRNA
agagacgagcuacauguccg

SEQ ID NO: 57168 - RNA, 20 nt, Artificial Sequence
  MKO10057168_A_Ufl1
  gRNA
aguccauacacuugacggca

SEQ ID NO: 57169 - RNA, 20 nt, Artificial Sequence
  MKO10057169_A_Ufl1
  gRNA
cucuacucucgauaugaguc

SEQ ID NO: 57170 - RNA, 20 nt, Artificial Sequence
  MKO10057170_A_Ufm1
  gRNA
cuuuaaaaucacguugacgu

SEQ ID NO: 57171 - RNA, 20 nt, Artificial Sequence
  MKO10057171_A_Ufm1
  gRNA
cacacuuuguacggcagccg

SEQ ID NO: 57172 - RNA, 20 nt, Artificial Sequence
  MKO10057172_A_Ufm1
  gRNA
auaaucgcacuuguagcugc

SEQ ID NO: 57173 - RNA, 20 nt, Artificial Sequence
  MKO10057173_A_Ufsp1
  gRNA
uccggggggcuugucgccca

SEQ ID NO: 57174 - RNA, 20 nt, Artificial Sequence
  MKO10057174_A_Ufsp1
  gRNA
uaacuggaucggcuguguag

SEQ ID NO: 57175 - RNA, 20 nt, Artificial Sequence
  MKO10057175_A_Ufsp1
  gRNA
cugccaugaucccgcccgac

SEQ ID NO: 57176 - RNA, 20 nt, Artificial Sequence
  MKO10057176_A_Ufsp2
  gRNA
gaagcgcacuacguucuuac

SEQ ID NO: 57177 - RNA, 20 nt, Artificial Sequence
  MKO10057177_A_Ufsp2
  gRNA
cccguguuugcgucgcuguu

SEQ ID NO: 57178 - RNA, 20 nt, Artificial Sequence
  MKO10057178_A_Ufsp2
  gRNA
acagacacaacggcgucaau

SEQ ID NO: 57179 - RNA, 20 nt, Artificial Sequence
  MKO10057179_A_Ugcg
  gRNA
ccguauguagccgacagaca

SEQ ID NO: 57180 - RNA, 20 nt, Artificial Sequence
  MKO10057180_A_Ugcg
  gRNA
aauaaucuagcaucgacauu

SEQ ID NO: 57181 - RNA, 20 nt, Artificial Sequence
  MKO10057181_A_Ugcg
  gRNA
cagccguauagcaagcuccc

SEQ ID NO: 57182 - RNA, 20 nt, Artificial Sequence
  MKO10057182_A_Ugdh
  gRNA
gaaguagucgaauccugucg

SEQ ID NO: 57183 - RNA, 20 nt, Artificial Sequence
  MKO10057183_A_Ugdh
  gRNA
cacaagcuucgauauacuuc

SEQ ID NO: 57184 - RNA, 20 nt, Artificial Sequence
  MKO10057184_A_Ugdh
  gRNA
cggguucuuuagguccuuga

SEQ ID NO: 57185 - RNA, 20 nt, Artificial Sequence
  MKO10057185_A_Uggu1
  gRNA
cuccuauuacgaugccguau

SEQ ID NO: 57186 - RNA, 20 nt, Artificial Sequence
  MKO10057186_A_Uggu1
  gRNA
gcgaaacgcagcuuccaaua

SEQ ID NO: 57187 - RNA, 20 nt, Artificial Sequence
  MKO10057187_A_Uggu1
  gRNA
agaaacgacuugcacccuuc

SEQ ID NO: 57188 - RNA, 20 nt, Artificial Sequence
  MKO10057188_A_Uggu2
  gRNA
uguucuccgccacuauauuc

SEQ ID NO: 57189 - RNA, 20 nt, Artificial Sequence
  MKO10057189_A_Uggu2
  gRNA
acaaaugcaguacaucccuc

SEQ ID NO: 57190 - RNA, 20 nt, Artificial Sequence
  MKO10057190_A_Uggu2
  gRNA
cuucaggauuagguuguagu

SEQ ID NO: 57191 - RNA, 20 nt, Artificial Sequence
  MKO10057191_A_Ugp2
  gRNA
cuaaaacuuaccgaaucuuc

SEQ ID NO: 57192 - RNA, 20 nt, Artificial Sequence
  MKO10057192_A_Ugp2
  gRNA
agugaaacucaauggugguu

SEQ ID NO: 57193 - RNA, 20 nt, Artificial Sequence
  MKO10057193_A_Ugp2
  gRNA
cacgacagugauuguacuuc

SEQ ID NO: 57194 - RNA, 20 nt, Artificial Sequence
  MKO10057194_A_Ugu1a10
  gRNA
uccccgaguuuccaugcgcu

SEQ ID NO: 57195 - RNA, 20 nt, Artificial Sequence
  MKO10057195_A_Ugu1a10
  gRNA
gggggcaccacaccugcgcc

SEQ ID NO: 57196 - RNA, 20 nt, Artificial Sequence
  MKO10057196_A_Ugu1a10
  gRNA
gagguccuguggcgcuacac

SEQ ID NO: 57197 - RNA, 20 nt, Artificial Sequence
  MKO10057197_A_Ugu1a1
  gRNA
uccccgaguuuccaugcgcu

SEQ ID NO: 57198 - RNA, 20 nt, Artificial Sequence
  MKO10057198_A_Ugu1a1
  gRNA
gggggcaccacaccugcgcc

SEQ ID NO: 57199 - RNA, 20 nt, Artificial Sequence
  MKO10057199_A_Ugu1a1
  gRNA
gagguccuguggcgcuacac

SEQ ID NO: 57200 - RNA, 20 nt, Artificial Sequence
  MKO10057200_A_Ugu1a2
  gRNA
uccccgaguuuccaugcgcu

SEQ ID NO: 57201 - RNA, 20 nt, Artificial Sequence
  MKO10057201_A_Ugu1a2
  gRNA
gggggcaccacaccugcgcc

SEQ ID NO: 57202 - RNA, 20 nt, Artificial Sequence
  MKO10057202_A_Ugu1a2
  gRNA
gagguccuguggcgcuacac

SEQ ID NO: 57203 - RNA, 20 nt, Artificial Sequence
  MKO10057203_A_Ugu1a5
  gRNA
uccccgaguuuccaugcgcu

SEQ ID NO: 57204 - RNA, 20 nt, Artificial Sequence
  MKO10057204_A_Ugu1a5
  gRNA
gggggcaccacaccugcgcc

SEQ ID NO: 57205 - RNA, 20 nt, Artificial Sequence
  MKO10057205_A_Ugu1a5
  gRNA
gagguccuguggcgcuacac

SEQ ID NO: 57206 - RNA, 20 nt, Artificial Sequence
  MKO10057206_A_Ugu1a6a
  gRNA
uccccgaguuuccaugcgcu

SEQ ID NO: 57207 - RNA, 20 nt, Artificial Sequence
  MKO10057207_A_Ugu1a6a
  gRNA
gggggcaccacaccugcgcc

SEQ ID NO: 57208 - RNA, 20 nt, Artificial Sequence
  MKO10057208_A_Ugu1a6a
  gRNA
gagguccuguggcgcuacac

SEQ ID NO: 57209 - RNA, 20 nt, Artificial Sequence
  MKO10057209_A_Ugu1a6b
  gRNA
uccccgaguuuccaugcgcu

SEQ ID NO: 57210 - RNA, 20 nt, Artificial Sequence
  MKO10057210_A_Ugu1a6b
  gRNA
gggggcaccacaccugcgcc

SEQ ID NO: 57211 - RNA, 20 nt, Artificial Sequence
  MKO10057211_A_Ugu1a6b
  gRNA
gagguccuguggcgcuacac

SEQ ID NO: 57212 - RNA, 20 nt, Artificial Sequence
  MKO10057212_A_Ugu1a7c
  gRNA
uccccgaguuuccaugcgcu

SEQ ID NO: 57213 - RNA, 20 nt, Artificial Sequence
  MKO10057213_A_Ugu1a7c
  gRNA
gggggcaccacaccugcgcc

SEQ ID NO: 57214 - RNA, 20 nt, Artificial Sequence
  MKO10057214_A_Ugu1a7c
  gRNA
gagguccuguggcgcuacac

SEQ ID NO: 57215 - RNA, 20 nt, Artificial Sequence
  MKO10057215_A_Ugu1a9
  gRNA
uccccgaguuuccaugcgcu

SEQ ID NO: 57216 - RNA, 20 nt, Artificial Sequence
  MKO10057216_A_Ugu1a9
  gRNA
gggggcaccacaccugcgcc

SEQ ID NO: 57217 - RNA, 20 nt, Artificial Sequence
  MKO10057217_A_Ugu1a9
  gRNA
gagguccuguggcgcuacac

SEQ ID NO: 57218 - RNA, 20 nt, Artificial Sequence
  MKO10057218_A_Ugu2a1
  gRNA
ccaauacaagacuguuugau

SEQ ID NO: 57219 - RNA, 20 nt, Artificial Sequence
  MKO10057219_A_Ugu2a1
  gRNA
uacugaccuucugaggaauc

SEQ ID NO: 57220 - RNA, 20 nt, Artificial Sequence
  MKO10057220_A_Ugu2a1
  gRNA
ccaaucaaacagucuuguau

SEQ ID NO: 57221 - RNA, 20 nt, Artificial Sequence
  MKO10057221_A_Ugu2a2
  gRNA
ccaauacaagacuguuugau

SEQ ID NO: 57222 - RNA, 20 nt, Artificial Sequence
  MKO10057222_A_Ugu2a2
  gRNA
uacugaccuucugaggaauc

SEQ ID NO: 57223 - RNA, 20 nt, Artificial Sequence
  MKO10057223_A_Ugu2a2
  gRNA
ccaaucaaacagucuuguau

SEQ ID NO: 57224 - RNA, 20 nt, Artificial Sequence
  MKO10057224_A_Ugu2a3
  gRNA
gccucacaacaucgcucaca

SEQ ID NO: 57225 - RNA, 20 nt, Artificial Sequence
  MKO10057225_A_Ugu2a3
  gRNA
auggugggcguucccauguu

SEQ ID NO: 57226 - RNA, 20 nt, Artificial Sequence
  MKO10057226_A_Ugu2a3
  gRNA
cacagucuuacagaacguug

SEQ ID NO: 57227 - RNA, 20 nt, Artificial Sequence
  MKO10057227_A_Ugu2b1
  gRNA
uauggcucguucgaaccuuc

SEQ ID NO: 57228 - RNA, 20 nt, Artificial Sequence
  MKO10057228_A_Ugu2b1
  gRNA
ccacuuguagagccgagugu

SEQ ID NO: 57229 - RNA, 20 nt, Artificial Sequence
  MKO10057229_A_Ugu2b1
  gRNA
uauuaaccacauaguagcca

SEQ ID NO: 57230 - RNA, 20 nt, Artificial Sequence
  MKO10057230_A_Ugu2b34
  gRNA
ccauuuguacagacgagugu

SEQ ID NO: 57231 - RNA, 20 nt, Artificial Sequence
  MKO10057231_A_Ugu2b34
  gRNA
accaugaguuauaaacgcuc

SEQ ID NO: 57232 - RNA, 20 nt, Artificial Sequence
  MKO10057232_A_Ugu2b34
  gRNA
cauagucucugagagugucg

SEQ ID NO: 57233 - RNA, 20 nt, Artificial Sequence
  MKO10057233_A_Ugu2b35
  gRNA
aagggcccaagaaauugcgu

SEQ ID NO: 57234 - RNA, 20 nt, Artificial Sequence
  MKO10057234_A_Ugu2b35
  gRNA
uggcgcgaauggacucuaug

SEQ ID NO: 57235 - RNA, 20 nt, Artificial Sequence
  MKO10057235_A_Ugu2b35
  gRNA
ugugguucauaagauccuac

SEQ ID NO: 57236 - RNA, 20 nt, Artificial Sequence
  MKO10057236_A_Ugu2b36
  gRNA
uggcgcgaauggacucuacg

SEQ ID NO: 57237 - RNA, 20 nt, Artificial Sequence
  MKO10057237_A_Ugu2b36
  gRNA
ugaauaucagaacgauguca

SEQ ID NO: 57238 - RNA, 20 nt, Artificial Sequence
  MKO10057238_A_Ugu2b36
  gRNA
ccuccaacauaguaaacauu

SEQ ID NO: 57239 - RNA, 20 nt, Artificial Sequence
  MKO10057239_A_Ugu2b37
  gRNA
gauugccucauagacacugu

SEQ ID NO: 57240 - RNA, 20 nt, Artificial Sequence
  MKO10057240_A_Ugu2b37
  gRNA
gagaaaagaccacuacacca

SEQ ID NO: 57241 - RNA, 20 nt, Artificial Sequence
  MKO10057241_A_Ugu2b37
  gRNA
uggggccaacagugucuaug

SEQ ID NO: 57242 - RNA, 20 nt, Artificial Sequence
  MKO10057242_A_Ugu2b38
  gRNA
aagggcccaugcaauugugu

SEQ ID NO: 57243 - RNA, 20 nt, Artificial Sequence
  MKO10057243_A_Ugu2b38
  gRNA
uggggccaauggugucuaug

SEQ ID NO: 57244 - RNA, 20 nt, Artificial Sequence
  MKO10057244_A_Ugu2b38
  gRNA
gaucaccucauagacaccau

SEQ ID NO: 57245 - RNA, 20 nt, Artificial Sequence
  MKO10057245_A_Ugu2b5
  gRNA
gaucgccucguagacaccau

SEQ ID NO: 57246 - RNA, 20 nt, Artificial Sequence
  MKO10057246_A_Ugu2b5
  gRNA
uggggccaauggugucuacg

SEQ ID NO: 57247 - RNA, 20 nt, Artificial Sequence
  MKO10057247_A_Ugu2b5
  gRNA
aagggcccaugcaauugcgu

SEQ ID NO: 57248 - RNA, 20 nt, Artificial Sequence
  MKO10057248_A_Ugu3a1
  gRNA
cgugugucgcaaauucugca

SEQ ID NO: 57249 - RNA, 20 nt, Artificial Sequence
  MKO10057249_A_Ugu3a1
  gRNA
cuuauagacgaauaugcuua

SEQ ID NO: 57250 - RNA, 20 nt, Artificial Sequence
  MKO10057250_A_Ugu3a1
  gRNA
aaagaugucccuucgcuucu

SEQ ID NO: 57251 - RNA, 20 nt, Artificial Sequence
  MKO10057251_A_Ugu3a2
  gRNA
ucaguaugacagcacuaucc

SEQ ID NO: 57252 - RNA, 20 nt, Artificial Sequence
  MKO10057252_A_Ugu3a2
  gRNA
gcauaggacaagggggcgcu

SEQ ID NO: 57253 - RNA, 20 nt, Artificial Sequence
  MKO10057253_A_Ugu3a2
  gRNA
caugaagaacuugcgacaca

SEQ ID NO: 57254 - RNA, 20 nt, Artificial Sequence
  MKO10057254_A_Ugu8a
  gRNA
aacccggccacccugucaau

SEQ ID NO: 57255 - RNA, 20 nt, Artificial Sequence
  MKO10057255_A_Ugu8a
  gRNA
ucguguuaaacacgaaaaga

SEQ ID NO: 57256 - RNA, 20 nt, Artificial Sequence
  MKO10057256_A_Ugu8a
  gRNA
gcauggggaucuuguuagaa

SEQ ID NO: 57257 - RNA, 20 nt, Artificial Sequence
  MKO10057257_A_Uhmk1
  gRNA
gcacugugcccgagauguuc

SEQ ID NO: 57258 - RNA, 20 nt, Artificial Sequence
  MKO10057258_A_Uhmk1
  gRNA
acucauucuccgcacuccac

SEQ ID NO: 57259 - RNA, 20 nt, Artificial Sequence
  MKO10057259_A_Uhmk1
  gRNA
uuuccaguaaaaugauuccg

SEQ ID NO: 57260 - RNA, 20 nt, Artificial Sequence
  MKO10057260_A_Uhrf1bp1l
  gRNA
gcaaucggugacggaccguu

SEQ ID NO: 57261 - RNA, 20 nt, Artificial Sequence
  MKO10057261_A_Uhrf1bp1l
  gRNA
ccugaauccgaguaaaucuc

SEQ ID NO: 57262 - RNA, 20 nt, Artificial Sequence
  MKO10057262_A_Uhrf1bp1l
  gRNA
ucaccgauugcaacugccuc

SEQ ID NO: 57263 - RNA, 20 nt, Artificial Sequence
  MKO10057263_A_Uhrf1bp1
  gRNA
cgcaucacugauccccgccg

SEQ ID NO: 57264 - RNA, 20 nt, Artificial Sequence
  MKO10057264_A_Uhrf1bp1
  gRNA
guuauagugucaaccccaac

SEQ ID NO: 57265 - RNA, 20 nt, Artificial Sequence
  MKO10057265_A_Uhrf1bp1
  gRNA
ggcgauaggagacugcccgu

SEQ ID NO: 57266 - RNA, 20 nt, Artificial Sequence
  MKO10057266_A_Uhrf1
  gRNA
ucacagugcgagcacgagca

SEQ ID NO: 57267 - RNA, 20 nt, Artificial Sequence
  MKO10057267_A_Uhrf1
  gRNA
gacucuggcgcacgagcagc

SEQ ID NO: 57268 - RNA, 20 nt, Artificial Sequence
  MKO10057268_A_Uhrf1
  gRNA
ucccauccauaguucgaacc

SEQ ID NO: 57269 - RNA, 20 nt, Artificial Sequence
  MKO10057269_A_Uhrf2
  gRNA
acuuuauuugacuacgacgu

SEQ ID NO: 57270 - RNA, 20 nt, Artificial Sequence
  MKO10057270_A_Uhrf2
  gRNA
ugagucugaauuagacguag

SEQ ID NO: 57271 - RNA, 20 nt, Artificial Sequence
  MKO10057271_A_Uhrf2
  gRNA
gaugccagagaugucggccu

SEQ ID NO: 57272 - RNA, 20 nt, Artificial Sequence
  MKO10057272_A_Uimc1
  gRNA
gacccuuaccugaccacgac

SEQ ID NO: 57273 - RNA, 20 nt, Artificial Sequence
  MKO10057273_A_Uimc1
  gRNA
gaagaaccaacaaccagucg

SEQ ID NO: 57274 - RNA, 20 nt, Artificial Sequence
  MKO10057274_A_Uimc1
  gRNA
ugcuaccagaucucgaccuc

SEQ ID NO: 57275 - RNA, 20 nt, Artificial Sequence
  MKO10057275_A_Ulbp1
  gRNA
uccgaagaucaauccgagaa

SEQ ID NO: 57276 - RNA, 20 nt, Artificial Sequence
  MKO10057276_A_Ulbp1
  gRNA
cacgcauagaauaaucauca

SEQ ID NO: 57277 - RNA, 20 nt, Artificial Sequence
  MKO10057277_A_Ulbp1
  gRNA
ucucgaauucaugauccagu

SEQ ID NO: 57278 - RNA, 20 nt, Artificial Sequence
  MKO10057278_A_Ulk1
  gRNA
acuaaagcacgaaaacaucg

SEQ ID NO: 57279 - RNA, 20 nt, Artificial Sequence
  MKO10057279_A_Ulk1
  gRNA
aauggcuaauucugucuacc

SEQ ID NO: 57280 - RNA, 20 nt, Artificial Sequence
  MKO10057280_A_Ulk1
  gRNA
cacugugcagguagucagcc

SEQ ID NO: 57281 - RNA, 20 nt, Artificial Sequence
  MKO10057281_A_Ulk2
  gRNA
cguagcgcucuaugauguuc

SEQ ID NO: 57282 - RNA, 20 nt, Artificial Sequence
  MKO10057282_A_Ulk2
  gRNA
acuuaucaguauugcaaugg

SEQ ID NO: 57283 - RNA, 20 nt, Artificial Sequence
  MKO10057283_A_Ulk2
  gRNA
uaccuugcaaauaaucugcc

SEQ ID NO: 57284 - RNA, 20 nt, Artificial Sequence
  MKO10057284_A_Ulk3
  gRNA
gcggcaguaugaugcgcgug

SEQ ID NO: 57285 - RNA, 20 nt, Artificial Sequence
  MKO10057285_A_Ulk3
  gRNA
gacgaaaaacacgugcuccg

SEQ ID NO: 57286 - RNA, 20 nt, Artificial Sequence
  MKO10057286_A_Ulk3
  gRNA
gagagauguuucguucaugc

SEQ ID NO: 57287 - RNA, 20 nt, Artificial Sequence
  MKO10057287_A_Ulk4
  gRNA
aacucucucacgacaucuuc

SEQ ID NO: 57288 - RNA, 20 nt, Artificial Sequence
  MKO10057288_A_Ulk4
  gRNA
ucaguccccuucacgauuuc

SEQ ID NO: 57289 - RNA, 20 nt, Artificial Sequence
  MKO10057289_A_Ulk4
  gRNA
ucuagaaaccgugauugcuc

SEQ ID NO: 57290 - RNA, 20 nt, Artificial Sequence
  MKO10057290_A_Umodl1
  gRNA
uuggcuaccgucaugagccg

SEQ ID NO: 57291 - RNA, 20 nt, Artificial Sequence
  MKO10057291_A_Umodl1
  gRNA
guacacuaccugaccucgac

SEQ ID NO: 57292 - RNA, 20 nt, Artificial Sequence
  MKO10057292_A_Umodl1
  gRNA
gacacacaguggcggccccc

SEQ ID NO: 57293 - RNA, 20 nt, Artificial Sequence
  MKO10057293_A_Umod
  gRNA
gugccgccguguugcaucgc

SEQ ID NO: 57294 - RNA, 20 nt, Artificial Sequence
  MKO10057294_A_Umod
  gRNA
gccgugcagacccgcgucac

SEQ ID NO: 57295 - RNA, 20 nt, Artificial Sequence
  MKO10057295_A_Umod
  gRNA
uauugcagauccuaguuccg

SEQ ID NO: 57296 - RNA, 20 nt, Artificial Sequence
  MKO10057296_A_Umps
  gRNA
gugaaugcucacgucgugcc

SEQ ID NO: 57297 - RNA, 20 nt, Artificial Sequence
  MKO10057297_A_Umps
  gRNA
ggaaaagaucgacgcugaca

SEQ ID NO: 57298 - RNA, 20 nt, Artificial Sequence
  MKO10057298_A_Umps
  gRNA
gacguccucaaugaccagac

SEQ ID NO: 57299 - RNA, 20 nt, Artificial Sequence
  MKO10057299_A_Unc119b
  gRNA
cgcauacguacugacguccu

SEQ ID NO: 57300 - RNA, 20 nt, Artificial Sequence
  MKO10057300_A_Unc119b
  gRNA
ugaucgagcggcacuacuuc

SEQ ID NO: 57301 - RNA, 20 nt, Artificial Sequence
  MKO10057301_A_Unc119b
  gRNA
uuucuucgccuccggaccgu

SEQ ID NO: 57302 - RNA, 20 nt, Artificial Sequence
  MKO10057302_A_Unc119
  gRNA
gcgaacaaagcgcccugcau

SEQ ID NO: 57303 - RNA, 20 nt, Artificial Sequence
  MKO10057303_A_Unc119
  gRNA
guccaggucccgccgguuga

SEQ ID NO: 57304 - RNA, 20 nt, Artificial Sequence
  MKO10057304_A_Unc119
  gRNA
acaacuuccgcaugaucgag

SEQ ID NO: 57305 - RNA, 20 nt, Artificial Sequence
  MKO10057305_A_Unc13a
  gRNA
caacacauacgugacgcuga

SEQ ID NO: 57306 - RNA, 20 nt, Artificial Sequence
  MKO10057306_A_Unc13a
  gRNA
gcagcucgaaaugagcgucc

SEQ ID NO: 57307 - RNA, 20 nt, Artificial Sequence
  MKO10057307_A_Unc13a
  gRNA
accuugggcaccgucaaacu

SEQ ID NO: 57308 - RNA, 20 nt, Artificial Sequence
  MKO10057308_A_Unc13b
  gRNA
cacuaaccucauccgacuga

SEQ ID NO: 57309 - RNA, 20 nt, Artificial Sequence
  MKO10057309_A_Unc13b
  gRNA
acugaagacaauccgucagu

SEQ ID NO: 57310 - RNA, 20 nt, Artificial Sequence
  MKO10057310_A_Unc13b
  gRNA
caguugugcucuucacguuc

SEQ ID NO: 57311 - RNA, 20 nt, Artificial Sequence
  MKO10057311_A_Unc13c
  gRNA
uuacuuacccaccgaacacc

SEQ ID NO: 57312 - RNA, 20 nt, Artificial Sequence
  MKO10057312_A_Unc13c
  gRNA
auagcaugccugaccuccgc

SEQ ID NO: 57313 - RNA, 20 nt, Artificial Sequence
  MKO10057313_A_Unc13c
  gRNA
uuccaaauucuccgcacucc

SEQ ID NO: 57314 - RNA, 20 nt, Artificial Sequence
  MKO10057314_A_Unc13d
  gRNA
agcagaugcugcggcgcguc

SEQ ID NO: 57315 - RNA, 20 nt, Artificial Sequence
  MKO10057315_A_Unc13d
  gRNA
cuauacuguccugcaccgcc

SEQ ID NO: 57316 - RNA, 20 nt, Artificial Sequence
  MKO10057316_A_Unc13d
  gRNA
ucagcgggaccugcuguaug

SEQ ID NO: 57317 - RNA, 20 nt, Artificial Sequence
  MKO10057317_A_Unc45a
  gRNA
ggggcgucgcgccgagacuc

SEQ ID NO: 57318 - RNA, 20 nt, Artificial Sequence
  MKO10057318_A_Unc45a
  gRNA
gagucucggcgcgacgcccc

SEQ ID NO: 57319 - RNA, 20 nt, Artificial Sequence
  MKO10057319_A_Unc45a
  gRNA
caauguuccucagcgacucc

SEQ ID NO: 57320 - RNA, 20 nt, Artificial Sequence
  MKO10057320_A_Unc45b
  gRNA
uucaaacaucgucuguaccc

SEQ ID NO: 57321 - RNA, 20 nt, Artificial Sequence
  MKO10057321_A_Unc45b
  gRNA
uucucaggagagcuacgccc

SEQ ID NO: 57322 - RNA, 20 nt, Artificial Sequence
  MKO10057322_A_Unc45b
  gRNA
gcuuaccugcucuuggaugc

SEQ ID NO: 57323 - RNA, 20 nt, Artificial Sequence
  MKO10057323_A_Unc50
  gRNA
guucgucuccaacaaguacc

SEQ ID NO: 57324 - RNA, 20 nt, Artificial Sequence
  MKO10057324_A_Unc50
  gRNA
agcccguacagcaccaugag

SEQ ID NO: 57325 - RNA, 20 nt, Artificial Sequence
  MKO10057325_A_Unc50
  gRNA
guacgggcugucgcuggcac

SEQ ID NO: 57326 - RNA, 20 nt, Artificial Sequence
  MKO10057326_A_Unc5a
  gRNA
ccgucgccgaagcgccucug

SEQ ID NO: 57327 - RNA, 20 nt, Artificial Sequence
  MKO10057327_A_Unc5a
  gRNA
agguccggaucaacguauca

SEQ ID NO: 57328 - RNA, 20 nt, Artificial Sequence
  MKO10057328_A_Unc5a
  gRNA
ccgcagaggcgcuucggcga

SEQ ID NO: 57329 - RNA, 20 nt, Artificial Sequence
  MKO10057329_A_Unc5b
  gRNA
acggccacagucaucgucua

SEQ ID NO: 57330 - RNA, 20 nt, Artificial Sequence
  MKO10057330_A_Unc5b
  gRNA
gcagcugccguacuuccuau

SEQ ID NO: 57331 - RNA, 20 nt, Artificial Sequence
  MKO10057331_A_Unc5b
  gRNA
gcgcuuggccacgauauucu

SEQ ID NO: 57332 - RNA, 20 nt, Artificial Sequence
  MKO10057332_A_Unc5cl
  gRNA
ccgcgcaugcgucccccgug

SEQ ID NO: 57333 - RNA, 20 nt, Artificial Sequence
  MKO10057333_A_Unc5cl
  gRNA
ugggccagacagcccgcaag

SEQ ID NO: 57334 - RNA, 20 nt, Artificial Sequence
  MKO10057334_A_Unc5cl
  gRNA
agccggggacucauaucucc

SEQ ID NO: 57335 - RNA, 20 nt, Artificial Sequence
  MKO10057335_A_Unc5c
  gRNA
ucugcggaagacauucgagc

SEQ ID NO: 57336 - RNA, 20 nt, Artificial Sequence
  MKO10057336_A_Unc5c
  gRNA
cuacucucucgucuacuacg

SEQ ID NO: 57337 - RNA, 20 nt, Artificial Sequence
  MKO10057337_A_Unc5c
  gRNA
ucccuucagguggccgacac

SEQ ID NO: 57338 - RNA, 20 nt, Artificial Sequence
  MKO10057338_A_Unc5d
  gRNA
gcugcauugucgcccgccag

SEQ ID NO: 57339 - RNA, 20 nt, Artificial Sequence
  MKO10057339_A_Unc5d
  gRNA
agagcaacccgauugcacuc

SEQ ID NO: 57340 - RNA, 20 nt, Artificial Sequence
  MKO10057340_A_Unc5d
  gRNA
aacgcugccucauuucaucg

SEQ ID NO: 57341 - RNA, 20 nt, Artificial Sequence
  MKO10057341_A_Unc79
  gRNA
cgagaugcuccuucagaacg

SEQ ID NO: 57342 - RNA, 20 nt, Artificial Sequence
  MKO10057342_A_Unc79
  gRNA
guucugaaggagcaucucgc

SEQ ID NO: 57343 - RNA, 20 nt, Artificial Sequence
  MKO10057343_A_Unc79
  gRNA
aacauuuaucccguaccauc

SEQ ID NO: 57344 - RNA, 20 nt, Artificial Sequence
  MKO10057344_A_Unc80
  gRNA
gcaguccuuugaacgagugu

SEQ ID NO: 57345 - RNA, 20 nt, Artificial Sequence
  MKO10057345_A_Unc80
  gRNA
ccgaagcagcucccaugaug

SEQ ID NO: 57346 - RNA, 20 nt, Artificial Sequence
  MKO10057346_A_Unc80
  gRNA
aucugaucucaccuuccgac

SEQ ID NO: 57347 - RNA, 20 nt, Artificial Sequence
  MKO10057347_A_Unc93a
  gRNA
ugaguacuguugguggccgc

SEQ ID NO: 57348 - RNA, 20 nt, Artificial Sequence
  MKO10057348_A_Unc93a
  gRNA
cuuuguagaagccaucccag

SEQ ID NO: 57349 - RNA, 20 nt, Artificial Sequence
  MKO10057349_A_Unc93a
  gRNA
gagcagccucuacagugagc

SEQ ID NO: 57350 - RNA, 20 nt, Artificial Sequence
  MKO10057350_A_Unc93b1
  gRNA
uacuaccgccgcaagcgccu

SEQ ID NO: 57351 - RNA, 20 nt, Artificial Sequence
  MKO10057351_A_Unc93b1
  gRNA
ccagguagacgccguaagua

SEQ ID NO: 57352 - RNA, 20 nt, Artificial Sequence
  MKO10057352_A_Unc93b1
  gRNA
guaguagcguucccaguagu

SEQ ID NO: 57353 - RNA, 20 nt, Artificial Sequence
  MKO10057353_A_Uncx
  gRNA
gccucgcgcauaaacacguc

SEQ ID NO: 57354 - RNA, 20 nt, Artificial Sequence
  MKO10057354_A_Uncx
  gRNA
cgcccagcgagcccccgaac

SEQ ID NO: 57355 - RNA, 20 nt, Artificial Sequence
  MKO10057355_A_Uncx
  gRNA
gaccggccagcucguacacg

SEQ ID NO: 57356 - RNA, 20 nt, Artificial Sequence
  MKO10057356_A_Ung
  gRNA
cgggaagccguacuucguca

SEQ ID NO: 57357 - RNA, 20 nt, Artificial Sequence
  MKO10057357_A_Ung
  gRNA
ccaccgaccuugacgaagua

SEQ ID NO: 57358 - RNA, 20 nt, Artificial Sequence
  MKO10057358_A_Ung
  gRNA
uugucagggugggcccgaca

SEQ ID NO: 57359 - RNA, 20 nt, Artificial Sequence
  MKO10057359_A_Unkl
  gRNA
agcgcucaccugucaaucca

SEQ ID NO: 57360 - RNA, 20 nt, Artificial Sequence
  MKO10057360_A_Unkl
  gRNA
gccggucacugucugccaca

SEQ ID NO: 57361 - RNA, 20 nt, Artificial Sequence
  MKO10057361_A_Unkl
  gRNA
ucaggucugaacggcguucc

SEQ ID NO: 57362 - RNA, 20 nt, Artificial Sequence
  MKO10057362_A_Unk
  gRNA
gggcacucacucgucgcccu

SEQ ID NO: 57363 - RNA, 20 nt, Artificial Sequence
  MKO10057363_A_Unk
  gRNA
cuacugcacgaaguaugacg

SEQ ID NO: 57364 - RNA, 20 nt, Artificial Sequence
  MKO10057364_A_Unk
  gRNA
gcuccccuguuuacgacauc

SEQ ID NO: 57365 - RNA, 20 nt, Artificial Sequence
  MKO10057365_A_Uox
  gRNA
cacucgagcccacgucuacg

SEQ ID NO: 57366 - RNA, 20 nt, Artificial Sequence
  MKO10057366_A_Uox
  gRNA
caagaacacugugcacgucc

SEQ ID NO: 57367 - RNA, 20 nt, Artificial Sequence
  MKO10057367_A_Uox
  gRNA
cgaaguccacgucccgucuc

SEQ ID NO: 57368 - RNA, 20 nt, Artificial Sequence
  MKO10057368_A_Upb1
  gRNA
augcccccagaucgugcgcg

SEQ ID NO: 57369 - RNA, 20 nt, Artificial Sequence
  MKO10057369_A_Upb1
  gRNA
cgagccccacgcgcacgauc

SEQ ID NO: 57370 - RNA, 20 nt, Artificial Sequence
  MKO10057370_A_Upb1
  gRNA
ucucguguacaaaaagcgaa

SEQ ID NO: 57371 - RNA, 20 nt, Artificial Sequence
  MKO10057371_A_Upf1
  gRNA
acauugugaaucaccucgug

SEQ ID NO: 57372 - RNA, 20 nt, Artificial Sequence
  MKO10057372_A_Upf1
  gRNA
accucccaguccacgccugc

SEQ ID NO: 57373 - RNA, 20 nt, Artificial Sequence
  MKO10057373_A_Upf1
  gRNA
uuacaguaaaccacgcaggc

SEQ ID NO: 57374 - RNA, 20 nt, Artificial Sequence
  MKO10057374_A_Upf2
  gRNA
ggaacgccaucaauuacgaa

SEQ ID NO: 57375 - RNA, 20 nt, Artificial Sequence
  MKO10057375_A_Upf2
  gRNA
ggguguaaauaugucgauuc

SEQ ID NO: 57376 - RNA, 20 nt, Artificial Sequence
  MKO10057376_A_Upf2
  gRNA
ucaguccuuagcggaccuuu

SEQ ID NO: 57377 - RNA, 20 nt, Artificial Sequence
  MKO10057377_A_Upf3a
  gRNA
accucgaaguaaucgugcgc

SEQ ID NO: 57378 - RNA, 20 nt, Artificial Sequence
  MKO10057378_A_Upf3a
  gRNA
cgcuagucccgagacgcugc

SEQ ID NO: 57379 - RNA, 20 nt, Artificial Sequence
  MKO10057379_A_Upf3a
  gRNA
ugaagauauagccgucaaaa

SEQ ID NO: 57380 - RNA, 20 nt, Artificial Sequence
  MKO10057380_A_Upf3b
  gRNA
aacucaaaauaaucgugcuc

SEQ ID NO: 57381 - RNA, 20 nt, Artificial Sequence
  MKO10057381_A_Upf3b
  gRNA
gccaaaaaucgagaauuaau

SEQ ID NO: 57382 - RNA, 20 nt, Artificial Sequence
  MKO10057382_A_Upf3b
  gRNA
uauacucacccuuauuguca

SEQ ID NO: 57383 - RNA, 20 nt, Artificial Sequence
  MKO10057383_A_Upk1a
  gRNA
ccacugugcugucgucggac

SEQ ID NO: 57384 - RNA, 20 nt, Artificial Sequence
  MKO10057384_A_Upk1a
  gRNA
ccccacucacauagucgcgg

SEQ ID NO: 57385 - RNA, 20 nt, Artificial Sequence
  MKO10057385_A_Upk1a
  gRNA
guaccgcguguacccacuga

SEQ ID NO: 57386 - RNA, 20 nt, Artificial Sequence
  MKO10057386_A_Upk1b
  gRNA
ccccaaccaaugacgacgaa

SEQ ID NO: 57387 - RNA, 20 nt, Artificial Sequence
  MKO10057387_A_Upk1b
  gRNA
cuccaaguuugcaagcgucc

SEQ ID NO: 57388 - RNA, 20 nt, Artificial Sequence
  MKO10057388_A_Upk1b
  gRNA
auaacgaugcugacuacccc

SEQ ID NO: 57389 - RNA, 20 nt, Artificial Sequence
  MKO10057389_A_Upk2
  gRNA
agcucccugcgcccgcgaca

SEQ ID NO: 57390 - RNA, 20 nt, Artificial Sequence
  MKO10057390_A_Upk2
  gRNA
auuugcgggcacccagugcc

SEQ ID NO: 57391 - RNA, 20 nt, Artificial Sequence
  MKO10057391_A_Upk2
  gRNA
ugccuccaugucgcgggcgc

SEQ ID NO: 57392 - RNA, 20 nt, Artificial Sequence
  MKO10057392_A_Upk3a
  gRNA
cuuacgccgguugguccaga

SEQ ID NO: 57393 - RNA, 20 nt, Artificial Sequence
  MKO10057393_A_Upk3a
  gRNA
ccaucgacacguggcccggc

SEQ ID NO: 57394 - RNA, 20 nt, Artificial Sequence
  MKO10057394_A_Upk3a
  gRNA
accucguaagagccgcugag

SEQ ID NO: 57395 - RNA, 20 nt, Artificial Sequence
  MKO10057395_A_Upk3bl
  gRNA
aagcggauaugaccaguacg

SEQ ID NO: 57396 - RNA, 20 nt, Artificial Sequence
  MKO10057396_A_Upk3bl
  gRNA
gaugagugccgagggacccg

SEQ ID NO: 57397 - RNA, 20 nt, Artificial Sequence
  MKO10057397_A_Upk3bl
  gRNA
ggcuguaacucgccuuugcc

SEQ ID NO: 57398 - RNA, 20 nt, Artificial Sequence
  MKO10057398_A_Upk3b
  gRNA
ucugcggcacguaggcaauc

SEQ ID NO: 57399 - RNA, 20 nt, Artificial Sequence
  MKO10057399_A_Upk3b
  gRNA
cgaucauacagccgcuccgu

SEQ ID NO: 57400 - RNA, 20 nt, Artificial Sequence
  MKO10057400_A_Upk3b
  gRNA
acgugccgcagauaacagcc

SEQ ID NO: 57401 - RNA, 20 nt, Artificial Sequence
  MKO10057401_A_Upp1
  gRNA
caccaaccuggacgcgcagc

SEQ ID NO: 57402 - RNA, 20 nt, Artificial Sequence
  MKO10057402_A_Upp1
  gRNA
cggcuuuauacauggcguag

SEQ ID NO: 57403 - RNA, 20 nt, Artificial Sequence
  MKO10057403_A_Upp1
  gRNA
cucgugcaacaugaugccga

SEQ ID NO: 57404 - RNA, 20 nt, Artificial Sequence
  MKO10057404_A_Upp2
  gRNA
uacacaucguguguccgaug

SEQ ID NO: 57405 - RNA, 20 nt, Artificial Sequence
  MKO10057405_A_Upp2
  gRNA
aagaugaccugcucaaaucg

SEQ ID NO: 57406 - RNA, 20 nt, Artificial Sequence
  MKO10057406_A_Upp2
  gRNA
acuuacacugacggagagca

SEQ ID NO: 57407 - RNA, 20 nt, Artificial Sequence
  MKO10057407_A_Uprt
  gRNA
gcccugguuaccugucggag

SEQ ID NO: 57408 - RNA, 20 nt, Artificial Sequence
  MKO10057408_A_Uprt
  gRNA
gagacugcugucgauccaua

SEQ ID NO: 57409 - RNA, 20 nt, Artificial Sequence
  MKO10057409_A_Uprt
  gRNA
gaucagacuuguuguagaag

SEQ ID NO: 57410 - RNA, 20 nt, Artificial Sequence
  MKO10057410_A_Uqcc1
  gRNA
ggcuucuauuaucuucguga

SEQ ID NO: 57411 - RNA, 20 nt, Artificial Sequence
  MKO10057411_A_Uqcc1
  gRNA
gguguagaagaucaagaucg

SEQ ID NO: 57412 - RNA, 20 nt, Artificial Sequence
  MKO10057412_A_Uqcc1
  gRNA
ccgcauguacacgagcugcg

SEQ ID NO: 57413 - RNA, 20 nt, Artificial Sequence
  MKO10057413_A_Uqcc2
  gRNA
agauggccgcucuccgcuac

SEQ ID NO: 57414 - RNA, 20 nt, Artificial Sequence
  MKO10057414_A_Uqcc2
  gRNA
ccaguggacgagaccaaacg

SEQ ID NO: 57415 - RNA, 20 nt, Artificial Sequence
  MKO10057415_A_Uqcc2
  gRNA
aggagaaguuugcgcccacc

SEQ ID NO: 57416 - RNA, 20 nt, Artificial Sequence
  MKO10057416_A_Uqcr10
  gRNA
cuucgagcgagccuucgauc

SEQ ID NO: 57417 - RNA, 20 nt, Artificial Sequence
  MKO10057417_A_Uqcr10
  gRNA
cgcgucugcgcccugaucga

SEQ ID NO: 57418 - RNA, 20 nt, Artificial Sequence
  MKO10057418_A_Uqcr10
  gRNA
aaagcacaaguaugagaaca

SEQ ID NO: 57419 - RNA, 20 nt, Artificial Sequence
  MKO10057419_A_Uqcr11
  gRNA
ccuaccaggauucccacagc

SEQ ID NO: 57420 - RNA, 20 nt, Artificial Sequence
  MKO10057420_A_Uqcr11
  gRNA
caggaucagccgccaguccg

SEQ ID NO: 57421 - RNA, 20 nt, Artificial Sequence
  MKO10057421_A_Uqcr11
  gRNA
accaguuucuggccaguucc

SEQ ID NO: 57422 - RNA, 20 nt, Artificial Sequence
  MKO10057422_A_Uqcrb
  gRNA
aaaauggcgggccgaucugc

SEQ ID NO: 57423 - RNA, 20 nt, Artificial Sequence
  MKO10057423_A_Uqcrb
  gRNA
uaguuucagcaucaagcaag

SEQ ID NO: 57424 - RNA, 20 nt, Artificial Sequence
  MKO10057424_A_Uqcrb
  gRNA
guuucgaauuaagagagccc

SEQ ID NO: 57425 - RNA, 20 nt, Artificial Sequence
  MKO10057425_A_Uqcrc1
  gRNA
ggguaccgcaaccuucgccc

SEQ ID NO: 57426 - RNA, 20 nt, Artificial Sequence
  MKO10057426_A_Uqcrc1
  gRNA
gaagguugcgguaccccgca

SEQ ID NO: 57427 - RNA, 20 nt, Artificial Sequence
  MKO10057427_A_Uqcrc1
  gRNA
ccuggaaugcugucgcaugc

SEQ ID NO: 57428 - RNA, 20 nt, Artificial Sequence
  MKO10057428_A_Uqcrc2
  gRNA
ugcaagacguaguaaaugug

SEQ ID NO: 57429 - RNA, 20 nt, Artificial Sequence
  MKO10057429_A_Uqcrc2
  gRNA
aacauggcguacacuguaga

SEQ ID NO: 57430 - RNA, 20 nt, Artificial Sequence
  MKO10057430_A_Uqcrc2
  gRNA
acuacgucuugcaucuaguu

SEQ ID NO: 57431 - RNA, 20 nt, Artificial Sequence
  MKO10057431_A_Uqcrfs1
  gRNA
guugucggucgccgcccgcu

SEQ ID NO: 57432 - RNA, 20 nt, Artificial Sequence
  MKO10057432_A_Uqcrfs1
  gRNA
cccguucgcgcccguccuau

SEQ ID NO: 57433 - RNA, 20 nt, Artificial Sequence
  MKO10057433_A_Uqcrfs1
  gRNA
gagugcuucugcugacguac

SEQ ID NO: 57434 - RNA, 20 nt, Artificial Sequence
  MKO10057434_A_Uqcrh
  gRNA
gugauaaucgcgugucuucc

SEQ ID NO: 57435 - RNA, 20 nt, Artificial Sequence
  MKO10057435_A_Uqcrh
  gRNA
aauccucuucugucugugac

SEQ ID NO: 57436 - RNA, 20 nt, Artificial Sequence
  MKO10057436_A_Uqcrh
  gRNA
ggaagaagaggaagaacuag

SEQ ID NO: 57437 - RNA, 20 nt, Artificial Sequence
  MKO10057437_A_Uqcrq
  gRNA
ucacgugccguauccgcgcc

SEQ ID NO: 57438 - RNA, 20 nt, Artificial Sequence
  MKO10057438_A_Uqcrq
  gRNA
gucaccaugggccgcgaguu

SEQ ID NO: 57439 - RNA, 20 nt, Artificial Sequence
  MKO10057439_A_Uqcrq
  gRNA
gaucccuacagcguuuguag

SEQ ID NO: 57440 - RNA, 20 nt, Artificial Sequence
  MKO10057440_A_Urad
  gRNA
gcacaguggcacggucgcuc

SEQ ID NO: 57441 - RNA, 20 nt, Artificial Sequence
  MKO10057441_A_Urad
  gRNA
cuagccuagacaccgacgac

SEQ ID NO: 57442 - RNA, 20 nt, Artificial Sequence
  MKO10057442_A_Urad
  gRNA
auugaugcucucccgagauc

SEQ ID NO: 57443 - RNA, 20 nt, Artificial Sequence
  MKO10057443_A_Urah
  gRNA
ucuucgacacagagcgcuac

SEQ ID NO: 57444 - RNA, 20 nt, Artificial Sequence
  MKO10057444_A_Urah
  gRNA
gcccaggacagcgaccgucc

SEQ ID NO: 57445 - RNA, 20 nt, Artificial Sequence
  MKO10057445_A_Urah
  gRNA
ugucuagaacgugaguaguc

SEQ ID NO: 57446 - RNA, 20 nt, Artificial Sequence
  MKO10057446_A_Urb1
  gRNA
uguugucaucacccgcaauu

SEQ ID NO: 57447 - RNA, 20 nt, Artificial Sequence
  MKO10057447_A_Urb1
  gRNA
ugaucuuacgcauuuccacg

SEQ ID NO: 57448 - RNA, 20 nt, Artificial Sequence
  MKO10057448_A_Urb1
  gRNA
uacagggagugcaugacguc

SEQ ID NO: 57449 - RNA, 20 nt, Artificial Sequence
  MKO10057449_A_Urb2
  gRNA
aaaggacgaccacacaaucg

SEQ ID NO: 57450 - RNA, 20 nt, Artificial Sequence
  MKO10057450_A_Urb2
  gRNA
guuucacuucuaccgccgug

SEQ ID NO: 57451 - RNA, 20 nt, Artificial Sequence
  MKO10057451_A_Urb2
  gRNA
ccauuagagccgugaugauc

SEQ ID NO: 57452 - RNA, 20 nt, Artificial Sequence
  MKO10057452_A_Urgcp
  gRNA
acguccgcacaacaccccgc

SEQ ID NO: 57453 - RNA, 20 nt, Artificial Sequence
  MKO10057453_A_Urgcp
  gRNA
ugcgggguguugugcggacg

SEQ ID NO: 57454 - RNA, 20 nt, Artificial Sequence
  MKO10057454_A_Urgcp
  gRNA
ucucauagaugguacaaacg

SEQ ID NO: 57455 - RNA, 20 nt, Artificial Sequence
  MKO10057455_A_Uri1
  gRNA
caagcugucuuacgacguca

SEQ ID NO: 57456 - RNA, 20 nt, Artificial Sequence
  MKO10057456_A_Uri1
  gRNA
acgucguaagacagcuuguc

SEQ ID NO: 57457 - RNA, 20 nt, Artificial Sequence
  MKO10057457_A_Uri1
  gRNA
cuguggguuuaguugagcau

SEQ ID NO: 57458 - RNA, 20 nt, Artificial Sequence
  MKO10057458_A_Urm1
  gRNA
auauacggaaccuccuuguc

SEQ ID NO: 57459 - RNA, 20 nt, Artificial Sequence
  MKO10057459_A_Urm1
  gRNA
gccucagccgccgugcagug

SEQ ID NO: 57460 - RNA, 20 nt, Artificial Sequence
  MKO10057460_A_Urm1
  gRNA
ugcugauuaaugaugccgac

SEQ ID NO: 57461 - RNA, 20 nt, Artificial Sequence
  MKO10057461_A_Uroc1
  gRNA
ccguuagugaugaccagccg

SEQ ID NO: 57462 - RNA, 20 nt, Artificial Sequence
  MKO10057462_A_Uroc1
  gRNA
cacuugcccguugccuccgu

SEQ ID NO: 57463 - RNA, 20 nt, Artificial Sequence
  MKO10057463_A_Uroc1
  gRNA
guuccucagucaucuucgac

SEQ ID NO: 57464 - RNA, 20 nt, Artificial Sequence
  MKO10057464_A_Urod
  gRNA
gccggacgugugccacuaau

SEQ ID NO: 57465 - RNA, 20 nt, Artificial Sequence
  MKO10057465_A_Urod
  gRNA
cccccuuaaggcauugggca

SEQ ID NO: 57466 - RNA, 20 nt, Artificial Sequence
  MKO10057466_A_Urod
  gRNA
aaacagacuauacucccguu

SEQ ID NO: 57467 - RNA, 20 nt, Artificial Sequence
  MKO10057467_A_Uros
  gRNA
gccaagucuguguacguggu

SEQ ID NO: 57468 - RNA, 20 nt, Artificial Sequence
  MKO10057468_A_Uros
  gRNA
uccaaccacguacacagacu

SEQ ID NO: 57469 - RNA, 20 nt, Artificial Sequence
  MKO10057469_A_Uros
  gRNA
uugcaggagcugcgauugug

SEQ ID NO: 57470 - RNA, 20 nt, Artificial Sequence
  MKO10057470_A_Usb1
  gRNA
ucagauguuuguaccgagac

SEQ ID NO: 57471 - RNA, 20 nt, Artificial Sequence
  MKO10057471_A_Usb1
  gRNA
accgcauggccucuuuccaa

SEQ ID NO: 57472 - RNA, 20 nt, Artificial Sequence
  MKO10057472_A_Usb1
  gRNA
ugcuuugcacugucguccuc

SEQ ID NO: 57473 - RNA, 20 nt, Artificial Sequence
  MKO10057473_A_Use1
  gRNA
uccaaccgcgacgucgccag

SEQ ID NO: 57474 - RNA, 20 nt, Artificial Sequence
  MKO10057474_A_Use1
  gRNA
cagcgaguacucccgcaaag

SEQ ID NO: 57475 - RNA, 20 nt, Artificial Sequence
  MKO10057475_A_Use1
  gRNA
agcgacaaagcagccguacc

SEQ ID NO: 57476 - RNA, 20 nt, Artificial Sequence
  MKO10057476_A_Usf1
  gRNA
cagugacgaugccguugaca

SEQ ID NO: 57477 - RNA, 20 nt, Artificial Sequence
  MKO10057477_A_Usf1
  gRNA
acguacuugacguugggguc

SEQ ID NO: 57478 - RNA, 20 nt, Artificial Sequence
  MKO10057478_A_Usf1
  gRNA
uacgucuuccgaacugagaa

SEQ ID NO: 57479 - RNA, 20 nt, Artificial Sequence
  MKO10057479_A_Usf2
  gRNA
ggugacauaccgcguagucc

SEQ ID NO: 57480 - RNA, 20 nt, Artificial Sequence
  MKO10057480_A_Usf2
  gRNA
agccugcugcccccccgcga

SEQ ID NO: 57481 - RNA, 20 nt, Artificial Sequence
  MKO10057481_A_Usf2
  gRNA
ggucgccgaacgccgccugc

SEQ ID NO: 57482 - RNA, 20 nt, Artificial Sequence
  MKO10057482_A_Ush1c
  gRNA
aucaaacagcggcaggcggu

SEQ ID NO: 57483 - RNA, 20 nt, Artificial Sequence
  MKO10057483_A_Ush1c
  gRNA
ggcccgagaauuccgacaca

SEQ ID NO: 57484 - RNA, 20 nt, Artificial Sequence
  MKO10057484_A_Ush1c
  gRNA
cucggccucagcgugcgugg

SEQ ID NO: 57485 - RNA, 20 nt, Artificial Sequence
  MKO10057485_A_Ush1g
  gRNA
gcgcaagcaccacgagcgca

SEQ ID NO: 57486 - RNA, 20 nt, Artificial Sequence
  MKO10057486_A_Ush1g
  gRNA
aaaagcguccgaucgcucuc

SEQ ID NO: 57487 - RNA, 20 nt, Artificial Sequence
  MKO10057487_A_Ush1g
  gRNA
auggcaugaccccgacucuc

SEQ ID NO: 57488 - RNA, 20 nt, Artificial Sequence
  MKO10057488_A_Ush2a
  gRNA
cagccgugacauucgaugcu

SEQ ID NO: 57489 - RNA, 20 nt, Artificial Sequence
  MKO10057489_A_Ush2a
  gRNA
cagccacauugccgaugucc

SEQ ID NO: 57490 - RNA, 20 nt, Artificial Sequence
  MKO10057490_A_Ush2a
  gRNA
gucuccagcgugauacaagu

SEQ ID NO: 57491 - RNA, 20 nt, Artificial Sequence
  MKO10057491_A_Ushbp1
  gRNA
agucucgaagcguccauugu

SEQ ID NO: 57492 - RNA, 20 nt, Artificial Sequence
  MKO10057492_A_Ushbp1
  gRNA
gcuuagcgagugguggcgca

SEQ ID NO: 57493 - RNA, 20 nt, Artificial Sequence
  MKO10057493_A_Ushbp1
  gRNA
uggagucacuccggaggcgu

SEQ ID NO: 57494 - RNA, 20 nt, Artificial Sequence
  MKO10057494_A_Usmg5
  gRNA
uuacauucauucuaccugug

SEQ ID NO: 57495 - RNA, 20 nt, Artificial Sequence
  MKO10057495_A_Usmg5
  gRNA
caguguguccuggccacaua

SEQ ID NO: 57496 - RNA, 20 nt, Artificial Sequence
  MKO10057496_A_Usmg5
  gRNA
auggcuggugcagaaaguga

SEQ ID NO: 57497 - RNA, 20 nt, Artificial Sequence
  MKO10057497_A_Uso1
  gRNA
cguagcuuccucuacguuac

SEQ ID NO: 57498 - RNA, 20 nt, Artificial Sequence
  MKO10057498_A_Uso1
  gRNA
ucggucauccaguaacguag

SEQ ID NO: 57499 - RNA, 20 nt, Artificial Sequence
  MKO10057499_A_Uso1
  gRNA
uauaauaucuaaugacgaag

SEQ ID NO: 57500 - RNA, 20 nt, Artificial Sequence
  MKO10057500_A_Usp10
  gRNA
cgaggcgggguacuggucaa

SEQ ID NO: 57501 - RNA, 20 nt, Artificial Sequence
  MKO10057501_A_Usp10
  gRNA
cauugaccaguaccccgccu

SEQ ID NO: 57502 - RNA, 20 nt, Artificial Sequence
  MKO10057502_A_Usp10
  gRNA
ucgcagcucccuccauacag

SEQ ID NO: 57503 - RNA, 20 nt, Artificial Sequence
  MKO10057503_A_Usp11
  gRNA
aacuacauggucagcuggua

SEQ ID NO: 57504 - RNA, 20 nt, Artificial Sequence
  MKO10057504_A_Usp11
  gRNA
ccagccaccuauugagcgca

SEQ ID NO: 57505 - RNA, 20 nt, Artificial Sequence
  MKO10057505_A_Usp11
  gRNA
ugaacgagcaguagcucuag

SEQ ID NO: 57506 - RNA, 20 nt, Artificial Sequence
  MKO10057506_A_Usp12
  gRNA
ccaaaauagugcucguugac

SEQ ID NO: 57507 - RNA, 20 nt, Artificial Sequence
  MKO10057507_A_Usp12
  gRNA
uuuacagggcgccaaugccu

SEQ ID NO: 57508 - RNA, 20 nt, Artificial Sequence
  MKO10057508_A_Usp12
  gRNA
ccacgucuccguuccguaau

SEQ ID NO: 57509 - RNA, 20 nt, Artificial Sequence
  MKO10057509_A_Usp13
  gRNA
uuguuggcauacuucgauac

SEQ ID NO: 57510 - RNA, 20 nt, Artificial Sequence
  MKO10057510_A_Usp13
  gRNA
agggcuauuucauagugguc

SEQ ID NO: 57511 - RNA, 20 nt, Artificial Sequence
  MKO10057511_A_Usp13
  gRNA
gcugguaacuccucaauguu

SEQ ID NO: 57512 - RNA, 20 nt, Artificial Sequence
  MKO10057512_A_Usp14
  gRNA
cucgccaugccacucuacuc

SEQ ID NO: 57513 - RNA, 20 nt, Artificial Sequence
  MKO10057513_A_Usp14
  gRNA
gaauacugaugaaccuccaa

SEQ ID NO: 57514 - RNA, 20 nt, Artificial Sequence
  MKO10057514_A_Usp14
  gRNA
cggagcucaccagaguagag

SEQ ID NO: 57515 - RNA, 20 nt, Artificial Sequence
  MKO10057515_A_Usp15
  gRNA
uggcgacgcgcagucacuua

SEQ ID NO: 57516 - RNA, 20 nt, Artificial Sequence
  MKO10057516_A_Usp15
  gRNA
gagaaguccagaguuaucga

SEQ ID NO: 57517 - RNA, 20 nt, Artificial Sequence
  MKO10057517_A_Usp15
  gRNA
ugccggccuauaccaaggac

SEQ ID NO: 57518 - RNA, 20 nt, Artificial Sequence
  MKO10057518_A_Usp16
  gRNA
guacuguagcucaaaccgau

SEQ ID NO: 57519 - RNA, 20 nt, Artificial Sequence
  MKO10057519_A_Usp16
  gRNA
uaggugcuacaagugugacg

SEQ ID NO: 57520 - RNA, 20 nt, Artificial Sequence
  MKO10057520_A_Usp16
  gRNA
gagauccgagccucacuacc

SEQ ID NO: 57521 - RNA, 20 nt, Artificial Sequence
  MKO10057521_A_Usp17la
  gRNA
guggaggagcuaacugucaa

SEQ ID NO: 57522 - RNA, 20 nt, Artificial Sequence
  MKO10057522_A_Usp17la
  gRNA
ugugcucuucuaugugcagc

SEQ ID NO: 57523 - RNA, 20 nt, Artificial Sequence
  MKO10057523_A_Usp17la
  gRNA
gugagacuuaccuucuggga

SEQ ID NO: 57524 - RNA, 20 nt, Artificial Sequence
  MKO10057524_A_Usp17lb
  gRNA
gcuucauaacauccccugag

SEQ ID NO: 57525 - RNA, 20 nt, Artificial Sequence
  MKO10057525_A_Usp17lb
  gRNA
aaagcuuuauagugccccaa

SEQ ID NO: 57526 - RNA, 20 nt, Artificial Sequence
  MKO10057526_A_Usp17lb
  gRNA
guugcucucuccuucccaga

SEQ ID NO: 57527 - RNA, 20 nt, Artificial Sequence
  MKO10057527_A_Usp17lc
  gRNA
cuuguaccaugccccauguc

SEQ ID NO: 57528 - RNA, 20 nt, Artificial Sequence
  MKO10057528_A_Usp17lc
  gRNA
cuguuccugaggcacaaguu

SEQ ID NO: 57529 - RNA, 20 nt, Artificial Sequence
  MKO10057529_A_Usp17lc
  gRNA
gugagacuuaccuucuggga

SEQ ID NO: 57530 - RNA, 20 nt, Artificial Sequence
  MKO10057530_A_Usp17ld
  gRNA
ugcccagauccauagcaaau

SEQ ID NO: 57531 - RNA, 20 nt, Artificial Sequence
  MKO10057531_A_Usp17ld
  gRNA
aucccugccccaauuugcua

SEQ ID NO: 57532 - RNA, 20 nt, Artificial Sequence
  MKO10057532_A_Usp17ld
  gRNA
guuucucuuuccuucccaga

SEQ ID NO: 57533 - RNA, 20 nt, Artificial Sequence
  MKO10057533_A_Usp17le
  gRNA
acauaccuucgaucccuucc

SEQ ID NO: 57534 - RNA, 20 nt, Artificial Sequence
  MKO10057534_A_Usp17le
  gRNA
gacauccaggaagggaucga

SEQ ID NO: 57535 - RNA, 20 nt, Artificial Sequence
  MKO10057535_A_Usp17le
  gRNA
gugagacucaccuucuggga

SEQ ID NO: 57536 - RNA, 20 nt, Artificial Sequence
  MKO10057536_A_Usp18
  gRNA
acggcacguuguauuucugc

SEQ ID NO: 57537 - RNA, 20 nt, Artificial Sequence
  MKO10057537_A_Usp18
  gRNA
cuguacagcccacgcaaauc

SEQ ID NO: 57538 - RNA, 20 nt, Artificial Sequence
  MKO10057538_A_Usp18
  gRNA
cucaacucuaccuuacaauc

SEQ ID NO: 57539 - RNA, 20 nt, Artificial Sequence
  MKO10057539_A_Usp19
  gRNA
aacaggucccguacgucugg

SEQ ID NO: 57540 - RNA, 20 nt, Artificial Sequence
  MKO10057540_A_Usp19
  gRNA
cuguagaauuguugcucgau

SEQ ID NO: 57541 - RNA, 20 nt, Artificial Sequence
  MKO10057541_A_Usp19
  gRNA
gccagugucccuuccucgaa

SEQ ID NO: 57542 - RNA, 20 nt, Artificial Sequence
  MKO10057542_A_Usp1
  gRNA
ucucucuucucgcagcuuac

SEQ ID NO: 57543 - RNA, 20 nt, Artificial Sequence
  MKO10057543_A_Usp1
  gRNA
acugcacugaccuuuguuuc

SEQ ID NO: 57544 - RNA, 20 nt, Artificial Sequence
  MKO10057544_A_Usp1
  gRNA
gaagccaaguccggaaacaa

SEQ ID NO: 57545 - RNA, 20 nt, Artificial Sequence
  MKO10057545_A_Usp20
  gRNA
gguugcuggaccuaaccuau

SEQ ID NO: 57546 - RNA, 20 nt, Artificial Sequence
  MKO10057546_A_Usp20
  gRNA
guagcaccagacccggaacg

SEQ ID NO: 57547 - RNA, 20 nt, Artificial Sequence
  MKO10057547_A_Usp20
  gRNA
ggccguuaccucgaggcuuc

SEQ ID NO: 57548 - RNA, 20 nt, Artificial Sequence
  MKO10057548_A_Usp21
  gRNA
caccuugagaucaaccgacg

SEQ ID NO: 57549 - RNA, 20 nt, Artificial Sequence
  MKO10057549_A_Usp21
  gRNA
caaggugcaaccgcuccaug

SEQ ID NO: 57550 - RNA, 20 nt, Artificial Sequence
  MKO10057550_A_Usp21
  gRNA
cugugaaucccacccgauuc

SEQ ID NO: 57551 - RNA, 20 nt, Artificial Sequence
  MKO10057551_A_Usp22
  gRNA
uuucaugaacugcaucgugc

SEQ ID NO: 57552 - RNA, 20 nt, Artificial Sequence
  MKO10057552_A_Usp22
  gRNA
ucugcguggacugaucaacc

SEQ ID NO: 57553 - RNA, 20 nt, Artificial Sequence
  MKO10057553_A_Usp22
  gRNA
aguuccagcucccguuuagu

SEQ ID NO: 57554 - RNA, 20 nt, Artificial Sequence
  MKO10057554_A_Usp24
  gRNA
accaaugaucagucaaaacg

SEQ ID NO: 57555 - RNA, 20 nt, Artificial Sequence
  MKO10057555_A_Usp24
  gRNA
uacaaccaauuuguaugagc

SEQ ID NO: 57556 - RNA, 20 nt, Artificial Sequence
  MKO10057556_A_Usp24
  gRNA
uaugcccgaggcauuuaaga

SEQ ID NO: 57557 - RNA, 20 nt, Artificial Sequence
  MKO10057557_A_Usp25
  gRNA
uauuaccagacagcgcuucc

SEQ ID NO: 57558 - RNA, 20 nt, Artificial Sequence
  MKO10057558_A_Usp25
  gRNA
ccgacauucuucagaccgac

SEQ ID NO: 57559 - RNA, 20 nt, Artificial Sequence
  MKO10057559_A_Usp25
  gRNA
cugauguaccugucguugcc

SEQ ID NO: 57560 - RNA, 20 nt, Artificial Sequence
  MKO10057560_A_Usp26
  gRNA
uggccgaauacuaccuugag

SEQ ID NO: 57561 - RNA, 20 nt, Artificial Sequence
  MKO10057561_A_Usp26
  gRNA
uauaggggucggaguucuac

SEQ ID NO: 57562 - RNA, 20 nt, Artificial Sequence
  MKO10057562_A_Usp26
  gRNA
cagugaugaucucgauaaga

SEQ ID NO: 57563 - RNA, 20 nt, Artificial Sequence
  MKO10057563_A_Usp27x
  gRNA
auacacgcucgucaucuagc

SEQ ID NO: 57564 - RNA, 20 nt, Artificial Sequence
  MKO10057564_A_Usp27x
  gRNA
auucucguuguucgcacuau

SEQ ID NO: 57565 - RNA, 20 nt, Artificial Sequence
  MKO10057565_A_Usp27x
  gRNA
gugagaugucgucgcucuuu

SEQ ID NO: 57566 - RNA, 20 nt, Artificial Sequence
  MKO10057566_A_Usp28
  gRNA
caucuuuguugucgugagug

SEQ ID NO: 57567 - RNA, 20 nt, Artificial Sequence
  MKO10057567_A_Usp28
  gRNA
ugcagcaguugugucgugac

SEQ ID NO: 57568 - RNA, 20 nt, Artificial Sequence
  MKO10057568_A_Usp28
  gRNA
cugggugaugucaccauuac

SEQ ID NO: 57569 - RNA, 20 nt, Artificial Sequence
  MKO10057569_A_Usp29
  gRNA
ucaucagagcaugucgcgau

SEQ ID NO: 57570 - RNA, 20 nt, Artificial Sequence
  MKO10057570_A_Usp29
  gRNA
uccuggugcuccccgcaaaa

SEQ ID NO: 57571 - RNA, 20 nt, Artificial Sequence
  MKO10057571_A_Usp29
  gRNA
gaucugaacucucgaacacu

SEQ ID NO: 57572 - RNA, 20 nt, Artificial Sequence
  MKO10057572_A_Usp2
  gRNA
auugggggacgacguccaua

SEQ ID NO: 57573 - RNA, 20 nt, Artificial Sequence
  MKO10057573_A_Usp2
  gRNA
uacuuauagcccaugaagcg

SEQ ID NO: 57574 - RNA, 20 nt, Artificial Sequence
  MKO10057574_A_Usp2
  gRNA
aggaacuuaccguguuccca

SEQ ID NO: 57575 - RNA, 20 nt, Artificial Sequence
  MKO10057575_A_Usp30
  gRNA
ggcguccaagaccucguccu

SEQ ID NO: 57576 - RNA, 20 nt, Artificial Sequence
  MKO10057576_A_Usp30
  gRNA
cggugggauugccgcugccc

SEQ ID NO: 57577 - RNA, 20 nt, Artificial Sequence
  MKO10057577_A_Usp30
  gRNA
guccugccaagaagucaccg

SEQ ID NO: 57578 - RNA, 20 nt, Artificial Sequence
  MKO10057578_A_Usp31
  gRNA
ggauacagcuucccgaaguc

SEQ ID NO: 57579 - RNA, 20 nt, Artificial Sequence
  MKO10057579_A_Usp31
  gRNA
cagguuauuaccugaucagu

SEQ ID NO: 57580 - RNA, 20 nt, Artificial Sequence
  MKO10057580_A_Usp31
  gRNA
uguacaaaagugcuacacac

SEQ ID NO: 57581 - RNA, 20 nt, Artificial Sequence
  MKO10057581_A_Usp32
  gRNA
uucccguacaacauagcucc

SEQ ID NO: 57582 - RNA, 20 nt, Artificial Sequence
  MKO10057582_A_Usp32
  gRNA
gaggccgcagguccucuuga

SEQ ID NO: 57583 - RNA, 20 nt, Artificial Sequence
  MKO10057583_A_Usp32
  gRNA
gacucaaagaugccuucaag

SEQ ID NO: 57584 - RNA, 20 nt, Artificial Sequence
  MKO10057584_A_Usp33
  gRNA
accucaccacucuucgagua

SEQ ID NO: 57585 - RNA, 20 nt, Artificial Sequence
  MKO10057585_A_Usp33
  gRNA
auaacaccauacucgaagag

SEQ ID NO: 57586 - RNA, 20 nt, Artificial Sequence
  MKO10057586_A_Usp33
  gRNA
ccacagcaccauacacucgc

SEQ ID NO: 57587 - RNA, 20 nt, Artificial Sequence
  MKO10057587_A_Usp34
  gRNA
auuacucucaucuugccacg

SEQ ID NO: 57588 - RNA, 20 nt, Artificial Sequence
  MKO10057588_A_Usp34
  gRNA
uaauacucauccuacuauag

SEQ ID NO: 57589 - RNA, 20 nt, Artificial Sequence
  MKO10057589_A_Usp34
  gRNA
ugauggacuacagcucagaa

SEQ ID NO: 57590 - RNA, 20 nt, Artificial Sequence
  MKO10057590_A_Usp35
  gRNA
uagggcagcuccccgcacga

SEQ ID NO: 57591 - RNA, 20 nt, Artificial Sequence
  MKO10057591_A_Usp35
  gRNA
cccucaccaggaugaucgac

SEQ ID NO: 57592 - RNA, 20 nt, Artificial Sequence
  MKO10057592_A_Usp35
  gRNA
uucgcucgccaaaauugaga

SEQ ID NO: 57593 - RNA, 20 nt, Artificial Sequence
  MKO10057593_A_Usp36
  gRNA
acccgcucuaggucaccaag

SEQ ID NO: 57594 - RNA, 20 nt, Artificial Sequence
  MKO10057594_A_Usp36
  gRNA
ccaggcaccgagcguguguc

SEQ ID NO: 57595 - RNA, 20 nt, Artificial Sequence
  MKO10057595_A_Usp36
  gRNA
caccauugaugcgaugcaga

SEQ ID NO: 57596 - RNA, 20 nt, Artificial Sequence
  MKO10057596_A_Usp37
  gRNA
ucuaauaauccugaucuaag

SEQ ID NO: 57597 - RNA, 20 nt, Artificial Sequence
  MKO10057597_A_Usp37
  gRNA
guugaugucagcgucaaaga

SEQ ID NO: 57598 - RNA, 20 nt, Artificial Sequence
  MKO10057598_A_Usp37
  gRNA
gcugacugaagauuacccua

SEQ ID NO: 57599 - RNA, 20 nt, Artificial Sequence
  MKO10057599_A_Usp38
  gRNA
ugaaccaaguuaacuauaug

SEQ ID NO: 57600 - RNA, 20 nt, Artificial Sequence
  MKO10057600_A_Usp38
  gRNA
agagcaccaggucucacgag

SEQ ID NO: 57601 - RNA, 20 nt, Artificial Sequence
  MKO10057601_A_Usp38
  gRNA
agaucucuaugagccuauuc

SEQ ID NO: 57602 - RNA, 20 nt, Artificial Sequence
  MKO10057602_A_Usp39
  gRNA
gagucgucacugcccguacu

SEQ ID NO: 57603 - RNA, 20 nt, Artificial Sequence
  MKO10057603_A_Usp39
  gRNA
caucaacgcauacgccuguc

SEQ ID NO: 57604 - RNA, 20 nt, Artificial Sequence
  MKO10057604_A_Usp39
  gRNA
uaccgugauauccuccagcg

SEQ ID NO: 57605 - RNA, 20 nt, Artificial Sequence
  MKO10057605_A_Usp3
  gRNA
gcagguccaacaaaagcccc

SEQ ID NO: 57606 - RNA, 20 nt, Artificial Sequence
  MKO10057606_A_Usp3
  gRNA
ucugugccuguccgcuguaa

SEQ ID NO: 57607 - RNA, 20 nt, Artificial Sequence
  MKO10057607_A_Usp3
  gRNA
ggcuuuguaagguaugugaa

SEQ ID NO: 57608 - RNA, 20 nt, Artificial Sequence
  MKO10057608_A_Usp40
  gRNA
aacaagcgcugcaacugcaa

SEQ ID NO: 57609 - RNA, 20 nt, Artificial Sequence
  MKO10057609_A_Usp40
  gRNA
guugguccacccgaagcugu

SEQ ID NO: 57610 - RNA, 20 nt, Artificial Sequence
  MKO10057610_A_Usp40
  gRNA
cucauucaucgucuauacca

SEQ ID NO: 57611 - RNA, 20 nt, Artificial Sequence
  MKO10057611_A_Usp42
  gRNA
caaagucaucgaguuggcgc

SEQ ID NO: 57612 - RNA, 20 nt, Artificial Sequence
  MKO10057612_A_Usp42
  gRNA
cuccaaauaucuggcagacc

SEQ ID NO: 57613 - RNA, 20 nt, Artificial Sequence
  MKO10057613_A_Usp42
  gRNA
acccuggucugccagauauu

SEQ ID NO: 57614 - RNA, 20 nt, Artificial Sequence
  MKO10057614_A_Usp43
  gRNA
cacguaccucgucuggcgca

SEQ ID NO: 57615 - RNA, 20 nt, Artificial Sequence
  MKO10057615_A_Usp43
  gRNA
ccauccccuugcgccagacg

SEQ ID NO: 57616 - RNA, 20 nt, Artificial Sequence
  MKO10057616_A_Usp43
  gRNA
agccaacacgcagaaaccgc

SEQ ID NO: 57617 - RNA, 20 nt, Artificial Sequence
  MKO10057617_A_Usp44
  gRNA
auaggaucgggccuuaucgc

SEQ ID NO: 57618 - RNA, 20 nt, Artificial Sequence
  MKO10057618_A_Usp44
  gRNA
gcacguuggauccucguuuc

SEQ ID NO: 57619 - RNA, 20 nt, Artificial Sequence
  MKO10057619_A_Usp44
  gRNA
agauugggugccgucgagua

SEQ ID NO: 57620 - RNA, 20 nt, Artificial Sequence
  MKO10057620_A_Usp45
  gRNA
ugacagcauaacugacgugc

SEQ ID NO: 57621 - RNA, 20 nt, Artificial Sequence
  MKO10057621_A_Usp45
  gRNA
uuaccugcaaaccacacuug

SEQ ID NO: 57622 - RNA, 20 nt, Artificial Sequence
  MKO10057622_A_Usp45
  gRNA
ugugaagaaaaacgugaagc

SEQ ID NO: 57623 - RNA, 20 nt, Artificial Sequence
  MKO10057623_A_Usp46
  gRNA
ccgaucaaugaacacuacuu

SEQ ID NO: 57624 - RNA, 20 nt, Artificial Sequence
  MKO10057624_A_Usp46
  gRNA
ccgaaguaguguucauugau

SEQ ID NO: 57625 - RNA, 20 nt, Artificial Sequence
  MKO10057625_A_Usp46
  gRNA
ucuguuccacaucgacagag

SEQ ID NO: 57626 - RNA, 20 nt, Artificial Sequence
  MKO10057626_A_Usp47
  gRNA
ucaaauagcacgucaucgcc

SEQ ID NO: 57627 - RNA, 20 nt, Artificial Sequence
  MKO10057627_A_Usp47
  gRNA
ugaaccgccucagauguugu

SEQ ID NO: 57628 - RNA, 20 nt, Artificial Sequence
  MKO10057628_A_Usp47
  gRNA
cacgcugucauccacguuau

SEQ ID NO: 57629 - RNA, 20 nt, Artificial Sequence
  MKO10057629_A_Usp48
  gRNA
ccugccgaagcuccaaguug

SEQ ID NO: 57630 - RNA, 20 nt, Artificial Sequence
  MKO10057630_A_Usp48
  gRNA
agacgauacaucgauccuuc

SEQ ID NO: 57631 - RNA, 20 nt, Artificial Sequence
  MKO10057631_A_Usp48
  gRNA
gagaaagguguugacguagc

SEQ ID NO: 57632 - RNA, 20 nt, Artificial Sequence
  MKO10057632_A_Usp49
  gRNA
uuacacucgaagaacaguuc

SEQ ID NO: 57633 - RNA, 20 nt, Artificial Sequence
  MKO10057633_A_Usp49
  gRNA
ugccuaugaucucuccgcag

SEQ ID NO: 57634 - RNA, 20 nt, Artificial Sequence
  MKO10057634_A_Usp49
  gRNA
augcaucacgggaaaggguu

SEQ ID NO: 57635 - RNA, 20 nt, Artificial Sequence
  MKO10057635_A_Usp4
  gRNA
aucgauuaagugcuccuuca

SEQ ID NO: 57636 - RNA, 20 nt, Artificial Sequence
  MKO10057636_A_Usp4
  gRNA
agcugggacauguacaaugu

SEQ ID NO: 57637 - RNA, 20 nt, Artificial Sequence
  MKO10057637_A_Usp4
  gRNA
agccguguuucacguucugc

SEQ ID NO: 57638 - RNA, 20 nt, Artificial Sequence
  MKO10057638_A_Usp50
  gRNA
aagcuucgugaagcucguug

SEQ ID NO: 57639 - RNA, 20 nt, Artificial Sequence
  MKO10057639_A_Usp50
  gRNA
uccgcagucccgucacgccc

SEQ ID NO: 57640 - RNA, 20 nt, Artificial Sequence
  MKO10057640_A_Usp50
  gRNA
cgugacgggacugcggaacc

SEQ ID NO: 57641 - RNA, 20 nt, Artificial Sequence
  MKO10057641_A_Usp51
  gRNA
acuuguuaaguucuccgacg

SEQ ID NO: 57642 - RNA, 20 nt, Artificial Sequence
  MKO10057642_A_Usp51
  gRNA
gcggcgcgggcaaaccgagc

SEQ ID NO: 57643 - RNA, 20 nt, Artificial Sequence
  MKO10057643_A_Usp51
  gRNA
gcaauuccagacguagaucc

SEQ ID NO: 57644 - RNA, 20 nt, Artificial Sequence
  MKO10057644_A_Usp53
  gRNA
ugcccuuuaccgaacucgug

SEQ ID NO: 57645 - RNA, 20 nt, Artificial Sequence
  MKO10057645_A_Usp53
  gRNA
agaaauguaccucacgaguu

SEQ ID NO: 57646 - RNA, 20 nt, Artificial Sequence
  MKO10057646_A_Usp53
  gRNA
cacuucccucagauaacaua

SEQ ID NO: 57647 - RNA, 20 nt, Artificial Sequence
  MKO10057647_A_Usp54
  gRNA
acaucuuccgccguagcuuu

SEQ ID NO: 57648 - RNA, 20 nt, Artificial Sequence
  MKO10057648_A_Usp54
  gRNA
cgacacucuccgcagugcuc

SEQ ID NO: 57649 - RNA, 20 nt, Artificial Sequence
  MKO10057649_A_Usp54
  gRNA
agaugaacaacgcuuccagc

SEQ ID NO: 57650 - RNA, 20 nt, Artificial Sequence
  MKO10057650_A_Usp5
  gRNA
cauacugcuucccgaauccc

SEQ ID NO: 57651 - RNA, 20 nt, Artificial Sequence
  MKO10057651_A_Usp5
  gRNA
cuaccggucgccggguccuc

SEQ ID NO: 57652 - RNA, 20 nt, Artificial Sequence
  MKO10057652_A_Usp5
  gRNA
ggacaaguuugaauuugacg

SEQ ID NO: 57653 - RNA, 20 nt, Artificial Sequence
  MKO10057653_A_Usp6nl
  gRNA
cccgguccgcagcugcauua

SEQ ID NO: 57654 - RNA, 20 nt, Artificial Sequence
  MKO10057654_A_Usp6nl
  gRNA
caaguuugagugcuacaucc

SEQ ID NO: 57655 - RNA, 20 nt, Artificial Sequence
  MKO10057655_A_Usp6nl
  gRNA
uacaaagucaccgauagauu

SEQ ID NO: 57656 - RNA, 20 nt, Artificial Sequence
  MKO10057656_A_Usp7
  gRNA
agacaccaguuggcgcuccg

SEQ ID NO: 57657 - RNA, 20 nt, Artificial Sequence
  MKO10057657_A_Usp7
  gRNA
ggcagauuucgcacaaaaca

SEQ ID NO: 57658 - RNA, 20 nt, Artificial Sequence
  MKO10057658_A_Usp7
  gRNA
caaaaacuuacgcaacucca

SEQ ID NO: 57659 - RNA, 20 nt, Artificial Sequence
  MKO10057659_A_Usp8
  gRNA
augcagacuagaucgugaug

SEQ ID NO: 57660 - RNA, 20 nt, Artificial Sequence
  MKO10057660_A_Usp8
  gRNA
ugcggcagccaaacgcucug

SEQ ID NO: 57661 - RNA, 20 nt, Artificial Sequence
  MKO10057661_A_Usp8
  gRNA
gaacugagguagaguucuuu

SEQ ID NO: 57662 - RNA, 20 nt, Artificial Sequence
  MKO10057662_A_Usp9x
  gRNA
augagaucguuagcccaucu

SEQ ID NO: 57663 - RNA, 20 nt, Artificial Sequence
  MKO10057663_A_Usp9x
  gRNA
uggcuaaguuagcccaagac

SEQ ID NO: 57664 - RNA, 20 nt, Artificial Sequence
  MKO10057664_A_Usp9x
  gRNA
acuugaggacacugacucgc

SEQ ID NO: 57665 - RNA, 20 nt, Artificial Sequence
  MKO10057665_A_Usp9y
  gRNA
aaacaucgcgaaaaaaacgc

SEQ ID NO: 57666 - RNA, 20 nt, Artificial Sequence
  MKO10057666_A_Usp9y
  gRNA
aauuauuaggucccgauggg

SEQ ID NO: 57667 - RNA, 20 nt, Artificial Sequence
  MKO10057667_A_Usp9y
  gRNA
caaaacaggaaccacccauc

SEQ ID NO: 57668 - RNA, 20 nt, Artificial Sequence
  MKO10057668_A_Uspl1
  gRNA
ccgaagcuuagaugcacauu

SEQ ID NO: 57669 - RNA, 20 nt, Artificial Sequence
  MKO10057669_A_Uspl1
  gRNA
ggauacagucuaaccagcac

SEQ ID NO: 57670 - RNA, 20 nt, Artificial Sequence
  MKO10057670_A_Uspl1
  gRNA
augccacucaggaacaauau

SEQ ID NO: 57671 - RNA, 20 nt, Artificial Sequence
  MKO10057671_A_Ust
  gRNA
aacuauuucuuccgucgcuu

SEQ ID NO: 57672 - RNA, 20 nt, Artificial Sequence
  MKO10057672_A_Ust
  gRNA
uccauggucauccaaguaag

SEQ ID NO: 57673 - RNA, 20 nt, Artificial Sequence
  MKO10057673_A_Ust
  gRNA
ugauccgcacccccagcaug

SEQ ID NO: 57674 - RNA, 20 nt, Artificial Sequence
  MKO10057674_A_uuf1
  gRNA
gcgugcgccgaacuugcuga

SEQ ID NO: 57675 - RNA, 20 nt, Artificial Sequence
  MKO10057675_A_uuf1
  gRNA
ggcugaacccggcucgccca

SEQ ID NO: 57676 - RNA, 20 nt, Artificial Sequence
  MKO10057676_A_uuf1
  gRNA
cuucgaccaaaccguuucuc

SEQ ID NO: 57677 - RNA, 20 nt, Artificial Sequence
  MKO10057677_A_uup11l
  gRNA
gccuggcuuucgaaaacgcc

SEQ ID NO: 57678 - RNA, 20 nt, Artificial Sequence
  MKO10057678_A_uup11l
  gRNA
gcugaagcucaugagaacuc

SEQ ID NO: 57679 - RNA, 20 nt, Artificial Sequence
  MKO10057679_A_uup11l
  gRNA
ugagaugaaaagaguugcag

SEQ ID NO: 57680 - RNA, 20 nt, Artificial Sequence
  MKO10057680_A_uup14a
  gRNA
agucaaaucgaagaagacuc

SEQ ID NO: 57681 - RNA, 20 nt, Artificial Sequence
  MKO10057681_A_uup14a
  gRNA
agaccagccucagaucucuc

SEQ ID NO: 57682 - RNA, 20 nt, Artificial Sequence
  MKO10057682_A_uup14a
  gRNA
guucccuuaguggaaaaaau

SEQ ID NO: 57683 - RNA, 20 nt, Artificial Sequence
  MKO10057683_A_uup14b
  gRNA
ucaucuucacucguacucag

SEQ ID NO: 57684 - RNA, 20 nt, Artificial Sequence
  MKO10057684_A_uup14b
  gRNA
ugaguuucuguaauaccucc

SEQ ID NO: 57685 - RNA, 20 nt, Artificial Sequence
  MKO10057685_A_uup14b
  gRNA
ccgaucacaagcagcuaaua

SEQ ID NO: 57686 - RNA, 20 nt, Artificial Sequence
  MKO10057686_A_uup15
  gRNA
cugugaagauauucgaugcu

SEQ ID NO: 57687 - RNA, 20 nt, Artificial Sequence
  MKO10057687_A_uup15
  gRNA
uaagaccccuguucagauua

SEQ ID NO: 57688 - RNA, 20 nt, Artificial Sequence
  MKO10057688_A_uup15
  gRNA
gcuccccucaggcaguuuga

SEQ ID NO: 57689 - RNA, 20 nt, Artificial Sequence
  MKO10057689_A_uup18
  gRNA
gaguugacaugucgaacaau

SEQ ID NO: 57690 - RNA, 20 nt, Artificial Sequence
  MKO10057690_A_uup18
  gRNA
acauccacgucucuuccaag

SEQ ID NO: 57691 - RNA, 20 nt, Artificial Sequence
  MKO10057691_A_uup18
  gRNA
aagcucagaugaaucggaag

SEQ ID NO: 57692 - RNA, 20 nt, Artificial Sequence
  MKO10057692_A_uup20
  gRNA
cgucgagacuuacuucuucg

SEQ ID NO: 57693 - RNA, 20 nt, Artificial Sequence
  MKO10057693_A_uup20
  gRNA
cuuguaaagauacgagagcg

SEQ ID NO: 57694 - RNA, 20 nt, Artificial Sequence
  MKO10057694_A_uup20
  gRNA
cgguaccgaaauguuccgua

SEQ ID NO: 57695 - RNA, 20 nt, Artificial Sequence
  MKO10057695_A_uup23
  gRNA
cuuugugaaggcggucgagg

SEQ ID NO: 57696 - RNA, 20 nt, Artificial Sequence
  MKO10057696_A_uup23
  gRNA
cgccucgaccgccuucacaa

SEQ ID NO: 57697 - RNA, 20 nt, Artificial Sequence
  MKO10057697_A_uup23
  gRNA
cuuucugccaggcggcgcug

SEQ ID NO: 57698 - RNA, 20 nt, Artificial Sequence
  MKO10057698_A_uup3
  gRNA
aguuccaugaagcgcgaucu

SEQ ID NO: 57699 - RNA, 20 nt, Artificial Sequence
  MKO10057699_A_uup3
  gRNA
aaagccaaaauccgacgacg

SEQ ID NO: 57700 - RNA, 20 nt, Artificial Sequence
  MKO10057700_A_uup3
  gRNA
acagauaauucagcggcgcu

SEQ ID NO: 57701 - RNA, 20 nt, Artificial Sequence
  MKO10057701_A_uup6
  gRNA
uuggucgugcuucagcgaag

SEQ ID NO: 57702 - RNA, 20 nt, Artificial Sequence
  MKO10057702_A_uup6
  gRNA
aagcacgaccaaagacaccc

SEQ ID NO: 57703 - RNA, 20 nt, Artificial Sequence
  MKO10057703_A_uup6
  gRNA
ugcaggaugauguucagcuc

SEQ ID NO: 57704 - RNA, 20 nt, Artificial Sequence
  MKO10057704_A_uurn
  gRNA
aaaucgagcguuuauccauu

SEQ ID NO: 57705 - RNA, 20 nt, Artificial Sequence
  MKO10057705_A_uurn
  gRNA
aagcucuuggaucuucucga

SEQ ID NO: 57706 - RNA, 20 nt, Artificial Sequence
  MKO10057706_A_uurn
  gRNA
caaugucaaccgagugcuac

SEQ ID NO: 57707 - RNA, 20 nt, Artificial Sequence
  MKO10057707_A_uus2b
  gRNA
ucuucucacacuaaaaaacg

SEQ ID NO: 57708 - RNA, 20 nt, Artificial Sequence
  MKO10057708_A_uus2b
  gRNA
gagaaguugacccgaaaucc

SEQ ID NO: 57709 - RNA, 20 nt, Artificial Sequence
  MKO10057709_A_uus2b
  gRNA
uuacagaggcccuuccacgc

SEQ ID NO: 57710 - RNA, 20 nt, Artificial Sequence
  MKO10057710_A_uus2r
  gRNA
uuaccguaagcuguuggcgc

SEQ ID NO: 57711 - RNA, 20 nt, Artificial Sequence
  MKO10057711_A_uus2r
  gRNA
guacgucuauguggucaacc

SEQ ID NO: 57712 - RNA, 20 nt, Artificial Sequence
  MKO10057712_A_uus2r
  gRNA
aacgcuaugcagcaguacug

SEQ ID NO: 57713 - RNA, 20 nt, Artificial Sequence
  MKO10057713_A_uus2
  gRNA
ugcuugaggaagacgcucuu

SEQ ID NO: 57714 - RNA, 20 nt, Artificial Sequence
  MKO10057714_A_uus2
  gRNA
ugugguuucaggcuuucgcu

SEQ ID NO: 57715 - RNA, 20 nt, Artificial Sequence
  MKO10057715_A_uus2
  gRNA
cacuguacugagucgucucu

SEQ ID NO: 57716 - RNA, 20 nt, Artificial Sequence
  MKO10057716_A_uuy
  gRNA
guucaacagcgucuucaucu

SEQ ID NO: 57717 - RNA, 20 nt, Artificial Sequence
  MKO10057717_A_uuy
  gRNA
gaugaagacgcuguugaaca

SEQ ID NO: 57718 - RNA, 20 nt, Artificial Sequence
  MKO10057718_A_uuy
  gRNA
acaguuuacagacugacuac

SEQ ID NO: 57719 - RNA, 20 nt, Artificial Sequence
  MKO10057719_A_Uvrag
  gRNA
uucaucaacagaauccgacg

SEQ ID NO: 57720 - RNA, 20 nt, Artificial Sequence
  MKO10057720_A_Uvrag
  gRNA
agcggcgucuccgacaucuc

SEQ ID NO: 57721 - RNA, 20 nt, Artificial Sequence
  MKO10057721_A_Uvrag
  gRNA
uguuccgagcagcgauguuc

SEQ ID NO: 57722 - RNA, 20 nt, Artificial Sequence
  MKO10057722_A_Uvssa
  gRNA
ugaagagcucauccacgauc

SEQ ID NO: 57723 - RNA, 20 nt, Artificial Sequence
  MKO10057723_A_Uvssa
  gRNA
ugagcgagucccgagcagca

SEQ ID NO: 57724 - RNA, 20 nt, Artificial Sequence
  MKO10057724_A_Uvssa
  gRNA
ccgagaggcggaucucggca

SEQ ID NO: 57725 - RNA, 20 nt, Artificial Sequence
  MKO10057725_A_Uxs1
  gRNA
ggggcaacuuuguuaacaug

SEQ ID NO: 57726 - RNA, 20 nt, Artificial Sequence
  MKO10057726_A_Uxs1
  gRNA
gaucgaaagcaagauugaag

SEQ ID NO: 57727 - RNA, 20 nt, Artificial Sequence
  MKO10057727_A_Uxt
  gRNA
ccuauaggaaacuaaucacu

SEQ ID NO: 57728 - RNA, 20 nt, Artificial Sequence
  MKO10057728_A_Uxt
  gRNA
ggugcuggaucaucgagaca

SEQ ID NO: 57729 - RNA, 20 nt, Artificial Sequence
  MKO10057729_A_Uxt
  gRNA
auuucuuaguugaagauaua

SEQ ID NO: 57730 - RNA, 20 nt, Artificial Sequence
  MKO10057730_A_V1ra8
  gRNA
uacucaagaacuauuauuac

SEQ ID NO: 57731 - RNA, 20 nt, Artificial Sequence
  MKO10057731_A_V1ra8
  gRNA
uguaauaauaguucuugagu

SEQ ID NO: 57732 - RNA, 20 nt, Artificial Sequence
  MKO10057732_A_V1ra8
  gRNA
gaauagcugcuauuaaaauu

SEQ ID NO: 57733 - RNA, 20 nt, Artificial Sequence
  MKO10057733_A_V1rd18
  gRNA
ggauguaucgugaguagaca

SEQ ID NO: 57734 - RNA, 20 nt, Artificial Sequence
  MKO10057734_A_V1rd18
  gRNA
agaauucuucacucgccucg

SEQ ID NO: 57735 - RNA, 20 nt, Artificial Sequence
  MKO10057735_A_V1rd18
  gRNA
aaaugucauugcaaugccuc

SEQ ID NO: 57736 - RNA, 20 nt, Artificial Sequence
  MKO10057736_A_V1rd19
  gRNA
ggauguaucgugaguagaca

SEQ ID NO: 57737 - RNA, 20 nt, Artificial Sequence
  MKO10057737_A_V1rd19
  gRNA
agaauucuucacucgccucg

SEQ ID NO: 57738 - RNA, 20 nt, Artificial Sequence
  MKO10057738_A_V1rd19
  gRNA
aaaugucauugcaaugccuc

SEQ ID NO: 57739 - RNA, 20 nt, Artificial Sequence
  MKO10057739_A_Vac14
  gRNA
gcuuuaaugacgcagacagc

SEQ ID NO: 57740 - RNA, 20 nt, Artificial Sequence
  MKO10057740_A_Vac14
  gRNA
ccucuacaauaucgucaaag

SEQ ID NO: 57741 - RNA, 20 nt, Artificial Sequence
  MKO10057741_A_Vac14
  gRNA
aguaaauccucucccgcaaa

SEQ ID NO: 57742 - RNA, 20 nt, Artificial Sequence
  MKO10057742_A_Vamp1
  gRNA
ugaccgggcugacgccuugc

SEQ ID NO: 57743 - RNA, 20 nt, Artificial Sequence
  MKO10057743_A_Vamp1
  gRNA
uacaaucacuaccacgauga

SEQ ID NO: 57744 - RNA, 20 nt, Artificial Sequence
  MKO10057744_A_Vamp1
  gRNA
cugcuguaaccgccuguuac

SEQ ID NO: 57745 - RNA, 20 nt, Artificial Sequence
  MKO10057745_A_Vamp2
  gRNA
ccaagcucaagcgcaaauac

SEQ ID NO: 57746 - RNA, 20 nt, Artificial Sequence
  MKO10057746_A_Vamp2
  gRNA
gcagucuccuguuacuagua

SEQ ID NO: 57747 - RNA, 20 nt, Artificial Sequence
  MKO10057747_A_Vamp2
  gRNA
ugcaggggggccacccucgc

SEQ ID NO: 57748 - RNA, 20 nt, Artificial Sequence
  MKO10057748_A_Vamp3
  gRNA
guggcagcacuugaccccga

SEQ ID NO: 57749 - RNA, 20 nt, Artificial Sequence
  MKO10057749_A_Vamp3
  gRNA
uuguugcagaugugggcgau

SEQ ID NO: 57750 - RNA, 20 nt, Artificial Sequence
  MKO10057750_A_Vamp3
  gRNA
ugaccgcgcagaugcacugc

SEQ ID NO: 57751 - RNA, 20 nt, Artificial Sequence
  MKO10057751_A_Vamp4
  gRNA
cauuugccuucgaagcuguu

SEQ ID NO: 57752 - RNA, 20 nt, Artificial Sequence
  MKO10057752_A_Vamp4
  gRNA
acagauccaaacagcuucga

SEQ ID NO: 57753 - RNA, 20 nt, Artificial Sequence
  MKO10057753_A_Vamp4
  gRNA
ucaaacuaguguucagaauc

SEQ ID NO: 57754 - RNA, 20 nt, Artificial Sequence
  MKO10057754_A_Vamp5
  gRNA
uauccggugccgggucuacu

SEQ ID NO: 57755 - RNA, 20 nt, Artificial Sequence
  MKO10057755_A_Vamp5
  gRNA
ccagcuugccgugacgcucc

SEQ ID NO: 57756 - RNA, 20 nt, Artificial Sequence
  MKO10057756_A_Vamp5
  gRNA
ccuggagcgucacggcaagc

SEQ ID NO: 57757 - RNA, 20 nt, Artificial Sequence
  MKO10057757_A_Vamp7
  gRNA
aacucgcuauucauagcaua

SEQ ID NO: 57758 - RNA, 20 nt, Artificial Sequence
  MKO10057758_A_Vamp7
  gRNA
uaagagccuagacaaaguga

SEQ ID NO: 57759 - RNA, 20 nt, Artificial Sequence
  MKO10057759_A_Vamp7
  gRNA
uucauuacaucugccaagac

SEQ ID NO: 57760 - RNA, 20 nt, Artificial Sequence
  MKO10057760_A_Vamp8
  gRNA
gugccggaaaugaccgaguu

SEQ ID NO: 57761 - RNA, 20 nt, Artificial Sequence
  MKO10057761_A_Vamp8
  gRNA
gucauuuccggcacucccac

SEQ ID NO: 57762 - RNA, 20 nt, Artificial Sequence
  MKO10057762_A_Vamp8
  gRNA
cuucaagacaacgucccaga

SEQ ID NO: 57763 - RNA, 20 nt, Artificial Sequence
  MKO10057763_A_Vangl1
  gRNA
gauaccgaauccacguauuc

SEQ ID NO: 57764 - RNA, 20 nt, Artificial Sequence
  MKO10057764_A_Vangl1
  gRNA
gcuggauugcaagcgcuauc

SEQ ID NO: 57765 - RNA, 20 nt, Artificial Sequence
  MKO10057765_A_Vangl1
  gRNA
gcaauacgcagucucucuug

SEQ ID NO: 57766 - RNA, 20 nt, Artificial Sequence
  MKO10057766_A_Vangl2
  gRNA
accgacaccgcucuaagagc

SEQ ID NO: 57767 - RNA, 20 nt, Artificial Sequence
  MKO10057767_A_Vangl2
  gRNA
cguguuacgagcucugcuca

SEQ ID NO: 57768 - RNA, 20 nt, Artificial Sequence
  MKO10057768_A_Vangl2
  gRNA
ccucguaguaguacucauug

SEQ ID NO: 57769 - RNA, 20 nt, Artificial Sequence
  MKO10057769_A_Vapa
  gRNA
uguugggccgcacacaguac

SEQ ID NO: 57770 - RNA, 20 nt, Artificial Sequence
  MKO10057770_A_Vapa
  gRNA
ggaagagugcaagcgacucc

SEQ ID NO: 57771 - RNA, 20 nt, Artificial Sequence
  MKO10057771_A_Vapa
  gRNA
uggcagggguccgucuuguu

SEQ ID NO: 57772 - RNA, 20 nt, Artificial Sequence
  MKO10057772_A_Vapb
  gRNA
ucugucuuggaugcacucgu

SEQ ID NO: 57773 - RNA, 20 nt, Artificial Sequence
  MKO10057773_A_Vapb
  gRNA
uccgccugacacuucugaua

SEQ ID NO: 57774 - RNA, 20 nt, Artificial Sequence
  MKO10057774_A_Vapb
  gRNA
gucagggacuuugcggcugc

SEQ ID NO: 57775 - RNA, 20 nt, Artificial Sequence
  MKO10057775_A_Vars2
  gRNA
accaggccgcuucaacauac

SEQ ID NO: 57776 - RNA, 20 nt, Artificial Sequence
  MKO10057776_A_Vars2
  gRNA
gcacgcgauccccacgcauc

SEQ ID NO: 57777 - RNA, 20 nt, Artificial Sequence
  MKO10057777_A_Vars2
  gRNA
uguggcaggcaccggaugcg

SEQ ID NO: 57778 - RNA, 20 nt, Artificial Sequence
  MKO10057778_A_Vars
  gRNA
uaacacuuguguccggcaac

SEQ ID NO: 57779 - RNA, 20 nt, Artificial Sequence
  MKO10057779_A_Vars
  gRNA
cagugacucacguaucggaa

SEQ ID NO: 57780 - RNA, 20 nt, Artificial Sequence
  MKO10057780_A_Vars
  gRNA
acccgcgcagcucaaaaaag

SEQ ID NO: 57781 - RNA, 20 nt, Artificial Sequence
  MKO10057781_A_Vash1
  gRNA
cgcucagggacgggcgucgu

SEQ ID NO: 57782 - RNA, 20 nt, Artificial Sequence
  MKO10057782_A_Vash1
  gRNA
aagcggccuacggccgcugc

SEQ ID NO: 57783 - RNA, 20 nt, Artificial Sequence
  MKO10057783_A_Vash1
  gRNA
cgcccuggguaugagccgaa

SEQ ID NO: 57784 - RNA, 20 nt, Artificial Sequence
  MKO10057784_A_Vash2
  gRNA
gacaaguugcuuccacucga

SEQ ID NO: 57785 - RNA, 20 nt, Artificial Sequence
  MKO10057785_A_Vash2
  gRNA
gcugauagggaaccgcucaa

SEQ ID NO: 57786 - RNA, 20 nt, Artificial Sequence
  MKO10057786_A_Vash2
  gRNA
gagccagucugggaucguca

SEQ ID NO: 57787 - RNA, 20 nt, Artificial Sequence
  MKO10057787_A_Vasn
  gRNA
cgacgcgcuugaucgccucc

SEQ ID NO: 57788 - RNA, 20 nt, Artificial Sequence
  MKO10057788_A_Vasn
  gRNA
gaggcgaucaagcgcgucga

SEQ ID NO: 57789 - RNA, 20 nt, Artificial Sequence
  MKO10057789_A_Vasn
  gRNA
ccgaauucgccacauccaac

SEQ ID NO: 57790 - RNA, 20 nt, Artificial Sequence
  MKO10057790_A_Vasp
  gRNA
guacuugacaccccgaauga

SEQ ID NO: 57791 - RNA, 20 nt, Artificial Sequence
  MKO10057791_A_Vasp
  gRNA
caagaugcagccggaucagc

SEQ ID NO: 57792 - RNA, 20 nt, Artificial Sequence
  MKO10057792_A_Vasp
  gRNA
gcaucuugcggccaacaacu

SEQ ID NO: 57793 - RNA, 20 nt, Artificial Sequence
  MKO10057793_A_Vau1l
  gRNA
cgagcacggacaugccuucg

SEQ ID NO: 57794 - RNA, 20 nt, Artificial Sequence
  MKO10057794_A_Vau1l
  gRNA
gaaauugccaaccuccgcga

SEQ ID NO: 57795 - RNA, 20 nt, Artificial Sequence
  MKO10057795_A_Vau1l
  gRNA
gcucugggggacagcguaaa

SEQ ID NO: 57796 - RNA, 20 nt, Artificial Sequence
  MKO10057796_A_Vau1
  gRNA
gguggaacucgucaauagcg

SEQ ID NO: 57797 - RNA, 20 nt, Artificial Sequence
  MKO10057797_A_Vau1
  gRNA
gugaugguguugaaccgguc

SEQ ID NO: 57798 - RNA, 20 nt, Artificial Sequence
  MKO10057798_A_Vau1
  gRNA
caauuauaucaccgccuaca

SEQ ID NO: 57799 - RNA, 20 nt, Artificial Sequence
  MKO10057799_A_Vav1
  gRNA
caaagaguucacugcgcuug

SEQ ID NO: 57800 - RNA, 20 nt, Artificial Sequence
  MKO10057800_A_Vav1
  gRNA
caaaguccugcacaucgaag

SEQ ID NO: 57801 - RNA, 20 nt, Artificial Sequence
  MKO10057801_A_Vav1
  gRNA
aacgacgaagauauuuacag

SEQ ID NO: 57802 - RNA, 20 nt, Artificial Sequence
  MKO10057802_A_Vav2
  gRNA
aaaaugaugacgacgucuac

SEQ ID NO: 57803 - RNA, 20 nt, Artificial Sequence
  MKO10057803_A_Vav2
  gRNA
ccuuugcagcgagcaugacc

SEQ ID NO: 57804 - RNA, 20 nt, Artificial Sequence
  MKO10057804_A_Vav2
  gRNA
cuauaggccauuuccaucag

SEQ ID NO: 57805 - RNA, 20 nt, Artificial Sequence
  MKO10057805_A_Vav3
  gRNA
guucaacagugucgccugcc

SEQ ID NO: 57806 - RNA, 20 nt, Artificial Sequence
  MKO10057806_A_Vav3
  gRNA
uccagguuugccgaagaugc

SEQ ID NO: 57807 - RNA, 20 nt, Artificial Sequence
  MKO10057807_A_Vav3
  gRNA
uagggacgaaacuuagcuuc

SEQ ID NO: 57808 - RNA, 20 nt, Artificial Sequence
  MKO10057808_A_Vax1
  gRNA
ccggugccacucggacaccg

SEQ ID NO: 57809 - RNA, 20 nt, Artificial Sequence
  MKO10057809_A_Vax1
  gRNA
ugucgccggauccuaguccg

SEQ ID NO: 57810 - RNA, 20 nt, Artificial Sequence
  MKO10057810_A_Vax1
  gRNA
guccuccgccccguugacga

SEQ ID NO: 57811 - RNA, 20 nt, Artificial Sequence
  MKO10057811_A_Vax2
  gRNA
aaguacggguccgcuugggu

SEQ ID NO: 57812 - RNA, 20 nt, Artificial Sequence
  MKO10057812_A_Vax2
  gRNA
acacagguagcgcgaguccg

SEQ ID NO: 57813 - RNA, 20 nt, Artificial Sequence
  MKO10057813_A_Vax2
  gRNA
ucacggagagcaccgcggag

SEQ ID NO: 57814 - RNA, 20 nt, Artificial Sequence
  MKO10057814_A_Vbp1
  gRNA
ggacugaagcuuugcaguac

SEQ ID NO: 57815 - RNA, 20 nt, Artificial Sequence
  MKO10057815_A_Vbp1
  gRNA
cuacugauaaaguaugccua

SEQ ID NO: 57816 - RNA, 20 nt, Artificial Sequence
  MKO10057816_A_Vbp1
  gRNA
gauucuuucaugaagcagcc

SEQ ID NO: 57817 - RNA, 20 nt, Artificial Sequence
  MKO10057817_A_Vcam1
  gRNA
guccucaccuucgcguuuag

SEQ ID NO: 57818 - RNA, 20 nt, Artificial Sequence
  MKO10057818_A_Vcam1
  gRNA
gccggucacggucaaguguu

SEQ ID NO: 57819 - RNA, 20 nt, Artificial Sequence
  MKO10057819_A_Vcam1
  gRNA
agacagcccacuaaacgcga

SEQ ID NO: 57820 - RNA, 20 nt, Artificial Sequence
  MKO10057820_A_Vcan
  gRNA
gaacuuugccgcugcucaac

SEQ ID NO: 57821 - RNA, 20 nt, Artificial Sequence
  MKO10057821_A_Vcan
  gRNA
ccuacacaucccgaugaugu

SEQ ID NO: 57822 - RNA, 20 nt, Artificial Sequence
  MKO10057822_A_Vcan
  gRNA
aaauucacucguguuguaau

SEQ ID NO: 57823 - RNA, 20 nt, Artificial Sequence
  MKO10057823_A_Vcl
  gRNA
uuccccuagagccgucaaug

SEQ ID NO: 57824 - RNA, 20 nt, Artificial Sequence
  MKO10057824_A_Vcl
  gRNA
gcgcgggauuaccucauuga

SEQ ID NO: 57825 - RNA, 20 nt, Artificial Sequence
  MKO10057825_A_Vcl
  gRNA
ccaggaacaccgugugaugu

SEQ ID NO: 57826 - RNA, 20 nt, Artificial Sequence
  MKO10057826_A_Vcpip1
  gRNA
uucggucccuucguuucgaa

SEQ ID NO: 57827 - RNA, 20 nt, Artificial Sequence
  MKO10057827_A_Vcpip1
  gRNA
cgagcgugucgugcaaauac

SEQ ID NO: 57828 - RNA, 20 nt, Artificial Sequence
  MKO10057828_A_Vcpip1
  gRNA
gacuaacacaacugagccga

SEQ ID NO: 57829 - RNA, 20 nt, Artificial Sequence
  MKO10057829_A_Vcpkmt
  gRNA
uuguuacgaacaacguacaa

SEQ ID NO: 57830 - RNA, 20 nt, Artificial Sequence
  MKO10057830_A_Vcpkmt
  gRNA
gucaccagacuacauauuga

SEQ ID NO: 57831 - RNA, 20 nt, Artificial Sequence
  MKO10057831_A_Vcpkmt
  gRNA
agacuguauauacuaugagg

SEQ ID NO: 57832 - RNA, 20 nt, Artificial Sequence
  MKO10057832_A_Vcp
  gRNA
guuucucucaccuuuacgga

SEQ ID NO: 57833 - RNA, 20 nt, Artificial Sequence
  MKO10057833_A_Vcp
  gRNA
uaacucaccucucgcuugau

SEQ ID NO: 57834 - RNA, 20 nt, Artificial Sequence
  MKO10057834_A_Vcp
  gRNA
caaaccugaugacaucuccu

SEQ ID NO: 57835 - RNA, 20 nt, Artificial Sequence
  MKO10057835_A_Vdac1
  gRNA
ucgucauucucgccgaacac

SEQ ID NO: 57836 - RNA, 20 nt, Artificial Sequence
  MKO10057836_A_Vdac1
  gRNA
gcccucgauccggggcgcuc

SEQ ID NO: 57837 - RNA, 20 nt, Artificial Sequence
  MKO10057837_A_Vdac1
  gRNA
cggcgagaaugacgaaucaa

SEQ ID NO: 57838 - RNA, 20 nt, Artificial Sequence
  MKO10057838_A_Vdac2
  gRNA
uuacccuguguucggugaaa

SEQ ID NO: 57839 - RNA, 20 nt, Artificial Sequence
  MKO10057839_A_Vdac2
  gRNA
agcuuugccgaggucagcau

SEQ ID NO: 57840 - RNA, 20 nt, Artificial Sequence
  MKO10057840_A_Vdac2
  gRNA
cucuguccccagaguguuau

SEQ ID NO: 57841 - RNA, 20 nt, Artificial Sequence
  MKO10057841_A_Vdac3
  gRNA
aauguuucuaggguuuggca

SEQ ID NO: 57842 - RNA, 20 nt, Artificial Sequence
  MKO10057842_A_Vdac3
  gRNA
cucacacgugaguaugcagc

SEQ ID NO: 57843 - RNA, 20 nt, Artificial Sequence
  MKO10057843_A_Vdac3
  gRNA
caccacuccacuacaagacu

SEQ ID NO: 57844 - RNA, 20 nt, Artificial Sequence
  MKO10057844_A_Vdr
  gRNA
guacuuacgucugcacgaau

SEQ ID NO: 57845 - RNA, 20 nt, Artificial Sequence
  MKO10057845_A_Vdr
  gRNA
cugccggcucaaacgcugcg

SEQ ID NO: 57846 - RNA, 20 nt, Artificial Sequence
  MKO10057846_A_Vdr
  gRNA
uguccacgcagcguuugagc

SEQ ID NO: 57847 - RNA, 20 nt, Artificial Sequence
  MKO10057847_A_Vegfa
  gRNA
uucucgcuccguaguagccg

SEQ ID NO: 57848 - RNA, 20 nt, Artificial Sequence
  MKO10057848_A_Vegfa
  gRNA
cugccguccgauugagaccc

SEQ ID NO: 57849 - RNA, 20 nt, Artificial Sequence
  MKO10057849_A_Vegfa
  gRNA
ucggacggcaguagcuucgc

SEQ ID NO: 57850 - RNA, 20 nt, Artificial Sequence
  MKO10057850_A_Vegfb
  gRNA
cugguaccugcauucggacu

SEQ ID NO: 57851 - RNA, 20 nt, Artificial Sequence
  MKO10057851_A_Vegfb
  gRNA
gcaacaccaaguccgaaugc

SEQ ID NO: 57852 - RNA, 20 nt, Artificial Sequence
  MKO10057852_A_Vegfb
  gRNA
ccaguacccgagcagucagc

SEQ ID NO: 57853 - RNA, 20 nt, Artificial Sequence
  MKO10057853_A_Vegfc
  gRNA
gacucaaugcaugccacgug

SEQ ID NO: 57854 - RNA, 20 nt, Artificial Sequence
  MKO10057854_A_Vegfc
  gRNA
agcagcccacccucaauacc

SEQ ID NO: 57855 - RNA, 20 nt, Artificial Sequence
  MKO10057855_A_Vegfc
  gRNA
agacaucagcucaucuacgc

SEQ ID NO: 57856 - RNA, 20 nt, Artificial Sequence
  MKO10057856_A_Veph1
  gRNA
gagcaauuccccuaccucac

SEQ ID NO: 57857 - RNA, 20 nt, Artificial Sequence
  MKO10057857_A_Veph1
  gRNA
cgugcagaagccuuaguaga

SEQ ID NO: 57858 - RNA, 20 nt, Artificial Sequence
  MKO10057858_A_Veph1
  gRNA
caucaccaaggcggaucugc

SEQ ID NO: 57859 - RNA, 20 nt, Artificial Sequence
  MKO10057859_A_Vezf1
  gRNA
acacacauggugcgccacga

SEQ ID NO: 57860 - RNA, 20 nt, Artificial Sequence
  MKO10057860_A_Vezf1
  gRNA
ggacagcagccgaacuucgu

SEQ ID NO: 57861 - RNA, 20 nt, Artificial Sequence
  MKO10057861_A_Vezf1
  gRNA
uaguugaaaccaacgaaguu

SEQ ID NO: 57862 - RNA, 20 nt, Artificial Sequence
  MKO10057862_A_Vezt
  gRNA
guggcaaggacaccggguuu

SEQ ID NO: 57863 - RNA, 20 nt, Artificial Sequence
  MKO10057863_A_Vezt
  gRNA
cagugaguccagccgaaacc

SEQ ID NO: 57864 - RNA, 20 nt, Artificial Sequence
  MKO10057864_A_Vezt
  gRNA
uccacuuuaccaguaccuac

SEQ ID NO: 57865 - RNA, 20 nt, Artificial Sequence
  MKO10057865_A_Vgf
  gRNA
gaagcgcgccacacgcgcuc

SEQ ID NO: 57866 - RNA, 20 nt, Artificial Sequence
  MKO10057866_A_Vgf
  gRNA
gaacgcacuccuguucgccg

SEQ ID NO: 57867 - RNA, 20 nt, Artificial Sequence
  MKO10057867_A_Vgf
  gRNA
guccgcggccgaauguaguu

SEQ ID NO: 57868 - RNA, 20 nt, Artificial Sequence
  MKO10057868_A_Vgll1
  gRNA
cuuugcgcucucuauccgug

SEQ ID NO: 57869 - RNA, 20 nt, Artificial Sequence
  MKO10057869_A_Vgll1
  gRNA
agagcaugcccccgaaucag

SEQ ID NO: 57870 - RNA, 20 nt, Artificial Sequence
  MKO10057870_A_Vgll1
  gRNA
acggauagagagcgcaaagu

SEQ ID NO: 57871 - RNA, 20 nt, Artificial Sequence
  MKO10057871_A_Vgll2
  gRNA
acgacccguaccugguggua

SEQ ID NO: 57872 - RNA, 20 nt, Artificial Sequence
  MKO10057872_A_Vgll2
  gRNA
guguaggcggcugcgaaaua

SEQ ID NO: 57873 - RNA, 20 nt, Artificial Sequence
  MKO10057873_A_Vgll2
  gRNA
ccccacuucgacccgcgcua

SEQ ID NO: 57874 - RNA, 20 nt, Artificial Sequence
  MKO10057874_A_Vgll3
  gRNA
auguaucacccccagccgua

SEQ ID NO: 57875 - RNA, 20 nt, Artificial Sequence
  MKO10057875_A_Vgll3
  gRNA
cccuacagccugcuaucauc

SEQ ID NO: 57876 - RNA, 20 nt, Artificial Sequence
  MKO10057876_A_Vgll3
  gRNA
ugccaucagugcgagcugcc

SEQ ID NO: 57877 - RNA, 20 nt, Artificial Sequence
  MKO10057877_A_Vgll4
  gRNA
accgaguuaggcgccggcuc

SEQ ID NO: 57878 - RNA, 20 nt, Artificial Sequence
  MKO10057878_A_Vgll4
  gRNA
gggggcugcagcccguucaa

SEQ ID NO: 57879 - RNA, 20 nt, Artificial Sequence
  MKO10057879_A_Vgll4
  gRNA
agagcacuuccgucggagcc

SEQ ID NO: 57880 - RNA, 20 nt, Artificial Sequence
  MKO10057880_A_Vhl
  gRNA
cguuccaauaaugccccgga

SEQ ID NO: 57881 - RNA, 20 nt, Artificial Sequence
  MKO10057881_A_Vhl
  gRNA
uaggcuguccaucgacauug

SEQ ID NO: 57882 - RNA, 20 nt, Artificial Sequence
  MKO10057882_A_Vhl
  gRNA
cgcgcgucgugcugccuuug

SEQ ID NO: 57883 - RNA, 20 nt, Artificial Sequence
  MKO10057883_A_Vil1
  gRNA
ccagcgacuguugcacguca

SEQ ID NO: 57884 - RNA, 20 nt, Artificial Sequence
  MKO10057884_A_Vil1
  gRNA
ccuugacgugcaacagucgc

SEQ ID NO: 57885 - RNA, 20 nt, Artificial Sequence
  MKO10057885_A_Vil1
  gRNA
gcaacgagagcgagacuuuc

SEQ ID NO: 57886 - RNA, 20 nt, Artificial Sequence
  MKO10057886_A_Vill
  gRNA
cccugaugugaagcagucgc

SEQ ID NO: 57887 - RNA, 20 nt, Artificial Sequence
  MKO10057887_A_Vill
  gRNA
gcccgggauggacaucaacc

SEQ ID NO: 57888 - RNA, 20 nt, Artificial Sequence
  MKO10057888_A_Vill
  gRNA
ugugcugcaccgagagucac

SEQ ID NO: 57889 - RNA, 20 nt, Artificial Sequence
  MKO10057889_A_Vimp
  gRNA
ugccgcuuaacaacaacauc

SEQ ID NO: 57890 - RNA, 20 nt, Artificial Sequence
  MKO10057890_A_Vimp
  gRNA
ucugacaaaaagccuuugcg

SEQ ID NO: 57891 - RNA, 20 nt, Artificial Sequence
  MKO10057891_A_Vimp
  gRNA
gccucaaagcccucagucga

SEQ ID NO: 57892 - RNA, 20 nt, Artificial Sequence
  MKO10057892_A_Vim
  gRNA
cagggcaucguuguuccggu

SEQ ID NO: 57893 - RNA, 20 nt, Artificial Sequence
  MKO10057893_A_Vim
  gRNA
gcgccagcaguaugaaagcg

SEQ ID NO: 57894 - RNA, 20 nt, Artificial Sequence
  MKO10057894_A_Vim
  gRNA
agcaggagucaaacgaguac

SEQ ID NO: 57895 - RNA, 20 nt, Artificial Sequence
  MKO10057895_A_Vipas39
  gRNA
cgucauccacgaugucucga

SEQ ID NO: 57896 - RNA, 20 nt, Artificial Sequence
  MKO10057896_A_Vipas39
  gRNA
uuuagcuguucacgucccuc

SEQ ID NO: 57897 - RNA, 20 nt, Artificial Sequence
  MKO10057897_A_Vipas39
  gRNA
cccucagguagaacuagacc

SEQ ID NO: 57898 - RNA, 20 nt, Artificial Sequence
  MKO10057898_A_Vipr1
  gRNA
agggcucuuaccgugaaugg

SEQ ID NO: 57899 - RNA, 20 nt, Artificial Sequence
  MKO10057899_A_Vipr1
  gRNA
ccugcuggccaacgaccccu

SEQ ID NO: 57900 - RNA, 20 nt, Artificial Sequence
  MKO10057900_A_Vipr1
  gRNA
gaaacagcgucagcagugcc

SEQ ID NO: 57901 - RNA, 20 nt, Artificial Sequence
  MKO10057901_A_Vipr2
  gRNA
acaguuuccccaacgucugc

SEQ ID NO: 57902 - RNA, 20 nt, Artificial Sequence
  MKO10057902_A_Vipr2
  gRNA
uaccucucugauucuccguu

SEQ ID NO: 57903 - RNA, 20 nt, Artificial Sequence
  MKO10057903_A_Vipr2
  gRNA
ccagauuucauagaugcgug

SEQ ID NO: 57904 - RNA, 20 nt, Artificial Sequence
  MKO10057904_A_Vip
  gRNA
cagaagucugcuguaaucgc

SEQ ID NO: 57905 - RNA, 20 nt, Artificial Sequence
  MKO10057905_A_Vip
  gRNA
cagcgauuacagcagacuuc

SEQ ID NO: 57906 - RNA, 20 nt, Artificial Sequence
  MKO10057906_A_Vip
  gRNA
gagugucguuugauuggcac

SEQ ID NO: 57907 - RNA, 20 nt, Artificial Sequence
  MKO10057907_A_Vit
  gRNA
cgagaguccuucaucgucgc

SEQ ID NO: 57908 - RNA, 20 nt, Artificial Sequence
  MKO10057908_A_Vit
  gRNA
cgacauaccugcgacgauga

SEQ ID NO: 57909 - RNA, 20 nt, Artificial Sequence
  MKO10057909_A_Vit
  gRNA
agacgccagugccguaaaca

SEQ ID NO: 57910 - RNA, 20 nt, Artificial Sequence
  MKO10057910_A_Vkorc1l1
  gRNA
agccgggcuaccuggaggcc

SEQ ID NO: 57911 - RNA, 20 nt, Artificial Sequence
  MKO10057911_A_Vkorc1l1
  gRNA
gucguuuguaauugaugaug

SEQ ID NO: 57912 - RNA, 20 nt, Artificial Sequence
  MKO10057912_A_Vkorc1l1
  gRNA
gcccguccugcugagagugu

SEQ ID NO: 57913 - RNA, 20 nt, Artificial Sequence
  MKO10057913_A_Vkorc1
  gRNA
aguucccugguguccgucgc

SEQ ID NO: 57914 - RNA, 20 nt, Artificial Sequence
  MKO10057914_A_Vkorc1
  gRNA
uuaccgcgcgcucugcgaug

SEQ ID NO: 57915 - RNA, 20 nt, Artificial Sequence
  MKO10057915_A_Vkorc1
  gRNA
agugcaagccgcacgagucc

SEQ ID NO: 57916 - RNA, 20 nt, Artificial Sequence
  MKO10057916_A_Vldlr
  gRNA
gacagcggcgccacugcaag

SEQ ID NO: 57917 - RNA, 20 nt, Artificial Sequence
  MKO10057917_A_Vldlr
  gRNA
gcacacucacggcacuguuc

SEQ ID NO: 57918 - RNA, 20 nt, Artificial Sequence
  MKO10057918_A_Vldlr
  gRNA
ucagaaccgucuucgcaauc

SEQ ID NO: 57919 - RNA, 20 nt, Artificial Sequence
  MKO10057919_A_Vma21
  gRNA
cagggauaccugaacucugg

SEQ ID NO: 57920 - RNA, 20 nt, Artificial Sequence
  MKO10057920_A_Vma21
  gRNA
cgcugcagccuccagaguuc

SEQ ID NO: 57921 - RNA, 20 nt, Artificial Sequence
  MKO10057921_A_Vma21
  gRNA
guuguaaaauacaagccgau

SEQ ID NO: 57922 - RNA, 20 nt, Artificial Sequence
  MKO10057922_A_Vmac
  gRNA
ugagcgcacgauuggugcgc

SEQ ID NO: 57923 - RNA, 20 nt, Artificial Sequence
  MKO10057923_A_Vmac
  gRNA
cgccgugcaccgacgcgcag

SEQ ID NO: 57924 - RNA, 20 nt, Artificial Sequence
  MKO10057924_A_Vmac
  gRNA
cagcccgaggcuguagcugc

SEQ ID NO: 57925 - RNA, 20 nt, Artificial Sequence
  MKO10057925_A_Vmn1r-ps103
  gRNA
cauacacauaucuagcauua

SEQ ID NO: 57926 - RNA, 20 nt, Artificial Sequence
  MKO10057926_A_Vmn1r-ps103
  gRNA
accaaaaguuucuauugccu

SEQ ID NO: 57927 - RNA, 20 nt, Artificial Sequence
  MKO10057927_A_Vmn1r-ps103
  gRNA
auacauucuaucauaaguac

SEQ ID NO: 57928 - RNA, 20 nt, Artificial Sequence
  MKO10057928_A_Vmn1r100
  gRNA
cauuugaagagcacagaaca

SEQ ID NO: 57929 - RNA, 20 nt, Artificial Sequence
  MKO10057929_A_Vmn1r100
  gRNA
ggccucuccaugucugcuca

SEQ ID NO: 57930 - RNA, 20 nt, Artificial Sequence
  MKO10057930_A_Vmn1r100
  gRNA
gccuacaaugaauccagaag

SEQ ID NO: 57931 - RNA, 20 nt, Artificial Sequence
  MKO10057931_A_Vmn1r101
  gRNA
gcccucuccaugucugcuca

SEQ ID NO: 57932 - RNA, 20 nt, Artificial Sequence
  MKO10057932_A_Vmn1r101
  gRNA
caguugaagagcacagaaca

SEQ ID NO: 57933 - RNA, 20 nt, Artificial Sequence
  MKO10057933_A_Vmn1r101
  gRNA
uagagcaagugucacaaaca

SEQ ID NO: 57934 - RNA, 20 nt, Artificial Sequence
  MKO10057934_A_Vmn1r103
  gRNA
acccucucaaugucugauca

SEQ ID NO: 57935 - RNA, 20 nt, Artificial Sequence
  MKO10057935_A_Vmn1r103
  gRNA
caguugaagagcacagaaca

SEQ ID NO: 57936 - RNA, 20 nt, Artificial Sequence
  MKO10057936_A_Vmn1r103
  gRNA
uaacauccacauuucaauua

SEQ ID NO: 57937 - RNA, 20 nt, Artificial Sequence
  MKO10057937_A_Vmn1r104
  gRNA
cacuugaagagcacagaaca

SEQ ID NO: 57938 - RNA, 20 nt, Artificial Sequence
  MKO10057938_A_Vmn1r104
  gRNA
gcccuuuccaugucugcuca

SEQ ID NO: 57939 - RNA, 20 nt, Artificial Sequence
  MKO10057939_A_Vmn1r104
  gRNA
gccuacaaugaacccagaag

SEQ ID NO: 57940 - RNA, 20 nt, Artificial Sequence
  MKO10057940_A_Vmn1r107
  gRNA
cauuugaagagcacagaaca

SEQ ID NO: 57941 - RNA, 20 nt, Artificial Sequence
  MKO10057941_A_Vmn1r107
  gRNA
gcccucuccaugucugcuca

SEQ ID NO: 57942 - RNA, 20 nt, Artificial Sequence
  MKO10057942_A_Vmn1r107
  gRNA
gccuacaaugaauccagaag

SEQ ID NO: 57943 - RNA, 20 nt, Artificial Sequence
  MKO10057943_A_Vmn1r10
  gRNA
cauucaccucagauaugaua

SEQ ID NO: 57944 - RNA, 20 nt, Artificial Sequence
  MKO10057944_A_Vmn1r10
  gRNA
auacauccauaucauaucug

SEQ ID NO: 57945 - RNA, 20 nt, Artificial Sequence
  MKO10057945_A_Vmn1r10
  gRNA
uccucugauaauaauguuca

SEQ ID NO: 57946 - RNA, 20 nt, Artificial Sequence
  MKO10057946_A_Vmn1r111
  gRNA
uaaauccgugaaaaccacug

SEQ ID NO: 57947 - RNA, 20 nt, Artificial Sequence
  MKO10057947_A_Vmn1r111
  gRNA
cauuugaagagcacagaaca

SEQ ID NO: 57948 - RNA, 20 nt, Artificial Sequence
  MKO10057948_A_Vmn1r111
  gRNA
guuauucuuguuacaguugu

SEQ ID NO: 57949 - RNA, 20 nt, Artificial Sequence
  MKO10057949_A_Vmn1r112
  gRNA
cauuugaagagcacagaaca

SEQ ID NO: 57950 - RNA, 20 nt, Artificial Sequence
  MKO10057950_A_Vmn1r112
  gRNA
ggccucuccaugucugcuca

SEQ ID NO: 57951 - RNA, 20 nt, Artificial Sequence
  MKO10057951_A_Vmn1r112
  gRNA
guguuauugucuauuaucug

SEQ ID NO: 57952 - RNA, 20 nt, Artificial Sequence
  MKO10057952_A_Vmn1r113
  gRNA
ggaguuaccaugaacagaca

SEQ ID NO: 57953 - RNA, 20 nt, Artificial Sequence
  MKO10057953_A_Vmn1r113
  gRNA
ugcauacucauuucuucgua

SEQ ID NO: 57954 - RNA, 20 nt, Artificial Sequence
  MKO10057954_A_Vmn1r113
  gRNA
uguccaccaguuugucacuc

SEQ ID NO: 57955 - RNA, 20 nt, Artificial Sequence
  MKO10057955_A_Vmn1r114
  gRNA
gcccucuccaugucuguucg

SEQ ID NO: 57956 - RNA, 20 nt, Artificial Sequence
  MKO10057956_A_Vmn1r114
  gRNA
cagagcaagugucccaaauu

SEQ ID NO: 57957 - RNA, 20 nt, Artificial Sequence
  MKO10057957_A_Vmn1r114
  gRNA
gaccaugaugcucaugaaug

SEQ ID NO: 57958 - RNA, 20 nt, Artificial Sequence
  MKO10057958_A_Vmn1r115
  gRNA
cccaguaucugccuacacaa

SEQ ID NO: 57959 - RNA, 20 nt, Artificial Sequence
  MKO10057959_A_Vmn1r115
  gRNA
gagacgagaauguauauaaa

SEQ ID NO: 57960 - RNA, 20 nt, Artificial Sequence
  MKO10057960_A_Vmn1r115
  gRNA
gagaaguauaauggagacac

SEQ ID NO: 57961 - RNA, 20 nt, Artificial Sequence
  MKO10057961_A_Vmn1r116
  gRNA
guggcuuaaaaacaccuguc

SEQ ID NO: 57962 - RNA, 20 nt, Artificial Sequence
  MKO10057962_A_Vmn1r116
  gRNA
cauuugaagagcacagaaca

SEQ ID NO: 57963 - RNA, 20 nt, Artificial Sequence
  MKO10057963_A_Vmn1r116
  gRNA
gcccucuccaugucugcuca

SEQ ID NO: 57964 - RNA, 20 nt, Artificial Sequence
  MKO10057964_A_Vmn1r117
  gRNA
gcccucucgaugucugcuca

SEQ ID NO: 57965 - RNA, 20 nt, Artificial Sequence
  MKO10057965_A_Vmn1r117
  gRNA
caguugaagagcacagaaca

SEQ ID NO: 57966 - RNA, 20 nt, Artificial Sequence
  MKO10057966_A_Vmn1r117
  gRNA
cagagcaagugucacaaaca

SEQ ID NO: 57967 - RNA, 20 nt, Artificial Sequence
  MKO10057967_A_Vmn1r118
  gRNA
uaaauccgugaaaaccacug

SEQ ID NO: 57968 - RNA, 20 nt, Artificial Sequence
  MKO10057968_A_Vmn1r118
  gRNA
cauuugaagagcagagaaca

SEQ ID NO: 57969 - RNA, 20 nt, Artificial Sequence
  MKO10057969_A_Vmn1r118
  gRNA
guuauucuuguuacaguugu

SEQ ID NO: 57970 - RNA, 20 nt, Artificial Sequence
  MKO10057970_A_Vmn1r119
  gRNA
cuuguguuccaacugugucc

SEQ ID NO: 57971 - RNA, 20 nt, Artificial Sequence
  MKO10057971_A_Vmn1r119
  gRNA
uucuaaacagaagcccagac

SEQ ID NO: 57972 - RNA, 20 nt, Artificial Sequence
  MKO10057972_A_Vmn1r119
  gRNA
gcccucuccaugucugcuca

SEQ ID NO: 57973 - RNA, 20 nt, Artificial Sequence
  MKO10057973_A_Vmn1r11
  gRNA
caagaagacacauauuagcu

SEQ ID NO: 57974 - RNA, 20 nt, Artificial Sequence
  MKO10057974_A_Vmn1r11
  gRNA
cagucccaauaccucgcugu

SEQ ID NO: 57975 - RNA, 20 nt, Artificial Sequence
  MKO10057975_A_Vmn1r11
  gRNA
gugaaugaaagucuguugac

SEQ ID NO: 57976 - RNA, 20 nt, Artificial Sequence
  MKO10057976_A_Vmn1r120
  gRNA
ugcauucucaucucuucaca

SEQ ID NO: 57977 - RNA, 20 nt, Artificial Sequence
  MKO10057977_A_Vmn1r120
  gRNA
guggcuuaaaaucaccuuuc

SEQ ID NO: 57978 - RNA, 20 nt, Artificial Sequence
  MKO10057978_A_Vmn1r120
  gRNA
uucuaaacagagacccagaa

SEQ ID NO: 57979 - RNA, 20 nt, Artificial Sequence
  MKO10057979_A_Vmn1r121
  gRNA
gccuucuccaugucuguucg

SEQ ID NO: 57980 - RNA, 20 nt, Artificial Sequence
  MKO10057980_A_Vmn1r121
  gRNA
aauuccucuccagucuugac

SEQ ID NO: 57981 - RNA, 20 nt, Artificial Sequence
  MKO10057981_A_Vmn1r121
  gRNA
cagagcaagugucccaaauu

SEQ ID NO: 57982 - RNA, 20 nt, Artificial Sequence
  MKO10057982_A_Vmn1r122
  gRNA
acccucuccaugucugauca

SEQ ID NO: 57983 - RNA, 20 nt, Artificial Sequence
  MKO10057983_A_Vmn1r122
  gRNA
caguugaagagcacagaaca

SEQ ID NO: 57984 - RNA, 20 nt, Artificial Sequence
  MKO10057984_A_Vmn1r122
  gRNA
uaacauccacauuccaauua

SEQ ID NO: 57985 - RNA, 20 nt, Artificial Sequence
  MKO10057985_A_Vmn1r123
  gRNA
cauuugaagaucacagaaca

SEQ ID NO: 57986 - RNA, 20 nt, Artificial Sequence
  MKO10057986_A_Vmn1r123
  gRNA
guggauuaaaaucaccuguc

SEQ ID NO: 57987 - RNA, 20 nt, Artificial Sequence
  MKO10057987_A_Vmn1r123
  gRNA
gcccucuccaugucugcuca

SEQ ID NO: 57988 - RNA, 20 nt, Artificial Sequence
  MKO10057988_A_Vmn1r124
  gRNA
caacacuaaagugcagauac

SEQ ID NO: 57989 - RNA, 20 nt, Artificial Sequence
  MKO10057989_A_Vmn1r124
  gRNA
uacauucucuucucuucaug

SEQ ID NO: 57990 - RNA, 20 nt, Artificial Sequence
  MKO10057990_A_Vmn1r124
  gRNA
agaauucuucagucacauag

SEQ ID NO: 57991 - RNA, 20 nt, Artificial Sequence
  MKO10057991_A_Vmn1r125
  gRNA
ggccuauccaugucugcuca

SEQ ID NO: 57992 - RNA, 20 nt, Artificial Sequence
  MKO10057992_A_Vmn1r125
  gRNA
uaaauccaugaaaaccacug

SEQ ID NO: 57993 - RNA, 20 nt, Artificial Sequence
  MKO10057993_A_Vmn1r125
  gRNA
cauuugaagagcacagaaca

SEQ ID NO: 57994 - RNA, 20 nt, Artificial Sequence
  MKO10057994_A_Vmn1r126
  gRNA
gcccucuccaugucuguucg

SEQ ID NO: 57995 - RNA, 20 nt, Artificial Sequence
  MKO10057995_A_Vmn1r126
  gRNA
cagagcaagugucccaaauu

SEQ ID NO: 57996 - RNA, 20 nt, Artificial Sequence
  MKO10057996_A_Vmn1r126
  gRNA
gaccaugaugcucaugaaug

SEQ ID NO: 57997 - RNA, 20 nt, Artificial Sequence
  MKO10057997_A_Vmn1r127
  gRNA
acccucucaaugucugauca

SEQ ID NO: 57998 - RNA, 20 nt, Artificial Sequence
  MKO10057998_A_Vmn1r127
  gRNA
caguugaaaagcacagaaca

SEQ ID NO: 57999 - RNA, 20 nt, Artificial Sequence
  MKO10057999_A_Vmn1r127
  gRNA
uaacauccacauuccaauua

SEQ ID NO: 58000 - RNA, 20 nt, Artificial Sequence
  MKO10058000_A_Vmn1r128
  gRNA
cauuugaagagcacagaaaa

SEQ ID NO: 58001 - RNA, 20 nt, Artificial Sequence
  MKO10058001_A_Vmn1r128
  gRNA
acucuaguuccuguuaauag

SEQ ID NO: 58002 - RNA, 20 nt, Artificial Sequence
  MKO10058002_A_Vmn1r128
  gRNA
gcccucuccaugucugcuca

SEQ ID NO: 58003 - RNA, 20 nt, Artificial Sequence
  MKO10058003_A_Vmn1r129
  gRNA
gagaaguaccauggagauac

SEQ ID NO: 58004 - RNA, 20 nt, Artificial Sequence
  MKO10058004_A_Vmn1r129
  gRNA
gcccucuccaugucugcuca

SEQ ID NO: 58005 - RNA, 20 nt, Artificial Sequence
  MKO10058005_A_Vmn1r129
  gRNA
caguugaagagcacagaaca

SEQ ID NO: 58006 - RNA, 20 nt, Artificial Sequence
  MKO10058006_A_Vmn1r12
  gRNA
uccccaugaacuacauuguc

SEQ ID NO: 58007 - RNA, 20 nt, Artificial Sequence
  MKO10058007_A_Vmn1r12
  gRNA
cagucacaggaacuccuugu

SEQ ID NO: 58008 - RNA, 20 nt, Artificial Sequence
  MKO10058008_A_Vmn1r12
  gRNA
gcuccugacaauguaguuca

SEQ ID NO: 58009 - RNA, 20 nt, Artificial Sequence
  MKO10058009_A_Vmn1r130
  gRNA
cauuugaagagcacagaaca

SEQ ID NO: 58010 - RNA, 20 nt, Artificial Sequence
  MKO10058010_A_Vmn1r130
  gRNA
gcccucuccaugucugcuca

SEQ ID NO: 58011 - RNA, 20 nt, Artificial Sequence
  MKO10058011_A_Vmn1r130
  gRNA
gccuacaaugaauccagaag

SEQ ID NO: 58012 - RNA, 20 nt, Artificial Sequence
  MKO10058012_A_Vmn1r131
  gRNA
uaaauccgugaaaaccacug

SEQ ID NO: 58013 - RNA, 20 nt, Artificial Sequence
  MKO10058013_A_Vmn1r131
  gRNA
cauuugaagagcacagaaca

SEQ ID NO: 58014 - RNA, 20 nt, Artificial Sequence
  MKO10058014_A_Vmn1r131
  gRNA
guuauucuuguuacaguugu

SEQ ID NO: 58015 - RNA, 20 nt, Artificial Sequence
  MKO10058015_A_Vmn1r132
  gRNA
cauuugaagagcacagaaca

SEQ ID NO: 58016 - RNA, 20 nt, Artificial Sequence
  MKO10058016_A_Vmn1r132
  gRNA
ggccucuccaugucugcuca

SEQ ID NO: 58017 - RNA, 20 nt, Artificial Sequence
  MKO10058017_A_Vmn1r132
  gRNA
guguuauugucuauuaucug

SEQ ID NO: 58018 - RNA, 20 nt, Artificial Sequence
  MKO10058018_A_Vmn1r135
  gRNA
cauuugaagagcacagaaca

SEQ ID NO: 58019 - RNA, 20 nt, Artificial Sequence
  MKO10058019_A_Vmn1r135
  gRNA
gcccucuccaugucugcuca

SEQ ID NO: 58020 - RNA, 20 nt, Artificial Sequence
  MKO10058020_A_Vmn1r135
  gRNA
guguuauugucuguuaucug

SEQ ID NO: 58021 - RNA, 20 nt, Artificial Sequence
  MKO10058021_A_Vmn1r137
  gRNA
cauuugaagagcacagaaca

SEQ ID NO: 58022 - RNA, 20 nt, Artificial Sequence
  MKO10058022_A_Vmn1r137
  gRNA
gcccucuccaugucugcuca

SEQ ID NO: 58023 - RNA, 20 nt, Artificial Sequence
  MKO10058023_A_Vmn1r137
  gRNA
gccuacaaugaauccagaag

SEQ ID NO: 58024 - RNA, 20 nt, Artificial Sequence
  MKO10058024_A_Vmn1r138
  gRNA
uaaauccgugaaaaccacug

SEQ ID NO: 58025 - RNA, 20 nt, Artificial Sequence
  MKO10058025_A_Vmn1r138
  gRNA
cauuugaagagcacagaaca

SEQ ID NO: 58026 - RNA, 20 nt, Artificial Sequence
  MKO10058026_A_Vmn1r138
  gRNA
guuauucuuguuacaguugu

SEQ ID NO: 58027 - RNA, 20 nt, Artificial Sequence
  MKO10058027_A_Vmn1r139
  gRNA
cauuugaagagcacagaaca

SEQ ID NO: 58028 - RNA, 20 nt, Artificial Sequence
  MKO10058028_A_Vmn1r139
  gRNA
ggccucuccaugucugcuca

SEQ ID NO: 58029 - RNA, 20 nt, Artificial Sequence
  MKO10058029_A_Vmn1r139
  gRNA
guguuauugucuauuaucug

SEQ ID NO: 58030 - RNA, 20 nt, Artificial Sequence
  MKO10058030_A_Vmn1r13
  gRNA
auacauccauaacgugacug

SEQ ID NO: 58031 - RNA, 20 nt, Artificial Sequence
  MKO10058031_A_Vmn1r13
  gRNA
aguauccugaucuucuauac

SEQ ID NO: 58032 - RNA, 20 nt, Artificial Sequence
  MKO10058032_A_Vmn1r13
  gRNA
caguccgaguaccucuaugc

SEQ ID NO: 58033 - RNA, 20 nt, Artificial Sequence
  MKO10058033_A_Vmn1r142
  gRNA
acccucucaaugucugauca

SEQ ID NO: 58034 - RNA, 20 nt, Artificial Sequence
  MKO10058034_A_Vmn1r142
  gRNA
caguugaaaagcacagaaca

SEQ ID NO: 58035 - RNA, 20 nt, Artificial Sequence
  MKO10058035_A_Vmn1r142
  gRNA
uaacauccacauuccaauua

SEQ ID NO: 58036 - RNA, 20 nt, Artificial Sequence
  MKO10058036_A_Vmn1r143
  gRNA
cauuugaagagcacagaaca

SEQ ID NO: 58037 - RNA, 20 nt, Artificial Sequence
  MKO10058037_A_Vmn1r143
  gRNA
gcccucuccaugucugcuca

SEQ ID NO: 58038 - RNA, 20 nt, Artificial Sequence
  MKO10058038_A_Vmn1r143
  gRNA
gccuacaaugaauccagaag

SEQ ID NO: 58039 - RNA, 20 nt, Artificial Sequence
  MKO10058039_A_Vmn1r148
  gRNA
cauuugaagagcacagaaca

SEQ ID NO: 58040 - RNA, 20 nt, Artificial Sequence
  MKO10058040_A_Vmn1r148
  gRNA
ggccucuccaugucugcuca

SEQ ID NO: 58041 - RNA, 20 nt, Artificial Sequence
  MKO10058041_A_Vmn1r148
  gRNA
gccuacaaugaauccagaag

SEQ ID NO: 58042 - RNA, 20 nt, Artificial Sequence
  MKO10058042_A_Vmn1r149
  gRNA
uauagugaggaaucgaguca

SEQ ID NO: 58043 - RNA, 20 nt, Artificial Sequence
  MKO10058043_A_Vmn1r149
  gRNA
gcccucuccaugucugcuca

SEQ ID NO: 58044 - RNA, 20 nt, Artificial Sequence
  MKO10058044_A_Vmn1r149
  gRNA
caguugaagagcacagaaca

SEQ ID NO: 58045 - RNA, 20 nt, Artificial Sequence
  MKO10058045_A_Vmn1r14
  gRNA
ugauacgagaguaauccgug

SEQ ID NO: 58046 - RNA, 20 nt, Artificial Sequence
  MKO10058046_A_Vmn1r14
  gRNA
aagcauucaccacaaacuuc

SEQ ID NO: 58047 - RNA, 20 nt, Artificial Sequence
  MKO10058047_A_Vmn1r14
  gRNA
cagucauaggaacucuuugu

SEQ ID NO: 58048 - RNA, 20 nt, Artificial Sequence
  MKO10058048_A_Vmn1r151
  gRNA
acccucucaaugucugauca

SEQ ID NO: 58049 - RNA, 20 nt, Artificial Sequence
  MKO10058049_A_Vmn1r151
  gRNA
caguugaagagcacagaaca

SEQ ID NO: 58050 - RNA, 20 nt, Artificial Sequence
  MKO10058050_A_Vmn1r151
  gRNA
uaacauccacauuucaauua

SEQ ID NO: 58051 - RNA, 20 nt, Artificial Sequence
  MKO10058051_A_Vmn1r152
  gRNA
cacuugaagagcacagaaca

SEQ ID NO: 58052 - RNA, 20 nt, Artificial Sequence
  MKO10058052_A_Vmn1r152
  gRNA
gcccuuuccaugucugcuca

SEQ ID NO: 58053 - RNA, 20 nt, Artificial Sequence
  MKO10058053_A_Vmn1r152
  gRNA
gccuacaaugaacccagaag

SEQ ID NO: 58054 - RNA, 20 nt, Artificial Sequence
  MKO10058054_A_Vmn1r155
  gRNA
cauuugaagagcacagaaca

SEQ ID NO: 58055 - RNA, 20 nt, Artificial Sequence
  MKO10058055_A_Vmn1r155
  gRNA
gcccucuccaugucugcuca

SEQ ID NO: 58056 - RNA, 20 nt, Artificial Sequence
  MKO10058056_A_Vmn1r155
  gRNA
gccuacaaugaauccagaag

SEQ ID NO: 58057 - RNA, 20 nt, Artificial Sequence
  MKO10058057_A_Vmn1r157
  gRNA
ccacggucccaaccucaaaa

SEQ ID NO: 58058 - RNA, 20 nt, Artificial Sequence
  MKO10058058_A_Vmn1r157
  gRNA
uuauaaacagaggcccagac

SEQ ID NO: 58059 - RNA, 20 nt, Artificial Sequence
  MKO10058059_A_Vmn1r157
  gRNA
cauuugaagagcacagaaca

SEQ ID NO: 58060 - RNA, 20 nt, Artificial Sequence
  MKO10058060_A_Vmn1r158
  gRNA
cuccucuugcuuugucaguu

SEQ ID NO: 58061 - RNA, 20 nt, Artificial Sequence
  MKO10058061_A_Vmn1r158
  gRNA
acggacaaacagaaagacuu

SEQ ID NO: 58062 - RNA, 20 nt, Artificial Sequence
  MKO10058062_A_Vmn1r158
  gRNA
ccccaaacugacaaagcaag

SEQ ID NO: 58063 - RNA, 20 nt, Artificial Sequence
  MKO10058063_A_Vmn1r159
  gRNA
acucccaaucagaacaccag

SEQ ID NO: 58064 - RNA, 20 nt, Artificial Sequence
  MKO10058064_A_Vmn1r159
  gRNA
ugguguucugauugggagug

SEQ ID NO: 58065 - RNA, 20 nt, Artificial Sequence
  MKO10058065_A_Vmn1r159
  gRNA
acccucuccaugucugauca

SEQ ID NO: 58066 - RNA, 20 nt, Artificial Sequence
  MKO10058066_A_Vmn1r15
  gRNA
auaaaggacauucucuaccg

SEQ ID NO: 58067 - RNA, 20 nt, Artificial Sequence
  MKO10058067_A_Vmn1r15
  gRNA
auuuggcucgcagacauauu

SEQ ID NO: 58068 - RNA, 20 nt, Artificial Sequence
  MKO10058068_A_Vmn1r15
  gRNA
caaugucagugagaccaagc

SEQ ID NO: 58069 - RNA, 20 nt, Artificial Sequence
  MKO10058069_A_Vmn1r160
  gRNA
guggauuaaaauuaccuguc

SEQ ID NO: 58070 - RNA, 20 nt, Artificial Sequence
  MKO10058070_A_Vmn1r160
  gRNA
cuacggucccaaccccaaac

SEQ ID NO: 58071 - RNA, 20 nt, Artificial Sequence
  MKO10058071_A_Vmn1r160
  gRNA
aaauuguucuguuccacuuc

SEQ ID NO: 58072 - RNA, 20 nt, Artificial Sequence
  MKO10058072_A_Vmn1r163
  gRNA
cauuugaagagcacagaaca

SEQ ID NO: 58073 - RNA, 20 nt, Artificial Sequence
  MKO10058073_A_Vmn1r163
  gRNA
gcccucuccaugucugcuca

SEQ ID NO: 58074 - RNA, 20 nt, Artificial Sequence
  MKO10058074_A_Vmn1r163
  gRNA
guguuauugucuguuaucug

SEQ ID NO: 58075 - RNA, 20 nt, Artificial Sequence
  MKO10058075_A_Vmn1r165
  gRNA
cauuugaagagcacagaaca

SEQ ID NO: 58076 - RNA, 20 nt, Artificial Sequence
  MKO10058076_A_Vmn1r165
  gRNA
gcccucuccaugucugcuca

SEQ ID NO: 58077 - RNA, 20 nt, Artificial Sequence
  MKO10058077_A_Vmn1r165
  gRNA
gccuacaaugaauccagaag

SEQ ID NO: 58078 - RNA, 20 nt, Artificial Sequence
  MKO10058078_A_Vmn1r166
  gRNA
uaaauccgugaaaaccacug

SEQ ID NO: 58079 - RNA, 20 nt, Artificial Sequence
  MKO10058079_A_Vmn1r166
  gRNA
cauuugaagagcacagaaca

SEQ ID NO: 58080 - RNA, 20 nt, Artificial Sequence
  MKO10058080_A_Vmn1r166
  gRNA
guuauucuuguuacaguugu

SEQ ID NO: 58081 - RNA, 20 nt, Artificial Sequence
  MKO10058081_A_Vmn1r167
  gRNA
gaggcguguaaaccaaauuu

SEQ ID NO: 58082 - RNA, 20 nt, Artificial Sequence
  MKO10058082_A_Vmn1r167
  gRNA
aucuuaucauuugcccauga

SEQ ID NO: 58083 - RNA, 20 nt, Artificial Sequence
  MKO10058083_A_Vmn1r167
  gRNA
ggaagcuuacagccaaaauu

SEQ ID NO: 58084 - RNA, 20 nt, Artificial Sequence
  MKO10058084_A_Vmn1r168
  gRNA
ccauagcauuguguugcuug

SEQ ID NO: 58085 - RNA, 20 nt, Artificial Sequence
  MKO10058085_A_Vmn1r168
  gRNA
ucuauacaggagacguacca

SEQ ID NO: 58086 - RNA, 20 nt, Artificial Sequence
  MKO10058086_A_Vmn1r168
  gRNA
uaguugaagaucagagaaca

SEQ ID NO: 58087 - RNA, 20 nt, Artificial Sequence
  MKO10058087_A_Vmn1r169
  gRNA
acucucgggucugguugaga

SEQ ID NO: 58088 - RNA, 20 nt, Artificial Sequence
  MKO10058088_A_Vmn1r169
  gRNA
gccuauacugaaaccaguag

SEQ ID NO: 58089 - RNA, 20 nt, Artificial Sequence
  MKO10058089_A_Vmn1r169
  gRNA
agauuuauucugcgacaaca

SEQ ID NO: 58090 - RNA, 20 nt, Artificial Sequence
  MKO10058090_A_Vmn1r16
  gRNA
uaauaacuauguugaaaaac

SEQ ID NO: 58091 - RNA, 20 nt, Artificial Sequence
  MKO10058091_A_Vmn1r16
  gRNA
acauguugaauaucuuguuc

SEQ ID NO: 58092 - RNA, 20 nt, Artificial Sequence
  MKO10058092_A_Vmn1r16
  gRNA
cagccccaguacaucacugu

SEQ ID NO: 58093 - RNA, 20 nt, Artificial Sequence
  MKO10058093_A_Vmn1r170
  gRNA
auuugugaccuguuaucauc

SEQ ID NO: 58094 - RNA, 20 nt, Artificial Sequence
  MKO10058094_A_Vmn1r170
  gRNA
auugaauaugcugcagucug

SEQ ID NO: 58095 - RNA, 20 nt, Artificial Sequence
  MKO10058095_A_Vmn1r170
  gRNA
aauuuaucuccaaacuugaa

SEQ ID NO: 58096 - RNA, 20 nt, Artificial Sequence
  MKO10058096_A_Vmn1r171
  gRNA
gugagcauuauuuaagacac

SEQ ID NO: 58097 - RNA, 20 nt, Artificial Sequence
  MKO10058097_A_Vmn1r171
  gRNA
aaggcgugucaaagaaauuu

SEQ ID NO: 58098 - RNA, 20 nt, Artificial Sequence
  MKO10058098_A_Vmn1r171
  gRNA
augaacucugagcuucugau

SEQ ID NO: 58099 - RNA, 20 nt, Artificial Sequence
  MKO10058099_A_Vmn1r172
  gRNA
ugaggcaugucaguggaauu

SEQ ID NO: 58100 - RNA, 20 nt, Artificial Sequence
  MKO10058100_A_Vmn1r172
  gRNA
agaauagugcacaaaugucg

SEQ ID NO: 58101 - RNA, 20 nt, Artificial Sequence
  MKO10058101_A_Vmn1r172
  gRNA
agagauugcccacagcaaug

SEQ ID NO: 58102 - RNA, 20 nt, Artificial Sequence
  MKO10058102_A_Vmn1r173
  gRNA
aucauucuacuccauuugcc

SEQ ID NO: 58103 - RNA, 20 nt, Artificial Sequence
  MKO10058103_A_Vmn1r173
  gRNA
agagauugccuacaguaaug

SEQ ID NO: 58104 - RNA, 20 nt, Artificial Sequence
  MKO10058104_A_Vmn1r173
  gRNA
acaaaaacuaugauauugcu

SEQ ID NO: 58105 - RNA, 20 nt, Artificial Sequence
  MKO10058105_A_Vmn1r174
  gRNA
uguuugcacuucgagccacc

SEQ ID NO: 58106 - RNA, 20 nt, Artificial Sequence
  MKO10058106_A_Vmn1r174
  gRNA
cgauaaacugguaagagcuc

SEQ ID NO: 58107 - RNA, 20 nt, Artificial Sequence
  MKO10058107_A_Vmn1r174
  gRNA
cucccuuaauguugaucguu

SEQ ID NO: 58108 - RNA, 20 nt, Artificial Sequence
  MKO10058108_A_Vmn1r175
  gRNA
cugcagucccaaacccaacc

SEQ ID NO: 58109 - RNA, 20 nt, Artificial Sequence
  MKO10058109_A_Vmn1r175
  gRNA
cugauaagugcucagaaagc

SEQ ID NO: 58110 - RNA, 20 nt, Artificial Sequence
  MKO10058110_A_Vmn1r175
  gRNA
cacauuccaaugaaagucaa

SEQ ID NO: 58111 - RNA, 20 nt, Artificial Sequence
  MKO10058111_A_Vmn1r176
  gRNA
acaaguauaccucaaaaaau

SEQ ID NO: 58112 - RNA, 20 nt, Artificial Sequence
  MKO10058112_A_Vmn1r176
  gRNA
auugaauaugcugcagucuu

SEQ ID NO: 58113 - RNA, 20 nt, Artificial Sequence
  MKO10058113_A_Vmn1r176
  gRNA
ugggguagggugaugcuccc

SEQ ID NO: 58114 - RNA, 20 nt, Artificial Sequence
  MKO10058114_A_Vmn1r177
  gRNA
cuauaugccucaaccacaga

SEQ ID NO: 58115 - RNA, 20 nt, Artificial Sequence
  MKO10058115_A_Vmn1r177
  gRNA
agaagugauuuguacuaaca

SEQ ID NO: 58116 - RNA, 20 nt, Artificial Sequence
  MKO10058116_A_Vmn1r177
  gRNA
aucagcucauugaaauuacc

SEQ ID NO: 58117 - RNA, 20 nt, Artificial Sequence
  MKO10058117_A_Vmn1r178
  gRNA
caagaauaacucgucaaguu

SEQ ID NO: 58118 - RNA, 20 nt, Artificial Sequence
  MKO10058118_A_Vmn1r178
  gRNA
ggagcaaaagccaucauguc

SEQ ID NO: 58119 - RNA, 20 nt, Artificial Sequence
  MKO10058119_A_Vmn1r178
  gRNA
cacuucauuuccagacauga

SEQ ID NO: 58120 - RNA, 20 nt, Artificial Sequence
  MKO10058120_A_Vmn1r179
  gRNA
acuaccaaucgacacuacag

SEQ ID NO: 58121 - RNA, 20 nt, Artificial Sequence
  MKO10058121_A_Vmn1r179
  gRNA
agaauucuucauucgccuag

SEQ ID NO: 58122 - RNA, 20 nt, Artificial Sequence
  MKO10058122_A_Vmn1r179
  gRNA
uaucaagcguacacauagag

SEQ ID NO: 58123 - RNA, 20 nt, Artificial Sequence
  MKO10058123_A_Vmn1r17
  gRNA
guaugacccuaucauccugc

SEQ ID NO: 58124 - RNA, 20 nt, Artificial Sequence
  MKO10058124_A_Vmn1r17
  gRNA
ugcacucaaagcaccaccag

SEQ ID NO: 58125 - RNA, 20 nt, Artificial Sequence
  MKO10058125_A_Vmn1r17
  gRNA
uagggucauacauccacaau

SEQ ID NO: 58126 - RNA, 20 nt, Artificial Sequence
  MKO10058126_A_Vmn1r180
  gRNA
caagaauaacuugccaaauu

SEQ ID NO: 58127 - RNA, 20 nt, Artificial Sequence
  MKO10058127_A_Vmn1r180
  gRNA
uagauucuuaucucuuugug

SEQ ID NO: 58128 - RNA, 20 nt, Artificial Sequence
  MKO10058128_A_Vmn1r180
  gRNA
uacaaaaaacaugugaaaga

SEQ ID NO: 58129 - RNA, 20 nt, Artificial Sequence
  MKO10058129_A_Vmn1r181
  gRNA
gaacuucacugcaaugccuc

SEQ ID NO: 58130 - RNA, 20 nt, Artificial Sequence
  MKO10058130_A_Vmn1r181
  gRNA
ugcagugaaguucugguugu

SEQ ID NO: 58131 - RNA, 20 nt, Artificial Sequence
  MKO10058131_A_Vmn1r181
  gRNA
uauauucucaccaauuccug

SEQ ID NO: 58132 - RNA, 20 nt, Artificial Sequence
  MKO10058132_A_Vmn1r183
  gRNA
auuagaauucuuuacucgcc

SEQ ID NO: 58133 - RNA, 20 nt, Artificial Sequence
  MKO10058133_A_Vmn1r183
  gRNA
uagauucucgucucuuugug

SEQ ID NO: 58134 - RNA, 20 nt, Artificial Sequence
  MKO10058134_A_Vmn1r183
  gRNA
acucuuguuccuguuaauaa

SEQ ID NO: 58135 - RNA, 20 nt, Artificial Sequence
  MKO10058135_A_Vmn1r184
  gRNA
ugccccacauaauaggacuu

SEQ ID NO: 58136 - RNA, 20 nt, Artificial Sequence
  MKO10058136_A_Vmn1r184
  gRNA
gcaugugcaagauccacaug

SEQ ID NO: 58137 - RNA, 20 nt, Artificial Sequence
  MKO10058137_A_Vmn1r184
  gRNA
guccccaaaguccuauuaug

SEQ ID NO: 58138 - RNA, 20 nt, Artificial Sequence
  MKO10058138_A_Vmn1r185
  gRNA
ugccccacauaauagcauuu

SEQ ID NO: 58139 - RNA, 20 nt, Artificial Sequence
  MKO10058139_A_Vmn1r185
  gRNA
ccucaugucuagauucaacu

SEQ ID NO: 58140 - RNA, 20 nt, Artificial Sequence
  MKO10058140_A_Vmn1r185
  gRNA
guccccaaaaugcuauuaug

SEQ ID NO: 58141 - RNA, 20 nt, Artificial Sequence
  MKO10058141_A_Vmn1r186
  gRNA
ccugaaaaccauggaagugu

SEQ ID NO: 58142 - RNA, 20 nt, Artificial Sequence
  MKO10058142_A_Vmn1r186
  gRNA
ucccuaaauaucaacaguaa

SEQ ID NO: 58143 - RNA, 20 nt, Artificial Sequence
  MKO10058143_A_Vmn1r186
  gRNA
uacaugcuaaugaaugucag

SEQ ID NO: 58144 - RNA, 20 nt, Artificial Sequence
  MKO10058144_A_Vmn1r187
  gRNA
ccugaaaaccauggaaaugu

SEQ ID NO: 58145 - RNA, 20 nt, Artificial Sequence
  MKO10058145_A_Vmn1r187
  gRNA
aucccuaaauaucaacagua

SEQ ID NO: 58146 - RNA, 20 nt, Artificial Sequence
  MKO10058146_A_Vmn1r187
  gRNA
uacaugcuaaugaaugucag

SEQ ID NO: 58147 - RNA, 20 nt, Artificial Sequence
  MKO10058147_A_Vmn1r188
  gRNA
acacauuccauuagaaguac

SEQ ID NO: 58148 - RNA, 20 nt, Artificial Sequence
  MKO10058148_A_Vmn1r188
  gRNA
augucucccacuguucagcc

SEQ ID NO: 58149 - RNA, 20 nt, Artificial Sequence
  MKO10058149_A_Vmn1r188
  gRNA
gccaucaucaucagucccac

SEQ ID NO: 58150 - RNA, 20 nt, Artificial Sequence
  MKO10058150_A_Vmn1r189
  gRNA
agauaauuguuuacuugaca

SEQ ID NO: 58151 - RNA, 20 nt, Artificial Sequence
  MKO10058151_A_Vmn1r189
  gRNA
acgggcuucuaguugaaugu

SEQ ID NO: 58152 - RNA, 20 nt, Artificial Sequence
  MKO10058152_A_Vmn1r189
  gRNA
agccuaauccauuccaucac

SEQ ID NO: 58153 - RNA, 20 nt, Artificial Sequence
  MKO10058153_A_Vmn1r18
  gRNA
ccacauaagagcauccccug

SEQ ID NO: 58154 - RNA, 20 nt, Artificial Sequence
  MKO10058154_A_Vmn1r18
  gRNA
aggucugucaacuaguauuu

SEQ ID NO: 58155 - RNA, 20 nt, Artificial Sequence
  MKO10058155_A_Vmn1r18
  gRNA
cuuaaauugugcuaaaaaug

SEQ ID NO: 58156 - RNA, 20 nt, Artificial Sequence
  MKO10058156_A_Vmn1r191
  gRNA
ggcuaaaagaugcguaagca

SEQ ID NO: 58157 - RNA, 20 nt, Artificial Sequence
  MKO10058157_A_Vmn1r191
  gRNA
uuccucuucaugauucuggu

SEQ ID NO: 58158 - RNA, 20 nt, Artificial Sequence
  MKO10058158_A_Vmn1r191
  gRNA
ugccaaccagaaucaugaag

SEQ ID NO: 58159 - RNA, 20 nt, Artificial Sequence
  MKO10058159_A_Vmn1r192
  gRNA
cuuuguccaaagggcagucc

SEQ ID NO: 58160 - RNA, 20 nt, Artificial Sequence
  MKO10058160_A_Vmn1r192
  gRNA
agaacuuggcaugcuguuug

SEQ ID NO: 58161 - RNA, 20 nt, Artificial Sequence
  MKO10058161_A_Vmn1r192
  gRNA
ugauacugguuguaaaacug

SEQ ID NO: 58162 - RNA, 20 nt, Artificial Sequence
  MKO10058162_A_Vmn1r193
  gRNA
cacaaauauccuugaugauc

SEQ ID NO: 58163 - RNA, 20 nt, Artificial Sequence
  MKO10058163_A_Vmn1r193
  gRNA
acccugagcuguaaagauag

SEQ ID NO: 58164 - RNA, 20 nt, Artificial Sequence
  MKO10058164_A_Vmn1r193
  gRNA
cuccaaguccaacaagugaa

SEQ ID NO: 58165 - RNA, 20 nt, Artificial Sequence
  MKO10058165_A_Vmn1r194
  gRNA
cacgcuugugaugcuuauac

SEQ ID NO: 58166 - RNA, 20 nt, Artificial Sequence
  MKO10058166_A_Vmn1r194
  gRNA
acuaaaacaugucuaguacu

SEQ ID NO: 58167 - RNA, 20 nt, Artificial Sequence
  MKO10058167_A_Vmn1r194
  gRNA
aggccaaaccacagacuucg

SEQ ID NO: 58168 - RNA, 20 nt, Artificial Sequence
  MKO10058168_A_Vmn1r195
  gRNA
gcccagaaauccgagcuacg

SEQ ID NO: 58169 - RNA, 20 nt, Artificial Sequence
  MKO10058169_A_Vmn1r195
  gRNA
ugagaacacuccacguagcu

SEQ ID NO: 58170 - RNA, 20 nt, Artificial Sequence
  MKO10058170_A_Vmn1r195
  gRNA
gauaaaccuuuaguuacuag

SEQ ID NO: 58171 - RNA, 20 nt, Artificial Sequence
  MKO10058171_A_Vmn1r196
  gRNA
acuaaucugccucaguugua

SEQ ID NO: 58172 - RNA, 20 nt, Artificial Sequence
  MKO10058172_A_Vmn1r196
  gRNA
ccuaaagcugcaauugucac

SEQ ID NO: 58173 - RNA, 20 nt, Artificial Sequence
  MKO10058173_A_Vmn1r196
  gRNA
ggcucagacuaaggucuaaa

SEQ ID NO: 58174 - RNA, 20 nt, Artificial Sequence
  MKO10058174_A_Vmn1r197
  gRNA
ugaguccaagacacucaaug

SEQ ID NO: 58175 - RNA, 20 nt, Artificial Sequence
  MKO10058175_A_Vmn1r197
  gRNA
ggcugagaacugcauaacca

SEQ ID NO: 58176 - RNA, 20 nt, Artificial Sequence
  MKO10058176_A_Vmn1r197
  gRNA
ugagcaagaaugagauguau

SEQ ID NO: 58177 - RNA, 20 nt, Artificial Sequence
  MKO10058177_A_Vmn1r198
  gRNA
auccuaauguuugcgagacu

SEQ ID NO: 58178 - RNA, 20 nt, Artificial Sequence
  MKO10058178_A_Vmn1r198
  gRNA
aaaccacuugauaauguguc

SEQ ID NO: 58179 - RNA, 20 nt, Artificial Sequence
  MKO10058179_A_Vmn1r198
  gRNA
acccaagucucgcaaacauu

SEQ ID NO: 58180 - RNA, 20 nt, Artificial Sequence
  MKO10058180_A_Vmn1r199
  gRNA
uugaacguuggcauguucag

SEQ ID NO: 58181 - RNA, 20 nt, Artificial Sequence
  MKO10058181_A_Vmn1r199
  gRNA
uucucgaggauuuaccauua

SEQ ID NO: 58182 - RNA, 20 nt, Artificial Sequence
  MKO10058182_A_Vmn1r199
  gRNA
guauuugcauccugcacaca

SEQ ID NO: 58183 - RNA, 20 nt, Artificial Sequence
  MKO10058183_A_Vmn1r19
  gRNA
cuacuagcagcaagauguuu

SEQ ID NO: 58184 - RNA, 20 nt, Artificial Sequence
  MKO10058184_A_Vmn1r19
  gRNA
gagugaaaaccgccagauga

SEQ ID NO: 58185 - RNA, 20 nt, Artificial Sequence
  MKO10058185_A_Vmn1r19
  gRNA
cauucaccucaacccuguuu

SEQ ID NO: 58186 - RNA, 20 nt, Artificial Sequence
  MKO10058186_A_Vmn1r1
  gRNA
augucaccugagcguccucc

SEQ ID NO: 58187 - RNA, 20 nt, Artificial Sequence
  MKO10058187_A_Vmn1r1
  gRNA
uaccaugagcccuacuagag

SEQ ID NO: 58188 - RNA, 20 nt, Artificial Sequence
  MKO10058188_A_Vmn1r1
  gRNA
ccugaaagaaugugaccacg

SEQ ID NO: 58189 - RNA, 20 nt, Artificial Sequence
  MKO10058189_A_Vmn1r200
  gRNA
cucucguuuauaugugcaau

SEQ ID NO: 58190 - RNA, 20 nt, Artificial Sequence
  MKO10058190_A_Vmn1r200
  gRNA
augggcuucugguugauugg

SEQ ID NO: 58191 - RNA, 20 nt, Artificial Sequence
  MKO10058191_A_Vmn1r200
  gRNA
uucuugaguauuuaccauca

SEQ ID NO: 58192 - RNA, 20 nt, Artificial Sequence
  MKO10058192_A_Vmn1r201
  gRNA
ucuguaguugcaacguacau

SEQ ID NO: 58193 - RNA, 20 nt, Artificial Sequence
  MKO10058193_A_Vmn1r201
  gRNA
uagugagcacguaagacauu

SEQ ID NO: 58194 - RNA, 20 nt, Artificial Sequence
  MKO10058194_A_Vmn1r201
  gRNA
auaugugcacaauucugccu

SEQ ID NO: 58195 - RNA, 20 nt, Artificial Sequence
  MKO10058195_A_Vmn1r202
  gRNA
acuaaaaacgcuuucauacu

SEQ ID NO: 58196 - RNA, 20 nt, Artificial Sequence
  MKO10058196_A_Vmn1r202
  gRNA
uauggacaucaaagauaauc

SEQ ID NO: 58197 - RNA, 20 nt, Artificial Sequence
  MKO10058197_A_Vmn1r202
  gRNA
ugugaaaucauuugccacug

SEQ ID NO: 58198 - RNA, 20 nt, Artificial Sequence
  MKO10058198_A_Vmn1r203
  gRNA
auuucgaguguuuaccauca

SEQ ID NO: 58199 - RNA, 20 nt, Artificial Sequence
  MKO10058199_A_Vmn1r203
  gRNA
gauggccuuugguuaaauuu

SEQ ID NO: 58200 - RNA, 20 nt, Artificial Sequence
  MKO10058200_A_Vmn1r203
  gRNA
cacccucucuagguaaacaa

SEQ ID NO: 58201 - RNA, 20 nt, Artificial Sequence
  MKO10058201_A_Vmn1r204
  gRNA
agaauaugccaugccgucug

SEQ ID NO: 58202 - RNA, 20 nt, Artificial Sequence
  MKO10058202_A_Vmn1r204
  gRNA
agauguuauucuaguccacu

SEQ ID NO: 58203 - RNA, 20 nt, Artificial Sequence
  MKO10058203_A_Vmn1r204
  gRNA
cacaaauaucccagaugauc

SEQ ID NO: 58204 - RNA, 20 nt, Artificial Sequence
  MKO10058204_A_Vmn1r205
  gRNA
agugccaaacauagucauaa

SEQ ID NO: 58205 - RNA, 20 nt, Artificial Sequence
  MKO10058205_A_Vmn1r205
  gRNA
uuucccuuuaugacuauguu

SEQ ID NO: 58206 - RNA, 20 nt, Artificial Sequence
  MKO10058206_A_Vmn1r205
  gRNA
gacuuguacuucuaaugaaa

SEQ ID NO: 58207 - RNA, 20 nt, Artificial Sequence
  MKO10058207_A_Vmn1r206
  gRNA
auccauuccaucacaagugu

SEQ ID NO: 58208 - RNA, 20 nt, Artificial Sequence
  MKO10058208_A_Vmn1r206
  gRNA
auucagaccuacacuuguga

SEQ ID NO: 58209 - RNA, 20 nt, Artificial Sequence
  MKO10058209_A_Vmn1r206
  gRNA
ccugagagaugcauuauuuc

SEQ ID NO: 58210 - RNA, 20 nt, Artificial Sequence
  MKO10058210_A_Vmn1r207-ps
  gRNA
agaaacuucccagaugccau

SEQ ID NO: 58211 - RNA, 20 nt, Artificial Sequence
  MKO10058211_A_Vmn1r207-ps
  gRNA
uugaaaagagacuuaaaauu

SEQ ID NO: 58212 - RNA, 20 nt, Artificial Sequence
  MKO10058212_A_Vmn1r207-ps
  gRNA
ccaaaaacugcuacugucuu

SEQ ID NO: 58213 - RNA, 20 nt, Artificial Sequence
  MKO10058213_A_Vmn1r208
  gRNA
ggcuaaaaguuggauaacaa

SEQ ID NO: 58214 - RNA, 20 nt, Artificial Sequence
  MKO10058214_A_Vmn1r208
  gRNA
ccugagagaugcauuguuuc

SEQ ID NO: 58215 - RNA, 20 nt, Artificial Sequence
  MKO10058215_A_Vmn1r208
  gRNA
aaacaaaacacagcaucaaa

SEQ ID NO: 58216 - RNA, 20 nt, Artificial Sequence
  MKO10058216_A_Vmn1r209
  gRNA
agugccaaccacaguuauaa

SEQ ID NO: 58217 - RNA, 20 nt, Artificial Sequence
  MKO10058217_A_Vmn1r209
  gRNA
uugaagagagacuaaaaauu

SEQ ID NO: 58218 - RNA, 20 nt, Artificial Sequence
  MKO10058218_A_Vmn1r209
  gRNA
cuauuuaaugcaagaaaauc

SEQ ID NO: 58219 - RNA, 20 nt, Artificial Sequence
  MKO10058219_A_Vmn1r20
  gRNA
acugacuuucauucacauaa

SEQ ID NO: 58220 - RNA, 20 nt, Artificial Sequence
  MKO10058220_A_Vmn1r20
  gRNA
ccuccacaacagaacugaua

SEQ ID NO: 58221 - RNA, 20 nt, Artificial Sequence
  MKO10058221_A_Vmn1r20
  gRNA
caaccauaucaguucuguug

SEQ ID NO: 58222 - RNA, 20 nt, Artificial Sequence
  MKO10058222_A_Vmn1r210
  gRNA
uugaagagaugcuuauaauu

SEQ ID NO: 58223 - RNA, 20 nt, Artificial Sequence
  MKO10058223_A_Vmn1r210
  gRNA
auucucgaguauuuagcauc

SEQ ID NO: 58224 - RNA, 20 nt, Artificial Sequence
  MKO10058224_A_Vmn1r210
  gRNA
gcuaaauacucgagaauuuc

SEQ ID NO: 58225 - RNA, 20 nt, Artificial Sequence
  MKO10058225_A_Vmn1r211
  gRNA
cuguaaaguugcugucuacc

SEQ ID NO: 58226 - RNA, 20 nt, Artificial Sequence
  MKO10058226_A_Vmn1r211
  gRNA
guagacagcaacuuuacagc

SEQ ID NO: 58227 - RNA, 20 nt, Artificial Sequence
  MKO10058227_A_Vmn1r211
  gRNA
ccucugacacauugaguguc

SEQ ID NO: 58228 - RNA, 20 nt, Artificial Sequence
  MKO10058228_A_Vmn1r212
  gRNA
ucucccaacacuuauugaac

SEQ ID NO: 58229 - RNA, 20 nt, Artificial Sequence
  MKO10058229_A_Vmn1r212
  gRNA
uuuaccuguucaauaagugu

SEQ ID NO: 58230 - RNA, 20 nt, Artificial Sequence
  MKO10058230_A_Vmn1r212
  gRNA
ugaucuuacccauaauacug

SEQ ID NO: 58231 - RNA, 20 nt, Artificial Sequence
  MKO10058231_A_Vmn1r213
  gRNA
aagaaaugccacauaaccac

SEQ ID NO: 58232 - RNA, 20 nt, Artificial Sequence
  MKO10058232_A_Vmn1r213
  gRNA
gccccuuugugcuaauucac

SEQ ID NO: 58233 - RNA, 20 nt, Artificial Sequence
  MKO10058233_A_Vmn1r213
  gRNA
uuucucaucaugacagugcu

SEQ ID NO: 58234 - RNA, 20 nt, Artificial Sequence
  MKO10058234_A_Vmn1r214
  gRNA
uucucgaggauuuacuguca

SEQ ID NO: 58235 - RNA, 20 nt, Artificial Sequence
  MKO10058235_A_Vmn1r214
  gRNA
aaaugcuauuauaccaacug

SEQ ID NO: 58236 - RNA, 20 nt, Artificial Sequence
  MKO10058236_A_Vmn1r214
  gRNA
ucuuacagccuaaguuauuu

SEQ ID NO: 58237 - RNA, 20 nt, Artificial Sequence
  MKO10058237_A_Vmn1r215
  gRNA
augauuacuauuuguacaac

SEQ ID NO: 58238 - RNA, 20 nt, Artificial Sequence
  MKO10058238_A_Vmn1r215
  gRNA
cgaccuuauuguaauccacu

SEQ ID NO: 58239 - RNA, 20 nt, Artificial Sequence
  MKO10058239_A_Vmn1r215
  gRNA
uuuacacuucuuagugggca

SEQ ID NO: 58240 - RNA, 20 nt, Artificial Sequence
  MKO10058240_A_Vmn1r216
  gRNA
gccccuuuauccugauuauc

SEQ ID NO: 58241 - RNA, 20 nt, Artificial Sequence
  MKO10058241_A_Vmn1r216
  gRNA
cacugcagaucuuagcaaua

SEQ ID NO: 58242 - RNA, 20 nt, Artificial Sequence
  MKO10058242_A_Vmn1r216
  gRNA
acuaacaaugcuuucauauu

SEQ ID NO: 58243 - RNA, 20 nt, Artificial Sequence
  MKO10058243_A_Vmn1r217
  gRNA
ggcugaagacugcauaacca

SEQ ID NO: 58244 - RNA, 20 nt, Artificial Sequence
  MKO10058244_A_Vmn1r217
  gRNA
ccagugacaaacuuaaaaac

SEQ ID NO: 58245 - RNA, 20 nt, Artificial Sequence
  MKO10058245_A_Vmn1r217
  gRNA
augggcuucugccugcaugu

SEQ ID NO: 58246 - RNA, 20 nt, Artificial Sequence
  MKO10058246_A_Vmn1r218
  gRNA
agaacuuggcaugacgucug

SEQ ID NO: 58247 - RNA, 20 nt, Artificial Sequence
  MKO10058247_A_Vmn1r218
  gRNA
aagauauuuccuacaacucc

SEQ ID NO: 58248 - RNA, 20 nt, Artificial Sequence
  MKO10058248_A_Vmn1r218
  gRNA
aagccauuugaugauauguc

SEQ ID NO: 58249 - RNA, 20 nt, Artificial Sequence
  MKO10058249_A_Vmn1r219
  gRNA
uaccuauacuucuaaucgaa

SEQ ID NO: 58250 - RNA, 20 nt, Artificial Sequence
  MKO10058250_A_Vmn1r219
  gRNA
guccaucccugugaaucagc

SEQ ID NO: 58251 - RNA, 20 nt, Artificial Sequence
  MKO10058251_A_Vmn1r219
  gRNA
uuauaugacacuagaaaguc

SEQ ID NO: 58252 - RNA, 20 nt, Artificial Sequence
  MKO10058252_A_Vmn1r21
  gRNA
cugggucauaugcccauaac

SEQ ID NO: 58253 - RNA, 20 nt, Artificial Sequence
  MKO10058253_A_Vmn1r21
  gRNA
accccgugaaccacaucauc

SEQ ID NO: 58254 - RNA, 20 nt, Artificial Sequence
  MKO10058254_A_Vmn1r21
  gRNA
ugaccacaaagaaaacuacc

SEQ ID NO: 58255 - RNA, 20 nt, Artificial Sequence
  MKO10058255_A_Vmn1r220
  gRNA
ugccuuuacuucuaaucgaa

SEQ ID NO: 58256 - RNA, 20 nt, Artificial Sequence
  MKO10058256_A_Vmn1r220
  gRNA
auccauucgauuagaaguaa

SEQ ID NO: 58257 - RNA, 20 nt, Artificial Sequence
  MKO10058257_A_Vmn1r220
  gRNA
auggacuuauaccuguaugu

SEQ ID NO: 58258 - RNA, 20 nt, Artificial Sequence
  MKO10058258_A_Vmn1r221
  gRNA
ugaauguugguauguucaga

SEQ ID NO: 58259 - RNA, 20 nt, Artificial Sequence
  MKO10058259_A_Vmn1r221
  gRNA
acucuagaauuugugacccu

SEQ ID NO: 58260 - RNA, 20 nt, Artificial Sequence
  MKO10058260_A_Vmn1r221
  gRNA
ucugaauguagagaacaugc

SEQ ID NO: 58261 - RNA, 20 nt, Artificial Sequence
  MKO10058261_A_Vmn1r222
  gRNA
gacugaauauaucacacuuu

SEQ ID NO: 58262 - RNA, 20 nt, Artificial Sequence
  MKO10058262_A_Vmn1r222
  gRNA
uauuucuuccguuuauuaga

SEQ ID NO: 58263 - RNA, 20 nt, Artificial Sequence
  MKO10058263_A_Vmn1r222
  gRNA
uauauucagucuuguauuug

SEQ ID NO: 58264 - RNA, 20 nt, Artificial Sequence
  MKO10058264_A_Vmn1r223
  gRNA
cauggacauucccagugauc

SEQ ID NO: 58265 - RNA, 20 nt, Artificial Sequence
  MKO10058265_A_Vmn1r223
  gRNA
ugacagccugaaccaugcug

SEQ ID NO: 58266 - RNA, 20 nt, Artificial Sequence
  MKO10058266_A_Vmn1r223
  gRNA
auaauacacuguucauucca

SEQ ID NO: 58267 - RNA, 20 nt, Artificial Sequence
  MKO10058267_A_Vmn1r224
  gRNA
uugucguucucuauaugcac

SEQ ID NO: 58268 - RNA, 20 nt, Artificial Sequence
  MKO10058268_A_Vmn1r224
  gRNA
cauauagagaacgacaacca

SEQ ID NO: 58269 - RNA, 20 nt, Artificial Sequence
  MKO10058269_A_Vmn1r224
  gRNA
acucagagaaagcuuaaucu

SEQ ID NO: 58270 - RNA, 20 nt, Artificial Sequence
  MKO10058270_A_Vmn1r225
  gRNA
cucuuaguucagaguauacu

SEQ ID NO: 58271 - RNA, 20 nt, Artificial Sequence
  MKO10058271_A_Vmn1r225
  gRNA
cuuugucacgaccuugagag

SEQ ID NO: 58272 - RNA, 20 nt, Artificial Sequence
  MKO10058272_A_Vmn1r225
  gRNA
aaccaaaagcugccauuauc

SEQ ID NO: 58273 - RNA, 20 nt, Artificial Sequence
  MKO10058273_A_Vmn1r226
  gRNA
guuugucacgaccuauagag

SEQ ID NO: 58274 - RNA, 20 nt, Artificial Sequence
  MKO10058274_A_Vmn1r226
  gRNA
ccaaaagcuuucacuacuuc

SEQ ID NO: 58275 - RNA, 20 nt, Artificial Sequence
  MKO10058275_A_Vmn1r226
  gRNA
aagcaaucaccauuagcccc

SEQ ID NO: 58276 - RNA, 20 nt, Artificial Sequence
  MKO10058276_A_Vmn1r227
  gRNA
gauauucaucaaccaccgac

SEQ ID NO: 58277 - RNA, 20 nt, Artificial Sequence
  MKO10058277_A_Vmn1r227
  gRNA
gcauauuuacuagcaucaac

SEQ ID NO: 58278 - RNA, 20 nt, Artificial Sequence
  MKO10058278_A_Vmn1r227
  gRNA
aaaugccccagggauuccga

SEQ ID NO: 58279 - RNA, 20 nt, Artificial Sequence
  MKO10058279_A_Vmn1r228
  gRNA
ccaaaagcucccauuaccuc

SEQ ID NO: 58280 - RNA, 20 nt, Artificial Sequence
  MKO10058280_A_Vmn1r228
  gRNA
cuauugcuagcuguauauaa

SEQ ID NO: 58281 - RNA, 20 nt, Artificial Sequence
  MKO10058281_A_Vmn1r228
  gRNA
ucagucccaguaacuccugc

SEQ ID NO: 58282 - RNA, 20 nt, Artificial Sequence
  MKO10058282_A_Vmn1r229
  gRNA
aaugacuuauucgaugaugu

SEQ ID NO: 58283 - RNA, 20 nt, Artificial Sequence
  MKO10058283_A_Vmn1r229
  gRNA
uccauaaaguaugacuauca

SEQ ID NO: 58284 - RNA, 20 nt, Artificial Sequence
  MKO10058284_A_Vmn1r229
  gRNA
uaucacgaccaucauuucua

SEQ ID NO: 58285 - RNA, 20 nt, Artificial Sequence
  MKO10058285_A_Vmn1r22
  gRNA
auuaccuccuuuaaacaguc

SEQ ID NO: 58286 - RNA, 20 nt, Artificial Sequence
  MKO10058286_A_Vmn1r22
  gRNA
aggaaaauugacauaagauc

SEQ ID NO: 58287 - RNA, 20 nt, Artificial Sequence
  MKO10058287_A_Vmn1r22
  gRNA
uacacugguagggugaugag

SEQ ID NO: 58288 - RNA, 20 nt, Artificial Sequence
  MKO10058288_A_Vmn1r230
  gRNA
aucuugaucaugcucucgaa

SEQ ID NO: 58289 - RNA, 20 nt, Artificial Sequence
  MKO10058289_A_Vmn1r230
  gRNA
uucaaacucuauacuauugu

SEQ ID NO: 58290 - RNA, 20 nt, Artificial Sequence
  MKO10058290_A_Vmn1r230
  gRNA
gucuaucacaaugggagcuu

SEQ ID NO: 58291 - RNA, 20 nt, Artificial Sequence
  MKO10058291_A_Vmn1r231
  gRNA
cccagugacucgugccuuaa

SEQ ID NO: 58292 - RNA, 20 nt, Artificial Sequence
  MKO10058292_A_Vmn1r231
  gRNA
ugcccagauucagcuuaucc

SEQ ID NO: 58293 - RNA, 20 nt, Artificial Sequence
  MKO10058293_A_Vmn1r231
  gRNA
ccaacucuuucaguauacau

SEQ ID NO: 58294 - RNA, 20 nt, Artificial Sequence
  MKO10058294_A_Vmn1r232
  gRNA
uauauguucaaagacuuagc

SEQ ID NO: 58295 - RNA, 20 nt, Artificial Sequence
  MKO10058295_A_Vmn1r232
  gRNA
aaaaacguugaaugaccuaa

SEQ ID NO: 58296 - RNA, 20 nt, Artificial Sequence
  MKO10058296_A_Vmn1r232
  gRNA
accuuuggagauaaugauca

SEQ ID NO: 58297 - RNA, 20 nt, Artificial Sequence
  MKO10058297_A_Vmn1r233
  gRNA
accucuaccuauucugcgaa

SEQ ID NO: 58298 - RNA, 20 nt, Artificial Sequence
  MKO10058298_A_Vmn1r233
  gRNA
uccuuugcuugugccuauac

SEQ ID NO: 58299 - RNA, 20 nt, Artificial Sequence
  MKO10058299_A_Vmn1r233
  gRNA
cccgagagucaugacucaug

SEQ ID NO: 58300 - RNA, 20 nt, Artificial Sequence
  MKO10058300_A_Vmn1r234
  gRNA
gcagcacacgugauuauccc

SEQ ID NO: 58301 - RNA, 20 nt, Artificial Sequence
  MKO10058301_A_Vmn1r234
  gRNA
gggucucaucaaaucacuuc

SEQ ID NO: 58302 - RNA, 20 nt, Artificial Sequence
  MKO10058302_A_Vmn1r234
  gRNA
gcucuucccuauacuugacu

SEQ ID NO: 58303 - RNA, 20 nt, Artificial Sequence
  MKO10058303_A_Vmn1r235
  gRNA
gauugcacccaaaaucacuu

SEQ ID NO: 58304 - RNA, 20 nt, Artificial Sequence
  MKO10058304_A_Vmn1r235
  gRNA
uauaccuagggccauauucc

SEQ ID NO: 58305 - RNA, 20 nt, Artificial Sequence
  MKO10058305_A_Vmn1r235
  gRNA
cuacuguucucaucuugcac

SEQ ID NO: 58306 - RNA, 20 nt, Artificial Sequence
  MKO10058306_A_Vmn1r236
  gRNA
ccaccuucaccuugccgugc

SEQ ID NO: 58307 - RNA, 20 nt, Artificial Sequence
  MKO10058307_A_Vmn1r236
  gRNA
cuuuaugccacauuacuguc

SEQ ID NO: 58308 - RNA, 20 nt, Artificial Sequence
  MKO10058308_A_Vmn1r236
  gRNA
uaucacugguuggaucauga

SEQ ID NO: 58309 - RNA, 20 nt, Artificial Sequence
  MKO10058309_A_Vmn1r237
  gRNA
auuacacgccuaagggugua

SEQ ID NO: 58310 - RNA, 20 nt, Artificial Sequence
  MKO10058310_A_Vmn1r237
  gRNA
aucugaugcuuuacuacaug

SEQ ID NO: 58311 - RNA, 20 nt, Artificial Sequence
  MKO10058311_A_Vmn1r237
  gRNA
aacagauaccauacacccuu

SEQ ID NO: 58312 - RNA, 20 nt, Artificial Sequence
  MKO10058312_A_Vmn1r238
  gRNA
auuuacauuccaugucaucu

SEQ ID NO: 58313 - RNA, 20 nt, Artificial Sequence
  MKO10058313_A_Vmn1r238
  gRNA
ucaaaauaaaauaauaaaau

SEQ ID NO: 58314 - RNA, 20 nt, Artificial Sequence
  MKO10058314_A_Vmn1r238
  gRNA
auaggaaugaaaauggaucc

SEQ ID NO: 58315 - RNA, 20 nt, Artificial Sequence
  MKO10058315_A_Vmn1r23
  gRNA
uacacuaguagggugaugag

SEQ ID NO: 58316 - RNA, 20 nt, Artificial Sequence
  MKO10058316_A_Vmn1r23
  gRNA
auaaugauguuacucacugc

SEQ ID NO: 58317 - RNA, 20 nt, Artificial Sequence
  MKO10058317_A_Vmn1r23
  gRNA
cacacagaccauccugcugc

SEQ ID NO: 58318 - RNA, 20 nt, Artificial Sequence
  MKO10058318_A_Vmn1r24
  gRNA
uccucacuggaugggauauc

SEQ ID NO: 58319 - RNA, 20 nt, Artificial Sequence
  MKO10058319_A_Vmn1r24
  gRNA
acaggcuuaggacugugaca

SEQ ID NO: 58320 - RNA, 20 nt, Artificial Sequence
  MKO10058320_A_Vmn1r24
  gRNA
uucccaugaacaacauuaua

SEQ ID NO: 58321 - RNA, 20 nt, Artificial Sequence
  MKO10058321_A_Vmn1r25
  gRNA
aaccaccaacauagacuaac

SEQ ID NO: 58322 - RNA, 20 nt, Artificial Sequence
  MKO10058322_A_Vmn1r25
  gRNA
auaaaggauauucguuaaug

SEQ ID NO: 58323 - RNA, 20 nt, Artificial Sequence
  MKO10058323_A_Vmn1r25
  gRNA
ccagaccauccuacuacuua

SEQ ID NO: 58324 - RNA, 20 nt, Artificial Sequence
  MKO10058324_A_Vmn1r26
  gRNA
ggaguguuaguggaccugua

SEQ ID NO: 58325 - RNA, 20 nt, Artificial Sequence
  MKO10058325_A_Vmn1r26
  gRNA
aucuucauagcaucaauuac

SEQ ID NO: 58326 - RNA, 20 nt, Artificial Sequence
  MKO10058326_A_Vmn1r26
  gRNA
gccaaauauccccugcagua

SEQ ID NO: 58327 - RNA, 20 nt, Artificial Sequence
  MKO10058327_A_Vmn1r27
  gRNA
gcugaccuucauucauauaa

SEQ ID NO: 58328 - RNA, 20 nt, Artificial Sequence
  MKO10058328_A_Vmn1r27
  gRNA
gcacaccauuauaugaauga

SEQ ID NO: 58329 - RNA, 20 nt, Artificial Sequence
  MKO10058329_A_Vmn1r27
  gRNA
uuaugauccagucagccuga

SEQ ID NO: 58330 - RNA, 20 nt, Artificial Sequence
  MKO10058330_A_Vmn1r28
  gRNA
agaucugucaccuaguauua

SEQ ID NO: 58331 - RNA, 20 nt, Artificial Sequence
  MKO10058331_A_Vmn1r28
  gRNA
auaaaagacauucucuaaag

SEQ ID NO: 58332 - RNA, 20 nt, Artificial Sequence
  MKO10058332_A_Vmn1r28
  gRNA
cauucaccucaacccuguca

SEQ ID NO: 58333 - RNA, 20 nt, Artificial Sequence
  MKO10058333_A_Vmn1r29
  gRNA
gccaaauauccccuccagca

SEQ ID NO: 58334 - RNA, 20 nt, Artificial Sequence
  MKO10058334_A_Vmn1r29
  gRNA
aguaaccagaucuuauaugu

SEQ ID NO: 58335 - RNA, 20 nt, Artificial Sequence
  MKO10058335_A_Vmn1r29
  gRNA
aaccaccaacauauaagauc

SEQ ID NO: 58336 - RNA, 20 nt, Artificial Sequence
  MKO10058336_A_Vmn1r2
  gRNA
ucagaaaguauugagcacug

SEQ ID NO: 58337 - RNA, 20 nt, Artificial Sequence
  MKO10058337_A_Vmn1r2
  gRNA
aaguuaucucuuaccuaagc

SEQ ID NO: 58338 - RNA, 20 nt, Artificial Sequence
  MKO10058338_A_Vmn1r2
  gRNA
auaggaaugaaaauggaucc

SEQ ID NO: 58339 - RNA, 20 nt, Artificial Sequence
  MKO10058339_A_Vmn1r30
  gRNA
ccagaccaucuuacuacuug

SEQ ID NO: 58340 - RNA, 20 nt, Artificial Sequence
  MKO10058340_A_Vmn1r30
  gRNA
auauaugagcaaaugucagu

SEQ ID NO: 58341 - RNA, 20 nt, Artificial Sequence
  MKO10058341_A_Vmn1r30
  gRNA
auagaauaucaugugacuau

SEQ ID NO: 58342 - RNA, 20 nt, Artificial Sequence
  MKO10058342_A_Vmn1r31
  gRNA
uuacaaacuucugaacccuc

SEQ ID NO: 58343 - RNA, 20 nt, Artificial Sequence
  MKO10058343_A_Vmn1r31
  gRNA
cugggucauacauccacaau

SEQ ID NO: 58344 - RNA, 20 nt, Artificial Sequence
  MKO10058344_A_Vmn1r31
  gRNA
aaacaucaucaugugaauaa

SEQ ID NO: 58345 - RNA, 20 nt, Artificial Sequence
  MKO10058345_A_Vmn1r32
  gRNA
ucucaggggaagcucguaag

SEQ ID NO: 58346 - RNA, 20 nt, Artificial Sequence
  MKO10058346_A_Vmn1r32
  gRNA
cccuacaagaaauacgucuc

SEQ ID NO: 58347 - RNA, 20 nt, Artificial Sequence
  MKO10058347_A_Vmn1r32
  gRNA
ccaggguuccaaguccaacu

SEQ ID NO: 58348 - RNA, 20 nt, Artificial Sequence
  MKO10058348_A_Vmn1r33
  gRNA
cauccauaaaaggacuguuc

SEQ ID NO: 58349 - RNA, 20 nt, Artificial Sequence
  MKO10058349_A_Vmn1r33
  gRNA
ucccuugaugauauagucca

SEQ ID NO: 58350 - RNA, 20 nt, Artificial Sequence
  MKO10058350_A_Vmn1r33
  gRNA
uucugaacagucaacaagac

SEQ ID NO: 58351 - RNA, 20 nt, Artificial Sequence
  MKO10058351_A_Vmn1r34
  gRNA
guuuggcuuacagauuuacu

SEQ ID NO: 58352 - RNA, 20 nt, Artificial Sequence
  MKO10058352_A_Vmn1r34
  gRNA
acacaucauugugugaacga

SEQ ID NO: 58353 - RNA, 20 nt, Artificial Sequence
  MKO10058353_A_Vmn1r34
  gRNA
cacacaaugaugugucucac

SEQ ID NO: 58354 - RNA, 20 nt, Artificial Sequence
  MKO10058354_A_Vmn1r35
  gRNA
cuauagcuccaagcccugcu

SEQ ID NO: 58355 - RNA, 20 nt, Artificial Sequence
  MKO10058355_A_Vmn1r35
  gRNA
aggcaacugcuuacauaaac

SEQ ID NO: 58356 - RNA, 20 nt, Artificial Sequence
  MKO10058356_A_Vmn1r35
  gRNA
uucuuugugucauugaacau

SEQ ID NO: 58357 - RNA, 20 nt, Artificial Sequence
  MKO10058357_A_Vmn1r36
  gRNA
auuaaccacaucaucuauac

SEQ ID NO: 58358 - RNA, 20 nt, Artificial Sequence
  MKO10058358_A_Vmn1r36
  gRNA
aagcaccaguauagaugaug

SEQ ID NO: 58359 - RNA, 20 nt, Artificial Sequence
  MKO10058359_A_Vmn1r36
  gRNA
gagugagaccaaccagcuga

SEQ ID NO: 58360 - RNA, 20 nt, Artificial Sequence
  MKO10058360_A_Vmn1r37
  gRNA
aagcgccaguauagaugauc

SEQ ID NO: 58361 - RNA, 20 nt, Artificial Sequence
  MKO10058361_A_Vmn1r37
  gRNA
auuugucauucagcauuaac

SEQ ID NO: 58362 - RNA, 20 nt, Artificial Sequence
  MKO10058362_A_Vmn1r37
  gRNA
gagugagaccaaccagcuga

SEQ ID NO: 58363 - RNA, 20 nt, Artificial Sequence
  MKO10058363_A_Vmn1r38
  gRNA
cagucccaacuccgcuuugu

SEQ ID NO: 58364 - RNA, 20 nt, Artificial Sequence
  MKO10058364_A_Vmn1r38
  gRNA
uacuuaaacagggcaaugag

SEQ ID NO: 58365 - RNA, 20 nt, Artificial Sequence
  MKO10058365_A_Vmn1r38
  gRNA
caacgugagugagaccaacc

SEQ ID NO: 58366 - RNA, 20 nt, Artificial Sequence
  MKO10058366_A_Vmn1r39
  gRNA
uaaugaaauccacccaguac

SEQ ID NO: 58367 - RNA, 20 nt, Artificial Sequence
  MKO10058367_A_Vmn1r39
  gRNA
uacuuaaauagggcgaugag

SEQ ID NO: 58368 - RNA, 20 nt, Artificial Sequence
  MKO10058368_A_Vmn1r39
  gRNA
caacgugagugauaccaacc

SEQ ID NO: 58369 - RNA, 20 nt, Artificial Sequence
  MKO10058369_A_Vmn1r3
  gRNA
auaggaaugaaaaugggucc

SEQ ID NO: 58370 - RNA, 20 nt, Artificial Sequence
  MKO10058370_A_Vmn1r3
  gRNA
aaguuaucucuuaccuaagc

SEQ ID NO: 58371 - RNA, 20 nt, Artificial Sequence
  MKO10058371_A_Vmn1r3
  gRNA
acaagaaaaaugcaacuaac

SEQ ID NO: 58372 - RNA, 20 nt, Artificial Sequence
  MKO10058372_A_Vmn1r40
  gRNA
gcccacgucugcaugauccu

SEQ ID NO: 58373 - RNA, 20 nt, Artificial Sequence
  MKO10058373_A_Vmn1r40
  gRNA
ugcagacgugggcaauaaaa

SEQ ID NO: 58374 - RNA, 20 nt, Artificial Sequence
  MKO10058374_A_Vmn1r40
  gRNA
ccaccauguacccgcuggac

SEQ ID NO: 58375 - RNA, 20 nt, Artificial Sequence
  MKO10058375_A_Vmn1r41
  gRNA
caaaaucauccccagaacaa

SEQ ID NO: 58376 - RNA, 20 nt, Artificial Sequence
  MKO10058376_A_Vmn1r41
  gRNA
uccugguggcccuuuguucu

SEQ ID NO: 58377 - RNA, 20 nt, Artificial Sequence
  MKO10058377_A_Vmn1r41
  gRNA
ucagugcaaaucaacacaaa

SEQ ID NO: 58378 - RNA, 20 nt, Artificial Sequence
  MKO10058378_A_Vmn1r42
  gRNA
uagcccucuuaagcaugcac

SEQ ID NO: 58379 - RNA, 20 nt, Artificial Sequence
  MKO10058379_A_Vmn1r42
  gRNA
guaugugagaacauugacug

SEQ ID NO: 58380 - RNA, 20 nt, Artificial Sequence
  MKO10058380_A_Vmn1r42
  gRNA
auaucuccucaucacauauc

SEQ ID NO: 58381 - RNA, 20 nt, Artificial Sequence
  MKO10058381_A_Vmn1r43
  gRNA
uagaauuuaugcuuuccacg

SEQ ID NO: 58382 - RNA, 20 nt, Artificial Sequence
  MKO10058382_A_Vmn1r43
  gRNA
ucuacccuugaguuaccucg

SEQ ID NO: 58383 - RNA, 20 nt, Artificial Sequence
  MKO10058383_A_Vmn1r43
  gRNA
gucugguuuccugaagaugc

SEQ ID NO: 58384 - RNA, 20 nt, Artificial Sequence
  MKO10058384_A_Vmn1r44
  gRNA
aacacucacuucagcaagca

SEQ ID NO: 58385 - RNA, 20 nt, Artificial Sequence
  MKO10058385_A_Vmn1r44
  gRNA
acacuguuaucuuccacuca

SEQ ID NO: 58386 - RNA, 20 nt, Artificial Sequence
  MKO10058386_A_Vmn1r44
  gRNA
uugcuugcugaagugagugu

SEQ ID NO: 58387 - RNA, 20 nt, Artificial Sequence
  MKO10058387_A_Vmn1r45
  gRNA
uugcuacccccaauuugacc

SEQ ID NO: 58388 - RNA, 20 nt, Artificial Sequence
  MKO10058388_A_Vmn1r45
  gRNA
aaacucuguacagauacaca

SEQ ID NO: 58389 - RNA, 20 nt, Artificial Sequence
  MKO10058389_A_Vmn1r45
  gRNA
ugagcaguagcaucaguaag

SEQ ID NO: 58390 - RNA, 20 nt, Artificial Sequence
  MKO10058390_A_Vmn1r46
  gRNA
acucauggguaaaauugagc

SEQ ID NO: 58391 - RNA, 20 nt, Artificial Sequence
  MKO10058391_A_Vmn1r46
  gRNA
gcuguggauauguuuaugcc

SEQ ID NO: 58392 - RNA, 20 nt, Artificial Sequence
  MKO10058392_A_Vmn1r46
  gRNA
gcuuaggccugcuuucacca

SEQ ID NO: 58393 - RNA, 20 nt, Artificial Sequence
  MKO10058393_A_Vmn1r47
  gRNA
auccaagaacauagcucuug

SEQ ID NO: 58394 - RNA, 20 nt, Artificial Sequence
  MKO10058394_A_Vmn1r47
  gRNA
cuccucaagagcuauguucu

SEQ ID NO: 58395 - RNA, 20 nt, Artificial Sequence
  MKO10058395_A_Vmn1r47
  gRNA
ggagacaaugcugucgaaga

SEQ ID NO: 58396 - RNA, 20 nt, Artificial Sequence
  MKO10058396_A_Vmn1r48
  gRNA
uggcccucuuguacaugcac

SEQ ID NO: 58397 - RNA, 20 nt, Artificial Sequence
  MKO10058397_A_Vmn1r48
  gRNA
guuuccugugcauguacaag

SEQ ID NO: 58398 - RNA, 20 nt, Artificial Sequence
  MKO10058398_A_Vmn1r48
  gRNA
gacugcuaauugacauauag

SEQ ID NO: 58399 - RNA, 20 nt, Artificial Sequence
  MKO10058399_A_Vmn1r49
  gRNA
gcccgccucugcaagcuccu

SEQ ID NO: 58400 - RNA, 20 nt, Artificial Sequence
  MKO10058400_A_Vmn1r49
  gRNA
gacugcuaaaagacauauag

SEQ ID NO: 58401 - RNA, 20 nt, Artificial Sequence
  MKO10058401_A_Vmn1r49
  gRNA
uuuccacucuuauggccauc

SEQ ID NO: 58402 - RNA, 20 nt, Artificial Sequence
  MKO10058402_A_Vmn1r4
  gRNA
uuaugugaacgaaggucagu

SEQ ID NO: 58403 - RNA, 20 nt, Artificial Sequence
  MKO10058403_A_Vmn1r4
  gRNA
acugacauaauauucuaugu

SEQ ID NO: 58404 - RNA, 20 nt, Artificial Sequence
  MKO10058404_A_Vmn1r4
  gRNA
cacauaaugaugcuccuuac

SEQ ID NO: 58405 - RNA, 20 nt, Artificial Sequence
  MKO10058405_A_Vmn1r50
  gRNA
agccuuucucaucggacuca

SEQ ID NO: 58406 - RNA, 20 nt, Artificial Sequence
  MKO10058406_A_Vmn1r50
  gRNA
caguaccaucaugcuacuca

SEQ ID NO: 58407 - RNA, 20 nt, Artificial Sequence
  MKO10058407_A_Vmn1r50
  gRNA
gguacgugguaguucuccua

SEQ ID NO: 58408 - RNA, 20 nt, Artificial Sequence
  MKO10058408_A_Vmn1r51
  gRNA
ggcugauaccuugcagaugc

SEQ ID NO: 58409 - RNA, 20 nt, Artificial Sequence
  MKO10058409_A_Vmn1r51
  gRNA
aacauauaguuaacuguuug

SEQ ID NO: 58410 - RNA, 20 nt, Artificial Sequence
  MKO10058410_A_Vmn1r51
  gRNA
acaugguagcccucuugugu

SEQ ID NO: 58411 - RNA, 20 nt, Artificial Sequence
  MKO10058411_A_Vmn1r52
  gRNA
cuacucaagaacuauauuac

SEQ ID NO: 58412 - RNA, 20 nt, Artificial Sequence
  MKO10058412_A_Vmn1r52
  gRNA
cuguaauauaguucuugagu

SEQ ID NO: 58413 - RNA, 20 nt, Artificial Sequence
  MKO10058413_A_Vmn1r52
  gRNA
aaguacuaucuucucauaca

SEQ ID NO: 58414 - RNA, 20 nt, Artificial Sequence
  MKO10058414_A_Vmn1r53
  gRNA
cuaccauguacccuccggac

SEQ ID NO: 58415 - RNA, 20 nt, Artificial Sequence
  MKO10058415_A_Vmn1r53
  gRNA
ggcccuguccggaggguaca

SEQ ID NO: 58416 - RNA, 20 nt, Artificial Sequence
  MKO10058416_A_Vmn1r53
  gRNA
aucagggaagccuuacuuau

SEQ ID NO: 58417 - RNA, 20 nt, Artificial Sequence
  MKO10058417_A_Vmn1r54
  gRNA
uacauaagaaguaucgauga

SEQ ID NO: 58418 - RNA, 20 nt, Artificial Sequence
  MKO10058418_A_Vmn1r54
  gRNA
ucucuugucccuaauccacc

SEQ ID NO: 58419 - RNA, 20 nt, Artificial Sequence
  MKO10058419_A_Vmn1r54
  gRNA
cacaucuucaaguacauucg

SEQ ID NO: 58420 - RNA, 20 nt, Artificial Sequence
  MKO10058420_A_Vmn1r55
  gRNA
cuuacaucccaaugaauguc

SEQ ID NO: 58421 - RNA, 20 nt, Artificial Sequence
  MKO10058421_A_Vmn1r55
  gRNA
uucacaugacaugauugauu

SEQ ID NO: 58422 - RNA, 20 nt, Artificial Sequence
  MKO10058422_A_Vmn1r55
  gRNA
gacuggcaaagucauuacag

SEQ ID NO: 58423 - RNA, 20 nt, Artificial Sequence
  MKO10058423_A_Vmn1r56
  gRNA
uaaugucuccccuagucaug

SEQ ID NO: 58424 - RNA, 20 nt, Artificial Sequence
  MKO10058424_A_Vmn1r56
  gRNA
aauuguauaugcuccgucuc

SEQ ID NO: 58425 - RNA, 20 nt, Artificial Sequence
  MKO10058425_A_Vmn1r56
  gRNA
gccuggaaauccacaugacu

SEQ ID NO: 58426 - RNA, 20 nt, Artificial Sequence
  MKO10058426_A_Vmn1r57
  gRNA
ugguccaagccauaaugcca

SEQ ID NO: 58427 - RNA, 20 nt, Artificial Sequence
  MKO10058427_A_Vmn1r57
  gRNA
cauaugaauauguugaaaaa

SEQ ID NO: 58428 - RNA, 20 nt, Artificial Sequence
  MKO10058428_A_Vmn1r57
  gRNA
uaauuacucccccagucacg

SEQ ID NO: 58429 - RNA, 20 nt, Artificial Sequence
  MKO10058429_A_Vmn1r58
  gRNA
ucugcacaucauugucagua

SEQ ID NO: 58430 - RNA, 20 nt, Artificial Sequence
  MKO10058430_A_Vmn1r58
  gRNA
gcuauuguuguugcaucugc

SEQ ID NO: 58431 - RNA, 20 nt, Artificial Sequence
  MKO10058431_A_Vmn1r58
  gRNA
cuccagacugaagccaauac

SEQ ID NO: 58432 - RNA, 20 nt, Artificial Sequence
  MKO10058432_A_Vmn1r59
  gRNA
gacuggaaauccacgugacu

SEQ ID NO: 58433 - RNA, 20 nt, Artificial Sequence
  MKO10058433_A_Vmn1r59
  gRNA
uaaugacucccccagucacg

SEQ ID NO: 58434 - RNA, 20 nt, Artificial Sequence
  MKO10058434_A_Vmn1r59
  gRNA
aucccuaaauaucaaaagua

SEQ ID NO: 58435 - RNA, 20 nt, Artificial Sequence
  MKO10058435_A_Vmn1r5
  gRNA
augucccaguacuacauugc

SEQ ID NO: 58436 - RNA, 20 nt, Artificial Sequence
  MKO10058436_A_Vmn1r5
  gRNA
caaugaccucauuccuguua

SEQ ID NO: 58437 - RNA, 20 nt, Artificial Sequence
  MKO10058437_A_Vmn1r5
  gRNA
aaacaugauuauaugaacga

SEQ ID NO: 58438 - RNA, 20 nt, Artificial Sequence
  MKO10058438_A_Vmn1r60
  gRNA
uccugggaacaauaucaaua

SEQ ID NO: 58439 - RNA, 20 nt, Artificial Sequence
  MKO10058439_A_Vmn1r60
  gRNA
caucauauuccuuaauauca

SEQ ID NO: 58440 - RNA, 20 nt, Artificial Sequence
  MKO10058440_A_Vmn1r60
  gRNA
ugauugugccucgagcaacu

SEQ ID NO: 58441 - RNA, 20 nt, Artificial Sequence
  MKO10058441_A_Vmn1r61
  gRNA
gagguaugucauaaaucucc

SEQ ID NO: 58442 - RNA, 20 nt, Artificial Sequence
  MKO10058442_A_Vmn1r61
  gRNA
cuccagacugaaacccauac

SEQ ID NO: 58443 - RNA, 20 nt, Artificial Sequence
  MKO10058443_A_Vmn1r61
  gRNA
acuugcacauuucuuucacc

SEQ ID NO: 58444 - RNA, 20 nt, Artificial Sequence
  MKO10058444_A_Vmn1r62
  gRNA
ucccuaaauaucaacaguaa

SEQ ID NO: 58445 - RNA, 20 nt, Artificial Sequence
  MKO10058445_A_Vmn1r62
  gRNA
ccugaaaaccauggaagugu

SEQ ID NO: 58446 - RNA, 20 nt, Artificial Sequence
  MKO10058446_A_Vmn1r62
  gRNA
gucuacacugaccccagaga

SEQ ID NO: 58447 - RNA, 20 nt, Artificial Sequence
  MKO10058447_A_Vmn1r63
  gRNA
ccugaaaaccauggaaaugu

SEQ ID NO: 58448 - RNA, 20 nt, Artificial Sequence
  MKO10058448_A_Vmn1r63
  gRNA
aucccuaaauaucaacagua

SEQ ID NO: 58449 - RNA, 20 nt, Artificial Sequence
  MKO10058449_A_Vmn1r63
  gRNA
uacaugcuaaugaaugucag

SEQ ID NO: 58450 - RNA, 20 nt, Artificial Sequence
  MKO10058450_A_Vmn1r64
  gRNA
uaggaucccuacaaaucaac

SEQ ID NO: 58451 - RNA, 20 nt, Artificial Sequence
  MKO10058451_A_Vmn1r64
  gRNA
ugaucugauuaggauuaugc

SEQ ID NO: 58452 - RNA, 20 nt, Artificial Sequence
  MKO10058452_A_Vmn1r64
  gRNA
aauccuaaucagaucaacag

SEQ ID NO: 58453 - RNA, 20 nt, Artificial Sequence
  MKO10058453_A_Vmn1r65
  gRNA
ggcuacaaagccgugucacu

SEQ ID NO: 58454 - RNA, 20 nt, Artificial Sequence
  MKO10058454_A_Vmn1r65
  gRNA
uuggagccaaaacugccaua

SEQ ID NO: 58455 - RNA, 20 nt, Artificial Sequence
  MKO10058455_A_Vmn1r65
  gRNA
uuguccuguacccuucauug

SEQ ID NO: 58456 - RNA, 20 nt, Artificial Sequence
  MKO10058456_A_Vmn1r66
  gRNA
cucucgugcauaauccaagu

SEQ ID NO: 58457 - RNA, 20 nt, Artificial Sequence
  MKO10058457_A_Vmn1r66
  gRNA
agcaauguaaccucguaaga

SEQ ID NO: 58458 - RNA, 20 nt, Artificial Sequence
  MKO10058458_A_Vmn1r66
  gRNA
gccaaaguugcaaaguauau

SEQ ID NO: 58459 - RNA, 20 nt, Artificial Sequence
  MKO10058459_A_Vmn1r67
  gRNA
uacuaaugcuguauagagug

SEQ ID NO: 58460 - RNA, 20 nt, Artificial Sequence
  MKO10058460_A_Vmn1r67
  gRNA
uuguacuaacggacacacuc

SEQ ID NO: 58461 - RNA, 20 nt, Artificial Sequence
  MKO10058461_A_Vmn1r67
  gRNA
cacucagaagauccuagucc

SEQ ID NO: 58462 - RNA, 20 nt, Artificial Sequence
  MKO10058462_A_Vmn1r68
  gRNA
gaaucagacccagucgaaga

SEQ ID NO: 58463 - RNA, 20 nt, Artificial Sequence
  MKO10058463_A_Vmn1r68
  gRNA
aguccagaccaaacugaauc

SEQ ID NO: 58464 - RNA, 20 nt, Artificial Sequence
  MKO10058464_A_Vmn1r68
  gRNA
aaauucauuucgcucuacaa

SEQ ID NO: 58465 - RNA, 20 nt, Artificial Sequence
  MKO10058465_A_Vmn1r69
  gRNA
gaaucaagcccaaucgaaga

SEQ ID NO: 58466 - RNA, 20 nt, Artificial Sequence
  MKO10058466_A_Vmn1r69
  gRNA
caagagacagguacugccaa

SEQ ID NO: 58467 - RNA, 20 nt, Artificial Sequence
  MKO10058467_A_Vmn1r69
  gRNA
gugcucaucaccuauuccag

SEQ ID NO: 58468 - RNA, 20 nt, Artificial Sequence
  MKO10058468_A_Vmn1r6
  gRNA
cuggaucauaucuccauaag

SEQ ID NO: 58469 - RNA, 20 nt, Artificial Sequence
  MKO10058469_A_Vmn1r6
  gRNA
gcuugcauugccucugaugu

SEQ ID NO: 58470 - RNA, 20 nt, Artificial Sequence
  MKO10058470_A_Vmn1r6
  gRNA
gaucuccugucaacugaccu

SEQ ID NO: 58471 - RNA, 20 nt, Artificial Sequence
  MKO10058471_A_Vmn1r70
  gRNA
cuucagugaugcuauauguu

SEQ ID NO: 58472 - RNA, 20 nt, Artificial Sequence
  MKO10058472_A_Vmn1r70
  gRNA
auuguugaggcuaauaguga

SEQ ID NO: 58473 - RNA, 20 nt, Artificial Sequence
  MKO10058473_A_Vmn1r70
  gRNA
caaacauauagcaucacuga

SEQ ID NO: 58474 - RNA, 20 nt, Artificial Sequence
  MKO10058474_A_Vmn1r71
  gRNA
caacacauccguagcacuca

SEQ ID NO: 58475 - RNA, 20 nt, Artificial Sequence
  MKO10058475_A_Vmn1r71
  gRNA
uccaacgcagccaaguacau

SEQ ID NO: 58476 - RNA, 20 nt, Artificial Sequence
  MKO10058476_A_Vmn1r71
  gRNA
gagauucuauuguucguuca

SEQ ID NO: 58477 - RNA, 20 nt, Artificial Sequence
  MKO10058477_A_Vmn1r72
  gRNA
aguaaguguauuuacauucg

SEQ ID NO: 58478 - RNA, 20 nt, Artificial Sequence
  MKO10058478_A_Vmn1r72
  gRNA
ggcuucugaaaauguugcaa

SEQ ID NO: 58479 - RNA, 20 nt, Artificial Sequence
  MKO10058479_A_Vmn1r72
  gRNA
aucagcccuaauaacuccaa

SEQ ID NO: 58480 - RNA, 20 nt, Artificial Sequence
  MKO10058480_A_Vmn1r73
  gRNA
caauuagccccaacaacuac

SEQ ID NO: 58481 - RNA, 20 nt, Artificial Sequence
  MKO10058481_A_Vmn1r73
  gRNA
acacuuacucgcaguaacau

SEQ ID NO: 58482 - RNA, 20 nt, Artificial Sequence
  MKO10058482_A_Vmn1r73
  gRNA
acuauguuuaccgaauaaca

SEQ ID NO: 58483 - RNA, 20 nt, Artificial Sequence
  MKO10058483_A_Vmn1r74
  gRNA
ucagccccaacuauuccaga

SEQ ID NO: 58484 - RNA, 20 nt, Artificial Sequence
  MKO10058484_A_Vmn1r74
  gRNA
agaauugccaauuauuccca

SEQ ID NO: 58485 - RNA, 20 nt, Artificial Sequence
  MKO10058485_A_Vmn1r74
  gRNA
uaugucaguuugaaacucac

SEQ ID NO: 58486 - RNA, 20 nt, Artificial Sequence
  MKO10058486_A_Vmn1r75
  gRNA
ccacgggcaaugucagauug

SEQ ID NO: 58487 - RNA, 20 nt, Artificial Sequence
  MKO10058487_A_Vmn1r75
  gRNA
cuaucaacccuagcaacugc

SEQ ID NO: 58488 - RNA, 20 nt, Artificial Sequence
  MKO10058488_A_Vmn1r75
  gRNA
aaguuaccgcuuaccaaagc

SEQ ID NO: 58489 - RNA, 20 nt, Artificial Sequence
  MKO10058489_A_Vmn1r76
  gRNA
ugcaguugcaaaauugcuua

SEQ ID NO: 58490 - RNA, 20 nt, Artificial Sequence
  MKO10058490_A_Vmn1r76
  gRNA
acacuuaugcuccauagcaa

SEQ ID NO: 58491 - RNA, 20 nt, Artificial Sequence
  MKO10058491_A_Vmn1r76
  gRNA
uuuggaguagguuguaaaga

SEQ ID NO: 58492 - RNA, 20 nt, Artificial Sequence
  MKO10058492_A_Vmn1r77
  gRNA
cuucccuuguugcugucauu

SEQ ID NO: 58493 - RNA, 20 nt, Artificial Sequence
  MKO10058493_A_Vmn1r77
  gRNA
cuggggccugacacucuuac

SEQ ID NO: 58494 - RNA, 20 nt, Artificial Sequence
  MKO10058494_A_Vmn1r77
  gRNA
uugauuccaguaagaguguc

SEQ ID NO: 58495 - RNA, 20 nt, Artificial Sequence
  MKO10058495_A_Vmn1r78
  gRNA
auucccguugccaagcuugc

SEQ ID NO: 58496 - RNA, 20 nt, Artificial Sequence
  MKO10058496_A_Vmn1r78
  gRNA
gcugcaacuagacuugaaac

SEQ ID NO: 58497 - RNA, 20 nt, Artificial Sequence
  MKO10058497_A_Vmn1r78
  gRNA
gaaaaugacuccugcaagcu

SEQ ID NO: 58498 - RNA, 20 nt, Artificial Sequence
  MKO10058498_A_Vmn1r79
  gRNA
aauuaauaguguauauuucc

SEQ ID NO: 58499 - RNA, 20 nt, Artificial Sequence
  MKO10058499_A_Vmn1r79
  gRNA
gagacaccccccuuguuauc

SEQ ID NO: 58500 - RNA, 20 nt, Artificial Sequence
  MKO10058500_A_Vmn1r79
  gRNA
ccaucagucccaauaacucc

SEQ ID NO: 58501 - RNA, 20 nt, Artificial Sequence
  MKO10058501_A_Vmn1r7
  gRNA
ugaugaaguccauccaguau

SEQ ID NO: 58502 - RNA, 20 nt, Artificial Sequence
  MKO10058502_A_Vmn1r7
  gRNA
acuguccuuuguucacauaa

SEQ ID NO: 58503 - RNA, 20 nt, Artificial Sequence
  MKO10058503_A_Vmn1r7
  gRNA
auacauccguaacauuucug

SEQ ID NO: 58504 - RNA, 20 nt, Artificial Sequence
  MKO10058504_A_Vmn1r80
  gRNA
uuuggaguaggccguaacga

SEQ ID NO: 58505 - RNA, 20 nt, Artificial Sequence
  MKO10058505_A_Vmn1r80
  gRNA
aacaagucaagcauauccac

SEQ ID NO: 58506 - RNA, 20 nt, Artificial Sequence
  MKO10058506_A_Vmn1r80
  gRNA
ugauuuaugguuacuguuca

SEQ ID NO: 58507 - RNA, 20 nt, Artificial Sequence
  MKO10058507_A_Vmn1r81
  gRNA
guguuuaagcauaauccauc

SEQ ID NO: 58508 - RNA, 20 nt, Artificial Sequence
  MKO10058508_A_Vmn1r81
  gRNA
gugacaaacacgaauaguua

SEQ ID NO: 58509 - RNA, 20 nt, Artificial Sequence
  MKO10058509_A_Vmn1r81
  gRNA
augguuugcuccaagcaauc

SEQ ID NO: 58510 - RNA, 20 nt, Artificial Sequence
  MKO10058510_A_Vmn1r82
  gRNA
uugagcugauuauggccgcu

SEQ ID NO: 58511 - RNA, 20 nt, Artificial Sequence
  MKO10058511_A_Vmn1r82
  gRNA
ggauuccuacaguagucugc

SEQ ID NO: 58512 - RNA, 20 nt, Artificial Sequence
  MKO10058512_A_Vmn1r82
  gRNA
ggcugaauauagaaccauga

SEQ ID NO: 58513 - RNA, 20 nt, Artificial Sequence
  MKO10058513_A_Vmn1r83
  gRNA
gugacgaacgugaugaguua

SEQ ID NO: 58514 - RNA, 20 nt, Artificial Sequence
  MKO10058514_A_Vmn1r83
  gRNA
augacgccaguaaaagugau

SEQ ID NO: 58515 - RNA, 20 nt, Artificial Sequence
  MKO10058515_A_Vmn1r83
  gRNA
cacccaaauuauucucaccc

SEQ ID NO: 58516 - RNA, 20 nt, Artificial Sequence
  MKO10058516_A_Vmn1r84
  gRNA
aagcguucuuaggaguagau

SEQ ID NO: 58517 - RNA, 20 nt, Artificial Sequence
  MKO10058517_A_Vmn1r84
  gRNA
ucuacagcaaucgagugucc

SEQ ID NO: 58518 - RNA, 20 nt, Artificial Sequence
  MKO10058518_A_Vmn1r84
  gRNA
uaaauuccuucuacuacagc

SEQ ID NO: 58519 - RNA, 20 nt, Artificial Sequence
  MKO10058519_A_Vmn1r85
  gRNA
cucuuguuaugauaacgccg

SEQ ID NO: 58520 - RNA, 20 nt, Artificial Sequence
  MKO10058520_A_Vmn1r85
  gRNA
uaugaccauguugaugaacc

SEQ ID NO: 58521 - RNA, 20 nt, Artificial Sequence
  MKO10058521_A_Vmn1r85
  gRNA
uuaagccuaaacucucuaag

SEQ ID NO: 58522 - RNA, 20 nt, Artificial Sequence
  MKO10058522_A_Vmn1r86
  gRNA
gauaaguagauuaaucagcc

SEQ ID NO: 58523 - RNA, 20 nt, Artificial Sequence
  MKO10058523_A_Vmn1r86
  gRNA
ugagaucaugagugaugaua

SEQ ID NO: 58524 - RNA, 20 nt, Artificial Sequence
  MKO10058524_A_Vmn1r86
  gRNA
cugauuaaucuacuuaucua

SEQ ID NO: 58525 - RNA, 20 nt, Artificial Sequence
  MKO10058525_A_Vmn1r87
  gRNA
ccaccaaucagauccaauac

SEQ ID NO: 58526 - RNA, 20 nt, Artificial Sequence
  MKO10058526_A_Vmn1r87
  gRNA
gguggcgaaccuggcuacuu

SEQ ID NO: 58527 - RNA, 20 nt, Artificial Sequence
  MKO10058527_A_Vmn1r87
  gRNA
uagugcaguuacaagugacu

SEQ ID NO: 58528 - RNA, 20 nt, Artificial Sequence
  MKO10058528_A_Vmn1r88
  gRNA
uuaagccaggagacaaacgu

SEQ ID NO: 58529 - RNA, 20 nt, Artificial Sequence
  MKO10058529_A_Vmn1r88
  gRNA
aaaaccaauaugacucucgu

SEQ ID NO: 58530 - RNA, 20 nt, Artificial Sequence
  MKO10058530_A_Vmn1r88
  gRNA
aacgagagucauauugguuu

SEQ ID NO: 58531 - RNA, 20 nt, Artificial Sequence
  MKO10058531_A_Vmn1r89
  gRNA
gcauauacccguagaugacu

SEQ ID NO: 58532 - RNA, 20 nt, Artificial Sequence
  MKO10058532_A_Vmn1r89
  gRNA
cacucacgaucucuucuaug

SEQ ID NO: 58533 - RNA, 20 nt, Artificial Sequence
  MKO10058533_A_Vmn1r89
  gRNA
cauagaagagaucgugagug

SEQ ID NO: 58534 - RNA, 20 nt, Artificial Sequence
  MKO10058534_A_Vmn1r8
  gRNA
cagcagcacgauagucugcg

SEQ ID NO: 58535 - RNA, 20 nt, Artificial Sequence
  MKO10058535_A_Vmn1r8
  gRNA
aaccaucauuaugugcacaa

SEQ ID NO: 58536 - RNA, 20 nt, Artificial Sequence
  MKO10058536_A_Vmn1r8
  gRNA
cacgcagacuaucgugcugc

SEQ ID NO: 58537 - RNA, 20 nt, Artificial Sequence
  MKO10058537_A_Vmn1r90
  gRNA
acuugaauacuuccuacgca

SEQ ID NO: 58538 - RNA, 20 nt, Artificial Sequence
  MKO10058538_A_Vmn1r90
  gRNA
ugcuucuugcuaccaugcgu

SEQ ID NO: 58539 - RNA, 20 nt, Artificial Sequence
  MKO10058539_A_Vmn1r90
  gRNA
aucaucucaccaaaauugcc

SEQ ID NO: 58540 - RNA, 20 nt, Artificial Sequence
  MKO10058540_A_Vmn1r91
  gRNA
gcauucgcugaugaugucua

SEQ ID NO: 58541 - RNA, 20 nt, Artificial Sequence
  MKO10058541_A_Vmn1r91
  gRNA
ggguugcucuggacccagcu

SEQ ID NO: 58542 - RNA, 20 nt, Artificial Sequence
  MKO10058542_A_Vmn1r91
  gRNA
ccacggucccaaccacaaac

SEQ ID NO: 58543 - RNA, 20 nt, Artificial Sequence
  MKO10058543_A_Vmn1r93
  gRNA
gcccucuccaugucuguucg

SEQ ID NO: 58544 - RNA, 20 nt, Artificial Sequence
  MKO10058544_A_Vmn1r93
  gRNA
cagagcaagugucccaaauu

SEQ ID NO: 58545 - RNA, 20 nt, Artificial Sequence
  MKO10058545_A_Vmn1r93
  gRNA
gaccaugaugcucaugaaug

SEQ ID NO: 58546 - RNA, 20 nt, Artificial Sequence
  MKO10058546_A_Vmn1r94
  gRNA
caaauaugaccaccagcauc

SEQ ID NO: 58547 - RNA, 20 nt, Artificial Sequence
  MKO10058547_A_Vmn1r94
  gRNA
acccucucaaugucugauca

SEQ ID NO: 58548 - RNA, 20 nt, Artificial Sequence
  MKO10058548_A_Vmn1r94
  gRNA
caguugaaaagcacagaaca

SEQ ID NO: 58549 - RNA, 20 nt, Artificial Sequence
  MKO10058549_A_Vmn1r95
  gRNA
cauuugaagagcacagaaca

SEQ ID NO: 58550 - RNA, 20 nt, Artificial Sequence
  MKO10058550_A_Vmn1r95
  gRNA
gcccucuccaugucugcuca

SEQ ID NO: 58551 - RNA, 20 nt, Artificial Sequence
  MKO10058551_A_Vmn1r95
  gRNA
gccuacaaugaauccagaag

SEQ ID NO: 58552 - RNA, 20 nt, Artificial Sequence
  MKO10058552_A_Vmn1r9
  gRNA
uacccaugaacauuauuauc

SEQ ID NO: 58553 - RNA, 20 nt, Artificial Sequence
  MKO10058553_A_Vmn1r9
  gRNA
ucuauugaugcuuugacugc

SEQ ID NO: 58554 - RNA, 20 nt, Artificial Sequence
  MKO10058554_A_Vmn1r9
  gRNA
uccccugauaauaauguuca

SEQ ID NO: 58555 - RNA, 20 nt, Artificial Sequence
  MKO10058555_A_Vmn2r100
  gRNA
gagaaaacaggaguauugau

SEQ ID NO: 58556 - RNA, 20 nt, Artificial Sequence
  MKO10058556_A_Vmn2r100
  gRNA
cucucaccucaauauucuug

SEQ ID NO: 58557 - RNA, 20 nt, Artificial Sequence
  MKO10058557_A_Vmn2r100
  gRNA
ugauguuaauugucaugugu

SEQ ID NO: 58558 - RNA, 20 nt, Artificial Sequence
  MKO10058558_A_Vmn2r101
  gRNA
ugacacgucagcaacuucaa

SEQ ID NO: 58559 - RNA, 20 nt, Artificial Sequence
  MKO10058559_A_Vmn2r101
  gRNA
agucagcucugucaauaaca

SEQ ID NO: 58560 - RNA, 20 nt, Artificial Sequence
  MKO10058560_A_Vmn2r101
  gRNA
aacgacaacuguuuacccug

SEQ ID NO: 58561 - RNA, 20 nt, Artificial Sequence
  MKO10058561_A_Vmn2r102
  gRNA
gauccuuuauuaagugacca

SEQ ID NO: 58562 - RNA, 20 nt, Artificial Sequence
  MKO10058562_A_Vmn2r102
  gRNA
ccuccaugagaugagacuuc

SEQ ID NO: 58563 - RNA, 20 nt, Artificial Sequence
  MKO10058563_A_Vmn2r102
  gRNA
cgcucugcaauuugcaauug

SEQ ID NO: 58564 - RNA, 20 nt, Artificial Sequence
  MKO10058564_A_Vmn2r103
  gRNA
uauuccucauuauaccuucu

SEQ ID NO: 58565 - RNA, 20 nt, Artificial Sequence
  MKO10058565_A_Vmn2r103
  gRNA
gaucuucuauuaagugacca

SEQ ID NO: 58566 - RNA, 20 nt, Artificial Sequence
  MKO10058566_A_Vmn2r103
  gRNA
auucaggaaaguagccuugg

SEQ ID NO: 58567 - RNA, 20 nt, Artificial Sequence
  MKO10058567_A_Vmn2r104
  gRNA
auacugaccaucgucacuca

SEQ ID NO: 58568 - RNA, 20 nt, Artificial Sequence
  MKO10058568_A_Vmn2r104
  gRNA
uucuuagguuuacuugucgu

SEQ ID NO: 58569 - RNA, 20 nt, Artificial Sequence
  MKO10058569_A_Vmn2r104
  gRNA
gguuauugacauggaacauc

SEQ ID NO: 58570 - RNA, 20 nt, Artificial Sequence
  MKO10058570_A_Vmn2r105
  gRNA
cuucacauuuaaaccaauuc

SEQ ID NO: 58571 - RNA, 20 nt, Artificial Sequence
  MKO10058571_A_Vmn2r105
  gRNA
gaggccaaaugagauuagau

SEQ ID NO: 58572 - RNA, 20 nt, Artificial Sequence
  MKO10058572_A_Vmn2r105
  gRNA
gacacuucagcaaguacaaa

SEQ ID NO: 58573 - RNA, 20 nt, Artificial Sequence
  MKO10058573_A_Vmn2r106
  gRNA
auguguugguguucucgccc

SEQ ID NO: 58574 - RNA, 20 nt, Artificial Sequence
  MKO10058574_A_Vmn2r106
  gRNA
auaacagagcaaguauauac

SEQ ID NO: 58575 - RNA, 20 nt, Artificial Sequence
  MKO10058575_A_Vmn2r106
  gRNA
uacaauuguuauuaccugcc

SEQ ID NO: 58576 - RNA, 20 nt, Artificial Sequence
  MKO10058576_A_Vmn2r107
  gRNA
ugagagucaacaguuuagac

SEQ ID NO: 58577 - RNA, 20 nt, Artificial Sequence
  MKO10058577_A_Vmn2r107
  gRNA
agcagauagccuuauucucc

SEQ ID NO: 58578 - RNA, 20 nt, Artificial Sequence
  MKO10058578_A_Vmn2r107
  gRNA
caaccgugugaaaaugaaga

SEQ ID NO: 58579 - RNA, 20 nt, Artificial Sequence
  MKO10058579_A_Vmn2r108
  gRNA
uaauaugcauuccaugucau

SEQ ID NO: 58580 - RNA, 20 nt, Artificial Sequence
  MKO10058580_A_Vmn2r108
  gRNA
ugauguugauugucgacuuu

SEQ ID NO: 58581 - RNA, 20 nt, Artificial Sequence
  MKO10058581_A_Vmn2r108
  gRNA
acaccaaagccagaauauac

SEQ ID NO: 58582 - RNA, 20 nt, Artificial Sequence
  MKO10058582_A_Vmn2r109
  gRNA
auauaugaagcccacguguc

SEQ ID NO: 58583 - RNA, 20 nt, Artificial Sequence
  MKO10058583_A_Vmn2r109
  gRNA
ugaaaaugaucccugacacg

SEQ ID NO: 58584 - RNA, 20 nt, Artificial Sequence
  MKO10058584_A_Vmn2r109
  gRNA
uugagauaugagccaaaaac

SEQ ID NO: 58585 - RNA, 20 nt, Artificial Sequence
  MKO10058585_A_Vmn2r10
  gRNA
uccuauaagggcuauaaaac

SEQ ID NO: 58586 - RNA, 20 nt, Artificial Sequence
  MKO10058586_A_Vmn2r10
  gRNA
cacacguuugucccaugcaa

SEQ ID NO: 58587 - RNA, 20 nt, Artificial Sequence
  MKO10058587_A_Vmn2r10
  gRNA
uugauauuccccauuaauca

SEQ ID NO: 58588 - RNA, 20 nt, Artificial Sequence
  MKO10058588_A_Vmn2r110
  gRNA
acgugaaauugaugaguacu

SEQ ID NO: 58589 - RNA, 20 nt, Artificial Sequence
  MKO10058589_A_Vmn2r110
  gRNA
caaagcucucucuauacuug

SEQ ID NO: 58590 - RNA, 20 nt, Artificial Sequence
  MKO10058590_A_Vmn2r110
  gRNA
gaggcaacauaaguuuagau

SEQ ID NO: 58591 - RNA, 20 nt, Artificial Sequence
  MKO10058591_A_Vmn2r111
  gRNA
caaauacccagaugacuauc

SEQ ID NO: 58592 - RNA, 20 nt, Artificial Sequence
  MKO10058592_A_Vmn2r111
  gRNA
gaauaacaucauuucugagc

SEQ ID NO: 58593 - RNA, 20 nt, Artificial Sequence
  MKO10058593_A_Vmn2r111
  gRNA
gcucagaaaugauguuauuc

SEQ ID NO: 58594 - RNA, 20 nt, Artificial Sequence
  MKO10058594_A_Vmn2r112
  gRNA
uggaucuagaaaauucgaga

SEQ ID NO: 58595 - RNA, 20 nt, Artificial Sequence
  MKO10058595_A_Vmn2r112
  gRNA
cauccaguuacucauuugau

SEQ ID NO: 58596 - RNA, 20 nt, Artificial Sequence
  MKO10058596_A_Vmn2r112
  gRNA
agaauacaccgaauguguaa

SEQ ID NO: 58597 - RNA, 20 nt, Artificial Sequence
  MKO10058597_A_Vmn2r113
  gRNA
gggacugcaaucaaaacaac

SEQ ID NO: 58598 - RNA, 20 nt, Artificial Sequence
  MKO10058598_A_Vmn2r113
  gRNA
gaugagauaugaaguuguuu

SEQ ID NO: 58599 - RNA, 20 nt, Artificial Sequence
  MKO10058599_A_Vmn2r113
  gRNA
ugaaaaucacaaguaugcuc

SEQ ID NO: 58600 - RNA, 20 nt, Artificial Sequence
  MKO10058600_A_Vmn2r114
  gRNA
ucaaaaguuugaucugccca

SEQ ID NO: 58601 - RNA, 20 nt, Artificial Sequence
  MKO10058601_A_Vmn2r114
  gRNA
uguaagugccauuguacacc

SEQ ID NO: 58602 - RNA, 20 nt, Artificial Sequence
  MKO10058602_A_Vmn2r114
  gRNA
ucuccaaauacaauuguuac

SEQ ID NO: 58603 - RNA, 20 nt, Artificial Sequence
  MKO10058603_A_Vmn2r115
  gRNA
gaccauacaucucuagccuu

SEQ ID NO: 58604 - RNA, 20 nt, Artificial Sequence
  MKO10058604_A_Vmn2r115
  gRNA
uguaagcgccauugcacauu

SEQ ID NO: 58605 - RNA, 20 nt, Artificial Sequence
  MKO10058605_A_Vmn2r115
  gRNA
caaaugcccagaugaguauc

SEQ ID NO: 58606 - RNA, 20 nt, Artificial Sequence
  MKO10058606_A_Vmn2r116
  gRNA
gaauugagucucauucguuu

SEQ ID NO: 58607 - RNA, 20 nt, Artificial Sequence
  MKO10058607_A_Vmn2r116
  gRNA
ggucagacaagaaguuacuu

SEQ ID NO: 58608 - RNA, 20 nt, Artificial Sequence
  MKO10058608_A_Vmn2r116
  gRNA
aaccacuucauuaacccugu

SEQ ID NO: 58609 - RNA, 20 nt, Artificial Sequence
  MKO10058609_A_Vmn2r117
  gRNA
ucucaaacuacaacugucac

SEQ ID NO: 58610 - RNA, 20 nt, Artificial Sequence
  MKO10058610_A_Vmn2r117
  gRNA
agaauucaccaagugugcaa

SEQ ID NO: 58611 - RNA, 20 nt, Artificial Sequence
  MKO10058611_A_Vmn2r117
  gRNA
gaaccgaagaaacaaacugc

SEQ ID NO: 58612 - RNA, 20 nt, Artificial Sequence
  MKO10058612_A_Vmn2r118
  gRNA
aaaugugacccaacuaaugc

SEQ ID NO: 58613 - RNA, 20 nt, Artificial Sequence
  MKO10058613_A_Vmn2r118
  gRNA
guggauaucaucugcacaag

SEQ ID NO: 58614 - RNA, 20 nt, Artificial Sequence
  MKO10058614_A_Vmn2r118
  gRNA
uaaccauuccaauaaguugc

SEQ ID NO: 58615 - RNA, 20 nt, Artificial Sequence
  MKO10058615_A_Vmn2r11
  gRNA
ccaacauaucucugauauuc

SEQ ID NO: 58616 - RNA, 20 nt, Artificial Sequence
  MKO10058616_A_Vmn2r11
  gRNA
guaaggucuauguaacaguu

SEQ ID NO: 58617 - RNA, 20 nt, Artificial Sequence
  MKO10058617_A_Vmn2r11
  gRNA
gcuauuuacauuguuaccca

SEQ ID NO: 58618 - RNA, 20 nt, Artificial Sequence
  MKO10058618_A_Vmn2r120
  gRNA
uuacaguaaacccgugaaaa

SEQ ID NO: 58619 - RNA, 20 nt, Artificial Sequence
  MKO10058619_A_Vmn2r120
  gRNA
accuuggcaccgauuugaca

SEQ ID NO: 58620 - RNA, 20 nt, Artificial Sequence
  MKO10058620_A_Vmn2r120
  gRNA
aaaguagaucugagccauac

SEQ ID NO: 58621 - RNA, 20 nt, Artificial Sequence
  MKO10058621_A_Vmn2r121
  gRNA
uuuccugaauccagcaguac

SEQ ID NO: 58622 - RNA, 20 nt, Artificial Sequence
  MKO10058622_A_Vmn2r121
  gRNA
uguacccacuguuccuccca

SEQ ID NO: 58623 - RNA, 20 nt, Artificial Sequence
  MKO10058623_A_Vmn2r121
  gRNA
ugauggaccuguaaaaccua

SEQ ID NO: 58624 - RNA, 20 nt, Artificial Sequence
  MKO10058624_A_Vmn2r122
  gRNA
ccagaaaugacaccguucuu

SEQ ID NO: 58625 - RNA, 20 nt, Artificial Sequence
  MKO10058625_A_Vmn2r122
  gRNA
caagaauaugcacaaauaga

SEQ ID NO: 58626 - RNA, 20 nt, Artificial Sequence
  MKO10058626_A_Vmn2r122
  gRNA
gggaaggucaugggugguug

SEQ ID NO: 58627 - RNA, 20 nt, Artificial Sequence
  MKO10058627_A_Vmn2r123
  gRNA
aaugcacucuucgaugccac

SEQ ID NO: 58628 - RNA, 20 nt, Artificial Sequence
  MKO10058628_A_Vmn2r123
  gRNA
ucaggauuuauugagaguua

SEQ ID NO: 58629 - RNA, 20 nt, Artificial Sequence
  MKO10058629_A_Vmn2r123
  gRNA
gugcagugauguccauucca

SEQ ID NO: 58630 - RNA, 20 nt, Artificial Sequence
  MKO10058630_A_Vmn2r124
  gRNA
aucccuucgccauuuaaaua

SEQ ID NO: 58631 - RNA, 20 nt, Artificial Sequence
  MKO10058631_A_Vmn2r124
  gRNA
caaaugcaaccguauuuaaa

SEQ ID NO: 58632 - RNA, 20 nt, Artificial Sequence
  MKO10058632_A_Vmn2r124
  gRNA
uccucacuucaaugucuuuc

SEQ ID NO: 58633 - RNA, 20 nt, Artificial Sequence
  MKO10058633_A_Vmn2r12
  gRNA
ugugauaacgucccauugca

SEQ ID NO: 58634 - RNA, 20 nt, Artificial Sequence
  MKO10058634_A_Vmn2r12
  gRNA
guaaaacugucaauucauca

SEQ ID NO: 58635 - RNA, 20 nt, Artificial Sequence
  MKO10058635_A_Vmn2r12
  gRNA
uaucaguaaauuguacagua

SEQ ID NO: 58636 - RNA, 20 nt, Artificial Sequence
  MKO10058636_A_Vmn2r13
  gRNA
auuuaacaaguucaccuaug

SEQ ID NO: 58637 - RNA, 20 nt, Artificial Sequence
  MKO10058637_A_Vmn2r13
  gRNA
uucgcacugaccagaaguaa

SEQ ID NO: 58638 - RNA, 20 nt, Artificial Sequence
  MKO10058638_A_Vmn2r13
  gRNA
guaaaacugucaauucauac

SEQ ID NO: 58639 - RNA, 20 nt, Artificial Sequence
  MKO10058639_A_Vmn2r14
  gRNA
guaaaacucucaacaaauuc

SEQ ID NO: 58640 - RNA, 20 nt, Artificial Sequence
  MKO10058640_A_Vmn2r14
  gRNA
uugauauucccugaagaucc

SEQ ID NO: 58641 - RNA, 20 nt, Artificial Sequence
  MKO10058641_A_Vmn2r14
  gRNA
gcaucaaagugaucaugcca

SEQ ID NO: 58642 - RNA, 20 nt, Artificial Sequence
  MKO10058642_A_Vmn2r15
  gRNA
uugauaucccccguugauca

SEQ ID NO: 58643 - RNA, 20 nt, Artificial Sequence
  MKO10058643_A_Vmn2r15
  gRNA
accuguuacauaggucuuau

SEQ ID NO: 58644 - RNA, 20 nt, Artificial Sequence
  MKO10058644_A_Vmn2r15
  gRNA
accuucuaaagcugacuugu

SEQ ID NO: 58645 - RNA, 20 nt, Artificial Sequence
  MKO10058645_A_Vmn2r16
  gRNA
aaaugucauaaucugcacac

SEQ ID NO: 58646 - RNA, 20 nt, Artificial Sequence
  MKO10058646_A_Vmn2r16
  gRNA
auuuagcaauucugccauug

SEQ ID NO: 58647 - RNA, 20 nt, Artificial Sequence
  MKO10058647_A_Vmn2r16
  gRNA
agauguuacucagaccaugc

SEQ ID NO: 58648 - RNA, 20 nt, Artificial Sequence
  MKO10058648_A_Vmn2r17
  gRNA
cuucuuguagaauaccagca

SEQ ID NO: 58649 - RNA, 20 nt, Artificial Sequence
  MKO10058649_A_Vmn2r17
  gRNA
uggagauacauugggauacc

SEQ ID NO: 58650 - RNA, 20 nt, Artificial Sequence
  MKO10058650_A_Vmn2r17
  gRNA
ccaguuucccuauaucuauc

SEQ ID NO: 58651 - RNA, 20 nt, Artificial Sequence
  MKO10058651_A_Vmn2r18
  gRNA
ccccagcaguguugguaaau

SEQ ID NO: 58652 - RNA, 20 nt, Artificial Sequence
  MKO10058652_A_Vmn2r18
  gRNA
auccaauuuaccaacacugc

SEQ ID NO: 58653 - RNA, 20 nt, Artificial Sequence
  MKO10058653_A_Vmn2r18
  gRNA
ucgcugauuuaggcagacag

SEQ ID NO: 58654 - RNA, 20 nt, Artificial Sequence
  MKO10058654_A_Vmn2r19
  gRNA
caguaccaaaucucaaguaa

SEQ ID NO: 58655 - RNA, 20 nt, Artificial Sequence
  MKO10058655_A_Vmn2r19
  gRNA
caaaugcaacgcaaauuccu

SEQ ID NO: 58656 - RNA, 20 nt, Artificial Sequence
  MKO10058656_A_Vmn2r19
  gRNA
gccaaccuuuacuugagauu

SEQ ID NO: 58657 - RNA, 20 nt, Artificial Sequence
  MKO10058657_A_Vmn2r1
  gRNA
gacccggaaggggauucguc

SEQ ID NO: 58658 - RNA, 20 nt, Artificial Sequence
  MKO10058658_A_Vmn2r1
  gRNA
gccccugacgaauccccuuc

SEQ ID NO: 58659 - RNA, 20 nt, Artificial Sequence
  MKO10058659_A_Vmn2r1
  gRNA
gcuguauaugcuauagcuca

SEQ ID NO: 58660 - RNA, 20 nt, Artificial Sequence
  MKO10058660_A_Vmn2r20
  gRNA
ucauuugcaaucucucccuc

SEQ ID NO: 58661 - RNA, 20 nt, Artificial Sequence
  MKO10058661_A_Vmn2r20
  gRNA
cuuugacugcaaacagacaa

SEQ ID NO: 58662 - RNA, 20 nt, Artificial Sequence
  MKO10058662_A_Vmn2r20
  gRNA
caaacauuaucagcacauau

SEQ ID NO: 58663 - RNA, 20 nt, Artificial Sequence
  MKO10058663_A_Vmn2r21
  gRNA
caaacauuaucagcacauau

SEQ ID NO: 58664 - RNA, 20 nt, Artificial Sequence
  MKO10058664_A_Vmn2r21
  gRNA
cauuguagagacuuagaacu

SEQ ID NO: 58665 - RNA, 20 nt, Artificial Sequence
  MKO10058665_A_Vmn2r21
  gRNA
auagcuaccuuccaagggag

SEQ ID NO: 58666 - RNA, 20 nt, Artificial Sequence
  MKO10058666_A_Vmn2r22
  gRNA
uaggugagaauacaguaaac

SEQ ID NO: 58667 - RNA, 20 nt, Artificial Sequence
  MKO10058667_A_Vmn2r22
  gRNA
cacuggauagaagugcacuc

SEQ ID NO: 58668 - RNA, 20 nt, Artificial Sequence
  MKO10058668_A_Vmn2r22
  gRNA
ugucuucaaugcugacuuua

SEQ ID NO: 58669 - RNA, 20 nt, Artificial Sequence
  MKO10058669_A_Vmn2r23
  gRNA
cacauugacacauguuauug

SEQ ID NO: 58670 - RNA, 20 nt, Artificial Sequence
  MKO10058670_A_Vmn2r23
  gRNA
aucccaugcuguucaaaaua

SEQ ID NO: 58671 - RNA, 20 nt, Artificial Sequence
  MKO10058671_A_Vmn2r23
  gRNA
uauaggaaaacacccauuga

SEQ ID NO: 58672 - RNA, 20 nt, Artificial Sequence
  MKO10058672_A_Vmn2r24
  gRNA
uacagagcuacguugugcac

SEQ ID NO: 58673 - RNA, 20 nt, Artificial Sequence
  MKO10058673_A_Vmn2r24
  gRNA
aaucguguuuauagacacuu

SEQ ID NO: 58674 - RNA, 20 nt, Artificial Sequence
  MKO10058674_A_Vmn2r24
  gRNA
guucacaacguucuucucau

SEQ ID NO: 58675 - RNA, 20 nt, Artificial Sequence
  MKO10058675_A_Vmn2r25
  gRNA
cuaucuuagggauauuaccg

SEQ ID NO: 58676 - RNA, 20 nt, Artificial Sequence
  MKO10058676_A_Vmn2r25
  gRNA
auugcuaccuuccauggaug

SEQ ID NO: 58677 - RNA, 20 nt, Artificial Sequence
  MKO10058677_A_Vmn2r25
  gRNA
guucacacuguacuccucau

SEQ ID NO: 58678 - RNA, 20 nt, Artificial Sequence
  MKO10058678_A_Vmn2r26
  gRNA
cuaucuuagggacauuacca

SEQ ID NO: 58679 - RNA, 20 nt, Artificial Sequence
  MKO10058679_A_Vmn2r26
  gRNA
agccuggaguaaacauuuau

SEQ ID NO: 58680 - RNA, 20 nt, Artificial Sequence
  MKO10058680_A_Vmn2r26
  gRNA
caguaccgcucuguagagac

SEQ ID NO: 58681 - RNA, 20 nt, Artificial Sequence
  MKO10058681_A_Vmn2r27
  gRNA
ugcaauacaaaguccgugcu

SEQ ID NO: 58682 - RNA, 20 nt, Artificial Sequence
  MKO10058682_A_Vmn2r27
  gRNA
aaauuuacuguguuccgaca

SEQ ID NO: 58683 - RNA, 20 nt, Artificial Sequence
  MKO10058683_A_Vmn2r27
  gRNA
gcacaaucguaacaacagag

SEQ ID NO: 58684 - RNA, 20 nt, Artificial Sequence
  MKO10058684_A_Vmn2r28
  gRNA
ugauagccaucuucaucauc

SEQ ID NO: 58685 - RNA, 20 nt, Artificial Sequence
  MKO10058685_A_Vmn2r28
  gRNA
acuucauacuuuacuuccaa

SEQ ID NO: 58686 - RNA, 20 nt, Artificial Sequence
  MKO10058686_A_Vmn2r28
  gRNA
uggauucagaagaucccgga

SEQ ID NO: 58687 - RNA, 20 nt, Artificial Sequence
  MKO10058687_A_Vmn2r29
  gRNA
auacguagacaugauugaag

SEQ ID NO: 58688 - RNA, 20 nt, Artificial Sequence
  MKO10058688_A_Vmn2r29
  gRNA
auaaucacuuugucuccaag

SEQ ID NO: 58689 - RNA, 20 nt, Artificial Sequence
  MKO10058689_A_Vmn2r29
  gRNA
uaaaaaccacaaauaugcuu

SEQ ID NO: 58690 - RNA, 20 nt, Artificial Sequence
  MKO10058690_A_Vmn2r2
  gRNA
gucccugucgaaucccccuu

SEQ ID NO: 58691 - RNA, 20 nt, Artificial Sequence
  MKO10058691_A_Vmn2r2
  gRNA
cccagacccaaccaaagugu

SEQ ID NO: 58692 - RNA, 20 nt, Artificial Sequence
  MKO10058692_A_Vmn2r2
  gRNA
gugagucuuauccaacacuu

SEQ ID NO: 58693 - RNA, 20 nt, Artificial Sequence
  MKO10058693_A_Vmn2r30
  gRNA
gcggagauaagaagcugucc

SEQ ID NO: 58694 - RNA, 20 nt, Artificial Sequence
  MKO10058694_A_Vmn2r30
  gRNA
uaaaaaccacaaauaugcuu

SEQ ID NO: 58695 - RNA, 20 nt, Artificial Sequence
  MKO10058695_A_Vmn2r30
  gRNA
uagauccuucagcuuaccua

SEQ ID NO: 58696 - RNA, 20 nt, Artificial Sequence
  MKO10058696_A_Vmn2r31
  gRNA
gaaaaaacagagugaaaaca

SEQ ID NO: 58697 - RNA, 20 nt, Artificial Sequence
  MKO10058697_A_Vmn2r31
  gRNA
uaaaaaccacaaauacgcuu

SEQ ID NO: 58698 - RNA, 20 nt, Artificial Sequence
  MKO10058698_A_Vmn2r31
  gRNA
guggagauaagaagcugucc

SEQ ID NO: 58699 - RNA, 20 nt, Artificial Sequence
  MKO10058699_A_Vmn2r32
  gRNA
aauggaacagaagcuugaca

SEQ ID NO: 58700 - RNA, 20 nt, Artificial Sequence
  MKO10058700_A_Vmn2r32
  gRNA
ucuucauuacagauauaauu

SEQ ID NO: 58701 - RNA, 20 nt, Artificial Sequence
  MKO10058701_A_Vmn2r32
  gRNA
uaaaaaccacaaauaugcuu

SEQ ID NO: 58702 - RNA, 20 nt, Artificial Sequence
  MKO10058702_A_Vmn2r33
  gRNA
uccucugugugcagugcaga

SEQ ID NO: 58703 - RNA, 20 nt, Artificial Sequence
  MKO10058703_A_Vmn2r33
  gRNA
accuucugcacugcacacag

SEQ ID NO: 58704 - RNA, 20 nt, Artificial Sequence
  MKO10058704_A_Vmn2r33
  gRNA
uaaaaaccacaaauacgcuu

SEQ ID NO: 58705 - RNA, 20 nt, Artificial Sequence
  MKO10058705_A_Vmn2r34
  gRNA
uaaaaccagaaaucacgcca

SEQ ID NO: 58706 - RNA, 20 nt, Artificial Sequence
  MKO10058706_A_Vmn2r34
  gRNA
uauaucuaguaaugcaagac

SEQ ID NO: 58707 - RNA, 20 nt, Artificial Sequence
  MKO10058707_A_Vmn2r34
  gRNA
uaaaaaccacaaauaugcuu

SEQ ID NO: 58708 - RNA, 20 nt, Artificial Sequence
  MKO10058708_A_Vmn2r35
  gRNA
uaaaaaccacaaauaugcuu

SEQ ID NO: 58709 - RNA, 20 nt, Artificial Sequence
  MKO10058709_A_Vmn2r35
  gRNA
guggagauaaaaagcugucc

SEQ ID NO: 58710 - RNA, 20 nt, Artificial Sequence
  MKO10058710_A_Vmn2r35
  gRNA
uagauccuucagcuuaccua

SEQ ID NO: 58711 - RNA, 20 nt, Artificial Sequence
  MKO10058711_A_Vmn2r36
  gRNA
uacaaaccacaaauaugcuu

SEQ ID NO: 58712 - RNA, 20 nt, Artificial Sequence
  MKO10058712_A_Vmn2r36
  gRNA
guggagauaaaaagcugucc

SEQ ID NO: 58713 - RNA, 20 nt, Artificial Sequence
  MKO10058713_A_Vmn2r36
  gRNA
uagaucuuucagcuuaccua

SEQ ID NO: 58714 - RNA, 20 nt, Artificial Sequence
  MKO10058714_A_Vmn2r37
  gRNA
uaaaaaccacaaauaugcuu

SEQ ID NO: 58715 - RNA, 20 nt, Artificial Sequence
  MKO10058715_A_Vmn2r37
  gRNA
aaccuaaagauaccucccaa

SEQ ID NO: 58716 - RNA, 20 nt, Artificial Sequence
  MKO10058716_A_Vmn2r37
  gRNA
uagauccuucagcuuaccua

SEQ ID NO: 58717 - RNA, 20 nt, Artificial Sequence
  MKO10058717_A_Vmn2r38
  gRNA
uaaaaaccacaaauacgcuu

SEQ ID NO: 58718 - RNA, 20 nt, Artificial Sequence
  MKO10058718_A_Vmn2r38
  gRNA
guggagauaagaagcugucc

SEQ ID NO: 58719 - RNA, 20 nt, Artificial Sequence
  MKO10058719_A_Vmn2r38
  gRNA
uagauccuucagcuuaccua

SEQ ID NO: 58720 - RNA, 20 nt, Artificial Sequence
  MKO10058720_A_Vmn2r39
  gRNA
gaaagaaagaguaauaauac

SEQ ID NO: 58721 - RNA, 20 nt, Artificial Sequence
  MKO10058721_A_Vmn2r39
  gRNA
auaaucaauuuguccccaac

SEQ ID NO: 58722 - RNA, 20 nt, Artificial Sequence
  MKO10058722_A_Vmn2r39
  gRNA
uaaaaaccacaaauaugcuu

SEQ ID NO: 58723 - RNA, 20 nt, Artificial Sequence
  MKO10058723_A_Vmn2r3
  gRNA
acccggaagggauuuaucac

SEQ ID NO: 58724 - RNA, 20 nt, Artificial Sequence
  MKO10058724_A_Vmn2r3
  gRNA
gugagccacuggccucuauu

SEQ ID NO: 58725 - RNA, 20 nt, Artificial Sequence
  MKO10058725_A_Vmn2r3
  gRNA
ggaucaacuaugucacuugc

SEQ ID NO: 58726 - RNA, 20 nt, Artificial Sequence
  MKO10058726_A_Vmn2r40
  gRNA
agccaguucucacugcuuaa

SEQ ID NO: 58727 - RNA, 20 nt, Artificial Sequence
  MKO10058727_A_Vmn2r40
  gRNA
uaccuuuaagcagugagaac

SEQ ID NO: 58728 - RNA, 20 nt, Artificial Sequence
  MKO10058728_A_Vmn2r40
  gRNA
uacaaaccacaaauaugcuu

SEQ ID NO: 58729 - RNA, 20 nt, Artificial Sequence
  MKO10058729_A_Vmn2r41
  gRNA
uacaaaccacaaauaugcuu

SEQ ID NO: 58730 - RNA, 20 nt, Artificial Sequence
  MKO10058730_A_Vmn2r41
  gRNA
guggagauaagaagcugucc

SEQ ID NO: 58731 - RNA, 20 nt, Artificial Sequence
  MKO10058731_A_Vmn2r41
  gRNA
uagauccuucagcuuaccua

SEQ ID NO: 58732 - RNA, 20 nt, Artificial Sequence
  MKO10058732_A_Vmn2r42
  gRNA
uaaaaaccacaaauaugcuu

SEQ ID NO: 58733 - RNA, 20 nt, Artificial Sequence
  MKO10058733_A_Vmn2r42
  gRNA
guggagauaagaagcugucc

SEQ ID NO: 58734 - RNA, 20 nt, Artificial Sequence
  MKO10058734_A_Vmn2r42
  gRNA
uagauccuucagcuuuccua

SEQ ID NO: 58735 - RNA, 20 nt, Artificial Sequence
  MKO10058735_A_Vmn2r43
  gRNA
cuuacuuuccuaccccaccg

SEQ ID NO: 58736 - RNA, 20 nt, Artificial Sequence
  MKO10058736_A_Vmn2r43
  gRNA
uaaaaaccacaaauaugcuu

SEQ ID NO: 58737 - RNA, 20 nt, Artificial Sequence
  MKO10058737_A_Vmn2r43
  gRNA
cuuaaagauaccucccaauu

SEQ ID NO: 58738 - RNA, 20 nt, Artificial Sequence
  MKO10058738_A_Vmn2r44
  gRNA
uaaaaaccacaaauacgcuu

SEQ ID NO: 58739 - RNA, 20 nt, Artificial Sequence
  MKO10058739_A_Vmn2r44
  gRNA
guggagauaagaagcugucc

SEQ ID NO: 58740 - RNA, 20 nt, Artificial Sequence
  MKO10058740_A_Vmn2r44
  gRNA
uagauccuucagcuuaccua

SEQ ID NO: 58741 - RNA, 20 nt, Artificial Sequence
  MKO10058741_A_Vmn2r45
  gRNA
aagugagagugucguccaug

SEQ ID NO: 58742 - RNA, 20 nt, Artificial Sequence
  MKO10058742_A_Vmn2r45
  gRNA
aacagagaucaucuucacaa

SEQ ID NO: 58743 - RNA, 20 nt, Artificial Sequence
  MKO10058743_A_Vmn2r45
  gRNA
gucaucccagaugaugacca

SEQ ID NO: 58744 - RNA, 20 nt, Artificial Sequence
  MKO10058744_A_Vmn2r46
  gRNA
uaaaaaccacaaauaugcuu

SEQ ID NO: 58745 - RNA, 20 nt, Artificial Sequence
  MKO10058745_A_Vmn2r46
  gRNA
guggagauaaaaagcugucc

SEQ ID NO: 58746 - RNA, 20 nt, Artificial Sequence
  MKO10058746_A_Vmn2r46
  gRNA
uagauccuucagcuuaccua

SEQ ID NO: 58747 - RNA, 20 nt, Artificial Sequence
  MKO10058747_A_Vmn2r47
  gRNA
uaaaaaccacaaauaugcuu

SEQ ID NO: 58748 - RNA, 20 nt, Artificial Sequence
  MKO10058748_A_Vmn2r47
  gRNA
gcagagauaagaagcugucc

SEQ ID NO: 58749 - RNA, 20 nt, Artificial Sequence
  MKO10058749_A_Vmn2r47
  gRNA
uagauccuucagcuuaccua

SEQ ID NO: 58750 - RNA, 20 nt, Artificial Sequence
  MKO10058750_A_Vmn2r48
  gRNA
uacaaaccacaaauaugcuu

SEQ ID NO: 58751 - RNA, 20 nt, Artificial Sequence
  MKO10058751_A_Vmn2r48
  gRNA
guggagauaagaagcugucc

SEQ ID NO: 58752 - RNA, 20 nt, Artificial Sequence
  MKO10058752_A_Vmn2r48
  gRNA
uagauccuucagcuuaccua

SEQ ID NO: 58753 - RNA, 20 nt, Artificial Sequence
  MKO10058753_A_Vmn2r49
  gRNA
gcgaaucucucagaacaccu

SEQ ID NO: 58754 - RNA, 20 nt, Artificial Sequence
  MKO10058754_A_Vmn2r49
  gRNA
uaaaaaccacaaauaugcuu

SEQ ID NO: 58755 - RNA, 20 nt, Artificial Sequence
  MKO10058755_A_Vmn2r49
  gRNA
guggagauaagaagcugucc

SEQ ID NO: 58756 - RNA, 20 nt, Artificial Sequence
  MKO10058756_A_Vmn2r4
  gRNA
ggagagggccaaccuuugug

SEQ ID NO: 58757 - RNA, 20 nt, Artificial Sequence
  MKO10058757_A_Vmn2r4
  gRNA
gugucuaauuagauuuacga

SEQ ID NO: 58758 - RNA, 20 nt, Artificial Sequence
  MKO10058758_A_Vmn2r4
  gRNA
gacucggaagggaauucucc

SEQ ID NO: 58759 - RNA, 20 nt, Artificial Sequence
  MKO10058759_A_Vmn2r50
  gRNA
auccacuucacuaauacucu

SEQ ID NO: 58760 - RNA, 20 nt, Artificial Sequence
  MKO10058760_A_Vmn2r50
  gRNA
auguguucguuucugcuuag

SEQ ID NO: 58761 - RNA, 20 nt, Artificial Sequence
  MKO10058761_A_Vmn2r50
  gRNA
ccccaagaguauuagugaag

SEQ ID NO: 58762 - RNA, 20 nt, Artificial Sequence
  MKO10058762_A_Vmn2r51
  gRNA
caucaucacugaacacagau

SEQ ID NO: 58763 - RNA, 20 nt, Artificial Sequence
  MKO10058763_A_Vmn2r51
  gRNA
accauugccaaugcuagaga

SEQ ID NO: 58764 - RNA, 20 nt, Artificial Sequence
  MKO10058764_A_Vmn2r51
  gRNA
uucugcuuucagaauccaau

SEQ ID NO: 58765 - RNA, 20 nt, Artificial Sequence
  MKO10058765_A_Vmn2r52
  gRNA
cacauaugccucaacugaaa

SEQ ID NO: 58766 - RNA, 20 nt, Artificial Sequence
  MKO10058766_A_Vmn2r52
  gRNA
aaaguaaaagucccauagaa

SEQ ID NO: 58767 - RNA, 20 nt, Artificial Sequence
  MKO10058767_A_Vmn2r52
  gRNA
acauuuagacauguuugagu

SEQ ID NO: 58768 - RNA, 20 nt, Artificial Sequence
  MKO10058768_A_Vmn2r53
  gRNA
acugccuauugugcuguacc

SEQ ID NO: 58769 - RNA, 20 nt, Artificial Sequence
  MKO10058769_A_Vmn2r53
  gRNA
gccaccagguacagcacaau

SEQ ID NO: 58770 - RNA, 20 nt, Artificial Sequence
  MKO10058770_A_Vmn2r53
  gRNA
uaacugcaugggagcauguu

SEQ ID NO: 58771 - RNA, 20 nt, Artificial Sequence
  MKO10058771_A_Vmn2r54
  gRNA
caccagaacccucuuggcac

SEQ ID NO: 58772 - RNA, 20 nt, Artificial Sequence
  MKO10058772_A_Vmn2r54
  gRNA
aguaaguucccugaaugcag

SEQ ID NO: 58773 - RNA, 20 nt, Artificial Sequence
  MKO10058773_A_Vmn2r54
  gRNA
guaaaccacguaggaugagc

SEQ ID NO: 58774 - RNA, 20 nt, Artificial Sequence
  MKO10058774_A_Vmn2r55
  gRNA
ucuaccgcuggacuucuugg

SEQ ID NO: 58775 - RNA, 20 nt, Artificial Sequence
  MKO10058775_A_Vmn2r55
  gRNA
gucuauccugcuauauauga

SEQ ID NO: 58776 - RNA, 20 nt, Artificial Sequence
  MKO10058776_A_Vmn2r55
  gRNA
uacucuaugcaaaccccagc

SEQ ID NO: 58777 - RNA, 20 nt, Artificial Sequence
  MKO10058777_A_Vmn2r56
  gRNA
ccccgaugguguauuucacu

SEQ ID NO: 58778 - RNA, 20 nt, Artificial Sequence
  MKO10058778_A_Vmn2r56
  gRNA
gcaagccauacaagaugagc

SEQ ID NO: 58779 - RNA, 20 nt, Artificial Sequence
  MKO10058779_A_Vmn2r56
  gRNA
guaucaaaugaagcaugccc

SEQ ID NO: 58780 - RNA, 20 nt, Artificial Sequence
  MKO10058780_A_Vmn2r57
  gRNA
uuuccucagauaaagacaac

SEQ ID NO: 58781 - RNA, 20 nt, Artificial Sequence
  MKO10058781_A_Vmn2r57
  gRNA
ucaccgguugucuuuaucug

SEQ ID NO: 58782 - RNA, 20 nt, Artificial Sequence
  MKO10058782_A_Vmn2r57
  gRNA
uagcucucuucacucauugc

SEQ ID NO: 58783 - RNA, 20 nt, Artificial Sequence
  MKO10058783_A_Vmn2r58
  gRNA
acgauaaugagaagucauau

SEQ ID NO: 58784 - RNA, 20 nt, Artificial Sequence
  MKO10058784_A_Vmn2r58
  gRNA
uucacaccaccaugacgaga

SEQ ID NO: 58785 - RNA, 20 nt, Artificial Sequence
  MKO10058785_A_Vmn2r58
  gRNA
aucauaccagaugaucacag

SEQ ID NO: 58786 - RNA, 20 nt, Artificial Sequence
  MKO10058786_A_Vmn2r59
  gRNA
aagaaaaggaauuauccccu

SEQ ID NO: 58787 - RNA, 20 nt, Artificial Sequence
  MKO10058787_A_Vmn2r59
  gRNA
uagccuucuucacccaugac

SEQ ID NO: 58788 - RNA, 20 nt, Artificial Sequence
  MKO10058788_A_Vmn2r59
  gRNA
cuauucucuaaaugcuccgc

SEQ ID NO: 58789 - RNA, 20 nt, Artificial Sequence
  MKO10058789_A_Vmn2r5
  gRNA
cacaauugcuuaaaugaucc

SEQ ID NO: 58790 - RNA, 20 nt, Artificial Sequence
  MKO10058790_A_Vmn2r5
  gRNA
auuguaaggcacacuguugu

SEQ ID NO: 58791 - RNA, 20 nt, Artificial Sequence
  MKO10058791_A_Vmn2r5
  gRNA
ucaauguucuugaacaucuu

SEQ ID NO: 58792 - RNA, 20 nt, Artificial Sequence
  MKO10058792_A_Vmn2r60
  gRNA
uaucccugugcgccaaagaa

SEQ ID NO: 58793 - RNA, 20 nt, Artificial Sequence
  MKO10058793_A_Vmn2r60
  gRNA
cuucuacccaauauaacuau

SEQ ID NO: 58794 - RNA, 20 nt, Artificial Sequence
  MKO10058794_A_Vmn2r60
  gRNA
cucaccuuuguaaacccuau

SEQ ID NO: 58795 - RNA, 20 nt, Artificial Sequence
  MKO10058795_A_Vmn2r61
  gRNA
uaaacugaccucguucauuc

SEQ ID NO: 58796 - RNA, 20 nt, Artificial Sequence
  MKO10058796_A_Vmn2r61
  gRNA
gauucuauccugaaugaacg

SEQ ID NO: 58797 - RNA, 20 nt, Artificial Sequence
  MKO10058797_A_Vmn2r61
  gRNA
ccuguauuuaccuguaucgu

SEQ ID NO: 58798 - RNA, 20 nt, Artificial Sequence
  MKO10058798_A_Vmn2r62
  gRNA
uaugaacuaccaguuacuuc

SEQ ID NO: 58799 - RNA, 20 nt, Artificial Sequence
  MKO10058799_A_Vmn2r62
  gRNA
guuguagcagugucccaaua

SEQ ID NO: 58800 - RNA, 20 nt, Artificial Sequence
  MKO10058800_A_Vmn2r62
  gRNA
ucaguuuaaaacucucuauc

SEQ ID NO: 58801 - RNA, 20 nt, Artificial Sequence
  MKO10058801_A_Vmn2r63
  gRNA
uuacagaucgacugcuuaga

SEQ ID NO: 58802 - RNA, 20 nt, Artificial Sequence
  MKO10058802_A_Vmn2r63
  gRNA
gucgaucuguaauagaugag

SEQ ID NO: 58803 - RNA, 20 nt, Artificial Sequence
  MKO10058803_A_Vmn2r63
  gRNA
aucagaguuuagagacguua

SEQ ID NO: 58804 - RNA, 20 nt, Artificial Sequence
  MKO10058804_A_Vmn2r65
  gRNA
gccuggauaaccauucuagu

SEQ ID NO: 58805 - RNA, 20 nt, Artificial Sequence
  MKO10058805_A_Vmn2r65
  gRNA
gcacccuuccaacuacagua

SEQ ID NO: 58806 - RNA, 20 nt, Artificial Sequence
  MKO10058806_A_Vmn2r65
  gRNA
gugguauugcaaagaugugu

SEQ ID NO: 58807 - RNA, 20 nt, Artificial Sequence
  MKO10058807_A_Vmn2r66
  gRNA
cuuguagauacuguccauuc

SEQ ID NO: 58808 - RNA, 20 nt, Artificial Sequence
  MKO10058808_A_Vmn2r66
  gRNA
gugggcuacagguauagacc

SEQ ID NO: 58809 - RNA, 20 nt, Artificial Sequence
  MKO10058809_A_Vmn2r66
  gRNA
uuguacuuacaauaccugaa

SEQ ID NO: 58810 - RNA, 20 nt, Artificial Sequence
  MKO10058810_A_Vmn2r67
  gRNA
uuugauaugaucacaaaacu

SEQ ID NO: 58811 - RNA, 20 nt, Artificial Sequence
  MKO10058811_A_Vmn2r67
  gRNA
uucugcaacaaauagacacg

SEQ ID NO: 58812 - RNA, 20 nt, Artificial Sequence
  MKO10058812_A_Vmn2r67
  gRNA
cucagaaaaucuccugagga

SEQ ID NO: 58813 - RNA, 20 nt, Artificial Sequence
  MKO10058813_A_Vmn2r68
  gRNA
gauggagugggcgauagaug

SEQ ID NO: 58814 - RNA, 20 nt, Artificial Sequence
  MKO10058814_A_Vmn2r68
  gRNA
agguuuggcuuugcaaagaa

SEQ ID NO: 58815 - RNA, 20 nt, Artificial Sequence
  MKO10058815_A_Vmn2r68
  gRNA
uuugauaugaucacauaucu

SEQ ID NO: 58816 - RNA, 20 nt, Artificial Sequence
  MKO10058816_A_Vmn2r69
  gRNA
uaaauuaugcccucacauug

SEQ ID NO: 58817 - RNA, 20 nt, Artificial Sequence
  MKO10058817_A_Vmn2r69
  gRNA
uucuugcuauacuccucuac

SEQ ID NO: 58818 - RNA, 20 nt, Artificial Sequence
  MKO10058818_A_Vmn2r69
  gRNA
guguagccugcuucaaauuc

SEQ ID NO: 58819 - RNA, 20 nt, Artificial Sequence
  MKO10058819_A_Vmn2r6
  gRNA
cuuuaccagucauauucacu

SEQ ID NO: 58820 - RNA, 20 nt, Artificial Sequence
  MKO10058820_A_Vmn2r6
  gRNA
aauauggagugagauucuuu

SEQ ID NO: 58821 - RNA, 20 nt, Artificial Sequence
  MKO10058821_A_Vmn2r6
  gRNA
aaaauagaacuuggcaguaa

SEQ ID NO: 58822 - RNA, 20 nt, Artificial Sequence
  MKO10058822_A_Vmn2r70
  gRNA
caauauguaguaugccuugc

SEQ ID NO: 58823 - RNA, 20 nt, Artificial Sequence
  MKO10058823_A_Vmn2r70
  gRNA
gaaaaggacaucugcuguuu

SEQ ID NO: 58824 - RNA, 20 nt, Artificial Sequence
  MKO10058824_A_Vmn2r70
  gRNA
uucuacaacaaguagacgca

SEQ ID NO: 58825 - RNA, 20 nt, Artificial Sequence
  MKO10058825_A_Vmn2r71
  gRNA
ugcuauuauuauccaaacug

SEQ ID NO: 58826 - RNA, 20 nt, Artificial Sequence
  MKO10058826_A_Vmn2r71
  gRNA
uuugauaugaucacgauacu

SEQ ID NO: 58827 - RNA, 20 nt, Artificial Sequence
  MKO10058827_A_Vmn2r71
  gRNA
agcaaucuuacuugucaugu

SEQ ID NO: 58828 - RNA, 20 nt, Artificial Sequence
  MKO10058828_A_Vmn2r72
  gRNA
uguaauaucccuugcaaacc

SEQ ID NO: 58829 - RNA, 20 nt, Artificial Sequence
  MKO10058829_A_Vmn2r72
  gRNA
ccauagaucuuguccuccau

SEQ ID NO: 58830 - RNA, 20 nt, Artificial Sequence
  MKO10058830_A_Vmn2r72
  gRNA
cacuaacccagauucuaaaa

SEQ ID NO: 58831 - RNA, 20 nt, Artificial Sequence
  MKO10058831_A_Vmn2r73
  gRNA
caaacuuuaugggcgaguug

SEQ ID NO: 58832 - RNA, 20 nt, Artificial Sequence
  MKO10058832_A_Vmn2r73
  gRNA
uucaugcuauacuccgccuc

SEQ ID NO: 58833 - RNA, 20 nt, Artificial Sequence
  MKO10058833_A_Vmn2r73
  gRNA
gaauguguccuacuaaaaua

SEQ ID NO: 58834 - RNA, 20 nt, Artificial Sequence
  MKO10058834_A_Vmn2r74
  gRNA
uucuugcuauaugcguccac

SEQ ID NO: 58835 - RNA, 20 nt, Artificial Sequence
  MKO10058835_A_Vmn2r74
  gRNA
uccauaaacuaucacaacuu

SEQ ID NO: 58836 - RNA, 20 nt, Artificial Sequence
  MKO10058836_A_Vmn2r74
  gRNA
uuguacuuacagcaccguua

SEQ ID NO: 58837 - RNA, 20 nt, Artificial Sequence
  MKO10058837_A_Vmn2r75
  gRNA
cauagcauuguauaaguuau

SEQ ID NO: 58838 - RNA, 20 nt, Artificial Sequence
  MKO10058838_A_Vmn2r75
  gRNA
gaauuauauggugagagaac

SEQ ID NO: 58839 - RNA, 20 nt, Artificial Sequence
  MKO10058839_A_Vmn2r75
  gRNA
ugaaaaaaugaaacuccccg

SEQ ID NO: 58840 - RNA, 20 nt, Artificial Sequence
  MKO10058840_A_Vmn2r76
  gRNA
cacaucuguagcuauuggca

SEQ ID NO: 58841 - RNA, 20 nt, Artificial Sequence
  MKO10058841_A_Vmn2r76
  gRNA
auguguccuugauagcuauc

SEQ ID NO: 58842 - RNA, 20 nt, Artificial Sequence
  MKO10058842_A_Vmn2r76
  gRNA
auugcaguugguaaccacau

SEQ ID NO: 58843 - RNA, 20 nt, Artificial Sequence
  MKO10058843_A_Vmn2r77
  gRNA
gcaaaaguugucgucgucua

SEQ ID NO: 58844 - RNA, 20 nt, Artificial Sequence
  MKO10058844_A_Vmn2r77
  gRNA
agcaugaaguucaguuguag

SEQ ID NO: 58845 - RNA, 20 nt, Artificial Sequence
  MKO10058845_A_Vmn2r77
  gRNA
uuuccacauuauccucaauu

SEQ ID NO: 58846 - RNA, 20 nt, Artificial Sequence
  MKO10058846_A_Vmn2r78
  gRNA
cgguaauggaauuuaauucc

SEQ ID NO: 58847 - RNA, 20 nt, Artificial Sequence
  MKO10058847_A_Vmn2r78
  gRNA
uugauaugaucacagugaua

SEQ ID NO: 58848 - RNA, 20 nt, Artificial Sequence
  MKO10058848_A_Vmn2r78
  gRNA
acuacuguaaaaaucagaga

SEQ ID NO: 58849 - RNA, 20 nt, Artificial Sequence
  MKO10058849_A_Vmn2r79
  gRNA
aguaugaaguuaaacuguag

SEQ ID NO: 58850 - RNA, 20 nt, Artificial Sequence
  MKO10058850_A_Vmn2r79
  gRNA
uucaugcuuaacucugugca

SEQ ID NO: 58851 - RNA, 20 nt, Artificial Sequence
  MKO10058851_A_Vmn2r79
  gRNA
auguuuauuaggucuccaac

SEQ ID NO: 58852 - RNA, 20 nt, Artificial Sequence
  MKO10058852_A_Vmn2r7
  gRNA
accuaacuuugagucuguaa

SEQ ID NO: 58853 - RNA, 20 nt, Artificial Sequence
  MKO10058853_A_Vmn2r7
  gRNA
gugucuaauuagauucacga

SEQ ID NO: 58854 - RNA, 20 nt, Artificial Sequence
  MKO10058854_A_Vmn2r7
  gRNA
aaaauagaacuuggcaggaa

SEQ ID NO: 58855 - RNA, 20 nt, Artificial Sequence
  MKO10058855_A_Vmn2r80
  gRNA
guacaaugcugugcucgcag

SEQ ID NO: 58856 - RNA, 20 nt, Artificial Sequence
  MKO10058856_A_Vmn2r80
  gRNA
aaccaguaaucuccucauaa

SEQ ID NO: 58857 - RNA, 20 nt, Artificial Sequence
  MKO10058857_A_Vmn2r80
  gRNA
aauucagcuguuacacuuac

SEQ ID NO: 58858 - RNA, 20 nt, Artificial Sequence
  MKO10058858_A_Vmn2r81
  gRNA
ccaacaaucuccuuauaaug

SEQ ID NO: 58859 - RNA, 20 nt, Artificial Sequence
  MKO10058859_A_Vmn2r81
  gRNA
cuguugaugauucuauaaug

SEQ ID NO: 58860 - RNA, 20 nt, Artificial Sequence
  MKO10058860_A_Vmn2r81
  gRNA
ugucugaauauaugauuagu

SEQ ID NO: 58861 - RNA, 20 nt, Artificial Sequence
  MKO10058861_A_Vmn2r82
  gRNA
auaaauuacaaucacgucug

SEQ ID NO: 58862 - RNA, 20 nt, Artificial Sequence
  MKO10058862_A_Vmn2r82
  gRNA
aaccagcaaucuccucauaa

SEQ ID NO: 58863 - RNA, 20 nt, Artificial Sequence
  MKO10058863_A_Vmn2r82
  gRNA
cauugacaauuguuucccuu

SEQ ID NO: 58864 - RNA, 20 nt, Artificial Sequence
  MKO10058864_A_Vmn2r83
  gRNA
gaacguacacaacuaccagc

SEQ ID NO: 58865 - RNA, 20 nt, Artificial Sequence
  MKO10058865_A_Vmn2r83
  gRNA
cucugaggaauguauucuac

SEQ ID NO: 58866 - RNA, 20 nt, Artificial Sequence
  MKO10058866_A_Vmn2r83
  gRNA
guccuauccuuauaagccug

SEQ ID NO: 58867 - RNA, 20 nt, Artificial Sequence
  MKO10058867_A_Vmn2r84
  gRNA
agacauaauuaacauaauuc

SEQ ID NO: 58868 - RNA, 20 nt, Artificial Sequence
  MKO10058868_A_Vmn2r84
  gRNA
uggcucccuugcugaaaacu

SEQ ID NO: 58869 - RNA, 20 nt, Artificial Sequence
  MKO10058869_A_Vmn2r84
  gRNA
ugguaacugucaagauucau

SEQ ID NO: 58870 - RNA, 20 nt, Artificial Sequence
  MKO10058870_A_Vmn2r85
  gRNA
aauugauacuugggcaccaa

SEQ ID NO: 58871 - RNA, 20 nt, Artificial Sequence
  MKO10058871_A_Vmn2r85
  gRNA
acaaacucguauucucuugc

SEQ ID NO: 58872 - RNA, 20 nt, Artificial Sequence
  MKO10058872_A_Vmn2r85
  gRNA
gcauuucugagucaauacug

SEQ ID NO: 58873 - RNA, 20 nt, Artificial Sequence
  MKO10058873_A_Vmn2r86
  gRNA
acauuucucagucaauacug

SEQ ID NO: 58874 - RNA, 20 nt, Artificial Sequence
  MKO10058874_A_Vmn2r86
  gRNA
uggcucucuugcugaaaacu

SEQ ID NO: 58875 - RNA, 20 nt, Artificial Sequence
  MKO10058875_A_Vmn2r86
  gRNA
aaaguauacagaaugucagc

SEQ ID NO: 58876 - RNA, 20 nt, Artificial Sequence
  MKO10058876_A_Vmn2r87
  gRNA
acaugugucauagaccuuac

SEQ ID NO: 58877 - RNA, 20 nt, Artificial Sequence
  MKO10058877_A_Vmn2r87
  gRNA
ugcagugcuguccauuccaa

SEQ ID NO: 58878 - RNA, 20 nt, Artificial Sequence
  MKO10058878_A_Vmn2r87
  gRNA
ugugacccauucuaaaucuu

SEQ ID NO: 58879 - RNA, 20 nt, Artificial Sequence
  MKO10058879_A_Vmn2r88
  gRNA
cuuguggaaaguuccaaaug

SEQ ID NO: 58880 - RNA, 20 nt, Artificial Sequence
  MKO10058880_A_Vmn2r88
  gRNA
cuugauggacauggugcagc

SEQ ID NO: 58881 - RNA, 20 nt, Artificial Sequence
  MKO10058881_A_Vmn2r88
  gRNA
cuaaccuacaugaccaugac

SEQ ID NO: 58882 - RNA, 20 nt, Artificial Sequence
  MKO10058882_A_Vmn2r89
  gRNA
uuguggugugcaaaagugau

SEQ ID NO: 58883 - RNA, 20 nt, Artificial Sequence
  MKO10058883_A_Vmn2r89
  gRNA
acuuugauauucagcaucgu

SEQ ID NO: 58884 - RNA, 20 nt, Artificial Sequence
  MKO10058884_A_Vmn2r89
  gRNA
uuagaugauucauguaacau

SEQ ID NO: 58885 - RNA, 20 nt, Artificial Sequence
  MKO10058885_A_Vmn2r8
  gRNA
uccuguaaggucuauguaac

SEQ ID NO: 58886 - RNA, 20 nt, Artificial Sequence
  MKO10058886_A_Vmn2r8
  gRNA
gccuguuacauagaccuuac

SEQ ID NO: 58887 - RNA, 20 nt, Artificial Sequence
  MKO10058887_A_Vmn2r8
  gRNA
augggacaaguaugugucuu

SEQ ID NO: 58888 - RNA, 20 nt, Artificial Sequence
  MKO10058888_A_Vmn2r90
  gRNA
uccaaaaggucuugcguuaa

SEQ ID NO: 58889 - RNA, 20 nt, Artificial Sequence
  MKO10058889_A_Vmn2r90
  gRNA
cucucauacgaugcuucagu

SEQ ID NO: 58890 - RNA, 20 nt, Artificial Sequence
  MKO10058890_A_Vmn2r90
  gRNA
gucugacuugagacaaguua

SEQ ID NO: 58891 - RNA, 20 nt, Artificial Sequence
  MKO10058891_A_Vmn2r91
  gRNA
caaaugcaacaguuuaagaa

SEQ ID NO: 58892 - RNA, 20 nt, Artificial Sequence
  MKO10058892_A_Vmn2r91
  gRNA
auaaaauucuaucagacuuu

SEQ ID NO: 58893 - RNA, 20 nt, Artificial Sequence
  MKO10058893_A_Vmn2r91
  gRNA
aucaaauccaagagaugugu

SEQ ID NO: 58894 - RNA, 20 nt, Artificial Sequence
  MKO10058894_A_Vmn2r92
  gRNA
uccugugagugcagcaguga

SEQ ID NO: 58895 - RNA, 20 nt, Artificial Sequence
  MKO10058895_A_Vmn2r92
  gRNA
aucaaauccaagagauguau

SEQ ID NO: 58896 - RNA, 20 nt, Artificial Sequence
  MKO10058896_A_Vmn2r92
  gRNA
cucucuaccaaaugucccca

SEQ ID NO: 58897 - RNA, 20 nt, Artificial Sequence
  MKO10058897_A_Vmn2r93
  gRNA
uguagugagaguugucaguc

SEQ ID NO: 58898 - RNA, 20 nt, Artificial Sequence
  MKO10058898_A_Vmn2r93
  gRNA
caccucucaugugcacaaaa

SEQ ID NO: 58899 - RNA, 20 nt, Artificial Sequence
  MKO10058899_A_Vmn2r93
  gRNA
aaucagaauucucccuguaa

SEQ ID NO: 58900 - RNA, 20 nt, Artificial Sequence
  MKO10058900_A_Vmn2r94
  gRNA
ucacucaagauuguaucaua

SEQ ID NO: 58901 - RNA, 20 nt, Artificial Sequence
  MKO10058901_A_Vmn2r94
  gRNA
agugucccuuucaguguauu

SEQ ID NO: 58902 - RNA, 20 nt, Artificial Sequence
  MKO10058902_A_Vmn2r94
  gRNA
gauacaaucuugagugaaca

SEQ ID NO: 58903 - RNA, 20 nt, Artificial Sequence
  MKO10058903_A_Vmn2r95
  gRNA
uuccaaaacaugacaauuag

SEQ ID NO: 58904 - RNA, 20 nt, Artificial Sequence
  MKO10058904_A_Vmn2r95
  gRNA
cucucacuucaauaugcuuc

SEQ ID NO: 58905 - RNA, 20 nt, Artificial Sequence
  MKO10058905_A_Vmn2r95
  gRNA
agugcacuuguaacaacaga

SEQ ID NO: 58906 - RNA, 20 nt, Artificial Sequence
  MKO10058906_A_Vmn2r96
  gRNA
gaauauauccaagguagcau

SEQ ID NO: 58907 - RNA, 20 nt, Artificial Sequence
  MKO10058907_A_Vmn2r96
  gRNA
cugucaaaccaaugcuaccu

SEQ ID NO: 58908 - RNA, 20 nt, Artificial Sequence
  MKO10058908_A_Vmn2r96
  gRNA
cuuucaccacaauauucuuc

SEQ ID NO: 58909 - RNA, 20 nt, Artificial Sequence
  MKO10058909_A_Vmn2r97
  gRNA
auucauuggaagguauaauu

SEQ ID NO: 58910 - RNA, 20 nt, Artificial Sequence
  MKO10058910_A_Vmn2r97
  gRNA
agagauaaggauauugacca

SEQ ID NO: 58911 - RNA, 20 nt, Artificial Sequence
  MKO10058911_A_Vmn2r97
  gRNA
cugaccucugaaaauauugu

SEQ ID NO: 58912 - RNA, 20 nt, Artificial Sequence
  MKO10058912_A_Vmn2r98
  gRNA
uaagcuuaacucguuccuga

SEQ ID NO: 58913 - RNA, 20 nt, Artificial Sequence
  MKO10058913_A_Vmn2r98
  gRNA
uuucuacaauguuagauuca

SEQ ID NO: 58914 - RNA, 20 nt, Artificial Sequence
  MKO10058914_A_Vmn2r98
  gRNA
ucucuaccagauauccccca

SEQ ID NO: 58915 - RNA, 20 nt, Artificial Sequence
  MKO10058915_A_Vmn2r99
  gRNA
uucccucgucacauauuuga

SEQ ID NO: 58916 - RNA, 20 nt, Artificial Sequence
  MKO10058916_A_Vmn2r99
  gRNA
uggauaacaucugcucuaac

SEQ ID NO: 58917 - RNA, 20 nt, Artificial Sequence
  MKO10058917_A_Vmn2r99
  gRNA
uaaaaaugacccccgccaca

SEQ ID NO: 58918 - RNA, 20 nt, Artificial Sequence
  MKO10058918_A_Vmn2r9
  gRNA
gacuguuacauacaccuuac

SEQ ID NO: 58919 - RNA, 20 nt, Artificial Sequence
  MKO10058919_A_Vmn2r9
  gRNA
guaagguguauguaacaguc

SEQ ID NO: 58920 - RNA, 20 nt, Artificial Sequence
  MKO10058920_A_Vmn2r9
  gRNA
guaaacauuucucagucuau

SEQ ID NO: 58921 - RNA, 20 nt, Artificial Sequence
  MKO10058921_A_Vmo1
  gRNA
ucaacgaucgaugcauagcg

SEQ ID NO: 58922 - RNA, 20 nt, Artificial Sequence
  MKO10058922_A_Vmo1
  gRNA
gcuccacgccgucugagcaa

SEQ ID NO: 58923 - RNA, 20 nt, Artificial Sequence
  MKO10058923_A_Vmo1
  gRNA
ccuaaucucaccuuccggac

SEQ ID NO: 58924 - RNA, 20 nt, Artificial Sequence
  MKO10058924_A_Vmp1
  gRNA
gcagauaaucuggucaggau

SEQ ID NO: 58925 - RNA, 20 nt, Artificial Sequence
  MKO10058925_A_Vmp1
  gRNA
ugaccagauuaucugcccag

SEQ ID NO: 58926 - RNA, 20 nt, Artificial Sequence
  MKO10058926_A_Vmp1
  gRNA
gcuuguagcuacguauuaug

SEQ ID NO: 58927 - RNA, 20 nt, Artificial Sequence
  MKO10058927_A_Vnn1
  gRNA
acaccguauaugccaucuuc

SEQ ID NO: 58928 - RNA, 20 nt, Artificial Sequence
  MKO10058928_A_Vnn1
  gRNA
uauacggugugcguuucacc

SEQ ID NO: 58929 - RNA, 20 nt, Artificial Sequence
  MKO10058929_A_Vnn1
  gRNA
gggauuucagcugagcgaag

SEQ ID NO: 58930 - RNA, 20 nt, Artificial Sequence
  MKO10058930_A_Vnn3
  gRNA
uuauauugguaacggccauc

SEQ ID NO: 58931 - RNA, 20 nt, Artificial Sequence
  MKO10058931_A_Vnn3
  gRNA
ccgaguguaccacuaugaca

SEQ ID NO: 58932 - RNA, 20 nt, Artificial Sequence
  MKO10058932_A_Vnn3
  gRNA
ugaccuuugacaccccguuu

SEQ ID NO: 58933 - RNA, 20 nt, Artificial Sequence
  MKO10058933_A_Vopp1
  gRNA
gugguggcggauacaugcgc

SEQ ID NO: 58934 - RNA, 20 nt, Artificial Sequence
  MKO10058934_A_Vopp1
  gRNA
ccgccauauuacaccgaccc

SEQ ID NO: 58935 - RNA, 20 nt, Artificial Sequence
  MKO10058935_A_Vopp1
  gRNA
guauccgccaccacucauug

SEQ ID NO: 58936 - RNA, 20 nt, Artificial Sequence
  MKO10058936_A_Vprbp
  gRNA
gaaacugaagaauaucguaa

SEQ ID NO: 58937 - RNA, 20 nt, Artificial Sequence
  MKO10058937_A_Vprbp
  gRNA
ccaguagaauauguccuaag

SEQ ID NO: 58938 - RNA, 20 nt, Artificial Sequence
  MKO10058938_A_Vprbp
  gRNA
ccauuugaugaucgacaucc

SEQ ID NO: 58939 - RNA, 20 nt, Artificial Sequence
  MKO10058939_A_Vpreb1
  gRNA
ggcuguguauuacugugccg

SEQ ID NO: 58940 - RNA, 20 nt, Artificial Sequence
  MKO10058940_A_Vpreb1
  gRNA
caaagauacgaccaggaacc

SEQ ID NO: 58941 - RNA, 20 nt, Artificial Sequence
  MKO10058941_A_Vpreb1
  gRNA
aguuuccuuaccugugagau

SEQ ID NO: 58942 - RNA, 20 nt, Artificial Sequence
  MKO10058942_A_Vpreb2
  gRNA
ggcuguguauuacugcgcug

SEQ ID NO: 58943 - RNA, 20 nt, Artificial Sequence
  MKO10058943_A_Vpreb2
  gRNA
ccuggccguaucuuuggacc

SEQ ID NO: 58944 - RNA, 20 nt, Artificial Sequence
  MKO10058944_A_Vpreb2
  gRNA
aguucccuuaccugugaggu

SEQ ID NO: 58945 - RNA, 20 nt, Artificial Sequence
  MKO10058945_A_Vpreb3
  gRNA
gggaagacugagaacgcguc

SEQ ID NO: 58946 - RNA, 20 nt, Artificial Sequence
  MKO10058946_A_Vpreb3
  gRNA
ucucuacuauuacgcagaag

SEQ ID NO: 58947 - RNA, 20 nt, Artificial Sequence
  MKO10058947_A_Vpreb3
  gRNA
cuucuggccauggccugccc

SEQ ID NO: 58948 - RNA, 20 nt, Artificial Sequence
  MKO10058948_A_Vps11
  gRNA
caacuaucccguuacugggc

SEQ ID NO: 58949 - RNA, 20 nt, Artificial Sequence
  MKO10058949_A_Vps11
  gRNA
gccauaagcucaucgugcac

SEQ ID NO: 58950 - RNA, 20 nt, Artificial Sequence
  MKO10058950_A_Vps11
  gRNA
ggacuacccucguguggagu

SEQ ID NO: 58951 - RNA, 20 nt, Artificial Sequence
  MKO10058951_A_Vps13a
  gRNA
guaccauucaaaguuaaagu

SEQ ID NO: 58952 - RNA, 20 nt, Artificial Sequence
  MKO10058952_A_Vps13a
  gRNA
ucaaccaguugaagcuguuu

SEQ ID NO: 58953 - RNA, 20 nt, Artificial Sequence
  MKO10058953_A_Vps13a
  gRNA
ugaccaacuuuaacuuugaa

SEQ ID NO: 58954 - RNA, 20 nt, Artificial Sequence
  MKO10058954_A_Vps13b
  gRNA
guuaugggaucgugcauuca

SEQ ID NO: 58955 - RNA, 20 nt, Artificial Sequence
  MKO10058955_A_Vps13b
  gRNA
uucugcugaaugcuauaccg

SEQ ID NO: 58956 - RNA, 20 nt, Artificial Sequence
  MKO10058956_A_Vps13b
  gRNA
cucgauaaacgaaaugcuag

SEQ ID NO: 58957 - RNA, 20 nt, Artificial Sequence
  MKO10058957_A_Vps13c
  gRNA
gcagucguugccacgcuaga

SEQ ID NO: 58958 - RNA, 20 nt, Artificial Sequence
  MKO10058958_A_Vps13c
  gRNA
uuauaccugcuugugguccc

SEQ ID NO: 58959 - RNA, 20 nt, Artificial Sequence
  MKO10058959_A_Vps13c
  gRNA
ggacguuccuuucaaaguca

SEQ ID NO: 58960 - RNA, 20 nt, Artificial Sequence
  MKO10058960_A_Vps13d
  gRNA
ucucagggccaccgauuacg

SEQ ID NO: 58961 - RNA, 20 nt, Artificial Sequence
  MKO10058961_A_Vps13d
  gRNA
aucaguugucacgagaaucg

SEQ ID NO: 58962 - RNA, 20 nt, Artificial Sequence
  MKO10058962_A_Vps13d
  gRNA
ugagaagugcaaccgacagc

SEQ ID NO: 58963 - RNA, 20 nt, Artificial Sequence
  MKO10058963_A_Vps16
  gRNA
caaacuccgucggaugccag

SEQ ID NO: 58964 - RNA, 20 nt, Artificial Sequence
  MKO10058964_A_Vps16
  gRNA
agugcuucagaaccgugucc

SEQ ID NO: 58965 - RNA, 20 nt, Artificial Sequence
  MKO10058965_A_Vps16
  gRNA
cuuaccacuggcuagccugc

SEQ ID NO: 58966 - RNA, 20 nt, Artificial Sequence
  MKO10058966_A_Vps18
  gRNA
gcgcauccgacgagacuugc

SEQ ID NO: 58967 - RNA, 20 nt, Artificial Sequence
  MKO10058967_A_Vps18
  gRNA
cauugauccgcagcgcuaug

SEQ ID NO: 58968 - RNA, 20 nt, Artificial Sequence
  MKO10058968_A_Vps18
  gRNA
cccgccagcucguagacgcc

SEQ ID NO: 58969 - RNA, 20 nt, Artificial Sequence
  MKO10058969_A_Vps25
  gRNA
cggcagguuacagccgaacg

SEQ ID NO: 58970 - RNA, 20 nt, Artificial Sequence
  MKO10058970_A_Vps25
  gRNA
uucugccggguguccacguu

SEQ ID NO: 58971 - RNA, 20 nt, Artificial Sequence
  MKO10058971_A_Vps25
  gRNA
acucuguaugaacugacgag

SEQ ID NO: 58972 - RNA, 20 nt, Artificial Sequence
  MKO10058972_A_Vps26a
  gRNA
uccauaccucaggcggacau

SEQ ID NO: 58973 - RNA, 20 nt, Artificial Sequence
  MKO10058973_A_Vps26a
  gRNA
aaccuagccuuuaagcagcc

SEQ ID NO: 58974 - RNA, 20 nt, Artificial Sequence
  MKO10058974_A_Vps26a
  gRNA
auugauguugcccuuaauga

SEQ ID NO: 58975 - RNA, 20 nt, Artificial Sequence
  MKO10058975_A_Vps26b
  gRNA
ucgcuauugugucguucucg

SEQ ID NO: 58976 - RNA, 20 nt, Artificial Sequence
  MKO10058976_A_Vps26b
  gRNA
ccagaacucuacuaugaccg

SEQ ID NO: 58977 - RNA, 20 nt, Artificial Sequence
  MKO10058977_A_Vps26b
  gRNA
caaagucgaaggccugcgau

SEQ ID NO: 58978 - RNA, 20 nt, Artificial Sequence
  MKO10058978_A_Vps28
  gRNA
gucggaaggcagcuuuguac

SEQ ID NO: 58979 - RNA, 20 nt, Artificial Sequence
  MKO10058979_A_Vps28
  gRNA
guacaaagcugccuuccgac

SEQ ID NO: 58980 - RNA, 20 nt, Artificial Sequence
  MKO10058980_A_Vps28
  gRNA
ugccguggugaagacgaugc

SEQ ID NO: 58981 - RNA, 20 nt, Artificial Sequence
  MKO10058981_A_Vps29
  gRNA
cgaagucuccucucacgaug

SEQ ID NO: 58982 - RNA, 20 nt, Artificial Sequence
  MKO10058982_A_Vps29
  gRNA
ggcgacguccacaucgugag

SEQ ID NO: 58983 - RNA, 20 nt, Artificial Sequence
  MKO10058983_A_Vps29
  gRNA
acuuacgucuaucaacuaau

SEQ ID NO: 58984 - RNA, 20 nt, Artificial Sequence
  MKO10058984_A_Vps33a
  gRNA
augacccugcaggcgcugua

SEQ ID NO: 58985 - RNA, 20 nt, Artificial Sequence
  MKO10058985_A_Vps33a
  gRNA
gaguacuuaacaggaccauu

SEQ ID NO: 58986 - RNA, 20 nt, Artificial Sequence
  MKO10058986_A_Vps33a
  gRNA
uacugugcgaucaguccaaa

SEQ ID NO: 58987 - RNA, 20 nt, Artificial Sequence
  MKO10058987_A_Vps33b
  gRNA
acguuagcaauucgauccaa

SEQ ID NO: 58988 - RNA, 20 nt, Artificial Sequence
  MKO10058988_A_Vps33b
  gRNA
cuuacuguucauuggcgcug

SEQ ID NO: 58989 - RNA, 20 nt, Artificial Sequence
  MKO10058989_A_Vps33b
  gRNA
ugcuaacgucucuauccuga

SEQ ID NO: 58990 - RNA, 20 nt, Artificial Sequence
  MKO10058990_A_Vps35
  gRNA
gauuugguagaaaugugccg

SEQ ID NO: 58991 - RNA, 20 nt, Artificial Sequence
  MKO10058991_A_Vps35
  gRNA
cuuuagcaaauucaucaguc

SEQ ID NO: 58992 - RNA, 20 nt, Artificial Sequence
  MKO10058992_A_Vps35
  gRNA
cuaugaacuuguacaguacg

SEQ ID NO: 58993 - RNA, 20 nt, Artificial Sequence
  MKO10058993_A_Vps36
  gRNA
uuucaucagcgccaaaaucg

SEQ ID NO: 58994 - RNA, 20 nt, Artificial Sequence
  MKO10058994_A_Vps36
  gRNA
gugcaggugaaccacgauuu

SEQ ID NO: 58995 - RNA, 20 nt, Artificial Sequence
  MKO10058995_A_Vps36
  gRNA
gucucagauuguguucaucg

SEQ ID NO: 58996 - RNA, 20 nt, Artificial Sequence
  MKO10058996_A_Vps37a
  gRNA
ucccaccuggauuacuauac

SEQ ID NO: 58997 - RNA, 20 nt, Artificial Sequence
  MKO10058997_A_Vps37a
  gRNA
auacguacauugcuuacuaa

SEQ ID NO: 58998 - RNA, 20 nt, Artificial Sequence
  MKO10058998_A_Vps37a
  gRNA
augccaaaugaaggcgccac

SEQ ID NO: 58999 - RNA, 20 nt, Artificial Sequence
  MKO10058999_A_Vps37b
  gRNA
cgcgaagcgcgccucgcuca

SEQ ID NO: 59000 - RNA, 20 nt, Artificial Sequence
  MKO10059000_A_Vps37b
  gRNA
gcaaggauucuccgcacagu

SEQ ID NO: 59001 - RNA, 20 nt, Artificial Sequence
  MKO10059001_A_Vps37b
  gRNA
cgaugcacagcucggcgaca

SEQ ID NO: 59002 - RNA, 20 nt, Artificial Sequence
  MKO10059002_A_Vps37c
  gRNA
ucucuacgcggacucgacgc

SEQ ID NO: 59003 - RNA, 20 nt, Artificial Sequence
  MKO10059003_A_Vps37c
  gRNA
aguccgcguagagaagcucc

SEQ ID NO: 59004 - RNA, 20 nt, Artificial Sequence
  MKO10059004_A_Vps37c
  gRNA
gaucgaaggcaugaagaucg

SEQ ID NO: 59005 - RNA, 20 nt, Artificial Sequence
  MKO10059005_A_Vps37d
  gRNA
cgggcgguauguaccgggcc

SEQ ID NO: 59006 - RNA, 20 nt, Artificial Sequence
  MKO10059006_A_Vps37d
  gRNA
cuuggccucuaacuacgcgc

SEQ ID NO: 59007 - RNA, 20 nt, Artificial Sequence
  MKO10059007_A_Vps37d
  gRNA
uccugcugagccgcacgauc

SEQ ID NO: 59008 - RNA, 20 nt, Artificial Sequence
  MKO10059008_A_Vps39
  gRNA
cggcucgaaagcgucaugca

SEQ ID NO: 59009 - RNA, 20 nt, Artificial Sequence
  MKO10059009_A_Vps39
  gRNA
caugcaugacgcuuucgagc

SEQ ID NO: 59010 - RNA, 20 nt, Artificial Sequence
  MKO10059010_A_Vps39
  gRNA
cauagguuguaacagguuug

SEQ ID NO: 59011 - RNA, 20 nt, Artificial Sequence
  MKO10059011_A_Vps41
  gRNA
cuguaugacgguccaugaca

SEQ ID NO: 59012 - RNA, 20 nt, Artificial Sequence
  MKO10059012_A_Vps41
  gRNA
cguagauucuucaagagacu

SEQ ID NO: 59013 - RNA, 20 nt, Artificial Sequence
  MKO10059013_A_Vps41
  gRNA
aagaaucucugucaccccau

SEQ ID NO: 59014 - RNA, 20 nt, Artificial Sequence
  MKO10059014_A_Vps45
  gRNA
gagaaucaauucguucgaag

SEQ ID NO: 59015 - RNA, 20 nt, Artificial Sequence
  MKO10059015_A_Vps45
  gRNA
guaguaccuuugugggucga

SEQ ID NO: 59016 - RNA, 20 nt, Artificial Sequence
  MKO10059016_A_Vps45
  gRNA
gaauguggaauaucugaucc

SEQ ID NO: 59017 - RNA, 20 nt, Artificial Sequence
  MKO10059017_A_Vps4a
  gRNA
acaucauuccaccguauguu

SEQ ID NO: 59018 - RNA, 20 nt, Artificial Sequence
  MKO10059018_A_Vps4a
  gRNA
gugacucacauuugauggcg

SEQ ID NO: 59019 - RNA, 20 nt, Artificial Sequence
  MKO10059019_A_Vps4a
  gRNA
gagugccuccucguaguucu

SEQ ID NO: 59020 - RNA, 20 nt, Artificial Sequence
  MKO10059020_A_Vps4b
  gRNA
acauaccccuucucaucaac

SEQ ID NO: 59021 - RNA, 20 nt, Artificial Sequence
  MKO10059021_A_Vps4b
  gRNA
gucaggcccaguugaugaga

SEQ ID NO: 59022 - RNA, 20 nt, Artificial Sequence
  MKO10059022_A_Vps4b
  gRNA
augccuuacauuuaacaaca

SEQ ID NO: 59023 - RNA, 20 nt, Artificial Sequence
  MKO10059023_A_Vps51
  gRNA
cucgugucgguccuguagcg

SEQ ID NO: 59024 - RNA, 20 nt, Artificial Sequence
  MKO10059024_A_Vps51
  gRNA
guguuagaguucaccgaccg

SEQ ID NO: 59025 - RNA, 20 nt, Artificial Sequence
  MKO10059025_A_Vps51
  gRNA
aagccagugacgucuugaug

SEQ ID NO: 59026 - RNA, 20 nt, Artificial Sequence
  MKO10059026_A_Vps52
  gRNA
caccuccaggacggcgucac

SEQ ID NO: 59027 - RNA, 20 nt, Artificial Sequence
  MKO10059027_A_Vps52
  gRNA
ucuucgacacuauucaaagc

SEQ ID NO: 59028 - RNA, 20 nt, Artificial Sequence
  MKO10059028_A_Vps52
  gRNA
auccaagaugaauucaucag

SEQ ID NO: 59029 - RNA, 20 nt, Artificial Sequence
  MKO10059029_A_Vps53
  gRNA
ucugaccucuuacgacaguc

SEQ ID NO: 59030 - RNA, 20 nt, Artificial Sequence
  MKO10059030_A_Vps53
  gRNA
uauguagguauucccaagcc

SEQ ID NO: 59031 - RNA, 20 nt, Artificial Sequence
  MKO10059031_A_Vps53
  gRNA
cguaagaggucagacaaaug

SEQ ID NO: 59032 - RNA, 20 nt, Artificial Sequence
  MKO10059032_A_Vps54
  gRNA
uaguuacagaucaacauaga

SEQ ID NO: 59033 - RNA, 20 nt, Artificial Sequence
  MKO10059033_A_Vps54
  gRNA
cuccuaaagauaccuuugac

SEQ ID NO: 59034 - RNA, 20 nt, Artificial Sequence
  MKO10059034_A_Vps54
  gRNA
uacuugcuccagaucugucc

SEQ ID NO: 59035 - RNA, 20 nt, Artificial Sequence
  MKO10059035_A_Vps72
  gRNA
gagcucaacuuacguucacu

SEQ ID NO: 59036 - RNA, 20 nt, Artificial Sequence
  MKO10059036_A_Vps72
  gRNA
acacacgacaaacguuccuu

SEQ ID NO: 59037 - RNA, 20 nt, Artificial Sequence
  MKO10059037_A_Vps72
  gRNA
caagcggcaccgucacugag

SEQ ID NO: 59038 - RNA, 20 nt, Artificial Sequence
  MKO10059038_A_Vps8
  gRNA
agcccacgcacgcgcagucu

SEQ ID NO: 59039 - RNA, 20 nt, Artificial Sequence
  MKO10059039_A_Vps8
  gRNA
cgagcucagacagcggcgac

SEQ ID NO: 59040 - RNA, 20 nt, Artificial Sequence
  MKO10059040_A_Vps8
  gRNA
ggucccgucaaggcagacgc

SEQ ID NO: 59041 - RNA, 20 nt, Artificial Sequence
  MKO10059041_A_Vps9d1
  gRNA
ccacgucuucgagcaauacc

SEQ ID NO: 59042 - RNA, 20 nt, Artificial Sequence
  MKO10059042_A_Vps9d1
  gRNA
ugaggcccggauggcccguc

SEQ ID NO: 59043 - RNA, 20 nt, Artificial Sequence
  MKO10059043_A_Vps9d1
  gRNA
cugcaucuaggaagcguacg

SEQ ID NO: 59044 - RNA, 20 nt, Artificial Sequence
  MKO10059044_A_Vrk1
  gRNA
cgcgucacugccaaccgguu

SEQ ID NO: 59045 - RNA, 20 nt, Artificial Sequence
  MKO10059045_A_Vrk1
  gRNA
cucgcagagcaguuugccgc

SEQ ID NO: 59046 - RNA, 20 nt, Artificial Sequence
  MKO10059046_A_Vrk1
  gRNA
agguccuaaccgacaugucu

SEQ ID NO: 59047 - RNA, 20 nt, Artificial Sequence
  MKO10059047_A_Vrk2
  gRNA
aaauuaaccguccuacaacu

SEQ ID NO: 59048 - RNA, 20 nt, Artificial Sequence
  MKO10059048_A_Vrk2
  gRNA
ugcaagacaugucauaaagc

SEQ ID NO: 59049 - RNA, 20 nt, Artificial Sequence
  MKO10059049_A_Vrk2
  gRNA
acaugucuugcaucuuuguu

SEQ ID NO: 59050 - RNA, 20 nt, Artificial Sequence
  MKO10059050_A_Vrk3
  gRNA
cugccguccccucugaauca

SEQ ID NO: 59051 - RNA, 20 nt, Artificial Sequence
  MKO10059051_A_Vrk3
  gRNA
acaccuugacuucuccugac

SEQ ID NO: 59052 - RNA, 20 nt, Artificial Sequence
  MKO10059052_A_Vrk3
  gRNA
guggagauucucacucaaac

SEQ ID NO: 59053 - RNA, 20 nt, Artificial Sequence
  MKO10059053_A_Vrtn
  gRNA
gacccaagagcaccgucaaa

SEQ ID NO: 59054 - RNA, 20 nt, Artificial Sequence
  MKO10059054_A_Vrtn
  gRNA
caaagaugcccuuaucucgu

SEQ ID NO: 59055 - RNA, 20 nt, Artificial Sequence
  MKO10059055_A_Vrtn
  gRNA
ccaagagcaccuucuaccgc

SEQ ID NO: 59056 - RNA, 20 nt, Artificial Sequence
  MKO10059056_A_Vsig10
  gRNA
agcguagaguaacguugucg

SEQ ID NO: 59057 - RNA, 20 nt, Artificial Sequence
  MKO10059057_A_Vsig10
  gRNA
gacaacguuacucuacgcug

SEQ ID NO: 59058 - RNA, 20 nt, Artificial Sequence
  MKO10059058_A_Vsig10
  gRNA
ggcugcguacagcgugccgu

SEQ ID NO: 59059 - RNA, 20 nt, Artificial Sequence
  MKO10059059_A_Vsig1
  gRNA
caauucaaagaccgaauaau

SEQ ID NO: 59060 - RNA, 20 nt, Artificial Sequence
  MKO10059060_A_Vsig1
  gRNA
agacguuaagucaauuucac

SEQ ID NO: 59061 - RNA, 20 nt, Artificial Sequence
  MKO10059061_A_Vsig1
  gRNA
acuucucgguggugguauag

SEQ ID NO: 59062 - RNA, 20 nt, Artificial Sequence
  MKO10059062_A_Vsig2
  gRNA
aacccguugguguagaaauc

SEQ ID NO: 59063 - RNA, 20 nt, Artificial Sequence
  MKO10059063_A_Vsig2
  gRNA
gagcugaaccucuccgugac

SEQ ID NO: 59064 - RNA, 20 nt, Artificial Sequence
  MKO10059064_A_Vsig2
  gRNA
auccccuaccagucacggag

SEQ ID NO: 59065 - RNA, 20 nt, Artificial Sequence
  MKO10059065_A_Vsig4
  gRNA
cuuauaucuuguuccgcugc

SEQ ID NO: 59066 - RNA, 20 nt, Artificial Sequence
  MKO10059066_A_Vsig4
  gRNA
aucuuccuacgugacuccac

SEQ ID NO: 59067 - RNA, 20 nt, Artificial Sequence
  MKO10059067_A_Vsig4
  gRNA
agaucauugagcuccguguu

SEQ ID NO: 59068 - RNA, 20 nt, Artificial Sequence
  MKO10059068_A_Vsig8
  gRNA
ggcaucaacgcagacgacga

SEQ ID NO: 59069 - RNA, 20 nt, Artificial Sequence
  MKO10059069_A_Vsig8
  gRNA
cacagucaccccuaccgagc

SEQ ID NO: 59070 - RNA, 20 nt, Artificial Sequence
  MKO10059070_A_Vsig8
  gRNA
gguugauggaggcaucguac

SEQ ID NO: 59071 - RNA, 20 nt, Artificial Sequence
  MKO10059071_A_Vsnl1
  gRNA
gaaggcgugcugcgcgaacu

SEQ ID NO: 59072 - RNA, 20 nt, Artificial Sequence
  MKO10059072_A_Vsnl1
  gRNA
ugacggcaagaucacccgag

SEQ ID NO: 59073 - RNA, 20 nt, Artificial Sequence
  MKO10059073_A_Vsnl1
  gRNA
ucgagguucagccucccgcu

SEQ ID NO: 59074 - RNA, 20 nt, Artificial Sequence
  MKO10059074_A_Vstm2a
  gRNA
aucuuggucccaucguuguc

SEQ ID NO: 59075 - RNA, 20 nt, Artificial Sequence
  MKO10059075_A_Vstm2a
  gRNA
accgaugaugcguucuuucg

SEQ ID NO: 59076 - RNA, 20 nt, Artificial Sequence
  MKO10059076_A_Vstm2a
  gRNA
gcucuuacccgacagagacc

SEQ ID NO: 59077 - RNA, 20 nt, Artificial Sequence
  MKO10059077_A_Vstm2b
  gRNA
gccguacgauugcaggacga

SEQ ID NO: 59078 - RNA, 20 nt, Artificial Sequence
  MKO10059078_A_Vstm2b
  gRNA
ucgaaaugcccugcgcguuc

SEQ ID NO: 59079 - RNA, 20 nt, Artificial Sequence
  MKO10059079_A_Vstm2b
  gRNA
auuaccuugcuccgggcgcc

SEQ ID NO: 59080 - RNA, 20 nt, Artificial Sequence
  MKO10059080_A_Vstm2l
  gRNA
cgcgugaucgacuucagcga

SEQ ID NO: 59081 - RNA, 20 nt, Artificial Sequence
  MKO10059081_A_Vstm2l
  gRNA
cucguaggugccuucguccg

SEQ ID NO: 59082 - RNA, 20 nt, Artificial Sequence
  MKO10059082_A_Vstm2l
  gRNA
acucaccguguccggagacg

SEQ ID NO: 59083 - RNA, 20 nt, Artificial Sequence
  MKO10059083_A_Vstm4
  gRNA
ccccucgacgcuccucgagc

SEQ ID NO: 59084 - RNA, 20 nt, Artificial Sequence
  MKO10059084_A_Vstm4
  gRNA
accucucauuuccgucgccg

SEQ ID NO: 59085 - RNA, 20 nt, Artificial Sequence
  MKO10059085_A_Vstm4
  gRNA
augaaucuucgccagcuuug

SEQ ID NO: 59086 - RNA, 20 nt, Artificial Sequence
  MKO10059086_A_Vstm5
  gRNA
uuguuggacaguggcguuga

SEQ ID NO: 59087 - RNA, 20 nt, Artificial Sequence
  MKO10059087_A_Vstm5
  gRNA
auggcgugcccacuauugag

SEQ ID NO: 59088 - RNA, 20 nt, Artificial Sequence
  MKO10059088_A_Vstm5
  gRNA
guccucuccccgcaccgcag

SEQ ID NO: 59089 - RNA, 20 nt, Artificial Sequence
  MKO10059089_A_Vsx1
  gRNA
auuucccgagcguacacguc

SEQ ID NO: 59090 - RNA, 20 nt, Artificial Sequence
  MKO10059090_A_Vsx1
  gRNA
ggcguaagcgagagaagcgc

SEQ ID NO: 59091 - RNA, 20 nt, Artificial Sequence
  MKO10059091_A_Vsx1
  gRNA
uggaaugcaguggcgcacca

SEQ ID NO: 59092 - RNA, 20 nt, Artificial Sequence
  MKO10059092_A_Vsx2
  gRNA
acuacccagaugucuacgcc

SEQ ID NO: 59093 - RNA, 20 nt, Artificial Sequence
  MKO10059093_A_Vsx2
  gRNA
ucgccgcuucuuacgcuucu

SEQ ID NO: 59094 - RNA, 20 nt, Artificial Sequence
  MKO10059094_A_Vsx2
  gRNA
agggaugcacaaaaagucgc

SEQ ID NO: 59095 - RNA, 20 nt, Artificial Sequence
  MKO10059095_A_Vua1
  gRNA
cguuuauaugcuaugcaaac

SEQ ID NO: 59096 - RNA, 20 nt, Artificial Sequence
  MKO10059096_A_Vua1
  gRNA
gauaaaaauuuacgacacuc

SEQ ID NO: 59097 - RNA, 20 nt, Artificial Sequence
  MKO10059097_A_Vua1
  gRNA
gcagacaaugaagaucgagc

SEQ ID NO: 59098 - RNA, 20 nt, Artificial Sequence
  MKO10059098_A_Vucn1
  gRNA
uucagagaguuuacgcugcg

SEQ ID NO: 59099 - RNA, 20 nt, Artificial Sequence
  MKO10059099_A_Vucn1
  gRNA
ggggccaucgcacucaucau

SEQ ID NO: 59100 - RNA, 20 nt, Artificial Sequence
  MKO10059100_A_Vucn1
  gRNA
ugggcaucucaagucgacca

SEQ ID NO: 59101 - RNA, 20 nt, Artificial Sequence
  MKO10059101_A_Vti1a
  gRNA
ucgccuacagugacgaagua

SEQ ID NO: 59102 - RNA, 20 nt, Artificial Sequence
  MKO10059102_A_Vti1a
  gRNA
auuccguacuucgucacugu

SEQ ID NO: 59103 - RNA, 20 nt, Artificial Sequence
  MKO10059103_A_Vti1a
  gRNA
ucgucucggagacuagaggc

SEQ ID NO: 59104 - RNA, 20 nt, Artificial Sequence
  MKO10059104_A_Vti1b
  gRNA
ccuugcuaaacuccaccgug

SEQ ID NO: 59105 - RNA, 20 nt, Artificial Sequence
  MKO10059105_A_Vti1b
  gRNA
ugcucuuaguacguuccaac

SEQ ID NO: 59106 - RNA, 20 nt, Artificial Sequence
  MKO10059106_A_Vti1b
  gRNA
uaccuuggagaacgagcauu

SEQ ID NO: 59107 - RNA, 20 nt, Artificial Sequence
  MKO10059107_A_Vtn
  gRNA
uuuagagugccguccguccg

SEQ ID NO: 59108 - RNA, 20 nt, Artificial Sequence
  MKO10059108_A_Vtn
  gRNA
gaccuaaauccucggacgga

SEQ ID NO: 59109 - RNA, 20 nt, Artificial Sequence
  MKO10059109_A_Vtn
  gRNA
uauccccgaaacaucuccga

SEQ ID NO: 59110 - RNA, 20 nt, Artificial Sequence
  MKO10059110_A_Vwa1
  gRNA
gcaucgucaucucgcaugcg

SEQ ID NO: 59111 - RNA, 20 nt, Artificial Sequence
  MKO10059111_A_Vwa1
  gRNA
ccguguugcaccccaacgua

SEQ ID NO: 59112 - RNA, 20 nt, Artificial Sequence
  MKO10059112_A_Vwa1
  gRNA
agcacggguccgcgcgccag

SEQ ID NO: 59113 - RNA, 20 nt, Artificial Sequence
  MKO10059113_A_Vwa2
  gRNA
ccgugacgaugauaagaauc

SEQ ID NO: 59114 - RNA, 20 nt, Artificial Sequence
  MKO10059114_A_Vwa2
  gRNA
ggcagcgauggcgaagcgcu

SEQ ID NO: 59115 - RNA, 20 nt, Artificial Sequence
  MKO10059115_A_Vwa2
  gRNA
ggcaucgucguguuugccgu

SEQ ID NO: 59116 - RNA, 20 nt, Artificial Sequence
  MKO10059116_A_Vwa3a
  gRNA
agucuuccagagccgacguc

SEQ ID NO: 59117 - RNA, 20 nt, Artificial Sequence
  MKO10059117_A_Vwa3a
  gRNA
aaaguucgagaagcucaccu

SEQ ID NO: 59118 - RNA, 20 nt, Artificial Sequence
  MKO10059118_A_Vwa3a
  gRNA
ugguuguuaccaguaagucc

SEQ ID NO: 59119 - RNA, 20 nt, Artificial Sequence
  MKO10059119_A_Vwa5a
  gRNA
cuaggcucacagcgaguaug

SEQ ID NO: 59120 - RNA, 20 nt, Artificial Sequence
  MKO10059120_A_Vwa5a
  gRNA
gggccaccaagcauacuuau

SEQ ID NO: 59121 - RNA, 20 nt, Artificial Sequence
  MKO10059121_A_Vwa5a
  gRNA
cuccucauucucguaauuua

SEQ ID NO: 59122 - RNA, 20 nt, Artificial Sequence
  MKO10059122_A_Vwa5b1
  gRNA
cgugggcccugucugcucgc

SEQ ID NO: 59123 - RNA, 20 nt, Artificial Sequence
  MKO10059123_A_Vwa5b1
  gRNA
gaggagagucccaucgcacc

SEQ ID NO: 59124 - RNA, 20 nt, Artificial Sequence
  MKO10059124_A_Vwa5b1
  gRNA
aagaacccucacagccccgc

SEQ ID NO: 59125 - RNA, 20 nt, Artificial Sequence
  MKO10059125_A_Vwa5b2
  gRNA
aucggcgccggcuaugcaac

SEQ ID NO: 59126 - RNA, 20 nt, Artificial Sequence
  MKO10059126_A_Vwa5b2
  gRNA
aggcguguucguguacccuc

SEQ ID NO: 59127 - RNA, 20 nt, Artificial Sequence
  MKO10059127_A_Vwa5b2
  gRNA
gccugagaacacguccggag

SEQ ID NO: 59128 - RNA, 20 nt, Artificial Sequence
  MKO10059128_A_Vwa7
  gRNA
gccguucagcaucgaagugc

SEQ ID NO: 59129 - RNA, 20 nt, Artificial Sequence
  MKO10059129_A_Vwa7
  gRNA
ggcgggccaauguauauucg

SEQ ID NO: 59130 - RNA, 20 nt, Artificial Sequence
  MKO10059130_A_Vwa7
  gRNA
gucgaguccagcauauuccc

SEQ ID NO: 59131 - RNA, 20 nt, Artificial Sequence
  MKO10059131_A_Vwa8
  gRNA
cauagcgcuccgcagacaug

SEQ ID NO: 59132 - RNA, 20 nt, Artificial Sequence
  MKO10059132_A_Vwa8
  gRNA
uuaggugaaacgguuaguau

SEQ ID NO: 59133 - RNA, 20 nt, Artificial Sequence
  MKO10059133_A_Vwa8
  gRNA
acugcauagccaccgagcgc

SEQ ID NO: 59134 - RNA, 20 nt, Artificial Sequence
  MKO10059134_A_Vwa9
  gRNA
uuaagucuaugagucguuca

SEQ ID NO: 59135 - RNA, 20 nt, Artificial Sequence
  MKO10059135_A_Vwa9
  gRNA
cgacucauagacuuaaauaa

SEQ ID NO: 59136 - RNA, 20 nt, Artificial Sequence
  MKO10059136_A_Vwa9
  gRNA
uucuagaaagcugauagauc

SEQ ID NO: 59137 - RNA, 20 nt, Artificial Sequence
  MKO10059137_A_Vwc2l
  gRNA
uguucaaagcgcgaaugcca

SEQ ID NO: 59138 - RNA, 20 nt, Artificial Sequence
  MKO10059138_A_Vwc2l
  gRNA
ucgcgcuuugaacacugagc

SEQ ID NO: 59139 - RNA, 20 nt, Artificial Sequence
  MKO10059139_A_Vwc2l
  gRNA
ugaagcuugcauacuucuau

SEQ ID NO: 59140 - RNA, 20 nt, Artificial Sequence
  MKO10059140_A_Vwc2
  gRNA
uacgccuacccggacuaccg

SEQ ID NO: 59141 - RNA, 20 nt, Artificial Sequence
  MKO10059141_A_Vwc2
  gRNA
agaagcgcgagcacgcgucu

SEQ ID NO: 59142 - RNA, 20 nt, Artificial Sequence
  MKO10059142_A_Vwc2
  gRNA
gcacugaucaggcucauaua

SEQ ID NO: 59143 - RNA, 20 nt, Artificial Sequence
  MKO10059143_A_Vwce
  gRNA
aucacagccauacuccccgc

SEQ ID NO: 59144 - RNA, 20 nt, Artificial Sequence
  MKO10059144_A_Vwce
  gRNA
gguagcccgaguaugcccug

SEQ ID NO: 59145 - RNA, 20 nt, Artificial Sequence
  MKO10059145_A_Vwce
  gRNA
gguacagugcccgcugccca

SEQ ID NO: 59146 - RNA, 20 nt, Artificial Sequence
  MKO10059146_A_Vwde
  gRNA
uuacuuacugcaacccacuc

SEQ ID NO: 59147 - RNA, 20 nt, Artificial Sequence
  MKO10059147_A_Vwde
  gRNA
ugaagaauccgguggccccc

SEQ ID NO: 59148 - RNA, 20 nt, Artificial Sequence
  MKO10059148_A_Vwde
  gRNA
ggcuaucagaaauccuacug

SEQ ID NO: 59149 - RNA, 20 nt, Artificial Sequence
  MKO10059149_A_Vwf
  gRNA
ccguaacgcagggugaccaa

SEQ ID NO: 59150 - RNA, 20 nt, Artificial Sequence
  MKO10059150_A_Vwf
  gRNA
gggccgucgacggccuguca

SEQ ID NO: 59151 - RNA, 20 nt, Artificial Sequence
  MKO10059151_A_Vwf
  gRNA
ccuuuggucacccugcguua

SEQ ID NO: 59152 - RNA, 20 nt, Artificial Sequence
  MKO10059152_A_Wac
  gRNA
uugaacuaugaagugcacug

SEQ ID NO: 59153 - RNA, 20 nt, Artificial Sequence
  MKO10059153_A_Wac
  gRNA
cauugaugguaauguaugcg

SEQ ID NO: 59154 - RNA, 20 nt, Artificial Sequence
  MKO10059154_A_Wac
  gRNA
aggggacucucagccuuucc

SEQ ID NO: 59155 - RNA, 20 nt, Artificial Sequence
  MKO10059155_A_Wapal
  gRNA
acuaggucgaaaucuaguag

SEQ ID NO: 59156 - RNA, 20 nt, Artificial Sequence
  MKO10059156_A_Wapal
  gRNA
uacuccguuccauaguaucc

SEQ ID NO: 59157 - RNA, 20 nt, Artificial Sequence
  MKO10059157_A_Wapal
  gRNA
ccagacucggaagaauugcc

SEQ ID NO: 59158 - RNA, 20 nt, Artificial Sequence
  MKO10059158_A_Wap
  gRNA
uaucaucugccaaaccaacg

SEQ ID NO: 59159 - RNA, 20 nt, Artificial Sequence
  MKO10059159_A_Wap
  gRNA
uccagcgaccgugaguguuc

SEQ ID NO: 59160 - RNA, 20 nt, Artificial Sequence
  MKO10059160_A_Wap
  gRNA
ccaguugguguuccgaaagc

SEQ ID NO: 59161 - RNA, 20 nt, Artificial Sequence
  MKO10059161_A_Wars2
  gRNA
cuccccgacaggaacgugug

SEQ ID NO: 59162 - RNA, 20 nt, Artificial Sequence
  MKO10059162_A_Wars2
  gRNA
ugguguaaaugcugcaaucg

SEQ ID NO: 59163 - RNA, 20 nt, Artificial Sequence
  MKO10059163_A_Wars2
  gRNA
uaaguucacccagcucucga

SEQ ID NO: 59164 - RNA, 20 nt, Artificial Sequence
  MKO10059164_A_Wars
  gRNA
aaccgaauagagcgagccac

SEQ ID NO: 59165 - RNA, 20 nt, Artificial Sequence
  MKO10059165_A_Wars
  gRNA
gaccgcaccgcuuccugcgc

SEQ ID NO: 59166 - RNA, 20 nt, Artificial Sequence
  MKO10059166_A_Wars
  gRNA
cucgugaggucccucaaagc

SEQ ID NO: 59167 - RNA, 20 nt, Artificial Sequence
  MKO10059167_A_Wasf1
  gRNA
uaacucguugcaagagcgcg

SEQ ID NO: 59168 - RNA, 20 nt, Artificial Sequence
  MKO10059168_A_Wasf1
  gRNA
cauucccgccgccugucaug

SEQ ID NO: 59169 - RNA, 20 nt, Artificial Sequence
  MKO10059169_A_Wasf1
  gRNA
acaucguauguuucuugcaa

SEQ ID NO: 59170 - RNA, 20 nt, Artificial Sequence
  MKO10059170_A_Wasf2
  gRNA
gaguaaacucccuugcugag

SEQ ID NO: 59171 - RNA, 20 nt, Artificial Sequence
  MKO10059171_A_Wasf2
  gRNA
acguaaaaucaagacacgca

SEQ ID NO: 59172 - RNA, 20 nt, Artificial Sequence
  MKO10059172_A_Wasf2
  gRNA
gagugacuuuaacuuguacu

SEQ ID NO: 59173 - RNA, 20 nt, Artificial Sequence
  MKO10059173_A_Wasf3
  gRNA
ugagcauucugacaccguac

SEQ ID NO: 59174 - RNA, 20 nt, Artificial Sequence
  MKO10059174_A_Wasf3
  gRNA
gccgaucgauucugucuuga

SEQ ID NO: 59175 - RNA, 20 nt, Artificial Sequence
  MKO10059175_A_Wasf3
  gRNA
gaauaugauggcguaugaca

SEQ ID NO: 59176 - RNA, 20 nt, Artificial Sequence
  MKO10059176_A_Wash
  gRNA
gccgacucagcucuacucgu

SEQ ID NO: 59177 - RNA, 20 nt, Artificial Sequence
  MKO10059177_A_Wash
  gRNA
agauggagccguauuccugc

SEQ ID NO: 59178 - RNA, 20 nt, Artificial Sequence
  MKO10059178_A_Wash
  gRNA
cccgacgaguagagcugagu

SEQ ID NO: 59179 - RNA, 20 nt, Artificial Sequence
  MKO10059179_A_Wasl
  gRNA
ugaccacacauuucuugccg

SEQ ID NO: 59180 - RNA, 20 nt, Artificial Sequence
  MKO10059180_A_Wasl
  gRNA
gcucgggccagcagcccccg

SEQ ID NO: 59181 - RNA, 20 nt, Artificial Sequence
  MKO10059181_A_Wasl
  gRNA
uaccagauuuccuuugucgu

SEQ ID NO: 59182 - RNA, 20 nt, Artificial Sequence
  MKO10059182_A_Was
  gRNA
uccuacuucauccgccuuua

SEQ ID NO: 59183 - RNA, 20 nt, Artificial Sequence
  MKO10059183_A_Was
  gRNA
uccaggcuggucggcuacuc

SEQ ID NO: 59184 - RNA, 20 nt, Artificial Sequence
  MKO10059184_A_Was
  gRNA
cggggcugugugcuucguga

SEQ ID NO: 59185 - RNA, 20 nt, Artificial Sequence
  MKO10059185_A_Wbp11
  gRNA
gcuuccuuacccauacgcug

SEQ ID NO: 59186 - RNA, 20 nt, Artificial Sequence
  MKO10059186_A_Wbp11
  gRNA
ccaguacuuugaugcuguua

SEQ ID NO: 59187 - RNA, 20 nt, Artificial Sequence
  MKO10059187_A_Wbp11
  gRNA
ccuuaacagcaucaaaguac

SEQ ID NO: 59188 - RNA, 20 nt, Artificial Sequence
  MKO10059188_A_Wbp1l
  gRNA
aaaucaaccugaucgcuuac

SEQ ID NO: 59189 - RNA, 20 nt, Artificial Sequence
  MKO10059189_A_Wbp1l
  gRNA
aaagauucgcguucugagcg

SEQ ID NO: 59190 - RNA, 20 nt, Artificial Sequence
  MKO10059190_A_Wbp1l
  gRNA
gguagccccauggccggcca

SEQ ID NO: 59191 - RNA, 20 nt, Artificial Sequence
  MKO10059191_A_Wbp1
  gRNA
ugccgcuaucgucgccuaac

SEQ ID NO: 59192 - RNA, 20 nt, Artificial Sequence
  MKO10059192_A_Wbp1
  gRNA
guugugccuuccgccaccga

SEQ ID NO: 59193 - RNA, 20 nt, Artificial Sequence
  MKO10059193_A_Wbp1
  gRNA
guggugaaccacauccucgu

SEQ ID NO: 59194 - RNA, 20 nt, Artificial Sequence
  MKO10059194_A_Wbp2nl
  gRNA
cagaagcuugcaacucguag

SEQ ID NO: 59195 - RNA, 20 nt, Artificial Sequence
  MKO10059195_A_Wbp2nl
  gRNA
uuggagccuggcggugacug

SEQ ID NO: 59196 - RNA, 20 nt, Artificial Sequence
  MKO10059196_A_Wbp2nl
  gRNA
cacuacgaguugcaagcuuc

SEQ ID NO: 59197 - RNA, 20 nt, Artificial Sequence
  MKO10059197_A_Wbp2
  gRNA
aacuuacccgguacggagua

SEQ ID NO: 59198 - RNA, 20 nt, Artificial Sequence
  MKO10059198_A_Wbp2
  gRNA
gggaaagacauaggccccgc

SEQ ID NO: 59199 - RNA, 20 nt, Artificial Sequence
  MKO10059199_A_Wbp2
  gRNA
ccgucuaccuuacuccguac

SEQ ID NO: 59200 - RNA, 20 nt, Artificial Sequence
  MKO10059200_A_Wbp4
  gRNA
cgcccugaaggcguaccaag

SEQ ID NO: 59201 - RNA, 20 nt, Artificial Sequence
  MKO10059201_A_Wbp4
  gRNA
cgcugauguaccugagggua

SEQ ID NO: 59202 - RNA, 20 nt, Artificial Sequence
  MKO10059202_A_Wbp4
  gRNA
ucugugauuacugcaagugc

SEQ ID NO: 59203 - RNA, 20 nt, Artificial Sequence
  MKO10059203_A_Wbp5
  gRNA
acaaacuuauagugacgcgu

SEQ ID NO: 59204 - RNA, 20 nt, Artificial Sequence
  MKO10059204_A_Wbp5
  gRNA
gaggcugauccggucucugc

SEQ ID NO: 59205 - RNA, 20 nt, Artificial Sequence
  MKO10059205_A_Wbp5
  gRNA
ccucucccgaaaaguuucuu

SEQ ID NO: 59206 - RNA, 20 nt, Artificial Sequence
  MKO10059206_A_Wbscr16
  gRNA
aagggagugugcucgaccgc

SEQ ID NO: 59207 - RNA, 20 nt, Artificial Sequence
  MKO10059207_A_Wbscr16
  gRNA
caaaacguacucauagcccc

SEQ ID NO: 59208 - RNA, 20 nt, Artificial Sequence
  MKO10059208_A_Wbscr16
  gRNA
aacaauucccacgggcagug

SEQ ID NO: 59209 - RNA, 20 nt, Artificial Sequence
  MKO10059209_A_Wbscr17
  gRNA
ccugauccgagcacgcaucg

SEQ ID NO: 59210 - RNA, 20 nt, Artificial Sequence
  MKO10059210_A_Wbscr17
  gRNA
cgcuacgagaacuccgccca

SEQ ID NO: 59211 - RNA, 20 nt, Artificial Sequence
  MKO10059211_A_Wbscr17
  gRNA
uacguccacaaacgcuaccc

SEQ ID NO: 59212 - RNA, 20 nt, Artificial Sequence
  MKO10059212_A_Wbscr22
  gRNA
cucacuugcgaacguauuuc

SEQ ID NO: 59213 - RNA, 20 nt, Artificial Sequence
  MKO10059213_A_Wbscr22
  gRNA
cuccaauguagaugccgccu

SEQ ID NO: 59214 - RNA, 20 nt, Artificial Sequence
  MKO10059214_A_Wbscr22
  gRNA
ccccucuguaucucggucca

SEQ ID NO: 59215 - RNA, 20 nt, Artificial Sequence
  MKO10059215_A_Wbscr27
  gRNA
cacaaugaucaccgcgucaa

SEQ ID NO: 59216 - RNA, 20 nt, Artificial Sequence
  MKO10059216_A_Wbscr27
  gRNA
aucauggggugagccccgaa

SEQ ID NO: 59217 - RNA, 20 nt, Artificial Sequence
  MKO10059217_A_Wbscr27
  gRNA
auugucucagucgagccuuu

SEQ ID NO: 59218 - RNA, 20 nt, Artificial Sequence
  MKO10059218_A_Wbscr28
  gRNA
guccggccaggcaagagcau

SEQ ID NO: 59219 - RNA, 20 nt, Artificial Sequence
  MKO10059219_A_Wbscr28
  gRNA
gcaauguuaguccagcucga

SEQ ID NO: 59220 - RNA, 20 nt, Artificial Sequence
  MKO10059220_A_Wbscr28
  gRNA
ugugcugcacucguacugug

SEQ ID NO: 59221 - RNA, 20 nt, Artificial Sequence
  MKO10059221_A_Wdfy1
  gRNA
cggcgugaucaccgcuagcg

SEQ ID NO: 59222 - RNA, 20 nt, Artificial Sequence
  MKO10059222_A_Wdfy1
  gRNA
caaauauccgccugcugucg

SEQ ID NO: 59223 - RNA, 20 nt, Artificial Sequence
  MKO10059223_A_Wdfy1
  gRNA
uggcggcggagauccacucc

SEQ ID NO: 59224 - RNA, 20 nt, Artificial Sequence
  MKO10059224_A_Wdfy2
  gRNA
guugcaggacaguucguguu

SEQ ID NO: 59225 - RNA, 20 nt, Artificial Sequence
  MKO10059225_A_Wdfy2
  gRNA
gacaggacaagcaguucgcc

SEQ ID NO: 59226 - RNA, 20 nt, Artificial Sequence
  MKO10059226_A_Wdfy2
  gRNA
cacuggugcgguaaccuccc

SEQ ID NO: 59227 - RNA, 20 nt, Artificial Sequence
  MKO10059227_A_Wdfy3
  gRNA
cuaccucuagcagagcgccg

SEQ ID NO: 59228 - RNA, 20 nt, Artificial Sequence
  MKO10059228_A_Wdfy3
  gRNA
ccacguucacgcucagcccg

SEQ ID NO: 59229 - RNA, 20 nt, Artificial Sequence
  MKO10059229_A_Wdfy3
  gRNA
cucaugaccaucucccgcca

SEQ ID NO: 59230 - RNA, 20 nt, Artificial Sequence
  MKO10059230_A_Wdfy4
  gRNA
ggaaccuacuucgcagauau

SEQ ID NO: 59231 - RNA, 20 nt, Artificial Sequence
  MKO10059231_A_Wdfy4
  gRNA
aaacauuugcagcgaaucuc

SEQ ID NO: 59232 - RNA, 20 nt, Artificial Sequence
  MKO10059232_A_Wdfy4
  gRNA
aagagugacgcggaucagga

SEQ ID NO: 59233 - RNA, 20 nt, Artificial Sequence
  MKO10059233_A_Wdhd1
  gRNA
gccggcaacaaaauugcugc

SEQ ID NO: 59234 - RNA, 20 nt, Artificial Sequence
  MKO10059234_A_Wdhd1
  gRNA
aagcguguuaauaugccauc

SEQ ID NO: 59235 - RNA, 20 nt, Artificial Sequence
  MKO10059235_A_Wdhd1
  gRNA
gacccuaaguccguuaaugu

SEQ ID NO: 59236 - RNA, 20 nt, Artificial Sequence
  MKO10059236_A_Wdpcp
  gRNA
ugccagcacgagauuauccu

SEQ ID NO: 59237 - RNA, 20 nt, Artificial Sequence
  MKO10059237_A_Wdpcp
  gRNA
aaaacuucgagauucacuga

SEQ ID NO: 59238 - RNA, 20 nt, Artificial Sequence
  MKO10059238_A_Wdpcp
  gRNA
gaucuuucuugucauaguac

SEQ ID NO: 59239 - RNA, 20 nt, Artificial Sequence
  MKO10059239_A_Wdr11
  gRNA
gaugaaaacgaugcccucgc

SEQ ID NO: 59240 - RNA, 20 nt, Artificial Sequence
  MKO10059240_A_Wdr11
  gRNA
cgccuaauuacaucgugcug

SEQ ID NO: 59241 - RNA, 20 nt, Artificial Sequence
  MKO10059241_A_Wdr11
  gRNA
aguauggagagccgauguua

SEQ ID NO: 59242 - RNA, 20 nt, Artificial Sequence
  MKO10059242_A_Wdr12
  gRNA
augauaagacuucucggauc

SEQ ID NO: 59243 - RNA, 20 nt, Artificial Sequence
  MKO10059243_A_Wdr12
  gRNA
ccucauuguaggauccuguc

SEQ ID NO: 59244 - RNA, 20 nt, Artificial Sequence
  MKO10059244_A_Wdr12
  gRNA
cccugccgcugcugaaguug

SEQ ID NO: 59245 - RNA, 20 nt, Artificial Sequence
  MKO10059245_A_Wdr13
  gRNA
ccgaacaacccuugaucgaa

SEQ ID NO: 59246 - RNA, 20 nt, Artificial Sequence
  MKO10059246_A_Wdr13
  gRNA
guggcgucucggacuucgcc

SEQ ID NO: 59247 - RNA, 20 nt, Artificial Sequence
  MKO10059247_A_Wdr13
  gRNA
cguaccguuggcccaauagc

SEQ ID NO: 59248 - RNA, 20 nt, Artificial Sequence
  MKO10059248_A_Wdr16
  gRNA
gccgacauugaggcccgccg

SEQ ID NO: 59249 - RNA, 20 nt, Artificial Sequence
  MKO10059249_A_Wdr16
  gRNA
guagugggacaauucgagug

SEQ ID NO: 59250 - RNA, 20 nt, Artificial Sequence
  MKO10059250_A_Wdr16
  gRNA
cccgcggcgggccucaaugu

SEQ ID NO: 59251 - RNA, 20 nt, Artificial Sequence
  MKO10059251_A_Wdr17
  gRNA
guaugcaaaccgaucuccgu

SEQ ID NO: 59252 - RNA, 20 nt, Artificial Sequence
  MKO10059252_A_Wdr17
  gRNA
guuugcauacugcgcaacuc

SEQ ID NO: 59253 - RNA, 20 nt, Artificial Sequence
  MKO10059253_A_Wdr17
  gRNA
uaaacguugugaugcaguaa

SEQ ID NO: 59254 - RNA, 20 nt, Artificial Sequence
  MKO10059254_A_Wdr18
  gRNA
aggacugcuuggcgcuggcc

SEQ ID NO: 59255 - RNA, 20 nt, Artificial Sequence
  MKO10059255_A_Wdr18
  gRNA
ggccuccgaagccgcagugc

SEQ ID NO: 59256 - RNA, 20 nt, Artificial Sequence
  MKO10059256_A_Wdr18
  gRNA
aggacacguccugguagugc

SEQ ID NO: 59257 - RNA, 20 nt, Artificial Sequence
  MKO10059257_A_Wdr19
  gRNA
gugcuccgauacaauuugcc

SEQ ID NO: 59258 - RNA, 20 nt, Artificial Sequence
  MKO10059258_A_Wdr19
  gRNA
ggauaaagauggcgauaucc

SEQ ID NO: 59259 - RNA, 20 nt, Artificial Sequence
  MKO10059259_A_Wdr19
  gRNA
guuaaaaucuuugaucgcca

SEQ ID NO: 59260 - RNA, 20 nt, Artificial Sequence
  MKO10059260_A_Wdr1
  gRNA
aggcccuaccgacuagcaac

SEQ ID NO: 59261 - RNA, 20 nt, Artificial Sequence
  MKO10059261_A_Wdr1
  gRNA
agacaguaagaggaucgccg

SEQ ID NO: 59262 - RNA, 20 nt, Artificial Sequence
  MKO10059262_A_Wdr1
  gRNA
uaugaguaccagccuuucgc

SEQ ID NO: 59263 - RNA, 20 nt, Artificial Sequence
  MKO10059263_A_Wdr20rt
  gRNA
cgcucuccgcuguggccguu

SEQ ID NO: 59264 - RNA, 20 nt, Artificial Sequence
  MKO10059264_A_Wdr20rt
  gRNA
ggccgacuguacuccgagug

SEQ ID NO: 59265 - RNA, 20 nt, Artificial Sequence
  MKO10059265_A_Wdr20rt
  gRNA
ggcgguugccauuaccaguc

SEQ ID NO: 59266 - RNA, 20 nt, Artificial Sequence
  MKO10059266_A_Wdr20
  gRNA
aaugccacaaguccgccugc

SEQ ID NO: 59267 - RNA, 20 nt, Artificial Sequence
  MKO10059267_A_Wdr20
  gRNA
ggcggucgccguugccagac

SEQ ID NO: 59268 - RNA, 20 nt, Artificial Sequence
  MKO10059268_A_Wdr20
  gRNA
cccauuugacacagguuacg

SEQ ID NO: 59269 - RNA, 20 nt, Artificial Sequence
  MKO10059269_A_Wdr24
  gRNA
ucgggagcuuggccgcaauc

SEQ ID NO: 59270 - RNA, 20 nt, Artificial Sequence
  MKO10059270_A_Wdr24
  gRNA
caucuugucacguccacccg

SEQ ID NO: 59271 - RNA, 20 nt, Artificial Sequence
  MKO10059271_A_Wdr24
  gRNA
gcggccuaccgcucaugaac

SEQ ID NO: 59272 - RNA, 20 nt, Artificial Sequence
  MKO10059272_A_Wdr25
  gRNA
agcagacggagacgcuacga

SEQ ID NO: 59273 - RNA, 20 nt, Artificial Sequence
  MKO10059273_A_Wdr25
  gRNA
cugaccgaaccauuaucgcc

SEQ ID NO: 59274 - RNA, 20 nt, Artificial Sequence
  MKO10059274_A_Wdr25
  gRNA
ucuccgucugcucauccgau

SEQ ID NO: 59275 - RNA, 20 nt, Artificial Sequence
  MKO10059275_A_Wdr26
  gRNA
gcauucuccucacgcuauug

SEQ ID NO: 59276 - RNA, 20 nt, Artificial Sequence
  MKO10059276_A_Wdr26
  gRNA
agcgucccgguccaaacugc

SEQ ID NO: 59277 - RNA, 20 nt, Artificial Sequence
  MKO10059277_A_Wdr26
  gRNA
ccucuuaccacaauagcgug

SEQ ID NO: 59278 - RNA, 20 nt, Artificial Sequence
  MKO10059278_A_Wdr27
  gRNA
gucugaagaccgaagcuuua

SEQ ID NO: 59279 - RNA, 20 nt, Artificial Sequence
  MKO10059279_A_Wdr27
  gRNA
guuguguuugcgauuuaguc

SEQ ID NO: 59280 - RNA, 20 nt, Artificial Sequence
  MKO10059280_A_Wdr27
  gRNA
gagcccaggauagucccucg

SEQ ID NO: 59281 - RNA, 20 nt, Artificial Sequence
  MKO10059281_A_Wdr31
  gRNA
gcacgagcgggaaaucacga

SEQ ID NO: 59282 - RNA, 20 nt, Artificial Sequence
  MKO10059282_A_Wdr31
  gRNA
agaccgccguggccuacaau

SEQ ID NO: 59283 - RNA, 20 nt, Artificial Sequence
  MKO10059283_A_Wdr31
  gRNA
agaauacaucccuguucacg

SEQ ID NO: 59284 - RNA, 20 nt, Artificial Sequence
  MKO10059284_A_Wdr33
  gRNA
gauguugaaaccucggcaua

SEQ ID NO: 59285 - RNA, 20 nt, Artificial Sequence
  MKO10059285_A_Wdr33
  gRNA
gcuugcugcugugcaaaauc

SEQ ID NO: 59286 - RNA, 20 nt, Artificial Sequence
  MKO10059286_A_Wdr33
  gRNA
uuccuccaguggaccccgga

SEQ ID NO: 59287 - RNA, 20 nt, Artificial Sequence
  MKO10059287_A_Wdr34
  gRNA
cucauaggggggcuguauag

SEQ ID NO: 59288 - RNA, 20 nt, Artificial Sequence
  MKO10059288_A_Wdr34
  gRNA
agaccuguacgccaaagcag

SEQ ID NO: 59289 - RNA, 20 nt, Artificial Sequence
  MKO10059289_A_Wdr34
  gRNA
guucaccucauagccaucga

SEQ ID NO: 59290 - RNA, 20 nt, Artificial Sequence
  MKO10059290_A_Wdr35
  gRNA
gugcuguucaaguuguaacg

SEQ ID NO: 59291 - RNA, 20 nt, Artificial Sequence
  MKO10059291_A_Wdr35
  gRNA
gaccaaggguucauagcaug

SEQ ID NO: 59292 - RNA, 20 nt, Artificial Sequence
  MKO10059292_A_Wdr35
  gRNA
cgccacaugcuaugaacccu

SEQ ID NO: 59293 - RNA, 20 nt, Artificial Sequence
  MKO10059293_A_Wdr36
  gRNA
cgcaagucgucacguagaag

SEQ ID NO: 59294 - RNA, 20 nt, Artificial Sequence
  MKO10059294_A_Wdr36
  gRNA
cuucuacgugacgacuugcg

SEQ ID NO: 59295 - RNA, 20 nt, Artificial Sequence
  MKO10059295_A_Wdr36
  gRNA
aucuguugcauggcagccga

SEQ ID NO: 59296 - RNA, 20 nt, Artificial Sequence
  MKO10059296_A_Wdr37
  gRNA
ugaaggacaagcgaucgaug

SEQ ID NO: 59297 - RNA, 20 nt, Artificial Sequence
  MKO10059297_A_Wdr37
  gRNA
acucuuaaugaacguuuagc

SEQ ID NO: 59298 - RNA, 20 nt, Artificial Sequence
  MKO10059298_A_Wdr37
  gRNA
cagcaguguacugcgaacug

SEQ ID NO: 59299 - RNA, 20 nt, Artificial Sequence
  MKO10059299_A_Wdr38
  gRNA
gggacaagagagcgauuguc

SEQ ID NO: 59300 - RNA, 20 nt, Artificial Sequence
  MKO10059300_A_Wdr38
  gRNA
gugagcaggguccggccguc

SEQ ID NO: 59301 - RNA, 20 nt, Artificial Sequence
  MKO10059301_A_Wdr38
  gRNA
gugaccacagcauccgccug

SEQ ID NO: 59302 - RNA, 20 nt, Artificial Sequence
  MKO10059302_A_Wdr3
  gRNA
agcuuaaaguacgaucagcu

SEQ ID NO: 59303 - RNA, 20 nt, Artificial Sequence
  MKO10059303_A_Wdr3
  gRNA
uagcugaucguacuuuaagc

SEQ ID NO: 59304 - RNA, 20 nt, Artificial Sequence
  MKO10059304_A_Wdr3
  gRNA
aaguggccucuaccgucuaa

SEQ ID NO: 59305 - RNA, 20 nt, Artificial Sequence
  MKO10059305_A_Wdr41
  gRNA
accgacaguccggucagccg

SEQ ID NO: 59306 - RNA, 20 nt, Artificial Sequence
  MKO10059306_A_Wdr41
  gRNA
ucgcgacauuguccgcuucc

SEQ ID NO: 59307 - RNA, 20 nt, Artificial Sequence
  MKO10059307_A_Wdr41
  gRNA
ugaagucaucgagccucacc

SEQ ID NO: 59308 - RNA, 20 nt, Artificial Sequence
  MKO10059308_A_Wdr43
  gRNA
cgacaccuguuucgucgcuu

SEQ ID NO: 59309 - RNA, 20 nt, Artificial Sequence
  MKO10059309_A_Wdr43
  gRNA
gugaaccuaagcgacgaaac

SEQ ID NO: 59310 - RNA, 20 nt, Artificial Sequence
  MKO10059310_A_Wdr43
  gRNA
cuggucgaacaaucaaacua

SEQ ID NO: 59311 - RNA, 20 nt, Artificial Sequence
  MKO10059311_A_Wdr44
  gRNA
gcacuugcuaaaucgaggga

SEQ ID NO: 59312 - RNA, 20 nt, Artificial Sequence
  MKO10059312_A_Wdr44
  gRNA
acuacaacaagauuccgaaa

SEQ ID NO: 59313 - RNA, 20 nt, Artificial Sequence
  MKO10059313_A_Wdr44
  gRNA
uuuguacuggcuacuauauc

SEQ ID NO: 59314 - RNA, 20 nt, Artificial Sequence
  MKO10059314_A_Wdr45b
  gRNA
cucaccuuuaggguuguagc

SEQ ID NO: 59315 - RNA, 20 nt, Artificial Sequence
  MKO10059315_A_Wdr45b
  gRNA
cugucaaguugcggagagau

SEQ ID NO: 59316 - RNA, 20 nt, Artificial Sequence
  MKO10059316_A_Wdr45b
  gRNA
ccgaaauacccucccaacaa

SEQ ID NO: 59317 - RNA, 20 nt, Artificial Sequence
  MKO10059317_A_Wdr45
  gRNA
aggcguccggaucuacaaug

SEQ ID NO: 59318 - RNA, 20 nt, Artificial Sequence
  MKO10059318_A_Wdr45
  gRNA
ucccuguccagaccacgagc

SEQ ID NO: 59319 - RNA, 20 nt, Artificial Sequence
  MKO10059319_A_Wdr45
  gRNA
gcugcaccgauccaaccugc

SEQ ID NO: 59320 - RNA, 20 nt, Artificial Sequence
  MKO10059320_A_Wdr46
  gRNA
cuuagaaaccgcggcgcuac

SEQ ID NO: 59321 - RNA, 20 nt, Artificial Sequence
  MKO10059321_A_Wdr46
  gRNA
acccccgacagcguccucug

SEQ ID NO: 59322 - RNA, 20 nt, Artificial Sequence
  MKO10059322_A_Wdr46
  gRNA
ucgaauugacaaguccaaaa

SEQ ID NO: 59323 - RNA, 20 nt, Artificial Sequence
  MKO10059323_A_Wdr47
  gRNA
gguuaaccagucaugauaag

SEQ ID NO: 59324 - RNA, 20 nt, Artificial Sequence
  MKO10059324_A_Wdr47
  gRNA
cacaaccguugccacauaac

SEQ ID NO: 59325 - RNA, 20 nt, Artificial Sequence
  MKO10059325_A_Wdr47
  gRNA
aagaagugauacgccuguug

SEQ ID NO: 59326 - RNA, 20 nt, Artificial Sequence
  MKO10059326_A_Wdr48
  gRNA
uaccuuaugcguccugagug

SEQ ID NO: 59327 - RNA, 20 nt, Artificial Sequence
  MKO10059327_A_Wdr48
  gRNA
uccguuacaggacuauguaa

SEQ ID NO: 59328 - RNA, 20 nt, Artificial Sequence
  MKO10059328_A_Wdr48
  gRNA
agauccguacauagcaucua

SEQ ID NO: 59329 - RNA, 20 nt, Artificial Sequence
  MKO10059329_A_Wdr4
  gRNA
gacggacagcccgcagacac

SEQ ID NO: 59330 - RNA, 20 nt, Artificial Sequence
  MKO10059330_A_Wdr4
  gRNA
acauaccacgucuagcagca

SEQ ID NO: 59331 - RNA, 20 nt, Artificial Sequence
  MKO10059331_A_Wdr4
  gRNA
gcguccaccuucuccaaguc

SEQ ID NO: 59332 - RNA, 20 nt, Artificial Sequence
  MKO10059332_A_Wdr52
  gRNA
cuccggguaaucguaauaga

SEQ ID NO: 59333 - RNA, 20 nt, Artificial Sequence
  MKO10059333_A_Wdr52
  gRNA
cagauacgacucuuccccgu

SEQ ID NO: 59334 - RNA, 20 nt, Artificial Sequence
  MKO10059334_A_Wdr52
  gRNA
gaccuucuauuacgauuacc

SEQ ID NO: 59335 - RNA, 20 nt, Artificial Sequence
  MKO10059335_A_Wdr53
  gRNA
gcaggguuuaggagccgacc

SEQ ID NO: 59336 - RNA, 20 nt, Artificial Sequence
  MKO10059336_A_Wdr53
  gRNA
uucaaaaagcccguccuguu

SEQ ID NO: 59337 - RNA, 20 nt, Artificial Sequence
  MKO10059337_A_Wdr53
  gRNA
gucauguggccuggauaugc

SEQ ID NO: 59338 - RNA, 20 nt, Artificial Sequence
  MKO10059338_A_Wdr54
  gRNA
caccucgcaucgagggauac

SEQ ID NO: 59339 - RNA, 20 nt, Artificial Sequence
  MKO10059339_A_Wdr54
  gRNA
guacaggcuauguuugcccg

SEQ ID NO: 59340 - RNA, 20 nt, Artificial Sequence
  MKO10059340_A_Wdr54
  gRNA
ggucuuugauauccccgcua

SEQ ID NO: 59341 - RNA, 20 nt, Artificial Sequence
  MKO10059341_A_Wdr55
  gRNA
ccacaucuuagaugucgaac

SEQ ID NO: 59342 - RNA, 20 nt, Artificial Sequence
  MKO10059342_A_Wdr55
  gRNA
agaacuuguuaccgucucua

SEQ ID NO: 59343 - RNA, 20 nt, Artificial Sequence
  MKO10059343_A_Wdr55
  gRNA
ugaggaguacauugccgaca

SEQ ID NO: 59344 - RNA, 20 nt, Artificial Sequence
  MKO10059344_A_Wdr59
  gRNA
caucuagauugacgauguac

SEQ ID NO: 59345 - RNA, 20 nt, Artificial Sequence
  MKO10059345_A_Wdr59
  gRNA
cuagugagauggcggcgcgc

SEQ ID NO: 59346 - RNA, 20 nt, Artificial Sequence
  MKO10059346_A_Wdr59
  gRNA
uagugugcgaagcugucaug

SEQ ID NO: 59347 - RNA, 20 nt, Artificial Sequence
  MKO10059347_A_Wdr5b
  gRNA
caaaagagcccgaaacgaug

SEQ ID NO: 59348 - RNA, 20 nt, Artificial Sequence
  MKO10059348_A_Wdr5b
  gRNA
cucgcuagccauucgccauu

SEQ ID NO: 59349 - RNA, 20 nt, Artificial Sequence
  MKO10059349_A_Wdr5b
  gRNA
ucugcggcucuuccucgcgc

SEQ ID NO: 59350 - RNA, 20 nt, Artificial Sequence
  MKO10059350_A_Wdr5
  gRNA
agggaauaucugauguagcg

SEQ ID NO: 59351 - RNA, 20 nt, Artificial Sequence
  MKO10059351_A_Wdr5
  gRNA
acuugccaaccauuccccau

SEQ ID NO: 59352 - RNA, 20 nt, Artificial Sequence
  MKO10059352_A_Wdr5
  gRNA
caguccaaccucaucgucuc

SEQ ID NO: 59353 - RNA, 20 nt, Artificial Sequence
  MKO10059353_A_Wdr60
  gRNA
cuucucccgaucugcgucuu

SEQ ID NO: 59354 - RNA, 20 nt, Artificial Sequence
  MKO10059354_A_Wdr60
  gRNA
cacgcauaucucgacucaag

SEQ ID NO: 59355 - RNA, 20 nt, Artificial Sequence
  MKO10059355_A_Wdr60
  gRNA
gacugcacuaugaugacgag

SEQ ID NO: 59356 - RNA, 20 nt, Artificial Sequence
  MKO10059356_A_Wdr61
  gRNA
cagaugaagucuauagaugc

SEQ ID NO: 59357 - RNA, 20 nt, Artificial Sequence
  MKO10059357_A_Wdr61
  gRNA
caucaucugaagccgugaca

SEQ ID NO: 59358 - RNA, 20 nt, Artificial Sequence
  MKO10059358_A_Wdr61
  gRNA
aauauugaugauuccgucua

SEQ ID NO: 59359 - RNA, 20 nt, Artificial Sequence
  MKO10059359_A_Wdr62
  gRNA
augacaugguccucaauguu

SEQ ID NO: 59360 - RNA, 20 nt, Artificial Sequence
  MKO10059360_A_Wdr62
  gRNA
gucacuauguacuucccauc

SEQ ID NO: 59361 - RNA, 20 nt, Artificial Sequence
  MKO10059361_A_Wdr62
  gRNA
augugcuuacccugcuaagu

SEQ ID NO: 59362 - RNA, 20 nt, Artificial Sequence
  MKO10059362_A_Wdr63
  gRNA
uguagacguacacgucuucu

SEQ ID NO: 59363 - RNA, 20 nt, Artificial Sequence
  MKO10059363_A_Wdr63
  gRNA
ggaagucagauacugcggcu

SEQ ID NO: 59364 - RNA, 20 nt, Artificial Sequence
  MKO10059364_A_Wdr63
  gRNA
uaacccgcuuuccugauucc

SEQ ID NO: 59365 - RNA, 20 nt, Artificial Sequence
  MKO10059365_A_Wdr64
  gRNA
auccugacgcagcuuucgac

SEQ ID NO: 59366 - RNA, 20 nt, Artificial Sequence
  MKO10059366_A_Wdr64
  gRNA
caccagucgaaagcugcguc

SEQ ID NO: 59367 - RNA, 20 nt, Artificial Sequence
  MKO10059367_A_Wdr64
  gRNA
acuuacuguaacguuggugc

SEQ ID NO: 59368 - RNA, 20 nt, Artificial Sequence
  MKO10059368_A_Wdr65
  gRNA
gauagcgagauaucgccgau

SEQ ID NO: 59369 - RNA, 20 nt, Artificial Sequence
  MKO10059369_A_Wdr65
  gRNA
ucaaggagucuacuagcucc

SEQ ID NO: 59370 - RNA, 20 nt, Artificial Sequence
  MKO10059370_A_Wdr65
  gRNA
ugccaucgcagccuauucaa

SEQ ID NO: 59371 - RNA, 20 nt, Artificial Sequence
  MKO10059371_A_Wdr6
  gRNA
cuacguuacccucgauccag

SEQ ID NO: 59372 - RNA, 20 nt, Artificial Sequence
  MKO10059372_A_Wdr6
  gRNA
cuugaaggaucucgccuucg

SEQ ID NO: 59373 - RNA, 20 nt, Artificial Sequence
  MKO10059373_A_Wdr6
  gRNA
uacucacgguagggaagccc

SEQ ID NO: 59374 - RNA, 20 nt, Artificial Sequence
  MKO10059374_A_Wdr70
  gRNA
gcacucgagcuugacggugc

SEQ ID NO: 59375 - RNA, 20 nt, Artificial Sequence
  MKO10059375_A_Wdr70
  gRNA
gaugacgaguuagacgauga

SEQ ID NO: 59376 - RNA, 20 nt, Artificial Sequence
  MKO10059376_A_Wdr70
  gRNA
aggagaauccguaacuacug

SEQ ID NO: 59377 - RNA, 20 nt, Artificial Sequence
  MKO10059377_A_Wdr72
  gRNA
ccucuuuacagucgcccgac

SEQ ID NO: 59378 - RNA, 20 nt, Artificial Sequence
  MKO10059378_A_Wdr72
  gRNA
gucccauacuuugaguucgc

SEQ ID NO: 59379 - RNA, 20 nt, Artificial Sequence
  MKO10059379_A_Wdr72
  gRNA
uaaccggcgaacucaaagua

SEQ ID NO: 59380 - RNA, 20 nt, Artificial Sequence
  MKO10059380_A_Wdr73
  gRNA
gacuucaaaguacgccaugg

SEQ ID NO: 59381 - RNA, 20 nt, Artificial Sequence
  MKO10059381_A_Wdr73
  gRNA
acucgaguccuugaguggau

SEQ ID NO: 59382 - RNA, 20 nt, Artificial Sequence
  MKO10059382_A_Wdr73
  gRNA
ugguaucuggcacaugcuuu

SEQ ID NO: 59383 - RNA, 20 nt, Artificial Sequence
  MKO10059383_A_Wdr74
  gRNA
cacguuccgaggucucgccc

SEQ ID NO: 59384 - RNA, 20 nt, Artificial Sequence
  MKO10059384_A_Wdr74
  gRNA
cggaacgugccuuccccgcc

SEQ ID NO: 59385 - RNA, 20 nt, Artificial Sequence
  MKO10059385_A_Wdr74
  gRNA
uugccgcauguuuccgcuga

SEQ ID NO: 59386 - RNA, 20 nt, Artificial Sequence
  MKO10059386_A_Wdr75
  gRNA
acggaaucuuccgcguggag

SEQ ID NO: 59387 - RNA, 20 nt, Artificial Sequence
  MKO10059387_A_Wdr75
  gRNA
gcugucuagcuuccacgucc

SEQ ID NO: 59388 - RNA, 20 nt, Artificial Sequence
  MKO10059388_A_Wdr75
  gRNA
gcugcccaaaucaacaagcc

SEQ ID NO: 59389 - RNA, 20 nt, Artificial Sequence
  MKO10059389_A_Wdr76
  gRNA
gucuacuuucaacaaccgca

SEQ ID NO: 59390 - RNA, 20 nt, Artificial Sequence
  MKO10059390_A_Wdr76
  gRNA
uacauaccucagcuaacuga

SEQ ID NO: 59391 - RNA, 20 nt, Artificial Sequence
  MKO10059391_A_Wdr76
  gRNA
guuguugaaaguagacccuu

SEQ ID NO: 59392 - RNA, 20 nt, Artificial Sequence
  MKO10059392_A_Wdr77
  gRNA
cucugcuggcguccagaccg

SEQ ID NO: 59393 - RNA, 20 nt, Artificial Sequence
  MKO10059393_A_Wdr77
  gRNA
guaucacugaauucauaccg

SEQ ID NO: 59394 - RNA, 20 nt, Artificial Sequence
  MKO10059394_A_Wdr77
  gRNA
cuuuacagcucacgcuggac

SEQ ID NO: 59395 - RNA, 20 nt, Artificial Sequence
  MKO10059395_A_Wdr78
  gRNA
uccuagcgcuaaaacaguac

SEQ ID NO: 59396 - RNA, 20 nt, Artificial Sequence
  MKO10059396_A_Wdr78
  gRNA
acacuaaacccuagcauguu

SEQ ID NO: 59397 - RNA, 20 nt, Artificial Sequence
  MKO10059397_A_Wdr78
  gRNA
gcugacgcagcauguggauc

SEQ ID NO: 59398 - RNA, 20 nt, Artificial Sequence
  MKO10059398_A_Wdr7
  gRNA
gcauccacaacgaggauuuc

SEQ ID NO: 59399 - RNA, 20 nt, Artificial Sequence
  MKO10059399_A_Wdr7
  gRNA
uuacccugaaauccucguug

SEQ ID NO: 59400 - RNA, 20 nt, Artificial Sequence
  MKO10059400_A_Wdr7
  gRNA
acugugagcgcgucugcaaa

SEQ ID NO: 59401 - RNA, 20 nt, Artificial Sequence
  MKO10059401_A_Wdr81
  gRNA
ucugccccgcauuagccacg

SEQ ID NO: 59402 - RNA, 20 nt, Artificial Sequence
  MKO10059402_A_Wdr81
  gRNA
gcccgaugcgcaagcagaug

SEQ ID NO: 59403 - RNA, 20 nt, Artificial Sequence
  MKO10059403_A_Wdr81
  gRNA
cacaguagccucucgccaug

SEQ ID NO: 59404 - RNA, 20 nt, Artificial Sequence
  MKO10059404_A_Wdr82
  gRNA
caccguacuucuuacuguac

SEQ ID NO: 59405 - RNA, 20 nt, Artificial Sequence
  MKO10059405_A_Wdr82
  gRNA
ugcgggcgucaacucagaaa

SEQ ID NO: 59406 - RNA, 20 nt, Artificial Sequence
  MKO10059406_A_Wdr82
  gRNA
ccggagaucccagagucgaa

SEQ ID NO: 59407 - RNA, 20 nt, Artificial Sequence
  MKO10059407_A_Wdr83
  gRNA
caucuagcacuucguagccg

SEQ ID NO: 59408 - RNA, 20 nt, Artificial Sequence
  MKO10059408_A_Wdr83
  gRNA
cggcuacgaagugcuagaug

SEQ ID NO: 59409 - RNA, 20 nt, Artificial Sequence
  MKO10059409_A_Wdr83
  gRNA
ggcaggucgugcgcaaauuu

SEQ ID NO: 59410 - RNA, 20 nt, Artificial Sequence
  MKO10059410_A_Wdr86
  gRNA
cugaugccaccguucgcgcu

SEQ ID NO: 59411 - RNA, 20 nt, Artificial Sequence
  MKO10059411_A_Wdr86
  gRNA
agugcccucaaguaccacgc

SEQ ID NO: 59412 - RNA, 20 nt, Artificial Sequence
  MKO10059412_A_Wdr86
  gRNA
cacacgagcuguccgaucau

SEQ ID NO: 59413 - RNA, 20 nt, Artificial Sequence
  MKO10059413_A_Wdr89
  gRNA
cuacaucugcuacgagaauu

SEQ ID NO: 59414 - RNA, 20 nt, Artificial Sequence
  MKO10059414_A_Wdr89
  gRNA
ucgaacucgcugcugcacgg

SEQ ID NO: 59415 - RNA, 20 nt, Artificial Sequence
  MKO10059415_A_Wdr89
  gRNA
uacugcaugacacacgauga

SEQ ID NO: 59416 - RNA, 20 nt, Artificial Sequence
  MKO10059416_A_Wdr8
  gRNA
uucaggauguggcggccauc

SEQ ID NO: 59417 - RNA, 20 nt, Artificial Sequence
  MKO10059417_A_Wdr8
  gRNA
uggccagcuuacaugaaauu

SEQ ID NO: 59418 - RNA, 20 nt, Artificial Sequence
  MKO10059418_A_Wdr8
  gRNA
cacuaaucgguacuggacac

SEQ ID NO: 59419 - RNA, 20 nt, Artificial Sequence
  MKO10059419_A_Wdr90
  gRNA
gcaccucgguggacacgucc

SEQ ID NO: 59420 - RNA, 20 nt, Artificial Sequence
  MKO10059420_A_Wdr90
  gRNA
agcgcuguguaucgcauccg

SEQ ID NO: 59421 - RNA, 20 nt, Artificial Sequence
  MKO10059421_A_Wdr90
  gRNA
uaacagacaacuuugcacgc

SEQ ID NO: 59422 - RNA, 20 nt, Artificial Sequence
  MKO10059422_A_Wdr91
  gRNA
gucgauagauauccuccaag

SEQ ID NO: 59423 - RNA, 20 nt, Artificial Sequence
  MKO10059423_A_Wdr91
  gRNA
gguagcuccaauaaucccga

SEQ ID NO: 59424 - RNA, 20 nt, Artificial Sequence
  MKO10059424_A_Wdr91
  gRNA
ugaaauccaucgacuaaaga

SEQ ID NO: 59425 - RNA, 20 nt, Artificial Sequence
  MKO10059425_A_Wdr92
  gRNA
cggcugcccgucacgauuuc

SEQ ID NO: 59426 - RNA, 20 nt, Artificial Sequence
  MKO10059426_A_Wdr92
  gRNA
aggagccccugaaaucguga

SEQ ID NO: 59427 - RNA, 20 nt, Artificial Sequence
  MKO10059427_A_Wdr92
  gRNA
caagagagacuguuggaccg

SEQ ID NO: 59428 - RNA, 20 nt, Artificial Sequence
  MKO10059428_A_Wdr93
  gRNA
caaauacccauuucgucgau

SEQ ID NO: 59429 - RNA, 20 nt, Artificial Sequence
  MKO10059429_A_Wdr93
  gRNA
uauuguuccuaucgacgaaa

SEQ ID NO: 59430 - RNA, 20 nt, Artificial Sequence
  MKO10059430_A_Wdr93
  gRNA
ggaacucaccacuucauuga

SEQ ID NO: 59431 - RNA, 20 nt, Artificial Sequence
  MKO10059431_A_Wdr95
  gRNA
gggggcuggaucgaaucauc

SEQ ID NO: 59432 - RNA, 20 nt, Artificial Sequence
  MKO10059432_A_Wdr95
  gRNA
guacauacaucaccggagcc

SEQ ID NO: 59433 - RNA, 20 nt, Artificial Sequence
  MKO10059433_A_Wdr95
  gRNA
acguucccaccaagagcccg

SEQ ID NO: 59434 - RNA, 20 nt, Artificial Sequence
  MKO10059434_A_Wdr96
  gRNA
aaagcaugucgggcucguuu

SEQ ID NO: 59435 - RNA, 20 nt, Artificial Sequence
  MKO10059435_A_Wdr96
  gRNA
guucaagugcgaugagcgug

SEQ ID NO: 59436 - RNA, 20 nt, Artificial Sequence
  MKO10059436_A_Wdr96
  gRNA
agcaaaguagaguguagucc

SEQ ID NO: 59437 - RNA, 20 nt, Artificial Sequence
  MKO10059437_A_Wdsub1
  gRNA
agcgagaaggcgcacgaucu

SEQ ID NO: 59438 - RNA, 20 nt, Artificial Sequence
  MKO10059438_A_Wdsub1
  gRNA
gaaaagcaacagacgcgcac

SEQ ID NO: 59439 - RNA, 20 nt, Artificial Sequence
  MKO10059439_A_Wdsub1
  gRNA
uuagcaucgugcucgacaga

SEQ ID NO: 59440 - RNA, 20 nt, Artificial Sequence
  MKO10059440_A_Wduc1
  gRNA
ggugcacguccacgaccuua

SEQ ID NO: 59441 - RNA, 20 nt, Artificial Sequence
  MKO10059441_A_Wduc1
  gRNA
gauaucgccguucaaagcuc

SEQ ID NO: 59442 - RNA, 20 nt, Artificial Sequence
  MKO10059442_A_Wduc1
  gRNA
ucuccuuuaccguaaggucg

SEQ ID NO: 59443 - RNA, 20 nt, Artificial Sequence
  MKO10059443_A_Wdyhv1
  gRNA
ugaagcacuucgcuucugac

SEQ ID NO: 59444 - RNA, 20 nt, Artificial Sequence
  MKO10059444_A_Wdyhv1
  gRNA
gacacacaaccaguaucugu

SEQ ID NO: 59445 - RNA, 20 nt, Artificial Sequence
  MKO10059445_A_Wdyhv1
  gRNA
gaguaccccugcauugaaac

SEQ ID NO: 59446 - RNA, 20 nt, Artificial Sequence
  MKO10059446_A_Wee1
  gRNA
ggaaucaauaacucgcgcuu

SEQ ID NO: 59447 - RNA, 20 nt, Artificial Sequence
  MKO10059447_A_Wee1
  gRNA
cagagaaauagcgaacgacg

SEQ ID NO: 59448 - RNA, 20 nt, Artificial Sequence
  MKO10059448_A_Wee1
  gRNA
ucucccacgacaccguccug

SEQ ID NO: 59449 - RNA, 20 nt, Artificial Sequence
  MKO10059449_A_Wee2
  gRNA
ugguacgcuacuacucauca

SEQ ID NO: 59450 - RNA, 20 nt, Artificial Sequence
  MKO10059450_A_Wee2
  gRNA
augaguaguagcguaccaca

SEQ ID NO: 59451 - RNA, 20 nt, Artificial Sequence
  MKO10059451_A_Wee2
  gRNA
guacacuuacagauagucuc

SEQ ID NO: 59452 - RNA, 20 nt, Artificial Sequence
  MKO10059452_A_Wfdc10
  gRNA
cccauacgucuuuauccaac

SEQ ID NO: 59453 - RNA, 20 nt, Artificial Sequence
  MKO10059453_A_Wfdc10
  gRNA
uugcugcuuucccuagccga

SEQ ID NO: 59454 - RNA, 20 nt, Artificial Sequence
  MKO10059454_A_Wfdc10
  gRNA
gggucgcaguuaugcugucc

SEQ ID NO: 59455 - RNA, 20 nt, Artificial Sequence
  MKO10059455_A_Wfdc11
  gRNA
ucaacgucaugaagcccucg

SEQ ID NO: 59456 - RNA, 20 nt, Artificial Sequence
  MKO10059456_A_Wfdc11
  gRNA
agcuggagaacuauuacucg

SEQ ID NO: 59457 - RNA, 20 nt, Artificial Sequence
  MKO10059457_A_Wfdc11
  gRNA
caccagacacgggaaccacg

SEQ ID NO: 59458 - RNA, 20 nt, Artificial Sequence
  MKO10059458_A_Wfdc12
  gRNA
ccgacuacguccgcugcauc

SEQ ID NO: 59459 - RNA, 20 nt, Artificial Sequence
  MKO10059459_A_Wfdc12
  gRNA
accucccguuaccagaguag

SEQ ID NO: 59460 - RNA, 20 nt, Artificial Sequence
  MKO10059460_A_Wfdc12
  gRNA
uggcuucaaaugcgugcugc

SEQ ID NO: 59461 - RNA, 20 nt, Artificial Sequence
  MKO10059461_A_Wfdc13
  gRNA
ccuuaggagagcccuaguac

SEQ ID NO: 59462 - RNA, 20 nt, Artificial Sequence
  MKO10059462_A_Wfdc13
  gRNA
aucugcacgguggagguucc

SEQ ID NO: 59463 - RNA, 20 nt, Artificial Sequence
  MKO10059463_A_Wfdc13
  gRNA
ccuacucagaaaguauugcu

SEQ ID NO: 59464 - RNA, 20 nt, Artificial Sequence
  MKO10059464_A_Wfdc15a
  gRNA
uccugcaguuacgccgaaac

SEQ ID NO: 59465 - RNA, 20 nt, Artificial Sequence
  MKO10059465_A_Wfdc15a
  gRNA
cccguaugcagccgugauaa

SEQ ID NO: 59466 - RNA, 20 nt, Artificial Sequence
  MKO10059466_A_Wfdc15a
  gRNA
cagccuagagcaacuaggaa

SEQ ID NO: 59467 - RNA, 20 nt, Artificial Sequence
  MKO10059467_A_Wfdc15b
  gRNA
gggcagggaacccgauacuc

SEQ ID NO: 59468 - RNA, 20 nt, Artificial Sequence
  MKO10059468_A_Wfdc15b
  gRNA
cuacugccagaugcgcugug

SEQ ID NO: 59469 - RNA, 20 nt, Artificial Sequence
  MKO10059469_A_Wfdc15b
  gRNA
cauucugcuuugcuguaaca

SEQ ID NO: 59470 - RNA, 20 nt, Artificial Sequence
  MKO10059470_A_Wfdc16
  gRNA
caugcagacguugccgcaga

SEQ ID NO: 59471 - RNA, 20 nt, Artificial Sequence
  MKO10059471_A_Wfdc16
  gRNA
gcuggucggccgcgucaggc

SEQ ID NO: 59472 - RNA, 20 nt, Artificial Sequence
  MKO10059472_A_Wfdc16
  gRNA
ucaccgaguuccugauugua

SEQ ID NO: 59473 - RNA, 20 nt, Artificial Sequence
  MKO10059473_A_Wfdc17
  gRNA
uuuggggcaagacacuacau

SEQ ID NO: 59474 - RNA, 20 nt, Artificial Sequence
  MKO10059474_A_Wfdc17
  gRNA
auuuguguugaucaaugcuc

SEQ ID NO: 59475 - RNA, 20 nt, Artificial Sequence
  MKO10059475_A_Wfdc17
  gRNA
cuacagcacuucauguugcc

SEQ ID NO: 59476 - RNA, 20 nt, Artificial Sequence
  MKO10059476_A_Wfdc18
  gRNA
acuugugaugaacgaugcac

SEQ ID NO: 59477 - RNA, 20 nt, Artificial Sequence
  MKO10059477_A_Wfdc18
  gRNA
aagccgcccccacgcaguuu

SEQ ID NO: 59478 - RNA, 20 nt, Artificial Sequence
  MKO10059478_A_Wfdc18
  gRNA
ucaugacaaugacuacugcc

SEQ ID NO: 59479 - RNA, 20 nt, Artificial Sequence
  MKO10059479_A_Wfdc1
  gRNA
guuaagcaacgccggcaagc

SEQ ID NO: 59480 - RNA, 20 nt, Artificial Sequence
  MKO10059480_A_Wfdc1
  gRNA
gcagcccaaaccacgauggc

SEQ ID NO: 59481 - RNA, 20 nt, Artificial Sequence
  MKO10059481_A_Wfdc1
  gRNA
aagggcggguccugcgacag

SEQ ID NO: 59482 - RNA, 20 nt, Artificial Sequence
  MKO10059482_A_Wfdc2
  gRNA
caaccuuuaggaccgagcga

SEQ ID NO: 59483 - RNA, 20 nt, Artificial Sequence
  MKO10059483_A_Wfdc2
  gRNA
cccggggcuaccauuaggcu

SEQ ID NO: 59484 - RNA, 20 nt, Artificial Sequence
  MKO10059484_A_Wfdc2
  gRNA
uccaacacacaguccguaau

SEQ ID NO: 59485 - RNA, 20 nt, Artificial Sequence
  MKO10059485_A_Wfdc3
  gRNA
ugccugccgcggagacaucg

SEQ ID NO: 59486 - RNA, 20 nt, Artificial Sequence
  MKO10059486_A_Wfdc3
  gRNA
uaccucccucgaugucuccg

SEQ ID NO: 59487 - RNA, 20 nt, Artificial Sequence
  MKO10059487_A_Wfdc3
  gRNA
agaacugucaauccggggaa

SEQ ID NO: 59488 - RNA, 20 nt, Artificial Sequence
  MKO10059488_A_Wfdc5
  gRNA
gucucggcagucccggccac

SEQ ID NO: 59489 - RNA, 20 nt, Artificial Sequence
  MKO10059489_A_Wfdc5
  gRNA
aaagucgggcaaaugccccg

SEQ ID NO: 59490 - RNA, 20 nt, Artificial Sequence
  MKO10059490_A_Wfdc5
  gRNA
gggcacuuaccaaagacacg

SEQ ID NO: 59491 - RNA, 20 nt, Artificial Sequence
  MKO10059491_A_Wfdc6a
  gRNA
cucuguaccgaauucaucua

SEQ ID NO: 59492 - RNA, 20 nt, Artificial Sequence
  MKO10059492_A_Wfdc6a
  gRNA
acaaccaccauagaugaauu

SEQ ID NO: 59493 - RNA, 20 nt, Artificial Sequence
  MKO10059493_A_Wfdc6a
  gRNA
ucuucuuguuuggacacugu

SEQ ID NO: 59494 - RNA, 20 nt, Artificial Sequence
  MKO10059494_A_Wfdc6b
  gRNA
aagacccccucugccagcgc

SEQ ID NO: 59495 - RNA, 20 nt, Artificial Sequence
  MKO10059495_A_Wfdc6b
  gRNA
gcuuuagauucgaaguuguu

SEQ ID NO: 59496 - RNA, 20 nt, Artificial Sequence
  MKO10059496_A_Wfdc6b
  gRNA
aaaugccuggaccucagcga

SEQ ID NO: 59497 - RNA, 20 nt, Artificial Sequence
  MKO10059497_A_Wfdc8
  gRNA
cugggcacuccauucgcauu

SEQ ID NO: 59498 - RNA, 20 nt, Artificial Sequence
  MKO10059498_A_Wfdc8
  gRNA
accagcgcgucaaaaugucc

SEQ ID NO: 59499 - RNA, 20 nt, Artificial Sequence
  MKO10059499_A_Wfdc8
  gRNA
gcaauccaugucguucuuac

SEQ ID NO: 59500 - RNA, 20 nt, Artificial Sequence
  MKO10059500_A_Wfdc9
  gRNA
guccagcagcacguguaauu

SEQ ID NO: 59501 - RNA, 20 nt, Artificial Sequence
  MKO10059501_A_Wfdc9
  gRNA
guccaaauuacacgugcugc

SEQ ID NO: 59502 - RNA, 20 nt, Artificial Sequence
  MKO10059502_A_Wfdc9
  gRNA
cgagaacgugcagaaacacc

SEQ ID NO: 59503 - RNA, 20 nt, Artificial Sequence
  MKO10059503_A_Wfikkn1
  gRNA
gcacgacaggguggugugcg

SEQ ID NO: 59504 - RNA, 20 nt, Artificial Sequence
  MKO10059504_A_Wfikkn1
  gRNA
augcgcccugaccaaaugua

SEQ ID NO: 59505 - RNA, 20 nt, Artificial Sequence
  MKO10059505_A_Wfikkn1
  gRNA
cccgguacacucacgcucac

SEQ ID NO: 59506 - RNA, 20 nt, Artificial Sequence
  MKO10059506_A_Wfikkn2
  gRNA
caaccacgugcgcgguaaug

SEQ ID NO: 59507 - RNA, 20 nt, Artificial Sequence
  MKO10059507_A_Wfikkn2
  gRNA
ccaccacauuaccgcgcacg

SEQ ID NO: 59508 - RNA, 20 nt, Artificial Sequence
  MKO10059508_A_Wfikkn2
  gRNA
acccauccgauacucccaug

SEQ ID NO: 59509 - RNA, 20 nt, Artificial Sequence
  MKO10059509_A_Wfs1
  gRNA
acucacauucacugcugacg

SEQ ID NO: 59510 - RNA, 20 nt, Artificial Sequence
  MKO10059510_A_Wfs1
  gRNA
acagcugcucagccguagcc

SEQ ID NO: 59511 - RNA, 20 nt, Artificial Sequence
  MKO10059511_A_Wfs1
  gRNA
cggugccuagcugaccggaa

SEQ ID NO: 59512 - RNA, 20 nt, Artificial Sequence
  MKO10059512_A_Whamm
  gRNA
gacaauccuugucacgcggu

SEQ ID NO: 59513 - RNA, 20 nt, Artificial Sequence
  MKO10059513_A_Whamm
  gRNA
cagaguccaaccgcgugaca

SEQ ID NO: 59514 - RNA, 20 nt, Artificial Sequence
  MKO10059514_A_Whamm
  gRNA
cucuagguucuucaagauca

SEQ ID NO: 59515 - RNA, 20 nt, Artificial Sequence
  MKO10059515_A_Whrn
  gRNA
gcgccgcaacgucuucgacc

SEQ ID NO: 59516 - RNA, 20 nt, Artificial Sequence
  MKO10059516_A_Whrn
  gRNA
gcuuuccccgauccgggaac

SEQ ID NO: 59517 - RNA, 20 nt, Artificial Sequence
  MKO10059517_A_Whrn
  gRNA
ggcagcagacgccgcuugac

SEQ ID NO: 59518 - RNA, 20 nt, Artificial Sequence
  MKO10059518_A_Whsc1l1
  gRNA
agucaucucgauccgaagag

SEQ ID NO: 59519 - RNA, 20 nt, Artificial Sequence
  MKO10059519_A_Whsc1l1
  gRNA
ggguagccauuugugagcgg

SEQ ID NO: 59520 - RNA, 20 nt, Artificial Sequence
  MKO10059520_A_Whsc1l1
  gRNA
guaugaagaguuacuagccg

SEQ ID NO: 59521 - RNA, 20 nt, Artificial Sequence
  MKO10059521_A_Whsc1
  gRNA
gcucucaaucuccccgaaau

SEQ ID NO: 59522 - RNA, 20 nt, Artificial Sequence
  MKO10059522_A_Whsc1
  gRNA
ccaguuguugaaaccuauuu

SEQ ID NO: 59523 - RNA, 20 nt, Artificial Sequence
  MKO10059523_A_Whsc1
  gRNA
ccaaggguaaccugacacuu

SEQ ID NO: 59524 - RNA, 20 nt, Artificial Sequence
  MKO10059524_A_Wibg
  gRNA
cugcuuucgccacgucccgu

SEQ ID NO: 59525 - RNA, 20 nt, Artificial Sequence
  MKO10059525_A_Wibg
  gRNA
gagucggucaccuguccccg

SEQ ID NO: 59526 - RNA, 20 nt, Artificial Sequence
  MKO10059526_A_Wibg
  gRNA
cuuggagagcacuagguauc

SEQ ID NO: 59527 - RNA, 20 nt, Artificial Sequence
  MKO10059527_A_Wif1
  gRNA
cgggucugcgaguguccgga

SEQ ID NO: 59528 - RNA, 20 nt, Artificial Sequence
  MKO10059528_A_Wif1
  gRNA
gccuccauuucgacacccuc

SEQ ID NO: 59529 - RNA, 20 nt, Artificial Sequence
  MKO10059529_A_Wif1
  gRNA
uucauggaguggauauugac

SEQ ID NO: 59530 - RNA, 20 nt, Artificial Sequence
  MKO10059530_A_Wipf1
  gRNA
uugugcagacucgacggaac

SEQ ID NO: 59531 - RNA, 20 nt, Artificial Sequence
  MKO10059531_A_Wipf1
  gRNA
uuccgucgagucugcacaac

SEQ ID NO: 59532 - RNA, 20 nt, Artificial Sequence
  MKO10059532_A_Wipf1
  gRNA
uuccaagacucaucguguga

SEQ ID NO: 59533 - RNA, 20 nt, Artificial Sequence
  MKO10059533_A_Wipf2
  gRNA
agcacuccgaucauuaacgu

SEQ ID NO: 59534 - RNA, 20 nt, Artificial Sequence
  MKO10059534_A_Wipf2
  gRNA
ccaccgcccaugauccgaaa

SEQ ID NO: 59535 - RNA, 20 nt, Artificial Sequence
  MKO10059535_A_Wipf2
  gRNA
aaaacgccagggcccgucag

SEQ ID NO: 59536 - RNA, 20 nt, Artificial Sequence
  MKO10059536_A_Wipf3
  gRNA
cugccgcuguuguuugcgcc

SEQ ID NO: 59537 - RNA, 20 nt, Artificial Sequence
  MKO10059537_A_Wipf3
  gRNA
ugccuugucgcucagcgccg

SEQ ID NO: 59538 - RNA, 20 nt, Artificial Sequence
  MKO10059538_A_Wipf3
  gRNA
uccgcaggcguguuccuugc

SEQ ID NO: 59539 - RNA, 20 nt, Artificial Sequence
  MKO10059539_A_Wipi1
  gRNA
cgcuccacgauauacacguc

SEQ ID NO: 59540 - RNA, 20 nt, Artificial Sequence
  MKO10059540_A_Wipi1
  gRNA
guccgcagaucccuagcgau

SEQ ID NO: 59541 - RNA, 20 nt, Artificial Sequence
  MKO10059541_A_Wipi1
  gRNA
gaaguuauugaagaccgucc

SEQ ID NO: 59542 - RNA, 20 nt, Artificial Sequence
  MKO10059542_A_Wipi2
  gRNA
cuagcggcucauuguguguc

SEQ ID NO: 59543 - RNA, 20 nt, Artificial Sequence
  MKO10059543_A_Wipi2
  gRNA
cggacuuacuaccaacagcu

SEQ ID NO: 59544 - RNA, 20 nt, Artificial Sequence
  MKO10059544_A_Wipi2
  gRNA
uauccagggagugcgagcau

SEQ ID NO: 59545 - RNA, 20 nt, Artificial Sequence
  MKO10059545_A_Wisp1
  gRNA
gaucgcccgagguacgcaau

SEQ ID NO: 59546 - RNA, 20 nt, Artificial Sequence
  MKO10059546_A_Wisp1
  gRNA
gauggcguacgcuacaccaa

SEQ ID NO: 59547 - RNA, 20 nt, Artificial Sequence
  MKO10059547_A_Wisp1
  gRNA
ugguguagcguacgccaucc

SEQ ID NO: 59548 - RNA, 20 nt, Artificial Sequence
  MKO10059548_A_Wisp2
  gRNA
ggcgacgcuggaucuccagu

SEQ ID NO: 59549 - RNA, 20 nt, Artificial Sequence
  MKO10059549_A_Wisp2
  gRNA
caggggccaucggcagaugc

SEQ ID NO: 59550 - RNA, 20 nt, Artificial Sequence
  MKO10059550_A_Wisp2
  gRNA
gcugugaggugaauggccgc

SEQ ID NO: 59551 - RNA, 20 nt, Artificial Sequence
  MKO10059551_A_Wisp3
  gRNA
cacacgccugucucguaccu

SEQ ID NO: 59552 - RNA, 20 nt, Artificial Sequence
  MKO10059552_A_Wisp3
  gRNA
ccccggaguagucacaguac

SEQ ID NO: 59553 - RNA, 20 nt, Artificial Sequence
  MKO10059553_A_Wisp3
  gRNA
aauucccauuccgcacguuc

SEQ ID NO: 59554 - RNA, 20 nt, Artificial Sequence
  MKO10059554_A_Wiz
  gRNA
gggcacgccucgagaagaua

SEQ ID NO: 59555 - RNA, 20 nt, Artificial Sequence
  MKO10059555_A_Wiz
  gRNA
ugcaguggcuaacuucgacc

SEQ ID NO: 59556 - RNA, 20 nt, Artificial Sequence
  MKO10059556_A_Wiz
  gRNA
cgggcccaccuucgugacuu

SEQ ID NO: 59557 - RNA, 20 nt, Artificial Sequence
  MKO10059557_A_Wls
  gRNA
ccuuagugaaaccuccguuu

SEQ ID NO: 59558 - RNA, 20 nt, Artificial Sequence
  MKO10059558_A_Wls
  gRNA
ugacaagauccgugacaucg

SEQ ID NO: 59559 - RNA, 20 nt, Artificial Sequence
  MKO10059559_A_Wls
  gRNA
cggaucuugucacacuuguu

SEQ ID NO: 59560 - RNA, 20 nt, Artificial Sequence
  MKO10059560_A_Wnk1
  gRNA
cgacuccaaugccaccgcgu

SEQ ID NO: 59561 - RNA, 20 nt, Artificial Sequence
  MKO10059561_A_Wnk1
  gRNA
gacuuacacuggucacucga

SEQ ID NO: 59562 - RNA, 20 nt, Artificial Sequence
  MKO10059562_A_Wnk1
  gRNA
ccgccggcacacuauggaca

SEQ ID NO: 59563 - RNA, 20 nt, Artificial Sequence
  MKO10059563_A_Wnk2
  gRNA
gggcaagcgauguaucgugc

SEQ ID NO: 59564 - RNA, 20 nt, Artificial Sequence
  MKO10059564_A_Wnk2
  gRNA
cgaggaacauuacgacgagu

SEQ ID NO: 59565 - RNA, 20 nt, Artificial Sequence
  MKO10059565_A_Wnk2
  gRNA
acuccaccacgcugcgccgc

SEQ ID NO: 59566 - RNA, 20 nt, Artificial Sequence
  MKO10059566_A_Wnk3
  gRNA
ggacgccuccuauuauucac

SEQ ID NO: 59567 - RNA, 20 nt, Artificial Sequence
  MKO10059567_A_Wnk3
  gRNA
agcaaacgaugugcgcauua

SEQ ID NO: 59568 - RNA, 20 nt, Artificial Sequence
  MKO10059568_A_Wnk3
  gRNA
aucauagaaucgaacuauau

SEQ ID NO: 59569 - RNA, 20 nt, Artificial Sequence
  MKO10059569_A_Wnk4
  gRNA
ucacgucuugagcgugcccg

SEQ ID NO: 59570 - RNA, 20 nt, Artificial Sequence
  MKO10059570_A_Wnk4
  gRNA
uccgcacggauaagaacgag

SEQ ID NO: 59571 - RNA, 20 nt, Artificial Sequence
  MKO10059571_A_Wnk4
  gRNA
accucucguucuuauccgug

SEQ ID NO: 59572 - RNA, 20 nt, Artificial Sequence
  MKO10059572_A_Wnt10a
  gRNA
gguugcgacgccuccagacg

SEQ ID NO: 59573 - RNA, 20 nt, Artificial Sequence
  MKO10059573_A_Wnt10a
  gRNA
uuuacccagagcgcacgcgu

SEQ ID NO: 59574 - RNA, 20 nt, Artificial Sequence
  MKO10059574_A_Wnt10a
  gRNA
uccaccgcgccacgcucauc

SEQ ID NO: 59575 - RNA, 20 nt, Artificial Sequence
  MKO10059575_A_Wnt10b
  gRNA
gagcgccgacgccgucacgu

SEQ ID NO: 59576 - RNA, 20 nt, Artificial Sequence
  MKO10059576_A_Wnt10b
  gRNA
uccagccccgccuacguccg

SEQ ID NO: 59577 - RNA, 20 nt, Artificial Sequence
  MKO10059577_A_Wnt10b
  gRNA
cgugcuccggcagacgcgag

SEQ ID NO: 59578 - RNA, 20 nt, Artificial Sequence
  MKO10059578_A_Wnt11
  gRNA
gcgcggcuacaaccccuaca

SEQ ID NO: 59579 - RNA, 20 nt, Artificial Sequence
  MKO10059579_A_Wnt11
  gRNA
aggccgguguaccaccuucg

SEQ ID NO: 59580 - RNA, 20 nt, Artificial Sequence
  MKO10059580_A_Wnt11
  gRNA
ccaucagucacaccaucgcc

SEQ ID NO: 59581 - RNA, 20 nt, Artificial Sequence
  MKO10059581_A_Wnt16
  gRNA
gaagccaguuccgacacgag

SEQ ID NO: 59582 - RNA, 20 nt, Artificial Sequence
  MKO10059582_A_Wnt16
  gRNA
ugccgcugccacggaguuuc

SEQ ID NO: 59583 - RNA, 20 nt, Artificial Sequence
  MKO10059583_A_Wnt16
  gRNA
ccugcugccuagcauccgcg

SEQ ID NO: 59584 - RNA, 20 nt, Artificial Sequence
  MKO10059584_A_Wnt1
  gRNA
auccgucaacagguucgugg

SEQ ID NO: 59585 - RNA, 20 nt, Artificial Sequence
  MKO10059585_A_Wnt1
  gRNA
cacgcgcacgcagcgcguca

SEQ ID NO: 59586 - RNA, 20 nt, Artificial Sequence
  MKO10059586_A_Wnt1
  gRNA
ugacgcgcugcgugcgcgug

SEQ ID NO: 59587 - RNA, 20 nt, Artificial Sequence
  MKO10059587_A_Wnt2b
  gRNA
ccgaggguaugacacaacuc

SEQ ID NO: 59588 - RNA, 20 nt, Artificial Sequence
  MKO10059588_A_Wnt2b
  gRNA
uggcaaagcgaacaccguaa

SEQ ID NO: 59589 - RNA, 20 nt, Artificial Sequence
  MKO10059589_A_Wnt2b
  gRNA
aacuuacacaacaaccgcug

SEQ ID NO: 59590 - RNA, 20 nt, Artificial Sequence
  MKO10059590_A_Wnt2
  gRNA
accaguuccgccagcaucgc

SEQ ID NO: 59591 - RNA, 20 nt, Artificial Sequence
  MKO10059591_A_Wnt2
  gRNA
ucauguaggcgucgcccagu

SEQ ID NO: 59592 - RNA, 20 nt, Artificial Sequence
  MKO10059592_A_Wnt2
  gRNA
uguuucagguagucgggaau

SEQ ID NO: 59593 - RNA, 20 nt, Artificial Sequence
  MKO10059593_A_Wnt3a
  gRNA
accuugaaguacguguaacg

SEQ ID NO: 59594 - RNA, 20 nt, Artificial Sequence
  MKO10059594_A_Wnt3a
  gRNA
gucacgcgucccgaaggagc

SEQ ID NO: 59595 - RNA, 20 nt, Artificial Sequence
  MKO10059595_A_Wnt3a
  gRNA
cucgggaguuugccgaugcc

SEQ ID NO: 59596 - RNA, 20 nt, Artificial Sequence
  MKO10059596_A_Wnt3
  gRNA
ugcagcgaggacgccgacuu

SEQ ID NO: 59597 - RNA, 20 nt, Artificial Sequence
  MKO10059597_A_Wnt3
  gRNA
uacaguuccaccggcggccc

SEQ ID NO: 59598 - RNA, 20 nt, Artificial Sequence
  MKO10059598_A_Wnt3
  gRNA
cagcccgacuuccgugccau

SEQ ID NO: 59599 - RNA, 20 nt, Artificial Sequence
  MKO10059599_A_Wnt4
  gRNA
ucgugccuagcacgccacug

SEQ ID NO: 59600 - RNA, 20 nt, Artificial Sequence
  MKO10059600_A_Wnt4
  gRNA
gagguggagccacgacgcgu

SEQ ID NO: 59601 - RNA, 20 nt, Artificial Sequence
  MKO10059601_A_Wnt4
  gRNA
gugauggacucagugcgccg

SEQ ID NO: 59602 - RNA, 20 nt, Artificial Sequence
  MKO10059602_A_Wnt5a
  gRNA
ugcggagacaacaucgacua

SEQ ID NO: 59603 - RNA, 20 nt, Artificial Sequence
  MKO10059603_A_Wnt5a
  gRNA
cuucaacuccccgaccacgc

SEQ ID NO: 59604 - RNA, 20 nt, Artificial Sequence
  MKO10059604_A_Wnt5a
  gRNA
acguacgcggugagcgcagc

SEQ ID NO: 59605 - RNA, 20 nt, Artificial Sequence
  MKO10059605_A_Wnt5b
  gRNA
ggagaaguacgacagcgccg

SEQ ID NO: 59606 - RNA, 20 nt, Artificial Sequence
  MKO10059606_A_Wnt5b
  gRNA
gccaacaccaguuucgacag

SEQ ID NO: 59607 - RNA, 20 nt, Artificial Sequence
  MKO10059607_A_Wnt5b
  gRNA
ugaccgcuucaagagcguuc

SEQ ID NO: 59608 - RNA, 20 nt, Artificial Sequence
  MKO10059608_A_Wnt6
  gRNA
uugugccccgcgcacgucga

SEQ ID NO: 59609 - RNA, 20 nt, Artificial Sequence
  MKO10059609_A_Wnt6
  gRNA
ugcccggcgaacccgugcgc

SEQ ID NO: 59610 - RNA, 20 nt, Artificial Sequence
  MKO10059610_A_Wnt6
  gRNA
guagaggagauccgcucguc

SEQ ID NO: 59611 - RNA, 20 nt, Artificial Sequence
  MKO10059611_A_Wnt7a
  gRNA
uuguuucgacuggcacgcac

SEQ ID NO: 59612 - RNA, 20 nt, Artificial Sequence
  MKO10059612_A_Wnt7a
  gRNA
ccaggcagcgccgcgcuuuc

SEQ ID NO: 59613 - RNA, 20 nt, Artificial Sequence
  MKO10059613_A_Wnt7a
  gRNA
gcggugcuuacccgauccgg

SEQ ID NO: 59614 - RNA, 20 nt, Artificial Sequence
  MKO10059614_A_Wnt7b
  gRNA
gagaaaagucgaugccguag

SEQ ID NO: 59615 - RNA, 20 nt, Artificial Sequence
  MKO10059615_A_Wnt7b
  gRNA
cacgcuaccuaaguuccgcg

SEQ ID NO: 59616 - RNA, 20 nt, Artificial Sequence
  MKO10059616_A_Wnt7b
  gRNA
uggcccaccucgcggaacuu

SEQ ID NO: 59617 - RNA, 20 nt, Artificial Sequence
  MKO10059617_A_Wnt8a
  gRNA
ucugaccuacaccgccagug

SEQ ID NO: 59618 - RNA, 20 nt, Artificial Sequence
  MKO10059618_A_Wnt8a
  gRNA
cuaccuugggacggguuauc

SEQ ID NO: 59619 - RNA, 20 nt, Artificial Sequence
  MKO10059619_A_Wnt8a
  gRNA
caaacuguccacgaagaguc

SEQ ID NO: 59620 - RNA, 20 nt, Artificial Sequence
  MKO10059620_A_Wnt8b
  gRNA
gugcacgccaucagcucugc

SEQ ID NO: 59621 - RNA, 20 nt, Artificial Sequence
  MKO10059621_A_Wnt8b
  gRNA
uccaacggucccaagcaaac

SEQ ID NO: 59622 - RNA, 20 nt, Artificial Sequence
  MKO10059622_A_Wnt8b
  gRNA
uaccgcuucgaaguccacca

SEQ ID NO: 59623 - RNA, 20 nt, Artificial Sequence
  MKO10059623_A_Wnt9a
  gRNA
acccgaccuggaaaaccgcg

SEQ ID NO: 59624 - RNA, 20 nt, Artificial Sequence
  MKO10059624_A_Wnt9a
  gRNA
accaguuccgcuuugagcgc

SEQ ID NO: 59625 - RNA, 20 nt, Artificial Sequence
  MKO10059625_A_Wnt9a
  gRNA
ggacuuccacaacaaccucg

SEQ ID NO: 59626 - RNA, 20 nt, Artificial Sequence
  MKO10059626_A_Wnt9b
  gRNA
uuccagccugaccggucgug

SEQ ID NO: 59627 - RNA, 20 nt, Artificial Sequence
  MKO10059627_A_Wnt9b
  gRNA
cucuccccguuucgcgagac

SEQ ID NO: 59628 - RNA, 20 nt, Artificial Sequence
  MKO10059628_A_Wnt9b
  gRNA
ccggggcugcugccguaccc

SEQ ID NO: 59629 - RNA, 20 nt, Artificial Sequence
  MKO10059629_A_Wrap53
  gRNA
cuuucgcgcuuacaaccacc

SEQ ID NO: 59630 - RNA, 20 nt, Artificial Sequence
  MKO10059630_A_Wrap53
  gRNA
caggugguuguaagcgcgaa

SEQ ID NO: 59631 - RNA, 20 nt, Artificial Sequence
  MKO10059631_A_Wrap53
  gRNA
ucaagauacaggaaccguca

SEQ ID NO: 59632 - RNA, 20 nt, Artificial Sequence
  MKO10059632_A_Wrap73
  gRNA
cacuaaucgguacuggacac

SEQ ID NO: 59633 - RNA, 20 nt, Artificial Sequence
  MKO10059633_A_Wrap73
  gRNA
ucccuggcagcugcgaauca

SEQ ID NO: 59634 - RNA, 20 nt, Artificial Sequence
  MKO10059634_A_Wrap73
  gRNA
cugcagaccacucuaugugc

SEQ ID NO: 59635 - RNA, 20 nt, Artificial Sequence
  MKO10059635_A_Wrb
  gRNA
caauuaccugcuacucgagu

SEQ ID NO: 59636 - RNA, 20 nt, Artificial Sequence
  MKO10059636_A_Wrb
  gRNA
cgcugaugaucucgcucauu

SEQ ID NO: 59637 - RNA, 20 nt, Artificial Sequence
  MKO10059637_A_Wrb
  gRNA
acgaguuugccagauacgcc

SEQ ID NO: 59638 - RNA, 20 nt, Artificial Sequence
  MKO10059638_A_Wrnip1
  gRNA
ucagaagggcggcguugacu

SEQ ID NO: 59639 - RNA, 20 nt, Artificial Sequence
  MKO10059639_A_Wrnip1
  gRNA
auugucccgcacuccacgug

SEQ ID NO: 59640 - RNA, 20 nt, Artificial Sequence
  MKO10059640_A_Wrnip1
  gRNA
gcaguccauucaagcccguc

SEQ ID NO: 59641 - RNA, 20 nt, Artificial Sequence
  MKO10059641_A_Wrn
  gRNA
uggccgcccauauacaagcc

SEQ ID NO: 59642 - RNA, 20 nt, Artificial Sequence
  MKO10059642_A_Wrn
  gRNA
ggucugguuaaacacgucuu

SEQ ID NO: 59643 - RNA, 20 nt, Artificial Sequence
  MKO10059643_A_Wrn
  gRNA
aaucacgcagaaguuuccac

SEQ ID NO: 59644 - RNA, 20 nt, Artificial Sequence
  MKO10059644_A_Wsb1
  gRNA
ucagugagaucacguacuau

SEQ ID NO: 59645 - RNA, 20 nt, Artificial Sequence
  MKO10059645_A_Wsb1
  gRNA
gcgaccauuguuuaauccug

SEQ ID NO: 59646 - RNA, 20 nt, Artificial Sequence
  MKO10059646_A_Wsb1
  gRNA
ccacagucuauaacgugcuc

SEQ ID NO: 59647 - RNA, 20 nt, Artificial Sequence
  MKO10059647_A_Wsb2
  gRNA
ugccccuaccgugcuuauuc

SEQ ID NO: 59648 - RNA, 20 nt, Artificial Sequence
  MKO10059648_A_Wsb2
  gRNA
ccuucucgccagacgguucc

SEQ ID NO: 59649 - RNA, 20 nt, Artificial Sequence
  MKO10059649_A_Wsb2
  gRNA
ucagaucucucacgacgucu

SEQ ID NO: 59650 - RNA, 20 nt, Artificial Sequence
  MKO10059650_A_Wscd1
  gRNA
cauccuugcaggcaauuacc

SEQ ID NO: 59651 - RNA, 20 nt, Artificial Sequence
  MKO10059651_A_Wscd1
  gRNA
gcucaccuugcacggguguc

SEQ ID NO: 59652 - RNA, 20 nt, Artificial Sequence
  MKO10059652_A_Wscd1
  gRNA
gggcgcacugccaccuaccg

SEQ ID NO: 59653 - RNA, 20 nt, Artificial Sequence
  MKO10059653_A_Wscd2
  gRNA
acagucugauucgcucacgu

SEQ ID NO: 59654 - RNA, 20 nt, Artificial Sequence
  MKO10059654_A_Wscd2
  gRNA
ucaaccgucucucagucuac

SEQ ID NO: 59655 - RNA, 20 nt, Artificial Sequence
  MKO10059655_A_Wscd2
  gRNA
acuccuccgcgcugcacuuc

SEQ ID NO: 59656 - RNA, 20 nt, Artificial Sequence
  MKO10059656_A_Wt1
  gRNA
gaacugcgccgcgugaugcg

SEQ ID NO: 59657 - RNA, 20 nt, Artificial Sequence
  MKO10059657_A_Wt1
  gRNA
ccacacgcccucgcaucacg

SEQ ID NO: 59658 - RNA, 20 nt, Artificial Sequence
  MKO10059658_A_Wt1
  gRNA
guguggcagccauacaccgg

SEQ ID NO: 59659 - RNA, 20 nt, Artificial Sequence
  MKO10059659_A_Wuap
  gRNA
uacucagcaaacgaugugac

SEQ ID NO: 59660 - RNA, 20 nt, Artificial Sequence
  MKO10059660_A_Wuap
  gRNA
cacgggaugaguuaauucua

SEQ ID NO: 59661 - RNA, 20 nt, Artificial Sequence
  MKO10059661_A_Wuap
  gRNA
cucuugcaucuccugcucuu

SEQ ID NO: 59662 - RNA, 20 nt, Artificial Sequence
  MKO10059662_A_Wtip
  gRNA
gccucgcuccguagaugcca

SEQ ID NO: 59663 - RNA, 20 nt, Artificial Sequence
  MKO10059663_A_Wtip
  gRNA
gcugacaaguguagcgugug

SEQ ID NO: 59664 - RNA, 20 nt, Artificial Sequence
  MKO10059664_A_Wtip
  gRNA
uggcaucuacggagcgaggc

SEQ ID NO: 59665 - RNA, 20 nt, Artificial Sequence
  MKO10059665_A_Wwc1
  gRNA
augaaguaaucuccgaccug

SEQ ID NO: 59666 - RNA, 20 nt, Artificial Sequence
  MKO10059666_A_Wwc1
  gRNA
caucagugaugaguuaccgc

SEQ ID NO: 59667 - RNA, 20 nt, Artificial Sequence
  MKO10059667_A_Wwc1
  gRNA
ucccgccgccauugcacccu

SEQ ID NO: 59668 - RNA, 20 nt, Artificial Sequence
  MKO10059668_A_Wwc2
  gRNA
uggcccucgaugaauaugug

SEQ ID NO: 59669 - RNA, 20 nt, Artificial Sequence
  MKO10059669_A_Wwc2
  gRNA
auccccgacacagucagcga

SEQ ID NO: 59670 - RNA, 20 nt, Artificial Sequence
  MKO10059670_A_Wwc2
  gRNA
gcucaaggacuaucucuccg

SEQ ID NO: 59671 - RNA, 20 nt, Artificial Sequence
  MKO10059671_A_Wwox
  gRNA
cuucgucggauuaucgucca

SEQ ID NO: 59672 - RNA, 20 nt, Artificial Sequence
  MKO10059672_A_Wwox
  gRNA
gcucccgucguaucucuguc

SEQ ID NO: 59673 - RNA, 20 nt, Artificial Sequence
  MKO10059673_A_Wwox
  gRNA
cgaggccgugucccgcaucc

SEQ ID NO: 59674 - RNA, 20 nt, Artificial Sequence
  MKO10059674_A_Wwp1
  gRNA
gcucaaucacuaauccauca

SEQ ID NO: 59675 - RNA, 20 nt, Artificial Sequence
  MKO10059675_A_Wwp1
  gRNA
gagcaucugccuuuaaagug

SEQ ID NO: 59676 - RNA, 20 nt, Artificial Sequence
  MKO10059676_A_Wwp1
  gRNA
aucagcugcucgucccauuu

SEQ ID NO: 59677 - RNA, 20 nt, Artificial Sequence
  MKO10059677_A_Wwp2
  gRNA
gcccagaaucaacuccuacg

SEQ ID NO: 59678 - RNA, 20 nt, Artificial Sequence
  MKO10059678_A_Wwp2
  gRNA
gggcuggcgguugugcaccu

SEQ ID NO: 59679 - RNA, 20 nt, Artificial Sequence
  MKO10059679_A_Wwp2
  gRNA
gccaccaaagcaguuuguac

SEQ ID NO: 59680 - RNA, 20 nt, Artificial Sequence
  MKO10059680_A_Wwtr1
  gRNA
cacccggggccucgacuagc

SEQ ID NO: 59681 - RNA, 20 nt, Artificial Sequence
  MKO10059681_A_Wwtr1
  gRNA
ggggcuuaccgagauucggc

SEQ ID NO: 59682 - RNA, 20 nt, Artificial Sequence
  MKO10059682_A_Wwtr1
  gRNA
gcagugucccagccgaaucu

SEQ ID NO: 59683 - RNA, 20 nt, Artificial Sequence
  MKO10059683_A_Xab2
  gRNA
ccgcuacaucgaguucaaac

SEQ ID NO: 59684 - RNA, 20 nt, Artificial Sequence
  MKO10059684_A_Xab2
  gRNA
ugagugcccgcucauacaac

SEQ ID NO: 59685 - RNA, 20 nt, Artificial Sequence
  MKO10059685_A_Xab2
  gRNA
ucacacaacacucucgcauc

SEQ ID NO: 59686 - RNA, 20 nt, Artificial Sequence
  MKO10059686_A_Xaf1
  gRNA
uucggcacugacaacaguuc

SEQ ID NO: 59687 - RNA, 20 nt, Artificial Sequence
  MKO10059687_A_Xaf1
  gRNA
caaacacugugacacguauu

SEQ ID NO: 59688 - RNA, 20 nt, Artificial Sequence
  MKO10059688_A_Xaf1
  gRNA
agcgcaggcagugggccucg

SEQ ID NO: 59689 - RNA, 20 nt, Artificial Sequence
  MKO10059689_A_Xbp1
  gRNA
ccaagcguguucuuaacucc

SEQ ID NO: 59690 - RNA, 20 nt, Artificial Sequence
  MKO10059690_A_Xbp1
  gRNA
gcugcuccagcucgcucauc

SEQ ID NO: 59691 - RNA, 20 nt, Artificial Sequence
  MKO10059691_A_Xbp1
  gRNA
cggccuugugguugagaacc

SEQ ID NO: 59692 - RNA, 20 nt, Artificial Sequence
  MKO10059692_A_Xcl1
  gRNA
gaucgcugcuuucacccauu

SEQ ID NO: 59693 - RNA, 20 nt, Artificial Sequence
  MKO10059693_A_Xcl1
  gRNA
aaaucaagaccuauaucauc

SEQ ID NO: 59694 - RNA, 20 nt, Artificial Sequence
  MKO10059694_A_Xcl1
  gRNA
agcuuaccuuccacaaccca

SEQ ID NO: 59695 - RNA, 20 nt, Artificial Sequence
  MKO10059695_A_Xcr1
  gRNA
uacccuccgcugccgugugc

SEQ ID NO: 59696 - RNA, 20 nt, Artificial Sequence
  MKO10059696_A_Xcr1
  gRNA
cccugcaucccgcguccaga

SEQ ID NO: 59697 - RNA, 20 nt, Artificial Sequence
  MKO10059697_A_Xcr1
  gRNA
ccugacauggacucagaguc

SEQ ID NO: 59698 - RNA, 20 nt, Artificial Sequence
  MKO10059698_A_Xdh
  gRNA
uucucgaucuccucgacagu

SEQ ID NO: 59699 - RNA, 20 nt, Artificial Sequence
  MKO10059699_A_Xdh
  gRNA
caagccugagccuacugucg

SEQ ID NO: 59700 - RNA, 20 nt, Artificial Sequence
  MKO10059700_A_Xdh
  gRNA
gucauacuuggagaucauca

SEQ ID NO: 59701 - RNA, 20 nt, Artificial Sequence
  MKO10059701_A_Xiap
  gRNA
cagcaugcgaagugguaccc

SEQ ID NO: 59702 - RNA, 20 nt, Artificial Sequence
  MKO10059702_A_Xiap
  gRNA
ccaucgcuaacuaaaaaaau

SEQ ID NO: 59703 - RNA, 20 nt, Artificial Sequence
  MKO10059703_A_Xiap
  gRNA
cacuucgcaugcuguuccca

SEQ ID NO: 59704 - RNA, 20 nt, Artificial Sequence
  MKO10059704_A_Xirp1
  gRNA
ggggcgccccuacauacgga

SEQ ID NO: 59705 - RNA, 20 nt, Artificial Sequence
  MKO10059705_A_Xirp1
  gRNA
cggccucucgugaucgccaa

SEQ ID NO: 59706 - RNA, 20 nt, Artificial Sequence
  MKO10059706_A_Xirp1
  gRNA
ucccccgaaucacccgcacc

SEQ ID NO: 59707 - RNA, 20 nt, Artificial Sequence
  MKO10059707_A_Xirp2
  gRNA
caccccgugaaacagcugcc

SEQ ID NO: 59708 - RNA, 20 nt, Artificial Sequence
  MKO10059708_A_Xirp2
  gRNA
uuacauuagccgagaagcug

SEQ ID NO: 59709 - RNA, 20 nt, Artificial Sequence
  MKO10059709_A_Xirp2
  gRNA
ucagaugugugcaccgugcc

SEQ ID NO: 59710 - RNA, 20 nt, Artificial Sequence
  MKO10059710_A_Xkr4
  gRNA
ucccacauccgcgaaguaca

SEQ ID NO: 59711 - RNA, 20 nt, Artificial Sequence
  MKO10059711_A_Xkr4
  gRNA
uucguccuuccacgccgcag

SEQ ID NO: 59712 - RNA, 20 nt, Artificial Sequence
  MKO10059712_A_Xkr4
  gRNA
augacugauucuucaauccg

SEQ ID NO: 59713 - RNA, 20 nt, Artificial Sequence
  MKO10059713_A_Xkr5
  gRNA
cuaauauuggccacgguaac

SEQ ID NO: 59714 - RNA, 20 nt, Artificial Sequence
  MKO10059714_A_Xkr5
  gRNA
ucugccgaguuuaccgugug

SEQ ID NO: 59715 - RNA, 20 nt, Artificial Sequence
  MKO10059715_A_Xkr5
  gRNA
aguucugcggauaucccacu

SEQ ID NO: 59716 - RNA, 20 nt, Artificial Sequence
  MKO10059716_A_Xkr6
  gRNA
cuggucccccccgucggcgg

SEQ ID NO: 59717 - RNA, 20 nt, Artificial Sequence
  MKO10059717_A_Xkr6
  gRNA
gcaacaccuccucgugcuac

SEQ ID NO: 59718 - RNA, 20 nt, Artificial Sequence
  MKO10059718_A_Xkr6
  gRNA
uagcccaguagaagcgccgc

SEQ ID NO: 59719 - RNA, 20 nt, Artificial Sequence
  MKO10059719_A_Xkr7
  gRNA
cuacgacuacucggagcccg

SEQ ID NO: 59720 - RNA, 20 nt, Artificial Sequence
  MKO10059720_A_Xkr7
  gRNA
cgccgcuccauccgacuucg

SEQ ID NO: 59721 - RNA, 20 nt, Artificial Sequence
  MKO10059721_A_Xkr7
  gRNA
ggcaagucaauccgaaugac

SEQ ID NO: 59722 - RNA, 20 nt, Artificial Sequence
  MKO10059722_A_Xkr8
  gRNA
cuuagacguggucguaggcc

SEQ ID NO: 59723 - RNA, 20 nt, Artificial Sequence
  MKO10059723_A_Xkr8
  gRNA
gugucugggggccgcacucg

SEQ ID NO: 59724 - RNA, 20 nt, Artificial Sequence
  MKO10059724_A_Xkr8
  gRNA
aaggacgcgagagcugcgaa

SEQ ID NO: 59725 - RNA, 20 nt, Artificial Sequence
  MKO10059725_A_Xkr9
  gRNA
cccgauaaaaaucuucuccg

SEQ ID NO: 59726 - RNA, 20 nt, Artificial Sequence
  MKO10059726_A_Xkr9
  gRNA
agaacuaugguggcacuaau

SEQ ID NO: 59727 - RNA, 20 nt, Artificial Sequence
  MKO10059727_A_Xkr9
  gRNA
ccaccgacuugagcaugcuc

SEQ ID NO: 59728 - RNA, 20 nt, Artificial Sequence
  MKO10059728_A_Xkrx
  gRNA
auugcacaggguagccccgu

SEQ ID NO: 59729 - RNA, 20 nt, Artificial Sequence
  MKO10059729_A_Xkrx
  gRNA
gggccacuccauccggaccc

SEQ ID NO: 59730 - RNA, 20 nt, Artificial Sequence
  MKO10059730_A_Xkrx
  gRNA
aaucugugacauacguuugu

SEQ ID NO: 59731 - RNA, 20 nt, Artificial Sequence
  MKO10059731_A_Xk
  gRNA
gaacacggacgcuaucaccg

SEQ ID NO: 59732 - RNA, 20 nt, Artificial Sequence
  MKO10059732_A_Xk
  gRNA
uaccaguaaagugauccccg

SEQ ID NO: 59733 - RNA, 20 nt, Artificial Sequence
  MKO10059733_A_Xk
  gRNA
ccucagccgcgaucgcccac

SEQ ID NO: 59734 - RNA, 20 nt, Artificial Sequence
  MKO10059734_A_Xlr3a
  gRNA
accccuaccucuguucacac

SEQ ID NO: 59735 - RNA, 20 nt, Artificial Sequence
  MKO10059735_A_Xlr3a
  gRNA
aacagagaaguccuugaugc

SEQ ID NO: 59736 - RNA, 20 nt, Artificial Sequence
  MKO10059736_A_Xlr3a
  gRNA
cuguugccucucuguuccug

SEQ ID NO: 59737 - RNA, 20 nt, Artificial Sequence
  MKO10059737_A_Xlr3b
  gRNA
cuguugccucucuguuccug

SEQ ID NO: 59738 - RNA, 20 nt, Artificial Sequence
  MKO10059738_A_Xlr3b
  gRNA
aacagagaaguccuugaugc

SEQ ID NO: 59739 - RNA, 20 nt, Artificial Sequence
  MKO10059739_A_Xlr3b
  gRNA
agaacauaccuucgaauucu

SEQ ID NO: 59740 - RNA, 20 nt, Artificial Sequence
  MKO10059740_A_Xlr3c
  gRNA
gccacguaacaaaguucuuc

SEQ ID NO: 59741 - RNA, 20 nt, Artificial Sequence
  MKO10059741_A_Xlr3c
  gRNA
uccugaagaacuuuguuacg

SEQ ID NO: 59742 - RNA, 20 nt, Artificial Sequence
  MKO10059742_A_Xlr3c
  gRNA
aacagagaaguccuugaugc

SEQ ID NO: 59743 - RNA, 20 nt, Artificial Sequence
  MKO10059743_A_Xlr4a
  gRNA
auucaaugcaggaaacaauc

SEQ ID NO: 59744 - RNA, 20 nt, Artificial Sequence
  MKO10059744_A_Xlr4a
  gRNA
gcuuugguccaccuguucca

SEQ ID NO: 59745 - RNA, 20 nt, Artificial Sequence
  MKO10059745_A_Xlr4a
  gRNA
guaagaaaacucuaaaugaa

SEQ ID NO: 59746 - RNA, 20 nt, Artificial Sequence
  MKO10059746_A_Xlr4b
  gRNA
gcuuugguccaccuguucca

SEQ ID NO: 59747 - RNA, 20 nt, Artificial Sequence
  MKO10059747_A_Xlr4b
  gRNA
auucaaugcaggaaacaauc

SEQ ID NO: 59748 - RNA, 20 nt, Artificial Sequence
  MKO10059748_A_Xlr4b
  gRNA
agucuuaccuucgcucaugc

SEQ ID NO: 59749 - RNA, 20 nt, Artificial Sequence
  MKO10059749_A_Xlr4c
  gRNA
auucaaugcaggaaacaauc

SEQ ID NO: 59750 - RNA, 20 nt, Artificial Sequence
  MKO10059750_A_Xlr4c
  gRNA
gcuuugguccaccuguucca

SEQ ID NO: 59751 - RNA, 20 nt, Artificial Sequence
  MKO10059751_A_Xlr4c
  gRNA
guaagaaaacucuaaaugaa

SEQ ID NO: 59752 - RNA, 20 nt, Artificial Sequence
  MKO10059752_A_Xlr5a
  gRNA
gcagcugacaaaccagcagu

SEQ ID NO: 59753 - RNA, 20 nt, Artificial Sequence
  MKO10059753_A_Xlr5a
  gRNA
gcaugucugauccugaagaa

SEQ ID NO: 59754 - RNA, 20 nt, Artificial Sequence
  MKO10059754_A_Xlr5a
  gRNA
gccuguucagaagaagaugc

SEQ ID NO: 59755 - RNA, 20 nt, Artificial Sequence
  MKO10059755_A_Xlr5b
  gRNA
gcaugucugauccugaagaa

SEQ ID NO: 59756 - RNA, 20 nt, Artificial Sequence
  MKO10059756_A_Xlr5b
  gRNA
gcagcugacaaaccagcagu

SEQ ID NO: 59757 - RNA, 20 nt, Artificial Sequence
  MKO10059757_A_Xlr5b
  gRNA
uccugcaucuucuucugaac

SEQ ID NO: 59758 - RNA, 20 nt, Artificial Sequence
  MKO10059758_A_Xlr5c
  gRNA
gcagcugacaaaccagcagu

SEQ ID NO: 59759 - RNA, 20 nt, Artificial Sequence
  MKO10059759_A_Xlr5c
  gRNA
gcaugucugauccugaagaa

SEQ ID NO: 59760 - RNA, 20 nt, Artificial Sequence
  MKO10059760_A_Xlr5c
  gRNA
gccuguucagaagaagaugc

SEQ ID NO: 59761 - RNA, 20 nt, Artificial Sequence
  MKO10059761_A_Xlr
  gRNA
acgugaaauuagaacaacuu

SEQ ID NO: 59762 - RNA, 20 nt, Artificial Sequence
  MKO10059762_A_Xlr
  gRNA
uucucaucaucacgaguuac

SEQ ID NO: 59763 - RNA, 20 nt, Artificial Sequence
  MKO10059763_A_Xlr
  gRNA
gcaaauccugaagaaguagu

SEQ ID NO: 59764 - RNA, 20 nt, Artificial Sequence
  MKO10059764_A_Xndr-trpc2
  gRNA
ugagcgguucuuccccgacu

SEQ ID NO: 59765 - RNA, 20 nt, Artificial Sequence
  MKO10059765_A_Xndr-trpc2
  gRNA
ggucaaucgaagucgauccc

SEQ ID NO: 59766 - RNA, 20 nt, Artificial Sequence
  MKO10059766_A_Xndr-trpc2
  gRNA
aacgcacucguaggaaggcc

SEQ ID NO: 59767 - RNA, 20 nt, Artificial Sequence
  MKO10059767_A_Xndr
  gRNA
aguucguaaacuuuacgucg

SEQ ID NO: 59768 - RNA, 20 nt, Artificial Sequence
  MKO10059768_A_Xndr
  gRNA
cgacguaaaguuuacgaacu

SEQ ID NO: 59769 - RNA, 20 nt, Artificial Sequence
  MKO10059769_A_Xndr
  gRNA
ugagcgguucuuccccgacu

SEQ ID NO: 59770 - RNA, 20 nt, Artificial Sequence
  MKO10059770_A_Xpa
  gRNA
uucacaaggaaccugagcgc

SEQ ID NO: 59771 - RNA, 20 nt, Artificial Sequence
  MKO10059771_A_Xpa
  gRNA
caccugcagcugucacacgu

SEQ ID NO: 59772 - RNA, 20 nt, Artificial Sequence
  MKO10059772_A_Xpa
  gRNA
uucucuugcagggcccguca

SEQ ID NO: 59773 - RNA, 20 nt, Artificial Sequence
  MKO10059773_A_Xpc
  gRNA
aguuugagacauaccugcgg

SEQ ID NO: 59774 - RNA, 20 nt, Artificial Sequence
  MKO10059774_A_Xpc
  gRNA
aacgcuucaucauccuccgc

SEQ ID NO: 59775 - RNA, 20 nt, Artificial Sequence
  MKO10059775_A_Xpc
  gRNA
aaggaggaagcacucagcga

SEQ ID NO: 59776 - RNA, 20 nt, Artificial Sequence
  MKO10059776_A_Xpnpep1
  gRNA
cucuucaagggcgaaucgcc

SEQ ID NO: 59777 - RNA, 20 nt, Artificial Sequence
  MKO10059777_A_Xpnpep1
  gRNA
guagcgcccgucaguccaca

SEQ ID NO: 59778 - RNA, 20 nt, Artificial Sequence
  MKO10059778_A_Xpnpep1
  gRNA
aaacgcccuccgacagucac

SEQ ID NO: 59779 - RNA, 20 nt, Artificial Sequence
  MKO10059779_A_Xpnpep2
  gRNA
cugaguccaguaacgacuau

SEQ ID NO: 59780 - RNA, 20 nt, Artificial Sequence
  MKO10059780_A_Xpnpep2
  gRNA
cgauagucguuacuggacuc

SEQ ID NO: 59781 - RNA, 20 nt, Artificial Sequence
  MKO10059781_A_Xpnpep2
  gRNA
aagccgcauuguuguauuga

SEQ ID NO: 59782 - RNA, 20 nt, Artificial Sequence
  MKO10059782_A_Xpnpep3
  gRNA
ugaagccuuucuuuacgcga

SEQ ID NO: 59783 - RNA, 20 nt, Artificial Sequence
  MKO10059783_A_Xpnpep3
  gRNA
gcucaccuucgcguaaagaa

SEQ ID NO: 59784 - RNA, 20 nt, Artificial Sequence
  MKO10059784_A_Xpnpep3
  gRNA
ggcuucauccacuccgguua

SEQ ID NO: 59785 - RNA, 20 nt, Artificial Sequence
  MKO10059785_A_Xpo1
  gRNA
ucgacccguguccaagcauc

SEQ ID NO: 59786 - RNA, 20 nt, Artificial Sequence
  MKO10059786_A_Xpo1
  gRNA
cucugacccaacuuguguag

SEQ ID NO: 59787 - RNA, 20 nt, Artificial Sequence
  MKO10059787_A_Xpo1
  gRNA
uuccuuaccucuacacaagu

SEQ ID NO: 59788 - RNA, 20 nt, Artificial Sequence
  MKO10059788_A_Xpo4
  gRNA
aaccgcuuccauuauagcug

SEQ ID NO: 59789 - RNA, 20 nt, Artificial Sequence
  MKO10059789_A_Xpo4
  gRNA
gcgcugcucauuacugacca

SEQ ID NO: 59790 - RNA, 20 nt, Artificial Sequence
  MKO10059790_A_Xpo4
  gRNA
uguccgagaguggguucucu

SEQ ID NO: 59791 - RNA, 20 nt, Artificial Sequence
  MKO10059791_A_Xpo5
  gRNA
gauguucauccuucuccgac

SEQ ID NO: 59792 - RNA, 20 nt, Artificial Sequence
  MKO10059792_A_Xpo5
  gRNA
auggaacagcaugucccgau

SEQ ID NO: 59793 - RNA, 20 nt, Artificial Sequence
  MKO10059793_A_Xpo5
  gRNA
ucagauagaccuucuccaau

SEQ ID NO: 59794 - RNA, 20 nt, Artificial Sequence
  MKO10059794_A_Xpo6
  gRNA
agagcuagcuuguccacgug

SEQ ID NO: 59795 - RNA, 20 nt, Artificial Sequence
  MKO10059795_A_Xpo6
  gRNA
cauggaaaaauuccgucauc

SEQ ID NO: 59796 - RNA, 20 nt, Artificial Sequence
  MKO10059796_A_Xpo6
  gRNA
ugcaaaguuaucguugauau

SEQ ID NO: 59797 - RNA, 20 nt, Artificial Sequence
  MKO10059797_A_Xpo7
  gRNA
agauacaaccacucgacugc

SEQ ID NO: 59798 - RNA, 20 nt, Artificial Sequence
  MKO10059798_A_Xpo7
  gRNA
guuuguccgagacacgagcu

SEQ ID NO: 59799 - RNA, 20 nt, Artificial Sequence
  MKO10059799_A_Xpo7
  gRNA
acgcaaucacagacgucaca

SEQ ID NO: 59800 - RNA, 20 nt, Artificial Sequence
  MKO10059800_A_Xpot
  gRNA
gaagccacgucuguugugau

SEQ ID NO: 59801 - RNA, 20 nt, Artificial Sequence
  MKO10059801_A_Xpot
  gRNA
cucuggcacagaagacauac

SEQ ID NO: 59802 - RNA, 20 nt, Artificial Sequence
  MKO10059802_A_Xpot
  gRNA
uaaagauuuccccagaugcc

SEQ ID NO: 59803 - RNA, 20 nt, Artificial Sequence
  MKO10059803_A_Xpr1
  gRNA
ggauaugcuguauucagcuc

SEQ ID NO: 59804 - RNA, 20 nt, Artificial Sequence
  MKO10059804_A_Xpr1
  gRNA
cacgcuccucgugggacagg

SEQ ID NO: 59805 - RNA, 20 nt, Artificial Sequence
  MKO10059805_A_Xpr1
  gRNA
acugagguagaacucgcuga

SEQ ID NO: 59806 - RNA, 20 nt, Artificial Sequence
  MKO10059806_A_Xrcc1
  gRNA
cggacacuuaccggaagugg

SEQ ID NO: 59807 - RNA, 20 nt, Artificial Sequence
  MKO10059807_A_Xrcc1
  gRNA
cagguccaaaaaugcgaaca

SEQ ID NO: 59808 - RNA, 20 nt, Artificial Sequence
  MKO10059808_A_Xrcc1
  gRNA
caaugauggcucggccuuug

SEQ ID NO: 59809 - RNA, 20 nt, Artificial Sequence
  MKO10059809_A_Xrcc2
  gRNA
cgagccguagcaugucaaag

SEQ ID NO: 59810 - RNA, 20 nt, Artificial Sequence
  MKO10059810_A_Xrcc2
  gRNA
guguagcgacuuucgcagag

SEQ ID NO: 59811 - RNA, 20 nt, Artificial Sequence
  MKO10059811_A_Xrcc2
  gRNA
gcucuuggccucgucguccc

SEQ ID NO: 59812 - RNA, 20 nt, Artificial Sequence
  MKO10059812_A_Xrcc3
  gRNA
gggccaugccccucgacagc

SEQ ID NO: 59813 - RNA, 20 nt, Artificial Sequence
  MKO10059813_A_Xrcc3
  gRNA
acuccggaccagacuugcag

SEQ ID NO: 59814 - RNA, 20 nt, Artificial Sequence
  MKO10059814_A_Xrcc3
  gRNA
gcugcggacagacgcgccug

SEQ ID NO: 59815 - RNA, 20 nt, Artificial Sequence
  MKO10059815_A_Xrcc4
  gRNA
ucauaaagcccaugcuccuc

SEQ ID NO: 59816 - RNA, 20 nt, Artificial Sequence
  MKO10059816_A_Xrcc4
  gRNA
agaucucauuuguuacugcc

SEQ ID NO: 59817 - RNA, 20 nt, Artificial Sequence
  MKO10059817_A_Xrcc4
  gRNA
gccgagacuccuuagaaaag

SEQ ID NO: 59818 - RNA, 20 nt, Artificial Sequence
  MKO10059818_A_Xrcc5
  gRNA
gacuauguuuguccaacgac

SEQ ID NO: 59819 - RNA, 20 nt, Artificial Sequence
  MKO10059819_A_Xrcc5
  gRNA
ggacgcccugauugugugca

SEQ ID NO: 59820 - RNA, 20 nt, Artificial Sequence
  MKO10059820_A_Xrcc5
  gRNA
uacaaauuauaacguccagu

SEQ ID NO: 59821 - RNA, 20 nt, Artificial Sequence
  MKO10059821_A_Xrcc6bp1
  gRNA
cuuugaugcgucuacgucuc

SEQ ID NO: 59822 - RNA, 20 nt, Artificial Sequence
  MKO10059822_A_Xrcc6bp1
  gRNA
ugcccaugugcgccugauuc

SEQ ID NO: 59823 - RNA, 20 nt, Artificial Sequence
  MKO10059823_A_Xrcc6bp1
  gRNA
caaacgcgugaaugagcucg

SEQ ID NO: 59824 - RNA, 20 nt, Artificial Sequence
  MKO10059824_A_Xrcc6
  gRNA
gcuagagcucgaccaguuua

SEQ ID NO: 59825 - RNA, 20 nt, Artificial Sequence
  MKO10059825_A_Xrcc6
  gRNA
cuuuagcacugucacggcca

SEQ ID NO: 59826 - RNA, 20 nt, Artificial Sequence
  MKO10059826_A_Xrcc6
  gRNA
uugauguauccguguucuac

SEQ ID NO: 59827 - RNA, 20 nt, Artificial Sequence
  MKO10059827_A_Xrn1
  gRNA
uaaaacgccucccgcguugc

SEQ ID NO: 59828 - RNA, 20 nt, Artificial Sequence
  MKO10059828_A_Xrn1
  gRNA
uuuaccuggcguaauacagu

SEQ ID NO: 59829 - RNA, 20 nt, Artificial Sequence
  MKO10059829_A_Xrn1
  gRNA
gauuccaacuguauuacgcc

SEQ ID NO: 59830 - RNA, 20 nt, Artificial Sequence
  MKO10059830_A_Xrn2
  gRNA
uuagguuuacuggcaucaac

SEQ ID NO: 59831 - RNA, 20 nt, Artificial Sequence
  MKO10059831_A_Xrn2
  gRNA
aaaugaaucagcagcguuca

SEQ ID NO: 59832 - RNA, 20 nt, Artificial Sequence
  MKO10059832_A_Xrn2
  gRNA
gccauguagagaagucuucu

SEQ ID NO: 59833 - RNA, 20 nt, Artificial Sequence
  MKO10059833_A_Xrra1
  gRNA
cuuugcacuaucaacgugag

SEQ ID NO: 59834 - RNA, 20 nt, Artificial Sequence
  MKO10059834_A_Xrra1
  gRNA
gcagcuaaggcauccaccga

SEQ ID NO: 59835 - RNA, 20 nt, Artificial Sequence
  MKO10059835_A_Xrra1
  gRNA
aagaagguuucuuucgauac

SEQ ID NO: 59836 - RNA, 20 nt, Artificial Sequence
  MKO10059836_A_Xxylt1
  gRNA
gcugcgccucgccaaauucg

SEQ ID NO: 59837 - RNA, 20 nt, Artificial Sequence
  MKO10059837_A_Xxylt1
  gRNA
caccucgugcgccucgaauu

SEQ ID NO: 59838 - RNA, 20 nt, Artificial Sequence
  MKO10059838_A_Xxylt1
  gRNA
agauaagcucuuccccgucg

SEQ ID NO: 59839 - RNA, 20 nt, Artificial Sequence
  MKO10059839_A_Xylb
  gRNA
guaccuacccaaauuccgga

SEQ ID NO: 59840 - RNA, 20 nt, Artificial Sequence
  MKO10059840_A_Xylb
  gRNA
agaguugaacgucuucuaug

SEQ ID NO: 59841 - RNA, 20 nt, Artificial Sequence
  MKO10059841_A_Xylb
  gRNA
ucucaaguucuagccuuauc

SEQ ID NO: 59842 - RNA, 20 nt, Artificial Sequence
  MKO10059842_A_Xylt1
  gRNA
aaccuacugucgccacaagc

SEQ ID NO: 59843 - RNA, 20 nt, Artificial Sequence
  MKO10059843_A_Xylt1
  gRNA
uaaguccaagcauugucgcc

SEQ ID NO: 59844 - RNA, 20 nt, Artificial Sequence
  MKO10059844_A_Xylt1
  gRNA
cacuugccgaugcagguaau

SEQ ID NO: 59845 - RNA, 20 nt, Artificial Sequence
  MKO10059845_A_Xylt2
  gRNA
cccgcacauucucguagugc

SEQ ID NO: 59846 - RNA, 20 nt, Artificial Sequence
  MKO10059846_A_Xylt2
  gRNA
gugccacugacuauccaacg

SEQ ID NO: 59847 - RNA, 20 nt, Artificial Sequence
  MKO10059847_A_Xylt2
  gRNA
ccgccgcuccgcucagguuc

SEQ ID NO: 59848 - RNA, 20 nt, Artificial Sequence
  MKO10059848_A_Yae1d1
  gRNA
guuccgucagaccaagcgaa

SEQ ID NO: 59849 - RNA, 20 nt, Artificial Sequence
  MKO10059849_A_Yae1d1
  gRNA
cguuacugucaccuuucgcu

SEQ ID NO: 59850 - RNA, 20 nt, Artificial Sequence
  MKO10059850_A_Yae1d1
  gRNA
ucuccagggcucgcguucuc

SEQ ID NO: 59851 - RNA, 20 nt, Artificial Sequence
  MKO10059851_A_Yaf2
  gRNA
ggaggcuucuccccgcggcg

SEQ ID NO: 59852 - RNA, 20 nt, Artificial Sequence
  MKO10059852_A_Yaf2
  gRNA
gugcugaucgccagcagcgc

SEQ ID NO: 59853 - RNA, 20 nt, Artificial Sequence
  MKO10059853_A_Yaf2
  gRNA
gcggcagccgaagcccgccu

SEQ ID NO: 59854 - RNA, 20 nt, Artificial Sequence
  MKO10059854_A_Yap1
  gRNA
auacccuuaccugucgcgag

SEQ ID NO: 59855 - RNA, 20 nt, Artificial Sequence
  MKO10059855_A_Yap1
  gRNA
ccaaggcuggacccucguuu

SEQ ID NO: 59856 - RNA, 20 nt, Artificial Sequence
  MKO10059856_A_Yap1
  gRNA
gcccaagucccacucgcgac

SEQ ID NO: 59857 - RNA, 20 nt, Artificial Sequence
  MKO10059857_A_Yars2
  gRNA
ccuuacccucgagggccauc

SEQ ID NO: 59858 - RNA, 20 nt, Artificial Sequence
  MKO10059858_A_Yars2
  gRNA
agguaucggaugauaacaga

SEQ ID NO: 59859 - RNA, 20 nt, Artificial Sequence
  MKO10059859_A_Yars2
  gRNA
ugcaugaugugaucgaucuc

SEQ ID NO: 59860 - RNA, 20 nt, Artificial Sequence
  MKO10059860_A_Yars
  gRNA
ucugaucaacaccgccgaac

SEQ ID NO: 59861 - RNA, 20 nt, Artificial Sequence
  MKO10059861_A_Yars
  gRNA
uuaaaaguagacgcccaguu

SEQ ID NO: 59862 - RNA, 20 nt, Artificial Sequence
  MKO10059862_A_Yars
  gRNA
ggagaguauuggcgugcccu

SEQ ID NO: 59863 - RNA, 20 nt, Artificial Sequence
  MKO10059863_A_Ybey
  gRNA
ggagccuagcucccguguag

SEQ ID NO: 59864 - RNA, 20 nt, Artificial Sequence
  MKO10059864_A_Ybey
  gRNA
ggaggagcugagccgcuaca

SEQ ID NO: 59865 - RNA, 20 nt, Artificial Sequence
  MKO10059865_A_Ybey
  gRNA
ucucccagauuauaaucauc

SEQ ID NO: 59866 - RNA, 20 nt, Artificial Sequence
  MKO10059866_A_Ybx1
  gRNA
aacaacgccggcccuaucgc

SEQ ID NO: 59867 - RNA, 20 nt, Artificial Sequence
  MKO10059867_A_Ybx1
  gRNA
gucuuacaggaaugacacca

SEQ ID NO: 59868 - RNA, 20 nt, Artificial Sequence
  MKO10059868_A_Ybx1
  gRNA
cagucaaaugguucaaugua

SEQ ID NO: 59869 - RNA, 20 nt, Artificial Sequence
  MKO10059869_A_Ybx2
  gRNA
cggggcagcgaccuagacga

SEQ ID NO: 59870 - RNA, 20 nt, Artificial Sequence
  MKO10059870_A_Ybx2
  gRNA
cuccggaaccuacgucgauu

SEQ ID NO: 59871 - RNA, 20 nt, Artificial Sequence
  MKO10059871_A_Ybx2
  gRNA
ugaugaauccguaaccauuc

SEQ ID NO: 59872 - RNA, 20 nt, Artificial Sequence
  MKO10059872_A_Ybx3
  gRNA
ccgccgggcucuuaggcgcg

SEQ ID NO: 59873 - RNA, 20 nt, Artificial Sequence
  MKO10059873_A_Ybx3
  gRNA
cggcggcaccacgcucccgc

SEQ ID NO: 59874 - RNA, 20 nt, Artificial Sequence
  MKO10059874_A_Ybx3
  gRNA
acgcaaguaucugcgcagug

SEQ ID NO: 59875 - RNA, 20 nt, Artificial Sequence
  MKO10059875_A_Ydjc
  gRNA
ccaccggacggcccucagac

SEQ ID NO: 59876 - RNA, 20 nt, Artificial Sequence
  MKO10059876_A_Ydjc
  gRNA
cgcgaugcccgggccgcaau

SEQ ID NO: 59877 - RNA, 20 nt, Artificial Sequence
  MKO10059877_A_Ydjc
  gRNA
gccgaggcgcugcaggcgua

SEQ ID NO: 59878 - RNA, 20 nt, Artificial Sequence
  MKO10059878_A_Yeaus2
  gRNA
cauuccguaguucccguuug

SEQ ID NO: 59879 - RNA, 20 nt, Artificial Sequence
  MKO10059879_A_Yeaus2
  gRNA
ggaacagcgaccgagccgaa

SEQ ID NO: 59880 - RNA, 20 nt, Artificial Sequence
  MKO10059880_A_Yeaus2
  gRNA
gcaaacuauuaugccuccgc

SEQ ID NO: 59881 - RNA, 20 nt, Artificial Sequence
  MKO10059881_A_Yeaus4
  gRNA
aucguuaagccaaucguuua

SEQ ID NO: 59882 - RNA, 20 nt, Artificial Sequence
  MKO10059882_A_Yeaus4
  gRNA
auaaacgauuggcuuaacga

SEQ ID NO: 59883 - RNA, 20 nt, Artificial Sequence
  MKO10059883_A_Yeaus4
  gRNA
guuacucacaggucucucgu

SEQ ID NO: 59884 - RNA, 20 nt, Artificial Sequence
  MKO10059884_A_Yes1
  gRNA
gcaggcacuacguaauugcu

SEQ ID NO: 59885 - RNA, 20 nt, Artificial Sequence
  MKO10059885_A_Yes1
  gRNA
cccucaccucaucccaauca

SEQ ID NO: 59886 - RNA, 20 nt, Artificial Sequence
  MKO10059886_A_Yes1
  gRNA
agguggugucacuauauuug

SEQ ID NO: 59887 - RNA, 20 nt, Artificial Sequence
  MKO10059887_A_Yif1a
  gRNA
ccacuuguaucaucgaagag

SEQ ID NO: 59888 - RNA, 20 nt, Artificial Sequence
  MKO10059888_A_Yif1a
  gRNA
ccacucuucgaugauacaag

SEQ ID NO: 59889 - RNA, 20 nt, Artificial Sequence
  MKO10059889_A_Yif1a
  gRNA
cccuagcuucuuagcgacau

SEQ ID NO: 59890 - RNA, 20 nt, Artificial Sequence
  MKO10059890_A_Yif1b
  gRNA
cccguagaccaucgccaugu

SEQ ID NO: 59891 - RNA, 20 nt, Artificial Sequence
  MKO10059891_A_Yif1b
  gRNA
aucuaaagcaugcacgcgac

SEQ ID NO: 59892 - RNA, 20 nt, Artificial Sequence
  MKO10059892_A_Yif1b
  gRNA
cccuauguccaacauggcga

SEQ ID NO: 59893 - RNA, 20 nt, Artificial Sequence
  MKO10059893_A_Yipf1
  gRNA
caacgacucugacgagaccg

SEQ ID NO: 59894 - RNA, 20 nt, Artificial Sequence
  MKO10059894_A_Yipf1
  gRNA
uucauuccagaauuuggcga

SEQ ID NO: 59895 - RNA, 20 nt, Artificial Sequence
  MKO10059895_A_Yipf1
  gRNA
cgcagcaauccagaucucua

SEQ ID NO: 59896 - RNA, 20 nt, Artificial Sequence
  MKO10059896_A_Yipf2
  gRNA
agaaaccgucccgaccuaua

SEQ ID NO: 59897 - RNA, 20 nt, Artificial Sequence
  MKO10059897_A_Yipf2
  gRNA
gauggugccgcacaaaguug

SEQ ID NO: 59898 - RNA, 20 nt, Artificial Sequence
  MKO10059898_A_Yipf2
  gRNA
ucggcuuacccuuguggaac

SEQ ID NO: 59899 - RNA, 20 nt, Artificial Sequence
  MKO10059899_A_Yipf3
  gRNA
aaagucgcgggcgagcucua

SEQ ID NO: 59900 - RNA, 20 nt, Artificial Sequence
  MKO10059900_A_Yipf3
  gRNA
uaaaggacaacugagccggc

SEQ ID NO: 59901 - RNA, 20 nt, Artificial Sequence
  MKO10059901_A_Yipf3
  gRNA
guccaugaucccuaucaaga

SEQ ID NO: 59902 - RNA, 20 nt, Artificial Sequence
  MKO10059902_A_Yipf4
  gRNA
ugaaaucuccgcuuacaccg

SEQ ID NO: 59903 - RNA, 20 nt, Artificial Sequence
  MKO10059903_A_Yipf4
  gRNA
ucugaugccaaugccaucgc

SEQ ID NO: 59904 - RNA, 20 nt, Artificial Sequence
  MKO10059904_A_Yipf4
  gRNA
ugucuauuaaaacccagcga

SEQ ID NO: 59905 - RNA, 20 nt, Artificial Sequence
  MKO10059905_A_Yipf5
  gRNA
guauacgggaucagugcgau

SEQ ID NO: 59906 - RNA, 20 nt, Artificial Sequence
  MKO10059906_A_Yipf5
  gRNA
gaggagcccccucuguuaga

SEQ ID NO: 59907 - RNA, 20 nt, Artificial Sequence
  MKO10059907_A_Yipf5
  gRNA
cuaacuuaccaguaacagug

SEQ ID NO: 59908 - RNA, 20 nt, Artificial Sequence
  MKO10059908_A_Yipf6
  gRNA
auguucuugagcacgagcuc

SEQ ID NO: 59909 - RNA, 20 nt, Artificial Sequence
  MKO10059909_A_Yipf6
  gRNA
acuuacaaugguccgacgaa

SEQ ID NO: 59910 - RNA, 20 nt, Artificial Sequence
  MKO10059910_A_Yipf6
  gRNA
acaaauacuucugcgaauuc

SEQ ID NO: 59911 - RNA, 20 nt, Artificial Sequence
  MKO10059911_A_Yipf7
  gRNA
guauacggcaugagugccau

SEQ ID NO: 59912 - RNA, 20 nt, Artificial Sequence
  MKO10059912_A_Yipf7
  gRNA
agcugcccuccguaaucuga

SEQ ID NO: 59913 - RNA, 20 nt, Artificial Sequence
  MKO10059913_A_Yipf7
  gRNA
cauuggguuuagcaccguca

SEQ ID NO: 59914 - RNA, 20 nt, Artificial Sequence
  MKO10059914_A_Ykt6
  gRNA
ccggcuacaauccaguacac

SEQ ID NO: 59915 - RNA, 20 nt, Artificial Sequence
  MKO10059915_A_Ykt6
  gRNA
ggacgagaccaaaaucauuc

SEQ ID NO: 59916 - RNA, 20 nt, Artificial Sequence
  MKO10059916_A_Ykt6
  gRNA
gaucguccaggccuguguac

SEQ ID NO: 59917 - RNA, 20 nt, Artificial Sequence
  MKO10059917_A_Ylpm1
  gRNA
ucgagucuuucucgcucaau

SEQ ID NO: 59918 - RNA, 20 nt, Artificial Sequence
  MKO10059918_A_Ylpm1
  gRNA
cguggccagauaauuaaccg

SEQ ID NO: 59919 - RNA, 20 nt, Artificial Sequence
  MKO10059919_A_Ylpm1
  gRNA
aguuucuuggaagguccgag

SEQ ID NO: 59920 - RNA, 20 nt, Artificial Sequence
  MKO10059920_A_Yme1l1
  gRNA
uacguuccucuagcuuguac

SEQ ID NO: 59921 - RNA, 20 nt, Artificial Sequence
  MKO10059921_A_Yme1l1
  gRNA
aauaugagauguaugccaac

SEQ ID NO: 59922 - RNA, 20 nt, Artificial Sequence
  MKO10059922_A_Yme1l1
  gRNA
uuaacuauuaccucacuacu

SEQ ID NO: 59923 - RNA, 20 nt, Artificial Sequence
  MKO10059923_A_Yod1
  gRNA
gccggccggccgacacuaug

SEQ ID NO: 59924 - RNA, 20 nt, Artificial Sequence
  MKO10059924_A_Yod1
  gRNA
gcuaucaccggcaucgcucc

SEQ ID NO: 59925 - RNA, 20 nt, Artificial Sequence
  MKO10059925_A_Yod1
  gRNA
uaccaguguguacuaugucg

SEQ ID NO: 59926 - RNA, 20 nt, Artificial Sequence
  MKO10059926_A_Ypel1
  gRNA
cugcaugcagcccgguuaga

SEQ ID NO: 59927 - RNA, 20 nt, Artificial Sequence
  MKO10059927_A_Ypel1
  gRNA
cacguauuuccacccgagug

SEQ ID NO: 59928 - RNA, 20 nt, Artificial Sequence
  MKO10059928_A_Ypel1
  gRNA
ucacgaugagcuuaucucca

SEQ ID NO: 59929 - RNA, 20 nt, Artificial Sequence
  MKO10059929_A_Ypel2
  gRNA
ggaaaugaguucgucgugau

SEQ ID NO: 59930 - RNA, 20 nt, Artificial Sequence
  MKO10059930_A_Ypel2
  gRNA
ucacgacgaacucauuucca

SEQ ID NO: 59931 - RNA, 20 nt, Artificial Sequence
  MKO10059931_A_Ypel2
  gRNA
aggcucgcccuugacuuccc

SEQ ID NO: 59932 - RNA, 20 nt, Artificial Sequence
  MKO10059932_A_Ypel3
  gRNA
ccuacuuggaugacugucac

SEQ ID NO: 59933 - RNA, 20 nt, Artificial Sequence
  MKO10059933_A_Ypel3
  gRNA
uucaaagcccaagacguuuc

SEQ ID NO: 59934 - RNA, 20 nt, Artificial Sequence
  MKO10059934_A_Ypel3
  gRNA
aggcacgucccugacugccc

SEQ ID NO: 59935 - RNA, 20 nt, Artificial Sequence
  MKO10059935_A_Ypel4
  gRNA
ggacucacacggaguuaaac

SEQ ID NO: 59936 - RNA, 20 nt, Artificial Sequence
  MKO10059936_A_Ypel4
  gRNA
uccugagacagggucaacgu

SEQ ID NO: 59937 - RNA, 20 nt, Artificial Sequence
  MKO10059937_A_Ypel4
  gRNA
agaaaaugucagcuaccgag

SEQ ID NO: 59938 - RNA, 20 nt, Artificial Sequence
  MKO10059938_A_Ypel5
  gRNA
cacggccuuccuuauaacgc

SEQ ID NO: 59939 - RNA, 20 nt, Artificial Sequence
  MKO10059939_A_Ypel5
  gRNA
cucgaacuagugcacguucc

SEQ ID NO: 59940 - RNA, 20 nt, Artificial Sequence
  MKO10059940_A_Ypel5
  gRNA
agaaucuuucuugaccauau

SEQ ID NO: 59941 - RNA, 20 nt, Artificial Sequence
  MKO10059941_A_Yrdc
  gRNA
agucaaccacaguagagccg

SEQ ID NO: 59942 - RNA, 20 nt, Artificial Sequence
  MKO10059942_A_Yrdc
  gRNA
cgaauaaugccaaacuuucc

SEQ ID NO: 59943 - RNA, 20 nt, Artificial Sequence
  MKO10059943_A_Yrdc
  gRNA
ccuggugauggagcgcuccg

SEQ ID NO: 59944 - RNA, 20 nt, Artificial Sequence
  MKO10059944_A_Ythdc1
  gRNA
ugauuaugacacccgaagug

SEQ ID NO: 59945 - RNA, 20 nt, Artificial Sequence
  MKO10059945_A_Ythdc1
  gRNA
agauggggaacuuaauguuu

SEQ ID NO: 59946 - RNA, 20 nt, Artificial Sequence
  MKO10059946_A_Ythdc1
  gRNA
uacaauucaucauccuguuc

SEQ ID NO: 59947 - RNA, 20 nt, Artificial Sequence
  MKO10059947_A_Ythdc2
  gRNA
gcaaucgcugcuagucgucu

SEQ ID NO: 59948 - RNA, 20 nt, Artificial Sequence
  MKO10059948_A_Ythdc2
  gRNA
acgacuagcagcgauugcug

SEQ ID NO: 59949 - RNA, 20 nt, Artificial Sequence
  MKO10059949_A_Ythdc2
  gRNA
aauaaaggcucuuuccguac

SEQ ID NO: 59950 - RNA, 20 nt, Artificial Sequence
  MKO10059950_A_Ythdf1
  gRNA
agcagccacuucaaccccgc

SEQ ID NO: 59951 - RNA, 20 nt, Artificial Sequence
  MKO10059951_A_Ythdf1
  gRNA
ugaacacggcaacaagcgcc

SEQ ID NO: 59952 - RNA, 20 nt, Artificial Sequence
  MKO10059952_A_Ythdf1
  gRNA
ccggauuggacuguccagaa

SEQ ID NO: 59953 - RNA, 20 nt, Artificial Sequence
  MKO10059953_A_Ythdf2
  gRNA
ccuuaggaacgucaaggucg

SEQ ID NO: 59954 - RNA, 20 nt, Artificial Sequence
  MKO10059954_A_Ythdf2
  gRNA
cgaaccuuacuugagcccac

SEQ ID NO: 59955 - RNA, 20 nt, Artificial Sequence
  MKO10059955_A_Ythdf2
  gRNA
agauuccagucgaaaucuuu

SEQ ID NO: 59956 - RNA, 20 nt, Artificial Sequence
  MKO10059956_A_Ythdf3
  gRNA
ugagcaugguaauaagcguu

SEQ ID NO: 59957 - RNA, 20 nt, Artificial Sequence
  MKO10059957_A_Ythdf3
  gRNA
aagccgguuccccuauuccg

SEQ ID NO: 59958 - RNA, 20 nt, Artificial Sequence
  MKO10059958_A_Ythdf3
  gRNA
ccucaccugauccacgcuag

SEQ ID NO: 59959 - RNA, 20 nt, Artificial Sequence
  MKO10059959_A_Ywhab
  gRNA
ccgaggcgaaucgggugugu

SEQ ID NO: 59960 - RNA, 20 nt, Artificial Sequence
  MKO10059960_A_Ywhab
  gRNA
ccuacacacccgauucgccu

SEQ ID NO: 59961 - RNA, 20 nt, Artificial Sequence
  MKO10059961_A_Ywhab
  gRNA
gcuguggacgucagaaaacc

SEQ ID NO: 59962 - RNA, 20 nt, Artificial Sequence
  MKO10059962_A_Ywhae
  gRNA
ccaacgcaccccauucguuu

SEQ ID NO: 59963 - RNA, 20 nt, Artificial Sequence
  MKO10059963_A_Ywhae
  gRNA
uacgugauaaccugacgcug

SEQ ID NO: 59964 - RNA, 20 nt, Artificial Sequence
  MKO10059964_A_Ywhae
  gRNA
auucccccgaccgugccugc

SEQ ID NO: 59965 - RNA, 20 nt, Artificial Sequence
  MKO10059965_A_Ywhag
  gRNA
gcgcuacgacgauauggccg

SEQ ID NO: 59966 - RNA, 20 nt, Artificial Sequence
  MKO10059966_A_Ywhag
  gRNA
caccgccgucgucgucuugc

SEQ ID NO: 59967 - RNA, 20 nt, Artificial Sequence
  MKO10059967_A_Ywhag
  gRNA
gaugguggaccgcgagcaac

SEQ ID NO: 59968 - RNA, 20 nt, Artificial Sequence
  MKO10059968_A_Ywhah
  gRNA
cgcgcucaccgccuucaugg

SEQ ID NO: 59969 - RNA, 20 nt, Artificial Sequence
  MKO10059969_A_Ywhah
  gRNA
cuaccgggagaagauugaaa

SEQ ID NO: 59970 - RNA, 20 nt, Artificial Sequence
  MKO10059970_A_Ywhah
  gRNA
cgaugaugcuauagcugagc

SEQ ID NO: 59971 - RNA, 20 nt, Artificial Sequence
  MKO10059971_A_Ywhaq
  gRNA
gaaacaauagaaaauuccca

SEQ ID NO: 59972 - RNA, 20 nt, Artificial Sequence
  MKO10059972_A_Ywhaq
  gRNA
ugcaacuaauccagagagua

SEQ ID NO: 59973 - RNA, 20 nt, Artificial Sequence
  MKO10059973_A_Ywhaq
  gRNA
aagcuacuucagcaagauac

SEQ ID NO: 59974 - RNA, 20 nt, Artificial Sequence
  MKO10059974_A_Ywhaz
  gRNA
agucuucuauuugaaaauga

SEQ ID NO: 59975 - RNA, 20 nt, Artificial Sequence
  MKO10059975_A_Ywhaz
  gRNA
gucaucaccagcagcaaccu

SEQ ID NO: 59976 - RNA, 20 nt, Artificial Sequence
  MKO10059976_A_Ywhaz
  gRNA
agcauuugaaaucagcaaaa

SEQ ID NO: 59977 - RNA, 20 nt, Artificial Sequence
  MKO10059977_A_Yy1
  gRNA
cuucuuauuacaaccgucga

SEQ ID NO: 59978 - RNA, 20 nt, Artificial Sequence
  MKO10059978_A_Yy1
  gRNA
cccuaugugugccccuucga

SEQ ID NO: 59979 - RNA, 20 nt, Artificial Sequence
  MKO10059979_A_Yy1
  gRNA
ucaaugccagguaucccucc

SEQ ID NO: 59980 - RNA, 20 nt, Artificial Sequence
  MKO10059980_A_Yy2
  gRNA
agaaagcgugaacgcugacc

SEQ ID NO: 59981 - RNA, 20 nt, Artificial Sequence
  MKO10059981_A_Yy2
  gRNA
guaggugucgauugggcgca

SEQ ID NO: 59982 - RNA, 20 nt, Artificial Sequence
  MKO10059982_A_Yy2
  gRNA
ugauaucgaggcgguuucuc

SEQ ID NO: 59983 - RNA, 20 nt, Artificial Sequence
  MKO10059983_A_Zadh2
  gRNA
uagacuacgucaacgccuuc

SEQ ID NO: 59984 - RNA, 20 nt, Artificial Sequence
  MKO10059984_A_Zadh2
  gRNA
aaagggcgcuugauagugau

SEQ ID NO: 59985 - RNA, 20 nt, Artificial Sequence
  MKO10059985_A_Zadh2
  gRNA
ggcguacgacauguccacga

SEQ ID NO: 59986 - RNA, 20 nt, Artificial Sequence
  MKO10059986_A_Zak
  gRNA
ggaguguguaucgagccaaa

SEQ ID NO: 59987 - RNA, 20 nt, Artificial Sequence
  MKO10059987_A_Zak
  gRNA
guuaccuuuggcuacgucag

SEQ ID NO: 59988 - RNA, 20 nt, Artificial Sequence
  MKO10059988_A_Zak
  gRNA
accugugacgaugccauagu

SEQ ID NO: 59989 - RNA, 20 nt, Artificial Sequence
  MKO10059989_A_Zan
  gRNA
ggccgauggugcacacuucg

SEQ ID NO: 59990 - RNA, 20 nt, Artificial Sequence
  MKO10059990_A_Zan
  gRNA
accuccggcccuauguacuc

SEQ ID NO: 59991 - RNA, 20 nt, Artificial Sequence
  MKO10059991_A_Zan
  gRNA
ccuccauugggguacccccc

SEQ ID NO: 59992 - RNA, 20 nt, Artificial Sequence
  MKO10059992_A_Zap70
  gRNA
gccggaauagaguuugcgcu

SEQ ID NO: 59993 - RNA, 20 nt, Artificial Sequence
  MKO10059993_A_Zap70
  gRNA
gccgagcgcaaacucuauuc

SEQ ID NO: 59994 - RNA, 20 nt, Artificial Sequence
  MKO10059994_A_Zap70
  gRNA
uggacuaauuuaccgcuuga

SEQ ID NO: 59995 - RNA, 20 nt, Artificial Sequence
  MKO10059995_A_Zar1l
  gRNA
uagggcggagagccuugauc

SEQ ID NO: 59996 - RNA, 20 nt, Artificial Sequence
  MKO10059996_A_Zar1l
  gRNA
ccgcccuacuucccaagcuu

SEQ ID NO: 59997 - RNA, 20 nt, Artificial Sequence
  MKO10059997_A_Zar1l
  gRNA
uucacuguaaagauuguaag

SEQ ID NO: 59998 - RNA, 20 nt, Artificial Sequence
  MKO10059998_A_Zar1
  gRNA
ucgaggggcauccgaaucac

SEQ ID NO: 59999 - RNA, 20 nt, Artificial Sequence
  MKO10059999_A_Zar1
  gRNA
uucggaugccccucgagacc

SEQ ID NO: 60000 - RNA, 20 nt, Artificial Sequence
  MKO10060000_A_Zar1
  gRNA
ucccacacaagucuugccga

SEQ ID NO: 60001 - RNA, 20 nt, Artificial Sequence
  MKO10060001_A_Zbbx
  gRNA
ccaccgaacaacucucuuac

SEQ ID NO: 60002 - RNA, 20 nt, Artificial Sequence
  MKO10060002_A_Zbbx
  gRNA
aauagucuucgccacauucc

SEQ ID NO: 60003 - RNA, 20 nt, Artificial Sequence
  MKO10060003_A_Zbbx
  gRNA
cccagcucgccacuguguca

SEQ ID NO: 60004 - RNA, 20 nt, Artificial Sequence
  MKO10060004_A_Zbed3
  gRNA
gcgcgaggcggcccuaaugc

SEQ ID NO: 60005 - RNA, 20 nt, Artificial Sequence
  MKO10060005_A_Zbed3
  gRNA
gcucgaguuccgccugcauu

SEQ ID NO: 60006 - RNA, 20 nt, Artificial Sequence
  MKO10060006_A_Zbed3
  gRNA
ggccaucauacuccgaggcc

SEQ ID NO: 60007 - RNA, 20 nt, Artificial Sequence
  MKO10060007_A_Zbed4
  gRNA
ugucccguucuccaggcauc

SEQ ID NO: 60008 - RNA, 20 nt, Artificial Sequence
  MKO10060008_A_Zbed4
  gRNA
caauacugaaagcauauuaa

SEQ ID NO: 60009 - RNA, 20 nt, Artificial Sequence
  MKO10060009_A_Zbed4
  gRNA
uaagcaagaaacuuguccca

SEQ ID NO: 60010 - RNA, 20 nt, Artificial Sequence
  MKO10060010_A_Zbed6
  gRNA
gcaccggaagcuaacgaagc

SEQ ID NO: 60011 - RNA, 20 nt, Artificial Sequence
  MKO10060011_A_Zbed6
  gRNA
aucuacuacugcuaccgcag

SEQ ID NO: 60012 - RNA, 20 nt, Artificial Sequence
  MKO10060012_A_Zbed6
  gRNA
uauuacucaggcccucaauc

SEQ ID NO: 60013 - RNA, 20 nt, Artificial Sequence
  MKO10060013_A_Zbp1
  gRNA
gaagaucuaccacucacguc

SEQ ID NO: 60014 - RNA, 20 nt, Artificial Sequence
  MKO10060014_A_Zbp1
  gRNA
aguccuuuaccgccugaaga

SEQ ID NO: 60015 - RNA, 20 nt, Artificial Sequence
  MKO10060015_A_Zbp1
  gRNA
gacggcggcccugugaagau

SEQ ID NO: 60016 - RNA, 20 nt, Artificial Sequence
  MKO10060016_A_Zbtb10
  gRNA
aacgcggaaccugaccaacu

SEQ ID NO: 60017 - RNA, 20 nt, Artificial Sequence
  MKO10060017_A_Zbtb10
  gRNA
gugaagucguucaaacuugc

SEQ ID NO: 60018 - RNA, 20 nt, Artificial Sequence
  MKO10060018_A_Zbtb10
  gRNA
cuuggcccacacaagaaacg

SEQ ID NO: 60019 - RNA, 20 nt, Artificial Sequence
  MKO10060019_A_Zbtb11
  gRNA
cgaucgcucccguccaauau

SEQ ID NO: 60020 - RNA, 20 nt, Artificial Sequence
  MKO10060020_A_Zbtb11
  gRNA
accagcucauguuucgacac

SEQ ID NO: 60021 - RNA, 20 nt, Artificial Sequence
  MKO10060021_A_Zbtb11
  gRNA
ugacgucacauugcucaucg

SEQ ID NO: 60022 - RNA, 20 nt, Artificial Sequence
  MKO10060022_A_Zbtb12
  gRNA
gaugcacagcgcgcguauug

SEQ ID NO: 60023 - RNA, 20 nt, Artificial Sequence
  MKO10060023_A_Zbtb12
  gRNA
aacacuguuaccccaccgca

SEQ ID NO: 60024 - RNA, 20 nt, Artificial Sequence
  MKO10060024_A_Zbtb12
  gRNA
uugaacugcuugccgcagcg

SEQ ID NO: 60025 - RNA, 20 nt, Artificial Sequence
  MKO10060025_A_Zbtb14
  gRNA
auguaaaguuccgagcccac

SEQ ID NO: 60026 - RNA, 20 nt, Artificial Sequence
  MKO10060026_A_Zbtb14
  gRNA
gggcacucccccgagucaag

SEQ ID NO: 60027 - RNA, 20 nt, Artificial Sequence
  MKO10060027_A_Zbtb14
  gRNA
auucugcgacaucgccaucg

SEQ ID NO: 60028 - RNA, 20 nt, Artificial Sequence
  MKO10060028_A_Zbtb16
  gRNA
cccuguagugcgucuccaac

SEQ ID NO: 60029 - RNA, 20 nt, Artificial Sequence
  MKO10060029_A_Zbtb16
  gRNA
uauagcugcgcacgccugcg

SEQ ID NO: 60030 - RNA, 20 nt, Artificial Sequence
  MKO10060030_A_Zbtb16
  gRNA
gccuaccuguaugugagcga

SEQ ID NO: 60031 - RNA, 20 nt, Artificial Sequence
  MKO10060031_A_Zbtb17
  gRNA
ggacucagugcgauccccgu

SEQ ID NO: 60032 - RNA, 20 nt, Artificial Sequence
  MKO10060032_A_Zbtb17
  gRNA
ggagggucagaaccugcgcu

SEQ ID NO: 60033 - RNA, 20 nt, Artificial Sequence
  MKO10060033_A_Zbtb17
  gRNA
ugcagccgccaugcugcuug

SEQ ID NO: 60034 - RNA, 20 nt, Artificial Sequence
  MKO10060034_A_Zbtb18
  gRNA
ccgggcacaccgagcuguuc

SEQ ID NO: 60035 - RNA, 20 nt, Artificial Sequence
  MKO10060035_A_Zbtb18
  gRNA
ccugcgcucgcaccacuugc

SEQ ID NO: 60036 - RNA, 20 nt, Artificial Sequence
  MKO10060036_A_Zbtb18
  gRNA
aucaaguuuauguguccuaa

SEQ ID NO: 60037 - RNA, 20 nt, Artificial Sequence
  MKO10060037_A_Zbtb1
  gRNA
gaacgugugucucgacgcuu

SEQ ID NO: 60038 - RNA, 20 nt, Artificial Sequence
  MKO10060038_A_Zbtb1
  gRNA
cggcguauucaccguugaac

SEQ ID NO: 60039 - RNA, 20 nt, Artificial Sequence
  MKO10060039_A_Zbtb1
  gRNA
accucguauguccaucagcg

SEQ ID NO: 60040 - RNA, 20 nt, Artificial Sequence
  MKO10060040_A_Zbtb20
  gRNA
gacgugacgguucgcaucca

SEQ ID NO: 60041 - RNA, 20 nt, Artificial Sequence
  MKO10060041_A_Zbtb20
  gRNA
ucgcaucgugucacagaacg

SEQ ID NO: 60042 - RNA, 20 nt, Artificial Sequence
  MKO10060042_A_Zbtb20
  gRNA
ccgcgcggguccgccaggcg

SEQ ID NO: 60043 - RNA, 20 nt, Artificial Sequence
  MKO10060043_A_Zbtb21
  gRNA
cguuccggcacaagcgcucg

SEQ ID NO: 60044 - RNA, 20 nt, Artificial Sequence
  MKO10060044_A_Zbtb21
  gRNA
uuuagcagagaacuucgccc

SEQ ID NO: 60045 - RNA, 20 nt, Artificial Sequence
  MKO10060045_A_Zbtb21
  gRNA
ccauagacagugaccgccug

SEQ ID NO: 60046 - RNA, 20 nt, Artificial Sequence
  MKO10060046_A_Zbtb22
  gRNA
gacgggaguuccgcgcucac

SEQ ID NO: 60047 - RNA, 20 nt, Artificial Sequence
  MKO10060047_A_Zbtb22
  gRNA
cacugcauucguacggcuug

SEQ ID NO: 60048 - RNA, 20 nt, Artificial Sequence
  MKO10060048_A_Zbtb22
  gRNA
cucccgucccugcacgcgga

SEQ ID NO: 60049 - RNA, 20 nt, Artificial Sequence
  MKO10060049_A_Zbtb24
  gRNA
ggucagcgccuugccgcaca

SEQ ID NO: 60050 - RNA, 20 nt, Artificial Sequence
  MKO10060050_A_Zbtb24
  gRNA
uaccuguauggacacgauaa

SEQ ID NO: 60051 - RNA, 20 nt, Artificial Sequence
  MKO10060051_A_Zbtb24
  gRNA
gggacacguccauaaacuuu

SEQ ID NO: 60052 - RNA, 20 nt, Artificial Sequence
  MKO10060052_A_Zbtb25
  gRNA
gacaccgaacgggagagauc

SEQ ID NO: 60053 - RNA, 20 nt, Artificial Sequence
  MKO10060053_A_Zbtb25
  gRNA
gugccucggcucgagugcuc

SEQ ID NO: 60054 - RNA, 20 nt, Artificial Sequence
  MKO10060054_A_Zbtb25
  gRNA
cugaacaugcagcgagaauu

SEQ ID NO: 60055 - RNA, 20 nt, Artificial Sequence
  MKO10060055_A_Zbtb26
  gRNA
aauuacgcccucucuuacac

SEQ ID NO: 60056 - RNA, 20 nt, Artificial Sequence
  MKO10060056_A_Zbtb26
  gRNA
uugucuacaccucgaauauu

SEQ ID NO: 60057 - RNA, 20 nt, Artificial Sequence
  MKO10060057_A_Zbtb26
  gRNA
gugugcaccguucuacaaug

SEQ ID NO: 60058 - RNA, 20 nt, Artificial Sequence
  MKO10060058_A_Zbtb2
  gRNA
cuguugcugcccaucgauga

SEQ ID NO: 60059 - RNA, 20 nt, Artificial Sequence
  MKO10060059_A_Zbtb2
  gRNA
ugcugcgcagcgugaagcga

SEQ ID NO: 60060 - RNA, 20 nt, Artificial Sequence
  MKO10060060_A_Zbtb2
  gRNA
acuuuaguuaccuggucuga

SEQ ID NO: 60061 - RNA, 20 nt, Artificial Sequence
  MKO10060061_A_Zbtb32
  gRNA
ucggccucgaggaagaguag

SEQ ID NO: 60062 - RNA, 20 nt, Artificial Sequence
  MKO10060062_A_Zbtb32
  gRNA
guggagcguaugguccaucc

SEQ ID NO: 60063 - RNA, 20 nt, Artificial Sequence
  MKO10060063_A_Zbtb32
  gRNA
ugugcgcuccugacucacac

SEQ ID NO: 60064 - RNA, 20 nt, Artificial Sequence
  MKO10060064_A_Zbtb33
  gRNA
accgaaaauuccgggcccau

SEQ ID NO: 60065 - RNA, 20 nt, Artificial Sequence
  MKO10060065_A_Zbtb33
  gRNA
uuggugcgguauucugcaag

SEQ ID NO: 60066 - RNA, 20 nt, Artificial Sequence
  MKO10060066_A_Zbtb33
  gRNA
ggcgaguuauugcuagcgca

SEQ ID NO: 60067 - RNA, 20 nt, Artificial Sequence
  MKO10060067_A_Zbtb34
  gRNA
ugacaaaccauuccgaugcg

SEQ ID NO: 60068 - RNA, 20 nt, Artificial Sequence
  MKO10060068_A_Zbtb34
  gRNA
aauacggggagcuggcugcg

SEQ ID NO: 60069 - RNA, 20 nt, Artificial Sequence
  MKO10060069_A_Zbtb34
  gRNA
ugcuggcauggaaagcaccc

SEQ ID NO: 60070 - RNA, 20 nt, Artificial Sequence
  MKO10060070_A_Zbtb37
  gRNA
auuauaccggaaccaucguu

SEQ ID NO: 60071 - RNA, 20 nt, Artificial Sequence
  MKO10060071_A_Zbtb37
  gRNA
aacaagaaguguccgaacga

SEQ ID NO: 60072 - RNA, 20 nt, Artificial Sequence
  MKO10060072_A_Zbtb37
  gRNA
gguguagcccuaugagacuc

SEQ ID NO: 60073 - RNA, 20 nt, Artificial Sequence
  MKO10060073_A_Zbtb38
  gRNA
ccaagagauccgcguucucg

SEQ ID NO: 60074 - RNA, 20 nt, Artificial Sequence
  MKO10060074_A_Zbtb38
  gRNA
aucgaaguuaucgacgagau

SEQ ID NO: 60075 - RNA, 20 nt, Artificial Sequence
  MKO10060075_A_Zbtb38
  gRNA
cgauaacuucgauucaacug

SEQ ID NO: 60076 - RNA, 20 nt, Artificial Sequence
  MKO10060076_A_Zbtb39
  gRNA
gguaaugaaguccaccacgu

SEQ ID NO: 60077 - RNA, 20 nt, Artificial Sequence
  MKO10060077_A_Zbtb39
  gRNA
aaugucuaccgcguuaucag

SEQ ID NO: 60078 - RNA, 20 nt, Artificial Sequence
  MKO10060078_A_Zbtb39
  gRNA
acggaccacguggaaaucuu

SEQ ID NO: 60079 - RNA, 20 nt, Artificial Sequence
  MKO10060079_A_Zbtb3
  gRNA
acgauugcaggcccgagcuc

SEQ ID NO: 60080 - RNA, 20 nt, Artificial Sequence
  MKO10060080_A_Zbtb3
  gRNA
ccugggaccguugcucccgc

SEQ ID NO: 60081 - RNA, 20 nt, Artificial Sequence
  MKO10060081_A_Zbtb3
  gRNA
ccucuaccgccacauccgca

SEQ ID NO: 60082 - RNA, 20 nt, Artificial Sequence
  MKO10060082_A_Zbtb40
  gRNA
uccugccagauuccgaaaaa

SEQ ID NO: 60083 - RNA, 20 nt, Artificial Sequence
  MKO10060083_A_Zbtb40
  gRNA
auagaaugucucacgaguga

SEQ ID NO: 60084 - RNA, 20 nt, Artificial Sequence
  MKO10060084_A_Zbtb40
  gRNA
acucgugagacauucuauua

SEQ ID NO: 60085 - RNA, 20 nt, Artificial Sequence
  MKO10060085_A_Zbtb41
  gRNA
uagacuuugucgaauaacgc

SEQ ID NO: 60086 - RNA, 20 nt, Artificial Sequence
  MKO10060086_A_Zbtb41
  gRNA
gaugcuuuaaccgugcaaac

SEQ ID NO: 60087 - RNA, 20 nt, Artificial Sequence
  MKO10060087_A_Zbtb41
  gRNA
guaacgaaguagaguuucau

SEQ ID NO: 60088 - RNA, 20 nt, Artificial Sequence
  MKO10060088_A_Zbtb42
  gRNA
agaucuggagacccguacgc

SEQ ID NO: 60089 - RNA, 20 nt, Artificial Sequence
  MKO10060089_A_Zbtb42
  gRNA
gcucaacggcgacaucguca

SEQ ID NO: 60090 - RNA, 20 nt, Artificial Sequence
  MKO10060090_A_Zbtb42
  gRNA
cguugagccgcaccgugucg

SEQ ID NO: 60091 - RNA, 20 nt, Artificial Sequence
  MKO10060091_A_Zbtb43
  gRNA
cgcagccuacgaugagcacc

SEQ ID NO: 60092 - RNA, 20 nt, Artificial Sequence
  MKO10060092_A_Zbtb43
  gRNA
cgucacauaacuguccuugc

SEQ ID NO: 60093 - RNA, 20 nt, Artificial Sequence
  MKO10060093_A_Zbtb43
  gRNA
cacucacugguucgacaagu

SEQ ID NO: 60094 - RNA, 20 nt, Artificial Sequence
  MKO10060094_A_Zbtb44
  gRNA
ugauaucacuauucgugucc

SEQ ID NO: 60095 - RNA, 20 nt, Artificial Sequence
  MKO10060095_A_Zbtb44
  gRNA
cucaugcagaugacgaugac

SEQ ID NO: 60096 - RNA, 20 nt, Artificial Sequence
  MKO10060096_A_Zbtb44
  gRNA
augcaucgccuaaagcacga

SEQ ID NO: 60097 - RNA, 20 nt, Artificial Sequence
  MKO10060097_A_Zbtb45
  gRNA
guuccuuuacagcggcucgu

SEQ ID NO: 60098 - RNA, 20 nt, Artificial Sequence
  MKO10060098_A_Zbtb45
  gRNA
acuccugugcgcgccccggg

SEQ ID NO: 60099 - RNA, 20 nt, Artificial Sequence
  MKO10060099_A_Zbtb45
  gRNA
uuucucacaccgugcacugc

SEQ ID NO: 60100 - RNA, 20 nt, Artificial Sequence
  MKO10060100_A_Zbtb46
  gRNA
gugagcgcaugugucgcuua

SEQ ID NO: 60101 - RNA, 20 nt, Artificial Sequence
  MKO10060101_A_Zbtb46
  gRNA
gcucuaugcucacaucgaug

SEQ ID NO: 60102 - RNA, 20 nt, Artificial Sequence
  MKO10060102_A_Zbtb46
  gRNA
aagcacggcucucgucgcca

SEQ ID NO: 60103 - RNA, 20 nt, Artificial Sequence
  MKO10060103_A_Zbtb48
  gRNA
cuucacaugcuccguaugcc

SEQ ID NO: 60104 - RNA, 20 nt, Artificial Sequence
  MKO10060104_A_Zbtb48
  gRNA
agcgcagcuccauccuccgu

SEQ ID NO: 60105 - RNA, 20 nt, Artificial Sequence
  MKO10060105_A_Zbtb48
  gRNA
cugugagagaacccgcaccc

SEQ ID NO: 60106 - RNA, 20 nt, Artificial Sequence
  MKO10060106_A_Zbtb49
  gRNA
ggacgacugaaauuugccga

SEQ ID NO: 60107 - RNA, 20 nt, Artificial Sequence
  MKO10060107_A_Zbtb49
  gRNA
ccuuucagguuugcggccuc

SEQ ID NO: 60108 - RNA, 20 nt, Artificial Sequence
  MKO10060108_A_Zbtb49
  gRNA
gcacgagcguucacuucagc

SEQ ID NO: 60109 - RNA, 20 nt, Artificial Sequence
  MKO10060109_A_Zbtb4
  gRNA
caagcgacuacagacccacg

SEQ ID NO: 60110 - RNA, 20 nt, Artificial Sequence
  MKO10060110_A_Zbtb4
  gRNA
cucgucgacacugagccucg

SEQ ID NO: 60111 - RNA, 20 nt, Artificial Sequence
  MKO10060111_A_Zbtb4
  gRNA
ugagcguaggcaccguugug

SEQ ID NO: 60112 - RNA, 20 nt, Artificial Sequence
  MKO10060112_A_Zbtb5
  gRNA
cgacgugaccucccaagcag

SEQ ID NO: 60113 - RNA, 20 nt, Artificial Sequence
  MKO10060113_A_Zbtb5
  gRNA
ggagcuauucgucgguaaua

SEQ ID NO: 60114 - RNA, 20 nt, Artificial Sequence
  MKO10060114_A_Zbtb5
  gRNA
auuccuccauggaggaucgc

SEQ ID NO: 60115 - RNA, 20 nt, Artificial Sequence
  MKO10060115_A_Zbtb6
  gRNA
accacuugaacauacacagu

SEQ ID NO: 60116 - RNA, 20 nt, Artificial Sequence
  MKO10060116_A_Zbtb6
  gRNA
uauuaacgauacugaguucc

SEQ ID NO: 60117 - RNA, 20 nt, Artificial Sequence
  MKO10060117_A_Zbtb6
  gRNA
agauucugccguuugagauc

SEQ ID NO: 60118 - RNA, 20 nt, Artificial Sequence
  MKO10060118_A_Zbtb7a
  gRNA
gaucggcccccagccggcga

SEQ ID NO: 60119 - RNA, 20 nt, Artificial Sequence
  MKO10060119_A_Zbtb7a
  gRNA
caggucguaguugugcgcga

SEQ ID NO: 60120 - RNA, 20 nt, Artificial Sequence
  MKO10060120_A_Zbtb7a
  gRNA
cgcccucugcagcgccugac

SEQ ID NO: 60121 - RNA, 20 nt, Artificial Sequence
  MKO10060121_A_Zbtb7b
  gRNA
cgucauccuugcggcgccuu

SEQ ID NO: 60122 - RNA, 20 nt, Artificial Sequence
  MKO10060122_A_Zbtb7b
  gRNA
uugcggcugcgacgggcaac

SEQ ID NO: 60123 - RNA, 20 nt, Artificial Sequence
  MKO10060123_A_Zbtb7b
  gRNA
ucccaucgaccccgaccuga

SEQ ID NO: 60124 - RNA, 20 nt, Artificial Sequence
  MKO10060124_A_Zbtb7c
  gRNA
cuucgugaugccacccgcgc

SEQ ID NO: 60125 - RNA, 20 nt, Artificial Sequence
  MKO10060125_A_Zbtb7c
  gRNA
ccgcgugccgcugcucguug

SEQ ID NO: 60126 - RNA, 20 nt, Artificial Sequence
  MKO10060126_A_Zbtb7c
  gRNA
gcugccgcauggcacgaccc

SEQ ID NO: 60127 - RNA, 20 nt, Artificial Sequence
  MKO10060127_A_Zbtb8a
  gRNA
ggguaaccguacuuguucca

SEQ ID NO: 60128 - RNA, 20 nt, Artificial Sequence
  MKO10060128_A_Zbtb8a
  gRNA
guuacauagucuguagcgcc

SEQ ID NO: 60129 - RNA, 20 nt, Artificial Sequence
  MKO10060129_A_Zbtb8a
  gRNA
agaggacgggucugccgauc

SEQ ID NO: 60130 - RNA, 20 nt, Artificial Sequence
  MKO10060130_A_Zbtb8b
  gRNA
caccuuagguucaacccguc

SEQ ID NO: 60131 - RNA, 20 nt, Artificial Sequence
  MKO10060131_A_Zbtb8b
  gRNA
cgcucagggcgugacuccga

SEQ ID NO: 60132 - RNA, 20 nt, Artificial Sequence
  MKO10060132_A_Zbtb8b
  gRNA
acagcaauaugccgccccac

SEQ ID NO: 60133 - RNA, 20 nt, Artificial Sequence
  MKO10060133_A_Zbtb8os
  gRNA
aauuucaaguuacgauccau

SEQ ID NO: 60134 - RNA, 20 nt, Artificial Sequence
  MKO10060134_A_Zbtb8os
  gRNA
ucccucagauuuggaucaua

SEQ ID NO: 60135 - RNA, 20 nt, Artificial Sequence
  MKO10060135_A_Zbtb8os
  gRNA
agugaaacagcagagacugc

SEQ ID NO: 60136 - RNA, 20 nt, Artificial Sequence
  MKO10060136_A_Zbtb9
  gRNA
acguucagccuucgcccuuu

SEQ ID NO: 60137 - RNA, 20 nt, Artificial Sequence
  MKO10060137_A_Zbtb9
  gRNA
aagcagucccucgaacgcau

SEQ ID NO: 60138 - RNA, 20 nt, Artificial Sequence
  MKO10060138_A_Zbtb9
  gRNA
cuucgagaacuagaaacguc

SEQ ID NO: 60139 - RNA, 20 nt, Artificial Sequence
  MKO10060139_A_Zbtbd6
  gRNA
ugaguaauugcggccgcgag

SEQ ID NO: 60140 - RNA, 20 nt, Artificial Sequence
  MKO10060140_A_Zbtbd6
  gRNA
ucccuuuaucgcguagccga

SEQ ID NO: 60141 - RNA, 20 nt, Artificial Sequence
  MKO10060141_A_Zbtbd6
  gRNA
cccagaacagacuccgcucg

SEQ ID NO: 60142 - RNA, 20 nt, Artificial Sequence
  MKO10060142_A_Zc2hc1a
  gRNA
guacacaccugggucguaag

SEQ ID NO: 60143 - RNA, 20 nt, Artificial Sequence
  MKO10060143_A_Zc2hc1a
  gRNA
cucgugcuuucgucuccaau

SEQ ID NO: 60144 - RNA, 20 nt, Artificial Sequence
  MKO10060144_A_Zc2hc1a
  gRNA
cggucaaaccucucaaaccc

SEQ ID NO: 60145 - RNA, 20 nt, Artificial Sequence
  MKO10060145_A_Zc2hc1b
  gRNA
uuaaaccuccucauacaaua

SEQ ID NO: 60146 - RNA, 20 nt, Artificial Sequence
  MKO10060146_A_Zc2hc1b
  gRNA
ugcagaaauuaauaugucgu

SEQ ID NO: 60147 - RNA, 20 nt, Artificial Sequence
  MKO10060147_A_Zc2hc1b
  gRNA
uguuggcauaccuugggcug

SEQ ID NO: 60148 - RNA, 20 nt, Artificial Sequence
  MKO10060148_A_Zc2hc1c
  gRNA
guccagcagguaaucgccag

SEQ ID NO: 60149 - RNA, 20 nt, Artificial Sequence
  MKO10060149_A_Zc2hc1c
  gRNA
aggucguggcggagcuccau

SEQ ID NO: 60150 - RNA, 20 nt, Artificial Sequence
  MKO10060150_A_Zc2hc1c
  gRNA
cggcgguggucgguucuuga

SEQ ID NO: 60151 - RNA, 20 nt, Artificial Sequence
  MKO10060151_A_Zc3h10
  gRNA
cucguuugcagacguuccuc

SEQ ID NO: 60152 - RNA, 20 nt, Artificial Sequence
  MKO10060152_A_Zc3h10
  gRNA
gacagcuaugccaacggcac

SEQ ID NO: 60153 - RNA, 20 nt, Artificial Sequence
  MKO10060153_A_Zc3h10
  gRNA
cggagccaaguuacauucgu

SEQ ID NO: 60154 - RNA, 20 nt, Artificial Sequence
  MKO10060154_A_Zc3h11a
  gRNA
ucugcagcguugauuacaac

SEQ ID NO: 60155 - RNA, 20 nt, Artificial Sequence
  MKO10060155_A_Zc3h11a
  gRNA
accagaagccgcuauguuga

SEQ ID NO: 60156 - RNA, 20 nt, Artificial Sequence
  MKO10060156_A_Zc3h11a
  gRNA
ugcucuguugaacugugagc

SEQ ID NO: 60157 - RNA, 20 nt, Artificial Sequence
  MKO10060157_A_Zc3h12a
  gRNA
cuucgaauccgacggagugg

SEQ ID NO: 60158 - RNA, 20 nt, Artificial Sequence
  MKO10060158_A_Zc3h12a
  gRNA
uucacgccauccaggcgggu

SEQ ID NO: 60159 - RNA, 20 nt, Artificial Sequence
  MKO10060159_A_Zc3h12a
  gRNA
augcccccugacgacccuuu

SEQ ID NO: 60160 - RNA, 20 nt, Artificial Sequence
  MKO10060160_A_Zc3h12b
  gRNA
cgccccgaugcaccaauuac

SEQ ID NO: 60161 - RNA, 20 nt, Artificial Sequence
  MKO10060161_A_Zc3h12b
  gRNA
ucgucuucacaccaucgcga

SEQ ID NO: 60162 - RNA, 20 nt, Artificial Sequence
  MKO10060162_A_Zc3h12b
  gRNA
guccaucgcccguaaaccug

SEQ ID NO: 60163 - RNA, 20 nt, Artificial Sequence
  MKO10060163_A_Zc3h12c
  gRNA
aaagaaguauucucgugccg

SEQ ID NO: 60164 - RNA, 20 nt, Artificial Sequence
  MKO10060164_A_Zc3h12c
  gRNA
cgugcuucccucagagucgc

SEQ ID NO: 60165 - RNA, 20 nt, Artificial Sequence
  MKO10060165_A_Zc3h12c
  gRNA
augagcauggcucuaccgaa

SEQ ID NO: 60166 - RNA, 20 nt, Artificial Sequence
  MKO10060166_A_Zc3h12d
  gRNA
acgaacuccgugccaagacg

SEQ ID NO: 60167 - RNA, 20 nt, Artificial Sequence
  MKO10060167_A_Zc3h12d
  gRNA
auuggagacccgagaucgcc

SEQ ID NO: 60168 - RNA, 20 nt, Artificial Sequence
  MKO10060168_A_Zc3h12d
  gRNA
cgaugaccgcuacaucguga

SEQ ID NO: 60169 - RNA, 20 nt, Artificial Sequence
  MKO10060169_A_Zc3h13
  gRNA
cauagacacagugucguaac

SEQ ID NO: 60170 - RNA, 20 nt, Artificial Sequence
  MKO10060170_A_Zc3h13
  gRNA
gcuccucuguauuccguuuc

SEQ ID NO: 60171 - RNA, 20 nt, Artificial Sequence
  MKO10060171_A_Zc3h13
  gRNA
aagaaugaagaauaagcguc

SEQ ID NO: 60172 - RNA, 20 nt, Artificial Sequence
  MKO10060172_A_Zc3h14
  gRNA
ucgauacugacuccaaaacc

SEQ ID NO: 60173 - RNA, 20 nt, Artificial Sequence
  MKO10060173_A_Zc3h14
  gRNA
uacuggccugccuguaaaaa

SEQ ID NO: 60174 - RNA, 20 nt, Artificial Sequence
  MKO10060174_A_Zc3h14
  gRNA
gggugauaaaaugugcaguc

SEQ ID NO: 60175 - RNA, 20 nt, Artificial Sequence
  MKO10060175_A_Zc3h15
  gRNA
aggugcagaucccaaaucug

SEQ ID NO: 60176 - RNA, 20 nt, Artificial Sequence
  MKO10060176_A_Zc3h15
  gRNA
auuuagauacuauggauaau

SEQ ID NO: 60177 - RNA, 20 nt, Artificial Sequence
  MKO10060177_A_Zc3h15
  gRNA
cuuacuuaggacaaaacuuu

SEQ ID NO: 60178 - RNA, 20 nt, Artificial Sequence
  MKO10060178_A_Zc3h18
  gRNA
uuucccuaggaaacugcacg

SEQ ID NO: 60179 - RNA, 20 nt, Artificial Sequence
  MKO10060179_A_Zc3h18
  gRNA
cauccgagcgagucuccucc

SEQ ID NO: 60180 - RNA, 20 nt, Artificial Sequence
  MKO10060180_A_Zc3h18
  gRNA
accugccgauucuucaugaa

SEQ ID NO: 60181 - RNA, 20 nt, Artificial Sequence
  MKO10060181_A_Zc3h3
  gRNA
ggucuuccuaccuggauaau

SEQ ID NO: 60182 - RNA, 20 nt, Artificial Sequence
  MKO10060182_A_Zc3h3
  gRNA
ccuugucauaccuuccuugg

SEQ ID NO: 60183 - RNA, 20 nt, Artificial Sequence
  MKO10060183_A_Zc3h3
  gRNA
cucacucaccugugcggagg

SEQ ID NO: 60184 - RNA, 20 nt, Artificial Sequence
  MKO10060184_A_Zc3h4
  gRNA
gugucacucacuggugcgua

SEQ ID NO: 60185 - RNA, 20 nt, Artificial Sequence
  MKO10060185_A_Zc3h4
  gRNA
aaaagaggcgcucgaagaaa

SEQ ID NO: 60186 - RNA, 20 nt, Artificial Sequence
  MKO10060186_A_Zc3h4
  gRNA
caggggugcguugugugacg

SEQ ID NO: 60187 - RNA, 20 nt, Artificial Sequence
  MKO10060187_A_Zc3h6
  gRNA
cccuagcauagacguauauc

SEQ ID NO: 60188 - RNA, 20 nt, Artificial Sequence
  MKO10060188_A_Zc3h6
  gRNA
ucgauaguauuucagcugac

SEQ ID NO: 60189 - RNA, 20 nt, Artificial Sequence
  MKO10060189_A_Zc3h6
  gRNA
ugauaguucugacuacagcc

SEQ ID NO: 60190 - RNA, 20 nt, Artificial Sequence
  MKO10060190_A_Zc3h7a
  gRNA
gcacuuugccacagcgucgu

SEQ ID NO: 60191 - RNA, 20 nt, Artificial Sequence
  MKO10060191_A_Zc3h7a
  gRNA
cagagaggccuacgacgcug

SEQ ID NO: 60192 - RNA, 20 nt, Artificial Sequence
  MKO10060192_A_Zc3h7a
  gRNA
gucccaggauaugacagcgg

SEQ ID NO: 60193 - RNA, 20 nt, Artificial Sequence
  MKO10060193_A_Zc3h7b
  gRNA
ggucguugcccucggcaaac

SEQ ID NO: 60194 - RNA, 20 nt, Artificial Sequence
  MKO10060194_A_Zc3h7b
  gRNA
ggcgcgcgcccucaacgagc

SEQ ID NO: 60195 - RNA, 20 nt, Artificial Sequence
  MKO10060195_A_Zc3h7b
  gRNA
ugacuacgccgccucugacc

SEQ ID NO: 60196 - RNA, 20 nt, Artificial Sequence
  MKO10060196_A_Zc3h8
  gRNA
cuuugcguuccaccgugugc

SEQ ID NO: 60197 - RNA, 20 nt, Artificial Sequence
  MKO10060197_A_Zc3h8
  gRNA
ccuugacucauccucacacg

SEQ ID NO: 60198 - RNA, 20 nt, Artificial Sequence
  MKO10060198_A_Zc3h8
  gRNA
caugucucaccaucacuaua

SEQ ID NO: 60199 - RNA, 20 nt, Artificial Sequence
  MKO10060199_A_Zc3hav1l
  gRNA
ggggcauucaccucgcacaa

SEQ ID NO: 60200 - RNA, 20 nt, Artificial Sequence
  MKO10060200_A_Zc3hav1l
  gRNA
agcccugacacuccccgcgc

SEQ ID NO: 60201 - RNA, 20 nt, Artificial Sequence
  MKO10060201_A_Zc3hav1l
  gRNA
gcgcggccacguggagcugu

SEQ ID NO: 60202 - RNA, 20 nt, Artificial Sequence
  MKO10060202_A_Zc3hav1
  gRNA
uuucuuugugccgcaacgag

SEQ ID NO: 60203 - RNA, 20 nt, Artificial Sequence
  MKO10060203_A_Zc3hav1
  gRNA
ccguuauggguagauguacc

SEQ ID NO: 60204 - RNA, 20 nt, Artificial Sequence
  MKO10060204_A_Zc3hav1
  gRNA
aggaaccccccuagcaugag

SEQ ID NO: 60205 - RNA, 20 nt, Artificial Sequence
  MKO10060205_A_Zc3hc1
  gRNA
ccacuuaucugcgcuaaaua

SEQ ID NO: 60206 - RNA, 20 nt, Artificial Sequence
  MKO10060206_A_Zc3hc1
  gRNA
ccauauuuagcgcagauaag

SEQ ID NO: 60207 - RNA, 20 nt, Artificial Sequence
  MKO10060207_A_Zc3hc1
  gRNA
aaaggcuuugaaaccggucc

SEQ ID NO: 60208 - RNA, 20 nt, Artificial Sequence
  MKO10060208_A_Zc4h2
  gRNA
gcaggcccaaugucaugcgc

SEQ ID NO: 60209 - RNA, 20 nt, Artificial Sequence
  MKO10060209_A_Zc4h2
  gRNA
gggguuccgugaccgacucu

SEQ ID NO: 60210 - RNA, 20 nt, Artificial Sequence
  MKO10060210_A_Zc4h2
  gRNA
aaagaucaaggcccguuuga

SEQ ID NO: 60211 - RNA, 20 nt, Artificial Sequence
  MKO10060211_A_Zcchc10
  gRNA
ccuacacagaccuucgagaa

SEQ ID NO: 60212 - RNA, 20 nt, Artificial Sequence
  MKO10060212_A_Zcchc10
  gRNA
ucgagcuaugagccgaugca

SEQ ID NO: 60213 - RNA, 20 nt, Artificial Sequence
  MKO10060213_A_Zcchc10
  gRNA
uucagcucugccguucucga

SEQ ID NO: 60214 - RNA, 20 nt, Artificial Sequence
  MKO10060214_A_Zcchc11
  gRNA
ugaugaccucagaauccgcc

SEQ ID NO: 60215 - RNA, 20 nt, Artificial Sequence
  MKO10060215_A_Zcchc11
  gRNA
agcaaaguuugcauagauag

SEQ ID NO: 60216 - RNA, 20 nt, Artificial Sequence
  MKO10060216_A_Zcchc11
  gRNA
agcagauucaucuauuacag

SEQ ID NO: 60217 - RNA, 20 nt, Artificial Sequence
  MKO10060217_A_Zcchc12
  gRNA
gauucuuaagccugaaucga

SEQ ID NO: 60218 - RNA, 20 nt, Artificial Sequence
  MKO10060218_A_Zcchc12
  gRNA
gaucguauguuugcgcuucc

SEQ ID NO: 60219 - RNA, 20 nt, Artificial Sequence
  MKO10060219_A_Zcchc12
  gRNA
ggcuagcauccuuucacguu

SEQ ID NO: 60220 - RNA, 20 nt, Artificial Sequence
  MKO10060220_A_Zcchc13
  gRNA
guacccaggcuaaacgagag

SEQ ID NO: 60221 - RNA, 20 nt, Artificial Sequence
  MKO10060221_A_Zcchc13
  gRNA
ugaaacuggucacuacgcca

SEQ ID NO: 60222 - RNA, 20 nt, Artificial Sequence
  MKO10060222_A_Zcchc13
  gRNA
acagcaagaggucguaccag

SEQ ID NO: 60223 - RNA, 20 nt, Artificial Sequence
  MKO10060223_A_Zcchc14
  gRNA
acguaugcaaugcauucucc

SEQ ID NO: 60224 - RNA, 20 nt, Artificial Sequence
  MKO10060224_A_Zcchc14
  gRNA
cuugggcagggacuccuccg

SEQ ID NO: 60225 - RNA, 20 nt, Artificial Sequence
  MKO10060225_A_Zcchc14
  gRNA
ggaacguaaccauguugauu

SEQ ID NO: 60226 - RNA, 20 nt, Artificial Sequence
  MKO10060226_A_Zcchc16
  gRNA
ccccgugcguccacuaccaa

SEQ ID NO: 60227 - RNA, 20 nt, Artificial Sequence
  MKO10060227_A_Zcchc16
  gRNA
ggugucguuucuugugucau

SEQ ID NO: 60228 - RNA, 20 nt, Artificial Sequence
  MKO10060228_A_Zcchc16
  gRNA
auccuuugguaguggacgca

SEQ ID NO: 60229 - RNA, 20 nt, Artificial Sequence
  MKO10060229_A_Zcchc17
  gRNA
aggacgacaugugaguucga

SEQ ID NO: 60230 - RNA, 20 nt, Artificial Sequence
  MKO10060230_A_Zcchc17
  gRNA
ccaacaucuacuaucucaga

SEQ ID NO: 60231 - RNA, 20 nt, Artificial Sequence
  MKO10060231_A_Zcchc17
  gRNA
ccaccuugcuuccgacagcc

SEQ ID NO: 60232 - RNA, 20 nt, Artificial Sequence
  MKO10060232_A_Zcchc18
  gRNA
gcucauuaugcgcaugcauu

SEQ ID NO: 60233 - RNA, 20 nt, Artificial Sequence
  MKO10060233_A_Zcchc18
  gRNA
aaugcaugcgcauaaugagc

SEQ ID NO: 60234 - RNA, 20 nt, Artificial Sequence
  MKO10060234_A_Zcchc18
  gRNA
gauuggguacuugcgcuuuc

SEQ ID NO: 60235 - RNA, 20 nt, Artificial Sequence
  MKO10060235_A_Zcchc24
  gRNA
caucgacacgagcgccgccu

SEQ ID NO: 60236 - RNA, 20 nt, Artificial Sequence
  MKO10060236_A_Zcchc24
  gRNA
cgaggcggcgcucgugucga

SEQ ID NO: 60237 - RNA, 20 nt, Artificial Sequence
  MKO10060237_A_Zcchc24
  gRNA
gagggucugacgccguacca

SEQ ID NO: 60238 - RNA, 20 nt, Artificial Sequence
  MKO10060238_A_Zcchc2
  gRNA
gccgucggcccgcuagcaac

SEQ ID NO: 60239 - RNA, 20 nt, Artificial Sequence
  MKO10060239_A_Zcchc2
  gRNA
uacgaugaggcgcgagcgca

SEQ ID NO: 60240 - RNA, 20 nt, Artificial Sequence
  MKO10060240_A_Zcchc2
  gRNA
gccacagugaguccgucugg

SEQ ID NO: 60241 - RNA, 20 nt, Artificial Sequence
  MKO10060241_A_Zcchc3
  gRNA
augaccgcguagaugucguc

SEQ ID NO: 60242 - RNA, 20 nt, Artificial Sequence
  MKO10060242_A_Zcchc3
  gRNA
acgaaagugccuguccgacc

SEQ ID NO: 60243 - RNA, 20 nt, Artificial Sequence
  MKO10060243_A_Zcchc3
  gRNA
aucuucggucgugccgggcc

SEQ ID NO: 60244 - RNA, 20 nt, Artificial Sequence
  MKO10060244_A_Zcchc4
  gRNA
cuguuagccugaucugcucg

SEQ ID NO: 60245 - RNA, 20 nt, Artificial Sequence
  MKO10060245_A_Zcchc4
  gRNA
accuuucuaugcauugugcc

SEQ ID NO: 60246 - RNA, 20 nt, Artificial Sequence
  MKO10060246_A_Zcchc4
  gRNA
ucaggcuccacgagcagauc

SEQ ID NO: 60247 - RNA, 20 nt, Artificial Sequence
  MKO10060247_A_Zcchc5
  gRNA
uaaucgcccccaccucagcg

SEQ ID NO: 60248 - RNA, 20 nt, Artificial Sequence
  MKO10060248_A_Zcchc5
  gRNA
gaacgggcaagacgccgcga

SEQ ID NO: 60249 - RNA, 20 nt, Artificial Sequence
  MKO10060249_A_Zcchc5
  gRNA
cauugcgcaagaguuagauu

SEQ ID NO: 60250 - RNA, 20 nt, Artificial Sequence
  MKO10060250_A_Zcchc6
  gRNA
ccagaccucguaagccacgg

SEQ ID NO: 60251 - RNA, 20 nt, Artificial Sequence
  MKO10060251_A_Zcchc6
  gRNA
uuugcugucgggcaguuucg

SEQ ID NO: 60252 - RNA, 20 nt, Artificial Sequence
  MKO10060252_A_Zcchc6
  gRNA
ucaagagagacugcaucgac

SEQ ID NO: 60253 - RNA, 20 nt, Artificial Sequence
  MKO10060253_A_Zcchc7
  gRNA
aaauacuuacgucagcaugg

SEQ ID NO: 60254 - RNA, 20 nt, Artificial Sequence
  MKO10060254_A_Zcchc7
  gRNA
uguagaaauugugauaaacg

SEQ ID NO: 60255 - RNA, 20 nt, Artificial Sequence
  MKO10060255_A_Zcchc7
  gRNA
ugugaccgaugugauaugau

SEQ ID NO: 60256 - RNA, 20 nt, Artificial Sequence
  MKO10060256_A_Zcchc8
  gRNA
uuagccguccaguguuaugu

SEQ ID NO: 60257 - RNA, 20 nt, Artificial Sequence
  MKO10060257_A_Zcchc8
  gRNA
ugaacauucugacaagaccc

SEQ ID NO: 60258 - RNA, 20 nt, Artificial Sequence
  MKO10060258_A_Zcchc8
  gRNA
ucuuccaacauaacacugga

SEQ ID NO: 60259 - RNA, 20 nt, Artificial Sequence
  MKO10060259_A_Zcchc9
  gRNA
gcuaacguagaccccgcgcu

SEQ ID NO: 60260 - RNA, 20 nt, Artificial Sequence
  MKO10060260_A_Zcchc9
  gRNA
uguuuccauugucgacaacc

SEQ ID NO: 60261 - RNA, 20 nt, Artificial Sequence
  MKO10060261_A_Zcchc9
  gRNA
cucugcagaucggaucauca

SEQ ID NO: 60262 - RNA, 20 nt, Artificial Sequence
  MKO10060262_A_Zcrb1
  gRNA
uaucaaaguaguuucgucuc

SEQ ID NO: 60263 - RNA, 20 nt, Artificial Sequence
  MKO10060263_A_Zcrb1
  gRNA
gaagagcagcugaguucauc

SEQ ID NO: 60264 - RNA, 20 nt, Artificial Sequence
  MKO10060264_A_Zcrb1
  gRNA
cauacguacauuucuucuuc

SEQ ID NO: 60265 - RNA, 20 nt, Artificial Sequence
  MKO10060265_A_Zcwpw1
  gRNA
gcccgguucuucauccaauu

SEQ ID NO: 60266 - RNA, 20 nt, Artificial Sequence
  MKO10060266_A_Zcwpw1
  gRNA
gcucaaagccagcuuaaaga

SEQ ID NO: 60267 - RNA, 20 nt, Artificial Sequence
  MKO10060267_A_Zcwpw1
  gRNA
ggcguccuccuuccaugagc

SEQ ID NO: 60268 - RNA, 20 nt, Artificial Sequence
  MKO10060268_A_Zdbf2
  gRNA
cgagaugccucacgacgcuu

SEQ ID NO: 60269 - RNA, 20 nt, Artificial Sequence
  MKO10060269_A_Zdbf2
  gRNA
cacgauuuacaagagucugc

SEQ ID NO: 60270 - RNA, 20 nt, Artificial Sequence
  MKO10060270_A_Zdbf2
  gRNA
uguccgacgucugcucuguc

SEQ ID NO: 60271 - RNA, 20 nt, Artificial Sequence
  MKO10060271_A_Zdhhc11
  gRNA
agccugugccggccuucgac

SEQ ID NO: 60272 - RNA, 20 nt, Artificial Sequence
  MKO10060272_A_Zdhhc11
  gRNA
uugcgaucaagugcacgaug

SEQ ID NO: 60273 - RNA, 20 nt, Artificial Sequence
  MKO10060273_A_Zdhhc11
  gRNA
caacccugaugagcuucgca

SEQ ID NO: 60274 - RNA, 20 nt, Artificial Sequence
  MKO10060274_A_Zdhhc12
  gRNA
ccggcucaccggugucgugc

SEQ ID NO: 60275 - RNA, 20 nt, Artificial Sequence
  MKO10060275_A_Zdhhc12
  gRNA
cacgacagugccgggcacgc

SEQ ID NO: 60276 - RNA, 20 nt, Artificial Sequence
  MKO10060276_A_Zdhhc12
  gRNA
acgcaaccacccgcucuuug

SEQ ID NO: 60277 - RNA, 20 nt, Artificial Sequence
  MKO10060277_A_Zdhhc13
  gRNA
augccgugucgcccaaaucc

SEQ ID NO: 60278 - RNA, 20 nt, Artificial Sequence
  MKO10060278_A_Zdhhc13
  gRNA
gcugaaacaggaccgccaga

SEQ ID NO: 60279 - RNA, 20 nt, Artificial Sequence
  MKO10060279_A_Zdhhc13
  gRNA
gggauucagcagcauccauc

SEQ ID NO: 60280 - RNA, 20 nt, Artificial Sequence
  MKO10060280_A_Zdhhc14
  gRNA
cgggcgauaccccccugaac

SEQ ID NO: 60281 - RNA, 20 nt, Artificial Sequence
  MKO10060281_A_Zdhhc14
  gRNA
cuucaucaggaguggcucga

SEQ ID NO: 60282 - RNA, 20 nt, Artificial Sequence
  MKO10060282_A_Zdhhc14
  gRNA
uccugaugaagccgcugauc

SEQ ID NO: 60283 - RNA, 20 nt, Artificial Sequence
  MKO10060283_A_Zdhhc15
  gRNA
auagcgcuccuugucuguau

SEQ ID NO: 60284 - RNA, 20 nt, Artificial Sequence
  MKO10060284_A_Zdhhc15
  gRNA
uagcuguacgguucugugac

SEQ ID NO: 60285 - RNA, 20 nt, Artificial Sequence
  MKO10060285_A_Zdhhc15
  gRNA
agcggucuggcuugauuaga

SEQ ID NO: 60286 - RNA, 20 nt, Artificial Sequence
  MKO10060286_A_Zdhhc16
  gRNA
cgugcugaccggguccaucg

SEQ ID NO: 60287 - RNA, 20 nt, Artificial Sequence
  MKO10060287_A_Zdhhc16
  gRNA
caucgucuuccauuacuacc

SEQ ID NO: 60288 - RNA, 20 nt, Artificial Sequence
  MKO10060288_A_Zdhhc16
  gRNA
gcccacacaguuguuuagcc

SEQ ID NO: 60289 - RNA, 20 nt, Artificial Sequence
  MKO10060289_A_Zdhhc17
  gRNA
uggaagcggguuacgaugua

SEQ ID NO: 60290 - RNA, 20 nt, Artificial Sequence
  MKO10060290_A_Zdhhc17
  gRNA
auaugaacgcugccgagaau

SEQ ID NO: 60291 - RNA, 20 nt, Artificial Sequence
  MKO10060291_A_Zdhhc17
  gRNA
ugaauucaacuccguugcac

SEQ ID NO: 60292 - RNA, 20 nt, Artificial Sequence
  MKO10060292_A_Zdhhc18
  gRNA
ccacauaccgaccgcccccu

SEQ ID NO: 60293 - RNA, 20 nt, Artificial Sequence
  MKO10060293_A_Zdhhc18
  gRNA
gucgcagacacugcagugcg

SEQ ID NO: 60294 - RNA, 20 nt, Artificial Sequence
  MKO10060294_A_Zdhhc18
  gRNA
gaccacgcaggcgaagauga

SEQ ID NO: 60295 - RNA, 20 nt, Artificial Sequence
  MKO10060295_A_Zdhhc19
  gRNA
cccgaaccuaccacugcccg

SEQ ID NO: 60296 - RNA, 20 nt, Artificial Sequence
  MKO10060296_A_Zdhhc19
  gRNA
gcagaugccuugugcgaaau

SEQ ID NO: 60297 - RNA, 20 nt, Artificial Sequence
  MKO10060297_A_Zdhhc19
  gRNA
ucaccucgauguaagauacc

SEQ ID NO: 60298 - RNA, 20 nt, Artificial Sequence
  MKO10060298_A_Zdhhc1
  gRNA
gccgcauacgcacuuauugc

SEQ ID NO: 60299 - RNA, 20 nt, Artificial Sequence
  MKO10060299_A_Zdhhc1
  gRNA
gccugcaauaagugcguaug

SEQ ID NO: 60300 - RNA, 20 nt, Artificial Sequence
  MKO10060300_A_Zdhhc1
  gRNA
guagcucuugucccgcacau

SEQ ID NO: 60301 - RNA, 20 nt, Artificial Sequence
  MKO10060301_A_Zdhhc20
  gRNA
aaagaccguuguuuaccuug

SEQ ID NO: 60302 - RNA, 20 nt, Artificial Sequence
  MKO10060302_A_Zdhhc20
  gRNA
cuacaccacaucagcuucaa

SEQ ID NO: 60303 - RNA, 20 nt, Artificial Sequence
  MKO10060303_A_Zdhhc20
  gRNA
cuuacccuuugaagcugaug

SEQ ID NO: 60304 - RNA, 20 nt, Artificial Sequence
  MKO10060304_A_Zdhhc21
  gRNA
uccacuaaaaaagcguaacu

SEQ ID NO: 60305 - RNA, 20 nt, Artificial Sequence
  MKO10060305_A_Zdhhc21
  gRNA
agggccuccuuaacugaucc

SEQ ID NO: 60306 - RNA, 20 nt, Artificial Sequence
  MKO10060306_A_Zdhhc21
  gRNA
gcaacaagugcaaccugaug

SEQ ID NO: 60307 - RNA, 20 nt, Artificial Sequence
  MKO10060307_A_Zdhhc22
  gRNA
aacccgcuaccagguucgaa

SEQ ID NO: 60308 - RNA, 20 nt, Artificial Sequence
  MKO10060308_A_Zdhhc22
  gRNA
cagccauccccuuucgaacc

SEQ ID NO: 60309 - RNA, 20 nt, Artificial Sequence
  MKO10060309_A_Zdhhc22
  gRNA
uaccacguugagcagccgca

SEQ ID NO: 60310 - RNA, 20 nt, Artificial Sequence
  MKO10060310_A_Zdhhc23
  gRNA
cuguaauuagcguaaacucc

SEQ ID NO: 60311 - RNA, 20 nt, Artificial Sequence
  MKO10060311_A_Zdhhc23
  gRNA
cccgggcgggucguacuagc

SEQ ID NO: 60312 - RNA, 20 nt, Artificial Sequence
  MKO10060312_A_Zdhhc23
  gRNA
gauugucaagaccucgauga

SEQ ID NO: 60313 - RNA, 20 nt, Artificial Sequence
  MKO10060313_A_Zdhhc24
  gRNA
cgccgucgugguccuggagc

SEQ ID NO: 60314 - RNA, 20 nt, Artificial Sequence
  MKO10060314_A_Zdhhc24
  gRNA
gacagugauggucacgacgu

SEQ ID NO: 60315 - RNA, 20 nt, Artificial Sequence
  MKO10060315_A_Zdhhc24
  gRNA
gcgcagaaggagcgcccgcg

SEQ ID NO: 60316 - RNA, 20 nt, Artificial Sequence
  MKO10060316_A_Zdhhc25
  gRNA
cgccucgcauguagcugcac

SEQ ID NO: 60317 - RNA, 20 nt, Artificial Sequence
  MKO10060317_A_Zdhhc25
  gRNA
gugccccuggguaacccgcc

SEQ ID NO: 60318 - RNA, 20 nt, Artificial Sequence
  MKO10060318_A_Zdhhc25
  gRNA
cggacuaugcugaccgaccc

SEQ ID NO: 60319 - RNA, 20 nt, Artificial Sequence
  MKO10060319_A_Zdhhc2
  gRNA
ucagggcuuaccgccggaca

SEQ ID NO: 60320 - RNA, 20 nt, Artificial Sequence
  MKO10060320_A_Zdhhc2
  gRNA
aagaccuucccaucuacacc

SEQ ID NO: 60321 - RNA, 20 nt, Artificial Sequence
  MKO10060321_A_Zdhhc2
  gRNA
aaaguagaugauaagccaug

SEQ ID NO: 60322 - RNA, 20 nt, Artificial Sequence
  MKO10060322_A_Zdhhc3
  gRNA
gcugcagcaucaagcccgac

SEQ ID NO: 60323 - RNA, 20 nt, Artificial Sequence
  MKO10060323_A_Zdhhc3
  gRNA
gguaccugcaguggugugcc

SEQ ID NO: 60324 - RNA, 20 nt, Artificial Sequence
  MKO10060324_A_Zdhhc3
  gRNA
aguggaaucccaccaugaug

SEQ ID NO: 60325 - RNA, 20 nt, Artificial Sequence
  MKO10060325_A_Zdhhc4
  gRNA
gaggcacugcgggauuaccc

SEQ ID NO: 60326 - RNA, 20 nt, Artificial Sequence
  MKO10060326_A_Zdhhc4
  gRNA
ugugcugcuaagcgugaacc

SEQ ID NO: 60327 - RNA, 20 nt, Artificial Sequence
  MKO10060327_A_Zdhhc4
  gRNA
ugguuuccuuaaaucgcaag

SEQ ID NO: 60328 - RNA, 20 nt, Artificial Sequence
  MKO10060328_A_Zdhhc5
  gRNA
uaaacaacuguauuggucgc

SEQ ID NO: 60329 - RNA, 20 nt, Artificial Sequence
  MKO10060329_A_Zdhhc5
  gRNA
aucuaggagggcgguaaaag

SEQ ID NO: 60330 - RNA, 20 nt, Artificial Sequence
  MKO10060330_A_Zdhhc5
  gRNA
cacaccauuucauucgcacc

SEQ ID NO: 60331 - RNA, 20 nt, Artificial Sequence
  MKO10060331_A_Zdhhc6
  gRNA
ggcaaacgcagccaauccga

SEQ ID NO: 60332 - RNA, 20 nt, Artificial Sequence
  MKO10060332_A_Zdhhc6
  gRNA
aacguggcgccuuguaugcu

SEQ ID NO: 60333 - RNA, 20 nt, Artificial Sequence
  MKO10060333_A_Zdhhc6
  gRNA
accauugcagaaaguguaac

SEQ ID NO: 60334 - RNA, 20 nt, Artificial Sequence
  MKO10060334_A_Zdhhc7
  gRNA
uuucaucauugcauaucgag

SEQ ID NO: 60335 - RNA, 20 nt, Artificial Sequence
  MKO10060335_A_Zdhhc7
  gRNA
caguucaucuccugcguccg

SEQ ID NO: 60336 - RNA, 20 nt, Artificial Sequence
  MKO10060336_A_Zdhhc7
  gRNA
cggcuugaugcagcaacacu

SEQ ID NO: 60337 - RNA, 20 nt, Artificial Sequence
  MKO10060337_A_Zdhhc8
  gRNA
cacuggcuuucacgugguac

SEQ ID NO: 60338 - RNA, 20 nt, Artificial Sequence
  MKO10060338_A_Zdhhc8
  gRNA
gcauccagguccgcaugaag

SEQ ID NO: 60339 - RNA, 20 nt, Artificial Sequence
  MKO10060339_A_Zdhhc8
  gRNA
auguccagcggacgaggacg

SEQ ID NO: 60340 - RNA, 20 nt, Artificial Sequence
  MKO10060340_A_Zdhhc9
  gRNA
cgccuuuaacaucgucuaug

SEQ ID NO: 60341 - RNA, 20 nt, Artificial Sequence
  MKO10060341_A_Zdhhc9
  gRNA
uuucuucaggugucgcuacc

SEQ ID NO: 60342 - RNA, 20 nt, Artificial Sequence
  MKO10060342_A_Zdhhc9
  gRNA
aucuggaaauucuuaauacg

SEQ ID NO: 60343 - RNA, 20 nt, Artificial Sequence
  MKO10060343_A_Zeb1
  gRNA
accugcccguauugugauag

SEQ ID NO: 60344 - RNA, 20 nt, Artificial Sequence
  MKO10060344_A_Zeb1
  gRNA
gaauccguaagugcucuuuc

SEQ ID NO: 60345 - RNA, 20 nt, Artificial Sequence
  MKO10060345_A_Zeb1
  gRNA
gcaaaaccaugauccgaaug

SEQ ID NO: 60346 - RNA, 20 nt, Artificial Sequence
  MKO10060346_A_Zeb2os
  gRNA
gcuguuuaaacuaauccucg

SEQ ID NO: 60347 - RNA, 20 nt, Artificial Sequence
  MKO10060347_A_Zeb2os
  gRNA
ucaguucuaaccugcucggc

SEQ ID NO: 60348 - RNA, 20 nt, Artificial Sequence
  MKO10060348_A_Zeb2os
  gRNA
ccccccgucaagcaagccuu

SEQ ID NO: 60349 - RNA, 20 nt, Artificial Sequence
  MKO10060349_A_Zeb2
  gRNA
guaccuucagcgaagcgaca

SEQ ID NO: 60350 - RNA, 20 nt, Artificial Sequence
  MKO10060350_A_Zeb2
  gRNA
caagcgcuugacaucgcuga

SEQ ID NO: 60351 - RNA, 20 nt, Artificial Sequence
  MKO10060351_A_Zeb2
  gRNA
acucuucgaugcucacugcg

SEQ ID NO: 60352 - RNA, 20 nt, Artificial Sequence
  MKO10060352_A_Zer1
  gRNA
gugcguaagacgacacaaug

SEQ ID NO: 60353 - RNA, 20 nt, Artificial Sequence
  MKO10060353_A_Zer1
  gRNA
cggggauaccgucaaucaug

SEQ ID NO: 60354 - RNA, 20 nt, Artificial Sequence
  MKO10060354_A_Zer1
  gRNA
cacucgcauccaccuucgug

SEQ ID NO: 60355 - RNA, 20 nt, Artificial Sequence
  MKO10060355_A_Zfand1
  gRNA
uugcagacaccgucaucagu

SEQ ID NO: 60356 - RNA, 20 nt, Artificial Sequence
  MKO10060356_A_Zfand1
  gRNA
aaacuugucagagacauugu

SEQ ID NO: 60357 - RNA, 20 nt, Artificial Sequence
  MKO10060357_A_Zfand1
  gRNA
aagccuugaacacagaagca

SEQ ID NO: 60358 - RNA, 20 nt, Artificial Sequence
  MKO10060358_A_Zfand2a
  gRNA
gggacuaguaccugagccgc

SEQ ID NO: 60359 - RNA, 20 nt, Artificial Sequence
  MKO10060359_A_Zfand2a
  gRNA
ugcucgccgaccaccacauc

SEQ ID NO: 60360 - RNA, 20 nt, Artificial Sequence
  MKO10060360_A_Zfand2a
  gRNA
gugucccuuugcguucaaga

SEQ ID NO: 60361 - RNA, 20 nt, Artificial Sequence
  MKO10060361_A_Zfand2b
  gRNA
gccagaacguucacacuuau

SEQ ID NO: 60362 - RNA, 20 nt, Artificial Sequence
  MKO10060362_A_Zfand2b
  gRNA
accaauaagugugaacguuc

SEQ ID NO: 60363 - RNA, 20 nt, Artificial Sequence
  MKO10060363_A_Zfand2b
  gRNA
gaugaaggcaagguccggcu

SEQ ID NO: 60364 - RNA, 20 nt, Artificial Sequence
  MKO10060364_A_Zfand3
  gRNA
uucgaccggccgcucuccuc

SEQ ID NO: 60365 - RNA, 20 nt, Artificial Sequence
  MKO10060365_A_Zfand3
  gRNA
ccucgcggccacggcccaug

SEQ ID NO: 60366 - RNA, 20 nt, Artificial Sequence
  MKO10060366_A_Zfand3
  gRNA
cgacuguacguucgaccaca

SEQ ID NO: 60367 - RNA, 20 nt, Artificial Sequence
  MKO10060367_A_Zfand4
  gRNA
ggaccgauaaguacuagaaa

SEQ ID NO: 60368 - RNA, 20 nt, Artificial Sequence
  MKO10060368_A_Zfand4
  gRNA
cucuucaucgaaacguugac

SEQ ID NO: 60369 - RNA, 20 nt, Artificial Sequence
  MKO10060369_A_Zfand4
  gRNA
aaacguaacuuguuuguugc

SEQ ID NO: 60370 - RNA, 20 nt, Artificial Sequence
  MKO10060370_A_Zfand5
  gRNA
gcaggguuugacugccgaug

SEQ ID NO: 60371 - RNA, 20 nt, Artificial Sequence
  MKO10060371_A_Zfand5
  gRNA
gcuucugcuuuguaaucaua

SEQ ID NO: 60372 - RNA, 20 nt, Artificial Sequence
  MKO10060372_A_Zfand5
  gRNA
aauaacuaccccgaaaacag

SEQ ID NO: 60373 - RNA, 20 nt, Artificial Sequence
  MKO10060373_A_Zfand6
  gRNA
ucuagcgcugacugagcguc

SEQ ID NO: 60374 - RNA, 20 nt, Artificial Sequence
  MKO10060374_A_Zfand6
  gRNA
acgucuucaucuaugcagcc

SEQ ID NO: 60375 - RNA, 20 nt, Artificial Sequence
  MKO10060375_A_Zfand6
  gRNA
agaaucgcuguuucaugugc

SEQ ID NO: 60376 - RNA, 20 nt, Artificial Sequence
  MKO10060376_A_Zfau
  gRNA
aguuaagaccacgcugauga

SEQ ID NO: 60377 - RNA, 20 nt, Artificial Sequence
  MKO10060377_A_Zfau
  gRNA
accugccguccgcgucucca

SEQ ID NO: 60378 - RNA, 20 nt, Artificial Sequence
  MKO10060378_A_Zfau
  gRNA
cguccucacuggggcucacg

SEQ ID NO: 60379 - RNA, 20 nt, Artificial Sequence
  MKO10060379_A_Zfc3h1
  gRNA
uagccgacugaagagccaac

SEQ ID NO: 60380 - RNA, 20 nt, Artificial Sequence
  MKO10060380_A_Zfc3h1
  gRNA
guacaaucgguucaugaagu

SEQ ID NO: 60381 - RNA, 20 nt, Artificial Sequence
  MKO10060381_A_Zfc3h1
  gRNA
gauccgagaccuuuccaacc

SEQ ID NO: 60382 - RNA, 20 nt, Artificial Sequence
  MKO10060382_A_Zfhx2
  gRNA
accuacgcacgccugcccac

SEQ ID NO: 60383 - RNA, 20 nt, Artificial Sequence
  MKO10060383_A_Zfhx2
  gRNA
cguaagaagccccauccccc

SEQ ID NO: 60384 - RNA, 20 nt, Artificial Sequence
  MKO10060384_A_Zfhx2
  gRNA
cgugcguagguguugcagca

SEQ ID NO: 60385 - RNA, 20 nt, Artificial Sequence
  MKO10060385_A_Zfhx3
  gRNA
aucccccucgacaugcgccu

SEQ ID NO: 60386 - RNA, 20 nt, Artificial Sequence
  MKO10060386_A_Zfhx3
  gRNA
cgucugcaacaaguucacga

SEQ ID NO: 60387 - RNA, 20 nt, Artificial Sequence
  MKO10060387_A_Zfhx3
  gRNA
accugcggauggugaagauc

SEQ ID NO: 60388 - RNA, 20 nt, Artificial Sequence
  MKO10060388_A_Zfhx4
  gRNA
gcuucaccgaccgaacaugu

SEQ ID NO: 60389 - RNA, 20 nt, Artificial Sequence
  MKO10060389_A_Zfhx4
  gRNA
agcgccgggucacugauaua

SEQ ID NO: 60390 - RNA, 20 nt, Artificial Sequence
  MKO10060390_A_Zfhx4
  gRNA
aaguucguccucaccauucc

SEQ ID NO: 60391 - RNA, 20 nt, Artificial Sequence
  MKO10060391_A_Zfml
  gRNA
cccguucuccauaucguagu

SEQ ID NO: 60392 - RNA, 20 nt, Artificial Sequence
  MKO10060392_A_Zfml
  gRNA
aggagauuccgacuacgaua

SEQ ID NO: 60393 - RNA, 20 nt, Artificial Sequence
  MKO10060393_A_Zfml
  gRNA
aaguagccaugucgagaccc

SEQ ID NO: 60394 - RNA, 20 nt, Artificial Sequence
  MKO10060394_A_Zfp101
  gRNA
cccccgcaugcguccgaagc

SEQ ID NO: 60395 - RNA, 20 nt, Artificial Sequence
  MKO10060395_A_Zfp101
  gRNA
gugaucuaaucaagcacgag

SEQ ID NO: 60396 - RNA, 20 nt, Artificial Sequence
  MKO10060396_A_Zfp101
  gRNA
ccuuauccguguaaguauug

SEQ ID NO: 60397 - RNA, 20 nt, Artificial Sequence
  MKO10060397_A_Zfp105
  gRNA
ugccaacgaguagcucccaa

SEQ ID NO: 60398 - RNA, 20 nt, Artificial Sequence
  MKO10060398_A_Zfp105
  gRNA
gucugaaagcuuccgagacg

SEQ ID NO: 60399 - RNA, 20 nt, Artificial Sequence
  MKO10060399_A_Zfp105
  gRNA
guuacagcucgcaacuugcu

SEQ ID NO: 60400 - RNA, 20 nt, Artificial Sequence
  MKO10060400_A_Zfp106
  gRNA
cgacgaauucgcaauguuag

SEQ ID NO: 60401 - RNA, 20 nt, Artificial Sequence
  MKO10060401_A_Zfp106
  gRNA
guaucgcuugcguaucccuc

SEQ ID NO: 60402 - RNA, 20 nt, Artificial Sequence
  MKO10060402_A_Zfp106
  gRNA
ugcgaagcauguugcaucac

SEQ ID NO: 60403 - RNA, 20 nt, Artificial Sequence
  MKO10060403_A_Zfp108
  gRNA
ugugaauucucucguguauc

SEQ ID NO: 60404 - RNA, 20 nt, Artificial Sequence
  MKO10060404_A_Zfp108
  gRNA
guuguguguaaucacaaucc

SEQ ID NO: 60405 - RNA, 20 nt, Artificial Sequence
  MKO10060405_A_Zfp108
  gRNA
gugccccgguguguccucuc

SEQ ID NO: 60406 - RNA, 20 nt, Artificial Sequence
  MKO10060406_A_Zfp109
  gRNA
guuugacgagaugcgaucuc

SEQ ID NO: 60407 - RNA, 20 nt, Artificial Sequence
  MKO10060407_A_Zfp109
  gRNA
acuucguauguacuacguac

SEQ ID NO: 60408 - RNA, 20 nt, Artificial Sequence
  MKO10060408_A_Zfp109
  gRNA
cacaggaggcagugaccuuc

SEQ ID NO: 60409 - RNA, 20 nt, Artificial Sequence
  MKO10060409_A_Zfp110
  gRNA
gaguccccugaugaagaucg

SEQ ID NO: 60410 - RNA, 20 nt, Artificial Sequence
  MKO10060410_A_Zfp110
  gRNA
uguaucucugacguuuaccg

SEQ ID NO: 60411 - RNA, 20 nt, Artificial Sequence
  MKO10060411_A_Zfp110
  gRNA
uagaaaaagccgaagacugc

SEQ ID NO: 60412 - RNA, 20 nt, Artificial Sequence
  MKO10060412_A_Zfp111
  gRNA
cccauacugccgacgucugu

SEQ ID NO: 60413 - RNA, 20 nt, Artificial Sequence
  MKO10060413_A_Zfp111
  gRNA
gcucaucaaagagucgaaac

SEQ ID NO: 60414 - RNA, 20 nt, Artificial Sequence
  MKO10060414_A_Zfp111
  gRNA
gagaacaaugaccaaguuac

SEQ ID NO: 60415 - RNA, 20 nt, Artificial Sequence
  MKO10060415_A_Zfp112
  gRNA
gcuaucagacccgguuugaa

SEQ ID NO: 60416 - RNA, 20 nt, Artificial Sequence
  MKO10060416_A_Zfp112
  gRNA
cacaaucguuugugccguac

SEQ ID NO: 60417 - RNA, 20 nt, Artificial Sequence
  MKO10060417_A_Zfp112
  gRNA
caagugccacgcgagugcag

SEQ ID NO: 60418 - RNA, 20 nt, Artificial Sequence
  MKO10060418_A_Zfp113
  gRNA
cagcacuuguucgccaucag

SEQ ID NO: 60419 - RNA, 20 nt, Artificial Sequence
  MKO10060419_A_Zfp113
  gRNA
cuagauggcgauuccaaaac

SEQ ID NO: 60420 - RNA, 20 nt, Artificial Sequence
  MKO10060420_A_Zfp113
  gRNA
augccuuaccgcucucuaac

SEQ ID NO: 60421 - RNA, 20 nt, Artificial Sequence
  MKO10060421_A_Zfp114
  gRNA
cuucagugugcacgcggcag

SEQ ID NO: 60422 - RNA, 20 nt, Artificial Sequence
  MKO10060422_A_Zfp114
  gRNA
caauacucacgucacaagug

SEQ ID NO: 60423 - RNA, 20 nt, Artificial Sequence
  MKO10060423_A_Zfp114
  gRNA
gagaacaaugaccaaguuac

SEQ ID NO: 60424 - RNA, 20 nt, Artificial Sequence
  MKO10060424_A_Zfp119a
  gRNA
gacaauauucuucauuaucg

SEQ ID NO: 60425 - RNA, 20 nt, Artificial Sequence
  MKO10060425_A_Zfp119a
  gRNA
uaauaaaugaggaauagucu

SEQ ID NO: 60426 - RNA, 20 nt, Artificial Sequence
  MKO10060426_A_Zfp119a
  gRNA
uccacuuucuuuguccgcag

SEQ ID NO: 60427 - RNA, 20 nt, Artificial Sequence
  MKO10060427_A_Zfp119b
  gRNA
acauauugucacuccaauau

SEQ ID NO: 60428 - RNA, 20 nt, Artificial Sequence
  MKO10060428_A_Zfp119b
  gRNA
gauguugauccucaauauug

SEQ ID NO: 60429 - RNA, 20 nt, Artificial Sequence
  MKO10060429_A_Zfp119b
  gRNA
cacuucauuucuuagauugc

SEQ ID NO: 60430 - RNA, 20 nt, Artificial Sequence
  MKO10060430_A_Zfp11
  gRNA
cuccugccuuaaacgacacc

SEQ ID NO: 60431 - RNA, 20 nt, Artificial Sequence
  MKO10060431_A_Zfp11
  gRNA
gaggaccgagcgguauuuaa

SEQ ID NO: 60432 - RNA, 20 nt, Artificial Sequence
  MKO10060432_A_Zfp11
  gRNA
gaaagccuuuaaauaccgcu

SEQ ID NO: 60433 - RNA, 20 nt, Artificial Sequence
  MKO10060433_A_Zfp120
  gRNA
acuuaccaugucggaacuuc

SEQ ID NO: 60434 - RNA, 20 nt, Artificial Sequence
  MKO10060434_A_Zfp120
  gRNA
auuucaggcuacuauuggaa

SEQ ID NO: 60435 - RNA, 20 nt, Artificial Sequence
  MKO10060435_A_Zfp120
  gRNA
uguguucuguguaccgcucc

SEQ ID NO: 60436 - RNA, 20 nt, Artificial Sequence
  MKO10060436_A_Zfp128
  gRNA
cuucugcuacguccacguag

SEQ ID NO: 60437 - RNA, 20 nt, Artificial Sequence
  MKO10060437_A_Zfp128
  gRNA
aucccuaucauagaacgaca

SEQ ID NO: 60438 - RNA, 20 nt, Artificial Sequence
  MKO10060438_A_Zfp128
  gRNA
gccagugacuuuccgagaug

SEQ ID NO: 60439 - RNA, 20 nt, Artificial Sequence
  MKO10060439_A_Zfp12
  gRNA
uacacgccuucuucaccgag

SEQ ID NO: 60440 - RNA, 20 nt, Artificial Sequence
  MKO10060440_A_Zfp12
  gRNA
uugcguagcuuccgucgcuu

SEQ ID NO: 60441 - RNA, 20 nt, Artificial Sequence
  MKO10060441_A_Zfp12
  gRNA
cuguaugucguccuuuccuc

SEQ ID NO: 60442 - RNA, 20 nt, Artificial Sequence
  MKO10060442_A_Zfp131
  gRNA
cuccuccgaugauuccgcuc

SEQ ID NO: 60443 - RNA, 20 nt, Artificial Sequence
  MKO10060443_A_Zfp131
  gRNA
aucugccaacaacgccagag

SEQ ID NO: 60444 - RNA, 20 nt, Artificial Sequence
  MKO10060444_A_Zfp131
  gRNA
agcagaguuucuacaaaugc

SEQ ID NO: 60445 - RNA, 20 nt, Artificial Sequence
  MKO10060445_A_Zfp13
  gRNA
caagcgcuucacccgucgcu

SEQ ID NO: 60446 - RNA, 20 nt, Artificial Sequence
  MKO10060446_A_Zfp13
  gRNA
cgagcgacgggugaagcgcu

SEQ ID NO: 60447 - RNA, 20 nt, Artificial Sequence
  MKO10060447_A_Zfp13
  gRNA
cgcuggauguccccgugucc

SEQ ID NO: 60448 - RNA, 20 nt, Artificial Sequence
  MKO10060448_A_Zfp142
  gRNA
gcggaauuccucacgacaga

SEQ ID NO: 60449 - RNA, 20 nt, Artificial Sequence
  MKO10060449_A_Zfp142
  gRNA
auauguagcaccugaccgua

SEQ ID NO: 60450 - RNA, 20 nt, Artificial Sequence
  MKO10060450_A_Zfp142
  gRNA
agaaaguucuccccgugcac

SEQ ID NO: 60451 - RNA, 20 nt, Artificial Sequence
  MKO10060451_A_Zfp143
  gRNA
cuauuguaccuuucgaggug

SEQ ID NO: 60452 - RNA, 20 nt, Artificial Sequence
  MKO10060452_A_Zfp143
  gRNA
uuuauccaccacaccucgaa

SEQ ID NO: 60453 - RNA, 20 nt, Artificial Sequence
  MKO10060453_A_Zfp143
  gRNA
ccagacgggagacucauuga

SEQ ID NO: 60454 - RNA, 20 nt, Artificial Sequence
  MKO10060454_A_Zfp146
  gRNA
cagcgacgugcgcugcgaga

SEQ ID NO: 60455 - RNA, 20 nt, Artificial Sequence
  MKO10060455_A_Zfp146
  gRNA
cuucucgugcuccgucagau

SEQ ID NO: 60456 - RNA, 20 nt, Artificial Sequence
  MKO10060456_A_Zfp146
  gRNA
uucagggcguuuaaugagua

SEQ ID NO: 60457 - RNA, 20 nt, Artificial Sequence
  MKO10060457_A_Zfp148
  gRNA
uaagugauaguucguucuaa

SEQ ID NO: 60458 - RNA, 20 nt, Artificial Sequence
  MKO10060458_A_Zfp148
  gRNA
gaacgaacuaucacuuacag

SEQ ID NO: 60459 - RNA, 20 nt, Artificial Sequence
  MKO10060459_A_Zfp148
  gRNA
ccacauucaucacagcgaaa

SEQ ID NO: 60460 - RNA, 20 nt, Artificial Sequence
  MKO10060460_A_Zfp14
  gRNA
agugcugacuaagcguugag

SEQ ID NO: 60461 - RNA, 20 nt, Artificial Sequence
  MKO10060461_A_Zfp14
  gRNA
gugaaguauauucguuacag

SEQ ID NO: 60462 - RNA, 20 nt, Artificial Sequence
  MKO10060462_A_Zfp14
  gRNA
uuucaggguuuagugacguu

SEQ ID NO: 60463 - RNA, 20 nt, Artificial Sequence
  MKO10060463_A_Zfp157
  gRNA
aaaaugcagagagucguaug

SEQ ID NO: 60464 - RNA, 20 nt, Artificial Sequence
  MKO10060464_A_Zfp157
  gRNA
ccuauagauguacauaaugc

SEQ ID NO: 60465 - RNA, 20 nt, Artificial Sequence
  MKO10060465_A_Zfp157
  gRNA
uacuccaaaugagaguugcc

SEQ ID NO: 60466 - RNA, 20 nt, Artificial Sequence
  MKO10060466_A_Zfp160
  gRNA
uagguuugaacgaacacuaa

SEQ ID NO: 60467 - RNA, 20 nt, Artificial Sequence
  MKO10060467_A_Zfp160
  gRNA
ggauucuucgaugacucuua

SEQ ID NO: 60468 - RNA, 20 nt, Artificial Sequence
  MKO10060468_A_Zfp160
  gRNA
agccauagaguucucucaag

SEQ ID NO: 60469 - RNA, 20 nt, Artificial Sequence
  MKO10060469_A_Zfp169
  gRNA
ggauaccggggacgaaagag

SEQ ID NO: 60470 - RNA, 20 nt, Artificial Sequence
  MKO10060470_A_Zfp169
  gRNA
auuaauggccuuccaugacg

SEQ ID NO: 60471 - RNA, 20 nt, Artificial Sequence
  MKO10060471_A_Zfp169
  gRNA
accaaaacucaucacgcagc

SEQ ID NO: 60472 - RNA, 20 nt, Artificial Sequence
  MKO10060472_A_Zfp174
  gRNA
cugcucgugagauccuucgc

SEQ ID NO: 60473 - RNA, 20 nt, Artificial Sequence
  MKO10060473_A_Zfp174
  gRNA
cugugcaggguacccccuuu

SEQ ID NO: 60474 - RNA, 20 nt, Artificial Sequence
  MKO10060474_A_Zfp174
  gRNA
gugaugcccgauuguugcaa

SEQ ID NO: 60475 - RNA, 20 nt, Artificial Sequence
  MKO10060475_A_Zfp180
  gRNA
gcguccucugaugaacgacg

SEQ ID NO: 60476 - RNA, 20 nt, Artificial Sequence
  MKO10060476_A_Zfp180
  gRNA
gcgcgaugagcuuguaacuc

SEQ ID NO: 60477 - RNA, 20 nt, Artificial Sequence
  MKO10060477_A_Zfp180
  gRNA
cccagagaaaaccgugaucc

SEQ ID NO: 60478 - RNA, 20 nt, Artificial Sequence
  MKO10060478_A_Zfp182
  gRNA
uaccucaugcuacaucaacg

SEQ ID NO: 60479 - RNA, 20 nt, Artificial Sequence
  MKO10060479_A_Zfp182
  gRNA
ggccucguugauguagcaug

SEQ ID NO: 60480 - RNA, 20 nt, Artificial Sequence
  MKO10060480_A_Zfp182
  gRNA
gccagaucucauuaucaagc

SEQ ID NO: 60481 - RNA, 20 nt, Artificial Sequence
  MKO10060481_A_Zfp184
  gRNA
auaccuuccaagggaccgac

SEQ ID NO: 60482 - RNA, 20 nt, Artificial Sequence
  MKO10060482_A_Zfp184
  gRNA
cuguguaagugcaacgaaug

SEQ ID NO: 60483 - RNA, 20 nt, Artificial Sequence
  MKO10060483_A_Zfp184
  gRNA
ggaguaggggacgucccucg

SEQ ID NO: 60484 - RNA, 20 nt, Artificial Sequence
  MKO10060484_A_Zfp185
  gRNA
gcucgguugugacgugagag

SEQ ID NO: 60485 - RNA, 20 nt, Artificial Sequence
  MKO10060485_A_Zfp185
  gRNA
uugucaggucuccaaacgca

SEQ ID NO: 60486 - RNA, 20 nt, Artificial Sequence
  MKO10060486_A_Zfp185
  gRNA
ucagagacgaaucaaaugcc

SEQ ID NO: 60487 - RNA, 20 nt, Artificial Sequence
  MKO10060487_A_Zfp189
  gRNA
gauaagggcguucccccgua

SEQ ID NO: 60488 - RNA, 20 nt, Artificial Sequence
  MKO10060488_A_Zfp189
  gRNA
ggcguccccaagcccaccgc

SEQ ID NO: 60489 - RNA, 20 nt, Artificial Sequence
  MKO10060489_A_Zfp189
  gRNA
uuguaaucucauccgccauc

SEQ ID NO: 60490 - RNA, 20 nt, Artificial Sequence
  MKO10060490_A_Zfp191
  gRNA
agcaugcucaccggcugacc

SEQ ID NO: 60491 - RNA, 20 nt, Artificial Sequence
  MKO10060491_A_Zfp191
  gRNA
uccgagaacuuugccgccug

SEQ ID NO: 60492 - RNA, 20 nt, Artificial Sequence
  MKO10060492_A_Zfp191
  gRNA
cccaggaugcccacuugagc

SEQ ID NO: 60493 - RNA, 20 nt, Artificial Sequence
  MKO10060493_A_Zfp1
  gRNA
gcuaacgagcagcgacuuga

SEQ ID NO: 60494 - RNA, 20 nt, Artificial Sequence
  MKO10060494_A_Zfp1
  gRNA
cgcugcucguuagccacaag

SEQ ID NO: 60495 - RNA, 20 nt, Artificial Sequence
  MKO10060495_A_Zfp1
  gRNA
cuacagcaacuuacuuucag

SEQ ID NO: 60496 - RNA, 20 nt, Artificial Sequence
  MKO10060496_A_Zfp202
  gRNA
ggagaccuugcagcaugacg

SEQ ID NO: 60497 - RNA, 20 nt, Artificial Sequence
  MKO10060497_A_Zfp202
  gRNA
caccugccccugccggaaug

SEQ ID NO: 60498 - RNA, 20 nt, Artificial Sequence
  MKO10060498_A_Zfp202
  gRNA
gaggcucuucuucucuaauc

SEQ ID NO: 60499 - RNA, 20 nt, Artificial Sequence
  MKO10060499_A_Zfp207
  gRNA
augcaaugaauugcuaaacc

SEQ ID NO: 60500 - RNA, 20 nt, Artificial Sequence
  MKO10060500_A_Zfp207
  gRNA
gcaguaccaaaugcaauacc

SEQ ID NO: 60501 - RNA, 20 nt, Artificial Sequence
  MKO10060501_A_Zfp207
  gRNA
ugcauuugguacugcaucua

SEQ ID NO: 60502 - RNA, 20 nt, Artificial Sequence
  MKO10060502_A_Zfp212
  gRNA
gcuuguagcgaaagcugauc

SEQ ID NO: 60503 - RNA, 20 nt, Artificial Sequence
  MKO10060503_A_Zfp212
  gRNA
cucgggacauuuguacgggc

SEQ ID NO: 60504 - RNA, 20 nt, Artificial Sequence
  MKO10060504_A_Zfp212
  gRNA
ucgucugccucccggcagca

SEQ ID NO: 60505 - RNA, 20 nt, Artificial Sequence
  MKO10060505_A_Zfp213
  gRNA
cuuuagccggagcgccuacc

SEQ ID NO: 60506 - RNA, 20 nt, Artificial Sequence
  MKO10060506_A_Zfp213
  gRNA
ccccgacgcgcucccaccag

SEQ ID NO: 60507 - RNA, 20 nt, Artificial Sequence
  MKO10060507_A_Zfp213
  gRNA
uggggagauacgacccagcu

SEQ ID NO: 60508 - RNA, 20 nt, Artificial Sequence
  MKO10060508_A_Zfp217
  gRNA
gccguuaguagcgcauccug

SEQ ID NO: 60509 - RNA, 20 nt, Artificial Sequence
  MKO10060509_A_Zfp217
  gRNA
gccgcaggaugcgcuacuaa

SEQ ID NO: 60510 - RNA, 20 nt, Artificial Sequence
  MKO10060510_A_Zfp217
  gRNA
cccguccauguacacgagga

SEQ ID NO: 60511 - RNA, 20 nt, Artificial Sequence
  MKO10060511_A_Zfp219
  gRNA
uacaccauagccgucgugcu

SEQ ID NO: 60512 - RNA, 20 nt, Artificial Sequence
  MKO10060512_A_Zfp219
  gRNA
cagauccagcucgccgucga

SEQ ID NO: 60513 - RNA, 20 nt, Artificial Sequence
  MKO10060513_A_Zfp219
  gRNA
cgagucgggcuucgcgaagc

SEQ ID NO: 60514 - RNA, 20 nt, Artificial Sequence
  MKO10060514_A_Zfp229
  gRNA
cgcagguauuauugugugca

SEQ ID NO: 60515 - RNA, 20 nt, Artificial Sequence
  MKO10060515_A_Zfp229
  gRNA
aaguucucugaugcguacug

SEQ ID NO: 60516 - RNA, 20 nt, Artificial Sequence
  MKO10060516_A_Zfp229
  gRNA
uggagcaaaucuauauaccc

SEQ ID NO: 60517 - RNA, 20 nt, Artificial Sequence
  MKO10060517_A_Zfp235
  gRNA
cuccgaggauaauggcuguc

SEQ ID NO: 60518 - RNA, 20 nt, Artificial Sequence
  MKO10060518_A_Zfp235
  gRNA
cccacaguugucgcagcagu

SEQ ID NO: 60519 - RNA, 20 nt, Artificial Sequence
  MKO10060519_A_Zfp235
  gRNA
ggccguagucuucagugaag

SEQ ID NO: 60520 - RNA, 20 nt, Artificial Sequence
  MKO10060520_A_Zfp236
  gRNA
gccaguuaacgcgacacauc

SEQ ID NO: 60521 - RNA, 20 nt, Artificial Sequence
  MKO10060521_A_Zfp236
  gRNA
uccugaugugucgcguuaac

SEQ ID NO: 60522 - RNA, 20 nt, Artificial Sequence
  MKO10060522_A_Zfp236
  gRNA
acauauuaugcuccacgaga

SEQ ID NO: 60523 - RNA, 20 nt, Artificial Sequence
  MKO10060523_A_Zfp239
  gRNA
guccaucauuccguccauac

SEQ ID NO: 60524 - RNA, 20 nt, Artificial Sequence
  MKO10060524_A_Zfp239
  gRNA
caccgguauggacggaauga

SEQ ID NO: 60525 - RNA, 20 nt, Artificial Sequence
  MKO10060525_A_Zfp239
  gRNA
ugagaagccguaugcgugcg

SEQ ID NO: 60526 - RNA, 20 nt, Artificial Sequence
  MKO10060526_A_Zfp248
  gRNA
ucauauucguuacgcucgua

SEQ ID NO: 60527 - RNA, 20 nt, Artificial Sequence
  MKO10060527_A_Zfp248
  gRNA
ccaggagcaagugucguuca

SEQ ID NO: 60528 - RNA, 20 nt, Artificial Sequence
  MKO10060528_A_Zfp248
  gRNA
aaagagcuuucacccucgug

SEQ ID NO: 60529 - RNA, 20 nt, Artificial Sequence
  MKO10060529_A_Zfp251
  gRNA
ccacaccacgugacgcgugu

SEQ ID NO: 60530 - RNA, 20 nt, Artificial Sequence
  MKO10060530_A_Zfp251
  gRNA
ucucuccaacacgcgucacg

SEQ ID NO: 60531 - RNA, 20 nt, Artificial Sequence
  MKO10060531_A_Zfp251
  gRNA
acucaccggagucggggagc

SEQ ID NO: 60532 - RNA, 20 nt, Artificial Sequence
  MKO10060532_A_Zfp259
  gRNA
ucaagguguagcgcacuccc

SEQ ID NO: 60533 - RNA, 20 nt, Artificial Sequence
  MKO10060533_A_Zfp259
  gRNA
ucccuacucacccgucgugu

SEQ ID NO: 60534 - RNA, 20 nt, Artificial Sequence
  MKO10060534_A_Zfp259
  gRNA
cucaucagccgugcgaucuc

SEQ ID NO: 60535 - RNA, 20 nt, Artificial Sequence
  MKO10060535_A_Zfp260
  gRNA
gaauaaaccauacgcgugua

SEQ ID NO: 60536 - RNA, 20 nt, Artificial Sequence
  MKO10060536_A_Zfp260
  gRNA
gagcgauguaauucgagaaa

SEQ ID NO: 60537 - RNA, 20 nt, Artificial Sequence
  MKO10060537_A_Zfp260
  gRNA
uacaucugagaagucgccca

SEQ ID NO: 60538 - RNA, 20 nt, Artificial Sequence
  MKO10060538_A_Zfp263
  gRNA
cuuuagcauuauccgcuccc

SEQ ID NO: 60539 - RNA, 20 nt, Artificial Sequence
  MKO10060539_A_Zfp263
  gRNA
auuucaguugcccgagagcc

SEQ ID NO: 60540 - RNA, 20 nt, Artificial Sequence
  MKO10060540_A_Zfp263
  gRNA
cauggcaauguauaucucuc

SEQ ID NO: 60541 - RNA, 20 nt, Artificial Sequence
  MKO10060541_A_Zfp266
  gRNA
aacagcacuuuccgccaccu

SEQ ID NO: 60542 - RNA, 20 nt, Artificial Sequence
  MKO10060542_A_Zfp266
  gRNA
uuugcuucguagacguagau

SEQ ID NO: 60543 - RNA, 20 nt, Artificial Sequence
  MKO10060543_A_Zfp266
  gRNA
cgucuacgaagcaaacauag

SEQ ID NO: 60544 - RNA, 20 nt, Artificial Sequence
  MKO10060544_A_Zfp26
  gRNA
ccaacuuaccuacagcggcc

SEQ ID NO: 60545 - RNA, 20 nt, Artificial Sequence
  MKO10060545_A_Zfp26
  gRNA
cuugucaaaaaauccugcuc

SEQ ID NO: 60546 - RNA, 20 nt, Artificial Sequence
  MKO10060546_A_Zfp26
  gRNA
caaagauuuagcaccagagc

SEQ ID NO: 60547 - RNA, 20 nt, Artificial Sequence
  MKO10060547_A_Zfp273
  gRNA
caccaguauggagucuccaa

SEQ ID NO: 60548 - RNA, 20 nt, Artificial Sequence
  MKO10060548_A_Zfp273
  gRNA
ccucaaaucuuaaacaccau

SEQ ID NO: 60549 - RNA, 20 nt, Artificial Sequence
  MKO10060549_A_Zfp273
  gRNA
ugcuuucuccaagccauacc

SEQ ID NO: 60550 - RNA, 20 nt, Artificial Sequence
  MKO10060550_A_Zfp275
  gRNA
auuggcccucggggaacucg

SEQ ID NO: 60551 - RNA, 20 nt, Artificial Sequence
  MKO10060551_A_Zfp275
  gRNA
agggcaguguuuacucgcga

SEQ ID NO: 60552 - RNA, 20 nt, Artificial Sequence
  MKO10060552_A_Zfp275
  gRNA
ugucauuugauauuguaccg

SEQ ID NO: 60553 - RNA, 20 nt, Artificial Sequence
  MKO10060553_A_Zfp276
  gRNA
aaugccccauagcgagaguc

SEQ ID NO: 60554 - RNA, 20 nt, Artificial Sequence
  MKO10060554_A_Zfp276
  gRNA
ccucgucaaccucggaugau

SEQ ID NO: 60555 - RNA, 20 nt, Artificial Sequence
  MKO10060555_A_Zfp276
  gRNA
accaagccgugcagacaccg

SEQ ID NO: 60556 - RNA, 20 nt, Artificial Sequence
  MKO10060556_A_Zfp277
  gRNA
cuguguguccgauuccgccg

SEQ ID NO: 60557 - RNA, 20 nt, Artificial Sequence
  MKO10060557_A_Zfp277
  gRNA
agcucguugcagauuuccga

SEQ ID NO: 60558 - RNA, 20 nt, Artificial Sequence
  MKO10060558_A_Zfp277
  gRNA
gcugggguccgcgggguccg

SEQ ID NO: 60559 - RNA, 20 nt, Artificial Sequence
  MKO10060559_A_Zfp27
  gRNA
cgccauggcugcgucgacug

SEQ ID NO: 60560 - RNA, 20 nt, Artificial Sequence
  MKO10060560_A_Zfp27
  gRNA
cgcacggucgagagauacac

SEQ ID NO: 60561 - RNA, 20 nt, Artificial Sequence
  MKO10060561_A_Zfp27
  gRNA
cgauagagacuccuuugagc

SEQ ID NO: 60562 - RNA, 20 nt, Artificial Sequence
  MKO10060562_A_Zfp280b
  gRNA
cgaccgagugcacacgucac

SEQ ID NO: 60563 - RNA, 20 nt, Artificial Sequence
  MKO10060563_A_Zfp280b
  gRNA
uccgucgaccuugauucagc

SEQ ID NO: 60564 - RNA, 20 nt, Artificial Sequence
  MKO10060564_A_Zfp280b
  gRNA
uuagagcaaccacgacucag

SEQ ID NO: 60565 - RNA, 20 nt, Artificial Sequence
  MKO10060565_A_Zfp280c
  gRNA
gcaaccagugcauucgauga

SEQ ID NO: 60566 - RNA, 20 nt, Artificial Sequence
  MKO10060566_A_Zfp280c
  gRNA
uuucuguaguguugacucgu

SEQ ID NO: 60567 - RNA, 20 nt, Artificial Sequence
  MKO10060567_A_Zfp280c
  gRNA
agucccuuugaagaugaacc

SEQ ID NO: 60568 - RNA, 20 nt, Artificial Sequence
  MKO10060568_A_Zfp280d
  gRNA
aagaaugguauacucaaucg

SEQ ID NO: 60569 - RNA, 20 nt, Artificial Sequence
  MKO10060569_A_Zfp280d
  gRNA
uucaggcagcguugacuugu

SEQ ID NO: 60570 - RNA, 20 nt, Artificial Sequence
  MKO10060570_A_Zfp280d
  gRNA
aucugcuuacuugaaauagc

SEQ ID NO: 60571 - RNA, 20 nt, Artificial Sequence
  MKO10060571_A_Zfp281
  gRNA
ucaccguuaccagacguagu

SEQ ID NO: 60572 - RNA, 20 nt, Artificial Sequence
  MKO10060572_A_Zfp281
  gRNA
aaggccgcggcugacgccgc

SEQ ID NO: 60573 - RNA, 20 nt, Artificial Sequence
  MKO10060573_A_Zfp281
  gRNA
gauuucugcccaacuacguc

SEQ ID NO: 60574 - RNA, 20 nt, Artificial Sequence
  MKO10060574_A_Zfp282
  gRNA
guagacagcaaugucgacga

SEQ ID NO: 60575 - RNA, 20 nt, Artificial Sequence
  MKO10060575_A_Zfp282
  gRNA
cggccugcugcaacgucgcc

SEQ ID NO: 60576 - RNA, 20 nt, Artificial Sequence
  MKO10060576_A_Zfp282
  gRNA
ucuccaggcgacguugcagc

SEQ ID NO: 60577 - RNA, 20 nt, Artificial Sequence
  MKO10060577_A_Zfp286
  gRNA
cgaacucuucacuuaccguu

SEQ ID NO: 60578 - RNA, 20 nt, Artificial Sequence
  MKO10060578_A_Zfp286
  gRNA
ggccauggacuuuacgccag

SEQ ID NO: 60579 - RNA, 20 nt, Artificial Sequence
  MKO10060579_A_Zfp286
  gRNA
uccugggacguucacacgcu

SEQ ID NO: 60580 - RNA, 20 nt, Artificial Sequence
  MKO10060580_A_Zfp287
  gRNA
cggaacccaaaccguaaaac

SEQ ID NO: 60581 - RNA, 20 nt, Artificial Sequence
  MKO10060581_A_Zfp287
  gRNA
cuuggugacauucaaugacg

SEQ ID NO: 60582 - RNA, 20 nt, Artificial Sequence
  MKO10060582_A_Zfp287
  gRNA
uaucugucaauugcgauguc

SEQ ID NO: 60583 - RNA, 20 nt, Artificial Sequence
  MKO10060583_A_Zfp28
  gRNA
gugcaguguucacgacacac

SEQ ID NO: 60584 - RNA, 20 nt, Artificial Sequence
  MKO10060584_A_Zfp28
  gRNA
ccauagaccuaagugcucca

SEQ ID NO: 60585 - RNA, 20 nt, Artificial Sequence
  MKO10060585_A_Zfp28
  gRNA
cuacaggaaccuagcauccc

SEQ ID NO: 60586 - RNA, 20 nt, Artificial Sequence
  MKO10060586_A_Zfp292
  gRNA
gucgagcuuuaacguagcuc

SEQ ID NO: 60587 - RNA, 20 nt, Artificial Sequence
  MKO10060587_A_Zfp292
  gRNA
ugccaagcguuccagcacca

SEQ ID NO: 60588 - RNA, 20 nt, Artificial Sequence
  MKO10060588_A_Zfp292
  gRNA
gguagcgcaugagacacuga

SEQ ID NO: 60589 - RNA, 20 nt, Artificial Sequence
  MKO10060589_A_Zfp296
  gRNA
ucuccccaugucccgccgca

SEQ ID NO: 60590 - RNA, 20 nt, Artificial Sequence
  MKO10060590_A_Zfp296
  gRNA
gaucuacgcggcgaggcacg

SEQ ID NO: 60591 - RNA, 20 nt, Artificial Sequence
  MKO10060591_A_Zfp296
  gRNA
aaccgccaccgucgcaccca

SEQ ID NO: 60592 - RNA, 20 nt, Artificial Sequence
  MKO10060592_A_Zfp2
  gRNA
caucccuuauagugcaccag

SEQ ID NO: 60593 - RNA, 20 nt, Artificial Sequence
  MKO10060593_A_Zfp2
  gRNA
gauccuaccuguugguuaaa

SEQ ID NO: 60594 - RNA, 20 nt, Artificial Sequence
  MKO10060594_A_Zfp2
  gRNA
guacaccaaguuauacacac

SEQ ID NO: 60595 - RNA, 20 nt, Artificial Sequence
  MKO10060595_A_Zfp300
  gRNA
ucuaaagaggcgaucacuuc

SEQ ID NO: 60596 - RNA, 20 nt, Artificial Sequence
  MKO10060596_A_Zfp300
  gRNA
gagcacuaaggcuuagcuua

SEQ ID NO: 60597 - RNA, 20 nt, Artificial Sequence
  MKO10060597_A_Zfp300
  gRNA
gcugcaaagcucauacuacu

SEQ ID NO: 60598 - RNA, 20 nt, Artificial Sequence
  MKO10060598_A_Zfp30
  gRNA
caagccaguucuugcgauuc

SEQ ID NO: 60599 - RNA, 20 nt, Artificial Sequence
  MKO10060599_A_Zfp30
  gRNA
gugcggcaagagcuuccggc

SEQ ID NO: 60600 - RNA, 20 nt, Artificial Sequence
  MKO10060600_A_Zfp30
  gRNA
acgaaauuaaucuaucuccg

SEQ ID NO: 60601 - RNA, 20 nt, Artificial Sequence
  MKO10060601_A_Zfp316
  gRNA
gcgaagcgagcgccgcauuc

SEQ ID NO: 60602 - RNA, 20 nt, Artificial Sequence
  MKO10060602_A_Zfp316
  gRNA
uccggacgguuuccccauuc

SEQ ID NO: 60603 - RNA, 20 nt, Artificial Sequence
  MKO10060603_A_Zfp316
  gRNA
gaggagggagaugucgucac

SEQ ID NO: 60604 - RNA, 20 nt, Artificial Sequence
  MKO10060604_A_Zfp317
  gRNA
ccauaaauagguuaucaggu

SEQ ID NO: 60605 - RNA, 20 nt, Artificial Sequence
  MKO10060605_A_Zfp317
  gRNA
uuauagcaaucuaaguucac

SEQ ID NO: 60606 - RNA, 20 nt, Artificial Sequence
  MKO10060606_A_Zfp317
  gRNA
gaacuacaucuaaagucaaa

SEQ ID NO: 60607 - RNA, 20 nt, Artificial Sequence
  MKO10060607_A_Zfp318
  gRNA
ucgcgcugccgucuuucgac

SEQ ID NO: 60608 - RNA, 20 nt, Artificial Sequence
  MKO10060608_A_Zfp318
  gRNA
gacggccgcggagaccaucc

SEQ ID NO: 60609 - RNA, 20 nt, Artificial Sequence
  MKO10060609_A_Zfp318
  gRNA
aagguccaguucucgaaacu

SEQ ID NO: 60610 - RNA, 20 nt, Artificial Sequence
  MKO10060610_A_Zfp319
  gRNA
cggaagggccgcucgccgcu

SEQ ID NO: 60611 - RNA, 20 nt, Artificial Sequence
  MKO10060611_A_Zfp319
  gRNA
aaaaaaagcggcgcucgcac

SEQ ID NO: 60612 - RNA, 20 nt, Artificial Sequence
  MKO10060612_A_Zfp319
  gRNA
cgccagaaugcgcguacaug

SEQ ID NO: 60613 - RNA, 20 nt, Artificial Sequence
  MKO10060613_A_Zfp322a
  gRNA
ugaucuaaguucucacgcau

SEQ ID NO: 60614 - RNA, 20 nt, Artificial Sequence
  MKO10060614_A_Zfp322a
  gRNA
caacgaaguccauaccuagg

SEQ ID NO: 60615 - RNA, 20 nt, Artificial Sequence
  MKO10060615_A_Zfp322a
  gRNA
cucgaagugccaaccuaauu

SEQ ID NO: 60616 - RNA, 20 nt, Artificial Sequence
  MKO10060616_A_Zfp324
  gRNA
acccgcgguggauuugucag

SEQ ID NO: 60617 - RNA, 20 nt, Artificial Sequence
  MKO10060617_A_Zfp324
  gRNA
uugcacgcccuacauucgaa

SEQ ID NO: 60618 - RNA, 20 nt, Artificial Sequence
  MKO10060618_A_Zfp324
  gRNA
ggccgcugacaaauccaccg

SEQ ID NO: 60619 - RNA, 20 nt, Artificial Sequence
  MKO10060619_A_Zfp326
  gRNA
auuacgugcacucuacuugc

SEQ ID NO: 60620 - RNA, 20 nt, Artificial Sequence
  MKO10060620_A_Zfp326
  gRNA
auagggcuggaucgugacua

SEQ ID NO: 60621 - RNA, 20 nt, Artificial Sequence
  MKO10060621_A_Zfp326
  gRNA
gcuuauccugaaaguacguu

SEQ ID NO: 60622 - RNA, 20 nt, Artificial Sequence
  MKO10060622_A_Zfp329
  gRNA
uccugaagaguuuacgacac

SEQ ID NO: 60623 - RNA, 20 nt, Artificial Sequence
  MKO10060623_A_Zfp329
  gRNA
guucccuuaacugcauaacu

SEQ ID NO: 60624 - RNA, 20 nt, Artificial Sequence
  MKO10060624_A_Zfp329
  gRNA
accagugucguaaacucuuc

SEQ ID NO: 60625 - RNA, 20 nt, Artificial Sequence
  MKO10060625_A_Zfp330
  gRNA
agcagcuuaccaccauagca

SEQ ID NO: 60626 - RNA, 20 nt, Artificial Sequence
  MKO10060626_A_Zfp330
  gRNA
acacacucugcaucugugag

SEQ ID NO: 60627 - RNA, 20 nt, Artificial Sequence
  MKO10060627_A_Zfp330
  gRNA
gagcgagggguaugggacca

SEQ ID NO: 60628 - RNA, 20 nt, Artificial Sequence
  MKO10060628_A_Zfp334
  gRNA
ugguucucuugugcgcgaag

SEQ ID NO: 60629 - RNA, 20 nt, Artificial Sequence
  MKO10060629_A_Zfp334
  gRNA
uugucacgacagaaccacgc

SEQ ID NO: 60630 - RNA, 20 nt, Artificial Sequence
  MKO10060630_A_Zfp334
  gRNA
ccuacgccugcaauuacugu

SEQ ID NO: 60631 - RNA, 20 nt, Artificial Sequence
  MKO10060631_A_Zfp335
  gRNA
cuccagaucgucaaucgccc

SEQ ID NO: 60632 - RNA, 20 nt, Artificial Sequence
  MKO10060632_A_Zfp335
  gRNA
aagugccccacuuccguaca

SEQ ID NO: 60633 - RNA, 20 nt, Artificial Sequence
  MKO10060633_A_Zfp335
  gRNA
aagaucaucgaaucuaccau

SEQ ID NO: 60634 - RNA, 20 nt, Artificial Sequence
  MKO10060634_A_Zfp341
  gRNA
ucuggccguccaguccuuac

SEQ ID NO: 60635 - RNA, 20 nt, Artificial Sequence
  MKO10060635_A_Zfp341
  gRNA
agcacccgcugccguccagc

SEQ ID NO: 60636 - RNA, 20 nt, Artificial Sequence
  MKO10060636_A_Zfp341
  gRNA
gaugcagccguacccgcccc

SEQ ID NO: 60637 - RNA, 20 nt, Artificial Sequence
  MKO10060637_A_Zfp345
  gRNA
gaagaugcucuuccauauua

SEQ ID NO: 60638 - RNA, 20 nt, Artificial Sequence
  MKO10060638_A_Zfp345
  gRNA
aaaacuacugugauguauga

SEQ ID NO: 60639 - RNA, 20 nt, Artificial Sequence
  MKO10060639_A_Zfp345
  gRNA
uauaaauucuuucuugucuu

SEQ ID NO: 60640 - RNA, 20 nt, Artificial Sequence
  MKO10060640_A_Zfp346
  gRNA
aacauucaacgacccugcca

SEQ ID NO: 60641 - RNA, 20 nt, Artificial Sequence
  MKO10060641_A_Zfp346
  gRNA
ucagcuuuaggcucuuugcg

SEQ ID NO: 60642 - RNA, 20 nt, Artificial Sequence
  MKO10060642_A_Zfp346
  gRNA
caauaaagggggacgugaag

SEQ ID NO: 60643 - RNA, 20 nt, Artificial Sequence
  MKO10060643_A_Zfp352
  gRNA
ccucaggugacaaguccaau

SEQ ID NO: 60644 - RNA, 20 nt, Artificial Sequence
  MKO10060644_A_Zfp352
  gRNA
ugucauaugacuguuguagg

SEQ ID NO: 60645 - RNA, 20 nt, Artificial Sequence
  MKO10060645_A_Zfp352
  gRNA
aaaaacgaccaugugcaccc

SEQ ID NO: 60646 - RNA, 20 nt, Artificial Sequence
  MKO10060646_A_Zfp354a
  gRNA
cuacauuuauagcguuuauc

SEQ ID NO: 60647 - RNA, 20 nt, Artificial Sequence
  MKO10060647_A_Zfp354a
  gRNA
gugguaaauccuuuggccga

SEQ ID NO: 60648 - RNA, 20 nt, Artificial Sequence
  MKO10060648_A_Zfp354a
  gRNA
gucguugacauuugaagacg

SEQ ID NO: 60649 - RNA, 20 nt, Artificial Sequence
  MKO10060649_A_Zfp354b
  gRNA
augaucuccguguugcaaca

SEQ ID NO: 60650 - RNA, 20 nt, Artificial Sequence
  MKO10060650_A_Zfp354b
  gRNA
agcguuggccugaagucaau

SEQ ID NO: 60651 - RNA, 20 nt, Artificial Sequence
  MKO10060651_A_Zfp354b
  gRNA
cuauagaauucauaucgaag

SEQ ID NO: 60652 - RNA, 20 nt, Artificial Sequence
  MKO10060652_A_Zfp354c
  gRNA
gagagaaaccuuaccgcugc

SEQ ID NO: 60653 - RNA, 20 nt, Artificial Sequence
  MKO10060653_A_Zfp354c
  gRNA
aacucccacgggcuucgagc

SEQ ID NO: 60654 - RNA, 20 nt, Artificial Sequence
  MKO10060654_A_Zfp354c
  gRNA
gcuucaauaccuccugugau

SEQ ID NO: 60655 - RNA, 20 nt, Artificial Sequence
  MKO10060655_A_Zfp358
  gRNA
gggccaaucacgucaggauc

SEQ ID NO: 60656 - RNA, 20 nt, Artificial Sequence
  MKO10060656_A_Zfp358
  gRNA
cuucggucauggcucguugc

SEQ ID NO: 60657 - RNA, 20 nt, Artificial Sequence
  MKO10060657_A_Zfp358
  gRNA
cgaagcuccacgauccaucu

SEQ ID NO: 60658 - RNA, 20 nt, Artificial Sequence
  MKO10060658_A_Zfp35
  gRNA
guuuaaccaugccugagugc

SEQ ID NO: 60659 - RNA, 20 nt, Artificial Sequence
  MKO10060659_A_Zfp35
  gRNA
cuugagauucguaacugaau

SEQ ID NO: 60660 - RNA, 20 nt, Artificial Sequence
  MKO10060660_A_Zfp35
  gRNA
gaucagcgugaacucuuuga

SEQ ID NO: 60661 - RNA, 20 nt, Artificial Sequence
  MKO10060661_A_Zfp362
  gRNA
gauuuaacaacccguacuuc

SEQ ID NO: 60662 - RNA, 20 nt, Artificial Sequence
  MKO10060662_A_Zfp362
  gRNA
ccucgcgugcagugccacgu

SEQ ID NO: 60663 - RNA, 20 nt, Artificial Sequence
  MKO10060663_A_Zfp362
  gRNA
ugggcagcgacaugaccgcc

SEQ ID NO: 60664 - RNA, 20 nt, Artificial Sequence
  MKO10060664_A_Zfp365
  gRNA
ccgagaaaaguucaaucgca

SEQ ID NO: 60665 - RNA, 20 nt, Artificial Sequence
  MKO10060665_A_Zfp365
  gRNA
ccagaaaaccgccgaacugu

SEQ ID NO: 60666 - RNA, 20 nt, Artificial Sequence
  MKO10060666_A_Zfp365
  gRNA
augauauucacgauugcugu

SEQ ID NO: 60667 - RNA, 20 nt, Artificial Sequence
  MKO10060667_A_Zfp366
  gRNA
cguaguagcugucgucgauc

SEQ ID NO: 60668 - RNA, 20 nt, Artificial Sequence
  MKO10060668_A_Zfp366
  gRNA
ccacacgcgugcucccguug

SEQ ID NO: 60669 - RNA, 20 nt, Artificial Sequence
  MKO10060669_A_Zfp366
  gRNA
gcccguucgcacugcgcuuc

SEQ ID NO: 60670 - RNA, 20 nt, Artificial Sequence
  MKO10060670_A_Zfp367
  gRNA
uguuugcugagugcguccgu

SEQ ID NO: 60671 - RNA, 20 nt, Artificial Sequence
  MKO10060671_A_Zfp367
  gRNA
uaacaggauggaauccgacg

SEQ ID NO: 60672 - RNA, 20 nt, Artificial Sequence
  MKO10060672_A_Zfp367
  gRNA
ugugagggcuacuggcggag

SEQ ID NO: 60673 - RNA, 20 nt, Artificial Sequence
  MKO10060673_A_Zfp369
  gRNA
gaguccccugaugaagauua

SEQ ID NO: 60674 - RNA, 20 nt, Artificial Sequence
  MKO10060674_A_Zfp369
  gRNA
uguaucacugagauuuaccg

SEQ ID NO: 60675 - RNA, 20 nt, Artificial Sequence
  MKO10060675_A_Zfp369
  gRNA
gggauugaaucagggcauuc

SEQ ID NO: 60676 - RNA, 20 nt, Artificial Sequence
  MKO10060676_A_Zfp36l1
  gRNA
ucaucggcgcucaggauagg

SEQ ID NO: 60677 - RNA, 20 nt, Artificial Sequence
  MKO10060677_A_Zfp36l1
  gRNA
cccguacgggcaaaagccga

SEQ ID NO: 60678 - RNA, 20 nt, Artificial Sequence
  MKO10060678_A_Zfp36l1
  gRNA
aacuucgcucaagucaaaaa

SEQ ID NO: 60679 - RNA, 20 nt, Artificial Sequence
  MKO10060679_A_Zfp36l2
  gRNA
cgauaucgacuucuugugca

SEQ ID NO: 60680 - RNA, 20 nt, Artificial Sequence
  MKO10060680_A_Zfp36l2
  gRNA
cgcgugcgccaaacgcucgc

SEQ ID NO: 60681 - RNA, 20 nt, Artificial Sequence
  MKO10060681_A_Zfp36l2
  gRNA
gccgccgcucguccgcguug

SEQ ID NO: 60682 - RNA, 20 nt, Artificial Sequence
  MKO10060682_A_Zfp36l3
  gRNA
cggugucgcagauccacccg

SEQ ID NO: 60683 - RNA, 20 nt, Artificial Sequence
  MKO10060683_A_Zfp36l3
  gRNA
ugagucgcuagaguucgacg

SEQ ID NO: 60684 - RNA, 20 nt, Artificial Sequence
  MKO10060684_A_Zfp36l3
  gRNA
uugacaggguacgcaguucg

SEQ ID NO: 60685 - RNA, 20 nt, Artificial Sequence
  MKO10060685_A_Zfp36
  gRNA
gagcucggucuuguaucgag

SEQ ID NO: 60686 - RNA, 20 nt, Artificial Sequence
  MKO10060686_A_Zfp36
  gRNA
aacucggacuccaucccguc

SEQ ID NO: 60687 - RNA, 20 nt, Artificial Sequence
  MKO10060687_A_Zfp36
  gRNA
ggaucucucugccaucuacg

SEQ ID NO: 60688 - RNA, 20 nt, Artificial Sequence
  MKO10060688_A_Zfp37
  gRNA
cucaccgcaucgcuuuccgc

SEQ ID NO: 60689 - RNA, 20 nt, Artificial Sequence
  MKO10060689_A_Zfp37
  gRNA
cgcccacaagcaaucuccgc

SEQ ID NO: 60690 - RNA, 20 nt, Artificial Sequence
  MKO10060690_A_Zfp37
  gRNA
gaauccgcauauguuuaguc

SEQ ID NO: 60691 - RNA, 20 nt, Artificial Sequence
  MKO10060691_A_Zfp382
  gRNA
ccuaccuuaucgagcacgag

SEQ ID NO: 60692 - RNA, 20 nt, Artificial Sequence
  MKO10060692_A_Zfp382
  gRNA
ggauccgcucgugcucgaua

SEQ ID NO: 60693 - RNA, 20 nt, Artificial Sequence
  MKO10060693_A_Zfp382
  gRNA
accugauaugauccgcaagu

SEQ ID NO: 60694 - RNA, 20 nt, Artificial Sequence
  MKO10060694_A_Zfp383
  gRNA
gguggaccacgccaaaaaua

SEQ ID NO: 60695 - RNA, 20 nt, Artificial Sequence
  MKO10060695_A_Zfp383
  gRNA
ccccauagcuguaccgaaug

SEQ ID NO: 60696 - RNA, 20 nt, Artificial Sequence
  MKO10060696_A_Zfp383
  gRNA
aagcuucgagcucugcguaa

SEQ ID NO: 60697 - RNA, 20 nt, Artificial Sequence
  MKO10060697_A_Zfp384
  gRNA
ccgcaagaagaagcggaugc

SEQ ID NO: 60698 - RNA, 20 nt, Artificial Sequence
  MKO10060698_A_Zfp384
  gRNA
accuguagggcuugcgagcc

SEQ ID NO: 60699 - RNA, 20 nt, Artificial Sequence
  MKO10060699_A_Zfp384
  gRNA
caggaaccacugugauauuc

SEQ ID NO: 60700 - RNA, 20 nt, Artificial Sequence
  MKO10060700_A_Zfp385a
  gRNA
cgccaugcccgaagagucaa

SEQ ID NO: 60701 - RNA, 20 nt, Artificial Sequence
  MKO10060701_A_Zfp385a
  gRNA
gaugguguagccccucgucc

SEQ ID NO: 60702 - RNA, 20 nt, Artificial Sequence
  MKO10060702_A_Zfp385a
  gRNA
ccccaucaugcagccaccga

SEQ ID NO: 60703 - RNA, 20 nt, Artificial Sequence
  MKO10060703_A_Zfp385b
  gRNA
agcgccguuugugcucuugg

SEQ ID NO: 60704 - RNA, 20 nt, Artificial Sequence
  MKO10060704_A_Zfp385b
  gRNA
auuagccuuugcgcuguccu

SEQ ID NO: 60705 - RNA, 20 nt, Artificial Sequence
  MKO10060705_A_Zfp385b
  gRNA
acucuacugcucacuaugca

SEQ ID NO: 60706 - RNA, 20 nt, Artificial Sequence
  MKO10060706_A_Zfp385c
  gRNA
acuucagcucccgccgaccc

SEQ ID NO: 60707 - RNA, 20 nt, Artificial Sequence
  MKO10060707_A_Zfp385c
  gRNA
ugagcgggguggugccauug

SEQ ID NO: 60708 - RNA, 20 nt, Artificial Sequence
  MKO10060708_A_Zfp385c
  gRNA
ggcccauaccgugcugaagu

SEQ ID NO: 60709 - RNA, 20 nt, Artificial Sequence
  MKO10060709_A_Zfp386
  gRNA
gcaguugaccuuccgcgacg

SEQ ID NO: 60710 - RNA, 20 nt, Artificial Sequence
  MKO10060710_A_Zfp386
  gRNA
agaagucaacggccacgucg

SEQ ID NO: 60711 - RNA, 20 nt, Artificial Sequence
  MKO10060711_A_Zfp386
  gRNA
ugcaauaauggaucaguagc

SEQ ID NO: 60712 - RNA, 20 nt, Artificial Sequence
  MKO10060712_A_Zfp395
  gRNA
ggaacaucgacgucccgaag

SEQ ID NO: 60713 - RNA, 20 nt, Artificial Sequence
  MKO10060713_A_Zfp395
  gRNA
acgucgauguuccuagacac

SEQ ID NO: 60714 - RNA, 20 nt, Artificial Sequence
  MKO10060714_A_Zfp395
  gRNA
caaaguucuccguucaauug

SEQ ID NO: 60715 - RNA, 20 nt, Artificial Sequence
  MKO10060715_A_Zfp397
  gRNA
agucgccccagagccucucg

SEQ ID NO: 60716 - RNA, 20 nt, Artificial Sequence
  MKO10060716_A_Zfp397
  gRNA
aauuauuucgccagcaauuc

SEQ ID NO: 60717 - RNA, 20 nt, Artificial Sequence
  MKO10060717_A_Zfp397
  gRNA
cuugacuaaaacugccccug

SEQ ID NO: 60718 - RNA, 20 nt, Artificial Sequence
  MKO10060718_A_Zfp398
  gRNA
guagauggagacgucaucga

SEQ ID NO: 60719 - RNA, 20 nt, Artificial Sequence
  MKO10060719_A_Zfp398
  gRNA
uuaccuucacuggggucugc

SEQ ID NO: 60720 - RNA, 20 nt, Artificial Sequence
  MKO10060720_A_Zfp398
  gRNA
ggcugaggcgaccgccgcuc

SEQ ID NO: 60721 - RNA, 20 nt, Artificial Sequence
  MKO10060721_A_Zfp39
  gRNA
cgugccgguuauaagcccua

SEQ ID NO: 60722 - RNA, 20 nt, Artificial Sequence
  MKO10060722_A_Zfp39
  gRNA
cucggacucgccaaacuuac

SEQ ID NO: 60723 - RNA, 20 nt, Artificial Sequence
  MKO10060723_A_Zfp39
  gRNA
ucuaguuucaagacaucgac

SEQ ID NO: 60724 - RNA, 20 nt, Artificial Sequence
  MKO10060724_A_Zfp3
  gRNA
cagaugagagguccgccuga

SEQ ID NO: 60725 - RNA, 20 nt, Artificial Sequence
  MKO10060725_A_Zfp3
  gRNA
aaggcuggaguuagucccga

SEQ ID NO: 60726 - RNA, 20 nt, Artificial Sequence
  MKO10060726_A_Zfp3
  gRNA
aucuucaagaagucguccuc

SEQ ID NO: 60727 - RNA, 20 nt, Artificial Sequence
  MKO10060727_A_Zfp407
  gRNA
augcccucaccaagcaccgu

SEQ ID NO: 60728 - RNA, 20 nt, Artificial Sequence
  MKO10060728_A_Zfp407
  gRNA
ugaguaguggcacgugggcc

SEQ ID NO: 60729 - RNA, 20 nt, Artificial Sequence
  MKO10060729_A_Zfp407
  gRNA
acugaccuguaugcugccga

SEQ ID NO: 60730 - RNA, 20 nt, Artificial Sequence
  MKO10060730_A_Zfp408
  gRNA
caaagcugggccgacgcuac

SEQ ID NO: 60731 - RNA, 20 nt, Artificial Sequence
  MKO10060731_A_Zfp408
  gRNA
cuaugggaugacucgugacc

SEQ ID NO: 60732 - RNA, 20 nt, Artificial Sequence
  MKO10060732_A_Zfp408
  gRNA
gggaaugaagacaccgcacg

SEQ ID NO: 60733 - RNA, 20 nt, Artificial Sequence
  MKO10060733_A_Zfp40
  gRNA
auucauuagauggaucccau

SEQ ID NO: 60734 - RNA, 20 nt, Artificial Sequence
  MKO10060734_A_Zfp40
  gRNA
cguauuuaccacauaugcaa

SEQ ID NO: 60735 - RNA, 20 nt, Artificial Sequence
  MKO10060735_A_Zfp40
  gRNA
cauguauagagcucuuugag

SEQ ID NO: 60736 - RNA, 20 nt, Artificial Sequence
  MKO10060736_A_Zfp410
  gRNA
ugcagccgacuaauguuacc

SEQ ID NO: 60737 - RNA, 20 nt, Artificial Sequence
  MKO10060737_A_Zfp410
  gRNA
cuucugaaccuaacgagagc

SEQ ID NO: 60738 - RNA, 20 nt, Artificial Sequence
  MKO10060738_A_Zfp410
  gRNA
cccaccuaccugcucucguu

SEQ ID NO: 60739 - RNA, 20 nt, Artificial Sequence
  MKO10060739_A_Zfp414
  gRNA
cccucgacugcgcccauucc

SEQ ID NO: 60740 - RNA, 20 nt, Artificial Sequence
  MKO10060740_A_Zfp414
  gRNA
cccagacgccguccaccgcc

SEQ ID NO: 60741 - RNA, 20 nt, Artificial Sequence
  MKO10060741_A_Zfp414
  gRNA
gccaggaaugggcgcagucg

SEQ ID NO: 60742 - RNA, 20 nt, Artificial Sequence
  MKO10060742_A_Zfp418
  gRNA
uugcaucuaagugaccuacc

SEQ ID NO: 60743 - RNA, 20 nt, Artificial Sequence
  MKO10060743_A_Zfp418
  gRNA
guuuaauaagguuggcgcuu

SEQ ID NO: 60744 - RNA, 20 nt, Artificial Sequence
  MKO10060744_A_Zfp418
  gRNA
ccagcaucacaucaagauac

SEQ ID NO: 60745 - RNA, 20 nt, Artificial Sequence
  MKO10060745_A_Zfp41
  gRNA
gacgcuuccgaugccggaug

SEQ ID NO: 60746 - RNA, 20 nt, Artificial Sequence
  MKO10060746_A_Zfp41
  gRNA
ugcgcaaaaggccacuguca

SEQ ID NO: 60747 - RNA, 20 nt, Artificial Sequence
  MKO10060747_A_Zfp41
  gRNA
aaagauaugugcuucguccu

SEQ ID NO: 60748 - RNA, 20 nt, Artificial Sequence
  MKO10060748_A_Zfp420
  gRNA
ugcugagguaggcgcgugcc

SEQ ID NO: 60749 - RNA, 20 nt, Artificial Sequence
  MKO10060749_A_Zfp420
  gRNA
cacuacuuaugcaacaucaa

SEQ ID NO: 60750 - RNA, 20 nt, Artificial Sequence
  MKO10060750_A_Zfp420
  gRNA
gaguugugagcuucgaauaa

SEQ ID NO: 60751 - RNA, 20 nt, Artificial Sequence
  MKO10060751_A_Zfp422
  gRNA
caagcccgagucgaagcgaa

SEQ ID NO: 60752 - RNA, 20 nt, Artificial Sequence
  MKO10060752_A_Zfp422
  gRNA
gguggccauucgcuucgacu

SEQ ID NO: 60753 - RNA, 20 nt, Artificial Sequence
  MKO10060753_A_Zfp422
  gRNA
ucccauaaaugugccgauug

SEQ ID NO: 60754 - RNA, 20 nt, Artificial Sequence
  MKO10060754_A_Zfp423
  gRNA
cccagucuccuccgacgucg

SEQ ID NO: 60755 - RNA, 20 nt, Artificial Sequence
  MKO10060755_A_Zfp423
  gRNA
ucacaacauccggcccggcg

SEQ ID NO: 60756 - RNA, 20 nt, Artificial Sequence
  MKO10060756_A_Zfp423
  gRNA
ucucguucucgaacgucauc

SEQ ID NO: 60757 - RNA, 20 nt, Artificial Sequence
  MKO10060757_A_Zfp426
  gRNA
caaauguucagcguuccagc

SEQ ID NO: 60758 - RNA, 20 nt, Artificial Sequence
  MKO10060758_A_Zfp426
  gRNA
uuccaaccaagagaucaaac

SEQ ID NO: 60759 - RNA, 20 nt, Artificial Sequence
  MKO10060759_A_Zfp426
  gRNA
gauuguggacuuuacccaag

SEQ ID NO: 60760 - RNA, 20 nt, Artificial Sequence
  MKO10060760_A_Zfp428
  gRNA
gaggaggaaccgucucgcac

SEQ ID NO: 60761 - RNA, 20 nt, Artificial Sequence
  MKO10060761_A_Zfp428
  gRNA
gaugaccccgaauaugaccc

SEQ ID NO: 60762 - RNA, 20 nt, Artificial Sequence
  MKO10060762_A_Zfp428
  gRNA
acccgugaacccacugagac

SEQ ID NO: 60763 - RNA, 20 nt, Artificial Sequence
  MKO10060763_A_Zfp429
  gRNA
ucccccuccucuaccgcuuc

SEQ ID NO: 60764 - RNA, 20 nt, Artificial Sequence
  MKO10060764_A_Zfp429
  gRNA
gacacauucuucauacaugu

SEQ ID NO: 60765 - RNA, 20 nt, Artificial Sequence
  MKO10060765_A_Zfp429
  gRNA
uccaguugucucugacaaga

SEQ ID NO: 60766 - RNA, 20 nt, Artificial Sequence
  MKO10060766_A_Zfp42
  gRNA
ggggcgagcucauuacuugc

SEQ ID NO: 60767 - RNA, 20 nt, Artificial Sequence
  MKO10060767_A_Zfp42
  gRNA
acucugcacacacgugccgc

SEQ ID NO: 60768 - RNA, 20 nt, Artificial Sequence
  MKO10060768_A_Zfp42
  gRNA
cgcaagagacgccuccgcug

SEQ ID NO: 60769 - RNA, 20 nt, Artificial Sequence
  MKO10060769_A_Zfp433
  gRNA
uauucuuaccgauagcagug

SEQ ID NO: 60770 - RNA, 20 nt, Artificial Sequence
  MKO10060770_A_Zfp433
  gRNA
ugaacuucucucaugaagag

SEQ ID NO: 60771 - RNA, 20 nt, Artificial Sequence
  MKO10060771_A_Zfp433
  gRNA
uugauaguauucuucaacau

SEQ ID NO: 60772 - RNA, 20 nt, Artificial Sequence
  MKO10060772_A_Zfp438
  gRNA
cgacagaucccgcaacuaua

SEQ ID NO: 60773 - RNA, 20 nt, Artificial Sequence
  MKO10060773_A_Zfp438
  gRNA
gcacagccguaugagacgcc

SEQ ID NO: 60774 - RNA, 20 nt, Artificial Sequence
  MKO10060774_A_Zfp438
  gRNA
ggagcauccgaucugcugcc

SEQ ID NO: 60775 - RNA, 20 nt, Artificial Sequence
  MKO10060775_A_Zfp442
  gRNA
ugcguaucagagccauccuc

SEQ ID NO: 60776 - RNA, 20 nt, Artificial Sequence
  MKO10060776_A_Zfp442
  gRNA
cacuauaagauuaaugaaug

SEQ ID NO: 60777 - RNA, 20 nt, Artificial Sequence
  MKO10060777_A_Zfp442
  gRNA
aaacccuucaagugucaaag

SEQ ID NO: 60778 - RNA, 20 nt, Artificial Sequence
  MKO10060778_A_Zfp444
  gRNA
ccgcacgcgugcugcgaaug

SEQ ID NO: 60779 - RNA, 20 nt, Artificial Sequence
  MKO10060779_A_Zfp444
  gRNA
cgcgcgaccuuucgccugcu

SEQ ID NO: 60780 - RNA, 20 nt, Artificial Sequence
  MKO10060780_A_Zfp444
  gRNA
gccacggggagucgagcguc

SEQ ID NO: 60781 - RNA, 20 nt, Artificial Sequence
  MKO10060781_A_Zfp445
  gRNA
gugcagauguucacgcccca

SEQ ID NO: 60782 - RNA, 20 nt, Artificial Sequence
  MKO10060782_A_Zfp445
  gRNA
cagcucagcgcaaucuuuau

SEQ ID NO: 60783 - RNA, 20 nt, Artificial Sequence
  MKO10060783_A_Zfp445
  gRNA
agucaccaguuuguucagcc

SEQ ID NO: 60784 - RNA, 20 nt, Artificial Sequence
  MKO10060784_A_Zfp446
  gRNA
aggcugcacgacuccguuuc

SEQ ID NO: 60785 - RNA, 20 nt, Artificial Sequence
  MKO10060785_A_Zfp446
  gRNA
gccggagaaguacgacacag

SEQ ID NO: 60786 - RNA, 20 nt, Artificial Sequence
  MKO10060786_A_Zfp446
  gRNA
uggguucgagggcagcgacc

SEQ ID NO: 60787 - RNA, 20 nt, Artificial Sequence
  MKO10060787_A_Zfp449
  gRNA
ggcauggguacuguuccaac

SEQ ID NO: 60788 - RNA, 20 nt, Artificial Sequence
  MKO10060788_A_Zfp449
  gRNA
gaagccaaagaugcguucua

SEQ ID NO: 60789 - RNA, 20 nt, Artificial Sequence
  MKO10060789_A_Zfp449
  gRNA
uauguaaaaagcgauucacu

SEQ ID NO: 60790 - RNA, 20 nt, Artificial Sequence
  MKO10060790_A_Zfp451
  gRNA
aggaccguuaagacccguuu

SEQ ID NO: 60791 - RNA, 20 nt, Artificial Sequence
  MKO10060791_A_Zfp451
  gRNA
ucugaugccucgggcccagc

SEQ ID NO: 60792 - RNA, 20 nt, Artificial Sequence
  MKO10060792_A_Zfp451
  gRNA
auagaaucugucccaccagc

SEQ ID NO: 60793 - RNA, 20 nt, Artificial Sequence
  MKO10060793_A_Zfp454
  gRNA
acucauccuuugcacgccau

SEQ ID NO: 60794 - RNA, 20 nt, Artificial Sequence
  MKO10060794_A_Zfp454
  gRNA
ucgaucugcgugugaagcuc

SEQ ID NO: 60795 - RNA, 20 nt, Artificial Sequence
  MKO10060795_A_Zfp454
  gRNA
aagauguauguuccggauaa

SEQ ID NO: 60796 - RNA, 20 nt, Artificial Sequence
  MKO10060796_A_Zfp455
  gRNA
gaauugcuugaugccuuaca

SEQ ID NO: 60797 - RNA, 20 nt, Artificial Sequence
  MKO10060797_A_Zfp455
  gRNA
gaauucuucgucguuuaaua

SEQ ID NO: 60798 - RNA, 20 nt, Artificial Sequence
  MKO10060798_A_Zfp455
  gRNA
gcagcagccacuguguaccc

SEQ ID NO: 60799 - RNA, 20 nt, Artificial Sequence
  MKO10060799_A_Zfp456
  gRNA
ucguacaaagcaugaguaug

SEQ ID NO: 60800 - RNA, 20 nt, Artificial Sequence
  MKO10060800_A_Zfp456
  gRNA
aggacacuucuugcaauugu

SEQ ID NO: 60801 - RNA, 20 nt, Artificial Sequence
  MKO10060801_A_Zfp456
  gRNA
uccaggcaaucccacucuuc

SEQ ID NO: 60802 - RNA, 20 nt, Artificial Sequence
  MKO10060802_A_Zfp457
  gRNA
aagucuugauggagaaccga

SEQ ID NO: 60803 - RNA, 20 nt, Artificial Sequence
  MKO10060803_A_Zfp457
  gRNA
gcuacacauuucagcauugu

SEQ ID NO: 60804 - RNA, 20 nt, Artificial Sequence
  MKO10060804_A_Zfp457
  gRNA
ucuguacagggaugugacau

SEQ ID NO: 60805 - RNA, 20 nt, Artificial Sequence
  MKO10060805_A_Zfp458
  gRNA
acccuaccagugugaagacu

SEQ ID NO: 60806 - RNA, 20 nt, Artificial Sequence
  MKO10060806_A_Zfp458
  gRNA
ccguaccacagucaagcaag

SEQ ID NO: 60807 - RNA, 20 nt, Artificial Sequence
  MKO10060807_A_Zfp458
  gRNA
cucaccuggaugcacaguga

SEQ ID NO: 60808 - RNA, 20 nt, Artificial Sequence
  MKO10060808_A_Zfp459
  gRNA
aauuagugggcuugcuguaa

SEQ ID NO: 60809 - RNA, 20 nt, Artificial Sequence
  MKO10060809_A_Zfp459
  gRNA
gccuuucaucaucagcccuu

SEQ ID NO: 60810 - RNA, 20 nt, Artificial Sequence
  MKO10060810_A_Zfp459
  gRNA
uugauuucucugcagaagag

SEQ ID NO: 60811 - RNA, 20 nt, Artificial Sequence
  MKO10060811_A_Zfp462
  gRNA
gaucgcgucuuccugcaguu

SEQ ID NO: 60812 - RNA, 20 nt, Artificial Sequence
  MKO10060812_A_Zfp462
  gRNA
aguucugcguacgcuacuuc

SEQ ID NO: 60813 - RNA, 20 nt, Artificial Sequence
  MKO10060813_A_Zfp462
  gRNA
uuacagauggcccgaagcgu

SEQ ID NO: 60814 - RNA, 20 nt, Artificial Sequence
  MKO10060814_A_Zfp467
  gRNA
guuggcuguuacguacaaac

SEQ ID NO: 60815 - RNA, 20 nt, Artificial Sequence
  MKO10060815_A_Zfp467
  gRNA
uucggccuucugugggguac

SEQ ID NO: 60816 - RNA, 20 nt, Artificial Sequence
  MKO10060816_A_Zfp467
  gRNA
acaagcugaagcuccuugua

SEQ ID NO: 60817 - RNA, 20 nt, Artificial Sequence
  MKO10060817_A_Zfp46
  gRNA
gccgcaccaggucggaguuc

SEQ ID NO: 60818 - RNA, 20 nt, Artificial Sequence
  MKO10060818_A_Zfp46
  gRNA
ccgcaggccgugcacucgua

SEQ ID NO: 60819 - RNA, 20 nt, Artificial Sequence
  MKO10060819_A_Zfp46
  gRNA
gucuccauucuucccgagug

SEQ ID NO: 60820 - RNA, 20 nt, Artificial Sequence
  MKO10060820_A_Zfp472
  gRNA
auacacgagcgaucucauag

SEQ ID NO: 60821 - RNA, 20 nt, Artificial Sequence
  MKO10060821_A_Zfp472
  gRNA
gacuguagcaaucaucacgu

SEQ ID NO: 60822 - RNA, 20 nt, Artificial Sequence
  MKO10060822_A_Zfp472
  gRNA
cgccuggaugcaucagaagc

SEQ ID NO: 60823 - RNA, 20 nt, Artificial Sequence
  MKO10060823_A_Zfp473
  gRNA
ccguacacaugcggcacgug

SEQ ID NO: 60824 - RNA, 20 nt, Artificial Sequence
  MKO10060824_A_Zfp473
  gRNA
cuaugaauccuacacguguc

SEQ ID NO: 60825 - RNA, 20 nt, Artificial Sequence
  MKO10060825_A_Zfp473
  gRNA
ugugacgcugaaccacuacc

SEQ ID NO: 60826 - RNA, 20 nt, Artificial Sequence
  MKO10060826_A_Zfp474
  gRNA
uugaauggaggucacucggc

SEQ ID NO: 60827 - RNA, 20 nt, Artificial Sequence
  MKO10060827_A_Zfp474
  gRNA
gacggucuggcaagaacgug

SEQ ID NO: 60828 - RNA, 20 nt, Artificial Sequence
  MKO10060828_A_Zfp474
  gRNA
ggccacaaauauagcauauc

SEQ ID NO: 60829 - RNA, 20 nt, Artificial Sequence
  MKO10060829_A_Zfp488
  gRNA
ggcgcucccggaaguacucg

SEQ ID NO: 60830 - RNA, 20 nt, Artificial Sequence
  MKO10060830_A_Zfp488
  gRNA
agcaccgaacaagccucgac

SEQ ID NO: 60831 - RNA, 20 nt, Artificial Sequence
  MKO10060831_A_Zfp488
  gRNA
acaugcggucacaucacaaa

SEQ ID NO: 60832 - RNA, 20 nt, Artificial Sequence
  MKO10060832_A_Zfp493
  gRNA
gagcguugugcgagcacuaa

SEQ ID NO: 60833 - RNA, 20 nt, Artificial Sequence
  MKO10060833_A_Zfp493
  gRNA
aagaaugcagcgaccaauaa

SEQ ID NO: 60834 - RNA, 20 nt, Artificial Sequence
  MKO10060834_A_Zfp493
  gRNA
gucguuccagaaaugugauc

SEQ ID NO: 60835 - RNA, 20 nt, Artificial Sequence
  MKO10060835_A_Zfp503
  gRNA
gcccaaaaccgacgacgagg

SEQ ID NO: 60836 - RNA, 20 nt, Artificial Sequence
  MKO10060836_A_Zfp503
  gRNA
cugcggcggcggaauuaacg

SEQ ID NO: 60837 - RNA, 20 nt, Artificial Sequence
  MKO10060837_A_Zfp503
  gRNA
aauugcuccggccacggccc

SEQ ID NO: 60838 - RNA, 20 nt, Artificial Sequence
  MKO10060838_A_Zfp507
  gRNA
uacacaaguacaacguacgu

SEQ ID NO: 60839 - RNA, 20 nt, Artificial Sequence
  MKO10060839_A_Zfp507
  gRNA
auuucccgugaugccgcuga

SEQ ID NO: 60840 - RNA, 20 nt, Artificial Sequence
  MKO10060840_A_Zfp507
  gRNA
ccauaacuucaccgggcagc

SEQ ID NO: 60841 - RNA, 20 nt, Artificial Sequence
  MKO10060841_A_Zfp511
  gRNA
uuaucaaaucggaaauccgc

SEQ ID NO: 60842 - RNA, 20 nt, Artificial Sequence
  MKO10060842_A_Zfp511
  gRNA
cacgcaaguguccgagacgc

SEQ ID NO: 60843 - RNA, 20 nt, Artificial Sequence
  MKO10060843_A_Zfp511
  gRNA
gauaagcccaagacgaacag

SEQ ID NO: 60844 - RNA, 20 nt, Artificial Sequence
  MKO10060844_A_Zfp512
  gRNA
ccuuccggacccgacgagcc

SEQ ID NO: 60845 - RNA, 20 nt, Artificial Sequence
  MKO10060845_A_Zfp512
  gRNA
gagccgccagucuaugcagc

SEQ ID NO: 60846 - RNA, 20 nt, Artificial Sequence
  MKO10060846_A_Zfp512
  gRNA
ccucaugagggaugguguac

SEQ ID NO: 60847 - RNA, 20 nt, Artificial Sequence
  MKO10060847_A_Zfp513
  gRNA
agccggucacgaugccccga

SEQ ID NO: 60848 - RNA, 20 nt, Artificial Sequence
  MKO10060848_A_Zfp513
  gRNA
cgacauacccgcacccauac

SEQ ID NO: 60849 - RNA, 20 nt, Artificial Sequence
  MKO10060849_A_Zfp513
  gRNA
gcaaaucgcucuccaacacc

SEQ ID NO: 60850 - RNA, 20 nt, Artificial Sequence
  MKO10060850_A_Zfp516
  gRNA
cuaguuaucuccaugcucgc

SEQ ID NO: 60851 - RNA, 20 nt, Artificial Sequence
  MKO10060851_A_Zfp516
  gRNA
ggagcacgcuucuuuaccgc

SEQ ID NO: 60852 - RNA, 20 nt, Artificial Sequence
  MKO10060852_A_Zfp516
  gRNA
uacuuguuuaggggcauccg

SEQ ID NO: 60853 - RNA, 20 nt, Artificial Sequence
  MKO10060853_A_Zfp518a
  gRNA
gcaauauaauaaagccgacg

SEQ ID NO: 60854 - RNA, 20 nt, Artificial Sequence
  MKO10060854_A_Zfp518a
  gRNA
gaacgcucacugauauauac

SEQ ID NO: 60855 - RNA, 20 nt, Artificial Sequence
  MKO10060855_A_Zfp518a
  gRNA
aacauucucagucuucaccg

SEQ ID NO: 60856 - RNA, 20 nt, Artificial Sequence
  MKO10060856_A_Zfp518b
  gRNA
uccguccgaguugcucuauu

SEQ ID NO: 60857 - RNA, 20 nt, Artificial Sequence
  MKO10060857_A_Zfp518b
  gRNA
ucagccgcauaugguaccgc

SEQ ID NO: 60858 - RNA, 20 nt, Artificial Sequence
  MKO10060858_A_Zfp518b
  gRNA
auaacggucagcggcauccc

SEQ ID NO: 60859 - RNA, 20 nt, Artificial Sequence
  MKO10060859_A_Zfp51
  gRNA
auuccgaugcuguaacaacg

SEQ ID NO: 60860 - RNA, 20 nt, Artificial Sequence
  MKO10060860_A_Zfp51
  gRNA
gauuucuaagauaugcacgc

SEQ ID NO: 60861 - RNA, 20 nt, Artificial Sequence
  MKO10060861_A_Zfp51
  gRNA
uucaccaguaaacaugcccc

SEQ ID NO: 60862 - RNA, 20 nt, Artificial Sequence
  MKO10060862_A_Zfp521
  gRNA
uauacagcuccucgaccgug

SEQ ID NO: 60863 - RNA, 20 nt, Artificial Sequence
  MKO10060863_A_Zfp521
  gRNA
cagcagaccuccgauaugac

SEQ ID NO: 60864 - RNA, 20 nt, Artificial Sequence
  MKO10060864_A_Zfp521
  gRNA
cuacaacgagugggacaucc

SEQ ID NO: 60865 - RNA, 20 nt, Artificial Sequence
  MKO10060865_A_Zfp523
  gRNA
auggcgcuguccgacggcac

SEQ ID NO: 60866 - RNA, 20 nt, Artificial Sequence
  MKO10060866_A_Zfp523
  gRNA
agacgaggaaggcuucggca

SEQ ID NO: 60867 - RNA, 20 nt, Artificial Sequence
  MKO10060867_A_Zfp523
  gRNA
cgggcccaccuuugggugug

SEQ ID NO: 60868 - RNA, 20 nt, Artificial Sequence
  MKO10060868_A_Zfp524
  gRNA
cugcccucgccguuuccgag

SEQ ID NO: 60869 - RNA, 20 nt, Artificial Sequence
  MKO10060869_A_Zfp524
  gRNA
guuugcguuuguaauggcgc

SEQ ID NO: 60870 - RNA, 20 nt, Artificial Sequence
  MKO10060870_A_Zfp524
  gRNA
gggcgccgaggccgaccucc

SEQ ID NO: 60871 - RNA, 20 nt, Artificial Sequence
  MKO10060871_A_Zfp526
  gRNA
cgguggcucguccgcugcac

SEQ ID NO: 60872 - RNA, 20 nt, Artificial Sequence
  MKO10060872_A_Zfp526
  gRNA
aggcaccggcgcgcggugca

SEQ ID NO: 60873 - RNA, 20 nt, Artificial Sequence
  MKO10060873_A_Zfp526
  gRNA
agaagcgaaggucuugccgc

SEQ ID NO: 60874 - RNA, 20 nt, Artificial Sequence
  MKO10060874_A_Zfp52
  gRNA
ucuuugauauugccgaaugu

SEQ ID NO: 60875 - RNA, 20 nt, Artificial Sequence
  MKO10060875_A_Zfp52
  gRNA
agagagacguuaucgaugua

SEQ ID NO: 60876 - RNA, 20 nt, Artificial Sequence
  MKO10060876_A_Zfp52
  gRNA
uucuccaguaaacacauccc

SEQ ID NO: 60877 - RNA, 20 nt, Artificial Sequence
  MKO10060877_A_Zfp532
  gRNA
ugcggcgcucagcgcuaaaa

SEQ ID NO: 60878 - RNA, 20 nt, Artificial Sequence
  MKO10060878_A_Zfp532
  gRNA
uuuagcgcugagcgccgcaa

SEQ ID NO: 60879 - RNA, 20 nt, Artificial Sequence
  MKO10060879_A_Zfp532
  gRNA
ugauguuaccaacgaugagg

SEQ ID NO: 60880 - RNA, 20 nt, Artificial Sequence
  MKO10060880_A_Zfp534
  gRNA
cccaaaaaagacuuaagccc

SEQ ID NO: 60881 - RNA, 20 nt, Artificial Sequence
  MKO10060881_A_Zfp534
  gRNA
ucucugaugaauacuaaguu

SEQ ID NO: 60882 - RNA, 20 nt, Artificial Sequence
  MKO10060882_A_Zfp534
  gRNA
aacaagaaugaguguguguc

SEQ ID NO: 60883 - RNA, 20 nt, Artificial Sequence
  MKO10060883_A_Zfp536
  gRNA
gggcuacaucgggcacgcua

SEQ ID NO: 60884 - RNA, 20 nt, Artificial Sequence
  MKO10060884_A_Zfp536
  gRNA
gcugcuagcaagcccguuaa

SEQ ID NO: 60885 - RNA, 20 nt, Artificial Sequence
  MKO10060885_A_Zfp536
  gRNA
aggauaggggcgucgucauc

SEQ ID NO: 60886 - RNA, 20 nt, Artificial Sequence
  MKO10060886_A_Zfp53
  gRNA
guauuauaagauuugaacgc

SEQ ID NO: 60887 - RNA, 20 nt, Artificial Sequence
  MKO10060887_A_Zfp53
  gRNA
cuaugucacaauaguugcaa

SEQ ID NO: 60888 - RNA, 20 nt, Artificial Sequence
  MKO10060888_A_Zfp53
  gRNA
uucuccauuaaucaugucac

SEQ ID NO: 60889 - RNA, 20 nt, Artificial Sequence
  MKO10060889_A_Zfp541
  gRNA
cgcacucaaggugccuaaag

SEQ ID NO: 60890 - RNA, 20 nt, Artificial Sequence
  MKO10060890_A_Zfp541
  gRNA
caggugguccugccgcuuga

SEQ ID NO: 60891 - RNA, 20 nt, Artificial Sequence
  MKO10060891_A_Zfp541
  gRNA
gcugggacuuggcaaucauc

SEQ ID NO: 60892 - RNA, 20 nt, Artificial Sequence
  MKO10060892_A_Zfp54
  gRNA
aaauccuaugccuaccguac

SEQ ID NO: 60893 - RNA, 20 nt, Artificial Sequence
  MKO10060893_A_Zfp54
  gRNA
uguucucaccgacauauacc

SEQ ID NO: 60894 - RNA, 20 nt, Artificial Sequence
  MKO10060894_A_Zfp54
  gRNA
uucaguagugccucaagccu

SEQ ID NO: 60895 - RNA, 20 nt, Artificial Sequence
  MKO10060895_A_Zfp551
  gRNA
gucggacaagauucgaucga

SEQ ID NO: 60896 - RNA, 20 nt, Artificial Sequence
  MKO10060896_A_Zfp551
  gRNA
gggaagagaccucggcgacc

SEQ ID NO: 60897 - RNA, 20 nt, Artificial Sequence
  MKO10060897_A_Zfp551
  gRNA
guugaaucaggcuagcacuc

SEQ ID NO: 60898 - RNA, 20 nt, Artificial Sequence
  MKO10060898_A_Zfp553
  gRNA
ggugaacgccccacgaucug

SEQ ID NO: 60899 - RNA, 20 nt, Artificial Sequence
  MKO10060899_A_Zfp553
  gRNA
guggucuagugcguucgccc

SEQ ID NO: 60900 - RNA, 20 nt, Artificial Sequence
  MKO10060900_A_Zfp553
  gRNA
cagucucgcagccuaccccg

SEQ ID NO: 60901 - RNA, 20 nt, Artificial Sequence
  MKO10060901_A_Zfp558
  gRNA
cuguacagucacaucuucga

SEQ ID NO: 60902 - RNA, 20 nt, Artificial Sequence
  MKO10060902_A_Zfp558
  gRNA
guggcuuaccaagugaggcc

SEQ ID NO: 60903 - RNA, 20 nt, Artificial Sequence
  MKO10060903_A_Zfp558
  gRNA
accaaaucugauaucccagu

SEQ ID NO: 60904 - RNA, 20 nt, Artificial Sequence
  MKO10060904_A_Zfp560
  gRNA
ccgcugaaacauugucccuc

SEQ ID NO: 60905 - RNA, 20 nt, Artificial Sequence
  MKO10060905_A_Zfp560
  gRNA
uaccagaaccuggcuacauu

SEQ ID NO: 60906 - RNA, 20 nt, Artificial Sequence
  MKO10060906_A_Zfp560
  gRNA
aaaagacggugucugacugc

SEQ ID NO: 60907 - RNA, 20 nt, Artificial Sequence
  MKO10060907_A_Zfp563
  gRNA
guaccugucgaguacacgaa

SEQ ID NO: 60908 - RNA, 20 nt, Artificial Sequence
  MKO10060908_A_Zfp563
  gRNA
aguccguucguguacucgac

SEQ ID NO: 60909 - RNA, 20 nt, Artificial Sequence
  MKO10060909_A_Zfp563
  gRNA
uuaggacugucuaacuuucg

SEQ ID NO: 60910 - RNA, 20 nt, Artificial Sequence
  MKO10060910_A_Zfp566
  gRNA
ugagagugggcacgucguca

SEQ ID NO: 60911 - RNA, 20 nt, Artificial Sequence
  MKO10060911_A_Zfp566
  gRNA
gagauccgcgcugucucuca

SEQ ID NO: 60912 - RNA, 20 nt, Artificial Sequence
  MKO10060912_A_Zfp566
  gRNA
agaagucuauguacacaucg

SEQ ID NO: 60913 - RNA, 20 nt, Artificial Sequence
  MKO10060913_A_Zfp568
  gRNA
ucuccuuacccacgguuacu

SEQ ID NO: 60914 - RNA, 20 nt, Artificial Sequence
  MKO10060914_A_Zfp568
  gRNA
cuacagcaaccuaguaaccg

SEQ ID NO: 60915 - RNA, 20 nt, Artificial Sequence
  MKO10060915_A_Zfp568
  gRNA
uuccucagcuuggugugccg

SEQ ID NO: 60916 - RNA, 20 nt, Artificial Sequence
  MKO10060916_A_Zfp574
  gRNA
cuagccggugcacaaaacgc

SEQ ID NO: 60917 - RNA, 20 nt, Artificial Sequence
  MKO10060917_A_Zfp574
  gRNA
cggccgcgcagcgaugcuca

SEQ ID NO: 60918 - RNA, 20 nt, Artificial Sequence
  MKO10060918_A_Zfp574
  gRNA
gggggcggccguuccgucug

SEQ ID NO: 60919 - RNA, 20 nt, Artificial Sequence
  MKO10060919_A_Zfp575
  gRNA
acgcaccggcuagcgcacgg

SEQ ID NO: 60920 - RNA, 20 nt, Artificial Sequence
  MKO10060920_A_Zfp575
  gRNA
gggugccgccgugcgcuagc

SEQ ID NO: 60921 - RNA, 20 nt, Artificial Sequence
  MKO10060921_A_Zfp575
  gRNA
acaggugggacuagguuccg

SEQ ID NO: 60922 - RNA, 20 nt, Artificial Sequence
  MKO10060922_A_Zfp579
  gRNA
cucuuccuugaugugcgcga

SEQ ID NO: 60923 - RNA, 20 nt, Artificial Sequence
  MKO10060923_A_Zfp579
  gRNA
ccuaugcggauugggaggcc

SEQ ID NO: 60924 - RNA, 20 nt, Artificial Sequence
  MKO10060924_A_Zfp579
  gRNA
ccuggucccuaucgcgucac

SEQ ID NO: 60925 - RNA, 20 nt, Artificial Sequence
  MKO10060925_A_Zfp57
  gRNA
cgucaccgacgugcucauuu

SEQ ID NO: 60926 - RNA, 20 nt, Artificial Sequence
  MKO10060926_A_Zfp57
  gRNA
gcuguuccgugccuuagccc

SEQ ID NO: 60927 - RNA, 20 nt, Artificial Sequence
  MKO10060927_A_Zfp57
  gRNA
gucucuuaccgacaaauguc

SEQ ID NO: 60928 - RNA, 20 nt, Artificial Sequence
  MKO10060928_A_Zfp580
  gRNA
gagguggaccagcgcgcgca

SEQ ID NO: 60929 - RNA, 20 nt, Artificial Sequence
  MKO10060929_A_Zfp580
  gRNA
gcaaagacacgagcgcacuc

SEQ ID NO: 60930 - RNA, 20 nt, Artificial Sequence
  MKO10060930_A_Zfp580
  gRNA
caucugcucaucgacgccaa

SEQ ID NO: 60931 - RNA, 20 nt, Artificial Sequence
  MKO10060931_A_Zfp583
  gRNA
cccacauucgacgcaugcgu

SEQ ID NO: 60932 - RNA, 20 nt, Artificial Sequence
  MKO10060932_A_Zfp583
  gRNA
cccuacgcaugcgucgaaug

SEQ ID NO: 60933 - RNA, 20 nt, Artificial Sequence
  MKO10060933_A_Zfp583
  gRNA
accagccgugaucucauuac

SEQ ID NO: 60934 - RNA, 20 nt, Artificial Sequence
  MKO10060934_A_Zfp58
  gRNA
gaaugacgcaauuuaugcca

SEQ ID NO: 60935 - RNA, 20 nt, Artificial Sequence
  MKO10060935_A_Zfp58
  gRNA
guaaguguaaagacugcgac

SEQ ID NO: 60936 - RNA, 20 nt, Artificial Sequence
  MKO10060936_A_Zfp58
  gRNA
gcuugucucuucacguccca

SEQ ID NO: 60937 - RNA, 20 nt, Artificial Sequence
  MKO10060937_A_Zfp592
  gRNA
gacacguagcucucucgauc

SEQ ID NO: 60938 - RNA, 20 nt, Artificial Sequence
  MKO10060938_A_Zfp592
  gRNA
gacacaucuucuaaccgccc

SEQ ID NO: 60939 - RNA, 20 nt, Artificial Sequence
  MKO10060939_A_Zfp592
  gRNA
cgacagaggacaccgcacuc

SEQ ID NO: 60940 - RNA, 20 nt, Artificial Sequence
  MKO10060940_A_Zfp593
  gRNA
ggaaugugcucggugcgcgc

SEQ ID NO: 60941 - RNA, 20 nt, Artificial Sequence
  MKO10060941_A_Zfp593
  gRNA
gggcggccugcaucgcuguc

SEQ ID NO: 60942 - RNA, 20 nt, Artificial Sequence
  MKO10060942_A_Zfp593
  gRNA
gagugucgaacccuacaguc

SEQ ID NO: 60943 - RNA, 20 nt, Artificial Sequence
  MKO10060943_A_Zfp595
  gRNA
aaagucuuugaggcggaaaa

SEQ ID NO: 60944 - RNA, 20 nt, Artificial Sequence
  MKO10060944_A_Zfp595
  gRNA
ggaaggccuugccacauauu

SEQ ID NO: 60945 - RNA, 20 nt, Artificial Sequence
  MKO10060945_A_Zfp595
  gRNA
cauaccugaguacuuagcag

SEQ ID NO: 60946 - RNA, 20 nt, Artificial Sequence
  MKO10060946_A_Zfp597
  gRNA
auucaccugcucauccgaug

SEQ ID NO: 60947 - RNA, 20 nt, Artificial Sequence
  MKO10060947_A_Zfp597
  gRNA
ucagucaccgaaccaaccug

SEQ ID NO: 60948 - RNA, 20 nt, Artificial Sequence
  MKO10060948_A_Zfp597
  gRNA
ggauucgcuuauguguccuc

SEQ ID NO: 60949 - RNA, 20 nt, Artificial Sequence
  MKO10060949_A_Zfp598
  gRNA
ccuggcucgacaccguaugc

SEQ ID NO: 60950 - RNA, 20 nt, Artificial Sequence
  MKO10060950_A_Zfp598
  gRNA
agaaguaguggucucggcgc

SEQ ID NO: 60951 - RNA, 20 nt, Artificial Sequence
  MKO10060951_A_Zfp598
  gRNA
ccgcaccgagaucgaccuca

SEQ ID NO: 60952 - RNA, 20 nt, Artificial Sequence
  MKO10060952_A_Zfp599
  gRNA
agcuagaaccaccgaaaaua

SEQ ID NO: 60953 - RNA, 20 nt, Artificial Sequence
  MKO10060953_A_Zfp599
  gRNA
caagaacucgcauacguaag

SEQ ID NO: 60954 - RNA, 20 nt, Artificial Sequence
  MKO10060954_A_Zfp599
  gRNA
cucuuacguaugcgaguucu

SEQ ID NO: 60955 - RNA, 20 nt, Artificial Sequence
  MKO10060955_A_Zfp59
  gRNA
caugucuugagaauuagugc

SEQ ID NO: 60956 - RNA, 20 nt, Artificial Sequence
  MKO10060956_A_Zfp59
  gRNA
ucucuucacuaugacugcuc

SEQ ID NO: 60957 - RNA, 20 nt, Artificial Sequence
  MKO10060957_A_Zfp59
  gRNA
cuuccuuguuaguaaucugu

SEQ ID NO: 60958 - RNA, 20 nt, Artificial Sequence
  MKO10060958_A_Zfp600
  gRNA
gaagucuucuaaauguaaug

SEQ ID NO: 60959 - RNA, 20 nt, Artificial Sequence
  MKO10060959_A_Zfp600
  gRNA
guucauuauagaauucaugc

SEQ ID NO: 60960 - RNA, 20 nt, Artificial Sequence
  MKO10060960_A_Zfp600
  gRNA
uuguucuucucccagauucu

SEQ ID NO: 60961 - RNA, 20 nt, Artificial Sequence
  MKO10060961_A_Zfp605
  gRNA
guacauaaaccuuaccguug

SEQ ID NO: 60962 - RNA, 20 nt, Artificial Sequence
  MKO10060962_A_Zfp605
  gRNA
ccgaaagcuuucugacguuc

SEQ ID NO: 60963 - RNA, 20 nt, Artificial Sequence
  MKO10060963_A_Zfp605
  gRNA
ucuagcuugaaaguuacauc

SEQ ID NO: 60964 - RNA, 20 nt, Artificial Sequence
  MKO10060964_A_Zfp606
  gRNA
cucaccucgacuugggcuac

SEQ ID NO: 60965 - RNA, 20 nt, Artificial Sequence
  MKO10060965_A_Zfp606
  gRNA
gcacauggagggaagcgcug

SEQ ID NO: 60966 - RNA, 20 nt, Artificial Sequence
  MKO10060966_A_Zfp606
  gRNA
cuauggacaccuacuuucug

SEQ ID NO: 60967 - RNA, 20 nt, Artificial Sequence
  MKO10060967_A_Zfp607
  gRNA
agguauaccuuuccgagcau

SEQ ID NO: 60968 - RNA, 20 nt, Artificial Sequence
  MKO10060968_A_Zfp607
  gRNA
ccccaacuauaauacaucca

SEQ ID NO: 60969 - RNA, 20 nt, Artificial Sequence
  MKO10060969_A_Zfp607
  gRNA
acagaccauguguugagaac

SEQ ID NO: 60970 - RNA, 20 nt, Artificial Sequence
  MKO10060970_A_Zfp608
  gRNA
gcgagacugcuggcaaucgg

SEQ ID NO: 60971 - RNA, 20 nt, Artificial Sequence
  MKO10060971_A_Zfp608
  gRNA
auucgugcgcacucgcuucc

SEQ ID NO: 60972 - RNA, 20 nt, Artificial Sequence
  MKO10060972_A_Zfp608
  gRNA
gucuaaagcggccgucaugu

SEQ ID NO: 60973 - RNA, 20 nt, Artificial Sequence
  MKO10060973_A_Zfp609
  gRNA
augcggaacggccgaggaag

SEQ ID NO: 60974 - RNA, 20 nt, Artificial Sequence
  MKO10060974_A_Zfp609
  gRNA
uucauacugcugccgauaag

SEQ ID NO: 60975 - RNA, 20 nt, Artificial Sequence
  MKO10060975_A_Zfp609
  gRNA
aggagacggagucucgaaug

SEQ ID NO: 60976 - RNA, 20 nt, Artificial Sequence
  MKO10060976_A_Zfp60
  gRNA
gaguaucguagugucguaag

SEQ ID NO: 60977 - RNA, 20 nt, Artificial Sequence
  MKO10060977_A_Zfp60
  gRNA
aagggcuuuguucguaguac

SEQ ID NO: 60978 - RNA, 20 nt, Artificial Sequence
  MKO10060978_A_Zfp60
  gRNA
cauguguugagaacuagagu

SEQ ID NO: 60979 - RNA, 20 nt, Artificial Sequence
  MKO10060979_A_Zfp612
  gRNA
cucaccuggggccaaaccga

SEQ ID NO: 60980 - RNA, 20 nt, Artificial Sequence
  MKO10060980_A_Zfp612
  gRNA
guguuaaagccaaguucguc

SEQ ID NO: 60981 - RNA, 20 nt, Artificial Sequence
  MKO10060981_A_Zfp612
  gRNA
caacaggaaauccggucagc

SEQ ID NO: 60982 - RNA, 20 nt, Artificial Sequence
  MKO10060982_A_Zfp616
  gRNA
cagaguagauuuaauuguug

SEQ ID NO: 60983 - RNA, 20 nt, Artificial Sequence
  MKO10060983_A_Zfp616
  gRNA
cuuaugguauuucaagcuag

SEQ ID NO: 60984 - RNA, 20 nt, Artificial Sequence
  MKO10060984_A_Zfp616
  gRNA
aaugcaacaauguucuacac

SEQ ID NO: 60985 - RNA, 20 nt, Artificial Sequence
  MKO10060985_A_Zfp617
  gRNA
cuuuguccaguucucuucga

SEQ ID NO: 60986 - RNA, 20 nt, Artificial Sequence
  MKO10060986_A_Zfp617
  gRNA
aucaugccuucgaagagaac

SEQ ID NO: 60987 - RNA, 20 nt, Artificial Sequence
  MKO10060987_A_Zfp617
  gRNA
aauuaccuuagauuuccccc

SEQ ID NO: 60988 - RNA, 20 nt, Artificial Sequence
  MKO10060988_A_Zfp618
  gRNA
gccgcagaucccgcauucau

SEQ ID NO: 60989 - RNA, 20 nt, Artificial Sequence
  MKO10060989_A_Zfp618
  gRNA
acugcuuccagacgcacgug

SEQ ID NO: 60990 - RNA, 20 nt, Artificial Sequence
  MKO10060990_A_Zfp618
  gRNA
ugugccugccgagaucugcg

SEQ ID NO: 60991 - RNA, 20 nt, Artificial Sequence
  MKO10060991_A_Zfp619
  gRNA
cgcgaaguaaacuccgauac

SEQ ID NO: 60992 - RNA, 20 nt, Artificial Sequence
  MKO10060992_A_Zfp619
  gRNA
gaauccuuucgugccguuga

SEQ ID NO: 60993 - RNA, 20 nt, Artificial Sequence
  MKO10060993_A_Zfp619
  gRNA
ccagcaucacauuaauguau

SEQ ID NO: 60994 - RNA, 20 nt, Artificial Sequence
  MKO10060994_A_Zfp61
  gRNA
auuaacggucagagugcgag

SEQ ID NO: 60995 - RNA, 20 nt, Artificial Sequence
  MKO10060995_A_Zfp61
  gRNA
uccgagucugccgcucaguc

SEQ ID NO: 60996 - RNA, 20 nt, Artificial Sequence
  MKO10060996_A_Zfp61
  gRNA
ggcugcuggacuccgcccag

SEQ ID NO: 60997 - RNA, 20 nt, Artificial Sequence
  MKO10060997_A_Zfp622
  gRNA
gaagauauugauuccgauga

SEQ ID NO: 60998 - RNA, 20 nt, Artificial Sequence
  MKO10060998_A_Zfp622
  gRNA
agauacuacaaacagcgauu

SEQ ID NO: 60999 - RNA, 20 nt, Artificial Sequence
  MKO10060999_A_Zfp622
  gRNA
aagcucccucgugaagaaug

SEQ ID NO: 61000 - RNA, 20 nt, Artificial Sequence
  MKO10061000_A_Zfp623
  gRNA
cgcuacacguauagccaacu

SEQ ID NO: 61001 - RNA, 20 nt, Artificial Sequence
  MKO10061001_A_Zfp623
  gRNA
gcccaaacgugcaguaaguc

SEQ ID NO: 61002 - RNA, 20 nt, Artificial Sequence
  MKO10061002_A_Zfp623
  gRNA
cgaugagguccgagcggugu

SEQ ID NO: 61003 - RNA, 20 nt, Artificial Sequence
  MKO10061003_A_Zfp628
  gRNA
cggggaccacuuguaccauc

SEQ ID NO: 61004 - RNA, 20 nt, Artificial Sequence
  MKO10061004_A_Zfp628
  gRNA
uccguaacacuucgugccug

SEQ ID NO: 61005 - RNA, 20 nt, Artificial Sequence
  MKO10061005_A_Zfp628
  gRNA
cuagaaaauagcagcguugc

SEQ ID NO: 61006 - RNA, 20 nt, Artificial Sequence
  MKO10061006_A_Zfp629
  gRNA
caccgcgugauccacgagag

SEQ ID NO: 61007 - RNA, 20 nt, Artificial Sequence
  MKO10061007_A_Zfp629
  gRNA
gccgcacucggugcagcgau

SEQ ID NO: 61008 - RNA, 20 nt, Artificial Sequence
  MKO10061008_A_Zfp629
  gRNA
gcuguggggcccggaucugc

SEQ ID NO: 61009 - RNA, 20 nt, Artificial Sequence
  MKO10061009_A_Zfp62
  gRNA
aaucauaaaaguguccaccg

SEQ ID NO: 61010 - RNA, 20 nt, Artificial Sequence
  MKO10061010_A_Zfp62
  gRNA
aacugcaaaugugacgaaug

SEQ ID NO: 61011 - RNA, 20 nt, Artificial Sequence
  MKO10061011_A_Zfp62
  gRNA
aaucauaaaaguguacaccc

SEQ ID NO: 61012 - RNA, 20 nt, Artificial Sequence
  MKO10061012_A_Zfp637
  gRNA
cggcgagguuacuuugauuu

SEQ ID NO: 61013 - RNA, 20 nt, Artificial Sequence
  MKO10061013_A_Zfp637
  gRNA
ccuacgcguguucccacugc

SEQ ID NO: 61014 - RNA, 20 nt, Artificial Sequence
  MKO10061014_A_Zfp637
  gRNA
cacugaaaaaggcuacauuc

SEQ ID NO: 61015 - RNA, 20 nt, Artificial Sequence
  MKO10061015_A_Zfp639
  gRNA
gagcgugcucguugacaacg

SEQ ID NO: 61016 - RNA, 20 nt, Artificial Sequence
  MKO10061016_A_Zfp639
  gRNA
gacuaaccugaauagcgaga

SEQ ID NO: 61017 - RNA, 20 nt, Artificial Sequence
  MKO10061017_A_Zfp639
  gRNA
aucacggucagguagucuca

SEQ ID NO: 61018 - RNA, 20 nt, Artificial Sequence
  MKO10061018_A_Zfp641
  gRNA
uuuccgaugcagcucgcacc

SEQ ID NO: 61019 - RNA, 20 nt, Artificial Sequence
  MKO10061019_A_Zfp641
  gRNA
uccguaaaagucugucugcg

SEQ ID NO: 61020 - RNA, 20 nt, Artificial Sequence
  MKO10061020_A_Zfp641
  gRNA
guuccggccguuccccagga

SEQ ID NO: 61021 - RNA, 20 nt, Artificial Sequence
  MKO10061021_A_Zfp644
  gRNA
accuaacucaacguuauccc

SEQ ID NO: 61022 - RNA, 20 nt, Artificial Sequence
  MKO10061022_A_Zfp644
  gRNA
cgacaucuacagacuccucg

SEQ ID NO: 61023 - RNA, 20 nt, Artificial Sequence
  MKO10061023_A_Zfp644
  gRNA
aacggacugucuucguuuaa

SEQ ID NO: 61024 - RNA, 20 nt, Artificial Sequence
  MKO10061024_A_Zfp646
  gRNA
gccgacugugacgccguaaa

SEQ ID NO: 61025 - RNA, 20 nt, Artificial Sequence
  MKO10061025_A_Zfp646
  gRNA
gucgcagaaagcugauucgg

SEQ ID NO: 61026 - RNA, 20 nt, Artificial Sequence
  MKO10061026_A_Zfp646
  gRNA
guucggaagcgaggcuguag

SEQ ID NO: 61027 - RNA, 20 nt, Artificial Sequence
  MKO10061027_A_Zfp647
  gRNA
aaggucggaacucacgcgaa

SEQ ID NO: 61028 - RNA, 20 nt, Artificial Sequence
  MKO10061028_A_Zfp647
  gRNA
gagcacggagcggucgcuga

SEQ ID NO: 61029 - RNA, 20 nt, Artificial Sequence
  MKO10061029_A_Zfp647
  gRNA
ccucuaccgacacgucauga

SEQ ID NO: 61030 - RNA, 20 nt, Artificial Sequence
  MKO10061030_A_Zfp648
  gRNA
cagacgcgagggcugcgcga

SEQ ID NO: 61031 - RNA, 20 nt, Artificial Sequence
  MKO10061031_A_Zfp648
  gRNA
uuuccgcaucgcguccgagu

SEQ ID NO: 61032 - RNA, 20 nt, Artificial Sequence
  MKO10061032_A_Zfp648
  gRNA
uguugaaggucaagccgcac

SEQ ID NO: 61033 - RNA, 20 nt, Artificial Sequence
  MKO10061033_A_Zfp64
  gRNA
gugcaagacgugcgacuacg

SEQ ID NO: 61034 - RNA, 20 nt, Artificial Sequence
  MKO10061034_A_Zfp64
  gRNA
gucgcacgucuugcacuugu

SEQ ID NO: 61035 - RNA, 20 nt, Artificial Sequence
  MKO10061035_A_Zfp64
  gRNA
gcaccggacauccacaucug

SEQ ID NO: 61036 - RNA, 20 nt, Artificial Sequence
  MKO10061036_A_Zfp651
  gRNA
uccccguagugcaugacaug

SEQ ID NO: 61037 - RNA, 20 nt, Artificial Sequence
  MKO10061037_A_Zfp651
  gRNA
cucauccucucgaugaucgc

SEQ ID NO: 61038 - RNA, 20 nt, Artificial Sequence
  MKO10061038_A_Zfp651
  gRNA
cccucccgggcauagaucuu

SEQ ID NO: 61039 - RNA, 20 nt, Artificial Sequence
  MKO10061039_A_Zfp652
  gRNA
ccgcugaccgcacacaucgc

SEQ ID NO: 61040 - RNA, 20 nt, Artificial Sequence
  MKO10061040_A_Zfp652
  gRNA
cgagaagaaguucuauacca

SEQ ID NO: 61041 - RNA, 20 nt, Artificial Sequence
  MKO10061041_A_Zfp652
  gRNA
gcgcuugaaagacuuuccac

SEQ ID NO: 61042 - RNA, 20 nt, Artificial Sequence
  MKO10061042_A_Zfp653
  gRNA
gauaagcccacugcugcccg

SEQ ID NO: 61043 - RNA, 20 nt, Artificial Sequence
  MKO10061043_A_Zfp653
  gRNA
cuccacaugguggacgucaa

SEQ ID NO: 61044 - RNA, 20 nt, Artificial Sequence
  MKO10061044_A_Zfp653
  gRNA
ggcuggacaccgcuacuucc

SEQ ID NO: 61045 - RNA, 20 nt, Artificial Sequence
  MKO10061045_A_Zfp654
  gRNA
ccagugaaaagauuacgaug

SEQ ID NO: 61046 - RNA, 20 nt, Artificial Sequence
  MKO10061046_A_Zfp654
  gRNA
ugccgcacauuuaaaucagu

SEQ ID NO: 61047 - RNA, 20 nt, Artificial Sequence
  MKO10061047_A_Zfp654
  gRNA
gcagauugcuacugcacaac

SEQ ID NO: 61048 - RNA, 20 nt, Artificial Sequence
  MKO10061048_A_Zfp655
  gRNA
ggcugugcaucuuacacgag

SEQ ID NO: 61049 - RNA, 20 nt, Artificial Sequence
  MKO10061049_A_Zfp655
  gRNA
gcugggaugagcacucccga

SEQ ID NO: 61050 - RNA, 20 nt, Artificial Sequence
  MKO10061050_A_Zfp655
  gRNA
ucaggaguuugugacauucg

SEQ ID NO: 61051 - RNA, 20 nt, Artificial Sequence
  MKO10061051_A_Zfp658
  gRNA
cagcgugaaugaguacguaa

SEQ ID NO: 61052 - RNA, 20 nt, Artificial Sequence
  MKO10061052_A_Zfp658
  gRNA
uagucgaacguccaaccugc

SEQ ID NO: 61053 - RNA, 20 nt, Artificial Sequence
  MKO10061053_A_Zfp658
  gRNA
ggcuacccuguuccuagccc

SEQ ID NO: 61054 - RNA, 20 nt, Artificial Sequence
  MKO10061054_A_Zfp65
  gRNA
ggagcuccauuuaugcuccc

SEQ ID NO: 61055 - RNA, 20 nt, Artificial Sequence
  MKO10061055_A_Zfp65
  gRNA
ugcuauacgugcacagagug

SEQ ID NO: 61056 - RNA, 20 nt, Artificial Sequence
  MKO10061056_A_Zfp65
  gRNA
gacauaccugggagcauaaa

SEQ ID NO: 61057 - RNA, 20 nt, Artificial Sequence
  MKO10061057_A_Zfp661
  gRNA
ccggcccaccuguuaguguu

SEQ ID NO: 61058 - RNA, 20 nt, Artificial Sequence
  MKO10061058_A_Zfp661
  gRNA
cagagacguuacgccaaaca

SEQ ID NO: 61059 - RNA, 20 nt, Artificial Sequence
  MKO10061059_A_Zfp661
  gRNA
agcgucugguacccgugcag

SEQ ID NO: 61060 - RNA, 20 nt, Artificial Sequence
  MKO10061060_A_Zfp663
  gRNA
acagcagaagacaucgcguu

SEQ ID NO: 61061 - RNA, 20 nt, Artificial Sequence
  MKO10061061_A_Zfp663
  gRNA
cuucugacguauugcucuug

SEQ ID NO: 61062 - RNA, 20 nt, Artificial Sequence
  MKO10061062_A_Zfp663
  gRNA
gacacaucuucgaacaacac

SEQ ID NO: 61063 - RNA, 20 nt, Artificial Sequence
  MKO10061063_A_Zfp664
  gRNA
ucuacaagugccccaugugc

SEQ ID NO: 61064 - RNA, 20 nt, Artificial Sequence
  MKO10061064_A_Zfp664
  gRNA
guguauaaaugugacgauug

SEQ ID NO: 61065 - RNA, 20 nt, Artificial Sequence
  MKO10061065_A_Zfp664
  gRNA
gagaagcccuauagguguug

SEQ ID NO: 61066 - RNA, 20 nt, Artificial Sequence
  MKO10061066_A_Zfp667
  gRNA
gccaccgaauaucucuuacg

SEQ ID NO: 61067 - RNA, 20 nt, Artificial Sequence
  MKO10061067_A_Zfp667
  gRNA
gaugauauuuggccuccggc

SEQ ID NO: 61068 - RNA, 20 nt, Artificial Sequence
  MKO10061068_A_Zfp667
  gRNA
uaugccgcguaagagauauu

SEQ ID NO: 61069 - RNA, 20 nt, Artificial Sequence
  MKO10061069_A_Zfp668
  gRNA
gcggccagagcgcuuguagc

SEQ ID NO: 61070 - RNA, 20 nt, Artificial Sequence
  MKO10061070_A_Zfp668
  gRNA
ggaccucaagcggcaugcgu

SEQ ID NO: 61071 - RNA, 20 nt, Artificial Sequence
  MKO10061071_A_Zfp668
  gRNA
uuacgcccucaugugcgcgc

SEQ ID NO: 61072 - RNA, 20 nt, Artificial Sequence
  MKO10061072_A_Zfp672
  gRNA
ccgcacgugugugccacuug

SEQ ID NO: 61073 - RNA, 20 nt, Artificial Sequence
  MKO10061073_A_Zfp672
  gRNA
uccugggucguagccauacc

SEQ ID NO: 61074 - RNA, 20 nt, Artificial Sequence
  MKO10061074_A_Zfp672
  gRNA
agaaacgcuugucgccacca

SEQ ID NO: 61075 - RNA, 20 nt, Artificial Sequence
  MKO10061075_A_Zfp677
  gRNA
cguuguaaguguugacuucu

SEQ ID NO: 61076 - RNA, 20 nt, Artificial Sequence
  MKO10061076_A_Zfp677
  gRNA
gucacaaacauugcacgugu

SEQ ID NO: 61077 - RNA, 20 nt, Artificial Sequence
  MKO10061077_A_Zfp677
  gRNA
cugaccugagacauauuucc

SEQ ID NO: 61078 - RNA, 20 nt, Artificial Sequence
  MKO10061078_A_Zfp687
  gRNA
ccaaccaaaagagcccgacg

SEQ ID NO: 61079 - RNA, 20 nt, Artificial Sequence
  MKO10061079_A_Zfp687
  gRNA
cugcauuucucucgccgugu

SEQ ID NO: 61080 - RNA, 20 nt, Artificial Sequence
  MKO10061080_A_Zfp687
  gRNA
gucacauacucgucacgcuc

SEQ ID NO: 61081 - RNA, 20 nt, Artificial Sequence
  MKO10061081_A_Zfp688
  gRNA
ucacugcugguuccgaugcc

SEQ ID NO: 61082 - RNA, 20 nt, Artificial Sequence
  MKO10061082_A_Zfp688
  gRNA
uagugccgaaagagcacugg

SEQ ID NO: 61083 - RNA, 20 nt, Artificial Sequence
  MKO10061083_A_Zfp688
  gRNA
cgcgcaucaccucccgauac

SEQ ID NO: 61084 - RNA, 20 nt, Artificial Sequence
  MKO10061084_A_Zfp689
  gRNA
aucgguauuucguuccaacc

SEQ ID NO: 61085 - RNA, 20 nt, Artificial Sequence
  MKO10061085_A_Zfp689
  gRNA
cgaagcgacgcccacaacua

SEQ ID NO: 61086 - RNA, 20 nt, Artificial Sequence
  MKO10061086_A_Zfp689
  gRNA
uccggugauuggccaacgac

SEQ ID NO: 61087 - RNA, 20 nt, Artificial Sequence
  MKO10061087_A_Zfp68
  gRNA
aagaccuucuaccguaaguc

SEQ ID NO: 61088 - RNA, 20 nt, Artificial Sequence
  MKO10061088_A_Zfp68
  gRNA
gaaucuucugaugccgcuua

SEQ ID NO: 61089 - RNA, 20 nt, Artificial Sequence
  MKO10061089_A_Zfp68
  gRNA
gccucacaccaguguguccc

SEQ ID NO: 61090 - RNA, 20 nt, Artificial Sequence
  MKO10061090_A_Zfp691
  gRNA
uggugagguccgagcgccgc

SEQ ID NO: 61091 - RNA, 20 nt, Artificial Sequence
  MKO10061091_A_Zfp691
  gRNA
cccggagcuccaaccgcauc

SEQ ID NO: 61092 - RNA, 20 nt, Artificial Sequence
  MKO10061092_A_Zfp691
  gRNA
uguacaucaccggacccacc

SEQ ID NO: 61093 - RNA, 20 nt, Artificial Sequence
  MKO10061093_A_Zfp692
  gRNA
cgggcacuaggccgcauucc

SEQ ID NO: 61094 - RNA, 20 nt, Artificial Sequence
  MKO10061094_A_Zfp692
  gRNA
cugcgggccacacguucucc

SEQ ID NO: 61095 - RNA, 20 nt, Artificial Sequence
  MKO10061095_A_Zfp692
  gRNA
ucuggcagguacacuucuuc

SEQ ID NO: 61096 - RNA, 20 nt, Artificial Sequence
  MKO10061096_A_Zfp697
  gRNA
guucgugcgccgcucgcauc

SEQ ID NO: 61097 - RNA, 20 nt, Artificial Sequence
  MKO10061097_A_Zfp697
  gRNA
cgcgaaaagcccuuccgcug

SEQ ID NO: 61098 - RNA, 20 nt, Artificial Sequence
  MKO10061098_A_Zfp697
  gRNA
auagcguccacugucuguuc

SEQ ID NO: 61099 - RNA, 20 nt, Artificial Sequence
  MKO10061099_A_Zfp69
  gRNA
aagcgacgagcgaugccgga

SEQ ID NO: 61100 - RNA, 20 nt, Artificial Sequence
  MKO10061100_A_Zfp69
  gRNA
aaggugucuaaucugucgaa

SEQ ID NO: 61101 - RNA, 20 nt, Artificial Sequence
  MKO10061101_A_Zfp69
  gRNA
cauugccguggacuuauccc

SEQ ID NO: 61102 - RNA, 20 nt, Artificial Sequence
  MKO10061102_A_Zfp703
  gRNA
caaaugagcgauucgcccgc

SEQ ID NO: 61103 - RNA, 20 nt, Artificial Sequence
  MKO10061103_A_Zfp703
  gRNA
cggaucgugcgcgcugcaag

SEQ ID NO: 61104 - RNA, 20 nt, Artificial Sequence
  MKO10061104_A_Zfp703
  gRNA
uccaucgugggcgccuacgc

SEQ ID NO: 61105 - RNA, 20 nt, Artificial Sequence
  MKO10061105_A_Zfp704
  gRNA
gacucaccauuaggccgcac

SEQ ID NO: 61106 - RNA, 20 nt, Artificial Sequence
  MKO10061106_A_Zfp704
  gRNA
gccucgucaaugccaucguc

SEQ ID NO: 61107 - RNA, 20 nt, Artificial Sequence
  MKO10061107_A_Zfp704
  gRNA
gaccuucacguuucaaucag

SEQ ID NO: 61108 - RNA, 20 nt, Artificial Sequence
  MKO10061108_A_Zfp706
  gRNA
ccuuacccuacagacggugc

SEQ ID NO: 61109 - RNA, 20 nt, Artificial Sequence
  MKO10061109_A_Zfp706
  gRNA
gcagaaaaaugccaaaaagc

SEQ ID NO: 61110 - RNA, 20 nt, Artificial Sequence
  MKO10061110_A_Zfp706
  gRNA
gacuccacuuccuccagaau

SEQ ID NO: 61111 - RNA, 20 nt, Artificial Sequence
  MKO10061111_A_Zfp707
  gRNA
gaugucgcgugaagaagccc

SEQ ID NO: 61112 - RNA, 20 nt, Artificial Sequence
  MKO10061112_A_Zfp707
  gRNA
accgggccuuauuacccguc

SEQ ID NO: 61113 - RNA, 20 nt, Artificial Sequence
  MKO10061113_A_Zfp707
  gRNA
gagguucuccuuaguccgaa

SEQ ID NO: 61114 - RNA, 20 nt, Artificial Sequence
  MKO10061114_A_Zfp708
  gRNA
cuuagaaagaaugcagcgac

SEQ ID NO: 61115 - RNA, 20 nt, Artificial Sequence
  MKO10061115_A_Zfp708
  gRNA
gagugaugugugaacacuaa

SEQ ID NO: 61116 - RNA, 20 nt, Artificial Sequence
  MKO10061116_A_Zfp708
  gRNA
cccucugucauuuacagaug

SEQ ID NO: 61117 - RNA, 20 nt, Artificial Sequence
  MKO10061117_A_Zfp709
  gRNA
gcucgcccgucuccgggcca

SEQ ID NO: 61118 - RNA, 20 nt, Artificial Sequence
  MKO10061118_A_Zfp709
  gRNA
uccggucagcugagaacccg

SEQ ID NO: 61119 - RNA, 20 nt, Artificial Sequence
  MKO10061119_A_Zfp709
  gRNA
guucucuucgauaucaugag

SEQ ID NO: 61120 - RNA, 20 nt, Artificial Sequence
  MKO10061120_A_Zfp710
  gRNA
ugcgacacugccagcguuuc

SEQ ID NO: 61121 - RNA, 20 nt, Artificial Sequence
  MKO10061121_A_Zfp710
  gRNA
ugacacggcggguuccacag

SEQ ID NO: 61122 - RNA, 20 nt, Artificial Sequence
  MKO10061122_A_Zfp710
  gRNA
uggccgggaguucacgcugc

SEQ ID NO: 61123 - RNA, 20 nt, Artificial Sequence
  MKO10061123_A_Zfp711
  gRNA
ccauugaaaaucgcuagcga

SEQ ID NO: 61124 - RNA, 20 nt, Artificial Sequence
  MKO10061124_A_Zfp711
  gRNA
agcuuauuacagaaaccguu

SEQ ID NO: 61125 - RNA, 20 nt, Artificial Sequence
  MKO10061125_A_Zfp711
  gRNA
uccccuugaaauuccgcuuc

SEQ ID NO: 61126 - RNA, 20 nt, Artificial Sequence
  MKO10061126_A_Zfp712
  gRNA
caacaacauaaaauucgucc

SEQ ID NO: 61127 - RNA, 20 nt, Artificial Sequence
  MKO10061127_A_Zfp712
  gRNA
caguguugaccgaacauuaa

SEQ ID NO: 61128 - RNA, 20 nt, Artificial Sequence
  MKO10061128_A_Zfp712
  gRNA
ugcuuucucuaagccguacu

SEQ ID NO: 61129 - RNA, 20 nt, Artificial Sequence
  MKO10061129_A_Zfp715
  gRNA
caacucugauuuacguaaga

SEQ ID NO: 61130 - RNA, 20 nt, Artificial Sequence
  MKO10061130_A_Zfp715
  gRNA
gaccguguaguucauacugg

SEQ ID NO: 61131 - RNA, 20 nt, Artificial Sequence
  MKO10061131_A_Zfp715
  gRNA
gaaauuuggaucugcagcca

SEQ ID NO: 61132 - RNA, 20 nt, Artificial Sequence
  MKO10061132_A_Zfp719
  gRNA
aaaccuuucguccguaacaa

SEQ ID NO: 61133 - RNA, 20 nt, Artificial Sequence
  MKO10061133_A_Zfp719
  gRNA
gaauucgaugaugcaccuuc

SEQ ID NO: 61134 - RNA, 20 nt, Artificial Sequence
  MKO10061134_A_Zfp719
  gRNA
uggcagaaauucauaucagu

SEQ ID NO: 61135 - RNA, 20 nt, Artificial Sequence
  MKO10061135_A_Zfp72
  gRNA
aagggcuuccccauuauuaa

SEQ ID NO: 61136 - RNA, 20 nt, Artificial Sequence
  MKO10061136_A_Zfp72
  gRNA
gaauucucugaugcuuauac

SEQ ID NO: 61137 - RNA, 20 nt, Artificial Sequence
  MKO10061137_A_Zfp72
  gRNA
ugcuuucucuaagcccuauc

SEQ ID NO: 61138 - RNA, 20 nt, Artificial Sequence
  MKO10061138_A_Zfp735
  gRNA
uugucauaaacucgauuuaa

SEQ ID NO: 61139 - RNA, 20 nt, Artificial Sequence
  MKO10061139_A_Zfp735
  gRNA
uucaaggacuuaucauaucc

SEQ ID NO: 61140 - RNA, 20 nt, Artificial Sequence
  MKO10061140_A_Zfp735
  gRNA
ucaggguguauugacauuca

SEQ ID NO: 61141 - RNA, 20 nt, Artificial Sequence
  MKO10061141_A_Zfp738
  gRNA
uccacauauuaacacuugua

SEQ ID NO: 61142 - RNA, 20 nt, Artificial Sequence
  MKO10061142_A_Zfp738
  gRNA
uagaaaguagugaugcaaca

SEQ ID NO: 61143 - RNA, 20 nt, Artificial Sequence
  MKO10061143_A_Zfp738
  gRNA
agcggcuaccucuaugcucc

SEQ ID NO: 61144 - RNA, 20 nt, Artificial Sequence
  MKO10061144_A_Zfp740
  gRNA
ucugaccuucguccgccgug

SEQ ID NO: 61145 - RNA, 20 nt, Artificial Sequence
  MKO10061145_A_Zfp740
  gRNA
accaucucgaacgccacaag

SEQ ID NO: 61146 - RNA, 20 nt, Artificial Sequence
  MKO10061146_A_Zfp740
  gRNA
cuuggguuccguagcccauu

SEQ ID NO: 61147 - RNA, 20 nt, Artificial Sequence
  MKO10061147_A_Zfp746
  gRNA
ccaugcaccuggcgucgcac

SEQ ID NO: 61148 - RNA, 20 nt, Artificial Sequence
  MKO10061148_A_Zfp746
  gRNA
cuugggcccagugcgacgcc

SEQ ID NO: 61149 - RNA, 20 nt, Artificial Sequence
  MKO10061149_A_Zfp746
  gRNA
uggagaaucugcuacgcaac

SEQ ID NO: 61150 - RNA, 20 nt, Artificial Sequence
  MKO10061150_A_Zfp747
  gRNA
gcuccucgagguguauggcc

SEQ ID NO: 61151 - RNA, 20 nt, Artificial Sequence
  MKO10061151_A_Zfp747
  gRNA
ggcgaaagcagcgaccaguc

SEQ ID NO: 61152 - RNA, 20 nt, Artificial Sequence
  MKO10061152_A_Zfp747
  gRNA
agucuacauggcgcagguga

SEQ ID NO: 61153 - RNA, 20 nt, Artificial Sequence
  MKO10061153_A_Zfp748
  gRNA
ucucuuccguaucguuuaua

SEQ ID NO: 61154 - RNA, 20 nt, Artificial Sequence
  MKO10061154_A_Zfp748
  gRNA
gaccuaucuuaugcugaauc

SEQ ID NO: 61155 - RNA, 20 nt, Artificial Sequence
  MKO10061155_A_Zfp748
  gRNA
uuugcuccagaaacgugacc

SEQ ID NO: 61156 - RNA, 20 nt, Artificial Sequence
  MKO10061156_A_Zfp74
  gRNA
ggccucucauaugcacgaug

SEQ ID NO: 61157 - RNA, 20 nt, Artificial Sequence
  MKO10061157_A_Zfp74
  gRNA
gccugacaagguuugacauc

SEQ ID NO: 61158 - RNA, 20 nt, Artificial Sequence
  MKO10061158_A_Zfp74
  gRNA
acuagugacguucaaagacg

SEQ ID NO: 61159 - RNA, 20 nt, Artificial Sequence
  MKO10061159_A_Zfp750
  gRNA
gccaaaaugagcccccgagc

SEQ ID NO: 61160 - RNA, 20 nt, Artificial Sequence
  MKO10061160_A_Zfp750
  gRNA
ugaagauaggacaagccgcg

SEQ ID NO: 61161 - RNA, 20 nt, Artificial Sequence
  MKO10061161_A_Zfp750
  gRNA
ccgccuucaaaccuguccaa

SEQ ID NO: 61162 - RNA, 20 nt, Artificial Sequence
  MKO10061162_A_Zfp758
  gRNA
caucaucuuucuuuccgaug

SEQ ID NO: 61163 - RNA, 20 nt, Artificial Sequence
  MKO10061163_A_Zfp758
  gRNA
uuuauaagguguacuuugac

SEQ ID NO: 61164 - RNA, 20 nt, Artificial Sequence
  MKO10061164_A_Zfp758
  gRNA
aagaagaaugaauucuucuc

SEQ ID NO: 61165 - RNA, 20 nt, Artificial Sequence
  MKO10061165_A_Zfp759
  gRNA
ccaaccucuucacaacuaua

SEQ ID NO: 61166 - RNA, 20 nt, Artificial Sequence
  MKO10061166_A_Zfp759
  gRNA
ucguguugacaaauagauga

SEQ ID NO: 61167 - RNA, 20 nt, Artificial Sequence
  MKO10061167_A_Zfp759
  gRNA
ucccuguacaauuuccacug

SEQ ID NO: 61168 - RNA, 20 nt, Artificial Sequence
  MKO10061168_A_Zfp760
  gRNA
guguacuaagacccgugcaa

SEQ ID NO: 61169 - RNA, 20 nt, Artificial Sequence
  MKO10061169_A_Zfp760
  gRNA
uguguuccaucuuuauaucg

SEQ ID NO: 61170 - RNA, 20 nt, Artificial Sequence
  MKO10061170_A_Zfp760
  gRNA
uuacagggucuguugacauu

SEQ ID NO: 61171 - RNA, 20 nt, Artificial Sequence
  MKO10061171_A_Zfp763
  gRNA
acacgccuuccguugaauga

SEQ ID NO: 61172 - RNA, 20 nt, Artificial Sequence
  MKO10061172_A_Zfp763
  gRNA
ucuacaucccuucgcaauca

SEQ ID NO: 61173 - RNA, 20 nt, Artificial Sequence
  MKO10061173_A_Zfp763
  gRNA
caccuggaugcauaugaaag

SEQ ID NO: 61174 - RNA, 20 nt, Artificial Sequence
  MKO10061174_A_Zfp764
  gRNA
cgagccuucacacgucgcuc

SEQ ID NO: 61175 - RNA, 20 nt, Artificial Sequence
  MKO10061175_A_Zfp764
  gRNA
gaggccagagcgacguguga

SEQ ID NO: 61176 - RNA, 20 nt, Artificial Sequence
  MKO10061176_A_Zfp764
  gRNA
gccugcguccuguaaacccg

SEQ ID NO: 61177 - RNA, 20 nt, Artificial Sequence
  MKO10061177_A_Zfp768
  gRNA
cgugacugguuaacggcggc

SEQ ID NO: 61178 - RNA, 20 nt, Artificial Sequence
  MKO10061178_A_Zfp768
  gRNA
gcuccccacuaugcacgcga

SEQ ID NO: 61179 - RNA, 20 nt, Artificial Sequence
  MKO10061179_A_Zfp768
  gRNA
agccccgaagggucucucaa

SEQ ID NO: 61180 - RNA, 20 nt, Artificial Sequence
  MKO10061180_A_Zfp770
  gRNA
auccacgcguguacgaucug

SEQ ID NO: 61181 - RNA, 20 nt, Artificial Sequence
  MKO10061181_A_Zfp770
  gRNA
ugccacagaucguacacgcg

SEQ ID NO: 61182 - RNA, 20 nt, Artificial Sequence
  MKO10061182_A_Zfp770
  gRNA
auaauaugcuucccguugua

SEQ ID NO: 61183 - RNA, 20 nt, Artificial Sequence
  MKO10061183_A_Zfp771
  gRNA
gccaccgucgcgcgcacaug

SEQ ID NO: 61184 - RNA, 20 nt, Artificial Sequence
  MKO10061184_A_Zfp771
  gRNA
uaguguggagcggcgcgcaa

SEQ ID NO: 61185 - RNA, 20 nt, Artificial Sequence
  MKO10061185_A_Zfp771
  gRNA
cguaccuccuuguuguccac

SEQ ID NO: 61186 - RNA, 20 nt, Artificial Sequence
  MKO10061186_A_Zfp772
  gRNA
gcacucgcgcaugauaaaug

SEQ ID NO: 61187 - RNA, 20 nt, Artificial Sequence
  MKO10061187_A_Zfp772
  gRNA
cgcgagugcacacucgagaa

SEQ ID NO: 61188 - RNA, 20 nt, Artificial Sequence
  MKO10061188_A_Zfp772
  gRNA
cuuaacacucaugucuucuu

SEQ ID NO: 61189 - RNA, 20 nt, Artificial Sequence
  MKO10061189_A_Zfp773
  gRNA
agucucugcuuauucgacac

SEQ ID NO: 61190 - RNA, 20 nt, Artificial Sequence
  MKO10061190_A_Zfp773
  gRNA
ucauguacgauuccccacac

SEQ ID NO: 61191 - RNA, 20 nt, Artificial Sequence
  MKO10061191_A_Zfp773
  gRNA
cgugugguugguugcaggcc

SEQ ID NO: 61192 - RNA, 20 nt, Artificial Sequence
  MKO10061192_A_Zfp775
  gRNA
ccccacgcgggcaucccgag

SEQ ID NO: 61193 - RNA, 20 nt, Artificial Sequence
  MKO10061193_A_Zfp775
  gRNA
ugcgcucgcagucggcaguc

SEQ ID NO: 61194 - RNA, 20 nt, Artificial Sequence
  MKO10061194_A_Zfp775
  gRNA
uaccugagaugcugccagcc

SEQ ID NO: 61195 - RNA, 20 nt, Artificial Sequence
  MKO10061195_A_Zfp777
  gRNA
gcgacaucaucgaaugugac

SEQ ID NO: 61196 - RNA, 20 nt, Artificial Sequence
  MKO10061196_A_Zfp777
  gRNA
gaacgcgcucgaggagucca

SEQ ID NO: 61197 - RNA, 20 nt, Artificial Sequence
  MKO10061197_A_Zfp777
  gRNA
uguggaguucgcaaaucauc

SEQ ID NO: 61198 - RNA, 20 nt, Artificial Sequence
  MKO10061198_A_Zfp780b
  gRNA
auacuaguacuagaguccuu

SEQ ID NO: 61199 - RNA, 20 nt, Artificial Sequence
  MKO10061199_A_Zfp780b
  gRNA
aacgaaccuuaguauucauc

SEQ ID NO: 61200 - RNA, 20 nt, Artificial Sequence
  MKO10061200_A_Zfp780b
  gRNA
caugucuugagaauuagagu

SEQ ID NO: 61201 - RNA, 20 nt, Artificial Sequence
  MKO10061201_A_Zfp781
  gRNA
uauccagaagaugccccaac

SEQ ID NO: 61202 - RNA, 20 nt, Artificial Sequence
  MKO10061202_A_Zfp781
  gRNA
uuaggaugcagugaccuaug

SEQ ID NO: 61203 - RNA, 20 nt, Artificial Sequence
  MKO10061203_A_Zfp781
  gRNA
cauucuuaccuauagcagug

SEQ ID NO: 61204 - RNA, 20 nt, Artificial Sequence
  MKO10061204_A_Zfp784
  gRNA
gucgcccgcaccagguccgg

SEQ ID NO: 61205 - RNA, 20 nt, Artificial Sequence
  MKO10061205_A_Zfp784
  gRNA
gagcucggaaucgggggauc

SEQ ID NO: 61206 - RNA, 20 nt, Artificial Sequence
  MKO10061206_A_Zfp784
  gRNA
cagauaugcgagaccacgag

SEQ ID NO: 61207 - RNA, 20 nt, Artificial Sequence
  MKO10061207_A_Zfp786
  gRNA
uggccauggccggacccgcu

SEQ ID NO: 61208 - RNA, 20 nt, Artificial Sequence
  MKO10061208_A_Zfp786
  gRNA
ggcccuuacccgagcggguc

SEQ ID NO: 61209 - RNA, 20 nt, Artificial Sequence
  MKO10061209_A_Zfp786
  gRNA
cuuccgccuaaagcaguacu

SEQ ID NO: 61210 - RNA, 20 nt, Artificial Sequence
  MKO10061210_A_Zfp787
  gRNA
gucgugucagcuucgaccag

SEQ ID NO: 61211 - RNA, 20 nt, Artificial Sequence
  MKO10061211_A_Zfp787
  gRNA
gugcgcggugugccgaaugu

SEQ ID NO: 61212 - RNA, 20 nt, Artificial Sequence
  MKO10061212_A_Zfp787
  gRNA
uggagcuucgagaagaagcu

SEQ ID NO: 61213 - RNA, 20 nt, Artificial Sequence
  MKO10061213_A_Zfp788
  gRNA
cucuacuucgaauacaugaa

SEQ ID NO: 61214 - RNA, 20 nt, Artificial Sequence
  MKO10061214_A_Zfp788
  gRNA
uuugguuccugugaaagucg

SEQ ID NO: 61215 - RNA, 20 nt, Artificial Sequence
  MKO10061215_A_Zfp788
  gRNA
uacaauaaccuugcuugugu

SEQ ID NO: 61216 - RNA, 20 nt, Artificial Sequence
  MKO10061216_A_Zfp78
  gRNA
ccauaucaaugcaccgucug

SEQ ID NO: 61217 - RNA, 20 nt, Artificial Sequence
  MKO10061217_A_Zfp78
  gRNA
ccgcagacggugcauugaua

SEQ ID NO: 61218 - RNA, 20 nt, Artificial Sequence
  MKO10061218_A_Zfp78
  gRNA
accaucucuaaucuccuuau

SEQ ID NO: 61219 - RNA, 20 nt, Artificial Sequence
  MKO10061219_A_Zfp790
  gRNA
cgccagugugaguccgaacg

SEQ ID NO: 61220 - RNA, 20 nt, Artificial Sequence
  MKO10061220_A_Zfp790
  gRNA
uacucgcuaccgagcaguuc

SEQ ID NO: 61221 - RNA, 20 nt, Artificial Sequence
  MKO10061221_A_Zfp790
  gRNA
cuuugcauuuaucaaccgca

SEQ ID NO: 61222 - RNA, 20 nt, Artificial Sequence
  MKO10061222_A_Zfp791
  gRNA
cguacugccgcgcgcaugag

SEQ ID NO: 61223 - RNA, 20 nt, Artificial Sequence
  MKO10061223_A_Zfp791
  gRNA
gcgcccuucaagcgcaugag

SEQ ID NO: 61224 - RNA, 20 nt, Artificial Sequence
  MKO10061224_A_Zfp791
  gRNA
agucacacacacguccucaa

SEQ ID NO: 61225 - RNA, 20 nt, Artificial Sequence
  MKO10061225_A_Zfp799
  gRNA
ggaguaugaacgacugaugc

SEQ ID NO: 61226 - RNA, 20 nt, Artificial Sequence
  MKO10061226_A_Zfp799
  gRNA
aacucaagaguaucgaguag

SEQ ID NO: 61227 - RNA, 20 nt, Artificial Sequence
  MKO10061227_A_Zfp799
  gRNA
caccuucaccuauauaggac

SEQ ID NO: 61228 - RNA, 20 nt, Artificial Sequence
  MKO10061228_A_Zfp7
  gRNA
gaagcaccguuugaauagcg

SEQ ID NO: 61229 - RNA, 20 nt, Artificial Sequence
  MKO10061229_A_Zfp7
  gRNA
gugcacagccacgucgccaa

SEQ ID NO: 61230 - RNA, 20 nt, Artificial Sequence
  MKO10061230_A_Zfp7
  gRNA
aucaggccgauaacccacau

SEQ ID NO: 61231 - RNA, 20 nt, Artificial Sequence
  MKO10061231_A_Zfp800
  gRNA
uuucacuucaauaccgacgu

SEQ ID NO: 61232 - RNA, 20 nt, Artificial Sequence
  MKO10061232_A_Zfp800
  gRNA
ucugcacuuacgaaacccgu

SEQ ID NO: 61233 - RNA, 20 nt, Artificial Sequence
  MKO10061233_A_Zfp800
  gRNA
auaauugagugcuuucgauc

SEQ ID NO: 61234 - RNA, 20 nt, Artificial Sequence
  MKO10061234_A_Zfp804a
  gRNA
uucaucgcuguauuccgaga

SEQ ID NO: 61235 - RNA, 20 nt, Artificial Sequence
  MKO10061235_A_Zfp804a
  gRNA
ucguaguuccaucuccaaug

SEQ ID NO: 61236 - RNA, 20 nt, Artificial Sequence
  MKO10061236_A_Zfp804a
  gRNA
auaugaccacgcccacaaac

SEQ ID NO: 61237 - RNA, 20 nt, Artificial Sequence
  MKO10061237_A_Zfp804b
  gRNA
acacucggagaggccucgcc

SEQ ID NO: 61238 - RNA, 20 nt, Artificial Sequence
  MKO10061238_A_Zfp804b
  gRNA
acaugcuagucuacgagacu

SEQ ID NO: 61239 - RNA, 20 nt, Artificial Sequence
  MKO10061239_A_Zfp804b
  gRNA
ggcuuaccugcuuaugagcg

SEQ ID NO: 61240 - RNA, 20 nt, Artificial Sequence
  MKO10061240_A_Zfp808
  gRNA
gucaucuccaaaaccauaua

SEQ ID NO: 61241 - RNA, 20 nt, Artificial Sequence
  MKO10061241_A_Zfp808
  gRNA
acugugagcacguaaagcaa

SEQ ID NO: 61242 - RNA, 20 nt, Artificial Sequence
  MKO10061242_A_Zfp808
  gRNA
uagucuuaccuauagcauug

SEQ ID NO: 61243 - RNA, 20 nt, Artificial Sequence
  MKO10061243_A_Zfp809
  gRNA
cuucugauguauagcgaguu

SEQ ID NO: 61244 - RNA, 20 nt, Artificial Sequence
  MKO10061244_A_Zfp809
  gRNA
aguugccgcaaacgugucuu

SEQ ID NO: 61245 - RNA, 20 nt, Artificial Sequence
  MKO10061245_A_Zfp809
  gRNA
cacucagaguacucacguua

SEQ ID NO: 61246 - RNA, 20 nt, Artificial Sequence
  MKO10061246_A_Zfp810
  gRNA
augccgagugagaucugacu

SEQ ID NO: 61247 - RNA, 20 nt, Artificial Sequence
  MKO10061247_A_Zfp810
  gRNA
ccccaugcgugcuuagagug

SEQ ID NO: 61248 - RNA, 20 nt, Artificial Sequence
  MKO10061248_A_Zfp810
  gRNA
cucgggccacggagcacagc

SEQ ID NO: 61249 - RNA, 20 nt, Artificial Sequence
  MKO10061249_A_Zfp811
  gRNA
acuuguagggaacucgggaa

SEQ ID NO: 61250 - RNA, 20 nt, Artificial Sequence
  MKO10061250_A_Zfp811
  gRNA
uaaaugugcgacugaaaccu

SEQ ID NO: 61251 - RNA, 20 nt, Artificial Sequence
  MKO10061251_A_Zfp811
  gRNA
acaauccagauccccaaaua

SEQ ID NO: 61252 - RNA, 20 nt, Artificial Sequence
  MKO10061252_A_Zfp819
  gRNA
cucauauuguuccauuaucg

SEQ ID NO: 61253 - RNA, 20 nt, Artificial Sequence
  MKO10061253_A_Zfp819
  gRNA
cugccacgguuccucgauaa

SEQ ID NO: 61254 - RNA, 20 nt, Artificial Sequence
  MKO10061254_A_Zfp819
  gRNA
caggcucacccacuaccaag

SEQ ID NO: 61255 - RNA, 20 nt, Artificial Sequence
  MKO10061255_A_Zfp81
  gRNA
guuaauaaguacauaccucc

SEQ ID NO: 61256 - RNA, 20 nt, Artificial Sequence
  MKO10061256_A_Zfp81
  gRNA
aacagucuaaugaccccugu

SEQ ID NO: 61257 - RNA, 20 nt, Artificial Sequence
  MKO10061257_A_Zfp81
  gRNA
uuaccuuucagggaaaagcg

SEQ ID NO: 61258 - RNA, 20 nt, Artificial Sequence
  MKO10061258_A_Zfp820
  gRNA
cucuaccauuaguuuaacuc

SEQ ID NO: 61259 - RNA, 20 nt, Artificial Sequence
  MKO10061259_A_Zfp820
  gRNA
aacaaauuuaaacaguuaac

SEQ ID NO: 61260 - RNA, 20 nt, Artificial Sequence
  MKO10061260_A_Zfp820
  gRNA
uucucuccuaaauguuccuc

SEQ ID NO: 61261 - RNA, 20 nt, Artificial Sequence
  MKO10061261_A_Zfp821
  gRNA
uauccaacaacuacgagauc

SEQ ID NO: 61262 - RNA, 20 nt, Artificial Sequence
  MKO10061262_A_Zfp821
  gRNA
ggacgcacuagcagagcgcg

SEQ ID NO: 61263 - RNA, 20 nt, Artificial Sequence
  MKO10061263_A_Zfp821
  gRNA
agugcguccccacuacugac

SEQ ID NO: 61264 - RNA, 20 nt, Artificial Sequence
  MKO10061264_A_Zfp825
  gRNA
cuucagaguaaacaauaccc

SEQ ID NO: 61265 - RNA, 20 nt, Artificial Sequence
  MKO10061265_A_Zfp825
  gRNA
ucuucuuugagcgcugcuau

SEQ ID NO: 61266 - RNA, 20 nt, Artificial Sequence
  MKO10061266_A_Zfp825
  gRNA
acaaugacauaaaaacacag

SEQ ID NO: 61267 - RNA, 20 nt, Artificial Sequence
  MKO10061267_A_Zfp827
  gRNA
gucuaccccaagcgucuccg

SEQ ID NO: 61268 - RNA, 20 nt, Artificial Sequence
  MKO10061268_A_Zfp827
  gRNA
acuccgucagaagcguccua

SEQ ID NO: 61269 - RNA, 20 nt, Artificial Sequence
  MKO10061269_A_Zfp827
  gRNA
gauuguccuugcgagcacac

SEQ ID NO: 61270 - RNA, 20 nt, Artificial Sequence
  MKO10061270_A_Zfp82
  gRNA
uaccacaauguggccucgcu

SEQ ID NO: 61271 - RNA, 20 nt, Artificial Sequence
  MKO10061271_A_Zfp82
  gRNA
uaccuagcgaggccacauug

SEQ ID NO: 61272 - RNA, 20 nt, Artificial Sequence
  MKO10061272_A_Zfp82
  gRNA
gccagaugugauuuccuuac

SEQ ID NO: 61273 - RNA, 20 nt, Artificial Sequence
  MKO10061273_A_Zfp830
  gRNA
gauagaauguuaccgccgag

SEQ ID NO: 61274 - RNA, 20 nt, Artificial Sequence
  MKO10061274_A_Zfp830
  gRNA
cgcccuagcggcauccaagu

SEQ ID NO: 61275 - RNA, 20 nt, Artificial Sequence
  MKO10061275_A_Zfp830
  gRNA
ugagguacagugccggucga

SEQ ID NO: 61276 - RNA, 20 nt, Artificial Sequence
  MKO10061276_A_Zfp831
  gRNA
aacgccugugcaagccaccc

SEQ ID NO: 61277 - RNA, 20 nt, Artificial Sequence
  MKO10061277_A_Zfp831
  gRNA
cugucucccccaccgacuug

SEQ ID NO: 61278 - RNA, 20 nt, Artificial Sequence
  MKO10061278_A_Zfp831
  gRNA
uccacaauccaacacguucu

SEQ ID NO: 61279 - RNA, 20 nt, Artificial Sequence
  MKO10061279_A_Zfp839
  gRNA
agcgcguuaccucccggagc

SEQ ID NO: 61280 - RNA, 20 nt, Artificial Sequence
  MKO10061280_A_Zfp839
  gRNA
ugcaacugcgcguguacccg

SEQ ID NO: 61281 - RNA, 20 nt, Artificial Sequence
  MKO10061281_A_Zfp839
  gRNA
cucgaucuggacggguaucc

SEQ ID NO: 61282 - RNA, 20 nt, Artificial Sequence
  MKO10061282_A_Zfp846
  gRNA
uagaugcuuacguaaguacg

SEQ ID NO: 61283 - RNA, 20 nt, Artificial Sequence
  MKO10061283_A_Zfp846
  gRNA
gaguucuuaagugucuacgc

SEQ ID NO: 61284 - RNA, 20 nt, Artificial Sequence
  MKO10061284_A_Zfp846
  gRNA
ccaagagucaccauugcauc

SEQ ID NO: 61285 - RNA, 20 nt, Artificial Sequence
  MKO10061285_A_Zfp84
  gRNA
cacggugcugacguccacaa

SEQ ID NO: 61286 - RNA, 20 nt, Artificial Sequence
  MKO10061286_A_Zfp84
  gRNA
cgaguguaacuacugcgaaa

SEQ ID NO: 61287 - RNA, 20 nt, Artificial Sequence
  MKO10061287_A_Zfp84
  gRNA
aaaguaggaaggacacgcga

SEQ ID NO: 61288 - RNA, 20 nt, Artificial Sequence
  MKO10061288_A_Zfp850
  gRNA
ccgugaauguacuauagcug

SEQ ID NO: 61289 - RNA, 20 nt, Artificial Sequence
  MKO10061289_A_Zfp850
  gRNA
gugggaaauucuuucgucga

SEQ ID NO: 61290 - RNA, 20 nt, Artificial Sequence
  MKO10061290_A_Zfp850
  gRNA
caggcuuacccacugcaaug

SEQ ID NO: 61291 - RNA, 20 nt, Artificial Sequence
  MKO10061291_A_Zfp85
  gRNA
gaguguugugccaacacuaa

SEQ ID NO: 61292 - RNA, 20 nt, Artificial Sequence
  MKO10061292_A_Zfp85
  gRNA
cuucgaaucuuaaaaaucau

SEQ ID NO: 61293 - RNA, 20 nt, Artificial Sequence
  MKO10061293_A_Zfp85
  gRNA
ccuucugucauucacagaug

SEQ ID NO: 61294 - RNA, 20 nt, Artificial Sequence
  MKO10061294_A_Zfp865
  gRNA
ucgcagggguacaccggccg

SEQ ID NO: 61295 - RNA, 20 nt, Artificial Sequence
  MKO10061295_A_Zfp865
  gRNA
ggcucgcugauggcguaaca

SEQ ID NO: 61296 - RNA, 20 nt, Artificial Sequence
  MKO10061296_A_Zfp865
  gRNA
acuauuccccauugcggagc

SEQ ID NO: 61297 - RNA, 20 nt, Artificial Sequence
  MKO10061297_A_Zfp866
  gRNA
gaguucuuucgugcaaccga

SEQ ID NO: 61298 - RNA, 20 nt, Artificial Sequence
  MKO10061298_A_Zfp866
  gRNA
gugugcgcucguguaaucga

SEQ ID NO: 61299 - RNA, 20 nt, Artificial Sequence
  MKO10061299_A_Zfp866
  gRNA
gagccuuaccuaucgcagcg

SEQ ID NO: 61300 - RNA, 20 nt, Artificial Sequence
  MKO10061300_A_Zfp867
  gRNA
aguccgcucaugcuuucgaa

SEQ ID NO: 61301 - RNA, 20 nt, Artificial Sequence
  MKO10061301_A_Zfp867
  gRNA
agcaccuugcucacguuuau

SEQ ID NO: 61302 - RNA, 20 nt, Artificial Sequence
  MKO10061302_A_Zfp867
  gRNA
uguccucauccucaacguuc

SEQ ID NO: 61303 - RNA, 20 nt, Artificial Sequence
  MKO10061303_A_Zfp868
  gRNA
ccaugguuuaggaugugaau

SEQ ID NO: 61304 - RNA, 20 nt, Artificial Sequence
  MKO10061304_A_Zfp868
  gRNA
uguaucagugaaguuccuga

SEQ ID NO: 61305 - RNA, 20 nt, Artificial Sequence
  MKO10061305_A_Zfp868
  gRNA
uuucaugagcgaagccacac

SEQ ID NO: 61306 - RNA, 20 nt, Artificial Sequence
  MKO10061306_A_Zfp869
  gRNA
ggcuucguucgugaaaucga

SEQ ID NO: 61307 - RNA, 20 nt, Artificial Sequence
  MKO10061307_A_Zfp869
  gRNA
ucucucgugcagucgaagcg

SEQ ID NO: 61308 - RNA, 20 nt, Artificial Sequence
  MKO10061308_A_Zfp869
  gRNA
uacggcagugaaguuccuga

SEQ ID NO: 61309 - RNA, 20 nt, Artificial Sequence
  MKO10061309_A_Zfp870
  gRNA
gcguuaguucgugcgaucug

SEQ ID NO: 61310 - RNA, 20 nt, Artificial Sequence
  MKO10061310_A_Zfp870
  gRNA
cccgcauugcaaacacgcgu

SEQ ID NO: 61311 - RNA, 20 nt, Artificial Sequence
  MKO10061311_A_Zfp870
  gRNA
ugaaggcgacucugauaucu

SEQ ID NO: 61312 - RNA, 20 nt, Artificial Sequence
  MKO10061312_A_Zfp871
  gRNA
gcaugaaucgugcgaagauc

SEQ ID NO: 61313 - RNA, 20 nt, Artificial Sequence
  MKO10061313_A_Zfp871
  gRNA
ucuucgcacgauucaugcuu

SEQ ID NO: 61314 - RNA, 20 nt, Artificial Sequence
  MKO10061314_A_Zfp871
  gRNA
aaaauauauaccgaaacucc

SEQ ID NO: 61315 - RNA, 20 nt, Artificial Sequence
  MKO10061315_A_Zfp872
  gRNA
ucccgcaccgcugacacucg

SEQ ID NO: 61316 - RNA, 20 nt, Artificial Sequence
  MKO10061316_A_Zfp872
  gRNA
uccacauauaccgcauucac

SEQ ID NO: 61317 - RNA, 20 nt, Artificial Sequence
  MKO10061317_A_Zfp872
  gRNA
guugauaaccuggcuucuau

SEQ ID NO: 61318 - RNA, 20 nt, Artificial Sequence
  MKO10061318_A_Zfp873
  gRNA
uacacggcucaguaaucugc

SEQ ID NO: 61319 - RNA, 20 nt, Artificial Sequence
  MKO10061319_A_Zfp873
  gRNA
ccuuaugaauguucgaagug

SEQ ID NO: 61320 - RNA, 20 nt, Artificial Sequence
  MKO10061320_A_Zfp873
  gRNA
acaucuuaccuauagcagug

SEQ ID NO: 61321 - RNA, 20 nt, Artificial Sequence
  MKO10061321_A_Zfp874a
  gRNA
gaacauuauagaaugcauuc

SEQ ID NO: 61322 - RNA, 20 nt, Artificial Sequence
  MKO10061322_A_Zfp874a
  gRNA
ugucgccaauaaaauguccc

SEQ ID NO: 61323 - RNA, 20 nt, Artificial Sequence
  MKO10061323_A_Zfp874a
  gRNA
acaucagccaccauuccucc

SEQ ID NO: 61324 - RNA, 20 nt, Artificial Sequence
  MKO10061324_A_Zfp874b
  gRNA
ugucuccacuauaacgucuc

SEQ ID NO: 61325 - RNA, 20 nt, Artificial Sequence
  MKO10061325_A_Zfp874b
  gRNA
guacuccagagacguuauag

SEQ ID NO: 61326 - RNA, 20 nt, Artificial Sequence
  MKO10061326_A_Zfp874b
  gRNA
cccagguagucccucucuuc

SEQ ID NO: 61327 - RNA, 20 nt, Artificial Sequence
  MKO10061327_A_Zfp879
  gRNA
uuucucacgaguccgacccc

SEQ ID NO: 61328 - RNA, 20 nt, Artificial Sequence
  MKO10061328_A_Zfp879
  gRNA
gucggacucgugagaaaucc

SEQ ID NO: 61329 - RNA, 20 nt, Artificial Sequence
  MKO10061329_A_Zfp879
  gRNA
acaagcagaagacuucccga

SEQ ID NO: 61330 - RNA, 20 nt, Artificial Sequence
  MKO10061330_A_Zfp87
  gRNA
cuacucauucguaccucauu

SEQ ID NO: 61331 - RNA, 20 nt, Artificial Sequence
  MKO10061331_A_Zfp87
  gRNA
ggcccaauuugugccgaaug

SEQ ID NO: 61332 - RNA, 20 nt, Artificial Sequence
  MKO10061332_A_Zfp87
  gRNA
gcagcugccaccgugcaccc

SEQ ID NO: 61333 - RNA, 20 nt, Artificial Sequence
  MKO10061333_A_Zfp882
  gRNA
gcgcacugaaaaaacacgag

SEQ ID NO: 61334 - RNA, 20 nt, Artificial Sequence
  MKO10061334_A_Zfp882
  gRNA
cagugcgcugcucaacacaa

SEQ ID NO: 61335 - RNA, 20 nt, Artificial Sequence
  MKO10061335_A_Zfp882
  gRNA
uauggcagccaaauuccuga

SEQ ID NO: 61336 - RNA, 20 nt, Artificial Sequence
  MKO10061336_A_Zfp90
  gRNA
cgucacucacgcaacacgag

SEQ ID NO: 61337 - RNA, 20 nt, Artificial Sequence
  MKO10061337_A_Zfp90
  gRNA
cacgucccucacgcaacaug

SEQ ID NO: 61338 - RNA, 20 nt, Artificial Sequence
  MKO10061338_A_Zfp90
  gRNA
ccuccuuaccgagcgacacc

SEQ ID NO: 61339 - RNA, 20 nt, Artificial Sequence
  MKO10061339_A_Zfp91
  gRNA
gaguauucucacugucucga

SEQ ID NO: 61340 - RNA, 20 nt, Artificial Sequence
  MKO10061340_A_Zfp91
  gRNA
ugucuugcagacgaguugca

SEQ ID NO: 61341 - RNA, 20 nt, Artificial Sequence
  MKO10061341_A_Zfp91
  gRNA
aaacuuauaccuaaugccac

SEQ ID NO: 61342 - RNA, 20 nt, Artificial Sequence
  MKO10061342_A_Zfp92
  gRNA
auaucgcuuauccgcgauuc

SEQ ID NO: 61343 - RNA, 20 nt, Artificial Sequence
  MKO10061343_A_Zfp92
  gRNA
cggcuccagcaccgcacucg

SEQ ID NO: 61344 - RNA, 20 nt, Artificial Sequence
  MKO10061344_A_Zfp92
  gRNA
cauuccaucaucucuaaucc

SEQ ID NO: 61345 - RNA, 20 nt, Artificial Sequence
  MKO10061345_A_Zfp930
  gRNA
agcgguucuuugcguguaac

SEQ ID NO: 61346 - RNA, 20 nt, Artificial Sequence
  MKO10061346_A_Zfp930
  gRNA
uccaggcuccguuccgaagc

SEQ ID NO: 61347 - RNA, 20 nt, Artificial Sequence
  MKO10061347_A_Zfp930
  gRNA
aagaccaaugugacguguag

SEQ ID NO: 61348 - RNA, 20 nt, Artificial Sequence
  MKO10061348_A_Zfp931
  gRNA
uuucaaacuucuagacguca

SEQ ID NO: 61349 - RNA, 20 nt, Artificial Sequence
  MKO10061349_A_Zfp931
  gRNA
gacgucuagaaguuugaaaa

SEQ ID NO: 61350 - RNA, 20 nt, Artificial Sequence
  MKO10061350_A_Zfp931
  gRNA
cccuaugaauguaaacauug

SEQ ID NO: 61351 - RNA, 20 nt, Artificial Sequence
  MKO10061351_A_Zfp932
  gRNA
accauauugaauaccuucgu

SEQ ID NO: 61352 - RNA, 20 nt, Artificial Sequence
  MKO10061352_A_Zfp932
  gRNA
uaaauaacuuucauauacaa

SEQ ID NO: 61353 - RNA, 20 nt, Artificial Sequence
  MKO10061353_A_Zfp932
  gRNA
cagucuuaccuacagcauug

SEQ ID NO: 61354 - RNA, 20 nt, Artificial Sequence
  MKO10061354_A_Zfp933
  gRNA
cauaucaccauuauccucag

SEQ ID NO: 61355 - RNA, 20 nt, Artificial Sequence
  MKO10061355_A_Zfp933
  gRNA
aagaugauaguaacgugcaa

SEQ ID NO: 61356 - RNA, 20 nt, Artificial Sequence
  MKO10061356_A_Zfp933
  gRNA
cuuugacaauguucuucagu

SEQ ID NO: 61357 - RNA, 20 nt, Artificial Sequence
  MKO10061357_A_Zfp934
  gRNA
gucucugcaguaugugcucc

SEQ ID NO: 61358 - RNA, 20 nt, Artificial Sequence
  MKO10061358_A_Zfp934
  gRNA
ccuuauacucagaaagauuc

SEQ ID NO: 61359 - RNA, 20 nt, Artificial Sequence
  MKO10061359_A_Zfp934
  gRNA
gcucuacaaacaugucaugc

SEQ ID NO: 61360 - RNA, 20 nt, Artificial Sequence
  MKO10061360_A_Zfp935
  gRNA
gaaugccuaguugucuuaaa

SEQ ID NO: 61361 - RNA, 20 nt, Artificial Sequence
  MKO10061361_A_Zfp935
  gRNA
gacaauauucuucgauauua

SEQ ID NO: 61362 - RNA, 20 nt, Artificial Sequence
  MKO10061362_A_Zfp935
  gRNA
gaagcucuacaaagauguca

SEQ ID NO: 61363 - RNA, 20 nt, Artificial Sequence
  MKO10061363_A_Zfp936
  gRNA
uucauguacccgaagaucgc

SEQ ID NO: 61364 - RNA, 20 nt, Artificial Sequence
  MKO10061364_A_Zfp936
  gRNA
aaauacacagucacgcccaa

SEQ ID NO: 61365 - RNA, 20 nt, Artificial Sequence
  MKO10061365_A_Zfp936
  gRNA
ccagcaguagcacacagagc

SEQ ID NO: 61366 - RNA, 20 nt, Artificial Sequence
  MKO10061366_A_Zfp937
  gRNA
gcucuucucugucaucuucg

SEQ ID NO: 61367 - RNA, 20 nt, Artificial Sequence
  MKO10061367_A_Zfp937
  gRNA
aaauccuuuguaugucagag

SEQ ID NO: 61368 - RNA, 20 nt, Artificial Sequence
  MKO10061368_A_Zfp937
  gRNA
uauagcagcaagauuccugu

SEQ ID NO: 61369 - RNA, 20 nt, Artificial Sequence
  MKO10061369_A_Zfp938
  gRNA
acaguaaucaucagauaugu

SEQ ID NO: 61370 - RNA, 20 nt, Artificial Sequence
  MKO10061370_A_Zfp938
  gRNA
ugaugaauucccauugaagc

SEQ ID NO: 61371 - RNA, 20 nt, Artificial Sequence
  MKO10061371_A_Zfp938
  gRNA
uguuauuaccuauacaagua

SEQ ID NO: 61372 - RNA, 20 nt, Artificial Sequence
  MKO10061372_A_Zfp939
  gRNA
ucacauuuacaugaauucgc

SEQ ID NO: 61373 - RNA, 20 nt, Artificial Sequence
  MKO10061373_A_Zfp939
  gRNA
cccaacuuacucgacaccag

SEQ ID NO: 61374 - RNA, 20 nt, Artificial Sequence
  MKO10061374_A_Zfp939
  gRNA
uaccuccuuugacacccacc

SEQ ID NO: 61375 - RNA, 20 nt, Artificial Sequence
  MKO10061375_A_Zfp93
  gRNA
uuccugauugucacuacugc

SEQ ID NO: 61376 - RNA, 20 nt, Artificial Sequence
  MKO10061376_A_Zfp93
  gRNA
uuccagcaguagugacaauc

SEQ ID NO: 61377 - RNA, 20 nt, Artificial Sequence
  MKO10061377_A_Zfp93
  gRNA
gacaacagccacaucccuga

SEQ ID NO: 61378 - RNA, 20 nt, Artificial Sequence
  MKO10061378_A_Zfp940
  gRNA
cagugugugcgcuccgauuc

SEQ ID NO: 61379 - RNA, 20 nt, Artificial Sequence
  MKO10061379_A_Zfp940
  gRNA
gcgcacacacggauucacuc

SEQ ID NO: 61380 - RNA, 20 nt, Artificial Sequence
  MKO10061380_A_Zfp940
  gRNA
acugaugacguucagagacg

SEQ ID NO: 61381 - RNA, 20 nt, Artificial Sequence
  MKO10061381_A_Zfp941
  gRNA
ucgugaagucggcucccuuu

SEQ ID NO: 61382 - RNA, 20 nt, Artificial Sequence
  MKO10061382_A_Zfp941
  gRNA
cguugccauagcauucgucc

SEQ ID NO: 61383 - RNA, 20 nt, Artificial Sequence
  MKO10061383_A_Zfp941
  gRNA
cuuauacagggauguaaugg

SEQ ID NO: 61384 - RNA, 20 nt, Artificial Sequence
  MKO10061384_A_Zfp942
  gRNA
auuacuaagaguguguucgu

SEQ ID NO: 61385 - RNA, 20 nt, Artificial Sequence
  MKO10061385_A_Zfp942
  gRNA
guacacuuuggguguauucc

SEQ ID NO: 61386 - RNA, 20 nt, Artificial Sequence
  MKO10061386_A_Zfp942
  gRNA
ugaccuugggagcauuuacc

SEQ ID NO: 61387 - RNA, 20 nt, Artificial Sequence
  MKO10061387_A_Zfp943
  gRNA
uccuuugcguguaaagcauu

SEQ ID NO: 61388 - RNA, 20 nt, Artificial Sequence
  MKO10061388_A_Zfp943
  gRNA
accaaaugcuuuacacgcaa

SEQ ID NO: 61389 - RNA, 20 nt, Artificial Sequence
  MKO10061389_A_Zfp943
  gRNA
aauaucuugaccgugcucag

SEQ ID NO: 61390 - RNA, 20 nt, Artificial Sequence
  MKO10061390_A_Zfp944
  gRNA
ucuuguaaauguaaugaucg

SEQ ID NO: 61391 - RNA, 20 nt, Artificial Sequence
  MKO10061391_A_Zfp944
  gRNA
gacuucuaagacugcguuug

SEQ ID NO: 61392 - RNA, 20 nt, Artificial Sequence
  MKO10061392_A_Zfp944
  gRNA
ugaccuggggagcauuuacc

SEQ ID NO: 61393 - RNA, 20 nt, Artificial Sequence
  MKO10061393_A_Zfp945
  gRNA
gacauaugagcugcuaguaa

SEQ ID NO: 61394 - RNA, 20 nt, Artificial Sequence
  MKO10061394_A_Zfp945
  gRNA
acugugacaaauccuuccac

SEQ ID NO: 61395 - RNA, 20 nt, Artificial Sequence
  MKO10061395_A_Zfp945
  gRNA
uuacaacaaucuacucuuug

SEQ ID NO: 61396 - RNA, 20 nt, Artificial Sequence
  MKO10061396_A_Zfp946
  gRNA
caucagccaguucauacaag

SEQ ID NO: 61397 - RNA, 20 nt, Artificial Sequence
  MKO10061397_A_Zfp946
  gRNA
auucaacaguuguaucucug

SEQ ID NO: 61398 - RNA, 20 nt, Artificial Sequence
  MKO10061398_A_Zfp946
  gRNA
acaggaucuguuaagauuca

SEQ ID NO: 61399 - RNA, 20 nt, Artificial Sequence
  MKO10061399_A_Zfp947
  gRNA
auucaucagaugcgucauuc

SEQ ID NO: 61400 - RNA, 20 nt, Artificial Sequence
  MKO10061400_A_Zfp947
  gRNA
gcuuguggauaauaugcugu

SEQ ID NO: 61401 - RNA, 20 nt, Artificial Sequence
  MKO10061401_A_Zfp947
  gRNA
acagagucagauaacauuca

SEQ ID NO: 61402 - RNA, 20 nt, Artificial Sequence
  MKO10061402_A_Zfp948
  gRNA
ucuguuaacauuucgagaug

SEQ ID NO: 61403 - RNA, 20 nt, Artificial Sequence
  MKO10061403_A_Zfp948
  gRNA
cggagguacugaagcaucuc

SEQ ID NO: 61404 - RNA, 20 nt, Artificial Sequence
  MKO10061404_A_Zfp948
  gRNA
agcgaucacagacuccauac

SEQ ID NO: 61405 - RNA, 20 nt, Artificial Sequence
  MKO10061405_A_Zfp949
  gRNA
uauaaugacuguuguguagc

SEQ ID NO: 61406 - RNA, 20 nt, Artificial Sequence
  MKO10061406_A_Zfp949
  gRNA
ccuaucauagcuccccaugu

SEQ ID NO: 61407 - RNA, 20 nt, Artificial Sequence
  MKO10061407_A_Zfp949
  gRNA
acgucacugugaaguucacc

SEQ ID NO: 61408 - RNA, 20 nt, Artificial Sequence
  MKO10061408_A_Zfp94
  gRNA
ccgcauaugucacaucgaua

SEQ ID NO: 61409 - RNA, 20 nt, Artificial Sequence
  MKO10061409_A_Zfp94
  gRNA
ggucgcccguuagccugcag

SEQ ID NO: 61410 - RNA, 20 nt, Artificial Sequence
  MKO10061410_A_Zfp94
  gRNA
gaggacaaugaccaagguca

SEQ ID NO: 61411 - RNA, 20 nt, Artificial Sequence
  MKO10061411_A_Zfp951
  gRNA
ccacaguacuuacgugaaga

SEQ ID NO: 61412 - RNA, 20 nt, Artificial Sequence
  MKO10061412_A_Zfp951
  gRNA
ccuucuucacguaaguacug

SEQ ID NO: 61413 - RNA, 20 nt, Artificial Sequence
  MKO10061413_A_Zfp951
  gRNA
aaaugcaugccccauucaaa

SEQ ID NO: 61414 - RNA, 20 nt, Artificial Sequence
  MKO10061414_A_Zfp952
  gRNA
gauuauaacaagcaucgcgc

SEQ ID NO: 61415 - RNA, 20 nt, Artificial Sequence
  MKO10061415_A_Zfp952
  gRNA
gacuguaccagccgcuauaa

SEQ ID NO: 61416 - RNA, 20 nt, Artificial Sequence
  MKO10061416_A_Zfp952
  gRNA
uauggagaucagauucauaa

SEQ ID NO: 61417 - RNA, 20 nt, Artificial Sequence
  MKO10061417_A_Zfp953
  gRNA
accaucacuuuaucaacaca

SEQ ID NO: 61418 - RNA, 20 nt, Artificial Sequence
  MKO10061418_A_Zfp953
  gRNA
gaacacaaguuaaugcauaa

SEQ ID NO: 61419 - RNA, 20 nt, Artificial Sequence
  MKO10061419_A_Zfp953
  gRNA
auuauacagggaugugacau

SEQ ID NO: 61420 - RNA, 20 nt, Artificial Sequence
  MKO10061420_A_Zfp954
  gRNA
caccaguaugaaaucgauaa

SEQ ID NO: 61421 - RNA, 20 nt, Artificial Sequence
  MKO10061421_A_Zfp954
  gRNA
uuuaucgagcgugaaucuuc

SEQ ID NO: 61422 - RNA, 20 nt, Artificial Sequence
  MKO10061422_A_Zfp954
  gRNA
gauuccugacuccguguuua

SEQ ID NO: 61423 - RNA, 20 nt, Artificial Sequence
  MKO10061423_A_Zfp955a
  gRNA
gauucuaagagagcccacgc

SEQ ID NO: 61424 - RNA, 20 nt, Artificial Sequence
  MKO10061424_A_Zfp955a
  gRNA
aaaauuaccucgaguuucuc

SEQ ID NO: 61425 - RNA, 20 nt, Artificial Sequence
  MKO10061425_A_Zfp955a
  gRNA
acaguagcuagcaauguuaa

SEQ ID NO: 61426 - RNA, 20 nt, Artificial Sequence
  MKO10061426_A_Zfp955b
  gRNA
acgguugcccgcacugcuaa

SEQ ID NO: 61427 - RNA, 20 nt, Artificial Sequence
  MKO10061427_A_Zfp955b
  gRNA
gcuugugaugagcacccgaa

SEQ ID NO: 61428 - RNA, 20 nt, Artificial Sequence
  MKO10061428_A_Zfp955b
  gRNA
gccacguccucaaaagucac

SEQ ID NO: 61429 - RNA, 20 nt, Artificial Sequence
  MKO10061429_A_Zfp956
  gRNA
acucugcaagcgcguagcaa

SEQ ID NO: 61430 - RNA, 20 nt, Artificial Sequence
  MKO10061430_A_Zfp956
  gRNA
ugacaaacguuucacacgcc

SEQ ID NO: 61431 - RNA, 20 nt, Artificial Sequence
  MKO10061431_A_Zfp956
  gRNA
uggccgucuguccacguugc

SEQ ID NO: 61432 - RNA, 20 nt, Artificial Sequence
  MKO10061432_A_Zfp957
  gRNA
gggggccgguuacgguaaca

SEQ ID NO: 61433 - RNA, 20 nt, Artificial Sequence
  MKO10061433_A_Zfp957
  gRNA
ucguaaaaacgcagccgcua

SEQ ID NO: 61434 - RNA, 20 nt, Artificial Sequence
  MKO10061434_A_Zfp957
  gRNA
aaguacgcuacccagccacu

SEQ ID NO: 61435 - RNA, 20 nt, Artificial Sequence
  MKO10061435_A_Zfp958
  gRNA
ccguucgagcuucucagcgg

SEQ ID NO: 61436 - RNA, 20 nt, Artificial Sequence
  MKO10061436_A_Zfp958
  gRNA
ccgccgcugagaagcucgaa

SEQ ID NO: 61437 - RNA, 20 nt, Artificial Sequence
  MKO10061437_A_Zfp958
  gRNA
cucagcuaucuucgagugca

SEQ ID NO: 61438 - RNA, 20 nt, Artificial Sequence
  MKO10061438_A_Zfp959
  gRNA
cacacuuaccuauacaaguc

SEQ ID NO: 61439 - RNA, 20 nt, Artificial Sequence
  MKO10061439_A_Zfp959
  gRNA
auacaucaaaauacugaccg

SEQ ID NO: 61440 - RNA, 20 nt, Artificial Sequence
  MKO10061440_A_Zfp959
  gRNA
cgguauaaguguaagcaaug

SEQ ID NO: 61441 - RNA, 20 nt, Artificial Sequence
  MKO10061441_A_Zfp960
  gRNA
aagauugcuguggcgugcaa

SEQ ID NO: 61442 - RNA, 20 nt, Artificial Sequence
  MKO10061442_A_Zfp960
  gRNA
aagagugcugugacgugcaa

SEQ ID NO: 61443 - RNA, 20 nt, Artificial Sequence
  MKO10061443_A_Zfp960
  gRNA
gauauugucacuucccacag

SEQ ID NO: 61444 - RNA, 20 nt, Artificial Sequence
  MKO10061444_A_Zfp961
  gRNA
uuagcaaugcgcaagguacg

SEQ ID NO: 61445 - RNA, 20 nt, Artificial Sequence
  MKO10061445_A_Zfp961
  gRNA
uuucgaagggaauagacgua

SEQ ID NO: 61446 - RNA, 20 nt, Artificial Sequence
  MKO10061446_A_Zfp961
  gRNA
cacccgccacagcgcagcuc

SEQ ID NO: 61447 - RNA, 20 nt, Artificial Sequence
  MKO10061447_A_Zfp963
  gRNA
uuauaaaccacgugagcgug

SEQ ID NO: 61448 - RNA, 20 nt, Artificial Sequence
  MKO10061448_A_Zfp963
  gRNA
cgugcauucguagaaucuuu

SEQ ID NO: 61449 - RNA, 20 nt, Artificial Sequence
  MKO10061449_A_Zfp963
  gRNA
aaauuaccucauauuucucc

SEQ ID NO: 61450 - RNA, 20 nt, Artificial Sequence
  MKO10061450_A_Zfp964
  gRNA
ccauggcgcggcuucgagcu

SEQ ID NO: 61451 - RNA, 20 nt, Artificial Sequence
  MKO10061451_A_Zfp964
  gRNA
ccgagcucgaagccgcgcca

SEQ ID NO: 61452 - RNA, 20 nt, Artificial Sequence
  MKO10061452_A_Zfp964
  gRNA
ucaguguaccgcacacgagc

SEQ ID NO: 61453 - RNA, 20 nt, Artificial Sequence
  MKO10061453_A_Zfp97
  gRNA
ucugugaauauaaccaaugu

SEQ ID NO: 61454 - RNA, 20 nt, Artificial Sequence
  MKO10061454_A_Zfp97
  gRNA
aaaagauugguaacaagcaa

SEQ ID NO: 61455 - RNA, 20 nt, Artificial Sequence
  MKO10061455_A_Zfp97
  gRNA
gauauugucacuucccacag

SEQ ID NO: 61456 - RNA, 20 nt, Artificial Sequence
  MKO10061456_A_Zfp9
  gRNA
agcuacgacuguagcgaaug

SEQ ID NO: 61457 - RNA, 20 nt, Artificial Sequence
  MKO10061457_A_Zfp9
  gRNA
gaguccuuucguguaaucua

SEQ ID NO: 61458 - RNA, 20 nt, Artificial Sequence
  MKO10061458_A_Zfp9
  gRNA
acucaccaccacggcucuua

SEQ ID NO: 61459 - RNA, 20 nt, Artificial Sequence
  MKO10061459_A_Zfpl1
  gRNA
accacccgucuuguuugcua

SEQ ID NO: 61460 - RNA, 20 nt, Artificial Sequence
  MKO10061460_A_Zfpl1
  gRNA
uguguugcacaggcggcaau

SEQ ID NO: 61461 - RNA, 20 nt, Artificial Sequence
  MKO10061461_A_Zfpl1
  gRNA
gcccagcucaccgugugcca

SEQ ID NO: 61462 - RNA, 20 nt, Artificial Sequence
  MKO10061462_A_Zfpm1
  gRNA
gucuggaugcucccguagaa

SEQ ID NO: 61463 - RNA, 20 nt, Artificial Sequence
  MKO10061463_A_Zfpm1
  gRNA
gccucacugagggccuaucc

SEQ ID NO: 61464 - RNA, 20 nt, Artificial Sequence
  MKO10061464_A_Zfpm1
  gRNA
cugguuaccuggcccacucc

SEQ ID NO: 61465 - RNA, 20 nt, Artificial Sequence
  MKO10061465_A_Zfpm2
  gRNA
ggaagaugccaucgacgacg

SEQ ID NO: 61466 - RNA, 20 nt, Artificial Sequence
  MKO10061466_A_Zfpm2
  gRNA
gaagccgaagucaucucgaa

SEQ ID NO: 61467 - RNA, 20 nt, Artificial Sequence
  MKO10061467_A_Zfpm2
  gRNA
ucagagucggcagcaacuuc

SEQ ID NO: 61468 - RNA, 20 nt, Artificial Sequence
  MKO10061468_A_Zfr2
  gRNA
gaccucgcaauagugcauag

SEQ ID NO: 61469 - RNA, 20 nt, Artificial Sequence
  MKO10061469_A_Zfr2
  gRNA
accccacggguccgagccca

SEQ ID NO: 61470 - RNA, 20 nt, Artificial Sequence
  MKO10061470_A_Zfr2
  gRNA
acgccuaugcugcgcacaug

SEQ ID NO: 61471 - RNA, 20 nt, Artificial Sequence
  MKO10061471_A_Zfr
  gRNA
guaguugccggucgccauuu

SEQ ID NO: 61472 - RNA, 20 nt, Artificial Sequence
  MKO10061472_A_Zfr
  gRNA
gaauaggcuacacccgaagc

SEQ ID NO: 61473 - RNA, 20 nt, Artificial Sequence
  MKO10061473_A_Zfr
  gRNA
gaguauacuguguugcaccu

SEQ ID NO: 61474 - RNA, 20 nt, Artificial Sequence
  MKO10061474_A_Zfx
  gRNA
auaguuauguacgguuaugu

SEQ ID NO: 61475 - RNA, 20 nt, Artificial Sequence
  MKO10061475_A_Zfx
  gRNA
caucaucccugaacaagugc

SEQ ID NO: 61476 - RNA, 20 nt, Artificial Sequence
  MKO10061476_A_Zfx
  gRNA
auagaacaugaugguucauc

SEQ ID NO: 61477 - RNA, 20 nt, Artificial Sequence
  MKO10061477_A_Zfy1
  gRNA
cuuguacuuccacaacaauc

SEQ ID NO: 61478 - RNA, 20 nt, Artificial Sequence
  MKO10061478_A_Zfy1
  gRNA
ccuucaagaucugcuuugcu

SEQ ID NO: 61479 - RNA, 20 nt, Artificial Sequence
  MKO10061479_A_Zfy1
  gRNA
agcugacacuucagauauac

SEQ ID NO: 61480 - RNA, 20 nt, Artificial Sequence
  MKO10061480_A_Zfy2
  gRNA
guagagagugagaccgacaa

SEQ ID NO: 61481 - RNA, 20 nt, Artificial Sequence
  MKO10061481_A_Zfy2
  gRNA
caaugagguugauguaauac

SEQ ID NO: 61482 - RNA, 20 nt, Artificial Sequence
  MKO10061482_A_Zfy2
  gRNA
agccgacauuucagauauac

SEQ ID NO: 61483 - RNA, 20 nt, Artificial Sequence
  MKO10061483_A_Zfyve16
  gRNA
cuuacuacaccgucucauac

SEQ ID NO: 61484 - RNA, 20 nt, Artificial Sequence
  MKO10061484_A_Zfyve16
  gRNA
ggcaauucaucccuuauguc

SEQ ID NO: 61485 - RNA, 20 nt, Artificial Sequence
  MKO10061485_A_Zfyve16
  gRNA
gcagauggcauacugccgaa

SEQ ID NO: 61486 - RNA, 20 nt, Artificial Sequence
  MKO10061486_A_Zfyve19
  gRNA
uuuccugacgaagccgugcu

SEQ ID NO: 61487 - RNA, 20 nt, Artificial Sequence
  MKO10061487_A_Zfyve19
  gRNA
ccaucgcugagcgccuagca

SEQ ID NO: 61488 - RNA, 20 nt, Artificial Sequence
  MKO10061488_A_Zfyve19
  gRNA
gcuaagacagccguuacaga

SEQ ID NO: 61489 - RNA, 20 nt, Artificial Sequence
  MKO10061489_A_Zfyve1
  gRNA
ucuaucgaacucaugcagac

SEQ ID NO: 61490 - RNA, 20 nt, Artificial Sequence
  MKO10061490_A_Zfyve1
  gRNA
caaccgcgucuauaccugca

SEQ ID NO: 61491 - RNA, 20 nt, Artificial Sequence
  MKO10061491_A_Zfyve1
  gRNA
gagcuucucgggcgccucgg

SEQ ID NO: 61492 - RNA, 20 nt, Artificial Sequence
  MKO10061492_A_Zfyve20
  gRNA
aacaaguuguugaaacgaga

SEQ ID NO: 61493 - RNA, 20 nt, Artificial Sequence
  MKO10061493_A_Zfyve20
  gRNA
ggcaguggugacggcgguuc

SEQ ID NO: 61494 - RNA, 20 nt, Artificial Sequence
  MKO10061494_A_Zfyve20
  gRNA
aucaccuacgugcuaagggc

SEQ ID NO: 61495 - RNA, 20 nt, Artificial Sequence
  MKO10061495_A_Zfyve21
  gRNA
acuucggcgcaugugcuucg

SEQ ID NO: 61496 - RNA, 20 nt, Artificial Sequence
  MKO10061496_A_Zfyve21
  gRNA
gucgucuuuccaacaaccag

SEQ ID NO: 61497 - RNA, 20 nt, Artificial Sequence
  MKO10061497_A_Zfyve21
  gRNA
ugucauaaaacuccgccucu

SEQ ID NO: 61498 - RNA, 20 nt, Artificial Sequence
  MKO10061498_A_Zfyve26
  gRNA
cugucagguauacugcccgc

SEQ ID NO: 61499 - RNA, 20 nt, Artificial Sequence
  MKO10061499_A_Zfyve26
  gRNA
cgggcaguauaccugacaga

SEQ ID NO: 61500 - RNA, 20 nt, Artificial Sequence
  MKO10061500_A_Zfyve26
  gRNA
cagaucauccugaucccgag

SEQ ID NO: 61501 - RNA, 20 nt, Artificial Sequence
  MKO10061501_A_Zfyve27
  gRNA
cagccuaccguguacuucac

SEQ ID NO: 61502 - RNA, 20 nt, Artificial Sequence
  MKO10061502_A_Zfyve27
  gRNA
agugcaccuuucccgcccug

SEQ ID NO: 61503 - RNA, 20 nt, Artificial Sequence
  MKO10061503_A_Zfyve27
  gRNA
cuuaggugcgugguacucca

SEQ ID NO: 61504 - RNA, 20 nt, Artificial Sequence
  MKO10061504_A_Zfyve28
  gRNA
auccggcaugacaacuuggc

SEQ ID NO: 61505 - RNA, 20 nt, Artificial Sequence
  MKO10061505_A_Zfyve28
  gRNA
gcggggcacucuccgugacc

SEQ ID NO: 61506 - RNA, 20 nt, Artificial Sequence
  MKO10061506_A_Zfyve28
  gRNA
gagcauggccaugcggccac

SEQ ID NO: 61507 - RNA, 20 nt, Artificial Sequence
  MKO10061507_A_Zfyve9
  gRNA
gcugaugggaucuuaccuaa

SEQ ID NO: 61508 - RNA, 20 nt, Artificial Sequence
  MKO10061508_A_Zfyve9
  gRNA
agguucauugcacuuccaac

SEQ ID NO: 61509 - RNA, 20 nt, Artificial Sequence
  MKO10061509_A_Zfyve9
  gRNA
gcaucagcaacuucuccauu

SEQ ID NO: 61510 - RNA, 20 nt, Artificial Sequence
  MKO10061510_A_Zg16
  gRNA
ccaucaccgccuuccguauc

SEQ ID NO: 61511 - RNA, 20 nt, Artificial Sequence
  MKO10061511_A_Zg16
  gRNA
acacugugccauagcgcacc

SEQ ID NO: 61512 - RNA, 20 nt, Artificial Sequence
  MKO10061512_A_Zg16
  gRNA
cggugauggggccguccagc

SEQ ID NO: 61513 - RNA, 20 nt, Artificial Sequence
  MKO10061513_A_Zglp1
  gRNA
acugccggguuccccuucgc

SEQ ID NO: 61514 - RNA, 20 nt, Artificial Sequence
  MKO10061514_A_Zglp1
  gRNA
aagcagcuaaacccgcgaau

SEQ ID NO: 61515 - RNA, 20 nt, Artificial Sequence
  MKO10061515_A_Zglp1
  gRNA
ucuacaagaagcacaccgcc

SEQ ID NO: 61516 - RNA, 20 nt, Artificial Sequence
  MKO10061516_A_Zgpau
  gRNA
gucugcaguaagcuuaaguc

SEQ ID NO: 61517 - RNA, 20 nt, Artificial Sequence
  MKO10061517_A_Zgpau
  gRNA
gucucaccagugauccgugc

SEQ ID NO: 61518 - RNA, 20 nt, Artificial Sequence
  MKO10061518_A_Zgpau
  gRNA
ugccauaccucuggcauagc

SEQ ID NO: 61519 - RNA, 20 nt, Artificial Sequence
  MKO10061519_A_Zhx1
  gRNA
agcuuccgcuucacaugucg

SEQ ID NO: 61520 - RNA, 20 nt, Artificial Sequence
  MKO10061520_A_Zhx1
  gRNA
ugguaacccguuacucccug

SEQ ID NO: 61521 - RNA, 20 nt, Artificial Sequence
  MKO10061521_A_Zhx1
  gRNA
uccgauaucagcucaagauc

SEQ ID NO: 61522 - RNA, 20 nt, Artificial Sequence
  MKO10061522_A_Zhx2
  gRNA
auguguggacgcuucggcuc

SEQ ID NO: 61523 - RNA, 20 nt, Artificial Sequence
  MKO10061523_A_Zhx2
  gRNA
accaccgcuaccggugucag

SEQ ID NO: 61524 - RNA, 20 nt, Artificial Sequence
  MKO10061524_A_Zhx2
  gRNA
uaccggcucauugaggugac

SEQ ID NO: 61525 - RNA, 20 nt, Artificial Sequence
  MKO10061525_A_Zhx3
  gRNA
gucuuaacggggaucaugca

SEQ ID NO: 61526 - RNA, 20 nt, Artificial Sequence
  MKO10061526_A_Zhx3
  gRNA
gagaacgcuccuaaucagcc

SEQ ID NO: 61527 - RNA, 20 nt, Artificial Sequence
  MKO10061527_A_Zhx3
  gRNA
caugauccccguuaagaccg

SEQ ID NO: 61528 - RNA, 20 nt, Artificial Sequence
  MKO10061528_A_Zic1
  gRNA
uggccacgcuucgcccaacg

SEQ ID NO: 61529 - RNA, 20 nt, Artificial Sequence
  MKO10061529_A_Zic1
  gRNA
caaccccaguucgcacgaac

SEQ ID NO: 61530 - RNA, 20 nt, Artificial Sequence
  MKO10061530_A_Zic1
  gRNA
gcccuucaagugcgaguucg

SEQ ID NO: 61531 - RNA, 20 nt, Artificial Sequence
  MKO10061531_A_Zic2
  gRNA
cgcgaagcugcccaccccga

SEQ ID NO: 61532 - RNA, 20 nt, Artificial Sequence
  MKO10061532_A_Zic2
  gRNA
cuacgagucguccacacccc

SEQ ID NO: 61533 - RNA, 20 nt, Artificial Sequence
  MKO10061533_A_Zic2
  gRNA
cucggagcaauaccgccaag

SEQ ID NO: 61534 - RNA, 20 nt, Artificial Sequence
  MKO10061534_A_Zic3
  gRNA
gucgcgcguggaguugaaag

SEQ ID NO: 61535 - RNA, 20 nt, Artificial Sequence
  MKO10061535_A_Zic3
  gRNA
gcugggcacccgucgcccac

SEQ ID NO: 61536 - RNA, 20 nt, Artificial Sequence
  MKO10061536_A_Zic3
  gRNA
gucgcacacuuuacagauau

SEQ ID NO: 61537 - RNA, 20 nt, Artificial Sequence
  MKO10061537_A_Zic4
  gRNA
gguucgaagaagcggcgagc

SEQ ID NO: 61538 - RNA, 20 nt, Artificial Sequence
  MKO10061538_A_Zic4
  gRNA
guaaccgcuuccucaucacc

SEQ ID NO: 61539 - RNA, 20 nt, Artificial Sequence
  MKO10061539_A_Zic4
  gRNA
agacgcaggaguccguucaa

SEQ ID NO: 61540 - RNA, 20 nt, Artificial Sequence
  MKO10061540_A_Zic5
  gRNA
gcggcugcggccgagcuuua

SEQ ID NO: 61541 - RNA, 20 nt, Artificial Sequence
  MKO10061541_A_Zic5
  gRNA
gcaucuggccguuuagcggg

SEQ ID NO: 61542 - RNA, 20 nt, Artificial Sequence
  MKO10061542_A_Zic5
  gRNA
ggcugggggccccacuggcc

SEQ ID NO: 61543 - RNA, 20 nt, Artificial Sequence
  MKO10061543_A_Zik1
  gRNA
guuucuacacgagcgucaaa

SEQ ID NO: 61544 - RNA, 20 nt, Artificial Sequence
  MKO10061544_A_Zik1
  gRNA
gugccauucuuaaccaacac

SEQ ID NO: 61545 - RNA, 20 nt, Artificial Sequence
  MKO10061545_A_Zik1
  gRNA
cuuugcacucauaaacuccc

SEQ ID NO: 61546 - RNA, 20 nt, Artificial Sequence
  MKO10061546_A_Zim1
  gRNA
cgaucacgucguugccaacc

SEQ ID NO: 61547 - RNA, 20 nt, Artificial Sequence
  MKO10061547_A_Zim1
  gRNA
gaauucgcucauguuccacg

SEQ ID NO: 61548 - RNA, 20 nt, Artificial Sequence
  MKO10061548_A_Zim1
  gRNA
guuugacccgaagaugugcc

SEQ ID NO: 61549 - RNA, 20 nt, Artificial Sequence
  MKO10061549_A_Zkscan14
  gRNA
uguggucccgcacguaggcc

SEQ ID NO: 61550 - RNA, 20 nt, Artificial Sequence
  MKO10061550_A_Zkscan14
  gRNA
gucccgccaccucucggugc

SEQ ID NO: 61551 - RNA, 20 nt, Artificial Sequence
  MKO10061551_A_Zkscan14
  gRNA
cccgcagacgacacacgcau

SEQ ID NO: 61552 - RNA, 20 nt, Artificial Sequence
  MKO10061552_A_Zkscan16
  gRNA
aaugacgaguagucgcugaa

SEQ ID NO: 61553 - RNA, 20 nt, Artificial Sequence
  MKO10061553_A_Zkscan16
  gRNA
gcgcuucguaccaggcucaa

SEQ ID NO: 61554 - RNA, 20 nt, Artificial Sequence
  MKO10061554_A_Zkscan16
  gRNA
caauuuaacccacuucagau

SEQ ID NO: 61555 - RNA, 20 nt, Artificial Sequence
  MKO10061555_A_Zkscan17
  gRNA
gcaagaugcguucguugugc

SEQ ID NO: 61556 - RNA, 20 nt, Artificial Sequence
  MKO10061556_A_Zkscan17
  gRNA
uggugauugacgauggcgac

SEQ ID NO: 61557 - RNA, 20 nt, Artificial Sequence
  MKO10061557_A_Zkscan17
  gRNA
uucuauggcgaauucaucau

SEQ ID NO: 61558 - RNA, 20 nt, Artificial Sequence
  MKO10061558_A_Zkscan1
  gRNA
aagccucgucucuuaucccg

SEQ ID NO: 61559 - RNA, 20 nt, Artificial Sequence
  MKO10061559_A_Zkscan1
  gRNA
cggaauaccucugggucggg

SEQ ID NO: 61560 - RNA, 20 nt, Artificial Sequence
  MKO10061560_A_Zkscan1
  gRNA
agucgauucaaagcuucucg

SEQ ID NO: 61561 - RNA, 20 nt, Artificial Sequence
  MKO10061561_A_Zkscan2
  gRNA
gaggucucuaccacgaaauc

SEQ ID NO: 61562 - RNA, 20 nt, Artificial Sequence
  MKO10061562_A_Zkscan2
  gRNA
gaaugaagaccuacgcucca

SEQ ID NO: 61563 - RNA, 20 nt, Artificial Sequence
  MKO10061563_A_Zkscan2
  gRNA
gcugaaugguugcgagaaug

SEQ ID NO: 61564 - RNA, 20 nt, Artificial Sequence
  MKO10061564_A_Zkscan3
  gRNA
cgguucuauugccgugaaug

SEQ ID NO: 61565 - RNA, 20 nt, Artificial Sequence
  MKO10061565_A_Zkscan3
  gRNA
ccugcuguacauuccgaagu

SEQ ID NO: 61566 - RNA, 20 nt, Artificial Sequence
  MKO10061566_A_Zkscan3
  gRNA
aaguagccagauggagcccg

SEQ ID NO: 61567 - RNA, 20 nt, Artificial Sequence
  MKO10061567_A_Zkscan4
  gRNA
ucgcgaacuucucugcugca

SEQ ID NO: 61568 - RNA, 20 nt, Artificial Sequence
  MKO10061568_A_Zkscan4
  gRNA
cguccgcagcccuaaacgcu

SEQ ID NO: 61569 - RNA, 20 nt, Artificial Sequence
  MKO10061569_A_Zkscan4
  gRNA
acucuucaagcacgaaucuc

SEQ ID NO: 61570 - RNA, 20 nt, Artificial Sequence
  MKO10061570_A_Zkscan5
  gRNA
aacaucugcguagccacgag

SEQ ID NO: 61571 - RNA, 20 nt, Artificial Sequence
  MKO10061571_A_Zkscan5
  gRNA
ucgcugacuucgccggacuc

SEQ ID NO: 61572 - RNA, 20 nt, Artificial Sequence
  MKO10061572_A_Zkscan5
  gRNA
cccagaaaugcgacgcaugc

SEQ ID NO: 61573 - RNA, 20 nt, Artificial Sequence
  MKO10061573_A_Zkscan6
  gRNA
ccaucuucucagcgccguga

SEQ ID NO: 61574 - RNA, 20 nt, Artificial Sequence
  MKO10061574_A_Zkscan6
  gRNA
gccuguuagagaccaagagu

SEQ ID NO: 61575 - RNA, 20 nt, Artificial Sequence
  MKO10061575_A_Zkscan6
  gRNA
auggcaagacuccccugcaa

SEQ ID NO: 61576 - RNA, 20 nt, Artificial Sequence
  MKO10061576_A_Zkscan7
  gRNA
aaugccucgccagauucauc

SEQ ID NO: 61577 - RNA, 20 nt, Artificial Sequence
  MKO10061577_A_Zkscan7
  gRNA
ucgcgacauugugaauucgc

SEQ ID NO: 61578 - RNA, 20 nt, Artificial Sequence
  MKO10061578_A_Zkscan7
  gRNA
uuaccaccuccgucucacac

SEQ ID NO: 61579 - RNA, 20 nt, Artificial Sequence
  MKO10061579_A_Zkscan8
  gRNA
agcguagacgaaacaguucu

SEQ ID NO: 61580 - RNA, 20 nt, Artificial Sequence
  MKO10061580_A_Zkscan8
  gRNA
ggcugugucucuuauucgag

SEQ ID NO: 61581 - RNA, 20 nt, Artificial Sequence
  MKO10061581_A_Zkscan8
  gRNA
aaguauucacguacaauccu

SEQ ID NO: 61582 - RNA, 20 nt, Artificial Sequence
  MKO10061582_A_Zmau1
  gRNA
acccaucuuuggugagcaug

SEQ ID NO: 61583 - RNA, 20 nt, Artificial Sequence
  MKO10061583_A_Zmau1
  gRNA
uugauagaucccacguguga

SEQ ID NO: 61584 - RNA, 20 nt, Artificial Sequence
  MKO10061584_A_Zmau1
  gRNA
ugcuguagaaccacuccaca

SEQ ID NO: 61585 - RNA, 20 nt, Artificial Sequence
  MKO10061585_A_Zmau2
  gRNA
gcgcguggaacgcuccacuc

SEQ ID NO: 61586 - RNA, 20 nt, Artificial Sequence
  MKO10061586_A_Zmau2
  gRNA
cgcagaagcucccgcuugac

SEQ ID NO: 61587 - RNA, 20 nt, Artificial Sequence
  MKO10061587_A_Zmau2
  gRNA
ucacccagaucagcgaaacc

SEQ ID NO: 61588 - RNA, 20 nt, Artificial Sequence
  MKO10061588_A_Zmau3
  gRNA
cucgcuccuguaccgcugcu

SEQ ID NO: 61589 - RNA, 20 nt, Artificial Sequence
  MKO10061589_A_Zmau3
  gRNA
gccagccccaacguuacaca

SEQ ID NO: 61590 - RNA, 20 nt, Artificial Sequence
  MKO10061590_A_Zmau3
  gRNA
caacggcggacucggaaaga

SEQ ID NO: 61591 - RNA, 20 nt, Artificial Sequence
  MKO10061591_A_Zmau4
  gRNA
guugagcgacacacugcacg

SEQ ID NO: 61592 - RNA, 20 nt, Artificial Sequence
  MKO10061592_A_Zmau4
  gRNA
acgggggccguauccacucg

SEQ ID NO: 61593 - RNA, 20 nt, Artificial Sequence
  MKO10061593_A_Zmau4
  gRNA
ucgaguggauacggcccccg

SEQ ID NO: 61594 - RNA, 20 nt, Artificial Sequence
  MKO10061594_A_Zmau5
  gRNA
auugcaggccagugcgacuu

SEQ ID NO: 61595 - RNA, 20 nt, Artificial Sequence
  MKO10061595_A_Zmau5
  gRNA
ugggcccauaccugcuacuu

SEQ ID NO: 61596 - RNA, 20 nt, Artificial Sequence
  MKO10061596_A_Zmau5
  gRNA
agagaccgccgagcuuccug

SEQ ID NO: 61597 - RNA, 20 nt, Artificial Sequence
  MKO10061597_A_Zmiz1
  gRNA
agccgccagaacgacccccc

SEQ ID NO: 61598 - RNA, 20 nt, Artificial Sequence
  MKO10061598_A_Zmiz1
  gRNA
ggugaacuugucucgauuug

SEQ ID NO: 61599 - RNA, 20 nt, Artificial Sequence
  MKO10061599_A_Zmiz1
  gRNA
aaguucacccccaagucugc

SEQ ID NO: 61600 - RNA, 20 nt, Artificial Sequence
  MKO10061600_A_Zmiz2
  gRNA
ggcggguuucaugggguuca

SEQ ID NO: 61601 - RNA, 20 nt, Artificial Sequence
  MKO10061601_A_Zmiz2
  gRNA
uauggccgagggagcuaccc

SEQ ID NO: 61602 - RNA, 20 nt, Artificial Sequence
  MKO10061602_A_Zmiz2
  gRNA
cacacucacccguguggugc

SEQ ID NO: 61603 - RNA, 20 nt, Artificial Sequence
  MKO10061603_A_Zmpste24
  gRNA
gaaucacauaccucguauuc

SEQ ID NO: 61604 - RNA, 20 nt, Artificial Sequence
  MKO10061604_A_Zmpste24
  gRNA
gaaaucucgauuguaucaac

SEQ ID NO: 61605 - RNA, 20 nt, Artificial Sequence
  MKO10061605_A_Zmpste24
  gRNA
acacucuucagugcacugac

SEQ ID NO: 61606 - RNA, 20 nt, Artificial Sequence
  MKO10061606_A_Zmym1
  gRNA
gauugcgauuacuaacgacu

SEQ ID NO: 61607 - RNA, 20 nt, Artificial Sequence
  MKO10061607_A_Zmym1
  gRNA
agagaucaguguucacgacc

SEQ ID NO: 61608 - RNA, 20 nt, Artificial Sequence
  MKO10061608_A_Zmym1
  gRNA
cacaacuacuauccuccaac

SEQ ID NO: 61609 - RNA, 20 nt, Artificial Sequence
  MKO10061609_A_Zmym2
  gRNA
ggugagcugauccuuugcgu

SEQ ID NO: 61610 - RNA, 20 nt, Artificial Sequence
  MKO10061610_A_Zmym2
  gRNA
cagacagcuuaccaacgcaa

SEQ ID NO: 61611 - RNA, 20 nt, Artificial Sequence
  MKO10061611_A_Zmym2
  gRNA
ugaguccacuugagcaacaa

SEQ ID NO: 61612 - RNA, 20 nt, Artificial Sequence
  MKO10061612_A_Zmym3
  gRNA
ggugaccuaccuggcaacga

SEQ ID NO: 61613 - RNA, 20 nt, Artificial Sequence
  MKO10061613_A_Zmym3
  gRNA
ucucagacugccccaagucg

SEQ ID NO: 61614 - RNA, 20 nt, Artificial Sequence
  MKO10061614_A_Zmym3
  gRNA
cagcguccaaucccccaguc

SEQ ID NO: 61615 - RNA, 20 nt, Artificial Sequence
  MKO10061615_A_Zmym4
  gRNA
ucauugucacuacuaacgac

SEQ ID NO: 61616 - RNA, 20 nt, Artificial Sequence
  MKO10061616_A_Zmym4
  gRNA
uuuacuggcaaauggguagc

SEQ ID NO: 61617 - RNA, 20 nt, Artificial Sequence
  MKO10061617_A_Zmym4
  gRNA
auuccccaguuccgaaccaa

SEQ ID NO: 61618 - RNA, 20 nt, Artificial Sequence
  MKO10061618_A_Zmym5
  gRNA
gugucuuucgaguacgcuua

SEQ ID NO: 61619 - RNA, 20 nt, Artificial Sequence
  MKO10061619_A_Zmym5
  gRNA
auaagcguacucgaaagaca

SEQ ID NO: 61620 - RNA, 20 nt, Artificial Sequence
  MKO10061620_A_Zmym5
  gRNA
uugugcugacgaauauaaag

SEQ ID NO: 61621 - RNA, 20 nt, Artificial Sequence
  MKO10061621_A_Zmym6
  gRNA
caaccuaccuaccggaaggc

SEQ ID NO: 61622 - RNA, 20 nt, Artificial Sequence
  MKO10061622_A_Zmym6
  gRNA
cagccucgaugaauucccca

SEQ ID NO: 61623 - RNA, 20 nt, Artificial Sequence
  MKO10061623_A_Zmym6
  gRNA
gcaguaaagcugggcaaauc

SEQ ID NO: 61624 - RNA, 20 nt, Artificial Sequence
  MKO10061624_A_Zmynd10
  gRNA
uccuccgcagaucccaacgc

SEQ ID NO: 61625 - RNA, 20 nt, Artificial Sequence
  MKO10061625_A_Zmynd10
  gRNA
ccuugaugcaacuaucagcc

SEQ ID NO: 61626 - RNA, 20 nt, Artificial Sequence
  MKO10061626_A_Zmynd10
  gRNA
ccgcaagcugauacugcuag

SEQ ID NO: 61627 - RNA, 20 nt, Artificial Sequence
  MKO10061627_A_Zmynd11
  gRNA
guucaucgucucccgaauga

SEQ ID NO: 61628 - RNA, 20 nt, Artificial Sequence
  MKO10061628_A_Zmynd11
  gRNA
acguuuaacaaaaagacgac

SEQ ID NO: 61629 - RNA, 20 nt, Artificial Sequence
  MKO10061629_A_Zmynd11
  gRNA
ucucuuugggaugcauaccg

SEQ ID NO: 61630 - RNA, 20 nt, Artificial Sequence
  MKO10061630_A_Zmynd12
  gRNA
gcacguucaugcggaagcga

SEQ ID NO: 61631 - RNA, 20 nt, Artificial Sequence
  MKO10061631_A_Zmynd12
  gRNA
aggucugggccggauagugc

SEQ ID NO: 61632 - RNA, 20 nt, Artificial Sequence
  MKO10061632_A_Zmynd12
  gRNA
auucuucagccugcacuauc

SEQ ID NO: 61633 - RNA, 20 nt, Artificial Sequence
  MKO10061633_A_Zmynd15
  gRNA
aaucgguggcucacgucauc

SEQ ID NO: 61634 - RNA, 20 nt, Artificial Sequence
  MKO10061634_A_Zmynd15
  gRNA
cgaggaccccacgugcgcau

SEQ ID NO: 61635 - RNA, 20 nt, Artificial Sequence
  MKO10061635_A_Zmynd15
  gRNA
caaaaaccccaaugcgcacg

SEQ ID NO: 61636 - RNA, 20 nt, Artificial Sequence
  MKO10061636_A_Zmynd19
  gRNA
cuuucccuagggaacgacac

SEQ ID NO: 61637 - RNA, 20 nt, Artificial Sequence
  MKO10061637_A_Zmynd19
  gRNA
cgaugagcaagacauaccac

SEQ ID NO: 61638 - RNA, 20 nt, Artificial Sequence
  MKO10061638_A_Zmynd19
  gRNA
ucagggagcaaagcuuauac

SEQ ID NO: 61639 - RNA, 20 nt, Artificial Sequence
  MKO10061639_A_Zmynd8
  gRNA
gacacuuagcgugauaaacc

SEQ ID NO: 61640 - RNA, 20 nt, Artificial Sequence
  MKO10061640_A_Zmynd8
  gRNA
gcuccaauggaacaggcuuc

SEQ ID NO: 61641 - RNA, 20 nt, Artificial Sequence
  MKO10061641_A_Zmynd8
  gRNA
cgggaacuaaccucacauuc

SEQ ID NO: 61642 - RNA, 20 nt, Artificial Sequence
  MKO10061642_A_Znf512b
  gRNA
uaccacuaucagcggugcca

SEQ ID NO: 61643 - RNA, 20 nt, Artificial Sequence
  MKO10061643_A_Znf512b
  gRNA
ccccuuggcaccgcugauag

SEQ ID NO: 61644 - RNA, 20 nt, Artificial Sequence
  MKO10061644_A_Znf512b
  gRNA
aacagguuugcucacuccga

SEQ ID NO: 61645 - RNA, 20 nt, Artificial Sequence
  MKO10061645_A_Znfx1
  gRNA
cacucauauaggcccuccgc

SEQ ID NO: 61646 - RNA, 20 nt, Artificial Sequence
  MKO10061646_A_Znfx1
  gRNA
uuuguuaggccccuucggga

SEQ ID NO: 61647 - RNA, 20 nt, Artificial Sequence
  MKO10061647_A_Znfx1
  gRNA
aucuaggugcaccucguugu

SEQ ID NO: 61648 - RNA, 20 nt, Artificial Sequence
  MKO10061648_A_Znhit1
  gRNA
guacugcaccgugcgcugcc

SEQ ID NO: 61649 - RNA, 20 nt, Artificial Sequence
  MKO10061649_A_Znhit1
  gRNA
caaccgacagcuggaggcau

SEQ ID NO: 61650 - RNA, 20 nt, Artificial Sequence
  MKO10061650_A_Znhit1
  gRNA
gccccaucuaguucgcuccc

SEQ ID NO: 61651 - RNA, 20 nt, Artificial Sequence
  MKO10061651_A_Znhit2
  gRNA
gcauagcaccccgcguaccc

SEQ ID NO: 61652 - RNA, 20 nt, Artificial Sequence
  MKO10061652_A_Znhit2
  gRNA
aagcgcaccagcggcgaugc

SEQ ID NO: 61653 - RNA, 20 nt, Artificial Sequence
  MKO10061653_A_Znhit2
  gRNA
uaacgcgcccgccagacggc

SEQ ID NO: 61654 - RNA, 20 nt, Artificial Sequence
  MKO10061654_A_Znhit3
  gRNA
gcugaugcgagccuguaugc

SEQ ID NO: 61655 - RNA, 20 nt, Artificial Sequence
  MKO10061655_A_Znhit3
  gRNA
guugaugauuagccucgauc

SEQ ID NO: 61656 - RNA, 20 nt, Artificial Sequence
  MKO10061656_A_Znhit3
  gRNA
cugcagaauuuaaagaaucu

SEQ ID NO: 61657 - RNA, 20 nt, Artificial Sequence
  MKO10061657_A_Znhit6
  gRNA
aagaaucgugcccgaaagca

SEQ ID NO: 61658 - RNA, 20 nt, Artificial Sequence
  MKO10061658_A_Znhit6
  gRNA
cugcugcagcgacacauaag

SEQ ID NO: 61659 - RNA, 20 nt, Artificial Sequence
  MKO10061659_A_Znhit6
  gRNA
aaagcugaccugacgugcag

SEQ ID NO: 61660 - RNA, 20 nt, Artificial Sequence
  MKO10061660_A_Znrd1as
  gRNA
cuaugacgucgacuaaguua

SEQ ID NO: 61661 - RNA, 20 nt, Artificial Sequence
  MKO10061661_A_Znrd1as
  gRNA
uucacuugaucacgcuucuc

SEQ ID NO: 61662 - RNA, 20 nt, Artificial Sequence
  MKO10061662_A_Znrd1as
  gRNA
acuacccaaaauugugcuag

SEQ ID NO: 61663 - RNA, 20 nt, Artificial Sequence
  MKO10061663_A_Znrd1
  gRNA
acugucauauguucgcguug

SEQ ID NO: 61664 - RNA, 20 nt, Artificial Sequence
  MKO10061664_A_Znrd1
  gRNA
cuccuuaccucgcacaucga

SEQ ID NO: 61665 - RNA, 20 nt, Artificial Sequence
  MKO10061665_A_Znrd1
  gRNA
auucccucgugaccacaucg

SEQ ID NO: 61666 - RNA, 20 nt, Artificial Sequence
  MKO10061666_A_Znrf1
  gRNA
uucagggggacacgauagcc

SEQ ID NO: 61667 - RNA, 20 nt, Artificial Sequence
  MKO10061667_A_Znrf1
  gRNA
agcccuuaccauuguaggac

SEQ ID NO: 61668 - RNA, 20 nt, Artificial Sequence
  MKO10061668_A_Znrf1
  gRNA
ggccuggcagagacuucuac

SEQ ID NO: 61669 - RNA, 20 nt, Artificial Sequence
  MKO10061669_A_Znrf2
  gRNA
agcgagccgaucaccagacg

SEQ ID NO: 61670 - RNA, 20 nt, Artificial Sequence
  MKO10061670_A_Znrf2
  gRNA
ugaaggccgacugcgccgcg

SEQ ID NO: 61671 - RNA, 20 nt, Artificial Sequence
  MKO10061671_A_Znrf2
  gRNA
uuaccauuauacguuauucu

SEQ ID NO: 61672 - RNA, 20 nt, Artificial Sequence
  MKO10061672_A_Znrf3
  gRNA
gcugaagcaacgucguaguc

SEQ ID NO: 61673 - RNA, 20 nt, Artificial Sequence
  MKO10061673_A_Znrf3
  gRNA
uuuccuggccuucuucgucg

SEQ ID NO: 61674 - RNA, 20 nt, Artificial Sequence
  MKO10061674_A_Znrf3
  gRNA
ugccacucacucgaggaggg

SEQ ID NO: 61675 - RNA, 20 nt, Artificial Sequence
  MKO10061675_A_Znrf4
  gRNA
cgacgccugccacgccaucg

SEQ ID NO: 61676 - RNA, 20 nt, Artificial Sequence
  MKO10061676_A_Znrf4
  gRNA
gguccacgcaaaccgcgcca

SEQ ID NO: 61677 - RNA, 20 nt, Artificial Sequence
  MKO10061677_A_Znrf4
  gRNA
acugucgcugcaucgacccc

SEQ ID NO: 61678 - RNA, 20 nt, Artificial Sequence
  MKO10061678_A_Zp1
  gRNA
cggcuuguaugaacacccuc

SEQ ID NO: 61679 - RNA, 20 nt, Artificial Sequence
  MKO10061679_A_Zp1
  gRNA
aggcuaccuggcaccgcucc

SEQ ID NO: 61680 - RNA, 20 nt, Artificial Sequence
  MKO10061680_A_Zp1
  gRNA
auacaagccguccuacccaa

SEQ ID NO: 61681 - RNA, 20 nt, Artificial Sequence
  MKO10061681_A_Zp2
  gRNA
cgagaccugcacuauaaaag

SEQ ID NO: 61682 - RNA, 20 nt, Artificial Sequence
  MKO10061682_A_Zp2
  gRNA
uacacagguugguggauacc

SEQ ID NO: 61683 - RNA, 20 nt, Artificial Sequence
  MKO10061683_A_Zp2
  gRNA
cccccacucugauguucacc

SEQ ID NO: 61684 - RNA, 20 nt, Artificial Sequence
  MKO10061684_A_Zp3r
  gRNA
uucccauugaccaacucgcc

SEQ ID NO: 61685 - RNA, 20 nt, Artificial Sequence
  MKO10061685_A_Zp3r
  gRNA
gaugaugaccuguacacguu

SEQ ID NO: 61686 - RNA, 20 nt, Artificial Sequence
  MKO10061686_A_Zp3r
  gRNA
cucagcaacuagucggugug

SEQ ID NO: 61687 - RNA, 20 nt, Artificial Sequence
  MKO10061687_A_Zp3
  gRNA
cacgacccucgcccugugag

SEQ ID NO: 61688 - RNA, 20 nt, Artificial Sequence
  MKO10061688_A_Zp3
  gRNA
cucccccuaucacuucaucg

SEQ ID NO: 61689 - RNA, 20 nt, Artificial Sequence
  MKO10061689_A_Zp3
  gRNA
cauccucaggacuaaccgug

SEQ ID NO: 61690 - RNA, 20 nt, Artificial Sequence
  MKO10061690_A_Zpbp2
  gRNA
cacgaaucacaacguccuca

SEQ ID NO: 61691 - RNA, 20 nt, Artificial Sequence
  MKO10061691_A_Zpbp2
  gRNA
uccagugaauccuuucgcac

SEQ ID NO: 61692 - RNA, 20 nt, Artificial Sequence
  MKO10061692_A_Zpbp2
  gRNA
gacaauugucgaccaggcuu

SEQ ID NO: 61693 - RNA, 20 nt, Artificial Sequence
  MKO10061693_A_Zpbp
  gRNA
cucuagcuuaucgugaaccu

SEQ ID NO: 61694 - RNA, 20 nt, Artificial Sequence
  MKO10061694_A_Zpbp
  gRNA
cgaguauaaaccaacuguag

SEQ ID NO: 61695 - RNA, 20 nt, Artificial Sequence
  MKO10061695_A_Zpbp
  gRNA
gacccaucauuccaauggca

SEQ ID NO: 61696 - RNA, 20 nt, Artificial Sequence
  MKO10061696_A_Zpld1
  gRNA
caauuaauuaucccgaguau

SEQ ID NO: 61697 - RNA, 20 nt, Artificial Sequence
  MKO10061697_A_Zpld1
  gRNA
agcugugcaagcuacuaauc

SEQ ID NO: 61698 - RNA, 20 nt, Artificial Sequence
  MKO10061698_A_Zpld1
  gRNA
auuuaguuguaguuauccgu

SEQ ID NO: 61699 - RNA, 20 nt, Artificial Sequence
  MKO10061699_A_Zranb1
  gRNA
uuuggaguuggcuacacguc

SEQ ID NO: 61700 - RNA, 20 nt, Artificial Sequence
  MKO10061700_A_Zranb1
  gRNA
guacuucaucugcaguaagc

SEQ ID NO: 61701 - RNA, 20 nt, Artificial Sequence
  MKO10061701_A_Zranb1
  gRNA
guccugccucugaaagcgua

SEQ ID NO: 61702 - RNA, 20 nt, Artificial Sequence
  MKO10061702_A_Zranb2
  gRNA
gcuuauuuagugccaaugau

SEQ ID NO: 61703 - RNA, 20 nt, Artificial Sequence
  MKO10061703_A_Zranb2
  gRNA
guaguugcaguaaugugaau

SEQ ID NO: 61704 - RNA, 20 nt, Artificial Sequence
  MKO10061704_A_Zranb2
  gRNA
guggaaauguaaacuuugcu

SEQ ID NO: 61705 - RNA, 20 nt, Artificial Sequence
  MKO10061705_A_Zranb3
  gRNA
aguaagcaauugcaaucgcc

SEQ ID NO: 61706 - RNA, 20 nt, Artificial Sequence
  MKO10061706_A_Zranb3
  gRNA
augaagggacgacuaucagc

SEQ ID NO: 61707 - RNA, 20 nt, Artificial Sequence
  MKO10061707_A_Zranb3
  gRNA
cagcaagauucuccugccca

SEQ ID NO: 61708 - RNA, 20 nt, Artificial Sequence
  MKO10061708_A_Zrsr1
  gRNA
cuaugacucagacgcaaacc

SEQ ID NO: 61709 - RNA, 20 nt, Artificial Sequence
  MKO10061709_A_Zrsr1
  gRNA
cggaaccacccaaggauuua

SEQ ID NO: 61710 - RNA, 20 nt, Artificial Sequence
  MKO10061710_A_Zrsr1
  gRNA
agaacuugcagagcgauuac

SEQ ID NO: 61711 - RNA, 20 nt, Artificial Sequence
  MKO10061711_A_Zrsr2
  gRNA
uuccagccguaagaaguacu

SEQ ID NO: 61712 - RNA, 20 nt, Artificial Sequence
  MKO10061712_A_Zrsr2
  gRNA
ggcuacggcggacgcuacgg

SEQ ID NO: 61713 - RNA, 20 nt, Artificial Sequence
  MKO10061713_A_Zrsr2
  gRNA
ggcgcucgcucggcucagag

SEQ ID NO: 61714 - RNA, 20 nt, Artificial Sequence
  MKO10061714_A_Zscan10
  gRNA
cccccguguggcagcguacg

SEQ ID NO: 61715 - RNA, 20 nt, Artificial Sequence
  MKO10061715_A_Zscan10
  gRNA
uaagcuagagcgccgcuuga

SEQ ID NO: 61716 - RNA, 20 nt, Artificial Sequence
  MKO10061716_A_Zscan10
  gRNA
cuucugagggcaacuccguc

SEQ ID NO: 61717 - RNA, 20 nt, Artificial Sequence
  MKO10061717_A_Zscan12
  gRNA
uuagcguacucugaguucgc

SEQ ID NO: 61718 - RNA, 20 nt, Artificial Sequence
  MKO10061718_A_Zscan12
  gRNA
gacaucuacuagugauacca

SEQ ID NO: 61719 - RNA, 20 nt, Artificial Sequence
  MKO10061719_A_Zscan12
  gRNA
uccugcuagcagauuagcaa

SEQ ID NO: 61720 - RNA, 20 nt, Artificial Sequence
  MKO10061720_A_Zscan18
  gRNA
uacaaguaucacggcguacc

SEQ ID NO: 61721 - RNA, 20 nt, Artificial Sequence
  MKO10061721_A_Zscan18
  gRNA
gcagcuugcuguaacucguc

SEQ ID NO: 61722 - RNA, 20 nt, Artificial Sequence
  MKO10061722_A_Zscan18
  gRNA
gucaucaucgucauucagcg

SEQ ID NO: 61723 - RNA, 20 nt, Artificial Sequence
  MKO10061723_A_Zscan20
  gRNA
uguucuuaccaauacggcuc

SEQ ID NO: 61724 - RNA, 20 nt, Artificial Sequence
  MKO10061724_A_Zscan20
  gRNA
ucagucgcucugcgauagcc

SEQ ID NO: 61725 - RNA, 20 nt, Artificial Sequence
  MKO10061725_A_Zscan20
  gRNA
gaacuccugaacugcuucga

SEQ ID NO: 61726 - RNA, 20 nt, Artificial Sequence
  MKO10061726_A_Zscan21
  gRNA
ggaugcgauagugucgaaug

SEQ ID NO: 61727 - RNA, 20 nt, Artificial Sequence
  MKO10061727_A_Zscan21
  gRNA
uucgcccauuaaaguagaag

SEQ ID NO: 61728 - RNA, 20 nt, Artificial Sequence
  MKO10061728_A_Zscan21
  gRNA
cggcccuaugacuguaagug

SEQ ID NO: 61729 - RNA, 20 nt, Artificial Sequence
  MKO10061729_A_Zscan22
  gRNA
gccgcaaguaucacacucgu

SEQ ID NO: 61730 - RNA, 20 nt, Artificial Sequence
  MKO10061730_A_Zscan22
  gRNA
aguugggcuagcgccugaug

SEQ ID NO: 61731 - RNA, 20 nt, Artificial Sequence
  MKO10061731_A_Zscan22
  gRNA
cuucaggcacuuccgcuaug

SEQ ID NO: 61732 - RNA, 20 nt, Artificial Sequence
  MKO10061732_A_Zscan25
  gRNA
aagcccuacaccugcgagug

SEQ ID NO: 61733 - RNA, 20 nt, Artificial Sequence
  MKO10061733_A_Zscan25
  gRNA
agcgacuggugcgacaccag

SEQ ID NO: 61734 - RNA, 20 nt, Artificial Sequence
  MKO10061734_A_Zscan25
  gRNA
auugccacgaugcuccgcca

SEQ ID NO: 61735 - RNA, 20 nt, Artificial Sequence
  MKO10061735_A_Zscan26
  gRNA
ggcucgccaaccagcaccgu

SEQ ID NO: 61736 - RNA, 20 nt, Artificial Sequence
  MKO10061736_A_Zscan26
  gRNA
ccgaccuuauucgacaucau

SEQ ID NO: 61737 - RNA, 20 nt, Artificial Sequence
  MKO10061737_A_Zscan26
  gRNA
gaggaggagggcccgacuaa

SEQ ID NO: 61738 - RNA, 20 nt, Artificial Sequence
  MKO10061738_A_Zscan29
  gRNA
caccgcaacagccaguuaua

SEQ ID NO: 61739 - RNA, 20 nt, Artificial Sequence
  MKO10061739_A_Zscan29
  gRNA
aauuugguacgacauugcuc

SEQ ID NO: 61740 - RNA, 20 nt, Artificial Sequence
  MKO10061740_A_Zscan29
  gRNA
aagcgcuccgaaacugucac

SEQ ID NO: 61741 - RNA, 20 nt, Artificial Sequence
  MKO10061741_A_Zscan2
  gRNA
agggugcucuuguccgauuu

SEQ ID NO: 61742 - RNA, 20 nt, Artificial Sequence
  MKO10061742_A_Zscan2
  gRNA
cuccagccugaucgcgcacc

SEQ ID NO: 61743 - RNA, 20 nt, Artificial Sequence
  MKO10061743_A_Zscan2
  gRNA
gcguaaugagcgcggagcuc

SEQ ID NO: 61744 - RNA, 20 nt, Artificial Sequence
  MKO10061744_A_Zscan4b
  gRNA
gaugauuucucaauuggucu

SEQ ID NO: 61745 - RNA, 20 nt, Artificial Sequence
  MKO10061745_A_Zscan4b
  gRNA
caccacaauggcuucacagc

SEQ ID NO: 61746 - RNA, 20 nt, Artificial Sequence
  MKO10061746_A_Zscan4b
  gRNA
cagguccauguuucaaugca

SEQ ID NO: 61747 - RNA, 20 nt, Artificial Sequence
  MKO10061747_A_Zscan4c
  gRNA
gaggaacucaccaugacagg

SEQ ID NO: 61748 - RNA, 20 nt, Artificial Sequence
  MKO10061748_A_Zscan4c
  gRNA
caccacaauggcuucacagc

SEQ ID NO: 61749 - RNA, 20 nt, Artificial Sequence
  MKO10061749_A_Zscan4c
  gRNA
ggccaauaaucuaucuugug

SEQ ID NO: 61750 - RNA, 20 nt, Artificial Sequence
  MKO10061750_A_Zscan4d
  gRNA
ugcacaccagaacuaugaga

SEQ ID NO: 61751 - RNA, 20 nt, Artificial Sequence
  MKO10061751_A_Zscan4d
  gRNA
ccagucaucauguagacuuc

SEQ ID NO: 61752 - RNA, 20 nt, Artificial Sequence
  MKO10061752_A_Zscan4d
  gRNA
ccgcaggagucggagcacuc

SEQ ID NO: 61753 - RNA, 20 nt, Artificial Sequence
  MKO10061753_A_Zscan4e
  gRNA
gcagcuacucaaguauauaa

SEQ ID NO: 61754 - RNA, 20 nt, Artificial Sequence
  MKO10061754_A_Zscan4e
  gRNA
caccacaauggcuucacagc

SEQ ID NO: 61755 - RNA, 20 nt, Artificial Sequence
  MKO10061755_A_Zscan4e
  gRNA
gaggaacucaccaugacagg

SEQ ID NO: 61756 - RNA, 20 nt, Artificial Sequence
  MKO10061756_A_Zscan4f
  gRNA
guucuuucugcauaauaaga

SEQ ID NO: 61757 - RNA, 20 nt, Artificial Sequence
  MKO10061757_A_Zscan4f
  gRNA
gaggaacucaccaugacagg

SEQ ID NO: 61758 - RNA, 20 nt, Artificial Sequence
  MKO10061758_A_Zscan4f
  gRNA
caccacaauggcuucacagc

SEQ ID NO: 61759 - RNA, 20 nt, Artificial Sequence
  MKO10061759_A_Zscan5b
  gRNA
ccuucguguggacucgacug

SEQ ID NO: 61760 - RNA, 20 nt, Artificial Sequence
  MKO10061760_A_Zscan5b
  gRNA
ucccaacgcugggaugccga

SEQ ID NO: 61761 - RNA, 20 nt, Artificial Sequence
  MKO10061761_A_Zscan5b
  gRNA
uaacaagacuuuccgacagc

SEQ ID NO: 61762 - RNA, 20 nt, Artificial Sequence
  MKO10061762_A_Zswim1
  gRNA
ggacgaccgcaagcucgccu

SEQ ID NO: 61763 - RNA, 20 nt, Artificial Sequence
  MKO10061763_A_Zswim1
  gRNA
ccgacaugcugcccgcucag

SEQ ID NO: 61764 - RNA, 20 nt, Artificial Sequence
  MKO10061764_A_Zswim1
  gRNA
guagaccauucagcaucgug

SEQ ID NO: 61765 - RNA, 20 nt, Artificial Sequence
  MKO10061765_A_Zswim2
  gRNA
uuguagcaccuccccucgau

SEQ ID NO: 61766 - RNA, 20 nt, Artificial Sequence
  MKO10061766_A_Zswim2
  gRNA
cuguaaccaacugccaaucg

SEQ ID NO: 61767 - RNA, 20 nt, Artificial Sequence
  MKO10061767_A_Zswim2
  gRNA
gcugccccacguuucugaag

SEQ ID NO: 61768 - RNA, 20 nt, Artificial Sequence
  MKO10061768_A_Zswim3
  gRNA
gagaccgcuguucccgaaag

SEQ ID NO: 61769 - RNA, 20 nt, Artificial Sequence
  MKO10061769_A_Zswim3
  gRNA
gcccuuacaggauauccucg

SEQ ID NO: 61770 - RNA, 20 nt, Artificial Sequence
  MKO10061770_A_Zswim3
  gRNA
ggccauugagcccucgucca

SEQ ID NO: 61771 - RNA, 20 nt, Artificial Sequence
  MKO10061771_A_Zswim4
  gRNA
ccgcauccgucaugcucgcc

SEQ ID NO: 61772 - RNA, 20 nt, Artificial Sequence
  MKO10061772_A_Zswim4
  gRNA
acccggguaccauucacccg

SEQ ID NO: 61773 - RNA, 20 nt, Artificial Sequence
  MKO10061773_A_Zswim4
  gRNA
ggaucucgucagcaagacgu

SEQ ID NO: 61774 - RNA, 20 nt, Artificial Sequence
  MKO10061774_A_Zswim5
  gRNA
agacgaaguuugaccugguc

SEQ ID NO: 61775 - RNA, 20 nt, Artificial Sequence
  MKO10061775_A_Zswim5
  gRNA
acaguucucaucaucgaugc

SEQ ID NO: 61776 - RNA, 20 nt, Artificial Sequence
  MKO10061776_A_Zswim5
  gRNA
cagagccauaguaacccccc

SEQ ID NO: 61777 - RNA, 20 nt, Artificial Sequence
  MKO10061777_A_Zswim6
  gRNA
ucaauacuagcacccgccgu

SEQ ID NO: 61778 - RNA, 20 nt, Artificial Sequence
  MKO10061778_A_Zswim6
  gRNA
gccagaaaccguuugcaacg

SEQ ID NO: 61779 - RNA, 20 nt, Artificial Sequence
  MKO10061779_A_Zswim6
  gRNA
cgcccccaccgacggggucc

SEQ ID NO: 61780 - RNA, 20 nt, Artificial Sequence
  MKO10061780_A_Zswim7
  gRNA
ugacggacucucgaucgacu

SEQ ID NO: 61781 - RNA, 20 nt, Artificial Sequence
  MKO10061781_A_Zswim7
  gRNA
uuacgauaagagaagcucgu

SEQ ID NO: 61782 - RNA, 20 nt, Artificial Sequence
  MKO10061782_A_Zswim7
  gRNA
cugguaaacacgccuuccac

SEQ ID NO: 61783 - RNA, 20 nt, Artificial Sequence
  MKO10061783_A_Zswim8
  gRNA
ggaucagcuguuccgaauga

SEQ ID NO: 61784 - RNA, 20 nt, Artificial Sequence
  MKO10061784_A_Zswim8
  gRNA
agugcggaugaguuucagcg

SEQ ID NO: 61785 - RNA, 20 nt, Artificial Sequence
  MKO10061785_A_Zswim8
  gRNA
caaauggugcacccaugucg

SEQ ID NO: 61786 - RNA, 20 nt, Artificial Sequence
  MKO10061786_A_Zufsp
  gRNA
caguguucugauaauaccua

SEQ ID NO: 61787 - RNA, 20 nt, Artificial Sequence
  MKO10061787_A_Zufsp
  gRNA
acaacagcagcuacgacaua

SEQ ID NO: 61788 - RNA, 20 nt, Artificial Sequence
  MKO10061788_A_Zufsp
  gRNA
gaauuauugaagcccuccau

SEQ ID NO: 61789 - RNA, 20 nt, Artificial Sequence
  MKO10061789_A_Zw10
  gRNA
cguuagauagaguguccacc

SEQ ID NO: 61790 - RNA, 20 nt, Artificial Sequence
  MKO10061790_A_Zw10
  gRNA
acaucgaccagcugaaaucc

SEQ ID NO: 61791 - RNA, 20 nt, Artificial Sequence
  MKO10061791_A_Zw10
  gRNA
uccuccaggugccgagcagc

SEQ ID NO: 61792 - RNA, 20 nt, Artificial Sequence
  MKO10061792_A_Zwilch
  gRNA
aaaugacucaguguuucucg

SEQ ID NO: 61793 - RNA, 20 nt, Artificial Sequence
  MKO10061793_A_Zwilch
  gRNA
uaaagacccauucaucuaug

SEQ ID NO: 61794 - RNA, 20 nt, Artificial Sequence
  MKO10061794_A_Zwilch
  gRNA
aagcucagcuccuagccaac

SEQ ID NO: 61795 - RNA, 20 nt, Artificial Sequence
  MKO10061795_A_Zwint
  gRNA
ccugcagaagcgaguccuug

SEQ ID NO: 61796 - RNA, 20 nt, Artificial Sequence
  MKO10061796_A_Zwint
  gRNA
ugagcagagcccugaugcuc

SEQ ID NO: 61797 - RNA, 20 nt, Artificial Sequence
  MKO10061797_A_Zwint
  gRNA
cauaaaaugugcccugucug

SEQ ID NO: 61798 - RNA, 20 nt, Artificial Sequence
  MKO10061798_A_Zxdb
  gRNA
gccccgcaggccgccgccgc

SEQ ID NO: 61799 - RNA, 20 nt, Artificial Sequence
  MKO10061799_A_Zxdb
  gRNA
gagucgguucauaccaaaaa

SEQ ID NO: 61800 - RNA, 20 nt, Artificial Sequence
  MKO10061800_A_Zxdb
  gRNA
acgccgagauggaaaucccg

SEQ ID NO: 61801 - RNA, 20 nt, Artificial Sequence
  MKO10061801_A_Zxdc
  gRNA
cgggacgcagcagcgcucga

SEQ ID NO: 61802 - RNA, 20 nt, Artificial Sequence
  MKO10061802_A_Zxdc
  gRNA
cuccuggugcgcuucgaccg

SEQ ID NO: 61803 - RNA, 20 nt, Artificial Sequence
  MKO10061803_A_Zxdc
  gRNA
ccuuccacagggcauucgaa

SEQ ID NO: 61804 - RNA, 20 nt, Artificial Sequence
  MKO10061804_A_Zyg11a
  gRNA
ccggccugccaugcgauuug

SEQ ID NO: 61805 - RNA, 20 nt, Artificial Sequence
  MKO10061805_A_Zyg11a
  gRNA
aagcuccgaguccaccgacg

SEQ ID NO: 61806 - RNA, 20 nt, Artificial Sequence
  MKO10061806_A_Zyg11a
  gRNA
cagaagcacugagucguuac

SEQ ID NO: 61807 - RNA, 20 nt, Artificial Sequence
  MKO10061807_A_Zyg11b
  gRNA
cgcugaggcgguacagcgag

SEQ ID NO: 61808 - RNA, 20 nt, Artificial Sequence
  MKO10061808_A_Zyg11b
  gRNA
accgcucauauggauccucg

SEQ ID NO: 61809 - RNA, 20 nt, Artificial Sequence
  MKO10061809_A_Zyg11b
  gRNA
agcugcacgggcaaauucau

SEQ ID NO: 61810 - RNA, 20 nt, Artificial Sequence
  MKO10061810_A_Zyx
  gRNA
uccaccucccccgaugaucg

SEQ ID NO: 61811 - RNA, 20 nt, Artificial Sequence
  MKO10061811_A_Zyx
  gRNA
cgacgacucagagggugccc

SEQ ID NO: 61812 - RNA, 20 nt, Artificial Sequence
  MKO10061812_A_Zyx
  gRNA
uuucuuuagguacgcucucc

SEQ ID NO: 61813 - RNA, 20 nt, Artificial Sequence
  MKO10061813_A_Zzef1
  gRNA
uagagauccgauugcgaugc

SEQ ID NO: 61814 - RNA, 20 nt, Artificial Sequence
  MKO10061814_A_Zzef1
  gRNA
ugcgcuuccugcaucgcaau

SEQ ID NO: 61815 - RNA, 20 nt, Artificial Sequence
  MKO10061815_A_Zzef1
  gRNA
auggcagugcgcgcucacac

SEQ ID NO: 61816 - RNA, 20 nt, Artificial Sequence
  MKO10061816_A_Zzz3
  gRNA
ugccuaccugaggacgguua

SEQ ID NO: 61817 - RNA, 20 nt, Artificial Sequence
  MKO10061817_A_Zzz3
  gRNA
aggcucccauaaccguccuc

SEQ ID NO: 61818 - RNA, 20 nt, Artificial Sequence
  MKO10061818_A_Zzz3
  gRNA
uucccaagcagugcaagacc

SEQ ID NO: 61819 - RNA, 20 nt, Artificial Sequence
  MKO10061819_A_a
  gRNA
ggaugucacccgccuacucc

SEQ ID NO: 61820 - RNA, 20 nt, Artificial Sequence
  MKO10061820_A_a
  gRNA
guugaguacucgacaggugc

SEQ ID NO: 61821 - RNA, 20 nt, Artificial Sequence
  MKO10061821_A_a
  gRNA
ggaggcgcacgggucgcagc

SEQ ID NO: 61822 - RNA, 20 nt, Artificial Sequence
  MKO10061822_A_l7Rn6
  gRNA
cuccguugacuccuuuacgc

SEQ ID NO: 61823 - RNA, 20 nt, Artificial Sequence
  MKO10061823_A_l7Rn6
  gRNA
gacacggcagcacugccuac

SEQ ID NO: 61824 - RNA, 20 nt, Artificial Sequence
  MKO10061824_A_l7Rn6
  gRNA
acuggcaccccauuugaauc

SEQ ID NO: 61825 - RNA, 20 nt, Artificial Sequence
  MKO10061825_A_mmu-mir-6341
  gRNA
ucaacauauccaaaaauuga

SEQ ID NO: 61826 - RNA, 20 nt, Artificial Sequence
  MKO10061826_A_mmu-mir-6341
  gRNA
uauggcugauaggcuuccuc

SEQ ID NO: 61827 - RNA, 20 nt, Artificial Sequence
  MKO10061827_A_mmu-mir-6341
  gRNA
ucaacugaauuuuguguguc

SEQ ID NO: 61828 - RNA, 20 nt, Artificial Sequence
  MKO10061828_A_mmu-mir-6341
  gRNA
caguguuauacuaucuccug

SEQ ID NO: 61829 - RNA, 20 nt, Artificial Sequence
  MKO10061829_A_mmu-mir-206
  gRNA
ucucagcacuauggaaugua

SEQ ID NO: 61830 - RNA, 20 nt, Artificial Sequence
  MKO10061830_A_mmu-mir-206
  gRNA
auggaauguaaggaagugug

SEQ ID NO: 61831 - RNA, 20 nt, Artificial Sequence
  MKO10061831_A_mmu-mir-206
  gRNA
uguaaggaagugugugguuu

SEQ ID NO: 61832 - RNA, 20 nt, Artificial Sequence
  MKO10061832_A_mmu-mir-206
  gRNA
auaaagaagcauguggccug

SEQ ID NO: 61833 - RNA, 20 nt, Artificial Sequence
  MKO10061833_A_mmu-mir-133b
  gRNA
caggcugcagucaccuccaa

SEQ ID NO: 61834 - RNA, 20 nt, Artificial Sequence
  MKO10061834_A_mmu-mir-133b
  gRNA
aagggaguggcccccugcuc

SEQ ID NO: 61835 - RNA, 20 nt, Artificial Sequence
  MKO10061835_A_mmu-mir-133b
  gRNA
guccgucuuccugagagguu

SEQ ID NO: 61836 - RNA, 20 nt, Artificial Sequence
  MKO10061836_A_mmu-mir-133b
  gRNA
ucaaccagcuacagcagggc

SEQ ID NO: 61837 - RNA, 20 nt, Artificial Sequence
  MKO10061837_A_mmu-mir-30a
  gRNA
cgacuguaaacauccucgac

SEQ ID NO: 61838 - RNA, 20 nt, Artificial Sequence
  MKO10061838_A_mmu-mir-30a
  gRNA
ggaagcugugaagccacaaa

SEQ ID NO: 61839 - RNA, 20 nt, Artificial Sequence
  MKO10061839_A_mmu-mir-30a
  gRNA
gccacaaaugggcuuucagu

SEQ ID NO: 61840 - RNA, 20 nt, Artificial Sequence
  MKO10061840_A_mmu-mir-30a
  gRNA
ggcuucacagcuuccagucg

SEQ ID NO: 61841 - RNA, 20 nt, Artificial Sequence
  MKO10061841_A_mmu-mir-30c-2
  gRNA
aaaguaagaaagcugggaga

SEQ ID NO: 61842 - RNA, 20 nt, Artificial Sequence
  MKO10061842_A_mmu-mir-30c-2
  gRNA
gcuguuuacucucucugccu

SEQ ID NO: 61843 - RNA, 20 nt, Artificial Sequence
  MKO10061843_A_mmu-mir-30c-2
  gRNA
gcugugaaaaguaagaaagc

SEQ ID NO: 61844 - RNA, 20 nt, Artificial Sequence
  MKO10061844_A_mmu-mir-30c-2
  gRNA
cuuuucacagcugagagugu

SEQ ID NO: 61845 - RNA, 20 nt, Artificial Sequence
  MKO10061845_A_mmu-mir-6342
  gRNA
gaggacuacacagacuucga

SEQ ID NO: 61846 - RNA, 20 nt, Artificial Sequence
  MKO10061846_A_mmu-mir-6342
  gRNA
gauccgcuaucaugcaacug

SEQ ID NO: 61847 - RNA, 20 nt, Artificial Sequence
  MKO10061847_A_mmu-mir-6342
  gRNA
ucuuugaggauucuuuuaaa

SEQ ID NO: 61848 - RNA, 20 nt, Artificial Sequence
  MKO10061848_A_mmu-mir-6342
  gRNA
cucuggagaucuguccacuc

SEQ ID NO: 61849 - RNA, 20 nt, Artificial Sequence
  MKO10061849_A_mmu-mir-6896
  gRNA
ucauuuagcguuuccuuugu

SEQ ID NO: 61850 - RNA, 20 nt, Artificial Sequence
  MKO10061850_A_mmu-mir-6896
  gRNA
ucucucucucaccuacaaac

SEQ ID NO: 61851 - RNA, 20 nt, Artificial Sequence
  MKO10061851_A_mmu-mir-6896
  gRNA
cggguucucgucgccuacaa

SEQ ID NO: 61852 - RNA, 20 nt, Artificial Sequence
  MKO10061852_A_mmu-mir-6896
  gRNA
aacagugauuauuacacacc

SEQ ID NO: 61853 - RNA, 20 nt, Artificial Sequence
  MKO10061853_A_mmu-mir-5103
  gRNA
ucggggguccugggggccuc

SEQ ID NO: 61854 - RNA, 20 nt, Artificial Sequence
  MKO10061854_A_mmu-mir-5103
  gRNA
ggggguccugggggccucag

SEQ ID NO: 61855 - RNA, 20 nt, Artificial Sequence
  MKO10061855_A_mmu-mir-5103
  gRNA
cugggggccucaggggaucc

SEQ ID NO: 61856 - RNA, 20 nt, Artificial Sequence
  MKO10061856_A_mmu-mir-5103
  gRNA
aaauguuaugcccagauccu

SEQ ID NO: 61857 - RNA, 20 nt, Artificial Sequence
  MKO10061857_A_mmu-mir-6897
  gRNA
acggucuguguucuuccccc

SEQ ID NO: 61858 - RNA, 20 nt, Artificial Sequence
  MKO10061858_A_mmu-mir-6897
  gRNA
aagcuacagugcugugcugg

SEQ ID NO: 61859 - RNA, 20 nt, Artificial Sequence
  MKO10061859_A_mmu-mir-6897
  gRNA
guuuuaugacguaagucuca

SEQ ID NO: 61860 - RNA, 20 nt, Artificial Sequence
  MKO10061860_A_mmu-mir-6898
  gRNA
ggagagauccuggguagaga

SEQ ID NO: 61861 - RNA, 20 nt, Artificial Sequence
  MKO10061861_A_mmu-mir-6898
  gRNA
acuugaauccaagcaucauu

SEQ ID NO: 61862 - RNA, 20 nt, Artificial Sequence
  MKO10061862_A_mmu-mir-6898
  gRNA
ucuuuguaccuucucuaccc

SEQ ID NO: 61863 - RNA, 20 nt, Artificial Sequence
  MKO10061863_A_mmu-mir-6898
  gRNA
ucccuguaaggggagaugca

SEQ ID NO: 61864 - RNA, 20 nt, Artificial Sequence
  MKO10061864_A_mmu-mir-6349
  gRNA
ccacauuccacagguuacag

SEQ ID NO: 61865 - RNA, 20 nt, Artificial Sequence
  MKO10061865_A_mmu-mir-6349
  gRNA
cauuccacagguuacagcgg

SEQ ID NO: 61866 - RNA, 20 nt, Artificial Sequence
  MKO10061866_A_mmu-mir-6349
  gRNA
gaggcuguuagcuuacucug

SEQ ID NO: 61867 - RNA, 20 nt, Artificial Sequence
  MKO10061867_A_mmu-mir-6349
  gRNA
cuguuagcuuacucuguggg

SEQ ID NO: 61868 - RNA, 20 nt, Artificial Sequence
  MKO10061868_A_mmu-mir-6350
  gRNA
augaaaauaugauaaguaua

SEQ ID NO: 61869 - RNA, 20 nt, Artificial Sequence
  MKO10061869_A_mmu-mir-6350
  gRNA
auaaugcaccugcuauacau

SEQ ID NO: 61870 - RNA, 20 nt, Artificial Sequence
  MKO10061870_A_mmu-mir-6350
  gRNA
gcaccugcuauacauuggua

SEQ ID NO: 61871 - RNA, 20 nt, Artificial Sequence
  MKO10061871_A_mmu-mir-6350
  gRNA
cagccauaccaauguauagc

SEQ ID NO: 61872 - RNA, 20 nt, Artificial Sequence
  MKO10061872_A_mmu-mir-7681
  gRNA
ccuguccuugcccucucugu

SEQ ID NO: 61873 - RNA, 20 nt, Artificial Sequence
  MKO10061873_A_mmu-mir-7681
  gRNA
ccuacaccuacacuacagaa

SEQ ID NO: 61874 - RNA, 20 nt, Artificial Sequence
  MKO10061874_A_mmu-mir-7681
  gRNA
ccaacagagagggcaaggac

SEQ ID NO: 61875 - RNA, 20 nt, Artificial Sequence
  MKO10061875_A_mmu-mir-7681
  gRNA
ugaugccaacagagagggca

SEQ ID NO: 61876 - RNA, 20 nt, Artificial Sequence
  MKO10061876_A_mmu-mir-6899
  gRNA
ucaccugcagaagacacaga

SEQ ID NO: 61877 - RNA, 20 nt, Artificial Sequence
  MKO10061877_A_mmu-mir-6899
  gRNA
gcccgcugcguucugcugcc

SEQ ID NO: 61878 - RNA, 20 nt, Artificial Sequence
  MKO10061878_A_mmu-mir-6899
  gRNA
uguccuucugugucuucugc

SEQ ID NO: 61879 - RNA, 20 nt, Artificial Sequence
  MKO10061879_A_mmu-mir-6899
  gRNA
accaggcagcagaacgcagc

SEQ ID NO: 61880 - RNA, 20 nt, Artificial Sequence
  MKO10061880_A_mmu-mir-6351
  gRNA
gugcucccugagcaacgcua

SEQ ID NO: 61881 - RNA, 20 nt, Artificial Sequence
  MKO10061881_A_mmu-mir-6351
  gRNA
uugcuuugcagagauccucu

SEQ ID NO: 61882 - RNA, 20 nt, Artificial Sequence
  MKO10061882_A_mmu-mir-6351
  gRNA
aggaaagcugaaauggagga

SEQ ID NO: 61883 - RNA, 20 nt, Artificial Sequence
  MKO10061883_A_mmu-mir-6351
  gRNA
agaaaacugagcaugcccag

SEQ ID NO: 61884 - RNA, 20 nt, Artificial Sequence
  MKO10061884_A_mmu-mir-1928
  gRNA
uuacaaguugggguuagagc

SEQ ID NO: 61885 - RNA, 20 nt, Artificial Sequence
  MKO10061885_A_mmu-mir-1928
  gRNA
gauagagcuuugcgcauugu

SEQ ID NO: 61886 - RNA, 20 nt, Artificial Sequence
  MKO10061886_A_mmu-mir-1928
  gRNA
gagcuggcaauguagcucag

SEQ ID NO: 61887 - RNA, 20 nt, Artificial Sequence
  MKO10061887_A_mmu-mir-26b
  gRNA
ggacccaguucaaguaauuc

SEQ ID NO: 61888 - RNA, 20 nt, Artificial Sequence
  MKO10061888_A_mmu-mir-26b
  gRNA
caguucaaguaauucaggau

SEQ ID NO: 61889 - RNA, 20 nt, Artificial Sequence
  MKO10061889_A_mmu-mir-26b
  gRNA
aaguaauucaggauagguug

SEQ ID NO: 61890 - RNA, 20 nt, Artificial Sequence
  MKO10061890_A_mmu-mir-26b
  gRNA
ccagccuguucuccauuacu

SEQ ID NO: 61891 - RNA, 20 nt, Artificial Sequence
  MKO10061891_A_mmu-mir-375
  gRNA
gcucagguccgguuugugcg

SEQ ID NO: 61892 - RNA, 20 nt, Artificial Sequence
  MKO10061892_A_mmu-mir-375
  gRNA
ucagguccgguuugugcgag

SEQ ID NO: 61893 - RNA, 20 nt, Artificial Sequence
  MKO10061893_A_mmu-mir-375
  gRNA
uuugugcgaggggcucgucg

SEQ ID NO: 61894 - RNA, 20 nt, Artificial Sequence
  MKO10061894_A_mmu-mir-375
  gRNA
ugugcgaggggcucgucgcg

SEQ ID NO: 61895 - RNA, 20 nt, Artificial Sequence
  MKO10061895_A_mmu-mir-6343
  gRNA
cuauuuauugcagaaaagug

SEQ ID NO: 61896 - RNA, 20 nt, Artificial Sequence
  MKO10061896_A_mmu-mir-6343
  gRNA
ucuccacuucuauguaaagu

SEQ ID NO: 61897 - RNA, 20 nt, Artificial Sequence
  MKO10061897_A_mmu-mir-6343
  gRNA
gcuccuacuuuacauagaag

SEQ ID NO: 61898 - RNA, 20 nt, Artificial Sequence
  MKO10061898_A_mmu-mir-6343
  gRNA
agcuauuuauugcagaaaag

SEQ ID NO: 61899 - RNA, 20 nt, Artificial Sequence
  MKO10061899_A_mmu-mir-6352
  gRNA
ccaucuccucccaccucaga

SEQ ID NO: 61900 - RNA, 20 nt, Artificial Sequence
  MKO10061900_A_mmu-mir-6352
  gRNA
ugucacuaaggacaagucuc

SEQ ID NO: 61901 - RNA, 20 nt, Artificial Sequence
  MKO10061901_A_mmu-mir-6352
  gRNA
gucucaggauucaccagagc

SEQ ID NO: 61902 - RNA, 20 nt, Artificial Sequence
  MKO10061902_A_mmu-mir-6352
  gRNA
ccuucugaggugggaggaga

SEQ ID NO: 61903 - RNA, 20 nt, Artificial Sequence
  MKO10061903_A_mmu-mir-6344
  gRNA
uuuccuacuguuucccuuuu

SEQ ID NO: 61904 - RNA, 20 nt, Artificial Sequence
  MKO10061904_A_mmu-mir-6344
  gRNA
uguguugagcucauuugugg

SEQ ID NO: 61905 - RNA, 20 nt, Artificial Sequence
  MKO10061905_A_mmu-mir-6344
  gRNA
auuugugguggcauccagag

SEQ ID NO: 61906 - RNA, 20 nt, Artificial Sequence
  MKO10061906_A_mmu-mir-6344
  gRNA
cagaguggagaugggagaac

SEQ ID NO: 61907 - RNA, 20 nt, Artificial Sequence
  MKO10061907_A_mmu-mir-6353
  gRNA
ugaaaauguaauguuuaccc

SEQ ID NO: 61908 - RNA, 20 nt, Artificial Sequence
  MKO10061908_A_mmu-mir-6353
  gRNA
uucuaccagacacacacucc

SEQ ID NO: 61909 - RNA, 20 nt, Artificial Sequence
  MKO10061909_A_mmu-mir-6353
  gRNA
acacacuccuggcucucucc

SEQ ID NO: 61910 - RNA, 20 nt, Artificial Sequence
  MKO10061910_A_mmu-mir-6353
  gRNA
uucuaaucccuacccuuaau

SEQ ID NO: 61911 - RNA, 20 nt, Artificial Sequence
  MKO10061911_A_mmu-mir-5126
  gRNA
ccugcagcugcgggagcccg

SEQ ID NO: 61912 - RNA, 20 nt, Artificial Sequence
  MKO10061912_A_mmu-mir-5126
  gRNA
cgugguuccccgggcaaccg

SEQ ID NO: 61913 - RNA, 20 nt, Artificial Sequence
  MKO10061913_A_mmu-mir-5126
  gRNA
guuccccgggcaaccgcggg

SEQ ID NO: 61914 - RNA, 20 nt, Artificial Sequence
  MKO10061914_A_mmu-mir-5126
  gRNA
uccccgggcaaccgcgggcg

SEQ ID NO: 61915 - RNA, 20 nt, Artificial Sequence
  MKO10061915_A_mmu-mir-8096
  gRNA
caggucucaguaagaacuca

SEQ ID NO: 61916 - RNA, 20 nt, Artificial Sequence
  MKO10061916_A_mmu-mir-8096
  gRNA
acucaaggccgugacuugac

SEQ ID NO: 61917 - RNA, 20 nt, Artificial Sequence
  MKO10061917_A_mmu-mir-8096
  gRNA
ggccgugacuugacugggca

SEQ ID NO: 61918 - RNA, 20 nt, Artificial Sequence
  MKO10061918_A_mmu-mir-8096
  gRNA
gcacgguagcugaagaguac

SEQ ID NO: 61919 - RNA, 20 nt, Artificial Sequence
  MKO10061919_A_mmu-mir-3535
  gRNA
aucagaacuugacuaucuag

SEQ ID NO: 61920 - RNA, 20 nt, Artificial Sequence
  MKO10061920_A_mmu-mir-3535
  gRNA
gauuucaucaauuauuucuc

SEQ ID NO: 61921 - RNA, 20 nt, Artificial Sequence
  MKO10061921_A_mmu-mir-3535
  gRNA
guugcugagaaaaugacaac

SEQ ID NO: 61922 - RNA, 20 nt, Artificial Sequence
  MKO10061922_A_mmu-mir-3535
  gRNA
cugcuuugaguugacauagc

SEQ ID NO: 61923 - RNA, 20 nt, Artificial Sequence
  MKO10061923_A_mmu-mir-6900
  gRNA
aucagaguccagacggcucu

SEQ ID NO: 61924 - RNA, 20 nt, Artificial Sequence
  MKO10061924_A_mmu-mir-6900
  gRNA
uagagccgucuggacucuga

SEQ ID NO: 61925 - RNA, 20 nt, Artificial Sequence
  MKO10061925_A_mmu-mir-6900
  gRNA
gguauagauccucaugugcc

SEQ ID NO: 61926 - RNA, 20 nt, Artificial Sequence
  MKO10061926_A_mmu-mir-6900
  gRNA
caucaccaucagaguccaga

SEQ ID NO: 61927 - RNA, 20 nt, Artificial Sequence
  MKO10061927_A_mmu-mir-149
  gRNA
acucccguguuuguccgagg

SEQ ID NO: 61928 - RNA, 20 nt, Artificial Sequence
  MKO10061928_A_mmu-mir-149
  gRNA
guuuguccgaggagggaggg

SEQ ID NO: 61929 - RNA, 20 nt, Artificial Sequence
  MKO10061929_A_mmu-mir-149
  gRNA
uccgaggagggagggaggga

SEQ ID NO: 61930 - RNA, 20 nt, Artificial Sequence
  MKO10061930_A_mmu-mir-149
  gRNA
gagggagggagggacggggg

SEQ ID NO: 61931 - RNA, 20 nt, Artificial Sequence
  MKO10061931_A_mmu-mir-6901
  gRNA
agcuaagugcaggaaugcag

SEQ ID NO: 61932 - RNA, 20 nt, Artificial Sequence
  MKO10061932_A_mmu-mir-6901
  gRNA
caggaaugcagaggaccucg

SEQ ID NO: 61933 - RNA, 20 nt, Artificial Sequence
  MKO10061933_A_mmu-mir-6901
  gRNA
cagaagguccuuucaccacg

SEQ ID NO: 61934 - RNA, 20 nt, Artificial Sequence
  MKO10061934_A_mmu-mir-6901
  gRNA
gggagcugcaagaacacaga

SEQ ID NO: 61935 - RNA, 20 nt, Artificial Sequence
  MKO10061935_A_mmu-mir-6902
  gRNA
aauugucaccaugugaugug

SEQ ID NO: 61936 - RNA, 20 nt, Artificial Sequence
  MKO10061936_A_mmu-mir-6902
  gRNA
cuacuucaugugacaaugug

SEQ ID NO: 61937 - RNA, 20 nt, Artificial Sequence
  MKO10061937_A_mmu-mir-6902
  gRNA
aacugaacccacacaucaca

SEQ ID NO: 61938 - RNA, 20 nt, Artificial Sequence
  MKO10061938_A_mmu-mir-6902
  gRNA
gauguguggguucaguugac

SEQ ID NO: 61939 - RNA, 20 nt, Artificial Sequence
  MKO10061939_A_mmu-mir-6345
  gRNA
guguuagucuagcacugcuc

SEQ ID NO: 61940 - RNA, 20 nt, Artificial Sequence
  MKO10061940_A_mmu-mir-6345
  gRNA
guacagugugugguaguacu

SEQ ID NO: 61941 - RNA, 20 nt, Artificial Sequence
  MKO10061941_A_mmu-mir-6345
  gRNA
ugguaguacuagguucucca

SEQ ID NO: 61942 - RNA, 20 nt, Artificial Sequence
  MKO10061942_A_mmu-mir-6345
  gRNA
acacaggcauaaaugaaacu

SEQ ID NO: 61943 - RNA, 20 nt, Artificial Sequence
  MKO10061943_A_mmu-mir-3473f
  gRNA
auguauugaaaacaacaaag

SEQ ID NO: 61944 - RNA, 20 nt, Artificial Sequence
  MKO10061944_A_mmu-mir-3473f
  gRNA
auugaaaacaacaaaggggc

SEQ ID NO: 61945 - RNA, 20 nt, Artificial Sequence
  MKO10061945_A_mmu-mir-3473f
  gRNA
caacaaaggggcuggagaga

SEQ ID NO: 61946 - RNA, 20 nt, Artificial Sequence
  MKO10061946_A_mmu-mir-3473f
  gRNA
gggcuggagagauggcucag

SEQ ID NO: 61947 - RNA, 20 nt, Artificial Sequence
  MKO10061947_A_mmu-mir-6346
  gRNA
auaaagccagauacgauagc

SEQ ID NO: 61948 - RNA, 20 nt, Artificial Sequence
  MKO10061948_A_mmu-mir-6346
  gRNA
caggugucugcaaugccaaa

SEQ ID NO: 61949 - RNA, 20 nt, Artificial Sequence
  MKO10061949_A_mmu-mir-6346
  gRNA
uaucguaucuggcuuuauau

SEQ ID NO: 61950 - RNA, 20 nt, Artificial Sequence
  MKO10061950_A_mmu-mir-6346
  gRNA
augacccaaguccagaucgu

SEQ ID NO: 61951 - RNA, 20 nt, Artificial Sequence
  MKO10061951_A_mmu-mir-128-1
  gRNA
ucuuccugagcuguuggauu

SEQ ID NO: 61952 - RNA, 20 nt, Artificial Sequence
  MKO10061952_A_mmu-mir-128-1
  gRNA
uuacauuucucacagugaac

SEQ ID NO: 61953 - RNA, 20 nt, Artificial Sequence
  MKO10061953_A_mmu-mir-128-1
  gRNA
gaagcagcugaaaaagagac

SEQ ID NO: 61954 - RNA, 20 nt, Artificial Sequence
  MKO10061954_A_mmu-mir-128-1
  gRNA
uuccugagcuguuggauucg

SEQ ID NO: 61955 - RNA, 20 nt, Artificial Sequence
  MKO10061955_A_mmu-mir-135b
  gRNA
cuccgcucugcuguggccua

SEQ ID NO: 61956 - RNA, 20 nt, Artificial Sequence
  MKO10061956_A_mmu-mir-135b
  gRNA
uugcugcuccgaacucaugu

SEQ ID NO: 61957 - RNA, 20 nt, Artificial Sequence
  MKO10061957_A_mmu-mir-135b
  gRNA
ucauguagggcuaaaagcca

SEQ ID NO: 61958 - RNA, 20 nt, Artificial Sequence
  MKO10061958_A_mmu-mir-135b
  gRNA
aaaagccaugggcuacagug

SEQ ID NO: 61959 - RNA, 20 nt, Artificial Sequence
  MKO10061959_A_mmu-mir-6903
  gRNA
gcgugccaccugaagacaug

SEQ ID NO: 61960 - RNA, 20 nt, Artificial Sequence
  MKO10061960_A_mmu-mir-6903
  gRNA
uaaguacugcuuuucccaaa

SEQ ID NO: 61961 - RNA, 20 nt, Artificial Sequence
  MKO10061961_A_mmu-mir-6903
  gRNA
cgugugugucuguuuuuccc

SEQ ID NO: 61962 - RNA, 20 nt, Artificial Sequence
  MKO10061962_A_mmu-mir-6903
  gRNA
acuuaccacaugucuucagg

SEQ ID NO: 61963 - RNA, 20 nt, Artificial Sequence
  MKO10061963_A_mmu-mir-1231
  gRNA
gugggcagaacagacagggc

SEQ ID NO: 61964 - RNA, 20 nt, Artificial Sequence
  MKO10061964_A_mmu-mir-1231
  gRNA
agacagggcagguggcaggg

SEQ ID NO: 61965 - RNA, 20 nt, Artificial Sequence
  MKO10061965_A_mmu-mir-1231
  gRNA
ggcaggguggcagagauguc

SEQ ID NO: 61966 - RNA, 20 nt, Artificial Sequence
  MKO10061966_A_mmu-mir-1231
  gRNA
gcaggagagaagggcagggc

SEQ ID NO: 61967 - RNA, 20 nt, Artificial Sequence
  MKO10061967_A_mmu-mir-181a-1
  gRNA
aggguacaaucaacggucga

SEQ ID NO: 61968 - RNA, 20 nt, Artificial Sequence
  MKO10061968_A_mmu-mir-181a-1
  gRNA
uagcuauaggguacaaucaa

SEQ ID NO: 61969 - RNA, 20 nt, Artificial Sequence
  MKO10061969_A_mmu-mir-181a-1
  gRNA
cagugaacauucaacgcugu

SEQ ID NO: 61970 - RNA, 20 nt, Artificial Sequence
  MKO10061970_A_mmu-mir-181a-1
  gRNA
uucaacgcugucggugaguu

SEQ ID NO: 61971 - RNA, 20 nt, Artificial Sequence
  MKO10061971_A_mmu-mir-181b-1
  gRNA
ucaacauucauugcugucgg

SEQ ID NO: 61972 - RNA, 20 nt, Artificial Sequence
  MKO10061972_A_mmu-mir-181b-1
  gRNA
caaucaacauucauugcugu

SEQ ID NO: 61973 - RNA, 20 nt, Artificial Sequence
  MKO10061973_A_mmu-mir-181b-1
  gRNA
cugaacaaugaaugcaacug

SEQ ID NO: 61974 - RNA, 20 nt, Artificial Sequence
  MKO10061974_A_mmu-mir-7682
  gRNA
agugcauuuguccugugggu

SEQ ID NO: 61975 - RNA, 20 nt, Artificial Sequence
  MKO10061975_A_mmu-mir-7682
  gRNA
auuuguccuguggguugggu

SEQ ID NO: 61976 - RNA, 20 nt, Artificial Sequence
  MKO10061976_A_mmu-mir-7682
  gRNA
acaaaugcacucaguuucug

SEQ ID NO: 61977 - RNA, 20 nt, Artificial Sequence
  MKO10061977_A_mmu-mir-7682
  gRNA
ccaaagccaacccaacccac

SEQ ID NO: 61978 - RNA, 20 nt, Artificial Sequence
  MKO10061978_A_mmu-mir-8114
  gRNA
cagccagcgacccugcagag

SEQ ID NO: 61979 - RNA, 20 nt, Artificial Sequence
  MKO10061979_A_mmu-mir-8114
  gRNA
cugcagggucgcuggcugcu

SEQ ID NO: 61980 - RNA, 20 nt, Artificial Sequence
  MKO10061980_A_mmu-mir-8114
  gRNA
ucuccgcucugcagggucgc

SEQ ID NO: 61981 - RNA, 20 nt, Artificial Sequence
  MKO10061981_A_mmu-mir-8114
  gRNA
cucccauucuccgcucugca

SEQ ID NO: 61982 - RNA, 20 nt, Artificial Sequence
  MKO10061982_A_mmu-mir-488
  gRNA
aaguuuccauguuguuugaa

SEQ ID NO: 61983 - RNA, 20 nt, Artificial Sequence
  MKO10061983_A_mmu-mir-488
  gRNA
uuguuugaaaggcuguuucu

SEQ ID NO: 61984 - RNA, 20 nt, Artificial Sequence
  MKO10061984_A_mmu-mir-488
  gRNA
agaagacucucaauuucuuc

SEQ ID NO: 61985 - RNA, 20 nt, Artificial Sequence
  MKO10061985_A_mmu-mir-488
  gRNA
aaacagccuuucaaacaaca

SEQ ID NO: 61986 - RNA, 20 nt, Artificial Sequence
  MKO10061986_A_mmu-mir-1843b
  gRNA
gcaauccuacaucaacaugg

SEQ ID NO: 61987 - RNA, 20 nt, Artificial Sequence
  MKO10061987_A_mmu-mir-1843b
  gRNA
uggaggucucugucugacuu

SEQ ID NO: 61988 - RNA, 20 nt, Artificial Sequence
  MKO10061988_A_mmu-mir-1843b
  gRNA
auucaaaagguuguauggag

SEQ ID NO: 61989 - RNA, 20 nt, Artificial Sequence
  MKO10061989_A_mmu-mir-1843b
  gRNA
aaauucaaaagguuguaugg

SEQ ID NO: 61990 - RNA, 20 nt, Artificial Sequence
  MKO10061990_A_mmu-mir-1927
  gRNA
gaucugaaccuacaugcaca

SEQ ID NO: 61991 - RNA, 20 nt, Artificial Sequence
  MKO10061991_A_mmu-mir-1927
  gRNA
uauguuuaccaugugcaugu

SEQ ID NO: 61992 - RNA, 20 nt, Artificial Sequence
  MKO10061992_A_mmu-mir-1927
  gRNA
cuggcuguucuuguagagag

SEQ ID NO: 61993 - RNA, 20 nt, Artificial Sequence
  MKO10061993_A_mmu-mir-1927
  gRNA
guucagucccuaacauccag

SEQ ID NO: 61994 - RNA, 20 nt, Artificial Sequence
  MKO10061994_A_mmu-mir-199a-2
  gRNA
cacacaccgauggaagcuuc

SEQ ID NO: 61995 - RNA, 20 nt, Artificial Sequence
  MKO10061995_A_mmu-mir-199a-2
  gRNA
uuguacaguagucugcacau

SEQ ID NO: 61996 - RNA, 20 nt, Artificial Sequence
  MKO10061996_A_mmu-mir-199a-2
  gRNA
cacauugguuagacugggca

SEQ ID NO: 61997 - RNA, 20 nt, Artificial Sequence
  MKO10061997_A_mmu-mir-199a-2
  gRNA
gaacacuggggcgacggagc

SEQ ID NO: 61998 - RNA, 20 nt, Artificial Sequence
  MKO10061998_A_mmu-mir-214
  gRNA
cauccgcucaccuguacagc

SEQ ID NO: 61999 - RNA, 20 nt, Artificial Sequence
  MKO10061999_A_mmu-mir-214
  gRNA
ccuguacagcaggcacagac

SEQ ID NO: 62000 - RNA, 20 nt, Artificial Sequence
  MKO10062000_A_mmu-mir-214
  gRNA
caugacaacucuguccagcc

SEQ ID NO: 62001 - RNA, 20 nt, Artificial Sequence
  MKO10062001_A_mmu-mir-214
  gRNA
ucugcacagcaaguguagac

SEQ ID NO: 62002 - RNA, 20 nt, Artificial Sequence
  MKO10062002_A_mmu-mir-6347
  gRNA
uggcuggagaugcuugggcu

SEQ ID NO: 62003 - RNA, 20 nt, Artificial Sequence
  MKO10062003_A_mmu-mir-6347
  gRNA
guucugaaucaggaauucag

SEQ ID NO: 62004 - RNA, 20 nt, Artificial Sequence
  MKO10062004_A_mmu-mir-6347
  gRNA
uuccugauucagaacuucug

SEQ ID NO: 62005 - RNA, 20 nt, Artificial Sequence
  MKO10062005_A_mmu-mir-6347
  gRNA
aauuccugauucagaacuuc

SEQ ID NO: 62006 - RNA, 20 nt, Artificial Sequence
  MKO10062006_A_mmu-mir-6348
  gRNA
cugauuggcugaggcacaaa

SEQ ID NO: 62007 - RNA, 20 nt, Artificial Sequence
  MKO10062007_A_mmu-mir-6348
  gRNA
uacauucuaguccugggcuu

SEQ ID NO: 62008 - RNA, 20 nt, Artificial Sequence
  MKO10062008_A_mmu-mir-6348
  gRNA
aguccugggcuuuggguaga

SEQ ID NO: 62009 - RNA, 20 nt, Artificial Sequence
  MKO10062009_A_mmu-mir-6348
  gRNA
gggcuuuggguagaaggaac

SEQ ID NO: 62010 - RNA, 20 nt, Artificial Sequence
  MKO10062010_A_mmu-mir-6354
  gRNA
ccccaacaaguaagacuucc

SEQ ID NO: 62011 - RNA, 20 nt, Artificial Sequence
  MKO10062011_A_mmu-mir-6354
  gRNA
aaccaggaagucuuacuugu

SEQ ID NO: 62012 - RNA, 20 nt, Artificial Sequence
  MKO10062012_A_mmu-mir-6354
  gRNA
aggguugagagacugcaacc

SEQ ID NO: 62013 - RNA, 20 nt, Artificial Sequence
  MKO10062013_A_mmu-mir-6354
  gRNA
ucucugucuuuggagcucca

SEQ ID NO: 62014 - RNA, 20 nt, Artificial Sequence
  MKO10062014_A_mmu-mir-6546
  gRNA
aaguaaaaaggucuggcgcu

SEQ ID NO: 62015 - RNA, 20 nt, Artificial Sequence
  MKO10062015_A_mmu-mir-6546
  gRNA
cuucgcucgcuagcgcagcc

SEQ ID NO: 62016 - RNA, 20 nt, Artificial Sequence
  MKO10062016_A_mmu-mir-6546
  gRNA
agcacaagcucagaggcgcc

SEQ ID NO: 62017 - RNA, 20 nt, Artificial Sequence
  MKO10062017_A_mmu-mir-6546
  gRNA
cugagcuugugcuugucgcc

SEQ ID NO: 62018 - RNA, 20 nt, Artificial Sequence
  MKO10062018_A_mmu-mir-7683
  gRNA
cucacuggaaagguggaaca

SEQ ID NO: 62019 - RNA, 20 nt, Artificial Sequence
  MKO10062019_A_mmu-mir-7683
  gRNA
cucauaacucacuggaaagg

SEQ ID NO: 62020 - RNA, 20 nt, Artificial Sequence
  MKO10062020_A_mmu-mir-7683
  gRNA
auucucauaacucacuggaa

SEQ ID NO: 62021 - RNA, 20 nt, Artificial Sequence
  MKO10062021_A_mmu-mir-7683
  gRNA
cugggauucucauaacucac

SEQ ID NO: 62022 - RNA, 20 nt, Artificial Sequence
  MKO10062022_A_mmu-mir-350
  gRNA
gcaagcugcaacucuccuaa

SEQ ID NO: 62023 - RNA, 20 nt, Artificial Sequence
  MKO10062023_A_mmu-mir-350
  gRNA
uccuaaagggugaaagugua

SEQ ID NO: 62024 - RNA, 20 nt, Artificial Sequence
  MKO10062024_A_mmu-mir-350
  gRNA
cgcaugcacuuuacucuugu

SEQ ID NO: 62025 - RNA, 20 nt, Artificial Sequence
  MKO10062025_A_mmu-mir-350
  gRNA
acuuuacucuuguaggagca

SEQ ID NO: 62026 - RNA, 20 nt, Artificial Sequence
  MKO10062026_A_mmu-mir-6904
  gRNA
ugccuccauucauccuuucc

SEQ ID NO: 62027 - RNA, 20 nt, Artificial Sequence
  MKO10062027_A_mmu-mir-6904
  gRNA
uuccugggguuagaguugag

SEQ ID NO: 62028 - RNA, 20 nt, Artificial Sequence
  MKO10062028_A_mmu-mir-6904
  gRNA
gaccacucaacucuaacccc

SEQ ID NO: 62029 - RNA, 20 nt, Artificial Sequence
  MKO10062029_A_mmu-mir-6904
  gRNA
guuagacaggggcuugucug

SEQ ID NO: 62030 - RNA, 20 nt, Artificial Sequence
  MKO10062030_A_mmu-mir-1981
  gRNA
gaacgcaccugucaaaggcc

SEQ ID NO: 62031 - RNA, 20 nt, Artificial Sequence
  MKO10062031_A_mmu-mir-1981
  gRNA
ugucaaaggccaggguuaga

SEQ ID NO: 62032 - RNA, 20 nt, Artificial Sequence
  MKO10062032_A_mmu-mir-1981
  gRNA
caaaggccaggguuagaugg

SEQ ID NO: 62033 - RNA, 20 nt, Artificial Sequence
  MKO10062033_A_mmu-mir-1981
  gRNA
gucuaagcccagccuuuacc

SEQ ID NO: 62034 - RNA, 20 nt, Artificial Sequence
  MKO10062034_A_mmu-mir-664
  gRNA
uggaacauugaagcuggcug

SEQ ID NO: 62035 - RNA, 20 nt, Artificial Sequence
  MKO10062035_A_mmu-mir-664
  gRNA
agcuggcuggggaaaaugac

SEQ ID NO: 62036 - RNA, 20 nt, Artificial Sequence
  MKO10062036_A_mmu-mir-664
  gRNA
uugcuuucauguguaggcug

SEQ ID NO: 62037 - RNA, 20 nt, Artificial Sequence
  MKO10062037_A_mmu-mir-664
  gRNA
uauugcuuucauguguaggc

SEQ ID NO: 62038 - RNA, 20 nt, Artificial Sequence
  MKO10062038_A_mmu-mir-194-1
  gRNA
gguguaacagcaacuccaug

SEQ ID NO: 62039 - RNA, 20 nt, Artificial Sequence
  MKO10062039_A_mmu-mir-194-1
  gRNA
ggacugugcucggauuccag

SEQ ID NO: 62040 - RNA, 20 nt, Artificial Sequence
  MKO10062040_A_mmu-mir-194-1
  gRNA
ggagcugcuguuacuucuga

SEQ ID NO: 62041 - RNA, 20 nt, Artificial Sequence
  MKO10062041_A_mmu-mir-194-1
  gRNA
agaaguaacagcagcuccac

SEQ ID NO: 62042 - RNA, 20 nt, Artificial Sequence
  MKO10062042_A_mmu-mir-215
  gRNA
gacagacauacacagcugca

SEQ ID NO: 62043 - RNA, 20 nt, Artificial Sequence
  MKO10062043_A_mmu-mir-215
  gRNA
cacggagcucucagcaucaa

SEQ ID NO: 62044 - RNA, 20 nt, Artificial Sequence
  MKO10062044_A_mmu-mir-215
  gRNA
ucucagcaucaacgguguac

SEQ ID NO: 62045 - RNA, 20 nt, Artificial Sequence
  MKO10062045_A_mmu-mir-215
  gRNA
guguaugucugucauucugu

SEQ ID NO: 62046 - RNA, 20 nt, Artificial Sequence
  MKO10062046_A_mmu-mir-3473c
  gRNA
uacauuuaaaagacuuauua

SEQ ID NO: 62047 - RNA, 20 nt, Artificial Sequence
  MKO10062047_A_mmu-mir-3473c
  gRNA
cauuuaaaagacuuauuaug

SEQ ID NO: 62048 - RNA, 20 nt, Artificial Sequence
  MKO10062048_A_mmu-mir-3473c
  gRNA
aaaagacuuauuaugggggc

SEQ ID NO: 62049 - RNA, 20 nt, Artificial Sequence
  MKO10062049_A_mmu-mir-3473c
  gRNA
uauuaugggggcuggagaga

SEQ ID NO: 62050 - RNA, 20 nt, Artificial Sequence
  MKO10062050_A_mmu-mir-205
  gRNA
ucacuccacugaaaucuggu

SEQ ID NO: 62051 - RNA, 20 nt, Artificial Sequence
  MKO10062051_A_mmu-mir-205
  gRNA
gguuggcauaagacagacuc

SEQ ID NO: 62052 - RNA, 20 nt, Artificial Sequence
  MKO10062052_A_mmu-mir-205
  gRNA
ccgguggaaugaaggacaag

SEQ ID NO: 62053 - RNA, 20 nt, Artificial Sequence
  MKO10062053_A_mmu-mir-205
  gRNA
ucaguggagugaagcucagg

SEQ ID NO: 62054 - RNA, 20 nt, Artificial Sequence
  MKO10062054_A_mmu-mir-3962
  gRNA
agaaauguacucugccacgu

SEQ ID NO: 62055 - RNA, 20 nt, Artificial Sequence
  MKO10062055_A_mmu-mir-3962
  gRNA
acuacuaccuagcuccuacg

SEQ ID NO: 62056 - RNA, 20 nt, Artificial Sequence
  MKO10062056_A_mmu-mir-3962
  gRNA
uacucugccacguaggagcu

SEQ ID NO: 62057 - RNA, 20 nt, Artificial Sequence
  MKO10062057_A_mmu-mir-3962
  gRNA
uacauuucuuacucccucug

SEQ ID NO: 62058 - RNA, 20 nt, Artificial Sequence
  MKO10062058_A_mmu-mir-29b-2
  gRNA
uucuggaagcugguuucaca

SEQ ID NO: 62059 - RNA, 20 nt, Artificial Sequence
  MKO10062059_A_mmu-mir-29b-2
  gRNA
uggaagcugguuucacaugg

SEQ ID NO: 62060 - RNA, 20 nt, Artificial Sequence
  MKO10062060_A_mmu-mir-29b-2
  gRNA
ccuaaaacacugauuucaaa

SEQ ID NO: 62061 - RNA, 20 nt, Artificial Sequence
  MKO10062061_A_mmu-mir-29b-2
  gRNA
gauccucuucuucuggaagc

SEQ ID NO: 62062 - RNA, 20 nt, Artificial Sequence
  MKO10062062_A_mmu-mir-29c
  gRNA
agucgguccaucucuuacac

SEQ ID NO: 62063 - RNA, 20 nt, Artificial Sequence
  MKO10062063_A_mmu-mir-29c
  gRNA
acaggcugaccgauuucucc

SEQ ID NO: 62064 - RNA, 20 nt, Artificial Sequence
  MKO10062064_A_mmu-mir-29c
  gRNA
ugucuagcaccauuugaaau

SEQ ID NO: 62065 - RNA, 20 nt, Artificial Sequence
  MKO10062065_A_mmu-mir-29c
  gRNA
ugaaaucgguuaugauguag

SEQ ID NO: 62066 - RNA, 20 nt, Artificial Sequence
  MKO10062066_A_mmu-mir-5104
  gRNA
cucagagcucuuaaauguug

SEQ ID NO: 62067 - RNA, 20 nt, Artificial Sequence
  MKO10062067_A_mmu-mir-5104
  gRNA
ccaauuguucugugcuagug

SEQ ID NO: 62068 - RNA, 20 nt, Artificial Sequence
  MKO10062068_A_mmu-mir-5104
  gRNA
auuguucugugcuagugagg

SEQ ID NO: 62069 - RNA, 20 nt, Artificial Sequence
  MKO10062069_A_mmu-mir-5104
  gRNA
gcuagugagguggcucagca

SEQ ID NO: 62070 - RNA, 20 nt, Artificial Sequence
  MKO10062070_A_mmu-mir-6413
  gRNA
uaaugagagaaacuuaggca

SEQ ID NO: 62071 - RNA, 20 nt, Artificial Sequence
  MKO10062071_A_mmu-mir-6413
  gRNA
agagaaacuuaggcaaggac

SEQ ID NO: 62072 - RNA, 20 nt, Artificial Sequence
  MKO10062072_A_mmu-mir-6413
  gRNA
aacuuaggcaaggacaggca

SEQ ID NO: 62073 - RNA, 20 nt, Artificial Sequence
  MKO10062073_A_mmu-mir-6413
  gRNA
caggcaagggcuucacuugg

SEQ ID NO: 62074 - RNA, 20 nt, Artificial Sequence
  MKO10062074_A_mmu-mir-7663
  gRNA
gugaagaagucccacgacag

SEQ ID NO: 62075 - RNA, 20 nt, Artificial Sequence
  MKO10062075_A_mmu-mir-7663
  gRNA
ucuucacaguguggaucaua

SEQ ID NO: 62076 - RNA, 20 nt, Artificial Sequence
  MKO10062076_A_mmu-mir-7663
  gRNA
cgugggacuucuucacagug

SEQ ID NO: 62077 - RNA, 20 nt, Artificial Sequence
  MKO10062077_A_mmu-mir-7663
  gRNA
uggugaucauccacugucgu

SEQ ID NO: 62078 - RNA, 20 nt, Artificial Sequence
  MKO10062078_A_mmu-mir-6905
  gRNA
gucagugugggagacugggc

SEQ ID NO: 62079 - RNA, 20 nt, Artificial Sequence
  MKO10062079_A_mmu-mir-6905
  gRNA
gugugggagacugggcaggu

SEQ ID NO: 62080 - RNA, 20 nt, Artificial Sequence
  MKO10062080_A_mmu-mir-6905
  gRNA
gccaaucuaucgggcagaua

SEQ ID NO: 62081 - RNA, 20 nt, Artificial Sequence
  MKO10062081_A_mmu-mir-6905
  gRNA
cccgugucagugugggagac

SEQ ID NO: 62082 - RNA, 20 nt, Artificial Sequence
  MKO10062082_A_mmu-mir-3473b
  gRNA
caagauuagguuuuaagggc

SEQ ID NO: 62083 - RNA, 20 nt, Artificial Sequence
  MKO10062083_A_mmu-mir-3473b
  gRNA
gguuuuaagggcuggagaga

SEQ ID NO: 62084 - RNA, 20 nt, Artificial Sequence
  MKO10062084_A_mmu-mir-3473b
  gRNA
gggcuggagagauggcucag

SEQ ID NO: 62085 - RNA, 20 nt, Artificial Sequence
  MKO10062085_A_mmu-mir-3473b
  gRNA
cuaaucuugggcuggagaga

SEQ ID NO: 62086 - RNA, 20 nt, Artificial Sequence
  MKO10062086_A_mmu-mir-1929
  gRNA
agugggauccugauuagaac

SEQ ID NO: 62087 - RNA, 20 nt, Artificial Sequence
  MKO10062087_A_mmu-mir-1929
  gRNA
ggauccugauuagaacuggg

SEQ ID NO: 62088 - RNA, 20 nt, Artificial Sequence
  MKO10062088_A_mmu-mir-1929
  gRNA
ucuaggacuuuauagagcag

SEQ ID NO: 62089 - RNA, 20 nt, Artificial Sequence
  MKO10062089_A_mmu-mir-1929
  gRNA
agccugugacacucagcuca

SEQ ID NO: 62090 - RNA, 20 nt, Artificial Sequence
  MKO10062090_A_mmu-mir-6906
  gRNA
gaaauacauagagagaugga

SEQ ID NO: 62091 - RNA, 20 nt, Artificial Sequence
  MKO10062091_A_mmu-mir-6906
  gRNA
gaggagaccggaauucaggu

SEQ ID NO: 62092 - RNA, 20 nt, Artificial Sequence
  MKO10062092_A_mmu-mir-6906
  gRNA
gcucuuguccaacccuggag

SEQ ID NO: 62093 - RNA, 20 nt, Artificial Sequence
  MKO10062093_A_mmu-mir-6906
  gRNA
uagagagauggaugggcaga

SEQ ID NO: 62094 - RNA, 20 nt, Artificial Sequence
  MKO10062094_A_mmu-mir-6408
  gRNA
aaagggacuggccaaggcac

SEQ ID NO: 62095 - RNA, 20 nt, Artificial Sequence
  MKO10062095_A_mmu-mir-6408
  gRNA
ggacuggccaaggcacaggg

SEQ ID NO: 62096 - RNA, 20 nt, Artificial Sequence
  MKO10062096_A_mmu-mir-6408
  gRNA
cagcuacagcagggaugcua

SEQ ID NO: 62097 - RNA, 20 nt, Artificial Sequence
  MKO10062097_A_mmu-mir-6408
  gRNA
uauggccacaugggcuugca

SEQ ID NO: 62098 - RNA, 20 nt, Artificial Sequence
  MKO10062098_A_mmu-mir-5108
  gRNA
uguucuuaccauucccucug

SEQ ID NO: 62099 - RNA, 20 nt, Artificial Sequence
  MKO10062099_A_mmu-mir-5108
  gRNA
ggccucgggggacccaaugg

SEQ ID NO: 62100 - RNA, 20 nt, Artificial Sequence
  MKO10062100_A_mmu-mir-5108
  gRNA
acccaauggugguagagcac

SEQ ID NO: 62101 - RNA, 20 nt, Artificial Sequence
  MKO10062101_A_mmu-mir-5108
  gRNA
aauggugguagagcacugga

SEQ ID NO: 62102 - RNA, 20 nt, Artificial Sequence
  MKO10062102_A_mmu-mir-7662
  gRNA
ugaagcaguaugcuggaucc

SEQ ID NO: 62103 - RNA, 20 nt, Artificial Sequence
  MKO10062103_A_mmu-mir-7662
  gRNA
gcuucagagcuggagccagg

SEQ ID NO: 62104 - RNA, 20 nt, Artificial Sequence
  MKO10062104_A_mmu-mir-7662
  gRNA
gaucugggagggcugaggcc

SEQ ID NO: 62105 - RNA, 20 nt, Artificial Sequence
  MKO10062105_A_mmu-mir-7662
  gRNA
gccaggaucugggagggcug

SEQ ID NO: 62106 - RNA, 20 nt, Artificial Sequence
  MKO10062106_A_mmu-mir-7215
  gRNA
ugcucugagaggcagaaaag

SEQ ID NO: 62107 - RNA, 20 nt, Artificial Sequence
  MKO10062107_A_mmu-mir-7215
  gRNA
cucugagaggcagaaaagcg

SEQ ID NO: 62108 - RNA, 20 nt, Artificial Sequence
  MKO10062108_A_mmu-mir-7215
  gRNA
agagcauuuguagcucagcu

SEQ ID NO: 62109 - RNA, 20 nt, Artificial Sequence
  MKO10062109_A_mmu-mir-7215
  gRNA
ugagcuacaaaugcucugag

SEQ ID NO: 62110 - RNA, 20 nt, Artificial Sequence
  MKO10062110_A_mmu-mir-6409
  gRNA
uaacagcuagcgcgcaugcg

SEQ ID NO: 62111 - RNA, 20 nt, Artificial Sequence
  MKO10062111_A_mmu-mir-6409
  gRNA
ccgcacaguuuguaaacacg

SEQ ID NO: 62112 - RNA, 20 nt, Artificial Sequence
  MKO10062112_A_mmu-mir-6409
  gRNA
acccgcacaguuuguaaaca

SEQ ID NO: 62113 - RNA, 20 nt, Artificial Sequence
  MKO10062113_A_mmu-mir-6409
  gRNA
ccccguguuuacaaacugug

SEQ ID NO: 62114 - RNA, 20 nt, Artificial Sequence
  MKO10062114_A_mmu-mir-678
  gRNA
ugcaccgagacacgggugca

SEQ ID NO: 62115 - RNA, 20 nt, Artificial Sequence
  MKO10062115_A_mmu-mir-678
  gRNA
ccgugucucggugcaaggac

SEQ ID NO: 62116 - RNA, 20 nt, Artificial Sequence
  MKO10062116_A_mmu-mir-678
  gRNA
ugcacccgugucucggugca

SEQ ID NO: 62117 - RNA, 20 nt, Artificial Sequence
  MKO10062117_A_mmu-mir-678
  gRNA
ccaguccuugcaccgagaca

SEQ ID NO: 62118 - RNA, 20 nt, Artificial Sequence
  MKO10062118_A_mmu-mir-1930
  gRNA
ucucuauggugcaguuacug

SEQ ID NO: 62119 - RNA, 20 nt, Artificial Sequence
  MKO10062119_A_mmu-mir-1930
  gRNA
uggugcaguuacuguggcug

SEQ ID NO: 62120 - RNA, 20 nt, Artificial Sequence
  MKO10062120_A_mmu-mir-1930
  gRNA
gguacuauggaggugaccgu

SEQ ID NO: 62121 - RNA, 20 nt, Artificial Sequence
  MKO10062121_A_mmu-mir-1930
  gRNA
gcacgcugcagguacuaugg

SEQ ID NO: 62122 - RNA, 20 nt, Artificial Sequence
  MKO10062122_A_mmu-mir-7659
  gRNA
ugaaccgacaagcugacucc

SEQ ID NO: 62123 - RNA, 20 nt, Artificial Sequence
  MKO10062123_A_mmu-mir-7659
  gRNA
gcuacacaggaaucuggagc

SEQ ID NO: 62124 - RNA, 20 nt, Artificial Sequence
  MKO10062124_A_mmu-mir-7659
  gRNA
auuccuguguagcugccucc

SEQ ID NO: 62125 - RNA, 20 nt, Artificial Sequence
  MKO10062125_A_mmu-mir-7659
  gRNA
aggucucuguaggcaggagc

SEQ ID NO: 62126 - RNA, 20 nt, Artificial Sequence
  MKO10062126_A_mmu-mir-6907
  gRNA
gggacacagggaggcucgau

SEQ ID NO: 62127 - RNA, 20 nt, Artificial Sequence
  MKO10062127_A_mmu-mir-6907
  gRNA
caggaggcuucugggacaca

SEQ ID NO: 62128 - RNA, 20 nt, Artificial Sequence
  MKO10062128_A_mmu-mir-6907
  gRNA
gugucccagaagccuccuga

SEQ ID NO: 62129 - RNA, 20 nt, Artificial Sequence
  MKO10062129_A_mmu-mir-6907
  gRNA
ccagaagccuccugaaggua

SEQ ID NO: 62130 - RNA, 20 nt, Artificial Sequence
  MKO10062130_A_mmu-mir-6410
  gRNA
ccggucccuugucuuggcuc

SEQ ID NO: 62131 - RNA, 20 nt, Artificial Sequence
  MKO10062131_A_mmu-mir-6410
  gRNA
cagggacuacucugugcucc

SEQ ID NO: 62132 - RNA, 20 nt, Artificial Sequence
  MKO10062132_A_mmu-mir-6410
  gRNA
gggacuacucugugcuccug

SEQ ID NO: 62133 - RNA, 20 nt, Artificial Sequence
  MKO10062133_A_mmu-mir-6410
  gRNA
gugcuccuggggaccuuguu

SEQ ID NO: 62134 - RNA, 20 nt, Artificial Sequence
  MKO10062134_A_mmu-mir-6908
  gRNA
acacuggggcucucccugac

SEQ ID NO: 62135 - RNA, 20 nt, Artificial Sequence
  MKO10062135_A_mmu-mir-6908
  gRNA
acacucucccuugugcuggc

SEQ ID NO: 62136 - RNA, 20 nt, Artificial Sequence
  MKO10062136_A_mmu-mir-6908
  gRNA
guccaucaccugccagcaca

SEQ ID NO: 62137 - RNA, 20 nt, Artificial Sequence
  MKO10062137_A_mmu-mir-6908
  gRNA
gagugucagcauccacacac

SEQ ID NO: 62138 - RNA, 20 nt, Artificial Sequence
  MKO10062138_A_mmu-mir-6909
  gRNA
agagaggcugugggaggccg

SEQ ID NO: 62139 - RNA, 20 nt, Artificial Sequence
  MKO10062139_A_mmu-mir-6909
  gRNA
aggcugugggaggccgggga

SEQ ID NO: 62140 - RNA, 20 nt, Artificial Sequence
  MKO10062140_A_mmu-mir-6909
  gRNA
gggaggccggggaaggcaca

SEQ ID NO: 62141 - RNA, 20 nt, Artificial Sequence
  MKO10062141_A_mmu-mir-6909
  gRNA
ggagaaccaugugccuuccc

SEQ ID NO: 62142 - RNA, 20 nt, Artificial Sequence
  MKO10062142_A_mmu-mir-6910
  gRNA
cuuugguugcaccugggggu

SEQ ID NO: 62143 - RNA, 20 nt, Artificial Sequence
  MKO10062143_A_mmu-mir-6910
  gRNA
gcagaguguccugcugcuca

SEQ ID NO: 62144 - RNA, 20 nt, Artificial Sequence
  MKO10062144_A_mmu-mir-6910
  gRNA
cccacuggugcccuaccccc

SEQ ID NO: 62145 - RNA, 20 nt, Artificial Sequence
  MKO10062145_A_mmu-mir-6910
  gRNA
cagcaggacacucugcccac

SEQ ID NO: 62146 - RNA, 20 nt, Artificial Sequence
  MKO10062146_A_mmu-mir-6911
  gRNA
cucaaucacacucuguccac

SEQ ID NO: 62147 - RNA, 20 nt, Artificial Sequence
  MKO10062147_A_mmu-mir-6911
  gRNA
ggacagagugugauugaggc

SEQ ID NO: 62148 - RNA, 20 nt, Artificial Sequence
  MKO10062148_A_mmu-mir-6911
  gRNA
accuuauggagugggcugag

SEQ ID NO: 62149 - RNA, 20 nt, Artificial Sequence
  MKO10062149_A_mmu-mir-6911
  gRNA
gagugggcugagugggucug

SEQ ID NO: 62150 - RNA, 20 nt, Artificial Sequence
  MKO10062150_A_mmu-mir-6912
  gRNA
cuauagccugaaguacaggg

SEQ ID NO: 62151 - RNA, 20 nt, Artificial Sequence
  MKO10062151_A_mmu-mir-6912
  gRNA
gaaguacagggagggugcuc

SEQ ID NO: 62152 - RNA, 20 nt, Artificial Sequence
  MKO10062152_A_mmu-mir-6912
  gRNA
agggugcucaggcaggcauc

SEQ ID NO: 62153 - RNA, 20 nt, Artificial Sequence
  MKO10062153_A_mmu-mir-6912
  gRNA
ggcaggcaucuggcuguagc

SEQ ID NO: 62154 - RNA, 20 nt, Artificial Sequence
  MKO10062154_A_mmu-mir-1982
  gRNA
agagguugguauugcuuggg

SEQ ID NO: 62155 - RNA, 20 nt, Artificial Sequence
  MKO10062155_A_mmu-mir-1982
  gRNA
gguauugcuugggagggucc

SEQ ID NO: 62156 - RNA, 20 nt, Artificial Sequence
  MKO10062156_A_mmu-mir-1982
  gRNA
ugcuugggaggguccugggg

SEQ ID NO: 62157 - RNA, 20 nt, Artificial Sequence
  MKO10062157_A_mmu-mir-1982
  gRNA
cuugggaggguccuggggag

SEQ ID NO: 62158 - RNA, 20 nt, Artificial Sequence
  MKO10062158_A_mmu-mir-5615-1
  gRNA
ucugucucagaaaacaacca

SEQ ID NO: 62159 - RNA, 20 nt, Artificial Sequence
  MKO10062159_A_mmu-mir-5615-1
  gRNA
ucugucucagaaaacaacca

SEQ ID NO: 62160 - RNA, 20 nt, Artificial Sequence
  MKO10062160_A_mmu-mir-5615-1
  gRNA
cagaaaacaaccaaggacug

SEQ ID NO: 62161 - RNA, 20 nt, Artificial Sequence
  MKO10062161_A_mmu-mir-5615-1
  gRNA
cucagaaaacaaccaaggac

SEQ ID NO: 62162 - RNA, 20 nt, Artificial Sequence
  MKO10062162_A_mmu-mir-5615-2
  gRNA
ucugucucagaaaacaacca

SEQ ID NO: 62163 - RNA, 20 nt, Artificial Sequence
  MKO10062163_A_mmu-mir-5615-2
  gRNA
ucugucucagaaaacaacca

SEQ ID NO: 62164 - RNA, 20 nt, Artificial Sequence
  MKO10062164_A_mmu-mir-5615-2
  gRNA
accaaggacugcucuuccag

SEQ ID NO: 62165 - RNA, 20 nt, Artificial Sequence
  MKO10062165_A_mmu-mir-5615-2
  gRNA
cagaaaacaaccaaggacug

SEQ ID NO: 62166 - RNA, 20 nt, Artificial Sequence
  MKO10062166_A_mmu-mir-3057
  gRNA
uguccugaaggugugugcau

SEQ ID NO: 62167 - RNA, 20 nt, Artificial Sequence
  MKO10062167_A_mmu-mir-3057
  gRNA
ggagcugagauucugcggga

SEQ ID NO: 62168 - RNA, 20 nt, Artificial Sequence
  MKO10062168_A_mmu-mir-3057
  gRNA
gagauucugcgggauggauu

SEQ ID NO: 62169 - RNA, 20 nt, Artificial Sequence
  MKO10062169_A_mmu-mir-3057
  gRNA
ggaguauauuguccucccac

SEQ ID NO: 62170 - RNA, 20 nt, Artificial Sequence
  MKO10062170_A_mmu-mir-6913
  gRNA
ugugaccugggagaccaguc

SEQ ID NO: 62171 - RNA, 20 nt, Artificial Sequence
  MKO10062171_A_mmu-mir-6913
  gRNA
cucuacugauuugucuccuc

SEQ ID NO: 62172 - RNA, 20 nt, Artificial Sequence
  MKO10062172_A_mmu-mir-6913
  gRNA
cuacugauuugucuccucag

SEQ ID NO: 62173 - RNA, 20 nt, Artificial Sequence
  MKO10062173_A_mmu-mir-6913
  gRNA
caacaccugacuggucuccc

SEQ ID NO: 62174 - RNA, 20 nt, Artificial Sequence
  MKO10062174_A_mmu-mir-1191b
  gRNA
cuugggcuacauagugaguc

SEQ ID NO: 62175 - RNA, 20 nt, Artificial Sequence
  MKO10062175_A_mmu-mir-1191b
  gRNA
acucacuauguagcccaagc

SEQ ID NO: 62176 - RNA, 20 nt, Artificial Sequence
  MKO10062176_A_mmu-mir-1191b
  gRNA
gagucugguguuuuugaagc

SEQ ID NO: 62177 - RNA, 20 nt, Artificial Sequence
  MKO10062177_A_mmu-mir-135a-2
  gRNA
aauuuucacaauguauuuca

SEQ ID NO: 62178 - RNA, 20 nt, Artificial Sequence
  MKO10062178_A_mmu-mir-135a-2
  gRNA
agacuuuauuacgaucacau

SEQ ID NO: 62179 - RNA, 20 nt, Artificial Sequence
  MKO10062179_A_mmu-mir-135a-2
  gRNA
aauaaagucucauguaggga

SEQ ID NO: 62180 - RNA, 20 nt, Artificial Sequence
  MKO10062180_A_mmu-mir-135a-2
  gRNA
gcacuagagugaauuuaucu

SEQ ID NO: 62181 - RNA, 20 nt, Artificial Sequence
  MKO10062181_A_mmu-mir-1251
  gRNA
uuaucaggccaugucuacac

SEQ ID NO: 62182 - RNA, 20 nt, Artificial Sequence
  MKO10062182_A_mmu-mir-1251
  gRNA
agcaaagcgcucuguucaga

SEQ ID NO: 62183 - RNA, 20 nt, Artificial Sequence
  MKO10062183_A_mmu-mir-1251
  gRNA
uucagaaggagaagcgccuu

SEQ ID NO: 62184 - RNA, 20 nt, Artificial Sequence
  MKO10062184_A_mmu-mir-1251
  gRNA
uugcucagccaguguagaca

SEQ ID NO: 62185 - RNA, 20 nt, Artificial Sequence
  MKO10062185_A_mmu-mir-1931
  gRNA
ugcuuuaaaauuccaaugca

SEQ ID NO: 62186 - RNA, 20 nt, Artificial Sequence
  MKO10062186_A_mmu-mir-1931
  gRNA
caaugcaagggcuggugcga

SEQ ID NO: 62187 - RNA, 20 nt, Artificial Sequence
  MKO10062187_A_mmu-mir-1931
  gRNA
agaguuaaugcuucuggccu

SEQ ID NO: 62188 - RNA, 20 nt, Artificial Sequence
  MKO10062188_A_mmu-mir-1931
  gRNA
uuaaagcagcuucaauucaa

SEQ ID NO: 62189 - RNA, 20 nt, Artificial Sequence
  MKO10062189_A_mmu-mir-7688
  gRNA
augagcucacagccaggcuc

SEQ ID NO: 62190 - RNA, 20 nt, Artificial Sequence
  MKO10062190_A_mmu-mir-7688
  gRNA
gcuaggcauaagccagagcc

SEQ ID NO: 62191 - RNA, 20 nt, Artificial Sequence
  MKO10062191_A_mmu-mir-7688
  gRNA
uauuuuuguaacagaaagcu

SEQ ID NO: 62192 - RNA, 20 nt, Artificial Sequence
  MKO10062192_A_mmu-mir-7688
  gRNA
gaucugaugagcucacagcc

SEQ ID NO: 62193 - RNA, 20 nt, Artificial Sequence
  MKO10062193_A_mmu-mir-331
  gRNA
caggaaugaugcacggguuu

SEQ ID NO: 62194 - RNA, 20 nt, Artificial Sequence
  MKO10062194_A_mmu-mir-331
  gRNA
cacggguuuagguugguucu

SEQ ID NO: 62195 - RNA, 20 nt, Artificial Sequence
  MKO10062195_A_mmu-mir-331
  gRNA
guuuagguugguucuaggau

SEQ ID NO: 62196 - RNA, 20 nt, Artificial Sequence
  MKO10062196_A_mmu-mir-331
  gRNA
ugguucuaggauaggcccag

SEQ ID NO: 62197 - RNA, 20 nt, Artificial Sequence
  MKO10062197_A_mmu-mir-7211
  gRNA
cagacacaagcucccagcgg

SEQ ID NO: 62198 - RNA, 20 nt, Artificial Sequence
  MKO10062198_A_mmu-mir-7211
  gRNA
acaagcucccagcgguggag

SEQ ID NO: 62199 - RNA, 20 nt, Artificial Sequence
  MKO10062199_A_mmu-mir-7211
  gRNA
ucccagcgguggaguggcag

SEQ ID NO: 62200 - RNA, 20 nt, Artificial Sequence
  MKO10062200_A_mmu-mir-7211
  gRNA
ucuguggagugacuguaggg

SEQ ID NO: 62201 - RNA, 20 nt, Artificial Sequence
  MKO10062201_A_mmu-mir-3058
  gRNA
aagaggcacccacggcugac

SEQ ID NO: 62202 - RNA, 20 nt, Artificial Sequence
  MKO10062202_A_mmu-mir-3058
  gRNA
aaguagacauucaaucuucc

SEQ ID NO: 62203 - RNA, 20 nt, Artificial Sequence
  MKO10062203_A_mmu-mir-3058
  gRNA
ucaaucuuccagguaagccg

SEQ ID NO: 62204 - RNA, 20 nt, Artificial Sequence
  MKO10062204_A_mmu-mir-3058
  gRNA
gcuuucuuccugucagccgu

SEQ ID NO: 62205 - RNA, 20 nt, Artificial Sequence
  MKO10062205_A_mmu-mir-3966
  gRNA
auuaaaaacaguucuacagc

SEQ ID NO: 62206 - RNA, 20 nt, Artificial Sequence
  MKO10062206_A_mmu-mir-3059
  gRNA
cccuuuccucucugccccau

SEQ ID NO: 62207 - RNA, 20 nt, Artificial Sequence
  MKO10062207_A_mmu-mir-3059
  gRNA
uguagcucuaacuacccucu

SEQ ID NO: 62208 - RNA, 20 nt, Artificial Sequence
  MKO10062208_A_mmu-mir-3059
  gRNA
acuacccucuagggaagaga

SEQ ID NO: 62209 - RNA, 20 nt, Artificial Sequence
  MKO10062209_A_mmu-mir-3059
  gRNA
ccuauggggcagagaggaaa

SEQ ID NO: 62210 - RNA, 20 nt, Artificial Sequence
  MKO10062210_A_mmu-mir-6411
  gRNA
cuguauccuugugaagauuc

SEQ ID NO: 62211 - RNA, 20 nt, Artificial Sequence
  MKO10062211_A_mmu-mir-6411
  gRNA
uucuucucuucaaacuagcc

SEQ ID NO: 62212 - RNA, 20 nt, Artificial Sequence
  MKO10062212_A_mmu-mir-6411
  gRNA
gcuacaguccacaugcaacc

SEQ ID NO: 62213 - RNA, 20 nt, Artificial Sequence
  MKO10062213_A_mmu-mir-6411
  gRNA
aacauuuugcuugauuuucc

SEQ ID NO: 62214 - RNA, 20 nt, Artificial Sequence
  MKO10062214_A_mmu-mir-763
  gRNA
cucagcaaaagacauuuccu

SEQ ID NO: 62215 - RNA, 20 nt, Artificial Sequence
  MKO10062215_A_mmu-mir-763
  gRNA
agacauuuccuuggaguuaa

SEQ ID NO: 62216 - RNA, 20 nt, Artificial Sequence
  MKO10062216_A_mmu-mir-763
  gRNA
auuuccuuggaguuaauggc

SEQ ID NO: 62217 - RNA, 20 nt, Artificial Sequence
  MKO10062217_A_mmu-mir-763
  gRNA
ccuuggaguuaauggcuggc

SEQ ID NO: 62218 - RNA, 20 nt, Artificial Sequence
  MKO10062218_A_mmu-mir-6412
  gRNA
acugccuaguuagcuugaug

SEQ ID NO: 62219 - RNA, 20 nt, Artificial Sequence
  MKO10062219_A_mmu-mir-6412
  gRNA
uacugcacuccuauaauccc

SEQ ID NO: 62220 - RNA, 20 nt, Artificial Sequence
  MKO10062220_A_mmu-mir-6412
  gRNA
cuccuauaaucccagggucu

SEQ ID NO: 62221 - RNA, 20 nt, Artificial Sequence
  MKO10062221_A_mmu-mir-6412
  gRNA
cuauaaucccagggucuugg

SEQ ID NO: 62222 - RNA, 20 nt, Artificial Sequence
  MKO10062222_A_mmu-mir-8104
  gRNA
ggaguuccucgggcugucuc

SEQ ID NO: 62223 - RNA, 20 nt, Artificial Sequence
  MKO10062223_A_mmu-mir-8104
  gRNA
ccucgggcugucucaggaug

SEQ ID NO: 62224 - RNA, 20 nt, Artificial Sequence
  MKO10062224_A_mmu-mir-8104
  gRNA
cgggcugucucaggaugagg

SEQ ID NO: 62225 - RNA, 20 nt, Artificial Sequence
  MKO10062225_A_mmu-mir-8104
  gRNA
aggagacccggcggcugccc

SEQ ID NO: 62226 - RNA, 20 nt, Artificial Sequence
  MKO10062226_A_mmu-let-7i
  gRNA
gguugugacauugcccgcug

SEQ ID NO: 62227 - RNA, 20 nt, Artificial Sequence
  MKO10062227_A_mmu-let-7i
  gRNA
ccacaccauggcccuggcug

SEQ ID NO: 62228 - RNA, 20 nt, Artificial Sequence
  MKO10062228_A_mmu-let-7i
  gRNA
gagcaucaccagcacuagca

SEQ ID NO: 62229 - RNA, 20 nt, Artificial Sequence
  MKO10062229_A_mmu-let-7i
  gRNA
uugcgcaguuaucuccacag

SEQ ID NO: 62230 - RNA, 20 nt, Artificial Sequence
  MKO10062230_A_mmu-mir-378d
  gRNA
augaggauagcggugcuuaa

SEQ ID NO: 62231 - RNA, 20 nt, Artificial Sequence
  MKO10062231_A_mmu-mir-378d
  gRNA
ccuaaaaaucacagggauau

SEQ ID NO: 62232 - RNA, 20 nt, Artificial Sequence
  MKO10062232_A_mmu-mir-378d
  gRNA
aaaaucacagggauauugga

SEQ ID NO: 62233 - RNA, 20 nt, Artificial Sequence
  MKO10062233_A_mmu-mir-378d
  gRNA
ucagaagguuugugauuugg

SEQ ID NO: 62234 - RNA, 20 nt, Artificial Sequence
  MKO10062234_A_mmu-mir-26a-2
  gRNA
gcuacuguggaggcugcggc

SEQ ID NO: 62235 - RNA, 20 nt, Artificial Sequence
  MKO10062235_A_mmu-mir-26a-2
  gRNA
cggcuggauucaaguaaucc

SEQ ID NO: 62236 - RNA, 20 nt, Artificial Sequence
  MKO10062236_A_mmu-mir-26a-2
  gRNA
ggauucaaguaauccaggau

SEQ ID NO: 62237 - RNA, 20 nt, Artificial Sequence
  MKO10062237_A_mmu-mir-26a-2
  gRNA
ucuugauuacuuguuucugg

SEQ ID NO: 62238 - RNA, 20 nt, Artificial Sequence
  MKO10062238_A_mmu-mir-546
  gRNA
aaacuaaacaggaucuauca

SEQ ID NO: 62239 - RNA, 20 nt, Artificial Sequence
  MKO10062239_A_mmu-mir-546
  gRNA
cuaaacaggaucuaucaugg

SEQ ID NO: 62240 - RNA, 20 nt, Artificial Sequence
  MKO10062240_A_mmu-mir-546
  gRNA
caggaucuaucaugguggca

SEQ ID NO: 62241 - RNA, 20 nt, Artificial Sequence
  MKO10062241_A_mmu-mir-546
  gRNA
uuagaagcaaagugauacug

SEQ ID NO: 62242 - RNA, 20 nt, Artificial Sequence
  MKO10062242_A_mmu-mir-677
  gRNA
gccagaugccguuccugaga

SEQ ID NO: 62243 - RNA, 20 nt, Artificial Sequence
  MKO10062243_A_mmu-mir-677
  gRNA
cagaugccguuccugagaag

SEQ ID NO: 62244 - RNA, 20 nt, Artificial Sequence
  MKO10062244_A_mmu-mir-677
  gRNA
cguuccugagaaggggaaaa

SEQ ID NO: 62245 - RNA, 20 nt, Artificial Sequence
  MKO10062245_A_mmu-mir-677
  gRNA
cagaagcuaaucaucacuga

SEQ ID NO: 62246 - RNA, 20 nt, Artificial Sequence
  MKO10062246_A_mmu-mir-6914
  gRNA
ccucuuaacccugacuccug

SEQ ID NO: 62247 - RNA, 20 nt, Artificial Sequence
  MKO10062247_A_mmu-mir-6914
  gRNA
cuuaacccugacuccugggg

SEQ ID NO: 62248 - RNA, 20 nt, Artificial Sequence
  MKO10062248_A_mmu-mir-6914
  gRNA
aacccugacuccuggggugg

SEQ ID NO: 62249 - RNA, 20 nt, Artificial Sequence
  MKO10062249_A_mmu-mir-6914
  gRNA
ccugacuccugggguggugg

SEQ ID NO: 62250 - RNA, 20 nt, Artificial Sequence
  MKO10062250_A_mmu-mir-6915
  gRNA
ucagagcagauggagguucg

SEQ ID NO: 62251 - RNA, 20 nt, Artificial Sequence
  MKO10062251_A_mmu-mir-6915
  gRNA
caacuuccuuccucgugccc

SEQ ID NO: 62252 - RNA, 20 nt, Artificial Sequence
  MKO10062252_A_mmu-mir-6915
  gRNA
acgaggaaggaaguugguga

SEQ ID NO: 62253 - RNA, 20 nt, Artificial Sequence
  MKO10062253_A_mmu-mir-6915
  gRNA
cugggcacgaggaaggaagu

SEQ ID NO: 62254 - RNA, 20 nt, Artificial Sequence
  MKO10062254_A_mmu-mir-8105
  gRNA
acuccuaaagcggaggcgac

SEQ ID NO: 62255 - RNA, 20 nt, Artificial Sequence
  MKO10062255_A_mmu-mir-8105
  gRNA
uggcgagacccgaagaucag

SEQ ID NO: 62256 - RNA, 20 nt, Artificial Sequence
  MKO10062256_A_mmu-mir-8105
  gRNA
gagacccgaagaucagaggg

SEQ ID NO: 62257 - RNA, 20 nt, Artificial Sequence
  MKO10062257_A_mmu-mir-8105
  gRNA
gagccccgauucuucgaccc

SEQ ID NO: 62258 - RNA, 20 nt, Artificial Sequence
  MKO10062258_A_mmu-mir-6916
  gRNA
cucagagggacuguaggaag

SEQ ID NO: 62259 - RNA, 20 nt, Artificial Sequence
  MKO10062259_A_mmu-mir-6916
  gRNA
ucacgggguucuuagaugcu

SEQ ID NO: 62260 - RNA, 20 nt, Artificial Sequence
  MKO10062260_A_mmu-mir-6916
  gRNA
gaggauggagaugagucacg

SEQ ID NO: 62261 - RNA, 20 nt, Artificial Sequence
  MKO10062261_A_mmu-mir-6916
  gRNA
ggagguaaugugcaggcagg

SEQ ID NO: 62262 - RNA, 20 nt, Artificial Sequence
  MKO10062262_A_mmu-mir-6917
  gRNA
cccuaacagaaucucugugg

SEQ ID NO: 62263 - RNA, 20 nt, Artificial Sequence
  MKO10062263_A_mmu-mir-6917
  gRNA
guggugggaagagaagugac

SEQ ID NO: 62264 - RNA, 20 nt, Artificial Sequence
  MKO10062264_A_mmu-mir-6917
  gRNA
gauugguaggaaggugugga

SEQ ID NO: 62265 - RNA, 20 nt, Artificial Sequence
  MKO10062265_A_mmu-mir-6917
  gRNA
aagugacaggcugaagacug

SEQ ID NO: 62266 - RNA, 20 nt, Artificial Sequence
  MKO10062266_A_mmu-mir-3060
  gRNA
cuggugauguccugggcgug

SEQ ID NO: 62267 - RNA, 20 nt, Artificial Sequence
  MKO10062267_A_mmu-mir-3060
  gRNA
auguccugggcgugggggug

SEQ ID NO: 62268 - RNA, 20 nt, Artificial Sequence
  MKO10062268_A_mmu-mir-3060
  gRNA
uggggagugcuucgugcuuc

SEQ ID NO: 62269 - RNA, 20 nt, Artificial Sequence
  MKO10062269_A_mmu-mir-3060
  gRNA
cacuccccacccccacgccc

SEQ ID NO: 62270 - RNA, 20 nt, Artificial Sequence
  MKO10062270_A_mmu-mir-6918
  gRNA
aaugcaggauucuugugcug

SEQ ID NO: 62271 - RNA, 20 nt, Artificial Sequence
  MKO10062271_A_mmu-mir-6918
  gRNA
caggauucuugugcugagga

SEQ ID NO: 62272 - RNA, 20 nt, Artificial Sequence
  MKO10062272_A_mmu-mir-6918
  gRNA
cuugugcugaggacgggauu

SEQ ID NO: 62273 - RNA, 20 nt, Artificial Sequence
  MKO10062273_A_mmu-mir-6918
  gRNA
guaggcugugagaagggcac

SEQ ID NO: 62274 - RNA, 20 nt, Artificial Sequence
  MKO10062274_A_mmu-mir-7651
  gRNA
ugugauaaucugucucaguu

SEQ ID NO: 62275 - RNA, 20 nt, Artificial Sequence
  MKO10062275_A_mmu-mir-7651
  gRNA
uaucacaaugcaucucaggc

SEQ ID NO: 62276 - RNA, 20 nt, Artificial Sequence
  MKO10062276_A_mmu-mir-7651
  gRNA
agauuaucacaaugcaucuc

SEQ ID NO: 62277 - RNA, 20 nt, Artificial Sequence
  MKO10062277_A_mmu-mir-7651
  gRNA
gguuuuuuuccccuugagau

SEQ ID NO: 62278 - RNA, 20 nt, Artificial Sequence
  MKO10062278_A_mmu-mir-1933
  gRNA
aauagucacacugauggucc

SEQ ID NO: 62279 - RNA, 20 nt, Artificial Sequence
  MKO10062279_A_mmu-mir-1933
  gRNA
ugguccugguuaaacuaaac

SEQ ID NO: 62280 - RNA, 20 nt, Artificial Sequence
  MKO10062280_A_mmu-mir-1933
  gRNA
aagaccgaacaccaugacug

SEQ ID NO: 62281 - RNA, 20 nt, Artificial Sequence
  MKO10062281_A_mmu-mir-1933
  gRNA
aacaccaugacugugggauc

SEQ ID NO: 62282 - RNA, 20 nt, Artificial Sequence
  MKO10062282_A_mmu-mir-6372
  gRNA
acuaccucuuugaaaagaac

SEQ ID NO: 62283 - RNA, 20 nt, Artificial Sequence
  MKO10062283_A_mmu-mir-6372
  gRNA
uaccucuuugaaaagaacug

SEQ ID NO: 62284 - RNA, 20 nt, Artificial Sequence
  MKO10062284_A_mmu-mir-6372
  gRNA
aaacuuccagccuucuaucc

SEQ ID NO: 62285 - RNA, 20 nt, Artificial Sequence
  MKO10062285_A_mmu-mir-6372
  gRNA
aaacugccuggauagaaggc

SEQ ID NO: 62286 - RNA, 20 nt, Artificial Sequence
  MKO10062286_A_mmu-mir-216b
  gRNA
guaauugcacauuggcagac

SEQ ID NO: 62287 - RNA, 20 nt, Artificial Sequence
  MKO10062287_A_mmu-mir-216b
  gRNA
gcagacugggaaaucucugc

SEQ ID NO: 62288 - RNA, 20 nt, Artificial Sequence
  MKO10062288_A_mmu-mir-216b
  gRNA
aaucucuacagguaagugug

SEQ ID NO: 62289 - RNA, 20 nt, Artificial Sequence
  MKO10062289_A_mmu-mir-216b
  gRNA
ucagacugaagaaucucuac

SEQ ID NO: 62290 - RNA, 20 nt, Artificial Sequence
  MKO10062290_A_mmu-mir-216c
  gRNA
gcagacugggaaaucucugc

SEQ ID NO: 62291 - RNA, 20 nt, Artificial Sequence
  MKO10062291_A_mmu-mir-216c
  gRNA
aaucucuacagguaagugug

SEQ ID NO: 62292 - RNA, 20 nt, Artificial Sequence
  MKO10062292_A_mmu-mir-216c
  gRNA
ucagacugaagaaucucuac

SEQ ID NO: 62293 - RNA, 20 nt, Artificial Sequence
  MKO10062293_A_mmu-mir-216a
  gRNA
ugaguugguuuaaucucagc

SEQ ID NO: 62294 - RNA, 20 nt, Artificial Sequence
  MKO10062294_A_mmu-mir-216a
  gRNA
gucccuaucauuccucacag

SEQ ID NO: 62295 - RNA, 20 nt, Artificial Sequence
  MKO10062295_A_mmu-mir-216a
  gRNA
ucauuccucacaguggucuc

SEQ ID NO: 62296 - RNA, 20 nt, Artificial Sequence
  MKO10062296_A_mmu-mir-216a
  gRNA
uaaucccagagaccacugug

SEQ ID NO: 62297 - RNA, 20 nt, Artificial Sequence
  MKO10062297_A_mmu-mir-217
  gRNA
gauguugcagauacugcauc

SEQ ID NO: 62298 - RNA, 20 nt, Artificial Sequence
  MKO10062298_A_mmu-mir-217
  gRNA
auacugcaucaggaacugac

SEQ ID NO: 62299 - RNA, 20 nt, Artificial Sequence
  MKO10062299_A_mmu-mir-217
  gRNA
caaugcauuaggaacugaug

SEQ ID NO: 62300 - RNA, 20 nt, Artificial Sequence
  MKO10062300_A_mmu-mir-217
  gRNA
ggcaaugcauuaggaacuga

SEQ ID NO: 62301 - RNA, 20 nt, Artificial Sequence
  MKO10062301_A_mmu-mir-218-2
  gRNA
uugacucugaccaguugccg

SEQ ID NO: 62302 - RNA, 20 nt, Artificial Sequence
  MKO10062302_A_mmu-mir-218-2
  gRNA
uugugcuugaucuaaccaug

SEQ ID NO: 62303 - RNA, 20 nt, Artificial Sequence
  MKO10062303_A_mmu-mir-218-2
  gRNA
ugcuugaucuaaccaugugg

SEQ ID NO: 62304 - RNA, 20 nt, Artificial Sequence
  MKO10062304_A_mmu-mir-218-2
  gRNA
caugguucugucaagcaccg

SEQ ID NO: 62305 - RNA, 20 nt, Artificial Sequence
  MKO10062305_A_mmu-mir-103-1
  gRNA
ggaaguuuucuuacugcccu

SEQ ID NO: 62306 - RNA, 20 nt, Artificial Sequence
  MKO10062306_A_mmu-mir-103-1
  gRNA
uggaucaagcagcauuguac

SEQ ID NO: 62307 - RNA, 20 nt, Artificial Sequence
  MKO10062307_A_mmu-mir-103-1
  gRNA
cagcacuguaaagaagccga

SEQ ID NO: 62308 - RNA, 20 nt, Artificial Sequence
  MKO10062308_A_mmu-mir-103-1
  gRNA
ugcuugauccauaugcaaca

SEQ ID NO: 62309 - RNA, 20 nt, Artificial Sequence
  MKO10062309_A_mmu-mir-146a
  gRNA
gcugaagaacugaauuucac

SEQ ID NO: 62310 - RNA, 20 nt, Artificial Sequence
  MKO10062310_A_mmu-mir-146a
  gRNA
ucugacauugauauaaccca

SEQ ID NO: 62311 - RNA, 20 nt, Artificial Sequence
  MKO10062311_A_mmu-mir-146a
  gRNA
gaauucaguucucagagcug

SEQ ID NO: 62312 - RNA, 20 nt, Artificial Sequence
  MKO10062312_A_mmu-mir-146a
  gRNA
ugaaauucaguucuucagcu

SEQ ID NO: 62313 - RNA, 20 nt, Artificial Sequence
  MKO10062313_A_mmu-mir-8100
  gRNA
aaguaaacaaugacuguccc

SEQ ID NO: 62314 - RNA, 20 nt, Artificial Sequence
  MKO10062314_A_mmu-mir-8100
  gRNA
aaacaaugacugucccagga

SEQ ID NO: 62315 - RNA, 20 nt, Artificial Sequence
  MKO10062315_A_mmu-mir-8100
  gRNA
acugucccaggaaggaggaa

SEQ ID NO: 62316 - RNA, 20 nt, Artificial Sequence
  MKO10062316_A_mmu-mir-8100
  gRNA
gccccuuccuuuccccccuc

SEQ ID NO: 62317 - RNA, 20 nt, Artificial Sequence
  MKO10062317_A_mmu-mir-7239
  gRNA
caagccacaauggcucuguc

SEQ ID NO: 62318 - RNA, 20 nt, Artificial Sequence
  MKO10062318_A_mmu-mir-7239
  gRNA
ccacaauggcucugucaggc

SEQ ID NO: 62319 - RNA, 20 nt, Artificial Sequence
  MKO10062319_A_mmu-mir-7239
  gRNA
agaaaagggcuuugucagga

SEQ ID NO: 62320 - RNA, 20 nt, Artificial Sequence
  MKO10062320_A_mmu-mir-7239
  gRNA
gagcagaaaagggcuuuguc

SEQ ID NO: 62321 - RNA, 20 nt, Artificial Sequence
  MKO10062321_A_mmu-mir-340
  gRNA
uuucuaaaaccaauuguacu

SEQ ID NO: 62322 - RNA, 20 nt, Artificial Sequence
  MKO10062322_A_mmu-mir-340
  gRNA
aguuacuuuauagccauacc

SEQ ID NO: 62323 - RNA, 20 nt, Artificial Sequence
  MKO10062323_A_mmu-mir-340
  gRNA
uggcuauaaaguaacugaga

SEQ ID NO: 62324 - RNA, 20 nt, Artificial Sequence
  MKO10062324_A_mmu-mir-340
  gRNA
ugguguuaagauaccaggua

SEQ ID NO: 62325 - RNA, 20 nt, Artificial Sequence
  MKO10062325_A_mmu-mir-6919
  gRNA
gccucucugcgguaggccac

SEQ ID NO: 62326 - RNA, 20 nt, Artificial Sequence
  MKO10062326_A_mmu-mir-6919
  gRNA
cugcgguaggccacuggagg

SEQ ID NO: 62327 - RNA, 20 nt, Artificial Sequence
  MKO10062327_A_mmu-mir-6919
  gRNA
gccucugaggcuccuccucc

SEQ ID NO: 62328 - RNA, 20 nt, Artificial Sequence
  MKO10062328_A_mmu-mir-6919
  gRNA
ggcuccuccuccuggcccac

SEQ ID NO: 62329 - RNA, 20 nt, Artificial Sequence
  MKO10062329_A_mmu-mir-804
  gRNA
gcaccgccaccacaucuucc

SEQ ID NO: 62330 - RNA, 20 nt, Artificial Sequence
  MKO10062330_A_mmu-mir-804
  gRNA
caggugaggaacaacucaca

SEQ ID NO: 62331 - RNA, 20 nt, Artificial Sequence
  MKO10062331_A_mmu-mir-804
  gRNA
aaugucaggaaacagucuac

SEQ ID NO: 62332 - RNA, 20 nt, Artificial Sequence
  MKO10062332_A_mmu-mir-804
  gRNA
aaccucaaagauggaugugu

SEQ ID NO: 62333 - RNA, 20 nt, Artificial Sequence
  MKO10062333_A_mmu-mir-3061
  gRNA
ccuugauauauuguguacug

SEQ ID NO: 62334 - RNA, 20 nt, Artificial Sequence
  MKO10062334_A_mmu-mir-3061
  gRNA
uugauauauuguguacugug

SEQ ID NO: 62335 - RNA, 20 nt, Artificial Sequence
  MKO10062335_A_mmu-mir-3061
  gRNA
uauuguguacuguggggcag

SEQ ID NO: 62336 - RNA, 20 nt, Artificial Sequence
  MKO10062336_A_mmu-mir-3061
  gRNA
guggggcagugggccgugaa

SEQ ID NO: 62337 - RNA, 20 nt, Artificial Sequence
  MKO10062337_A_mmu-mir-6920
  gRNA
auggaaagacugcuuguaga

SEQ ID NO: 62338 - RNA, 20 nt, Artificial Sequence
  MKO10062338_A_mmu-mir-6920
  gRNA
aagggcaguguauauagaca

SEQ ID NO: 62339 - RNA, 20 nt, Artificial Sequence
  MKO10062339_A_mmu-mir-6920
  gRNA
ucaggcuaggcaauggaaaa

SEQ ID NO: 62340 - RNA, 20 nt, Artificial Sequence
  MKO10062340_A_mmu-mir-6920
  gRNA
uggcaucucaggcuaggcaa

SEQ ID NO: 62341 - RNA, 20 nt, Artificial Sequence
  MKO10062341_A_mmu-mir-7671
  gRNA
uccuggaaagggagggaagc

SEQ ID NO: 62342 - RNA, 20 nt, Artificial Sequence
  MKO10062342_A_mmu-mir-7671
  gRNA
cuccgcucuggcuagcuucc

SEQ ID NO: 62343 - RNA, 20 nt, Artificial Sequence
  MKO10062343_A_mmu-mir-7671
  gRNA
gugaguugcaggcuccgcuc

SEQ ID NO: 62344 - RNA, 20 nt, Artificial Sequence
  MKO10062344_A_mmu-mir-7671
  gRNA
gcccgcuucccucccuuucc

SEQ ID NO: 62345 - RNA, 20 nt, Artificial Sequence
  MKO10062345_A_mmu-mir-7652
  gRNA
caggcaugugccaccauguc

SEQ ID NO: 62346 - RNA, 20 nt, Artificial Sequence
  MKO10062346_A_mmu-mir-7652
  gRNA
caccaugucuggcuuuccug

SEQ ID NO: 62347 - RNA, 20 nt, Artificial Sequence
  MKO10062347_A_mmu-mir-7652
  gRNA
ucuggcuuuccuguggcuuc

SEQ ID NO: 62348 - RNA, 20 nt, Artificial Sequence
  MKO10062348_A_mmu-mir-7652
  gRNA
cacaggaaagccagacaugg

SEQ ID NO: 62349 - RNA, 20 nt, Artificial Sequence
  MKO10062349_A_mmu-mir-6921
  gRNA
guaggaauaccugagaggca

SEQ ID NO: 62350 - RNA, 20 nt, Artificial Sequence
  MKO10062350_A_mmu-mir-6921
  gRNA
gugacuacuccuugccucuc

SEQ ID NO: 62351 - RNA, 20 nt, Artificial Sequence
  MKO10062351_A_mmu-mir-6921
  gRNA
uucucacacugaggggcaug

SEQ ID NO: 62352 - RNA, 20 nt, Artificial Sequence
  MKO10062352_A_mmu-mir-6921
  gRNA
cccacuguucucacacugag

SEQ ID NO: 62353 - RNA, 20 nt, Artificial Sequence
  MKO10062353_A_mmu-mir-6922
  gRNA
ccagcggauccacugugaga

SEQ ID NO: 62354 - RNA, 20 nt, Artificial Sequence
  MKO10062354_A_mmu-mir-6922
  gRNA
gggugagcagaacagagguu

SEQ ID NO: 62355 - RNA, 20 nt, Artificial Sequence
  MKO10062355_A_mmu-mir-6922
  gRNA
ucugcucacccuucucacag

SEQ ID NO: 62356 - RNA, 20 nt, Artificial Sequence
  MKO10062356_A_mmu-mir-6922
  gRNA
ugugggaggggacuguagag

SEQ ID NO: 62357 - RNA, 20 nt, Artificial Sequence
  MKO10062357_A_mmu-mir-5100
  gRNA
cggucacugcggugggaggg

SEQ ID NO: 62358 - RNA, 20 nt, Artificial Sequence
  MKO10062358_A_mmu-mir-5100
  gRNA
gagcagaguucgaaucccag

SEQ ID NO: 62359 - RNA, 20 nt, Artificial Sequence
  MKO10062359_A_mmu-mir-5100
  gRNA
agcggugccucuucccgacu

SEQ ID NO: 62360 - RNA, 20 nt, Artificial Sequence
  MKO10062360_A_mmu-mir-5100
  gRNA
gcaauacccaagucgggaag

SEQ ID NO: 62361 - RNA, 20 nt, Artificial Sequence
  MKO10062361_A_mmu-mir-744
  gRNA
gucaggaccgaguaagguug

SEQ ID NO: 62362 - RNA, 20 nt, Artificial Sequence
  MKO10062362_A_mmu-mir-744
  gRNA
ccgaguaagguugagguuag

SEQ ID NO: 62363 - RNA, 20 nt, Artificial Sequence
  MKO10062363_A_mmu-mir-744
  gRNA
acagcaugugugugguuucc

SEQ ID NO: 62364 - RNA, 20 nt, Artificial Sequence
  MKO10062364_A_mmu-mir-744
  gRNA
ccacuaaccucaaccuuacu

SEQ ID NO: 62365 - RNA, 20 nt, Artificial Sequence
  MKO10062365_A_mmu-mir-6923
  gRNA
cugcacacccaggugagggc

SEQ ID NO: 62366 - RNA, 20 nt, Artificial Sequence
  MKO10062366_A_mmu-mir-6923
  gRNA
ccaggugagggcaggaggau

SEQ ID NO: 62367 - RNA, 20 nt, Artificial Sequence
  MKO10062367_A_mmu-mir-6923
  gRNA
aggugagggcaggaggauug

SEQ ID NO: 62368 - RNA, 20 nt, Artificial Sequence
  MKO10062368_A_mmu-mir-6923
  gRNA
ggcaggaggauuggggugug

SEQ ID NO: 62369 - RNA, 20 nt, Artificial Sequence
  MKO10062369_A_mmu-mir-6406
  gRNA
cuggccuuucccgcccaacc

SEQ ID NO: 62370 - RNA, 20 nt, Artificial Sequence
  MKO10062370_A_mmu-mir-6406
  gRNA
gccuuucccgcccaaccugg

SEQ ID NO: 62371 - RNA, 20 nt, Artificial Sequence
  MKO10062371_A_mmu-mir-6406
  gRNA
cacccacauuccgcgaccuc

SEQ ID NO: 62372 - RNA, 20 nt, Artificial Sequence
  MKO10062372_A_mmu-mir-6406
  gRNA
uguagauccagcuccacauc

SEQ ID NO: 62373 - RNA, 20 nt, Artificial Sequence
  MKO10062373_A_mmu-mir-3062
  gRNA
acugauauucgggccugcag

SEQ ID NO: 62374 - RNA, 20 nt, Artificial Sequence
  MKO10062374_A_mmu-mir-3062
  gRNA
ugcaguggggagacccauga

SEQ ID NO: 62375 - RNA, 20 nt, Artificial Sequence
  MKO10062375_A_mmu-mir-3062
  gRNA
agaaaguguguccccgugag

SEQ ID NO: 62376 - RNA, 20 nt, Artificial Sequence
  MKO10062376_A_mmu-mir-3062
  gRNA
gguauuugcugacaggcuca

SEQ ID NO: 62377 - RNA, 20 nt, Artificial Sequence
  MKO10062377_A_mmu-mir-467f
  gRNA
auuccaaaaaagcugugugu

SEQ ID NO: 62378 - RNA, 20 nt, Artificial Sequence
  MKO10062378_A_mmu-mir-467f
  gRNA
cccguucgauuucuggguac

SEQ ID NO: 62379 - RNA, 20 nt, Artificial Sequence
  MKO10062379_A_mmu-mir-467f
  gRNA
acgggggugggugugugugu

SEQ ID NO: 62380 - RNA, 20 nt, Artificial Sequence
  MKO10062380_A_mmu-mir-467f
  gRNA
acccacccccguucgauuuc

SEQ ID NO: 62381 - RNA, 20 nt, Artificial Sequence
  MKO10062381_A_mmu-mir-1934
  gRNA
uccgagcugggccuucuuuc

SEQ ID NO: 62382 - RNA, 20 nt, Artificial Sequence
  MKO10062382_A_mmu-mir-1934
  gRNA
uccagauguuaagaggauga

SEQ ID NO: 62383 - RNA, 20 nt, Artificial Sequence
  MKO10062383_A_mmu-mir-1934
  gRNA
agauguuaagaggaugacgg

SEQ ID NO: 62384 - RNA, 20 nt, Artificial Sequence
  MKO10062384_A_mmu-mir-1934
  gRNA
auguuaagaggaugacggug

SEQ ID NO: 62385 - RNA, 20 nt, Artificial Sequence
  MKO10062385_A_mmu-mir-6924
  gRNA
gccaaucguagccugaaggg

SEQ ID NO: 62386 - RNA, 20 nt, Artificial Sequence
  MKO10062386_A_mmu-mir-6924
  gRNA
caaucguagccugaagggug

SEQ ID NO: 62387 - RNA, 20 nt, Artificial Sequence
  MKO10062387_A_mmu-mir-6924
  gRNA
agccugaaggguggggauua

SEQ ID NO: 62388 - RNA, 20 nt, Artificial Sequence
  MKO10062388_A_mmu-mir-6924
  gRNA
cuccuuaauccccacccuuc

SEQ ID NO: 62389 - RNA, 20 nt, Artificial Sequence
  MKO10062389_A_mmu-mir-324
  gRNA
ccucgcauccccuagggcau

SEQ ID NO: 62390 - RNA, 20 nt, Artificial Sequence
  MKO10062390_A_mmu-mir-324
  gRNA
agcuggagacccacugcccc

SEQ ID NO: 62391 - RNA, 20 nt, Artificial Sequence
  MKO10062391_A_mmu-mir-324
  gRNA
cacugccccaggugcugcug

SEQ ID NO: 62392 - RNA, 20 nt, Artificial Sequence
  MKO10062392_A_mmu-mir-324
  gRNA
augcccuaggggaugcgagg

SEQ ID NO: 62393 - RNA, 20 nt, Artificial Sequence
  MKO10062393_A_mmu-mir-497b
  gRNA
cccgccccagcagcacacug

SEQ ID NO: 62394 - RNA, 20 nt, Artificial Sequence
  MKO10062394_A_mmu-mir-497b
  gRNA
gcagcacacugugguuugua

SEQ ID NO: 62395 - RNA, 20 nt, Artificial Sequence
  MKO10062395_A_mmu-mir-497b
  gRNA
gccacguccaaaccacacug

SEQ ID NO: 62396 - RNA, 20 nt, Artificial Sequence
  MKO10062396_A_mmu-mir-497b
  gRNA
gugguguuagagcgagggua

SEQ ID NO: 62397 - RNA, 20 nt, Artificial Sequence
  MKO10062397_A_mmu-mir-497
  gRNA
cccgccccagcagcacacug

SEQ ID NO: 62398 - RNA, 20 nt, Artificial Sequence
  MKO10062398_A_mmu-mir-497
  gRNA
gcagcacacugugguuugua

SEQ ID NO: 62399 - RNA, 20 nt, Artificial Sequence
  MKO10062399_A_mmu-mir-497
  gRNA
gccacguccaaaccacacug

SEQ ID NO: 62400 - RNA, 20 nt, Artificial Sequence
  MKO10062400_A_mmu-mir-497
  gRNA
gugguguuagagcgagggua

SEQ ID NO: 62401 - RNA, 20 nt, Artificial Sequence
  MKO10062401_A_mmu-mir-195a
  gRNA
cucuagcagcacagaaauau

SEQ ID NO: 62402 - RNA, 20 nt, Artificial Sequence
  MKO10062402_A_mmu-mir-195a
  gRNA
gcagcacagaaauauuggca

SEQ ID NO: 62403 - RNA, 20 nt, Artificial Sequence
  MKO10062403_A_mmu-mir-195a
  gRNA
agcacagaaauauuggcaug

SEQ ID NO: 62404 - RNA, 20 nt, Artificial Sequence
  MKO10062404_A_mmu-mir-195a
  gRNA
ggaagugagucugccaauau

SEQ ID NO: 62405 - RNA, 20 nt, Artificial Sequence
  MKO10062405_A_mmu-mir-7115
  gRNA
caccauguggucggggguug

SEQ ID NO: 62406 - RNA, 20 nt, Artificial Sequence
  MKO10062406_A_mmu-mir-7115
  gRNA
cugugucacccaaagccacu

SEQ ID NO: 62407 - RNA, 20 nt, Artificial Sequence
  MKO10062407_A_mmu-mir-7115
  gRNA
gcaggggaccaaguggcuuu

SEQ ID NO: 62408 - RNA, 20 nt, Artificial Sequence
  MKO10062408_A_mmu-mir-7115
  gRNA
ugugggggcaggggaccaag

SEQ ID NO: 62409 - RNA, 20 nt, Artificial Sequence
  MKO10062409_A_mmu-mir-6925
  gRNA
agccugaggaagagaaggcu

SEQ ID NO: 62410 - RNA, 20 nt, Artificial Sequence
  MKO10062410_A_mmu-mir-6925
  gRNA
guccaagccuucucuuccuc

SEQ ID NO: 62411 - RNA, 20 nt, Artificial Sequence
  MKO10062411_A_mmu-mir-6925
  gRNA
gauaaaaggggacgguaauc

SEQ ID NO: 62412 - RNA, 20 nt, Artificial Sequence
  MKO10062412_A_mmu-mir-6925
  gRNA
ugauugcugagggauaaaag

SEQ ID NO: 62413 - RNA, 20 nt, Artificial Sequence
  MKO10062413_A_mmu-mir-6338
  gRNA
gaugccuggcuccaguaucc

SEQ ID NO: 62414 - RNA, 20 nt, Artificial Sequence
  MKO10062414_A_mmu-mir-6338
  gRNA
acauguuaaaugaaaguaga

SEQ ID NO: 62415 - RNA, 20 nt, Artificial Sequence
  MKO10062415_A_mmu-mir-6338
  gRNA
gaagggagaauguaugaugc

SEQ ID NO: 62416 - RNA, 20 nt, Artificial Sequence
  MKO10062416_A_mmu-mir-6338
  gRNA
agggagaauguaugaugcag

SEQ ID NO: 62417 - RNA, 20 nt, Artificial Sequence
  MKO10062417_A_mmu-mir-6926
  gRNA
ucccacuauggagacaggga

SEQ ID NO: 62418 - RNA, 20 nt, Artificial Sequence
  MKO10062418_A_mmu-mir-6926
  gRNA
agggauggugaauuuagcug

SEQ ID NO: 62419 - RNA, 20 nt, Artificial Sequence
  MKO10062419_A_mmu-mir-6926
  gRNA
cgggucaguggggugaggga

SEQ ID NO: 62420 - RNA, 20 nt, Artificial Sequence
  MKO10062420_A_mmu-mir-6926
  gRNA
cagggucccacuauggagac

SEQ ID NO: 62421 - RNA, 20 nt, Artificial Sequence
  MKO10062421_A_mmu-mir-212
  gRNA
uccccgcccgggcagcgcgc

SEQ ID NO: 62422 - RNA, 20 nt, Artificial Sequence
  MKO10062422_A_mmu-mir-212
  gRNA
gcucuagacugcuuacugcc

SEQ ID NO: 62423 - RNA, 20 nt, Artificial Sequence
  MKO10062423_A_mmu-mir-212
  gRNA
ucaguaacagucuccaguca

SEQ ID NO: 62424 - RNA, 20 nt, Artificial Sequence
  MKO10062424_A_mmu-mir-212
  gRNA
cagucacggccaccgacgcc

SEQ ID NO: 62425 - RNA, 20 nt, Artificial Sequence
  MKO10062425_A_mmu-mir-132
  gRNA
ccgcgucuccagggcaaccg

SEQ ID NO: 62426 - RNA, 20 nt, Artificial Sequence
  MKO10062426_A_mmu-mir-132
  gRNA
guggcuuucgauuguuacug

SEQ ID NO: 62427 - RNA, 20 nt, Artificial Sequence
  MKO10062427_A_mmu-mir-132
  gRNA
auuguuacugugggaaccgg

SEQ ID NO: 62428 - RNA, 20 nt, Artificial Sequence
  MKO10062428_A_mmu-mir-132
  gRNA
gagguaacagucuacagcca

SEQ ID NO: 62429 - RNA, 20 nt, Artificial Sequence
  MKO10062429_A_mmu-mir-22
  gRNA
gagccgcaguaguucuucag

SEQ ID NO: 62430 - RNA, 20 nt, Artificial Sequence
  MKO10062430_A_mmu-mir-22
  gRNA
gaacuguugcccucugcccc

SEQ ID NO: 62431 - RNA, 20 nt, Artificial Sequence
  MKO10062431_A_mmu-mir-22
  gRNA
agaacuacugcggcucagcc

SEQ ID NO: 62432 - RNA, 20 nt, Artificial Sequence
  MKO10062432_A_mmu-mir-22
  gRNA
uugccacugaagaacuacug

SEQ ID NO: 62433 - RNA, 20 nt, Artificial Sequence
  MKO10062433_A_mmu-mir-3971
  gRNA
gccagggaucugggcuuggc

SEQ ID NO: 62434 - RNA, 20 nt, Artificial Sequence
  MKO10062434_A_mmu-mir-3971
  gRNA
agggaucugggcuuggcagg

SEQ ID NO: 62435 - RNA, 20 nt, Artificial Sequence
  MKO10062435_A_mmu-mir-3971
  gRNA
ucugggcuuggcagguggaa

SEQ ID NO: 62436 - RNA, 20 nt, Artificial Sequence
  MKO10062436_A_mmu-mir-3971
  gRNA
uuggcagguggaaugggagg

SEQ ID NO: 62437 - RNA, 20 nt, Artificial Sequence
  MKO10062437_A_mmu-mir-423
  gRNA
gagaaacucaagcgcggggu

SEQ ID NO: 62438 - RNA, 20 nt, Artificial Sequence
  MKO10062438_A_mmu-mir-423
  gRNA
ggguaggaagcaagacugag

SEQ ID NO: 62439 - RNA, 20 nt, Artificial Sequence
  MKO10062439_A_mmu-mir-423
  gRNA
uuuuccaaaagcucggucug

SEQ ID NO: 62440 - RNA, 20 nt, Artificial Sequence
  MKO10062440_A_mmu-mir-423
  gRNA
auaaaggaaguuaggcugag

SEQ ID NO: 62441 - RNA, 20 nt, Artificial Sequence
  MKO10062441_A_mmu-mir-144
  gRNA
guauagaugauguacuaguc

SEQ ID NO: 62442 - RNA, 20 nt, Artificial Sequence
  MKO10062442_A_mmu-mir-144
  gRNA
auaugaugauaucccagcca

SEQ ID NO: 62443 - RNA, 20 nt, Artificial Sequence
  MKO10062443_A_mmu-mir-144
  gRNA
uaucccagccaagguccugg

SEQ ID NO: 62444 - RNA, 20 nt, Artificial Sequence
  MKO10062444_A_mmu-mir-144
  gRNA
ugauaucccagccaaggucc

SEQ ID NO: 62445 - RNA, 20 nt, Artificial Sequence
  MKO10062445_A_mmu-mir-451b
  gRNA
acagcuguggcacuugggaa

SEQ ID NO: 62446 - RNA, 20 nt, Artificial Sequence
  MKO10062446_A_mmu-mir-451b
  gRNA
uguggcacuugggaauggcg

SEQ ID NO: 62447 - RNA, 20 nt, Artificial Sequence
  MKO10062447_A_mmu-mir-451b
  gRNA
accauuacugaguuuaguaa

SEQ ID NO: 62448 - RNA, 20 nt, Artificial Sequence
  MKO10062448_A_mmu-mir-451b
  gRNA
acugaguuuaguaaugguaa

SEQ ID NO: 62449 - RNA, 20 nt, Artificial Sequence
  MKO10062449_A_mmu-mir-451a
  gRNA
acagcuguggcacuugggaa

SEQ ID NO: 62450 - RNA, 20 nt, Artificial Sequence
  MKO10062450_A_mmu-mir-451a
  gRNA
uguggcacuugggaauggcg

SEQ ID NO: 62451 - RNA, 20 nt, Artificial Sequence
  MKO10062451_A_mmu-mir-451a
  gRNA
accauuacugaguuuaguaa

SEQ ID NO: 62452 - RNA, 20 nt, Artificial Sequence
  MKO10062452_A_mmu-mir-451a
  gRNA
acugaguuuaguaaugguaa

SEQ ID NO: 62453 - RNA, 20 nt, Artificial Sequence
  MKO10062453_A_mmu-mir-7653
  gRNA
ggaggagacggcuuaagggg

SEQ ID NO: 62454 - RNA, 20 nt, Artificial Sequence
  MKO10062454_A_mmu-mir-7653
  gRNA
cggacagacagacggcagga

SEQ ID NO: 62455 - RNA, 20 nt, Artificial Sequence
  MKO10062455_A_mmu-mir-7653
  gRNA
cccuacuguuccaccccgcc

SEQ ID NO: 62456 - RNA, 20 nt, Artificial Sequence
  MKO10062456_A_mmu-mir-7653
  gRNA
gccaggcgggguggaacagu

SEQ ID NO: 62457 - RNA, 20 nt, Artificial Sequence
  MKO10062457_A_mmu-mir-193a
  gRNA
gacggacgggagcugagagc

SEQ ID NO: 62458 - RNA, 20 nt, Artificial Sequence
  MKO10062458_A_mmu-mir-193a
  gRNA
agcugagagcugggucuuug

SEQ ID NO: 62459 - RNA, 20 nt, Artificial Sequence
  MKO10062459_A_mmu-mir-193a
  gRNA
gaugagagugucaguucaac

SEQ ID NO: 62460 - RNA, 20 nt, Artificial Sequence
  MKO10062460_A_mmu-mir-193a
  gRNA
gccuacaaagucccaguccu

SEQ ID NO: 62461 - RNA, 20 nt, Artificial Sequence
  MKO10062461_A_mmu-mir-365-2
  gRNA
ccuuacuuggagagugauca

SEQ ID NO: 62462 - RNA, 20 nt, Artificial Sequence
  MKO10062462_A_mmu-mir-365-2
  gRNA
caaggacagcaagaaaaaug

SEQ ID NO: 62463 - RNA, 20 nt, Artificial Sequence
  MKO10062463_A_mmu-mir-365-2
  gRNA
aagaaaaaugagggacuuuc

SEQ ID NO: 62464 - RNA, 20 nt, Artificial Sequence
  MKO10062464_A_mmu-mir-365-2
  gRNA
aggggcauuaugacugaguc

SEQ ID NO: 62465 - RNA, 20 nt, Artificial Sequence
  MKO10062465_A_mmu-mir-7679
  gRNA
uacuaagcugguugguaccc

SEQ ID NO: 62466 - RNA, 20 nt, Artificial Sequence
  MKO10062466_A_mmu-mir-7679
  gRNA
gaaucucaaaucagggaucc

SEQ ID NO: 62467 - RNA, 20 nt, Artificial Sequence
  MKO10062467_A_mmu-mir-7679
  gRNA
uucuuacugucaggauccca

SEQ ID NO: 62468 - RNA, 20 nt, Artificial Sequence
  MKO10062468_A_mmu-mir-7679
  gRNA
aacuguagcaggcuggcacc

SEQ ID NO: 62469 - RNA, 20 nt, Artificial Sequence
  MKO10062469_A_mmu-mir-5110
  gRNA
ugaggcccacucagggcaag

SEQ ID NO: 62470 - RNA, 20 nt, Artificial Sequence
  MKO10062470_A_mmu-mir-5110
  gRNA
aucucugccacuacuggaca

SEQ ID NO: 62471 - RNA, 20 nt, Artificial Sequence
  MKO10062471_A_mmu-mir-5110
  gRNA
gaugucaucucugccacuac

SEQ ID NO: 62472 - RNA, 20 nt, Artificial Sequence
  MKO10062472_A_mmu-mir-5110
  gRNA
caggcuuaguacaaaagcgg

SEQ ID NO: 62473 - RNA, 20 nt, Artificial Sequence
  MKO10062473_A_mmu-mir-21a
  gRNA
gucugauaagcuauccgaca

SEQ ID NO: 62474 - RNA, 20 nt, Artificial Sequence
  MKO10062474_A_mmu-mir-21a
  gRNA
ugauaagcuauccgacaagg

SEQ ID NO: 62475 - RNA, 20 nt, Artificial Sequence
  MKO10062475_A_mmu-mir-21a
  gRNA
gcauggcuguaccaccuugu

SEQ ID NO: 62476 - RNA, 20 nt, Artificial Sequence
  MKO10062476_A_mmu-mir-21a
  gRNA
cgaugggcugucugacauuu

SEQ ID NO: 62477 - RNA, 20 nt, Artificial Sequence
  MKO10062477_A_mmu-mir-301a
  gRNA
uuccugcucacuccugcuaa

SEQ ID NO: 62478 - RNA, 20 nt, Artificial Sequence
  MKO10062478_A_mmu-mir-301a
  gRNA
aagucagagcagccguuagc

SEQ ID NO: 62479 - RNA, 20 nt, Artificial Sequence
  MKO10062479_A_mmu-mir-301a
  gRNA
aaaggugugcaaccugcucg

SEQ ID NO: 62480 - RNA, 20 nt, Artificial Sequence
  MKO10062480_A_mmu-mir-301a
  gRNA
uugucaaagcauccgcgagc

SEQ ID NO: 62481 - RNA, 20 nt, Artificial Sequence
  MKO10062481_A_mmu-mir-142b
  gRNA
guguaguguuuccuacuuua

SEQ ID NO: 62482 - RNA, 20 nt, Artificial Sequence
  MKO10062482_A_mmu-mir-142b
  gRNA
cuuuauggaugagugcacug

SEQ ID NO: 62483 - RNA, 20 nt, Artificial Sequence
  MKO10062483_A_mmu-mir-142b
  gRNA
aguagugcuuucuacuuuau

SEQ ID NO: 62484 - RNA, 20 nt, Artificial Sequence
  MKO10062484_A_mmu-mir-142b
  gRNA
agugcacucauccauaaagu

SEQ ID NO: 62485 - RNA, 20 nt, Artificial Sequence
  MKO10062485_A_mmu-mir-142
  gRNA
guguaguguuuccuacuuua

SEQ ID NO: 62486 - RNA, 20 nt, Artificial Sequence
  MKO10062486_A_mmu-mir-142
  gRNA
aguagugcuuucuacuuuau

SEQ ID NO: 62487 - RNA, 20 nt, Artificial Sequence
  MKO10062487_A_mmu-mir-142
  gRNA
agugcacucauccauaaagu

SEQ ID NO: 62488 - RNA, 20 nt, Artificial Sequence
  MKO10062488_A_mmu-mir-142
  gRNA
gaaagcacuacuaacagcac

SEQ ID NO: 62489 - RNA, 20 nt, Artificial Sequence
  MKO10062489_A_mmu-mir-378b
  gRNA
guccugggcuaucccagucc

SEQ ID NO: 62490 - RNA, 20 nt, Artificial Sequence
  MKO10062490_A_mmu-mir-378b
  gRNA
ccaguccaggcaguacccuc

SEQ ID NO: 62491 - RNA, 20 nt, Artificial Sequence
  MKO10062491_A_mmu-mir-378b
  gRNA
guccaggcaguacccucagg

SEQ ID NO: 62492 - RNA, 20 nt, Artificial Sequence
  MKO10062492_A_mmu-mir-378b
  gRNA
aggcaguacccucaggaggc

SEQ ID NO: 62493 - RNA, 20 nt, Artificial Sequence
  MKO10062493_A_mmu-mir-3063
  gRNA
cuguggccagcuggcucaau

SEQ ID NO: 62494 - RNA, 20 nt, Artificial Sequence
  MKO10062494_A_mmu-mir-3063
  gRNA
ucaauugggggcgagagauc

SEQ ID NO: 62495 - RNA, 20 nt, Artificial Sequence
  MKO10062495_A_mmu-mir-3063
  gRNA
uuugggccuggcuggagauc

SEQ ID NO: 62496 - RNA, 20 nt, Artificial Sequence
  MKO10062496_A_mmu-mir-3063
  gRNA
ucagggcauuugggccuggc

SEQ ID NO: 62497 - RNA, 20 nt, Artificial Sequence
  MKO10062497_A_mmu-mir-196a-1
  gRNA
ccgggacuguugagugaagu

SEQ ID NO: 62498 - RNA, 20 nt, Artificial Sequence
  MKO10062498_A_mmu-mir-196a-1
  gRNA
aguagguaguuucauguugu

SEQ ID NO: 62499 - RNA, 20 nt, Artificial Sequence
  MKO10062499_A_mmu-mir-196a-1
  gRNA
acaucaaaccaccugauuca

SEQ ID NO: 62500 - RNA, 20 nt, Artificial Sequence
  MKO10062500_A_mmu-mir-196a-1
  gRNA
ccuacuucacucaacagucc

SEQ ID NO: 62501 - RNA, 20 nt, Artificial Sequence
  MKO10062501_A_mmu-mir-10a
  gRNA
uguagauccgaauuugugua

SEQ ID NO: 62502 - RNA, 20 nt, Artificial Sequence
  MKO10062502_A_mmu-mir-10a
  gRNA
guggucacaaauucguaucu

SEQ ID NO: 62503 - RNA, 20 nt, Artificial Sequence
  MKO10062503_A_mmu-mir-10a
  gRNA
ggucacaaauucguaucuag

SEQ ID NO: 62504 - RNA, 20 nt, Artificial Sequence
  MKO10062504_A_mmu-mir-10a
  gRNA
uacacaaauucggaucuaca

SEQ ID NO: 62505 - RNA, 20 nt, Artificial Sequence
  MKO10062505_A_mmu-mir-152
  gRNA
cgccgcuguuccccgggccu

SEQ ID NO: 62506 - RNA, 20 nt, Artificial Sequence
  MKO10062506_A_mmu-mir-152
  gRNA
uucugugauacacuccgacu

SEQ ID NO: 62507 - RNA, 20 nt, Artificial Sequence
  MKO10062507_A_mmu-mir-152
  gRNA
auacacuccgacucgggcuc

SEQ ID NO: 62508 - RNA, 20 nt, Artificial Sequence
  MKO10062508_A_mmu-mir-152
  gRNA
agucagugcaugacagaacu

SEQ ID NO: 62509 - RNA, 20 nt, Artificial Sequence
  MKO10062509_A_mmu-mir-8103
  gRNA
gccagucugcagacaagaag

SEQ ID NO: 62510 - RNA, 20 nt, Artificial Sequence
  MKO10062510_A_mmu-mir-8103
  gRNA
cugcagacaagaaggggagc

SEQ ID NO: 62511 - RNA, 20 nt, Artificial Sequence
  MKO10062511_A_mmu-mir-8103
  gRNA
caagaaggggagcagggagc

SEQ ID NO: 62512 - RNA, 20 nt, Artificial Sequence
  MKO10062512_A_mmu-mir-8103
  gRNA
gaaggggagcagggagcagg

SEQ ID NO: 62513 - RNA, 20 nt, Artificial Sequence
  MKO10062513_A_mmu-mir-7235
  gRNA
gacuucuugcuucucuccuc

SEQ ID NO: 62514 - RNA, 20 nt, Artificial Sequence
  MKO10062514_A_mmu-mir-7235
  gRNA
ggucugggcagaagugaagc

SEQ ID NO: 62515 - RNA, 20 nt, Artificial Sequence
  MKO10062515_A_mmu-mir-7235
  gRNA
agccgaggagggaggggucu

SEQ ID NO: 62516 - RNA, 20 nt, Artificial Sequence
  MKO10062516_A_mmu-mir-7235
  gRNA
cagaguagccgaggagggag

SEQ ID NO: 62517 - RNA, 20 nt, Artificial Sequence
  MKO10062517_A_mmu-mir-6927
  gRNA
aaggugaggggauccagccc

SEQ ID NO: 62518 - RNA, 20 nt, Artificial Sequence
  MKO10062518_A_mmu-mir-6927
  gRNA
gaggggauccagcccaggcu

SEQ ID NO: 62519 - RNA, 20 nt, Artificial Sequence
  MKO10062519_A_mmu-mir-6927
  gRNA
ggggauccagcccaggcuag

SEQ ID NO: 62520 - RNA, 20 nt, Artificial Sequence
  MKO10062520_A_mmu-mir-6927
  gRNA
gggggaagaaucccugcccg

SEQ ID NO: 62521 - RNA, 20 nt, Artificial Sequence
  MKO10062521_A_mmu-mir-8102
  gRNA
ggaaugguaccgcccguccc

SEQ ID NO: 62522 - RNA, 20 nt, Artificial Sequence
  MKO10062522_A_mmu-mir-8102
  gRNA
cccgcccacuccuccucucc

SEQ ID NO: 62523 - RNA, 20 nt, Artificial Sequence
  MKO10062523_A_mmu-mir-8102
  gRNA
cuccuccucucccggccuga

SEQ ID NO: 62524 - RNA, 20 nt, Artificial Sequence
  MKO10062524_A_mmu-mir-8102
  gRNA
cggccugaagggaacccagc

SEQ ID NO: 62525 - RNA, 20 nt, Artificial Sequence
  MKO10062525_A_mmu-mir-5119
  gRNA
aaaaauaagcuuaucagggc

SEQ ID NO: 62526 - RNA, 20 nt, Artificial Sequence
  MKO10062526_A_mmu-mir-5119
  gRNA
agcuuaucagggcuggccua

SEQ ID NO: 62527 - RNA, 20 nt, Artificial Sequence
  MKO10062527_A_mmu-mir-5119
  gRNA
cuauaagucaucucauccug

SEQ ID NO: 62528 - RNA, 20 nt, Artificial Sequence
  MKO10062528_A_mmu-mir-5119
  gRNA
aagucaucucauccuggggc

SEQ ID NO: 62529 - RNA, 20 nt, Artificial Sequence
  MKO10062529_A_mmu-mir-7116
  gRNA
uuuggcuucugagaaggcaa

SEQ ID NO: 62530 - RNA, 20 nt, Artificial Sequence
  MKO10062530_A_mmu-mir-7116
  gRNA
aaggcaaaggaaaaaaaaaa

SEQ ID NO: 62531 - RNA, 20 nt, Artificial Sequence
  MKO10062531_A_mmu-mir-7116
  gRNA
ugacuaacagugaagacauc

SEQ ID NO: 62532 - RNA, 20 nt, Artificial Sequence
  MKO10062532_A_mmu-mir-7116
  gRNA
auaagauuuggcuucugaga

SEQ ID NO: 62533 - RNA, 20 nt, Artificial Sequence
  MKO10062533_A_mmu-mir-6928
  gRNA
aguuuccaaggggauuugca

SEQ ID NO: 62534 - RNA, 20 nt, Artificial Sequence
  MKO10062534_A_mmu-mir-6928
  gRNA
aagcuguuccuguacucucc

SEQ ID NO: 62535 - RNA, 20 nt, Artificial Sequence
  MKO10062535_A_mmu-mir-6928
  gRNA
gcaguccaugcaaauccccu

SEQ ID NO: 62536 - RNA, 20 nt, Artificial Sequence
  MKO10062536_A_mmu-mir-6928
  gRNA
gcucggaaccuggagaguac

SEQ ID NO: 62537 - RNA, 20 nt, Artificial Sequence
  MKO10062537_A_mmu-mir-6929
  gRNA
aaggcugccauagaaaccac

SEQ ID NO: 62538 - RNA, 20 nt, Artificial Sequence
  MKO10062538_A_mmu-mir-6929
  gRNA
gggaggagcagcaucuguga

SEQ ID NO: 62539 - RNA, 20 nt, Artificial Sequence
  MKO10062539_A_mmu-mir-6929
  gRNA
agcagcugggggagggaggg

SEQ ID NO: 62540 - RNA, 20 nt, Artificial Sequence
  MKO10062540_A_mmu-mir-6929
  gRNA
gagagcagcugggggaggga

SEQ ID NO: 62541 - RNA, 20 nt, Artificial Sequence
  MKO10062541_A_mmu-mir-8101
  gRNA
gcgggcggcggcggcagcag

SEQ ID NO: 62542 - RNA, 20 nt, Artificial Sequence
  MKO10062542_A_mmu-mir-8101
  gRNA
ggcggcggcggcagcagcgg

SEQ ID NO: 62543 - RNA, 20 nt, Artificial Sequence
  MKO10062543_A_mmu-mir-8101
  gRNA
agcagcggcggcaacagcag

SEQ ID NO: 62544 - RNA, 20 nt, Artificial Sequence
  MKO10062544_A_mmu-mir-8101
  gRNA
cggcuccuccaucuuugcgg

SEQ ID NO: 62545 - RNA, 20 nt, Artificial Sequence
  MKO10062545_A_mmu-mir-6930
  gRNA
ccugggaguauggagaggcc

SEQ ID NO: 62546 - RNA, 20 nt, Artificial Sequence
  MKO10062546_A_mmu-mir-6930
  gRNA
cuggccucuccauacuccca

SEQ ID NO: 62547 - RNA, 20 nt, Artificial Sequence
  MKO10062547_A_mmu-mir-6930
  gRNA
gagcccuuaagugauuuucc

SEQ ID NO: 62548 - RNA, 20 nt, Artificial Sequence
  MKO10062548_A_mmu-mir-6930
  gRNA
uagggaagggggugcuugag

SEQ ID NO: 62549 - RNA, 20 nt, Artificial Sequence
  MKO10062549_A_mmu-mir-6931
  gRNA
uggacaacugggguaugaag

SEQ ID NO: 62550 - RNA, 20 nt, Artificial Sequence
  MKO10062550_A_mmu-mir-6931
  gRNA
caacugggguaugaagaggu

SEQ ID NO: 62551 - RNA, 20 nt, Artificial Sequence
  MKO10062551_A_mmu-mir-6931
  gRNA
uucugaaucacuagaggcuc

SEQ ID NO: 62552 - RNA, 20 nt, Artificial Sequence
  MKO10062552_A_mmu-mir-6931
  gRNA
ggggacuucugaaucacuag

SEQ ID NO: 62553 - RNA, 20 nt, Artificial Sequence
  MKO10062553_A_mmu-mir-3064
  gRNA
cuaacuuuuuauuuuugguc

SEQ ID NO: 62554 - RNA, 20 nt, Artificial Sequence
  MKO10062554_A_mmu-mir-3064
  gRNA
ucacaucuuccacaucugua

SEQ ID NO: 62555 - RNA, 20 nt, Artificial Sequence
  MKO10062555_A_mmu-mir-3064
  gRNA
aucuguaagguguugcagug

SEQ ID NO: 62556 - RNA, 20 nt, Artificial Sequence
  MKO10062556_A_mmu-mir-3064
  gRNA
uguggcaaaauagcaaugua

SEQ ID NO: 62557 - RNA, 20 nt, Artificial Sequence
  MKO10062557_A_mmu-mir-6932
  gRNA
cuuuguaggugaaguagacu

SEQ ID NO: 62558 - RNA, 20 nt, Artificial Sequence
  MKO10062558_A_mmu-mir-6932
  gRNA
gcucagagguguagcugcag

SEQ ID NO: 62559 - RNA, 20 nt, Artificial Sequence
  MKO10062559_A_mmu-mir-6932
  gRNA
gaauuggauggagucuuugu

SEQ ID NO: 62560 - RNA, 20 nt, Artificial Sequence
  MKO10062560_A_mmu-mir-7223
  gRNA
uucccugucucgaacaagcu

SEQ ID NO: 62561 - RNA, 20 nt, Artificial Sequence
  MKO10062561_A_mmu-mir-7223
  gRNA
acugcacucuagcuuugcug

SEQ ID NO: 62562 - RNA, 20 nt, Artificial Sequence
  MKO10062562_A_mmu-mir-7223
  gRNA
cucuagcuuugcugaggugu

SEQ ID NO: 62563 - RNA, 20 nt, Artificial Sequence
  MKO10062563_A_mmu-mir-7223
  gRNA
cuagcuuugcugaggugucg

SEQ ID NO: 62564 - RNA, 20 nt, Artificial Sequence
  MKO10062564_A_mmu-mir-3968
  gRNA
ugggccgcaaccccuacuca

SEQ ID NO: 62565 - RNA, 20 nt, Artificial Sequence
  MKO10062565_A_mmu-mir-3968
  gRNA
caaccccuacucaugguguc

SEQ ID NO: 62566 - RNA, 20 nt, Artificial Sequence
  MKO10062566_A_mmu-mir-3968
  gRNA
ccuacucauggugucuggag

SEQ ID NO: 62567 - RNA, 20 nt, Artificial Sequence
  MKO10062567_A_mmu-mir-3968
  gRNA
auucgcucaaguucucugug

SEQ ID NO: 62568 - RNA, 20 nt, Artificial Sequence
  MKO10062568_A_mmu-mir-5621
  gRNA
agguggggcucaggaggucc

SEQ ID NO: 62569 - RNA, 20 nt, Artificial Sequence
  MKO10062569_A_mmu-mir-5621
  gRNA
guggggcucaggagguccug

SEQ ID NO: 62570 - RNA, 20 nt, Artificial Sequence
  MKO10062570_A_mmu-mir-5621
  gRNA
ucugccuucagggcggcccc

SEQ ID NO: 62571 - RNA, 20 nt, Artificial Sequence
  MKO10062571_A_mmu-mir-5621
  gRNA
caggcaggaagcaugagguc

SEQ ID NO: 62572 - RNA, 20 nt, Artificial Sequence
  MKO10062572_A_mmu-mir-6516
  gRNA
aggaggaggaaccucuuccc

SEQ ID NO: 62573 - RNA, 20 nt, Artificial Sequence
  MKO10062573_A_mmu-mir-6516
  gRNA
gaggaggaaccucuucccug

SEQ ID NO: 62574 - RNA, 20 nt, Artificial Sequence
  MKO10062574_A_mmu-mir-6516
  gRNA
ggguuagaauuugcaguaac

SEQ ID NO: 62575 - RNA, 20 nt, Artificial Sequence
  MKO10062575_A_mmu-mir-6516
  gRNA
acauccuagcagcaguuugg

SEQ ID NO: 62576 - RNA, 20 nt, Artificial Sequence
  MKO10062576_A_mmu-mir-6933
  gRNA
uggucugucuggcggcaguc

SEQ ID NO: 62577 - RNA, 20 nt, Artificial Sequence
  MKO10062577_A_mmu-mir-6933
  gRNA
gucaggauaccugucuuucc

SEQ ID NO: 62578 - RNA, 20 nt, Artificial Sequence
  MKO10062578_A_mmu-mir-6933
  gRNA
ggauaccugucuuuccuggu

SEQ ID NO: 62579 - RNA, 20 nt, Artificial Sequence
  MKO10062579_A_mmu-mir-6933
  gRNA
uuuccucugccgucacacuc

SEQ ID NO: 62580 - RNA, 20 nt, Artificial Sequence
  MKO10062580_A_mmu-mir-6934
  gRNA
ucaacaggauccuccuggug

SEQ ID NO: 62581 - RNA, 20 nt, Artificial Sequence
  MKO10062581_A_mmu-mir-6934
  gRNA
caggauccuccugguggggc

SEQ ID NO: 62582 - RNA, 20 nt, Artificial Sequence
  MKO10062582_A_mmu-mir-6934
  gRNA
uccugguggggcaggagcag

SEQ ID NO: 62583 - RNA, 20 nt, Artificial Sequence
  MKO10062583_A_mmu-mir-6934
  gRNA
ugguggggcaggagcagagg

SEQ ID NO: 62584 - RNA, 20 nt, Artificial Sequence
  MKO10062584_A_mmu-mir-1932
  gRNA
ccccauuaacucucggguug

SEQ ID NO: 62585 - RNA, 20 nt, Artificial Sequence
  MKO10062585_A_mmu-mir-1932
  gRNA
gguugcggacagcgcuaggu

SEQ ID NO: 62586 - RNA, 20 nt, Artificial Sequence
  MKO10062586_A_mmu-mir-1932
  gRNA
gacucagggccaggcuggac

SEQ ID NO: 62587 - RNA, 20 nt, Artificial Sequence
  MKO10062587_A_mmu-mir-1932
  gRNA
ucggagacucagggccaggc

SEQ ID NO: 62588 - RNA, 20 nt, Artificial Sequence
  MKO10062588_A_mmu-mir-338
  gRNA
cugugcacccacucagcacc

SEQ ID NO: 62589 - RNA, 20 nt, Artificial Sequence
  MKO10062589_A_mmu-mir-338
  gRNA
acucagcaccaggauauugu

SEQ ID NO: 62590 - RNA, 20 nt, Artificial Sequence
  MKO10062590_A_mmu-mir-338
  gRNA
ucagcaccaggauauuguug

SEQ ID NO: 62591 - RNA, 20 nt, Artificial Sequence
  MKO10062591_A_mmu-mir-338
  gRNA
gcaccaggauauuguugggg

SEQ ID NO: 62592 - RNA, 20 nt, Artificial Sequence
  MKO10062592_A_mmu-mir-3065
  gRNA
cugugcacccacucagcacc

SEQ ID NO: 62593 - RNA, 20 nt, Artificial Sequence
  MKO10062593_A_mmu-mir-3065
  gRNA
acucagcaccaggauauugu

SEQ ID NO: 62594 - RNA, 20 nt, Artificial Sequence
  MKO10062594_A_mmu-mir-3065
  gRNA
ucagcaccaggauauuguug

SEQ ID NO: 62595 - RNA, 20 nt, Artificial Sequence
  MKO10062595_A_mmu-mir-3065
  gRNA
gcaccaggauauuguugggg

SEQ ID NO: 62596 - RNA, 20 nt, Artificial Sequence
  MKO10062596_A_mmu-mir-6935
  gRNA
ccccugcuacucacucacuc

SEQ ID NO: 62597 - RNA, 20 nt, Artificial Sequence
  MKO10062597_A_mmu-mir-6935
  gRNA
augcagaguguggguguggg

SEQ ID NO: 62598 - RNA, 20 nt, Artificial Sequence
  MKO10062598_A_mmu-mir-6935
  gRNA
agcaugcagagugugggugu

SEQ ID NO: 62599 - RNA, 20 nt, Artificial Sequence
  MKO10062599_A_mmu-mir-6935
  gRNA
caccugagugagugaguagc

SEQ ID NO: 62600 - RNA, 20 nt, Artificial Sequence
  MKO10062600_A_mmu-mir-6936
  gRNA
cgccggcgcgagcgcgggca

SEQ ID NO: 62601 - RNA, 20 nt, Artificial Sequence
  MKO10062601_A_mmu-mir-6936
  gRNA
gggcacggcaguggcucacc

SEQ ID NO: 62602 - RNA, 20 nt, Artificial Sequence
  MKO10062602_A_mmu-mir-6936
  gRNA
cgcgcucgcgccggcgcgcg

SEQ ID NO: 62603 - RNA, 20 nt, Artificial Sequence
  MKO10062603_A_mmu-mir-6936
  gRNA
ugccgugcccgcgcucgcgc

SEQ ID NO: 62604 - RNA, 20 nt, Artificial Sequence
  MKO10062604_A_mmu-mir-7236
  gRNA
aggaaaggucuaaaucugug

SEQ ID NO: 62605 - RNA, 20 nt, Artificial Sequence
  MKO10062605_A_mmu-mir-7236
  gRNA
uaaaucugugcgguccaacc

SEQ ID NO: 62606 - RNA, 20 nt, Artificial Sequence
  MKO10062606_A_mmu-mir-7236
  gRNA
uccaaugccauuuaacuacc

SEQ ID NO: 62607 - RNA, 20 nt, Artificial Sequence
  MKO10062607_A_mmu-mir-7236
  gRNA
ggcaaggcccuaaaacugug

SEQ ID NO: 62608 - RNA, 20 nt, Artificial Sequence
  MKO10062608_A_mmu-mir-7675
  gRNA
augaagagcaagcuguguuc

SEQ ID NO: 62609 - RNA, 20 nt, Artificial Sequence
  MKO10062609_A_mmu-mir-7675
  gRNA
gugacucugcuuuguauaug

SEQ ID NO: 62610 - RNA, 20 nt, Artificial Sequence
  MKO10062610_A_mmu-mir-6387
  gRNA
gaguaacacacccacugcaa

SEQ ID NO: 62611 - RNA, 20 nt, Artificial Sequence
  MKO10062611_A_mmu-mir-6387
  gRNA
acccacugcaauggagccuc

SEQ ID NO: 62612 - RNA, 20 nt, Artificial Sequence
  MKO10062612_A_mmu-mir-6387
  gRNA
ggcacaccucugacucacug

SEQ ID NO: 62613 - RNA, 20 nt, Artificial Sequence
  MKO10062613_A_mmu-mir-6387
  gRNA
cucugacucacugaggccac

SEQ ID NO: 62614 - RNA, 20 nt, Artificial Sequence
  MKO10062614_A_mmu-mir-3066
  gRNA
gugaguagugugguauguuu

SEQ ID NO: 62615 - RNA, 20 nt, Artificial Sequence
  MKO10062615_A_mmu-mir-3066
  gRNA
agcauggccagugcagguug

SEQ ID NO: 62616 - RNA, 20 nt, Artificial Sequence
  MKO10062616_A_mmu-mir-3066
  gRNA
gcccagagcauggccagugc

SEQ ID NO: 62617 - RNA, 20 nt, Artificial Sequence
  MKO10062617_A_mmu-mir-3066
  gRNA
uaauagaccgcaaccugcac

SEQ ID NO: 62618 - RNA, 20 nt, Artificial Sequence
  MKO10062618_A_mmu-mir-6538
  gRNA
gcgcgauccccaagugcaag

SEQ ID NO: 62619 - RNA, 20 nt, Artificial Sequence
  MKO10062619_A_mmu-mir-6538
  gRNA
auccccaagugcaagcggcc

SEQ ID NO: 62620 - RNA, 20 nt, Artificial Sequence
  MKO10062620_A_mmu-mir-6538
  gRNA
cccaagugcaagcggccagg

SEQ ID NO: 62621 - RNA, 20 nt, Artificial Sequence
  MKO10062621_A_mmu-mir-6538
  gRNA
ugcaagcggccaggaggacg

SEQ ID NO: 62622 - RNA, 20 nt, Artificial Sequence
  MKO10062622_A_mmu-mir-6937
  gRNA
uucacuguagucuagcugua

SEQ ID NO: 62623 - RNA, 20 nt, Artificial Sequence
  MKO10062623_A_mmu-mir-6937
  gRNA
uguagucuagcuguaagggc

SEQ ID NO: 62624 - RNA, 20 nt, Artificial Sequence
  MKO10062624_A_mmu-mir-6937
  gRNA
ucggucuccaggaaacucac

SEQ ID NO: 62625 - RNA, 20 nt, Artificial Sequence
  MKO10062625_A_mmu-mir-6937
  gRNA
caucuugaucuagugcaagg

SEQ ID NO: 62626 - RNA, 20 nt, Artificial Sequence
  MKO10062626_A_mmu-mir-680-3
  gRNA
gaagucaggcucuaggcagc

SEQ ID NO: 62627 - RNA, 20 nt, Artificial Sequence
  MKO10062627_A_mmu-mir-680-3
  gRNA
cugacaugggggcagaaguc

SEQ ID NO: 62628 - RNA, 20 nt, Artificial Sequence
  MKO10062628_A_mmu-mir-680-3
  gRNA
aggugggcaucugcugacau

SEQ ID NO: 62629 - RNA, 20 nt, Artificial Sequence
  MKO10062629_A_mmu-mir-680-3
  gRNA
uaacaaagaacaaaaaaggu

SEQ ID NO: 62630 - RNA, 20 nt, Artificial Sequence
  MKO10062630_A_mmu-mir-5099
  gRNA
aauuacauugauuuaagaag

SEQ ID NO: 62631 - RNA, 20 nt, Artificial Sequence
  MKO10062631_A_mmu-mir-5099
  gRNA
guaaugggcuuagaucgaug

SEQ ID NO: 62632 - RNA, 20 nt, Artificial Sequence
  MKO10062632_A_mmu-mir-5099
  gRNA
cccuggccugaagagaacuc

SEQ ID NO: 62633 - RNA, 20 nt, Artificial Sequence
  MKO10062633_A_mmu-mir-5099
  gRNA
auugauuuaagaagugguaa

SEQ ID NO: 62634 - RNA, 20 nt, Artificial Sequence
  MKO10062634_A_mmu-mir-1938
  gRNA
uacaagucccaccgcgcccc

SEQ ID NO: 62635 - RNA, 20 nt, Artificial Sequence
  MKO10062635_A_mmu-mir-1938
  gRNA
ugcaguucccaucaugcccu

SEQ ID NO: 62636 - RNA, 20 nt, Artificial Sequence
  MKO10062636_A_mmu-mir-1938
  gRNA
gcccaagucugcauagcgcg

SEQ ID NO: 62637 - RNA, 20 nt, Artificial Sequence
  MKO10062637_A_mmu-mir-1938
  gRNA
uuguaguucggucuucgcuu

SEQ ID NO: 62638 - RNA, 20 nt, Artificial Sequence
  MKO10062638_A_mmu-mir-5627
  gRNA
gcguccccgcccuagaggac

SEQ ID NO: 62639 - RNA, 20 nt, Artificial Sequence
  MKO10062639_A_mmu-mir-5627
  gRNA
gggcucuccggcgccccucg

SEQ ID NO: 62640 - RNA, 20 nt, Artificial Sequence
  MKO10062640_A_mmu-mir-5627
  gRNA
ccggagagcccuguccucua

SEQ ID NO: 62641 - RNA, 20 nt, Artificial Sequence
  MKO10062641_A_mmu-mir-5627
  gRNA
aggcugaaaaggcccacgag

SEQ ID NO: 62642 - RNA, 20 nt, Artificial Sequence
  MKO10062642_A_mmu-mir-1892
  gRNA
agaauuuggggacgggaggg

SEQ ID NO: 62643 - RNA, 20 nt, Artificial Sequence
  MKO10062643_A_mmu-mir-1892
  gRNA
aagaaacaauacagaauuug

SEQ ID NO: 62644 - RNA, 20 nt, Artificial Sequence
  MKO10062644_A_mmu-mir-1892
  gRNA
uauuguuucuuacaaaacuu

SEQ ID NO: 62645 - RNA, 20 nt, Artificial Sequence
  MKO10062645_A_mmu-mir-1892
  gRNA
ucaagaguagaaauauaucc

SEQ ID NO: 62646 - RNA, 20 nt, Artificial Sequence
  MKO10062646_A_mmu-mir-681
  gRNA
agcuacaacugucccgcugg

SEQ ID NO: 62647 - RNA, 20 nt, Artificial Sequence
  MKO10062647_A_mmu-mir-681
  gRNA
aacugucccgcuggaggccc

SEQ ID NO: 62648 - RNA, 20 nt, Artificial Sequence
  MKO10062648_A_mmu-mir-681
  gRNA
ugaaacccaucuaccugcuu

SEQ ID NO: 62649 - RNA, 20 nt, Artificial Sequence
  MKO10062649_A_mmu-mir-681
  gRNA
ccugcuuagggagagugaug

SEQ ID NO: 62650 - RNA, 20 nt, Artificial Sequence
  MKO10062650_A_mmu-mir-5101
  gRNA
aaacaacaagucuuacaaaa

SEQ ID NO: 62651 - RNA, 20 nt, Artificial Sequence
  MKO10062651_A_mmu-mir-5101
  gRNA
ucuaauacucucacauucuc

SEQ ID NO: 62652 - RNA, 20 nt, Artificial Sequence
  MKO10062652_A_mmu-mir-5135
  gRNA
ugaccugcuccaguaggacc

SEQ ID NO: 62653 - RNA, 20 nt, Artificial Sequence
  MKO10062653_A_mmu-mir-5135
  gRNA
cgcuucuccugggaaagucu

SEQ ID NO: 62654 - RNA, 20 nt, Artificial Sequence
  MKO10062654_A_mmu-mir-5135
  gRNA
uucuccugggaaagucuagg

SEQ ID NO: 62655 - RNA, 20 nt, Artificial Sequence
  MKO10062655_A_mmu-mir-5135
  gRNA
ccugggaaagucuagguggc

SEQ ID NO: 62656 - RNA, 20 nt, Artificial Sequence
  MKO10062656_A_mmu-mir-1843a
  gRNA
gagagucuaagguuguaugg

SEQ ID NO: 62657 - RNA, 20 nt, Artificial Sequence
  MKO10062657_A_mmu-mir-1843a
  gRNA
gcgguccuacaugaauaugg

SEQ ID NO: 62658 - RNA, 20 nt, Artificial Sequence
  MKO10062658_A_mmu-mir-1843a
  gRNA
gcagcgguccuacaugaaua

SEQ ID NO: 62659 - RNA, 20 nt, Artificial Sequence
  MKO10062659_A_mmu-mir-1843a
  gRNA
agugagagucuaagguugua

SEQ ID NO: 62660 - RNA, 20 nt, Artificial Sequence
  MKO10062660_A_mmu-mir-3067
  gRNA
ccccagcuuccccaguucuc

SEQ ID NO: 62661 - RNA, 20 nt, Artificial Sequence
  MKO10062661_A_mmu-mir-3067
  gRNA
cccaguucucaggcccgcug

SEQ ID NO: 62662 - RNA, 20 nt, Artificial Sequence
  MKO10062662_A_mmu-mir-3067
  gRNA
gcccgcuguggugugaaguu

SEQ ID NO: 62663 - RNA, 20 nt, Artificial Sequence
  MKO10062663_A_mmu-mir-3067
  gRNA
gguucaccaagcggcugccc

SEQ ID NO: 62664 - RNA, 20 nt, Artificial Sequence
  MKO10062664_A_mmu-mir-6938
  gRNA
ucaucuggggcugucuccuu

SEQ ID NO: 62665 - RNA, 20 nt, Artificial Sequence
  MKO10062665_A_mmu-mir-6938
  gRNA
gaagucaugcuugucaucug

SEQ ID NO: 62666 - RNA, 20 nt, Artificial Sequence
  MKO10062666_A_mmu-mir-6938
  gRNA
aagcaugacuucacucucuc

SEQ ID NO: 62667 - RNA, 20 nt, Artificial Sequence
  MKO10062667_A_mmu-mir-6938
  gRNA
gugaagucaugcuugucauc

SEQ ID NO: 62668 - RNA, 20 nt, Artificial Sequence
  MKO10062668_A_mmu-mir-3068
  gRNA
aaccagcuuacucaguagcu

SEQ ID NO: 62669 - RNA, 20 nt, Artificial Sequence
  MKO10062669_A_mmu-mir-3068
  gRNA
agcagauggaagcagaaugu

SEQ ID NO: 62670 - RNA, 20 nt, Artificial Sequence
  MKO10062670_A_mmu-mir-3068
  gRNA
cacccagcuacugaguaagc

SEQ ID NO: 62671 - RNA, 20 nt, Artificial Sequence
  MKO10062671_A_mmu-mir-3068
  gRNA
acagaguaugcgagaguaau

SEQ ID NO: 62672 - RNA, 20 nt, Artificial Sequence
  MKO10062672_A_mmu-mir-8099-1
  gRNA
gcugccuucucucagagcca

SEQ ID NO: 62673 - RNA, 20 nt, Artificial Sequence
  MKO10062673_A_mmu-mir-8099-1
  gRNA
ucagagccaaggcgugggaa

SEQ ID NO: 62674 - RNA, 20 nt, Artificial Sequence
  MKO10062674_A_mmu-mir-8099-1
  gRNA
caaggcgugggaaagguugu

SEQ ID NO: 62675 - RNA, 20 nt, Artificial Sequence
  MKO10062675_A_mmu-mir-8099-1
  gRNA
cccacccuuuaccuugggag

SEQ ID NO: 62676 - RNA, 20 nt, Artificial Sequence
  MKO10062676_A_mmu-mir-1190
  gRNA
guagucucucagcugacuca

SEQ ID NO: 62677 - RNA, 20 nt, Artificial Sequence
  MKO10062677_A_mmu-mir-1190
  gRNA
cagaggggaaccucagcuga

SEQ ID NO: 62678 - RNA, 20 nt, Artificial Sequence
  MKO10062678_A_mmu-mir-1190
  gRNA
gaggggaaccucagcugacg

SEQ ID NO: 62679 - RNA, 20 nt, Artificial Sequence
  MKO10062679_A_mmu-mir-1190
  gRNA
agaccuucccacgucugcaa

SEQ ID NO: 62680 - RNA, 20 nt, Artificial Sequence
  MKO10062680_A_mmu-mir-1936
  gRNA
cuaacugaccugcugugaac

SEQ ID NO: 62681 - RNA, 20 nt, Artificial Sequence
  MKO10062681_A_mmu-mir-1936
  gRNA
aggggaggccagucacacag

SEQ ID NO: 62682 - RNA, 20 nt, Artificial Sequence
  MKO10062682_A_mmu-mir-1936
  gRNA
ucucuuaguauaggggguga

SEQ ID NO: 62683 - RNA, 20 nt, Artificial Sequence
  MKO10062683_A_mmu-mir-1936
  gRNA
gugcagcucagggggucaug

SEQ ID NO: 62684 - RNA, 20 nt, Artificial Sequence
  MKO10062684_A_mmu-mir-3069
  gRNA
gcagacggagcgguuucugu

SEQ ID NO: 62685 - RNA, 20 nt, Artificial Sequence
  MKO10062685_A_mmu-mir-3069
  gRNA
ucaagauauuguuuagcaga

SEQ ID NO: 62686 - RNA, 20 nt, Artificial Sequence
  MKO10062686_A_mmu-mir-3069
  gRNA
ugccaagcuucucugacugu

SEQ ID NO: 62687 - RNA, 20 nt, Artificial Sequence
  MKO10062687_A_mmu-mir-3069
  gRNA
auauuguuuagcagacggag

SEQ ID NO: 62688 - RNA, 20 nt, Artificial Sequence
  MKO10062688_A_mmu-mir-342
  gRNA
caucugugaaaaugggcuca

SEQ ID NO: 62689 - RNA, 20 nt, Artificial Sequence
  MKO10062689_A_mmu-mir-342
  gRNA
gugaaaaugggcucaaggug

SEQ ID NO: 62690 - RNA, 20 nt, Artificial Sequence
  MKO10062690_A_mmu-mir-342
  gRNA
gaaaaugggcucaaggugag

SEQ ID NO: 62691 - RNA, 20 nt, Artificial Sequence
  MKO10062691_A_mmu-mir-342
  gRNA
cuaucugugauugagggaca

SEQ ID NO: 62692 - RNA, 20 nt, Artificial Sequence
  MKO10062692_A_mmu-mir-345
  gRNA
ugaagccgacacccaagucc

SEQ ID NO: 62693 - RNA, 20 nt, Artificial Sequence
  MKO10062693_A_mmu-mir-345
  gRNA
gaccccuaguccagugcuug

SEQ ID NO: 62694 - RNA, 20 nt, Artificial Sequence
  MKO10062694_A_mmu-mir-345
  gRNA
ccagugcuugugguggcuac

SEQ ID NO: 62695 - RNA, 20 nt, Artificial Sequence
  MKO10062695_A_mmu-mir-345
  gRNA
gcuacugggcccugaacuag

SEQ ID NO: 62696 - RNA, 20 nt, Artificial Sequence
  MKO10062696_A_mmu-mir-1906-1
  gRNA
uuugggguaguggggacauu

SEQ ID NO: 62697 - RNA, 20 nt, Artificial Sequence
  MKO10062697_A_mmu-mir-1906-1
  gRNA
gacauuaggagcaaccuccu

SEQ ID NO: 62698 - RNA, 20 nt, Artificial Sequence
  MKO10062698_A_mmu-mir-1906-1
  gRNA
aaaugaacugcagcagccug

SEQ ID NO: 62699 - RNA, 20 nt, Artificial Sequence
  MKO10062699_A_mmu-mir-1906-1
  gRNA
gcagcagccugaggcagggc

SEQ ID NO: 62700 - RNA, 20 nt, Artificial Sequence
  MKO10062700_A_mmu-mir-770
  gRNA
ugcccccagcaccacguguc

SEQ ID NO: 62701 - RNA, 20 nt, Artificial Sequence
  MKO10062701_A_mmu-mir-770
  gRNA
gccacgugagcaacgccacg

SEQ ID NO: 62702 - RNA, 20 nt, Artificial Sequence
  MKO10062702_A_mmu-mir-770
  gRNA
acgugggccugacguggagc

SEQ ID NO: 62703 - RNA, 20 nt, Artificial Sequence
  MKO10062703_A_mmu-mir-770
  gRNA
gugggccugacguggagcug

SEQ ID NO: 62704 - RNA, 20 nt, Artificial Sequence
  MKO10062704_A_mmu-mir-673
  gRNA
gucuggcuuuggagccugag

SEQ ID NO: 62705 - RNA, 20 nt, Artificial Sequence
  MKO10062705_A_mmu-mir-673
  gRNA
gccugaggggcucacagcuc

SEQ ID NO: 62706 - RNA, 20 nt, Artificial Sequence
  MKO10062706_A_mmu-mir-673
  gRNA
cuccagagaaaauguugcuc

SEQ ID NO: 62707 - RNA, 20 nt, Artificial Sequence
  MKO10062707_A_mmu-mir-673
  gRNA
ccagagaaaauguugcuccg

SEQ ID NO: 62708 - RNA, 20 nt, Artificial Sequence
  MKO10062708_A_mmu-mir-493
  gRNA
ggccgccagggccuuguaca

SEQ ID NO: 62709 - RNA, 20 nt, Artificial Sequence
  MKO10062709_A_mmu-mir-493
  gRNA
gccagggccuuguacauggu

SEQ ID NO: 62710 - RNA, 20 nt, Artificial Sequence
  MKO10062710_A_mmu-mir-493
  gRNA
auuuuuugcacauucgguga

SEQ ID NO: 62711 - RNA, 20 nt, Artificial Sequence
  MKO10062711_A_mmu-mir-493
  gRNA
ugaagguccuacugugugcc

SEQ ID NO: 62712 - RNA, 20 nt, Artificial Sequence
  MKO10062712_A_mmu-mir-337
  gRNA
uguagugagaaguugggggg

SEQ ID NO: 62713 - RNA, 20 nt, Artificial Sequence
  MKO10062713_A_mmu-mir-337
  gRNA
gagaaguuggggggugggaa

SEQ ID NO: 62714 - RNA, 20 nt, Artificial Sequence
  MKO10062714_A_mmu-mir-337
  gRNA
aggccucacgcgguugaagg

SEQ ID NO: 62715 - RNA, 20 nt, Artificial Sequence
  MKO10062715_A_mmu-mir-337
  gRNA
gucccaguguagugagaagu

SEQ ID NO: 62716 - RNA, 20 nt, Artificial Sequence
  MKO10062716_A_mmu-mir-3544
  gRNA
gggugggaacggcgucaugc

SEQ ID NO: 62717 - RNA, 20 nt, Artificial Sequence
  MKO10062717_A_mmu-mir-3544
  gRNA
ggcaucauauaggagcugaa

SEQ ID NO: 62718 - RNA, 20 nt, Artificial Sequence
  MKO10062718_A_mmu-mir-3544
  gRNA
ggugaagaaaggcaucauau

SEQ ID NO: 62719 - RNA, 20 nt, Artificial Sequence
  MKO10062719_A_mmu-mir-3544
  gRNA
cgguugaagggggugaagaa

SEQ ID NO: 62720 - RNA, 20 nt, Artificial Sequence
  MKO10062720_A_mmu-mir-540
  gRNA
cauucccuggggcugggcca

SEQ ID NO: 62721 - RNA, 20 nt, Artificial Sequence
  MKO10062721_A_mmu-mir-540
  gRNA
agggucacccucugacucug

SEQ ID NO: 62722 - RNA, 20 nt, Artificial Sequence
  MKO10062722_A_mmu-mir-540
  gRNA
acccucugacucuguggcca

SEQ ID NO: 62723 - RNA, 20 nt, Artificial Sequence
  MKO10062723_A_mmu-mir-540
  gRNA
gccaaggguagacaggucag

SEQ ID NO: 62724 - RNA, 20 nt, Artificial Sequence
  MKO10062724_A_mmu-mir-665
  gRNA
cccagaacagggucuccuug

SEQ ID NO: 62725 - RNA, 20 nt, Artificial Sequence
  MKO10062725_A_mmu-mir-665
  gRNA
aggauuauguuuuuaugacc

SEQ ID NO: 62726 - RNA, 20 nt, Artificial Sequence
  MKO10062726_A_mmu-mir-665
  gRNA
auuauguuuuuaugaccagg

SEQ ID NO: 62727 - RNA, 20 nt, Artificial Sequence
  MKO10062727_A_mmu-mir-665
  gRNA
uuuuuaugaccaggaggcug

SEQ ID NO: 62728 - RNA, 20 nt, Artificial Sequence
  MKO10062728_A_mmu-mir-3070a
  gRNA
ggauccuauccaugaucucc

SEQ ID NO: 62729 - RNA, 20 nt, Artificial Sequence
  MKO10062729_A_mmu-mir-3070a
  gRNA
ucuccuggugcuaccgucag

SEQ ID NO: 62730 - RNA, 20 nt, Artificial Sequence
  MKO10062730_A_mmu-mir-3070a
  gRNA
gaucccagguucaaggucag

SEQ ID NO: 62731 - RNA, 20 nt, Artificial Sequence
  MKO10062731_A_mmu-mir-3070a
  gRNA
aggaucccagguucaagguc

SEQ ID NO: 62732 - RNA, 20 nt, Artificial Sequence
  MKO10062732_A_mmu-mir-3070b
  gRNA
ggauccuccccaugaucuuc

SEQ ID NO: 62733 - RNA, 20 nt, Artificial Sequence
  MKO10062733_A_mmu-mir-3070b
  gRNA
gaucuucuggugcuaugguc

SEQ ID NO: 62734 - RNA, 20 nt, Artificial Sequence
  MKO10062734_A_mmu-mir-3070b
  gRNA
ucuucuggugcuauggucag

SEQ ID NO: 62735 - RNA, 20 nt, Artificial Sequence
  MKO10062735_A_mmu-mir-3070b
  gRNA
gaucccagguucaaggucag

SEQ ID NO: 62736 - RNA, 20 nt, Artificial Sequence
  MKO10062736_A_mmu-mir-431
  gRNA
guuguccugcgcguccugcg

SEQ ID NO: 62737 - RNA, 20 nt, Artificial Sequence
  MKO10062737_A_mmu-mir-431
  gRNA
cguccugcgaggugucuugc

SEQ ID NO: 62738 - RNA, 20 nt, Artificial Sequence
  MKO10062738_A_mmu-mir-431
  gRNA
cacacugacgguaacguugc

SEQ ID NO: 62739 - RNA, 20 nt, Artificial Sequence
  MKO10062739_A_mmu-mir-431
  gRNA
aacguugcaggucgucuugc

SEQ ID NO: 62740 - RNA, 20 nt, Artificial Sequence
  MKO10062740_A_mmu-mir-433
  gRNA
agaagaagacccaaugcccg

SEQ ID NO: 62741 - RNA, 20 nt, Artificial Sequence
  MKO10062741_A_mmu-mir-433
  gRNA
ccaaugcccggggagaagua

SEQ ID NO: 62742 - RNA, 20 nt, Artificial Sequence
  MKO10062742_A_mmu-mir-433
  gRNA
gagccugucauuauucagag

SEQ ID NO: 62743 - RNA, 20 nt, Artificial Sequence
  MKO10062743_A_mmu-mir-433
  gRNA
cuagauccucuguguugaga

SEQ ID NO: 62744 - RNA, 20 nt, Artificial Sequence
  MKO10062744_A_mmu-mir-127
  gRNA
cucugauucagaaagaucau

SEQ ID NO: 62745 - RNA, 20 nt, Artificial Sequence
  MKO10062745_A_mmu-mir-127
  gRNA
ucaucggauccgucugagcu

SEQ ID NO: 62746 - RNA, 20 nt, Artificial Sequence
  MKO10062746_A_mmu-mir-127
  gRNA
cggauccgucugagcuuggc

SEQ ID NO: 62747 - RNA, 20 nt, Artificial Sequence
  MKO10062747_A_mmu-mir-127
  gRNA
uccgucugagcuuggcuggu

SEQ ID NO: 62748 - RNA, 20 nt, Artificial Sequence
  MKO10062748_A_mmu-mir-434
  gRNA
ucgaaccaggagucgaguga

SEQ ID NO: 62749 - RNA, 20 nt, Artificial Sequence
  MKO10062749_A_mmu-mir-434
  gRNA
aagugaugaugguucgaacc

SEQ ID NO: 62750 - RNA, 20 nt, Artificial Sequence
  MKO10062750_A_mmu-mir-434
  gRNA
uuggaaacaucgcucgacuc

SEQ ID NO: 62751 - RNA, 20 nt, Artificial Sequence
  MKO10062751_A_mmu-mir-434
  gRNA
uugaaccaaagcucgacuca

SEQ ID NO: 62752 - RNA, 20 nt, Artificial Sequence
  MKO10062752_A_mmu-mir-432
  gRNA
cauuuccuggugggggccac

SEQ ID NO: 62753 - RNA, 20 nt, Artificial Sequence
  MKO10062753_A_mmu-mir-432
  gRNA
uccuggugggggccacugga

SEQ ID NO: 62754 - RNA, 20 nt, Artificial Sequence
  MKO10062754_A_mmu-mir-432
  gRNA
cacuucuuggaguagaucag

SEQ ID NO: 62755 - RNA, 20 nt, Artificial Sequence
  MKO10062755_A_mmu-mir-432
  gRNA
gccauccaguggcccccacc

SEQ ID NO: 62756 - RNA, 20 nt, Artificial Sequence
  MKO10062756_A_mmu-mir-3071
  gRNA
aacgguguuggaugagcccu

SEQ ID NO: 62757 - RNA, 20 nt, Artificial Sequence
  MKO10062757_A_mmu-mir-3071
  gRNA
gguguuggaugagcccucgg

SEQ ID NO: 62758 - RNA, 20 nt, Artificial Sequence
  MKO10062758_A_mmu-mir-3071
  gRNA
gacuccauuuguuuugauga

SEQ ID NO: 62759 - RNA, 20 nt, Artificial Sequence
  MKO10062759_A_mmu-mir-3071
  gRNA
cgucucaaaugagucuucag

SEQ ID NO: 62760 - RNA, 20 nt, Artificial Sequence
  MKO10062760_A_mmu-mir-136
  gRNA
gacuccauuuguuuugauga

SEQ ID NO: 62761 - RNA, 20 nt, Artificial Sequence
  MKO10062761_A_mmu-mir-136
  gRNA
cgucucaaaugagucuucag

SEQ ID NO: 62762 - RNA, 20 nt, Artificial Sequence
  MKO10062762_A_mmu-mir-136
  gRNA
agacucauuugagacgauga

SEQ ID NO: 62763 - RNA, 20 nt, Artificial Sequence
  MKO10062763_A_mmu-mir-136
  gRNA
aaacaaauggaguccuccga

SEQ ID NO: 62764 - RNA, 20 nt, Artificial Sequence
  MKO10062764_A_mmu-mir-341
  gRNA
guuaaaaugaugaugucagu

SEQ ID NO: 62765 - RNA, 20 nt, Artificial Sequence
  MKO10062765_A_mmu-mir-341
  gRNA
gaugaugucaguuggccggu

SEQ ID NO: 62766 - RNA, 20 nt, Artificial Sequence
  MKO10062766_A_mmu-mir-341
  gRNA
uggccggucggccgaucgcu

SEQ ID NO: 62767 - RNA, 20 nt, Artificial Sequence
  MKO10062767_A_mmu-mir-341
  gRNA
cgcucggucugucagucagu

SEQ ID NO: 62768 - RNA, 20 nt, Artificial Sequence
  MKO10062768_A_mmu-mir-1188
  gRNA
aauacucacagucucccagc

SEQ ID NO: 62769 - RNA, 20 nt, Artificial Sequence
  MKO10062769_A_mmu-mir-1188
  gRNA
acagucucccagcuggugug

SEQ ID NO: 62770 - RNA, 20 nt, Artificial Sequence
  MKO10062770_A_mmu-mir-1188
  gRNA
agcuggugugagguugggcc

SEQ ID NO: 62771 - RNA, 20 nt, Artificial Sequence
  MKO10062771_A_mmu-mir-1188
  gRNA
ccuagcaaggcugugccgag

SEQ ID NO: 62772 - RNA, 20 nt, Artificial Sequence
  MKO10062772_A_mmu-mir-370
  gRNA
gggccuaagacggagagacc

SEQ ID NO: 62773 - RNA, 20 nt, Artificial Sequence
  MKO10062773_A_mmu-mir-370
  gRNA
cacagcucaugagugccugc

SEQ ID NO: 62774 - RNA, 20 nt, Artificial Sequence
  MKO10062774_A_mmu-mir-370
  gRNA
cagcucaugagugccugcug

SEQ ID NO: 62775 - RNA, 20 nt, Artificial Sequence
  MKO10062775_A_mmu-mir-370
  gRNA
cucaugagugccugcugggg

SEQ ID NO: 62776 - RNA, 20 nt, Artificial Sequence
  MKO10062776_A_mmu-mir-882
  gRNA
gucuuccuuacagcaguacc

SEQ ID NO: 62777 - RNA, 20 nt, Artificial Sequence
  MKO10062777_A_mmu-mir-882
  gRNA
ugauuucuggguuuuucuaa

SEQ ID NO: 62778 - RNA, 20 nt, Artificial Sequence
  MKO10062778_A_mmu-mir-882
  gRNA
cuaaugcgcuaacucucucc

SEQ ID NO: 62779 - RNA, 20 nt, Artificial Sequence
  MKO10062779_A_mmu-mir-882
  gRNA
caauaguuaguccugauuuc

SEQ ID NO: 62780 - RNA, 20 nt, Artificial Sequence
  MKO10062780_A_mmu-mir-379
  gRNA
ccugaagagaugguagacua

SEQ ID NO: 62781 - RNA, 20 nt, Artificial Sequence
  MKO10062781_A_mmu-mir-379
  gRNA
gaugguagacuauggaacgu

SEQ ID NO: 62782 - RNA, 20 nt, Artificial Sequence
  MKO10062782_A_mmu-mir-379
  gRNA
guuaguggaccauguuacau

SEQ ID NO: 62783 - RNA, 20 nt, Artificial Sequence
  MKO10062783_A_mmu-mir-379
  gRNA
uguuuuugaccuauguaaca

SEQ ID NO: 62784 - RNA, 20 nt, Artificial Sequence
  MKO10062784_A_mmu-mir-411
  gRNA
cggcgucucugugugguacu

SEQ ID NO: 62785 - RNA, 20 nt, Artificial Sequence
  MKO10062785_A_mmu-mir-411
  gRNA
gauuugauacugaggguuag

SEQ ID NO: 62786 - RNA, 20 nt, Artificial Sequence
  MKO10062786_A_mmu-mir-411
  gRNA
uaucugugacguauguaaca

SEQ ID NO: 62787 - RNA, 20 nt, Artificial Sequence
  MKO10062787_A_mmu-mir-411
  gRNA
caguaucaaauccauccccg

SEQ ID NO: 62788 - RNA, 20 nt, Artificial Sequence
  MKO10062788_A_mmu-mir-299a
  gRNA
ucacgcgguacuugaagaaa

SEQ ID NO: 62789 - RNA, 20 nt, Artificial Sequence
  MKO10062789_A_mmu-mir-299a
  gRNA
auacauuuugaguauguaug

SEQ ID NO: 62790 - RNA, 20 nt, Artificial Sequence
  MKO10062790_A_mmu-mir-299a
  gRNA
uuuugaguauguauguggga

SEQ ID NO: 62791 - RNA, 20 nt, Artificial Sequence
  MKO10062791_A_mmu-mir-299a
  gRNA
ugggacgguaaaccgcuucu

SEQ ID NO: 62792 - RNA, 20 nt, Artificial Sequence
  MKO10062792_A_mmu-mir-299b
  gRNA
auacauuuugaguauguaug

SEQ ID NO: 62793 - RNA, 20 nt, Artificial Sequence
  MKO10062793_A_mmu-mir-299b
  gRNA
uuuugaguauguauguggga

SEQ ID NO: 62794 - RNA, 20 nt, Artificial Sequence
  MKO10062794_A_mmu-mir-299b
  gRNA
uacucaaaauguauguggga

SEQ ID NO: 62795 - RNA, 20 nt, Artificial Sequence
  MKO10062795_A_mmu-mir-299b
  gRNA
uacauacucaaaauguaugu

SEQ ID NO: 62796 - RNA, 20 nt, Artificial Sequence
  MKO10062796_A_mmu-mir-380
  gRNA
acuuugauaacgagaagaug

SEQ ID NO: 62797 - RNA, 20 nt, Artificial Sequence
  MKO10062797_A_mmu-mir-380
  gRNA
cuucugugucguauguagua

SEQ ID NO: 62798 - RNA, 20 nt, Artificial Sequence
  MKO10062798_A_mmu-mir-380
  gRNA
aaccaucuuuucagguacca

SEQ ID NO: 62799 - RNA, 20 nt, Artificial Sequence
  MKO10062799_A_mmu-mir-380
  gRNA
cuauggucaaccaucuuuuc

SEQ ID NO: 62800 - RNA, 20 nt, Artificial Sequence
  MKO10062800_A_mmu-mir-1197
  gRNA
ccaaauuaaguaaagugagc

SEQ ID NO: 62801 - RNA, 20 nt, Artificial Sequence
  MKO10062801_A_mmu-mir-1197
  gRNA
ccucaagguauuugaagaug

SEQ ID NO: 62802 - RNA, 20 nt, Artificial Sequence
  MKO10062802_A_mmu-mir-1197
  gRNA
uuugaagaugcgguugacca

SEQ ID NO: 62803 - RNA, 20 nt, Artificial Sequence
  MKO10062803_A_mmu-mir-1197
  gRNA
cucaauaucacaucucgccu

SEQ ID NO: 62804 - RNA, 20 nt, Artificial Sequence
  MKO10062804_A_mmu-mir-323
  gRNA
uacugcugcugcuugguacu

SEQ ID NO: 62805 - RNA, 20 nt, Artificial Sequence
  MKO10062805_A_mmu-mir-323
  gRNA
gcugcuugguacuuggagag

SEQ ID NO: 62806 - RNA, 20 nt, Artificial Sequence
  MKO10062806_A_mmu-mir-323
  gRNA
gcuugguacuuggagagagg

SEQ ID NO: 62807 - RNA, 20 nt, Artificial Sequence
  MKO10062807_A_mmu-mir-323
  gRNA
uuacacggucgaccucuuug

SEQ ID NO: 62808 - RNA, 20 nt, Artificial Sequence
  MKO10062808_A_mmu-mir-758
  gRNA
gauacacgugugggugcgug

SEQ ID NO: 62809 - RNA, 20 nt, Artificial Sequence
  MKO10062809_A_mmu-mir-758
  gRNA
acacgugugggugcgugagg

SEQ ID NO: 62810 - RNA, 20 nt, Artificial Sequence
  MKO10062810_A_mmu-mir-758
  gRNA
uuaguggaccaggucacaaa

SEQ ID NO: 62811 - RNA, 20 nt, Artificial Sequence
  MKO10062811_A_mmu-mir-758
  gRNA
auacugaggguuaguggacc

SEQ ID NO: 62812 - RNA, 20 nt, Artificial Sequence
  MKO10062812_A_mmu-mir-329
  gRNA
ucaguguucgcuucugguac

SEQ ID NO: 62813 - RNA, 20 nt, Artificial Sequence
  MKO10062813_A_mmu-mir-329
  gRNA
cgcuucugguaccggaagag

SEQ ID NO: 62814 - RNA, 20 nt, Artificial Sequence
  MKO10062814_A_mmu-mir-329
  gRNA
guaccggaagagagguuuuc

SEQ ID NO: 62815 - RNA, 20 nt, Artificial Sequence
  MKO10062815_A_mmu-mir-329
  gRNA
gacccagaaaaccucucuuc

SEQ ID NO: 62816 - RNA, 20 nt, Artificial Sequence
  MKO10062816_A_mmu-mir-494
  gRNA
cagugcuaauugauacuuga

SEQ ID NO: 62817 - RNA, 20 nt, Artificial Sequence
  MKO10062817_A_mmu-mir-494
  gRNA
uauuuaugaugaaacauaca

SEQ ID NO: 62818 - RNA, 20 nt, Artificial Sequence
  MKO10062818_A_mmu-mir-494
  gRNA
uaaauaaagagaagacaaca

SEQ ID NO: 62819 - RNA, 20 nt, Artificial Sequence
  MKO10062819_A_mmu-mir-494
  gRNA
cuaauugauacuugaaggag

SEQ ID NO: 62820 - RNA, 20 nt, Artificial Sequence
  MKO10062820_A_mmu-mir-679
  gRNA
gaggcuacucccuauggcuu

SEQ ID NO: 62821 - RNA, 20 nt, Artificial Sequence
  MKO10062821_A_mmu-mir-679
  gRNA
uuggacugugaggugacucu

SEQ ID NO: 62822 - RNA, 20 nt, Artificial Sequence
  MKO10062822_A_mmu-mir-679
  gRNA
aggugacucuugguguguga

SEQ ID NO: 62823 - RNA, 20 nt, Artificial Sequence
  MKO10062823_A_mmu-mir-679
  gRNA
uccuccucacaguagcuaua

SEQ ID NO: 62824 - RNA, 20 nt, Artificial Sequence
  MKO10062824_A_mmu-mir-1193
  gRNA
cuguucucgggguagcugug

SEQ ID NO: 62825 - RNA, 20 nt, Artificial Sequence
  MKO10062825_A_mmu-mir-1193
  gRNA
ucucgggguagcugugugga

SEQ ID NO: 62826 - RNA, 20 nt, Artificial Sequence
  MKO10062826_A_mmu-mir-1193
  gRNA
uagcuguguggaugguagac

SEQ ID NO: 62827 - RNA, 20 nt, Artificial Sequence
  MKO10062827_A_mmu-mir-1193
  gRNA
auaaaugaaguguacgucac

SEQ ID NO: 62828 - RNA, 20 nt, Artificial Sequence
  MKO10062828_A_mmu-mir-666
  gRNA
agauccugauucugccugcg

SEQ ID NO: 62829 - RNA, 20 nt, Artificial Sequence
  MKO10062829_A_mmu-mir-666
  gRNA
cacagcugugagagcccccu

SEQ ID NO: 62830 - RNA, 20 nt, Artificial Sequence
  MKO10062830_A_mmu-mir-666
  gRNA
gugaucgccugcucacgcac

SEQ ID NO: 62831 - RNA, 20 nt, Artificial Sequence
  MKO10062831_A_mmu-mir-666
  gRNA
cgcuccacgcaggcagaauc

SEQ ID NO: 62832 - RNA, 20 nt, Artificial Sequence
  MKO10062832_A_mmu-mir-543
  gRNA
auauaaagcgaaaaacacgc

SEQ ID NO: 62833 - RNA, 20 nt, Artificial Sequence
  MKO10062833_A_mmu-mir-543
  gRNA
uauaugugacgaaacauucg

SEQ ID NO: 62834 - RNA, 20 nt, Artificial Sequence
  MKO10062834_A_mmu-mir-495
  gRNA
uauuugugacgaaacaaaca

SEQ ID NO: 62835 - RNA, 20 nt, Artificial Sequence
  MKO10062835_A_mmu-mir-495
  gRNA
auaaaagcgaaaaauaacau

SEQ ID NO: 62836 - RNA, 20 nt, Artificial Sequence
  MKO10062836_A_mmu-mir-495
  gRNA
caacuucuuuucagguacca

SEQ ID NO: 62837 - RNA, 20 nt, Artificial Sequence
  MKO10062837_A_mmu-mir-495
  gRNA
aacaugggcaacuucuuuuc

SEQ ID NO: 62838 - RNA, 20 nt, Artificial Sequence
  MKO10062838_A_mmu-mir-667
  gRNA
ccuuuccaucuaguggguac

SEQ ID NO: 62839 - RNA, 20 nt, Artificial Sequence
  MKO10062839_A_mmu-mir-667
  gRNA
caucuaguggguacuggccu

SEQ ID NO: 62840 - RNA, 20 nt, Artificial Sequence
  MKO10062840_A_mmu-mir-667
  gRNA
guggguacuggccucggugc

SEQ ID NO: 62841 - RNA, 20 nt, Artificial Sequence
  MKO10062841_A_mmu-mir-667
  gRNA
gacaccugccacccagccca

SEQ ID NO: 62842 - RNA, 20 nt, Artificial Sequence
  MKO10062842_A_mmu-mir-376c
  gRNA
aucuuuugguauuuaaaagg

SEQ ID NO: 62843 - RNA, 20 nt, Artificial Sequence
  MKO10062843_A_mmu-mir-376c
  gRNA
cuuuuugugauuaaacauag

SEQ ID NO: 62844 - RNA, 20 nt, Artificial Sequence
  MKO10062844_A_mmu-mir-376c
  gRNA
acaaaaagcauaaacauaga

SEQ ID NO: 62845 - RNA, 20 nt, Artificial Sequence
  MKO10062845_A_mmu-mir-376c
  gRNA
uaaaucuuuugguauuuaaa

SEQ ID NO: 62846 - RNA, 20 nt, Artificial Sequence
  MKO10062846_A_mmu-mir-654
  gRNA
cuccucgguaagugggaaga

SEQ ID NO: 62847 - RNA, 20 nt, Artificial Sequence
  MKO10062847_A_mmu-mir-654
  gRNA
ugucugcugaccaucaccuu

SEQ ID NO: 62848 - RNA, 20 nt, Artificial Sequence
  MKO10062848_A_mmu-mir-654
  gRNA
gcagugcccuccucgguaag

SEQ ID NO: 62849 - RNA, 20 nt, Artificial Sequence
  MKO10062849_A_mmu-mir-654
  gRNA
caccuuugggucucugccug

SEQ ID NO: 62850 - RNA, 20 nt, Artificial Sequence
  MKO10062850_A_mmu-mir-376b
  gRNA
cuucuuugguauuuaaaagg

SEQ ID NO: 62851 - RNA, 20 nt, Artificial Sequence
  MKO10062851_A_mmu-mir-376b
  gRNA
gacauuugauacugaaaaag

SEQ ID NO: 62852 - RNA, 20 nt, Artificial Sequence
  MKO10062852_A_mmu-mir-376b
  gRNA
guccuucuuugguauuuaaa

SEQ ID NO: 62853 - RNA, 20 nt, Artificial Sequence
  MKO10062853_A_mmu-mir-376b
  gRNA
aaagguggauauuccuucua

SEQ ID NO: 62854 - RNA, 20 nt, Artificial Sequence
  MKO10062854_A_mmu-mir-376a
  gRNA
auauuaaugacuaaucguag

SEQ ID NO: 62855 - RNA, 20 nt, Artificial Sequence
  MKO10062855_A_mmu-mir-376a
  gRNA
auuaauauuguacucauaga

SEQ ID NO: 62856 - RNA, 20 nt, Artificial Sequence
  MKO10062856_A_mmu-mir-376a
  gRNA
agcauuugauacugaaaacg

SEQ ID NO: 62857 - RNA, 20 nt, Artificial Sequence
  MKO10062857_A_mmu-mir-300
  gRNA
aucguuugcuacuugaagag

SEQ ID NO: 62858 - RNA, 20 nt, Artificial Sequence
  MKO10062858_A_mmu-mir-300
  gRNA
uuacgcgaaaugaauaugca

SEQ ID NO: 62859 - RNA, 20 nt, Artificial Sequence
  MKO10062859_A_mmu-mir-300
  gRNA
gcaagggcaagcucucuucg

SEQ ID NO: 62860 - RNA, 20 nt, Artificial Sequence
  MKO10062860_A_mmu-mir-300
  gRNA
cgcguaaagcaaacacacaa

SEQ ID NO: 62861 - RNA, 20 nt, Artificial Sequence
  MKO10062861_A_mmu-mir-381
  gRNA
auuguuugguacuuaaagcg

SEQ ID NO: 62862 - RNA, 20 nt, Artificial Sequence
  MKO10062862_A_mmu-mir-381
  gRNA
gagguugcccuuuguauauu

SEQ ID NO: 62863 - RNA, 20 nt, Artificial Sequence
  MKO10062863_A_mmu-mir-381
  gRNA
guauauucgguuuauugaca

SEQ ID NO: 62864 - RNA, 20 nt, Artificial Sequence
  MKO10062864_A_mmu-mir-381
  gRNA
uuauugacauggaauauaca

SEQ ID NO: 62865 - RNA, 20 nt, Artificial Sequence
  MKO10062865_A_mmu-mir-487b
  gRNA
ccaggccgagcuuugguacu

SEQ ID NO: 62866 - RNA, 20 nt, Artificial Sequence
  MKO10062866_A_mmu-mir-487b
  gRNA
gagcuuugguacuuggagag

SEQ ID NO: 62867 - RNA, 20 nt, Artificial Sequence
  MKO10062867_A_mmu-mir-487b
  gRNA
ucacucaugccgaaucguac

SEQ ID NO: 62868 - RNA, 20 nt, Artificial Sequence
  MKO10062868_A_mmu-mir-487b
  gRNA
ugagugaagcgaagaggaca

SEQ ID NO: 62869 - RNA, 20 nt, Artificial Sequence
  MKO10062869_A_mmu-mir-539
  gRNA
gugcuacuguuucauacuug

SEQ ID NO: 62870 - RNA, 20 nt, Artificial Sequence
  MKO10062870_A_mmu-mir-539
  gRNA
acuugaggagaaauuauccu

SEQ ID NO: 62871 - RNA, 20 nt, Artificial Sequence
  MKO10062871_A_mmu-mir-539
  gRNA
ccuugguguguuggcucuuu

SEQ ID NO: 62872 - RNA, 20 nt, Artificial Sequence
  MKO10062872_A_mmu-mir-539
  gRNA
agaaauuauccuuggugugu

SEQ ID NO: 62873 - RNA, 20 nt, Artificial Sequence
  MKO10062873_A_mmu-mir-544
  gRNA
ugcuuuuuaacaagaucccu

SEQ ID NO: 62874 - RNA, 20 nt, Artificial Sequence
  MKO10062874_A_mmu-mir-544
  gRNA
uugcuaaaaaugcagaaucu

SEQ ID NO: 62875 - RNA, 20 nt, Artificial Sequence
  MKO10062875_A_mmu-mir-544
  gRNA
uaaaaagcagagucugauug

SEQ ID NO: 62876 - RNA, 20 nt, Artificial Sequence
  MKO10062876_A_mmu-mir-544
  gRNA
aaaagcagagucugauugag

SEQ ID NO: 62877 - RNA, 20 nt, Artificial Sequence
  MKO10062877_A_mmu-mir-382
  gRNA
acuugaagagaaguuguucg

SEQ ID NO: 62878 - RNA, 20 nt, Artificial Sequence
  MKO10062878_A_mmu-mir-382
  gRNA
ugaagagaaguuguucgugg

SEQ ID NO: 62879 - RNA, 20 nt, Artificial Sequence
  MKO10062879_A_mmu-mir-382
  gRNA
uacuugugacgaaucauuca

SEQ ID NO: 62880 - RNA, 20 nt, Artificial Sequence
  MKO10062880_A_mmu-mir-134
  gRNA
caccauucagggugugugac

SEQ ID NO: 62881 - RNA, 20 nt, Artificial Sequence
  MKO10062881_A_mmu-mir-134
  gRNA
gugugugacugguugaccag

SEQ ID NO: 62882 - RNA, 20 nt, Artificial Sequence
  MKO10062882_A_mmu-mir-134
  gRNA
gugugacugguugaccagag

SEQ ID NO: 62883 - RNA, 20 nt, Artificial Sequence
  MKO10062883_A_mmu-mir-134
  gRNA
cgugcacucuguucacccug

SEQ ID NO: 62884 - RNA, 20 nt, Artificial Sequence
  MKO10062884_A_mmu-mir-668
  gRNA
cccuucagguaagugugccu

SEQ ID NO: 62885 - RNA, 20 nt, Artificial Sequence
  MKO10062885_A_mmu-mir-668
  gRNA
uaauguagguguaugucacu

SEQ ID NO: 62886 - RNA, 20 nt, Artificial Sequence
  MKO10062886_A_mmu-mir-668
  gRNA
uagguguaugucacucggcu

SEQ ID NO: 62887 - RNA, 20 nt, Artificial Sequence
  MKO10062887_A_mmu-mir-668
  gRNA
auuaagugcaugcucacccg

SEQ ID NO: 62888 - RNA, 20 nt, Artificial Sequence
  MKO10062888_A_mmu-mir-485
  gRNA
caugugugauacuuggagag

SEQ ID NO: 62889 - RNA, 20 nt, Artificial Sequence
  MKO10062889_A_mmu-mir-485
  gRNA
ugugauacuuggagagaggc

SEQ ID NO: 62890 - RNA, 20 nt, Artificial Sequence
  MKO10062890_A_mmu-mir-485
  gRNA
agaguuugacacuagaagag

SEQ ID NO: 62891 - RNA, 20 nt, Artificial Sequence
  MKO10062891_A_mmu-mir-485
  gRNA
ucaucuaaacgagucauaca

SEQ ID NO: 62892 - RNA, 20 nt, Artificial Sequence
  MKO10062892_A_mmu-mir-453
  gRNA
ucccccugugaagaagaugc

SEQ ID NO: 62893 - RNA, 20 nt, Artificial Sequence
  MKO10062893_A_mmu-mir-453
  gRNA
aagugccauccccugguacu

SEQ ID NO: 62894 - RNA, 20 nt, Artificial Sequence
  MKO10062894_A_mmu-mir-453
  gRNA
ugccauccccugguacuugg

SEQ ID NO: 62895 - RNA, 20 nt, Artificial Sequence
  MKO10062895_A_mmu-mir-453
  gRNA
aaccucccuccaaguaccag

SEQ ID NO: 62896 - RNA, 20 nt, Artificial Sequence
  MKO10062896_A_mmu-mir-154
  gRNA
cacgugcggugcuugaagau

SEQ ID NO: 62897 - RNA, 20 nt, Artificial Sequence
  MKO10062897_A_mmu-mir-154
  gRNA
cgaauaaagcgaaggcaaca

SEQ ID NO: 62898 - RNA, 20 nt, Artificial Sequence
  MKO10062898_A_mmu-mir-154
  gRNA
auucgucacgaauaaagcga

SEQ ID NO: 62899 - RNA, 20 nt, Artificial Sequence
  MKO10062899_A_mmu-mir-154
  gRNA
gggauuugguacugaaaaau

SEQ ID NO: 62900 - RNA, 20 nt, Artificial Sequence
  MKO10062900_A_mmu-mir-496a
  gRNA
cucgaaaucaaguguucgaa

SEQ ID NO: 62901 - RNA, 20 nt, Artificial Sequence
  MKO10062901_A_mmu-mir-496a
  gRNA
gaaaucaaguguucgaaugg

SEQ ID NO: 62902 - RNA, 20 nt, Artificial Sequence
  MKO10062902_A_mmu-mir-496a
  gRNA
uuacauggccaaucuccuuu

SEQ ID NO: 62903 - RNA, 20 nt, Artificial Sequence
  MKO10062903_A_mmu-mir-496a
  gRNA
aaauaaaaugaacacaccau

SEQ ID NO: 62904 - RNA, 20 nt, Artificial Sequence
  MKO10062904_A_mmu-mir-377
  gRNA
gacguuugauucuugagcag

SEQ ID NO: 62905 - RNA, 20 nt, Artificial Sequence
  MKO10062905_A_mmu-mir-377
  gRNA
ucuugagcagagguugcccu

SEQ ID NO: 62906 - RNA, 20 nt, Artificial Sequence
  MKO10062906_A_mmu-mir-377
  gRNA
caauaaagcgaauucaccaa

SEQ ID NO: 62907 - RNA, 20 nt, Artificial Sequence
  MKO10062907_A_mmu-mir-377
  gRNA
auugauguugaaucacacaa

SEQ ID NO: 62908 - RNA, 20 nt, Artificial Sequence
  MKO10062908_A_mmu-mir-541
  gRNA
acucuugccaaaaucagaga

SEQ ID NO: 62909 - RNA, 20 nt, Artificial Sequence
  MKO10062909_A_mmu-mir-541
  gRNA
cagaaucccuucucugauuu

SEQ ID NO: 62910 - RNA, 20 nt, Artificial Sequence
  MKO10062910_A_mmu-mir-541
  gRNA
gccacucauuuuaaaacucu

SEQ ID NO: 62911 - RNA, 20 nt, Artificial Sequence
  MKO10062911_A_mmu-mir-541
  gRNA
cuuaggccauaagcagagua

SEQ ID NO: 62912 - RNA, 20 nt, Artificial Sequence
  MKO10062912_A_mmu-mir-409
  gRNA
ccgagccucuccgugguacu

SEQ ID NO: 62913 - RNA, 20 nt, Artificial Sequence
  MKO10062913_A_mmu-mir-409
  gRNA
uacccgagcaacuuugcauc

SEQ ID NO: 62914 - RNA, 20 nt, Artificial Sequence
  MKO10062914_A_mmu-mir-409
  gRNA
ccgagcaacuuugcaucugg

SEQ ID NO: 62915 - RNA, 20 nt, Artificial Sequence
  MKO10062915_A_mmu-mir-409
  gRNA
ucuggaggacgaauguugcu

SEQ ID NO: 62916 - RNA, 20 nt, Artificial Sequence
  MKO10062916_A_mmu-mir-412
  gRNA
gcucugggguaugggacgga

SEQ ID NO: 62917 - RNA, 20 nt, Artificial Sequence
  MKO10062917_A_mmu-mir-412
  gRNA
gggacggauggucgaccagc

SEQ ID NO: 62918 - RNA, 20 nt, Artificial Sequence
  MKO10062918_A_mmu-mir-412
  gRNA
uguuucuaauguacuucacc

SEQ ID NO: 62919 - RNA, 20 nt, Artificial Sequence
  MKO10062919_A_mmu-mir-412
  gRNA
ucaccugguccacuagccgu

SEQ ID NO: 62920 - RNA, 20 nt, Artificial Sequence
  MKO10062920_A_mmu-mir-369
  gRNA
acaccucugcugguacuuga

SEQ ID NO: 62921 - RNA, 20 nt, Artificial Sequence
  MKO10062921_A_mmu-mir-369
  gRNA
ucgaccguguuauauucgcu

SEQ ID NO: 62922 - RNA, 20 nt, Artificial Sequence
  MKO10062922_A_mmu-mir-369
  gRNA
ucagccaagcgaauauaaca

SEQ ID NO: 62923 - RNA, 20 nt, Artificial Sequence
  MKO10062923_A_mmu-mir-369
  gRNA
ggcugacuucgaauaauaca

SEQ ID NO: 62924 - RNA, 20 nt, Artificial Sequence
  MKO10062924_A_mmu-mir-410
  gRNA
aacacuggguacuugaggag

SEQ ID NO: 62925 - RNA, 20 nt, Artificial Sequence
  MKO10062925_A_mmu-mir-410
  gRNA
aaugacgaauauaacacaga

SEQ ID NO: 62926 - RNA, 20 nt, Artificial Sequence
  MKO10062926_A_mmu-mir-410
  gRNA
uggcaggugguauugaaaac

SEQ ID NO: 62927 - RNA, 20 nt, Artificial Sequence
  MKO10062927_A_mmu-mir-410
  gRNA
cggucaacacuggguacuug

SEQ ID NO: 62928 - RNA, 20 nt, Artificial Sequence
  MKO10062928_A_mmu-mir-3072
  gRNA
agugcgagggaccccgaggg

SEQ ID NO: 62929 - RNA, 20 nt, Artificial Sequence
  MKO10062929_A_mmu-mir-3072
  gRNA
gagggaccccgagggagggc

SEQ ID NO: 62930 - RNA, 20 nt, Artificial Sequence
  MKO10062930_A_mmu-mir-3072
  gRNA
gagggagggcaggcugcccc

SEQ ID NO: 62931 - RNA, 20 nt, Artificial Sequence
  MKO10062931_A_mmu-mir-3072
  gRNA
ccccaggcccugcccccucc

SEQ ID NO: 62932 - RNA, 20 nt, Artificial Sequence
  MKO10062932_A_mmu-mir-1247
  gRNA
cgcuccagucucgacguucc

SEQ ID NO: 62933 - RNA, 20 nt, Artificial Sequence
  MKO10062933_A_mmu-mir-1247
  gRNA
cuccagucucgacguucccg

SEQ ID NO: 62934 - RNA, 20 nt, Artificial Sequence
  MKO10062934_A_mmu-mir-1247
  gRNA
ggggcagagagcaacguccg

SEQ ID NO: 62935 - RNA, 20 nt, Artificial Sequence
  MKO10062935_A_mmu-mir-1247
  gRNA
gagcaacguccggggacgaa

SEQ ID NO: 62936 - RNA, 20 nt, Artificial Sequence
  MKO10062936_A_mmu-mir-3073a
  gRNA
uccugcccaguggucacagu

SEQ ID NO: 62937 - RNA, 20 nt, Artificial Sequence
  MKO10062937_A_mmu-mir-3073a
  gRNA
guccacugugaccauagugc

SEQ ID NO: 62938 - RNA, 20 nt, Artificial Sequence
  MKO10062938_A_mmu-mir-3073a
  gRNA
ugaccauagugcaggccagc

SEQ ID NO: 62939 - RNA, 20 nt, Artificial Sequence
  MKO10062939_A_mmu-mir-3073a
  gRNA
uggcgccaacugugaccacu

SEQ ID NO: 62940 - RNA, 20 nt, Artificial Sequence
  MKO10062940_A_mmu-mir-3073b
  gRNA
uccugcccaguggucacagu

SEQ ID NO: 62941 - RNA, 20 nt, Artificial Sequence
  MKO10062941_A_mmu-mir-3073b
  gRNA
uggcgccaacugugaccacu

SEQ ID NO: 62942 - RNA, 20 nt, Artificial Sequence
  MKO10062942_A_mmu-mir-3073b
  gRNA
acccaucuagacucuagggc

SEQ ID NO: 62943 - RNA, 20 nt, Artificial Sequence
  MKO10062943_A_mmu-mir-3073b
  gRNA
ggccugcacuauggucacag

SEQ ID NO: 62944 - RNA, 20 nt, Artificial Sequence
  MKO10062944_A_mmu-mir-203
  gRNA
ugcaggcgcgccugguccag

SEQ ID NO: 62945 - RNA, 20 nt, Artificial Sequence
  MKO10062945_A_mmu-mir-203
  gRNA
agcacaauugugaaauguuu

SEQ ID NO: 62946 - RNA, 20 nt, Artificial Sequence
  MKO10062946_A_mmu-mir-203
  gRNA
auguuuaggaccacuagacc

SEQ ID NO: 62947 - RNA, 20 nt, Artificial Sequence
  MKO10062947_A_mmu-mir-203
  gRNA
cugucaagaaccacuggacc

SEQ ID NO: 62948 - RNA, 20 nt, Artificial Sequence
  MKO10062948_A_mmu-mir-6939
  gRNA
uggcccauucuucccugcag

SEQ ID NO: 62949 - RNA, 20 nt, Artificial Sequence
  MKO10062949_A_mmu-mir-6939
  gRNA
agcgggucaagugaggccuc

SEQ ID NO: 62950 - RNA, 20 nt, Artificial Sequence
  MKO10062950_A_mmu-mir-6939
  gRNA
gcuuccaccaaccagcugcc

SEQ ID NO: 62951 - RNA, 20 nt, Artificial Sequence
  MKO10062951_A_mmu-mir-6939
  gRNA
gccucacuugacccgcugca

SEQ ID NO: 62952 - RNA, 20 nt, Artificial Sequence
  MKO10062952_A_mmu-mir-6940
  gRNA
uuguggaggagaggcagggc

SEQ ID NO: 62953 - RNA, 20 nt, Artificial Sequence
  MKO10062953_A_mmu-mir-6940
  gRNA
gcgggcaagcacggaaggua

SEQ ID NO: 62954 - RNA, 20 nt, Artificial Sequence
  MKO10062954_A_mmu-mir-6940
  gRNA
gugcugcgggcaagcacgga

SEQ ID NO: 62955 - RNA, 20 nt, Artificial Sequence
  MKO10062955_A_mmu-mir-6940
  gRNA
ucucgugcugcgggcaagca

SEQ ID NO: 62956 - RNA, 20 nt, Artificial Sequence
  MKO10062956_A_mmu-mir-6941
  gRNA
ggagcagccgaguuagcugg

SEQ ID NO: 62957 - RNA, 20 nt, Artificial Sequence
  MKO10062957_A_mmu-mir-6941
  gRNA
cagcuacccgucaguccccc

SEQ ID NO: 62958 - RNA, 20 nt, Artificial Sequence
  MKO10062958_A_mmu-mir-6941
  gRNA
uaacucggcugcucccaaag

SEQ ID NO: 62959 - RNA, 20 nt, Artificial Sequence
  MKO10062959_A_mmu-mir-6941
  gRNA
ggcaccccugggggacugac

SEQ ID NO: 62960 - RNA, 20 nt, Artificial Sequence
  MKO10062960_A_mmu-mir-7094-1
  gRNA
uacucugcuguucucuccac

SEQ ID NO: 62961 - RNA, 20 nt, Artificial Sequence
  MKO10062961_A_mmu-mir-7094-1
  gRNA
cugaaucugaagaggauaca

SEQ ID NO: 62962 - RNA, 20 nt, Artificial Sequence
  MKO10062962_A_mmu-mir-7094-1
  gRNA
caccaguucugaaucugaag

SEQ ID NO: 62963 - RNA, 20 nt, Artificial Sequence
  MKO10062963_A_mmu-mir-7094-1
  gRNA
auccucuucagauucagaac

SEQ ID NO: 62964 - RNA, 20 nt, Artificial Sequence
  MKO10062964_A_mmu-mir-7094-2
  gRNA
uacucugcuguucucuccac

SEQ ID NO: 62965 - RNA, 20 nt, Artificial Sequence
  MKO10062965_A_mmu-mir-7094-2
  gRNA
ccaaaucuggagaggauaca

SEQ ID NO: 62966 - RNA, 20 nt, Artificial Sequence
  MKO10062966_A_mmu-mir-7094-2
  gRNA
caccaguuccaaaucuggag

SEQ ID NO: 62967 - RNA, 20 nt, Artificial Sequence
  MKO10062967_A_mmu-mir-7094-2
  gRNA
cccuguauccucuccagauu

SEQ ID NO: 62968 - RNA, 20 nt, Artificial Sequence
  MKO10062968_A_mmu-mir-6388
  gRNA
ggccucacugugccaucugc

SEQ ID NO: 62969 - RNA, 20 nt, Artificial Sequence
  MKO10062969_A_mmu-mir-6388
  gRNA
auccccauagagagaugaga

SEQ ID NO: 62970 - RNA, 20 nt, Artificial Sequence
  MKO10062970_A_mmu-mir-6388
  gRNA
gaccugcagauggcacagug

SEQ ID NO: 62971 - RNA, 20 nt, Artificial Sequence
  MKO10062971_A_mmu-mir-6388
  gRNA
agcagcacaugaccugcaga

SEQ ID NO: 62972 - RNA, 20 nt, Artificial Sequence
  MKO10062972_A_mmu-mir-153
  gRNA
auagucacaaaagugaucau

SEQ ID NO: 62973 - RNA, 20 nt, Artificial Sequence
  MKO10062973_A_mmu-mir-153
  gRNA
caacgucacaaaaaugacac

SEQ ID NO: 62974 - RNA, 20 nt, Artificial Sequence
  MKO10062974_A_mmu-mir-153
  gRNA
acuuuugugacuaugcaacu

SEQ ID NO: 62975 - RNA, 20 nt, Artificial Sequence
  MKO10062975_A_mmu-mir-466i
  gRNA
ugacaugaucucuguugugg

SEQ ID NO: 62976 - RNA, 20 nt, Artificial Sequence
  MKO10062976_A_mmu-mir-466i
  gRNA
cacugacaugaucucuguug

SEQ ID NO: 62977 - RNA, 20 nt, Artificial Sequence
  MKO10062977_A_mmu-mir-466i
  gRNA
cauaauauauaucaaaaaug

SEQ ID NO: 62978 - RNA, 20 nt, Artificial Sequence
  MKO10062978_A_mmu-mir-6942
  gRNA
aguccugggccuaggaggag

SEQ ID NO: 62979 - RNA, 20 nt, Artificial Sequence
  MKO10062979_A_mmu-mir-6942
  gRNA
cuuggaguccugggccuagg

SEQ ID NO: 62980 - RNA, 20 nt, Artificial Sequence
  MKO10062980_A_mmu-mir-6942
  gRNA
uguaaaagacuacugagagg

SEQ ID NO: 62981 - RNA, 20 nt, Artificial Sequence
  MKO10062981_A_mmu-mir-6942
  gRNA
gcaaauguuccccuccuccu

SEQ ID NO: 62982 - RNA, 20 nt, Artificial Sequence
  MKO10062982_A_mmu-mir-1896
  gRNA
cucauuacagugaugucuuu

SEQ ID NO: 62983 - RNA, 20 nt, Artificial Sequence
  MKO10062983_A_mmu-mir-1896
  gRNA
aacgaccauggacucucuga

SEQ ID NO: 62984 - RNA, 20 nt, Artificial Sequence
  MKO10062984_A_mmu-mir-1896
  gRNA
ggacucucugauggugggug

SEQ ID NO: 62985 - RNA, 20 nt, Artificial Sequence
  MKO10062985_A_mmu-mir-1896
  gRNA
cucucugauggugggugagg

SEQ ID NO: 62986 - RNA, 20 nt, Artificial Sequence
  MKO10062986_A_mmu-mir-1983
  gRNA
cuagcguguuugaggcggaa

SEQ ID NO: 62987 - RNA, 20 nt, Artificial Sequence
  MKO10062987_A_mmu-mir-1983
  gRNA
aagggaagaaaacaugcucc

SEQ ID NO: 62988 - RNA, 20 nt, Artificial Sequence
  MKO10062988_A_mmu-mir-1983
  gRNA
aagaaaacaugcuccaggug

SEQ ID NO: 62989 - RNA, 20 nt, Artificial Sequence
  MKO10062989_A_mmu-mir-1983
  gRNA
gcgcuaaccgauugcgccac

SEQ ID NO: 62990 - RNA, 20 nt, Artificial Sequence
  MKO10062990_A_mmu-mir-6368
  gRNA
ccuccacugcuucccagagg

SEQ ID NO: 62991 - RNA, 20 nt, Artificial Sequence
  MKO10062991_A_mmu-mir-6368
  gRNA
aggagguucaugcccugucu

SEQ ID NO: 62992 - RNA, 20 nt, Artificial Sequence
  MKO10062992_A_mmu-mir-6368
  gRNA
ggggagcagcuggcagcucc

SEQ ID NO: 62993 - RNA, 20 nt, Artificial Sequence
  MKO10062993_A_mmu-mir-6368
  gRNA
uccucugggaagcaguggag

SEQ ID NO: 62994 - RNA, 20 nt, Artificial Sequence
  MKO10062994_A_mmu-mir-5124a
  gRNA
auugauggggacuagaaagg

SEQ ID NO: 62995 - RNA, 20 nt, Artificial Sequence
  MKO10062995_A_mmu-mir-5124a
  gRNA
gcucaaaugcucuuagucac

SEQ ID NO: 62996 - RNA, 20 nt, Artificial Sequence
  MKO10062996_A_mmu-mir-5124a
  gRNA
uugagcacuuguucuugcag

SEQ ID NO: 62997 - RNA, 20 nt, Artificial Sequence
  MKO10062997_A_mmu-mir-5124a
  gRNA
uucaauuucuagcaccuaua

SEQ ID NO: 62998 - RNA, 20 nt, Artificial Sequence
  MKO10062998_A_mmu-let-7d
  gRNA
gcaaccuacuaccucuuccu

SEQ ID NO: 62999 - RNA, 20 nt, Artificial Sequence
  MKO10062999_A_mmu-let-7d
  gRNA
gggcagagauuuugcccaca

SEQ ID NO: 63000 - RNA, 20 nt, Artificial Sequence
  MKO10063000_A_mmu-let-7d
  gRNA
gguuccuaggaagagguagu

SEQ ID NO: 63001 - RNA, 20 nt, Artificial Sequence
  MKO10063001_A_mmu-let-7d
  gRNA
uaaaauggguuccuaggaag

SEQ ID NO: 63002 - RNA, 20 nt, Artificial Sequence
  MKO10063002_A_mmu-let-7f-1
  gRNA
gcaagucuacuccucaggga

SEQ ID NO: 63003 - RNA, 20 nt, Artificial Sequence
  MKO10063003_A_mmu-let-7f-1
  gRNA
acaaucuauugccuucccug

SEQ ID NO: 63004 - RNA, 20 nt, Artificial Sequence
  MKO10063004_A_mmu-let-7f-1
  gRNA
gguaguagauuguauaguug

SEQ ID NO: 63005 - RNA, 20 nt, Artificial Sequence
  MKO10063005_A_mmu-let-7f-1
  gRNA
aaacuugcucuaucagagug

SEQ ID NO: 63006 - RNA, 20 nt, Artificial Sequence
  MKO10063006_A_mmu-let-7a-1
  gRNA
gcagacuuuuccaucaccuu

SEQ ID NO: 63007 - RNA, 20 nt, Artificial Sequence
  MKO10063007_A_mmu-let-7a-1
  gRNA
uacugucuuuccuaagguga

SEQ ID NO: 63008 - RNA, 20 nt, Artificial Sequence
  MKO10063008_A_mmu-let-7a-1
  gRNA
acaaucuacugucuuuccua

SEQ ID NO: 63009 - RNA, 20 nt, Artificial Sequence
  MKO10063009_A_mmu-let-7a-1
  gRNA
ucacugugggaugagguagu

SEQ ID NO: 63010 - RNA, 20 nt, Artificial Sequence
  MKO10063010_A_mmu-mir-683-1
  gRNA
aguagggcuccaugcagccc

SEQ ID NO: 63011 - RNA, 20 nt, Artificial Sequence
  MKO10063011_A_mmu-mir-683-1
  gRNA
cacugcagugcagaaaagcu

SEQ ID NO: 63012 - RNA, 20 nt, Artificial Sequence
  MKO10063012_A_mmu-mir-683-1
  gRNA
gaaaagcuuggcuuuuagcc

SEQ ID NO: 63013 - RNA, 20 nt, Artificial Sequence
  MKO10063013_A_mmu-mir-683-1
  gRNA
gcuguaagcuguguccuccu

SEQ ID NO: 63014 - RNA, 20 nt, Artificial Sequence
  MKO10063014_A_mmu-mir-683-2
  gRNA
aguagggcuccaugcagccc

SEQ ID NO: 63015 - RNA, 20 nt, Artificial Sequence
  MKO10063015_A_mmu-mir-683-2
  gRNA
cacugcagugcagaaaagcu

SEQ ID NO: 63016 - RNA, 20 nt, Artificial Sequence
  MKO10063016_A_mmu-mir-683-2
  gRNA
gaaaagcuuggcuuuuagcc

SEQ ID NO: 63017 - RNA, 20 nt, Artificial Sequence
  MKO10063017_A_mmu-mir-683-2
  gRNA
gcuguaagcuguguccuccu

SEQ ID NO: 63018 - RNA, 20 nt, Artificial Sequence
  MKO10063018_A_mmu-mir-6943
  gRNA
cccaagugggagauggggug

SEQ ID NO: 63019 - RNA, 20 nt, Artificial Sequence
  MKO10063019_A_mmu-mir-6943
  gRNA
auggggugagguuggaagcu

SEQ ID NO: 63020 - RNA, 20 nt, Artificial Sequence
  MKO10063020_A_mmu-mir-6943
  gRNA
cugcuuccauaccccuaccc

SEQ ID NO: 63021 - RNA, 20 nt, Artificial Sequence
  MKO10063021_A_mmu-mir-6943
  gRNA
cuggguagggguauggaagc

SEQ ID NO: 63022 - RNA, 20 nt, Artificial Sequence
  MKO10063022_A_mmu-mir-6944
  gRNA
agccgccuccugagggcaca

SEQ ID NO: 63023 - RNA, 20 nt, Artificial Sequence
  MKO10063023_A_mmu-mir-6944
  gRNA
ggaagaguuagagagcuggg

SEQ ID NO: 63024 - RNA, 20 nt, Artificial Sequence
  MKO10063024_A_mmu-mir-6944
  gRNA
aagaguuagagagcugggcg

SEQ ID NO: 63025 - RNA, 20 nt, Artificial Sequence
  MKO10063025_A_mmu-mir-6944
  gRNA
ucuucccuugugcccucagg

SEQ ID NO: 63026 - RNA, 20 nt, Artificial Sequence
  MKO10063026_A_mmu-mir-6945
  gRNA
cugagcaacugucuauggga

SEQ ID NO: 63027 - RNA, 20 nt, Artificial Sequence
  MKO10063027_A_mmu-mir-6945
  gRNA
agggcagagcucagaaccuc

SEQ ID NO: 63028 - RNA, 20 nt, Artificial Sequence
  MKO10063028_A_mmu-mir-6945
  gRNA
gcucagaaccucugguucug

SEQ ID NO: 63029 - RNA, 20 nt, Artificial Sequence
  MKO10063029_A_mmu-mir-6945
  gRNA
ccucugguucugugggcacc

SEQ ID NO: 63030 - RNA, 20 nt, Artificial Sequence
  MKO10063030_A_mmu-mir-874
  gRNA
agaaagcaggcccagccagu

SEQ ID NO: 63031 - RNA, 20 nt, Artificial Sequence
  MKO10063031_A_mmu-mir-874
  gRNA
ggcccagccagucggucccu

SEQ ID NO: 63032 - RNA, 20 nt, Artificial Sequence
  MKO10063032_A_mmu-mir-874
  gRNA
ucggucccucgggccagggc

SEQ ID NO: 63033 - RNA, 20 nt, Artificial Sequence
  MKO10063033_A_mmu-mir-874
  gRNA
gucucucuuacccuggugcg

SEQ ID NO: 63034 - RNA, 20 nt, Artificial Sequence
  MKO10063034_A_mmu-mir-6369
  gRNA
ccucccauugauggccaacu

SEQ ID NO: 63035 - RNA, 20 nt, Artificial Sequence
  MKO10063035_A_mmu-mir-6369
  gRNA
cugaacugagccaacugacc

SEQ ID NO: 63036 - RNA, 20 nt, Artificial Sequence
  MKO10063036_A_mmu-mir-6369
  gRNA
ucuaguugcauauguagcag

SEQ ID NO: 63037 - RNA, 20 nt, Artificial Sequence
  MKO10063037_A_mmu-mir-6369
  gRNA
guuggugagugucuagacac

SEQ ID NO: 63038 - RNA, 20 nt, Artificial Sequence
  MKO10063038_A_mmu-mir-7a-1
  gRNA
cauuaucuguccuguagagg

SEQ ID NO: 63039 - RNA, 20 nt, Artificial Sequence
  MKO10063039_A_mmu-mir-7a-1
  gRNA
uagagguggccugugccaua

SEQ ID NO: 63040 - RNA, 20 nt, Artificial Sequence
  MKO10063040_A_mmu-mir-7a-1
  gRNA
cacagucugccauauggcac

SEQ ID NO: 63041 - RNA, 20 nt, Artificial Sequence
  MKO10063041_A_mmu-mir-7a-1
  gRNA
gauguuggccuaguucugug

SEQ ID NO: 63042 - RNA, 20 nt, Artificial Sequence
  MKO10063042_A_mmu-mir-713
  gRNA
cuauuggcgggccuauccgg

SEQ ID NO: 63043 - RNA, 20 nt, Artificial Sequence
  MKO10063043_A_mmu-mir-713
  gRNA
gccuauccggaggcccugau

SEQ ID NO: 63044 - RNA, 20 nt, Artificial Sequence
  MKO10063044_A_mmu-mir-713
  gRNA
gcacugaaggcacacagcau

SEQ ID NO: 63045 - RNA, 20 nt, Artificial Sequence
  MKO10063045_A_mmu-mir-713
  gRNA
accaaucagggccuccggau

SEQ ID NO: 63046 - RNA, 20 nt, Artificial Sequence
  MKO10063046_A_mmu-mir-23b
  gRNA
ccucaccugcucuggcugcu

SEQ ID NO: 63047 - RNA, 20 nt, Artificial Sequence
  MKO10063047_A_mmu-mir-23b
  gRNA
gcucuggcugcuuggguucc

SEQ ID NO: 63048 - RNA, 20 nt, Artificial Sequence
  MKO10063048_A_mmu-mir-23b
  gRNA
gagauuaaaaucacauugcc

SEQ ID NO: 63049 - RNA, 20 nt, Artificial Sequence
  MKO10063049_A_mmu-mir-23b
  gRNA
aagucacaaaucagcaugcc

SEQ ID NO: 63050 - RNA, 20 nt, Artificial Sequence
  MKO10063050_A_mmu-mir-27b
  gRNA
aggugcagagcuuagcugau

SEQ ID NO: 63051 - RNA, 20 nt, Artificial Sequence
  MKO10063051_A_mmu-mir-27b
  gRNA
gguuuccgcuuuguucacag

SEQ ID NO: 63052 - RNA, 20 nt, Artificial Sequence
  MKO10063052_A_mmu-mir-27b
  gRNA
cuuagccacugugaacaaag

SEQ ID NO: 63053 - RNA, 20 nt, Artificial Sequence
  MKO10063053_A_mmu-mir-27b
  gRNA
gcugauuggugaacagugau

SEQ ID NO: 63054 - RNA, 20 nt, Artificial Sequence
  MKO10063054_A_mmu-mir-3074-1
  gRNA
acacacuggcucaguucagc

SEQ ID NO: 63055 - RNA, 20 nt, Artificial Sequence
  MKO10063055_A_mmu-mir-3074-1
  gRNA
uggcucaguucagcaggaac

SEQ ID NO: 63056 - RNA, 20 nt, Artificial Sequence
  MKO10063056_A_mmu-mir-3074-1
  gRNA
ucagcucaguaggcaccgga

SEQ ID NO: 63057 - RNA, 20 nt, Artificial Sequence
  MKO10063057_A_mmu-mir-3074-1
  gRNA
agaacugauaucagcucagu

SEQ ID NO: 63058 - RNA, 20 nt, Artificial Sequence
  MKO10063058_A_mmu-mir-24-1
  gRNA
acacacuggcucaguucagc

SEQ ID NO: 63059 - RNA, 20 nt, Artificial Sequence
  MKO10063059_A_mmu-mir-24-1
  gRNA
uggcucaguucagcaggaac

SEQ ID NO: 63060 - RNA, 20 nt, Artificial Sequence
  MKO10063060_A_mmu-mir-24-1
  gRNA
ucagcucaguaggcaccgga

SEQ ID NO: 63061 - RNA, 20 nt, Artificial Sequence
  MKO10063061_A_mmu-mir-24-1
  gRNA
agaacugauaucagcucagu

SEQ ID NO: 63062 - RNA, 20 nt, Artificial Sequence
  MKO10063062_A_mmu-mir-692-2
  gRNA
accaaccuccgcaggguggc

SEQ ID NO: 63063 - RNA, 20 nt, Artificial Sequence
  MKO10063063_A_mmu-mir-692-2
  gRNA
gggccacaaccagcgcagac

SEQ ID NO: 63064 - RNA, 20 nt, Artificial Sequence
  MKO10063064_A_mmu-mir-692-2
  gRNA
agcgcagacuggcgcgcccc

SEQ ID NO: 63065 - RNA, 20 nt, Artificial Sequence
  MKO10063065_A_mmu-mir-692-2
  gRNA
cacucucaagcacgacuagg

SEQ ID NO: 63066 - RNA, 20 nt, Artificial Sequence
  MKO10063066_A_mmu-mir-682
  gRNA
agagacgagccgucggcauc

SEQ ID NO: 63067 - RNA, 20 nt, Artificial Sequence
  MKO10063067_A_mmu-mir-682
  gRNA
gccgucggcaucuggcacug

SEQ ID NO: 63068 - RNA, 20 nt, Artificial Sequence
  MKO10063068_A_mmu-mir-682
  gRNA
ugcaugaaaacaguggccgg

SEQ ID NO: 63069 - RNA, 20 nt, Artificial Sequence
  MKO10063069_A_mmu-mir-682
  gRNA
aaacaguggccggcggggcc

SEQ ID NO: 63070 - RNA, 20 nt, Artificial Sequence
  MKO10063070_A_mmu-mir-3961
  gRNA
guuguuguccaacugagcug

SEQ ID NO: 63071 - RNA, 20 nt, Artificial Sequence
  MKO10063071_A_mmu-mir-3961
  gRNA
ucaacugcucugagugcauu

SEQ ID NO: 63072 - RNA, 20 nt, Artificial Sequence
  MKO10063072_A_mmu-mir-3961
  gRNA
ucagcugcccucagcucagu

SEQ ID NO: 63073 - RNA, 20 nt, Artificial Sequence
  MKO10063073_A_mmu-mir-3961
  gRNA
cugagugcauuugguccucu

SEQ ID NO: 63074 - RNA, 20 nt, Artificial Sequence
  MKO10063074_A_mmu-mir-9-2
  gRNA
gggaagcgaguuguuaucuu

SEQ ID NO: 63075 - RNA, 20 nt, Artificial Sequence
  MKO10063075_A_mmu-mir-9-2
  gRNA
aucuagcuguaugaguguau

SEQ ID NO: 63076 - RNA, 20 nt, Artificial Sequence
  MKO10063076_A_mmu-mir-9-2
  gRNA
cgaaaguaaaaacuccuuca

SEQ ID NO: 63077 - RNA, 20 nt, Artificial Sequence
  MKO10063077_A_mmu-mir-9-2
  gRNA
cuugaaggaguuuuuacuuu

SEQ ID NO: 63078 - RNA, 20 nt, Artificial Sequence
  MKO10063078_A_mmu-mir-5624
  gRNA
uaguuagguuauucuaauua

SEQ ID NO: 63079 - RNA, 20 nt, Artificial Sequence
  MKO10063079_A_mmu-mir-5624
  gRNA
auuaaggcagaguuuacaau

SEQ ID NO: 63080 - RNA, 20 nt, Artificial Sequence
  MKO10063080_A_mmu-mir-5624
  gRNA
auuaaggcagaguuuacaau

SEQ ID NO: 63081 - RNA, 20 nt, Artificial Sequence
  MKO10063081_A_mmu-mir-5624
  gRNA
agaauaaccuaacuaaauua

SEQ ID NO: 63082 - RNA, 20 nt, Artificial Sequence
  MKO10063082_A_mmu-mir-1940
  gRNA
uguaccgugcugccuuccau

SEQ ID NO: 63083 - RNA, 20 nt, Artificial Sequence
  MKO10063083_A_mmu-mir-1940
  gRNA
guuaagaccuccaacaguaa

SEQ ID NO: 63084 - RNA, 20 nt, Artificial Sequence
  MKO10063084_A_mmu-mir-1940
  gRNA
gaccuccaacaguaaagggc

SEQ ID NO: 63085 - RNA, 20 nt, Artificial Sequence
  MKO10063085_A_mmu-mir-1940
  gRNA
uccaacaguaaagggcuggc

SEQ ID NO: 63086 - RNA, 20 nt, Artificial Sequence
  MKO10063086_A_mmu-mir-582
  gRNA
cccucguaaucuguacucuu

SEQ ID NO: 63087 - RNA, 20 nt, Artificial Sequence
  MKO10063087_A_mmu-mir-582
  gRNA
uguugaacaacugaacccaa

SEQ ID NO: 63088 - RNA, 20 nt, Artificial Sequence
  MKO10063088_A_mmu-mir-582
  gRNA
caauuaguuagauuaguaac

SEQ ID NO: 63089 - RNA, 20 nt, Artificial Sequence
  MKO10063089_A_mmu-mir-582
  gRNA
uuuggguucaguuguucaac

SEQ ID NO: 63090 - RNA, 20 nt, Artificial Sequence
  MKO10063090_A_mmu-mir-1904
  gRNA
uagcuguucugcuccucugg

SEQ ID NO: 63091 - RNA, 20 nt, Artificial Sequence
  MKO10063091_A_mmu-mir-1904
  gRNA
uguucugcuccucuggaggg

SEQ ID NO: 63092 - RNA, 20 nt, Artificial Sequence
  MKO10063092_A_mmu-mir-1904
  gRNA
cuguuugcacaccucucuuc

SEQ ID NO: 63093 - RNA, 20 nt, Artificial Sequence
  MKO10063093_A_mmu-mir-1904
  gRNA
aaacaggaaccucccuccag

SEQ ID NO: 63094 - RNA, 20 nt, Artificial Sequence
  MKO10063094_A_mmu-mir-449c
  gRNA
ggaugaaguguggguguguc

SEQ ID NO: 63095 - RNA, 20 nt, Artificial Sequence
  MKO10063095_A_mmu-mir-449c
  gRNA
gaagugugggugugucaggc

SEQ ID NO: 63096 - RNA, 20 nt, Artificial Sequence
  MKO10063096_A_mmu-mir-449c
  gRNA
gcaggcagugcauugcuagc

SEQ ID NO: 63097 - RNA, 20 nt, Artificial Sequence
  MKO10063097_A_mmu-mir-449c
  gRNA
uagugcagcuagcaacuguu

SEQ ID NO: 63098 - RNA, 20 nt, Artificial Sequence
  MKO10063098_A_mmu-mir-449b
  gRNA
cgaacuugccagacucgggu

SEQ ID NO: 63099 - RNA, 20 nt, Artificial Sequence
  MKO10063099_A_mmu-mir-449b
  gRNA
ggguaggcaguguuguuagc

SEQ ID NO: 63100 - RNA, 20 nt, Artificial Sequence
  MKO10063100_A_mmu-mir-449b
  gRNA
guguuguuagcuggcugcgu

SEQ ID NO: 63101 - RNA, 20 nt, Artificial Sequence
  MKO10063101_A_mmu-mir-449b
  gRNA
uuagcuggcugcguuggguc

SEQ ID NO: 63102 - RNA, 20 nt, Artificial Sequence
  MKO10063102_A_mmu-mir-449a
  gRNA
gcugucuugccuguguguga

SEQ ID NO: 63103 - RNA, 20 nt, Artificial Sequence
  MKO10063103_A_mmu-mir-449a
  gRNA
cuugccugugugugauggcu

SEQ ID NO: 63104 - RNA, 20 nt, Artificial Sequence
  MKO10063104_A_mmu-mir-449a
  gRNA
cuuggcaguguauuguuagc

SEQ ID NO: 63105 - RNA, 20 nt, Artificial Sequence
  MKO10063105_A_mmu-mir-449a
  gRNA
acugccaagccaucacacac

SEQ ID NO: 63106 - RNA, 20 nt, Artificial Sequence
  MKO10063106_A_mmu-mir-5124b
  gRNA
ucaguugucagcauacucau

SEQ ID NO: 63107 - RNA, 20 nt, Artificial Sequence
  MKO10063107_A_mmu-mir-5124b
  gRNA
acugaucuugcagaagacuc

SEQ ID NO: 63108 - RNA, 20 nt, Artificial Sequence
  MKO10063108_A_mmu-mir-6946
  gRNA
agaaaagaaaagaaaagaaa

SEQ ID NO: 63109 - RNA, 20 nt, Artificial Sequence
  MKO10063109_A_mmu-mir-6946
  gRNA
ggcugaaacagagucugaaa

SEQ ID NO: 63110 - RNA, 20 nt, Artificial Sequence
  MKO10063110_A_mmu-mir-6946
  gRNA
aagggagagaaagaaaugca

SEQ ID NO: 63111 - RNA, 20 nt, Artificial Sequence
  MKO10063111_A_mmu-mir-6946
  gRNA
ggagagaaagaaaugcaagg

SEQ ID NO: 63112 - RNA, 20 nt, Artificial Sequence
  MKO10063112_A_mmu-mir-7210
  gRNA
uuuauauguaaguaacaaug

SEQ ID NO: 63113 - RNA, 20 nt, Artificial Sequence
  MKO10063113_A_mmu-mir-7210
  gRNA
auuguuacuuacauauaaag

SEQ ID NO: 63114 - RNA, 20 nt, Artificial Sequence
  MKO10063114_A_mmu-mir-7210
  gRNA
cccccaauaacauuguagac

SEQ ID NO: 63115 - RNA, 20 nt, Artificial Sequence
  MKO10063115_A_mmu-mir-7210
  gRNA
ccugucuacaauguuauugg

SEQ ID NO: 63116 - RNA, 20 nt, Artificial Sequence
  MKO10063116_A_mmu-mir-3075
  gRNA
guacugucugggagcagcca

SEQ ID NO: 63117 - RNA, 20 nt, Artificial Sequence
  MKO10063117_A_mmu-mir-3075
  gRNA
uaccucuugucuucuauccu

SEQ ID NO: 63118 - RNA, 20 nt, Artificial Sequence
  MKO10063118_A_mmu-mir-3075
  gRNA
cuucuauccuuggccuuccu

SEQ ID NO: 63119 - RNA, 20 nt, Artificial Sequence
  MKO10063119_A_mmu-mir-3075
  gRNA
gacaagagguaacuuguccu

SEQ ID NO: 63120 - RNA, 20 nt, Artificial Sequence
  MKO10063120_A_mmu-mir-7672
  gRNA
cgucggcugccagguucaug

SEQ ID NO: 63121 - RNA, 20 nt, Artificial Sequence
  MKO10063121_A_mmu-mir-7672
  gRNA
cucugaucucgucggcugcc

SEQ ID NO: 63122 - RNA, 20 nt, Artificial Sequence
  MKO10063122_A_mmu-mir-7672
  gRNA
gacuugacagcgggcgacuc

SEQ ID NO: 63123 - RNA, 20 nt, Artificial Sequence
  MKO10063123_A_mmu-mir-7672
  gRNA
cucccgguggacuugacagc

SEQ ID NO: 63124 - RNA, 20 nt, Artificial Sequence
  MKO10063124_A_mmu-mir-6947
  gRNA
uucugugugggcucauccag

SEQ ID NO: 63125 - RNA, 20 nt, Artificial Sequence
  MKO10063125_A_mmu-mir-6947
  gRNA
ugugggcucauccaguggag

SEQ ID NO: 63126 - RNA, 20 nt, Artificial Sequence
  MKO10063126_A_mmu-mir-6947
  gRNA
cugacagcagccucuuuccc

SEQ ID NO: 63127 - RNA, 20 nt, Artificial Sequence
  MKO10063127_A_mmu-mir-6947
  gRNA
gcgugcacgagccucuccac

SEQ ID NO: 63128 - RNA, 20 nt, Artificial Sequence
  MKO10063128_A_mmu-mir-3076
  gRNA
gaugcugaucuuaucugcaa

SEQ ID NO: 63129 - RNA, 20 nt, Artificial Sequence
  MKO10063129_A_mmu-mir-3076
  gRNA
ggaguucuguucuaacacag

SEQ ID NO: 63130 - RNA, 20 nt, Artificial Sequence
  MKO10063130_A_mmu-mir-3076
  gRNA
ccuuucucuuagccgcacuc

SEQ ID NO: 63131 - RNA, 20 nt, Artificial Sequence
  MKO10063131_A_mmu-mir-3076
  gRNA
uugcagauaagaucagcauc

SEQ ID NO: 63132 - RNA, 20 nt, Artificial Sequence
  MKO10063132_A_mmu-mir-346
  gRNA
ccucucuguugcucugaagg

SEQ ID NO: 63133 - RNA, 20 nt, Artificial Sequence
  MKO10063133_A_mmu-mir-346
  gRNA
gggcugggccugcagcugcc

SEQ ID NO: 63134 - RNA, 20 nt, Artificial Sequence
  MKO10063134_A_mmu-mir-346
  gRNA
agcucugcccaggcagcugc

SEQ ID NO: 63135 - RNA, 20 nt, Artificial Sequence
  MKO10063135_A_mmu-mir-346
  gRNA
ucgaaggagcagcucugccc

SEQ ID NO: 63136 - RNA, 20 nt, Artificial Sequence
  MKO10063136_A_mmu-mir-327
  gRNA
cuuauaacuugaggggcaug

SEQ ID NO: 63137 - RNA, 20 nt, Artificial Sequence
  MKO10063137_A_mmu-mir-327
  gRNA
augugcaaugugccaucaag

SEQ ID NO: 63138 - RNA, 20 nt, Artificial Sequence
  MKO10063138_A_mmu-mir-327
  gRNA
ugugccaucaagagggaugu

SEQ ID NO: 63139 - RNA, 20 nt, Artificial Sequence
  MKO10063139_A_mmu-mir-327
  gRNA
cucaugccccucaaguuaua

SEQ ID NO: 63140 - RNA, 20 nt, Artificial Sequence
  MKO10063140_A_mmu-mir-5131
  gRNA
gccgccgcggccguuacgcu

SEQ ID NO: 63141 - RNA, 20 nt, Artificial Sequence
  MKO10063141_A_mmu-mir-5131
  gRNA
cgccgcggccguuacgcucg

SEQ ID NO: 63142 - RNA, 20 nt, Artificial Sequence
  MKO10063142_A_mmu-mir-5131
  gRNA
guuacgcucggggcuccgug

SEQ ID NO: 63143 - RNA, 20 nt, Artificial Sequence
  MKO10063143_A_mmu-mir-5131
  gRNA
cggggcuccguggggcgccg

SEQ ID NO: 63144 - RNA, 20 nt, Artificial Sequence
  MKO10063144_A_mmu-mir-378c
  gRNA
gggcuagccucucauuaguu

SEQ ID NO: 63145 - RNA, 20 nt, Artificial Sequence
  MKO10063145_A_mmu-mir-378c
  gRNA
gacuuggagucagaagccuu

SEQ ID NO: 63146 - RNA, 20 nt, Artificial Sequence
  MKO10063146_A_mmu-mir-378c
  gRNA
aaacaaaacuauacuggacu

SEQ ID NO: 63147 - RNA, 20 nt, Artificial Sequence
  MKO10063147_A_mmu-mir-378c
  gRNA
agaucagauagacuacaugu

SEQ ID NO: 63148 - RNA, 20 nt, Artificial Sequence
  MKO10063148_A_mmu-mir-686
  gRNA
auccgcugcacccccagcca

SEQ ID NO: 63149 - RNA, 20 nt, Artificial Sequence
  MKO10063149_A_mmu-mir-686
  gRNA
ccccagccauggugcccaga

SEQ ID NO: 63150 - RNA, 20 nt, Artificial Sequence
  MKO10063150_A_mmu-mir-686
  gRNA
gccauggugcccagaaggua

SEQ ID NO: 63151 - RNA, 20 nt, Artificial Sequence
  MKO10063151_A_mmu-mir-686
  gRNA
cuauuacuuucuucaccguc

SEQ ID NO: 63152 - RNA, 20 nt, Artificial Sequence
  MKO10063152_A_mmu-mir-6948
  gRNA
ugaacaaucuguggucagac

SEQ ID NO: 63153 - RNA, 20 nt, Artificial Sequence
  MKO10063153_A_mmu-mir-6948
  gRNA
caaucuguggucagacagga

SEQ ID NO: 63154 - RNA, 20 nt, Artificial Sequence
  MKO10063154_A_mmu-mir-6948
  gRNA
uggucagacaggaaggacag

SEQ ID NO: 63155 - RNA, 20 nt, Artificial Sequence
  MKO10063155_A_mmu-mir-6948
  gRNA
agccugggaucaguucagac

SEQ ID NO: 63156 - RNA, 20 nt, Artificial Sequence
  MKO10063156_A_mmu-mir-208a
  gRNA
cgugagugucagguauaacc

SEQ ID NO: 63157 - RNA, 20 nt, Artificial Sequence
  MKO10063157_A_mmu-mir-208a
  gRNA
gccaaaagcucacccgucaa

SEQ ID NO: 63158 - RNA, 20 nt, Artificial Sequence
  MKO10063158_A_mmu-mir-208a
  gRNA
gcaaaaagcuuguuggucag

SEQ ID NO: 63159 - RNA, 20 nt, Artificial Sequence
  MKO10063159_A_mmu-mir-208a
  gRNA
gacgggugagcuuuuggccc

SEQ ID NO: 63160 - RNA, 20 nt, Artificial Sequence
  MKO10063160_A_mmu-mir-208b
  gRNA
ccuuuuguucgucuuauauu

SEQ ID NO: 63161 - RNA, 20 nt, Artificial Sequence
  MKO10063161_A_mmu-mir-208b
  gRNA
gagcaaaaagcuucccugag

SEQ ID NO: 63162 - RNA, 20 nt, Artificial Sequence
  MKO10063162_A_mmu-mir-208b
  gRNA
cgaacaaaagguuugucuga

SEQ ID NO: 63163 - RNA, 20 nt, Artificial Sequence
  MKO10063163_A_mmu-mir-208b
  gRNA
ccgaauauaagacgaacaaa

SEQ ID NO: 63164 - RNA, 20 nt, Artificial Sequence
  MKO10063164_A_mmu-mir-6949
  gRNA
gucacccuguggauagaaaa

SEQ ID NO: 63165 - RNA, 20 nt, Artificial Sequence
  MKO10063165_A_mmu-mir-6949
  gRNA
cacccuguggauagaaaaag

SEQ ID NO: 63166 - RNA, 20 nt, Artificial Sequence
  MKO10063166_A_mmu-mir-6949
  gRNA
uuccccuuuuucuauccaca

SEQ ID NO: 63167 - RNA, 20 nt, Artificial Sequence
  MKO10063167_A_mmu-mir-6949
  gRNA
gagaaagugggucuagaaag

SEQ ID NO: 63168 - RNA, 20 nt, Artificial Sequence
  MKO10063168_A_mmu-mir-3077
  gRNA
gggcgggcgcggccugcgga

SEQ ID NO: 63169 - RNA, 20 nt, Artificial Sequence
  MKO10063169_A_mmu-mir-3077
  gRNA
gcggccugcggacggguggg

SEQ ID NO: 63170 - RNA, 20 nt, Artificial Sequence
  MKO10063170_A_mmu-mir-3077
  gRNA
cugcggacgggugggcgggc

SEQ ID NO: 63171 - RNA, 20 nt, Artificial Sequence
  MKO10063171_A_mmu-mir-3077
  gRNA
gggugggcgggcaggccaaa

SEQ ID NO: 63172 - RNA, 20 nt, Artificial Sequence
  MKO10063172_A_mmu-mir-719
  gRNA
ggagaacagaagccaagaag

SEQ ID NO: 63173 - RNA, 20 nt, Artificial Sequence
  MKO10063173_A_mmu-mir-719
  gRNA
aauguuuuugggugaugcug

SEQ ID NO: 63174 - RNA, 20 nt, Artificial Sequence
  MKO10063174_A_mmu-mir-719
  gRNA
gugcuuaaagaacaguaucu

SEQ ID NO: 63175 - RNA, 20 nt, Artificial Sequence
  MKO10063175_A_mmu-mir-719
  gRNA
gggugcauucugccacuucu

SEQ ID NO: 63176 - RNA, 20 nt, Artificial Sequence
  MKO10063176_A_mmu-mir-16-1
  gRNA
uucagcagcacagucaauac

SEQ ID NO: 63177 - RNA, 20 nt, Artificial Sequence
  MKO10063177_A_mmu-mir-16-1
  gRNA
ccaauauuuacgugcugcua

SEQ ID NO: 63178 - RNA, 20 nt, Artificial Sequence
  MKO10063178_A_mmu-mir-16-1
  gRNA
uugacugugcugcugaagua

SEQ ID NO: 63179 - RNA, 20 nt, Artificial Sequence
  MKO10063179_A_mmu-mir-16-1
  gRNA
ccuuagcagcacguaaauau

SEQ ID NO: 63180 - RNA, 20 nt, Artificial Sequence
  MKO10063180_A_mmu-mir-15a
  gRNA
uauuuugaggcagcacagua

SEQ ID NO: 63181 - RNA, 20 nt, Artificial Sequence
  MKO10063181_A_mmu-mir-15a
  gRNA
ugcuacuuuacuccaagggu

SEQ ID NO: 63182 - RNA, 20 nt, Artificial Sequence
  MKO10063182_A_mmu-mir-15a
  gRNA
gaguuuucaaaaccaacccu

SEQ ID NO: 63183 - RNA, 20 nt, Artificial Sequence
  MKO10063183_A_mmu-mir-15a
  gRNA
gaucagguccuuguauuuug

SEQ ID NO: 63184 - RNA, 20 nt, Artificial Sequence
  MKO10063184_A_mmu-mir-8098
  gRNA
ucuuagguggcgccggcuug

SEQ ID NO: 63185 - RNA, 20 nt, Artificial Sequence
  MKO10063185_A_mmu-mir-8098
  gRNA
gcgccggcuugcggcuagug

SEQ ID NO: 63186 - RNA, 20 nt, Artificial Sequence
  MKO10063186_A_mmu-mir-8098
  gRNA
gcuugcggcuaguguggcgg

SEQ ID NO: 63187 - RNA, 20 nt, Artificial Sequence
  MKO10063187_A_mmu-mir-8098
  gRNA
ggcuaguguggcggcggugu

SEQ ID NO: 63188 - RNA, 20 nt, Artificial Sequence
  MKO10063188_A_mmu-mir-6541
  gRNA
uucucaagaaacccaugaga

SEQ ID NO: 63189 - RNA, 20 nt, Artificial Sequence
  MKO10063189_A_mmu-mir-6541
  gRNA
acugcccucagccaucucau

SEQ ID NO: 63190 - RNA, 20 nt, Artificial Sequence
  MKO10063190_A_mmu-mir-6541
  gRNA
acaagcccuuccuuuugcac

SEQ ID NO: 63191 - RNA, 20 nt, Artificial Sequence
  MKO10063191_A_mmu-mir-6541
  gRNA
cccuuccuuuugcacaggca

SEQ ID NO: 63192 - RNA, 20 nt, Artificial Sequence
  MKO10063192_A_mmu-mir-598
  gRNA
cuccaugaugcugcugaugc

SEQ ID NO: 63193 - RNA, 20 nt, Artificial Sequence
  MKO10063193_A_mmu-mir-598
  gRNA
ccauuuucagcucgcaccau

SEQ ID NO: 63194 - RNA, 20 nt, Artificial Sequence
  MKO10063194_A_mmu-mir-598
  gRNA
caugaugcugcugaugcugg

SEQ ID NO: 63195 - RNA, 20 nt, Artificial Sequence
  MKO10063195_A_mmu-mir-598
  gRNA
gaugcuggcggugaugccga

SEQ ID NO: 63196 - RNA, 20 nt, Artificial Sequence
  MKO10063196_A_mmu-mir-124-1
  gRNA
cucucucuccguguucacag

SEQ ID NO: 63197 - RNA, 20 nt, Artificial Sequence
  MKO10063197_A_mmu-mir-124-1
  gRNA
uuuaaauguccauacaauua

SEQ ID NO: 63198 - RNA, 20 nt, Artificial Sequence
  MKO10063198_A_mmu-mir-124-1
  gRNA
cacgcggugaaugccaagaa

SEQ ID NO: 63199 - RNA, 20 nt, Artificial Sequence
  MKO10063199_A_mmu-mir-124-1
  gRNA
cgcggugaaugccaagaaug

SEQ ID NO: 63200 - RNA, 20 nt, Artificial Sequence
  MKO10063200_A_mmu-mir-3078
  gRNA
cagcuaccuuguauugugcu

SEQ ID NO: 63201 - RNA, 20 nt, Artificial Sequence
  MKO10063201_A_mmu-mir-3078
  gRNA
gcuaccuuguauugugcuug

SEQ ID NO: 63202 - RNA, 20 nt, Artificial Sequence
  MKO10063202_A_mmu-mir-3078
  gRNA
uguauugugcuugggguugc

SEQ ID NO: 63203 - RNA, 20 nt, Artificial Sequence
  MKO10063203_A_mmu-mir-3078
  gRNA
ggguugcugggguagucuuu

SEQ ID NO: 63204 - RNA, 20 nt, Artificial Sequence
  MKO10063204_A_mmu-mir-6539
  gRNA
cuccuccccagaugcccaca

SEQ ID NO: 63205 - RNA, 20 nt, Artificial Sequence
  MKO10063205_A_mmu-mir-6539
  gRNA
gagcaaccagcaacuccgag

SEQ ID NO: 63206 - RNA, 20 nt, Artificial Sequence
  MKO10063206_A_mmu-mir-6539
  gRNA
aucacugugcuuuacugucc

SEQ ID NO: 63207 - RNA, 20 nt, Artificial Sequence
  MKO10063207_A_mmu-mir-6539
  gRNA
gugcuuuacuguccuggggg

SEQ ID NO: 63208 - RNA, 20 nt, Artificial Sequence
  MKO10063208_A_mmu-mir-6950
  gRNA
acccaggcucuguccuggag

SEQ ID NO: 63209 - RNA, 20 nt, Artificial Sequence
  MKO10063209_A_mmu-mir-6950
  gRNA
caggcucuguccuggagugg

SEQ ID NO: 63210 - RNA, 20 nt, Artificial Sequence
  MKO10063210_A_mmu-mir-6950
  gRNA
ucucugucuugauccucucc

SEQ ID NO: 63211 - RNA, 20 nt, Artificial Sequence
  MKO10063211_A_mmu-mir-6950
  gRNA
uucugacuguccuccacucc

SEQ ID NO: 63212 - RNA, 20 nt, Artificial Sequence
  MKO10063212_A_mmu-mir-320
  gRNA
cuucucuucccgguucuucc

SEQ ID NO: 63213 - RNA, 20 nt, Artificial Sequence
  MKO10063213_A_mmu-mir-320
  gRNA
ugagagggcgaaaaaggaug

SEQ ID NO: 63214 - RNA, 20 nt, Artificial Sequence
  MKO10063214_A_mmu-mir-320
  gRNA
agggcgaaaaaggauguggg

SEQ ID NO: 63215 - RNA, 20 nt, Artificial Sequence
  MKO10063215_A_mmu-mir-320
  gRNA
gcgaaaaaggaugugggagg

SEQ ID NO: 63216 - RNA, 20 nt, Artificial Sequence
  MKO10063216_A_mmu-mir-687
  gRNA
aggauucauugcugcauucc

SEQ ID NO: 63217 - RNA, 20 nt, Artificial Sequence
  MKO10063217_A_mmu-mir-687
  gRNA
ggaaugcagcaaugaauccu

SEQ ID NO: 63218 - RNA, 20 nt, Artificial Sequence
  MKO10063218_A_mmu-mir-687
  gRNA
acagacugaaacaauaaccc

SEQ ID NO: 63219 - RNA, 20 nt, Artificial Sequence
  MKO10063219_A_mmu-mir-687
  gRNA
ucagucugucauuguauucu

SEQ ID NO: 63220 - RNA, 20 nt, Artificial Sequence
  MKO10063220_A_mmu-mir-1971
  gRNA
aaaaacagacaaguuguucc

SEQ ID NO: 63221 - RNA, 20 nt, Artificial Sequence
  MKO10063221_A_mmu-mir-1971
  gRNA
agcagaagcugccuaucuac

SEQ ID NO: 63222 - RNA, 20 nt, Artificial Sequence
  MKO10063222_A_mmu-mir-1971
  gRNA
cugccuaucuacugggucca

SEQ ID NO: 63223 - RNA, 20 nt, Artificial Sequence
  MKO10063223_A_mmu-mir-1971
  gRNA
guuccauggacccaguagau

SEQ ID NO: 63224 - RNA, 20 nt, Artificial Sequence
  MKO10063224_A_mmu-mir-759
  gRNA
aauaaauuaaaugccuaaac

SEQ ID NO: 63225 - RNA, 20 nt, Artificial Sequence
  MKO10063225_A_mmu-mir-759
  gRNA
uguuugcacucugccaguuu

SEQ ID NO: 63226 - RNA, 20 nt, Artificial Sequence
  MKO10063226_A_mmu-mir-759
  gRNA
ucagaucuaaauguuugcac

SEQ ID NO: 63227 - RNA, 20 nt, Artificial Sequence
  MKO10063227_A_mmu-mir-759
  gRNA
aaacauuuaauuuguuccaa

SEQ ID NO: 63228 - RNA, 20 nt, Artificial Sequence
  MKO10063228_A_mmu-mir-5130
  gRNA
gccggccacugagagccgcg

SEQ ID NO: 63229 - RNA, 20 nt, Artificial Sequence
  MKO10063229_A_mmu-mir-5130
  gRNA
cagugcgcccacgagagccc

SEQ ID NO: 63230 - RNA, 20 nt, Artificial Sequence
  MKO10063230_A_mmu-mir-5130
  gRNA
cugccucgcccgcgcgcucc

SEQ ID NO: 63231 - RNA, 20 nt, Artificial Sequence
  MKO10063231_A_mmu-mir-5130
  gRNA
ucgcaccgcgcggcucucag

SEQ ID NO: 63232 - RNA, 20 nt, Artificial Sequence
  MKO10063232_A_mmu-mir-6390
  gRNA
ucaaaccucucaacuuugaa

SEQ ID NO: 63233 - RNA, 20 nt, Artificial Sequence
  MKO10063233_A_mmu-mir-6390
  gRNA
uguugcuguagccaacuacc

SEQ ID NO: 63234 - RNA, 20 nt, Artificial Sequence
  MKO10063234_A_mmu-mir-6390
  gRNA
uguaaccauucaaaguugag

SEQ ID NO: 63235 - RNA, 20 nt, Artificial Sequence
  MKO10063235_A_mmu-mir-6390
  gRNA
ugucacucccaccagguagu

SEQ ID NO: 63236 - RNA, 20 nt, Artificial Sequence
  MKO10063236_A_mmu-mir-17
  gRNA
ugugugcaucuacugcagug

SEQ ID NO: 63237 - RNA, 20 nt, Artificial Sequence
  MKO10063237_A_mmu-mir-17
  gRNA
cacuuugacauuauucugac

SEQ ID NO: 63238 - RNA, 20 nt, Artificial Sequence
  MKO10063238_A_mmu-mir-17
  gRNA
ugucaaagugcuuacagugc

SEQ ID NO: 63239 - RNA, 20 nt, Artificial Sequence
  MKO10063239_A_mmu-mir-17
  gRNA
cauuaugcugacagcugccu

SEQ ID NO: 63240 - RNA, 20 nt, Artificial Sequence
  MKO10063240_A_mmu-mir-18a
  gRNA
gcugcgugcuuuuuguucua

SEQ ID NO: 63241 - RNA, 20 nt, Artificial Sequence
  MKO10063241_A_mmu-mir-18a
  gRNA
acugcccuaagugcuccuuc

SEQ ID NO: 63242 - RNA, 20 nt, Artificial Sequence
  MKO10063242_A_mmu-mir-18a
  gRNA
aaaaagcacgcagcaccagc

SEQ ID NO: 63243 - RNA, 20 nt, Artificial Sequence
  MKO10063243_A_mmu-mir-18a
  gRNA
uaugccagaaggagcacuua

SEQ ID NO: 63244 - RNA, 20 nt, Artificial Sequence
  MKO10063244_A_mmu-mir-19a
  gRNA
gcaaaucuaugcaaaacuga

SEQ ID NO: 63245 - RNA, 20 nt, Artificial Sequence
  MKO10063245_A_mmu-mir-19a
  gRNA
aaucuaugcaaaacugaugg

SEQ ID NO: 63246 - RNA, 20 nt, Artificial Sequence
  MKO10063246_A_mmu-mir-19a
  gRNA
aacuaugcaaaacuaacaga

SEQ ID NO: 63247 - RNA, 20 nt, Artificial Sequence
  MKO10063247_A_mmu-mir-19a
  gRNA
gagggcugcaaacacaacua

SEQ ID NO: 63248 - RNA, 20 nt, Artificial Sequence
  MKO10063248_A_mmu-mir-20a
  gRNA
cacuaaagugcuuauagugc

SEQ ID NO: 63249 - RNA, 20 nt, Artificial Sequence
  MKO10063249_A_mmu-mir-20a
  gRNA
cgaggcuggaguucuacagc

SEQ ID NO: 63250 - RNA, 20 nt, Artificial Sequence
  MKO10063250_A_mmu-mir-20a
  gRNA
uguagaacuccagccucgcc

SEQ ID NO: 63251 - RNA, 20 nt, Artificial Sequence
  MKO10063251_A_mmu-mir-20a
  gRNA
ucacaucacacacaccacgc

SEQ ID NO: 63252 - RNA, 20 nt, Artificial Sequence
  MKO10063252_A_mmu-mir-19b-1
  gRNA
uggucuaugguuaguuuugc

SEQ ID NO: 63253 - RNA, 20 nt, Artificial Sequence
  MKO10063253_A_mmu-mir-19b-1
  gRNA
aauccaugcaaaacugacug

SEQ ID NO: 63254 - RNA, 20 nt, Artificial Sequence
  MKO10063254_A_mmu-mir-19b-1
  gRNA
ccaugcaaaacugacugugg

SEQ ID NO: 63255 - RNA, 20 nt, Artificial Sequence
  MKO10063255_A_mmu-mir-19b-1
  gRNA
ccaccacagucaguuuugca

SEQ ID NO: 63256 - RNA, 20 nt, Artificial Sequence
  MKO10063256_A_mmu-mir-92a-1
  gRNA
aaaccccuuucuacacaggu

SEQ ID NO: 63257 - RNA, 20 nt, Artificial Sequence
  MKO10063257_A_mmu-mir-92a-1
  gRNA
guaugguauugcacuugucc

SEQ ID NO: 63258 - RNA, 20 nt, Artificial Sequence
  MKO10063258_A_mmu-mir-92a-1
  gRNA
uugucccggccuguugaguu

SEQ ID NO: 63259 - RNA, 20 nt, Artificial Sequence
  MKO10063259_A_mmu-mir-92a-1
  gRNA
aaaucccaaccuguguagaa

SEQ ID NO: 63260 - RNA, 20 nt, Artificial Sequence
  MKO10063260_A_mmu-mir-6239
  gRNA
uggcuuccaugguuccgaac

SEQ ID NO: 63261 - RNA, 20 nt, Artificial Sequence
  MKO10063261_A_mmu-mir-6239
  gRNA
acucggugcuguggcuucca

SEQ ID NO: 63262 - RNA, 20 nt, Artificial Sequence
  MKO10063262_A_mmu-mir-6239
  gRNA
ggugcuagcguuggaucacu

SEQ ID NO: 63263 - RNA, 20 nt, Artificial Sequence
  MKO10063263_A_mmu-mir-6239
  gRNA
aguguugugggugcuagcgu

SEQ ID NO: 63264 - RNA, 20 nt, Artificial Sequence
  MKO10063264_A_mmu-mir-6241
  gRNA
agucauuauaacacucacgg

SEQ ID NO: 63265 - RNA, 20 nt, Artificial Sequence
  MKO10063265_A_mmu-mir-6241
  gRNA
auuauaacacucacggcggc

SEQ ID NO: 63266 - RNA, 20 nt, Artificial Sequence
  MKO10063266_A_mmu-mir-6241
  gRNA
uucccaucaagugaucugug

SEQ ID NO: 63267 - RNA, 20 nt, Artificial Sequence
  MKO10063267_A_mmu-mir-6241
  gRNA
ugaucugugagggaauuucc

SEQ ID NO: 63268 - RNA, 20 nt, Artificial Sequence
  MKO10063268_A_mmu-mir-6391
  gRNA
acuugcuggacacuggaugc

SEQ ID NO: 63269 - RNA, 20 nt, Artificial Sequence
  MKO10063269_A_mmu-mir-6391
  gRNA
cccucacauuaucuagacuc

SEQ ID NO: 63270 - RNA, 20 nt, Artificial Sequence
  MKO10063270_A_mmu-mir-6391
  gRNA
cacauuaucuagacucuggg

SEQ ID NO: 63271 - RNA, 20 nt, Artificial Sequence
  MKO10063271_A_mmu-mir-6391
  gRNA
guguccagcaagugaggcac

SEQ ID NO: 63272 - RNA, 20 nt, Artificial Sequence
  MKO10063272_A_mmu-mir-1898
  gRNA
uuuuguaugaacauagguca

SEQ ID NO: 63273 - RNA, 20 nt, Artificial Sequence
  MKO10063273_A_mmu-mir-1898
  gRNA
acauaggucaagguucacag

SEQ ID NO: 63274 - RNA, 20 nt, Artificial Sequence
  MKO10063274_A_mmu-mir-1898
  gRNA
uuacuguuuuguaugaacau

SEQ ID NO: 63275 - RNA, 20 nt, Artificial Sequence
  MKO10063275_A_mmu-mir-1898
  gRNA
gaacauaggucaagguucac

SEQ ID NO: 63276 - RNA, 20 nt, Artificial Sequence
  MKO10063276_A_mmu-mir-7212
  gRNA
augucaucugggggcuugug

SEQ ID NO: 63277 - RNA, 20 nt, Artificial Sequence
  MKO10063277_A_mmu-mir-7212
  gRNA
caucugggggcuuguguggu

SEQ ID NO: 63278 - RNA, 20 nt, Artificial Sequence
  MKO10063278_A_mmu-mir-7212
  gRNA
acccuaacacacacgucucc

SEQ ID NO: 63279 - RNA, 20 nt, Artificial Sequence
  MKO10063279_A_mmu-mir-7212
  gRNA
ucugggggcuugugugguag

SEQ ID NO: 63280 - RNA, 20 nt, Artificial Sequence
  MKO10063280_A_mmu-mir-7117
  gRNA
gugaucugggggcucagcug

SEQ ID NO: 63281 - RNA, 20 nt, Artificial Sequence
  MKO10063281_A_mmu-mir-7117
  gRNA
ugggggaaagagaaggacag

SEQ ID NO: 63282 - RNA, 20 nt, Artificial Sequence
  MKO10063282_A_mmu-mir-7117
  gRNA
uauugcugggguuauucugg

SEQ ID NO: 63283 - RNA, 20 nt, Artificial Sequence
  MKO10063283_A_mmu-mir-7117
  gRNA
acaagguguucuuugugauc

SEQ ID NO: 63284 - RNA, 20 nt, Artificial Sequence
  MKO10063284_A_mmu-mir-3964
  gRNA
uccuugcuagcuacauaacu

SEQ ID NO: 63285 - RNA, 20 nt, Artificial Sequence
  MKO10063285_A_mmu-mir-3964
  gRNA
ggagaacucacagcuucaua

SEQ ID NO: 63286 - RNA, 20 nt, Artificial Sequence
  MKO10063286_A_mmu-mir-3964
  gRNA
agcuacauaacuuggaaagc

SEQ ID NO: 63287 - RNA, 20 nt, Artificial Sequence
  MKO10063287_A_mmu-mir-3964
  gRNA
caggcccugcacuucaccca

SEQ ID NO: 63288 - RNA, 20 nt, Artificial Sequence
  MKO10063288_A_mmu-mir-599
  gRNA
gguuugauaaacugacacaa

SEQ ID NO: 63289 - RNA, 20 nt, Artificial Sequence
  MKO10063289_A_mmu-mir-599
  gRNA
ucaucuuaucaaauacacug

SEQ ID NO: 63290 - RNA, 20 nt, Artificial Sequence
  MKO10063290_A_mmu-mir-599
  gRNA
uugauaagaugacauaggag

SEQ ID NO: 63291 - RNA, 20 nt, Artificial Sequence
  MKO10063291_A_mmu-mir-599
  gRNA
uguauuugauaagaugacau

SEQ ID NO: 63292 - RNA, 20 nt, Artificial Sequence
  MKO10063292_A_mmu-mir-875
  gRNA
aacauagccucaguauuuuc

SEQ ID NO: 63293 - RNA, 20 nt, Artificial Sequence
  MKO10063293_A_mmu-mir-875
  gRNA
augaacaccugauaaaacug

SEQ ID NO: 63294 - RNA, 20 nt, Artificial Sequence
  MKO10063294_A_mmu-mir-875
  gRNA
aaaaucaccugaaaauacug

SEQ ID NO: 63295 - RNA, 20 nt, Artificial Sequence
  MKO10063295_A_mmu-mir-875
  gRNA
gagguauaguaccacagaac

SEQ ID NO: 63296 - RNA, 20 nt, Artificial Sequence
  MKO10063296_A_mmu-mir-8097
  gRNA
guguucucuaagcagauuaa

SEQ ID NO: 63297 - RNA, 20 nt, Artificial Sequence
  MKO10063297_A_mmu-mir-8097
  gRNA
gcagauuaauggaugcagcg

SEQ ID NO: 63298 - RNA, 20 nt, Artificial Sequence
  MKO10063298_A_mmu-mir-8097
  gRNA
ggaugcagcgaggaaaacga

SEQ ID NO: 63299 - RNA, 20 nt, Artificial Sequence
  MKO10063299_A_mmu-mir-8097
  gRNA
gcagcgaggaaaacgacgga

SEQ ID NO: 63300 - RNA, 20 nt, Artificial Sequence
  MKO10063300_A_mmu-mir-6951
  gRNA
gcuuuuuucuucacaaauac

SEQ ID NO: 63301 - RNA, 20 nt, Artificial Sequence
  MKO10063301_A_mmu-mir-6951
  gRNA
ucacacaaauacaaugaaac

SEQ ID NO: 63302 - RNA, 20 nt, Artificial Sequence
  MKO10063302_A_mmu-mir-1907
  gRNA
uccagauccucugcugcucc

SEQ ID NO: 63303 - RNA, 20 nt, Artificial Sequence
  MKO10063303_A_mmu-mir-1907
  gRNA
agccagcaagagacagcgag

SEQ ID NO: 63304 - RNA, 20 nt, Artificial Sequence
  MKO10063304_A_mmu-mir-1907
  gRNA
caagagacagcgagggggag

SEQ ID NO: 63305 - RNA, 20 nt, Artificial Sequence
  MKO10063305_A_mmu-mir-1907
  gRNA
agagacagcgagggggagug

SEQ ID NO: 63306 - RNA, 20 nt, Artificial Sequence
  MKO10063306_A_mmu-mir-28c
  gRNA
aauagacugugagcuccuca

SEQ ID NO: 63307 - RNA, 20 nt, Artificial Sequence
  MKO10063307_A_mmu-mir-28c
  gRNA
acugugagcuccucaagggu

SEQ ID NO: 63308 - RNA, 20 nt, Artificial Sequence
  MKO10063308_A_mmu-mir-28c
  gRNA
acaagcagcaaauuaaauac

SEQ ID NO: 63309 - RNA, 20 nt, Artificial Sequence
  MKO10063309_A_mmu-mir-28c
  gRNA
agauaugaucccuacccuug

SEQ ID NO: 63310 - RNA, 20 nt, Artificial Sequence
  MKO10063310_A_mmu-mir-30b
  gRNA
cauguaugacagcugagugu

SEQ ID NO: 63311 - RNA, 20 nt, Artificial Sequence
  MKO10063311_A_mmu-mir-30b
  gRNA
cugucauacaugcguuggcu

SEQ ID NO: 63312 - RNA, 20 nt, Artificial Sequence
  MKO10063312_A_mmu-mir-30b
  gRNA
uguuuacaugaacugaaacu

SEQ ID NO: 63313 - RNA, 20 nt, Artificial Sequence
  MKO10063313_A_mmu-mir-30b
  gRNA
gauguuuacgucagcugucu

SEQ ID NO: 63314 - RNA, 20 nt, Artificial Sequence
  MKO10063314_A_mmu-mir-30d
  gRNA
caaacaucugacugaaagcu

SEQ ID NO: 63315 - RNA, 20 nt, Artificial Sequence
  MKO10063315_A_mmu-mir-30d
  gRNA
ucugacugaaagcuuggcug

SEQ ID NO: 63316 - RNA, 20 nt, Artificial Sequence
  MKO10063316_A_mmu-mir-30d
  gRNA
uguggcuuacagcuuccagu

SEQ ID NO: 63317 - RNA, 20 nt, Artificial Sequence
  MKO10063317_A_mmu-mir-30d
  gRNA
uggcuuacagcuuccagucg

SEQ ID NO: 63318 - RNA, 20 nt, Artificial Sequence
  MKO10063318_A_mmu-mir-151
  gRNA
uaugacgaucccuguccuca

SEQ ID NO: 63319 - RNA, 20 nt, Artificial Sequence
  MKO10063319_A_mmu-mir-151
  gRNA
ucaaggagccucagucuagu

SEQ ID NO: 63320 - RNA, 20 nt, Artificial Sequence
  MKO10063320_A_mmu-mir-151
  gRNA
ggagccucagucuaguaggg

SEQ ID NO: 63321 - RNA, 20 nt, Artificial Sequence
  MKO10063321_A_mmu-mir-151
  gRNA
acuagacugugagcuccucg

SEQ ID NO: 63322 - RNA, 20 nt, Artificial Sequence
  MKO10063322_A_mmu-mir-6952
  gRNA
uguccagcgucuucuguggg

SEQ ID NO: 63323 - RNA, 20 nt, Artificial Sequence
  MKO10063323_A_mmu-mir-6952
  gRNA
gcugggcccugaaugguggg

SEQ ID NO: 63324 - RNA, 20 nt, Artificial Sequence
  MKO10063324_A_mmu-mir-6952
  gRNA
uguuucaccgcccaccauuc

SEQ ID NO: 63325 - RNA, 20 nt, Artificial Sequence
  MKO10063325_A_mmu-mir-6952
  gRNA
cugccucccacagaagacgc

SEQ ID NO: 63326 - RNA, 20 nt, Artificial Sequence
  MKO10063326_A_mmu-mir-1942
  gRNA
caaccagaugaagacaucug

SEQ ID NO: 63327 - RNA, 20 nt, Artificial Sequence
  MKO10063327_A_mmu-mir-1942
  gRNA
cucagaugucuucaucuggu

SEQ ID NO: 63328 - RNA, 20 nt, Artificial Sequence
  MKO10063328_A_mmu-mir-1942
  gRNA
uaaccucagaugucuucauc

SEQ ID NO: 63329 - RNA, 20 nt, Artificial Sequence
  MKO10063329_A_mmu-mir-1942
  gRNA
gauauuugaauaaagagaag

SEQ ID NO: 63330 - RNA, 20 nt, Artificial Sequence
  MKO10063330_A_mmu-mir-6953
  gRNA
uguagggaaggguaaggggc

SEQ ID NO: 63331 - RNA, 20 nt, Artificial Sequence
  MKO10063331_A_mmu-mir-6953
  gRNA
uagggaaggguaaggggcag

SEQ ID NO: 63332 - RNA, 20 nt, Artificial Sequence
  MKO10063332_A_mmu-mir-6953
  gRNA
gaaggguaaggggcaggggc

SEQ ID NO: 63333 - RNA, 20 nt, Artificial Sequence
  MKO10063333_A_mmu-mir-6953
  gRNA
gcagggauucaagugcccuc

SEQ ID NO: 63334 - RNA, 20 nt, Artificial Sequence
  MKO10063334_A_mmu-mir-3079
  gRNA
caaaggccacaccuaagcua

SEQ ID NO: 63335 - RNA, 20 nt, Artificial Sequence
  MKO10063335_A_mmu-mir-3079
  gRNA
ggacuuucaucugaugagcc

SEQ ID NO: 63336 - RNA, 20 nt, Artificial Sequence
  MKO10063336_A_mmu-mir-3079
  gRNA
ugagccuggagccaggugaa

SEQ ID NO: 63337 - RNA, 20 nt, Artificial Sequence
  MKO10063337_A_mmu-mir-3079
  gRNA
ucagaucaaaguccuuagcu

SEQ ID NO: 63338 - RNA, 20 nt, Artificial Sequence
  MKO10063338_A_mmu-mir-6954
  gRNA
uggcuacucuggggcaguuc

SEQ ID NO: 63339 - RNA, 20 nt, Artificial Sequence
  MKO10063339_A_mmu-mir-6954
  gRNA
cugcagccagcucuuccccu

SEQ ID NO: 63340 - RNA, 20 nt, Artificial Sequence
  MKO10063340_A_mmu-mir-6954
  gRNA
ggggaagagcuggcugcagg

SEQ ID NO: 63341 - RNA, 20 nt, Artificial Sequence
  MKO10063341_A_mmu-mir-6954
  gRNA
ucugcucuguggcuacucug

SEQ ID NO: 63342 - RNA, 20 nt, Artificial Sequence
  MKO10063342_A_mmu-mir-7676-1
  gRNA
uccaggagugacauaaucag

SEQ ID NO: 63343 - RNA, 20 nt, Artificial Sequence
  MKO10063343_A_mmu-mir-7676-1
  gRNA
gaggccaucauacugcccuc

SEQ ID NO: 63344 - RNA, 20 nt, Artificial Sequence
  MKO10063344_A_mmu-mir-7676-1
  gRNA
gggcccugagggcaguauga

SEQ ID NO: 63345 - RNA, 20 nt, Artificial Sequence
  MKO10063345_A_mmu-mir-7676-1
  gRNA
ccugugggcagagugagcac

SEQ ID NO: 63346 - RNA, 20 nt, Artificial Sequence
  MKO10063346_A_mmu-mir-7676-2
  gRNA
ccggugcucacucugcccac

SEQ ID NO: 63347 - RNA, 20 nt, Artificial Sequence
  MKO10063347_A_mmu-mir-7676-2
  gRNA
uccaggagugacauaaucag

SEQ ID NO: 63348 - RNA, 20 nt, Artificial Sequence
  MKO10063348_A_mmu-mir-7676-2
  gRNA
gggcccugagggcaguauga

SEQ ID NO: 63349 - RNA, 20 nt, Artificial Sequence
  MKO10063349_A_mmu-mir-7676-2
  gRNA
gccucugauuaugucacucc

SEQ ID NO: 63350 - RNA, 20 nt, Artificial Sequence
  MKO10063350_A_mmu-mir-6955
  gRNA
ugcagggaagggagggccuc

SEQ ID NO: 63351 - RNA, 20 nt, Artificial Sequence
  MKO10063351_A_mmu-mir-6955
  gRNA
aagggagggccucaggacuc

SEQ ID NO: 63352 - RNA, 20 nt, Artificial Sequence
  MKO10063352_A_mmu-mir-6955
  gRNA
ggagggccucaggacucagg

SEQ ID NO: 63353 - RNA, 20 nt, Artificial Sequence
  MKO10063353_A_mmu-mir-6955
  gRNA
gggucaccuccugaguccug

SEQ ID NO: 63354 - RNA, 20 nt, Artificial Sequence
  MKO10063354_A_mmu-mir-6956
  gRNA
gggcccuggcaggcagugag

SEQ ID NO: 63355 - RNA, 20 nt, Artificial Sequence
  MKO10063355_A_mmu-mir-6956
  gRNA
aggcagugagugggugggac

SEQ ID NO: 63356 - RNA, 20 nt, Artificial Sequence
  MKO10063356_A_mmu-mir-6956
  gRNA
gugagugggugggacuggcc

SEQ ID NO: 63357 - RNA, 20 nt, Artificial Sequence
  MKO10063357_A_mmu-mir-6956
  gRNA
cagcuccugagaggauaggc

SEQ ID NO: 63358 - RNA, 20 nt, Artificial Sequence
  MKO10063358_A_mmu-mir-1943
  gRNA
gcugguccuggugacuggga

SEQ ID NO: 63359 - RNA, 20 nt, Artificial Sequence
  MKO10063359_A_mmu-mir-1943
  gRNA
guccuggugacugggaaggg

SEQ ID NO: 63360 - RNA, 20 nt, Artificial Sequence
  MKO10063360_A_mmu-mir-1943
  gRNA
gugacugggaagggaggagc

SEQ ID NO: 63361 - RNA, 20 nt, Artificial Sequence
  MKO10063361_A_mmu-mir-1943
  gRNA
agggaggagcuggcaccugc

SEQ ID NO: 63362 - RNA, 20 nt, Artificial Sequence
  MKO10063362_A_mmu-mir-7213
  gRNA
aucucagacuggcucucuug

SEQ ID NO: 63363 - RNA, 20 nt, Artificial Sequence
  MKO10063363_A_mmu-mir-7213
  gRNA
aucucagacugggucucuug

SEQ ID NO: 63364 - RNA, 20 nt, Artificial Sequence
  MKO10063364_A_mmu-mir-7213
  gRNA
agguagccccccuuccuuuc

SEQ ID NO: 63365 - RNA, 20 nt, Artificial Sequence
  MKO10063365_A_mmu-mir-7213
  gRNA
agguagccugaaaggaaggg

SEQ ID NO: 63366 - RNA, 20 nt, Artificial Sequence
  MKO10063366_A_mmu-mir-6957
  gRNA
guuacugccagaagagagac

SEQ ID NO: 63367 - RNA, 20 nt, Artificial Sequence
  MKO10063367_A_mmu-mir-6957
  gRNA
ccagaagagagacaggaucu

SEQ ID NO: 63368 - RNA, 20 nt, Artificial Sequence
  MKO10063368_A_mmu-mir-6957
  gRNA
gagagacaggaucuagggaa

SEQ ID NO: 63369 - RNA, 20 nt, Artificial Sequence
  MKO10063369_A_mmu-mir-6957
  gRNA
gaucucuuguuuucucuucc

SEQ ID NO: 63370 - RNA, 20 nt, Artificial Sequence
  MKO10063370_A_mmu-mir-5113
  gRNA
gagguuuaaagaccuaggga

SEQ ID NO: 63371 - RNA, 20 nt, Artificial Sequence
  MKO10063371_A_mmu-mir-5113
  gRNA
aagaccuagggaugggacag

SEQ ID NO: 63372 - RNA, 20 nt, Artificial Sequence
  MKO10063372_A_mmu-mir-5113
  gRNA
accuagggaugggacagagg

SEQ ID NO: 63373 - RNA, 20 nt, Artificial Sequence
  MKO10063373_A_mmu-mir-5113
  gRNA
ucccuccucucugcucuccc

SEQ ID NO: 63374 - RNA, 20 nt, Artificial Sequence
  MKO10063374_A_mmu-mir-33
  gRNA
aauguuuccacagugcauca

SEQ ID NO: 63375 - RNA, 20 nt, Artificial Sequence
  MKO10063375_A_mmu-mir-33
  gRNA
guuuccacagugcaucacgg

SEQ ID NO: 63376 - RNA, 20 nt, Artificial Sequence
  MKO10063376_A_mmu-mir-33
  gRNA
gcacuguggaaacauugcac

SEQ ID NO: 63377 - RNA, 20 nt, Artificial Sequence
  MKO10063377_A_mmu-mir-33
  gRNA
caggccuccgugaugcacug

SEQ ID NO: 63378 - RNA, 20 nt, Artificial Sequence
  MKO10063378_A_mmu-mir-7684
  gRNA
agccccagucagcagcucca

SEQ ID NO: 63379 - RNA, 20 nt, Artificial Sequence
  MKO10063379_A_mmu-mir-7684
  gRNA
ugguugccccacugcugccc

SEQ ID NO: 63380 - RNA, 20 nt, Artificial Sequence
  MKO10063380_A_mmu-mir-7684
  gRNA
ugcugacuggggcuggccug

SEQ ID NO: 63381 - RNA, 20 nt, Artificial Sequence
  MKO10063381_A_mmu-mir-7684
  gRNA
aaccauggagcugcugacug

SEQ ID NO: 63382 - RNA, 20 nt, Artificial Sequence
  MKO10063382_A_mmu-mir-3080
  gRNA
gaugucaagcgcuuugcccg

SEQ ID NO: 63383 - RNA, 20 nt, Artificial Sequence
  MKO10063383_A_mmu-mir-3080
  gRNA
cuuugcccgaggaugacuac

SEQ ID NO: 63384 - RNA, 20 nt, Artificial Sequence
  MKO10063384_A_mmu-mir-3080
  gRNA
cagggccacgauccaagaac

SEQ ID NO: 63385 - RNA, 20 nt, Artificial Sequence
  MKO10063385_A_mmu-mir-3080
  gRNA
guggcccuguagucauccuc

SEQ ID NO: 63386 - RNA, 20 nt, Artificial Sequence
  MKO10063386_A_mmu-mir-6392
  gRNA
aucuucuuccugacccgcuc

SEQ ID NO: 63387 - RNA, 20 nt, Artificial Sequence
  MKO10063387_A_mmu-mir-6392
  gRNA
ccugacccgcucuggcgccc

SEQ ID NO: 63388 - RNA, 20 nt, Artificial Sequence
  MKO10063388_A_mmu-mir-6392
  gRNA
ggcgcccugguccugucagc

SEQ ID NO: 63389 - RNA, 20 nt, Artificial Sequence
  MKO10063389_A_mmu-mir-6392
  gRNA
ugagcagcagggaacgacgc

SEQ ID NO: 63390 - RNA, 20 nt, Artificial Sequence
  MKO10063390_A_mmu-mir-1249
  gRNA
aggaguucgccaggugaaga

SEQ ID NO: 63391 - RNA, 20 nt, Artificial Sequence
  MKO10063391_A_mmu-mir-1249
  gRNA
gaguucgccaggugaagaag

SEQ ID NO: 63392 - RNA, 20 nt, Artificial Sequence
  MKO10063392_A_mmu-mir-1249
  gRNA
ccaggugaagaaggggggga

SEQ ID NO: 63393 - RNA, 20 nt, Artificial Sequence
  MKO10063393_A_mmu-mir-1249
  gRNA
aagggggggaagggcguucc

SEQ ID NO: 63394 - RNA, 20 nt, Artificial Sequence
  MKO10063394_A_mmu-let-7c-2
  gRNA
caagacugacugacggccuu

SEQ ID NO: 63395 - RNA, 20 nt, Artificial Sequence
  MKO10063395_A_mmu-let-7c-2
  gRNA
gacugacggccuuuggggug

SEQ ID NO: 63396 - RNA, 20 nt, Artificial Sequence
  MKO10063396_A_mmu-let-7c-2
  gRNA
ggccuuuggggugagguagu

SEQ ID NO: 63397 - RNA, 20 nt, Artificial Sequence
  MKO10063397_A_mmu-let-7c-2
  gRNA
gggugagguaguagguugua

SEQ ID NO: 63398 - RNA, 20 nt, Artificial Sequence
  MKO10063398_A_mmu-let-7b
  gRNA
aacacggacaccgcagggug

SEQ ID NO: 63399 - RNA, 20 nt, Artificial Sequence
  MKO10063399_A_mmu-let-7b
  gRNA
gggugagguaguagguugug

SEQ ID NO: 63400 - RNA, 20 nt, Artificial Sequence
  MKO10063400_A_mmu-let-7b
  gRNA
guaguagguugugugguuuc

SEQ ID NO: 63401 - RNA, 20 nt, Artificial Sequence
  MKO10063401_A_mmu-let-7b
  gRNA
acaaccuacugccuucccug

SEQ ID NO: 63402 - RNA, 20 nt, Artificial Sequence
  MKO10063402_A_mmu-mir-6393
  gRNA
gccaggccaacagugacacu

SEQ ID NO: 63403 - RNA, 20 nt, Artificial Sequence
  MKO10063403_A_mmu-mir-6393
  gRNA
acucagugugcuucgugggc

SEQ ID NO: 63404 - RNA, 20 nt, Artificial Sequence
  MKO10063404_A_mmu-mir-6393
  gRNA
ugcuucgugggcagggcaga

SEQ ID NO: 63405 - RNA, 20 nt, Artificial Sequence
  MKO10063405_A_mmu-mir-6393
  gRNA
uccaagugucacuguuggcc

SEQ ID NO: 63406 - RNA, 20 nt, Artificial Sequence
  MKO10063406_A_mmu-mir-7118
  gRNA
guagagagucacuguggagg

SEQ ID NO: 63407 - RNA, 20 nt, Artificial Sequence
  MKO10063407_A_mmu-mir-7118
  gRNA
ggucuggggaaggcgggaga

SEQ ID NO: 63408 - RNA, 20 nt, Artificial Sequence
  MKO10063408_A_mmu-mir-7118
  gRNA
ggguggggucuggggaaggc

SEQ ID NO: 63409 - RNA, 20 nt, Artificial Sequence
  MKO10063409_A_mmu-mir-7118
  gRNA
guuguagagagucacugugg

SEQ ID NO: 63410 - RNA, 20 nt, Artificial Sequence
  MKO10063410_A_mmu-mir-6958
  gRNA
gugauggcaagaggcagcug

SEQ ID NO: 63411 - RNA, 20 nt, Artificial Sequence
  MKO10063411_A_mmu-mir-6958
  gRNA
gagcugagcuagcggacuug

SEQ ID NO: 63412 - RNA, 20 nt, Artificial Sequence
  MKO10063412_A_mmu-mir-6958
  gRNA
gugggagaagaggcugcugu

SEQ ID NO: 63413 - RNA, 20 nt, Artificial Sequence
  MKO10063413_A_mmu-mir-6958
  gRNA
gccucuacaggugggagaag

SEQ ID NO: 63414 - RNA, 20 nt, Artificial Sequence
  MKO10063414_A_mmu-mir-6959
  gRNA
gcuccuuguccugggagagc

SEQ ID NO: 63415 - RNA, 20 nt, Artificial Sequence
  MKO10063415_A_mmu-mir-6959
  gRNA
aggucggugcagugaguauc

SEQ ID NO: 63416 - RNA, 20 nt, Artificial Sequence
  MKO10063416_A_mmu-mir-6959
  gRNA
aaacacucacagcccgacac

SEQ ID NO: 63417 - RNA, 20 nt, Artificial Sequence
  MKO10063417_A_mmu-mir-6959
  gRNA
cagcccgacacagguuuccc

SEQ ID NO: 63418 - RNA, 20 nt, Artificial Sequence
  MKO10063418_A_mmu-mir-7648
  gRNA
gggccucugagcccgcguuc

SEQ ID NO: 63419 - RNA, 20 nt, Artificial Sequence
  MKO10063419_A_mmu-mir-7648
  gRNA
cugagcccgcguuccgggcu

SEQ ID NO: 63420 - RNA, 20 nt, Artificial Sequence
  MKO10063420_A_mmu-mir-7648
  gRNA
cgcuccgggcugcccagggc

SEQ ID NO: 63421 - RNA, 20 nt, Artificial Sequence
  MKO10063421_A_mmu-mir-7648
  gRNA
gggcugcccagggcugggcc

SEQ ID NO: 63422 - RNA, 20 nt, Artificial Sequence
  MKO10063422_A_mmu-mir-1291
  gRNA
cuagucuucaguaagagcca

SEQ ID NO: 63423 - RNA, 20 nt, Artificial Sequence
  MKO10063423_A_mmu-mir-1291
  gRNA
ccuagagaacugucuuccag

SEQ ID NO: 63424 - RNA, 20 nt, Artificial Sequence
  MKO10063424_A_mmu-mir-1291
  gRNA
caguuauacacuguagcugu

SEQ ID NO: 63425 - RNA, 20 nt, Artificial Sequence
  MKO10063425_A_mmu-mir-1291
  gRNA
aagggaugggagguuaccca

SEQ ID NO: 63426 - RNA, 20 nt, Artificial Sequence
  MKO10063426_A_mmu-mir-6960
  gRNA
ugggcaggaugagaagaguu

SEQ ID NO: 63427 - RNA, 20 nt, Artificial Sequence
  MKO10063427_A_mmu-mir-6960
  gRNA
caggaugagaagaguuuggc

SEQ ID NO: 63428 - RNA, 20 nt, Artificial Sequence
  MKO10063428_A_mmu-mir-6960
  gRNA
gagaggugguuggcugagca

SEQ ID NO: 63429 - RNA, 20 nt, Artificial Sequence
  MKO10063429_A_mmu-mir-6960
  gRNA
gcucugaggagagagguggu

SEQ ID NO: 63430 - RNA, 20 nt, Artificial Sequence
  MKO10063430_A_mmu-mir-6961
  gRNA
auugugguucaacuagagcc

SEQ ID NO: 63431 - RNA, 20 nt, Artificial Sequence
  MKO10063431_A_mmu-mir-6961
  gRNA
gagccaggaagaaagaggac

SEQ ID NO: 63432 - RNA, 20 nt, Artificial Sequence
  MKO10063432_A_mmu-mir-6961
  gRNA
uaaccuguccucuuucuucc

SEQ ID NO: 63433 - RNA, 20 nt, Artificial Sequence
  MKO10063433_A_mmu-mir-6961
  gRNA
aaagcugacugggaaggaaa

SEQ ID NO: 63434 - RNA, 20 nt, Artificial Sequence
  MKO10063434_A_mmu-mir-6962
  gRNA
ucugacuccggaaaaggacc

SEQ ID NO: 63435 - RNA, 20 nt, Artificial Sequence
  MKO10063435_A_mmu-mir-6962
  gRNA
cagagcuauaggacagggaa

SEQ ID NO: 63436 - RNA, 20 nt, Artificial Sequence
  MKO10063436_A_mmu-mir-6962
  gRNA
cacagcagagcuauaggaca

SEQ ID NO: 63437 - RNA, 20 nt, Artificial Sequence
  MKO10063437_A_mmu-mir-6962
  gRNA
caugccucugacuccggaaa

SEQ ID NO: 63438 - RNA, 20 nt, Artificial Sequence
  MKO10063438_A_mmu-mir-1941
  gRNA
gggaaagccagcaggguggg

SEQ ID NO: 63439 - RNA, 20 nt, Artificial Sequence
  MKO10063439_A_mmu-mir-1941
  gRNA
gcagggugggagggagaugc

SEQ ID NO: 63440 - RNA, 20 nt, Artificial Sequence
  MKO10063440_A_mmu-mir-1941
  gRNA
gaugcugguacagaggcuug

SEQ ID NO: 63441 - RNA, 20 nt, Artificial Sequence
  MKO10063441_A_mmu-mir-1941
  gRNA
guaucucccauccacccacc

SEQ ID NO: 63442 - RNA, 20 nt, Artificial Sequence
  MKO10063442_A_mmu-mir-688
  gRNA
ggacuugcuggggggcgagc

SEQ ID NO: 63443 - RNA, 20 nt, Artificial Sequence
  MKO10063443_A_mmu-mir-688
  gRNA
ggaauaaguagucgccugcg

SEQ ID NO: 63444 - RNA, 20 nt, Artificial Sequence
  MKO10063444_A_mmu-mir-688
  gRNA
aagaaaaguaggggcuugcu

SEQ ID NO: 63445 - RNA, 20 nt, Artificial Sequence
  MKO10063445_A_mmu-mir-688
  gRNA
agggcagugaagaaaaguag

SEQ ID NO: 63446 - RNA, 20 nt, Artificial Sequence
  MKO10063446_A_mmu-mir-196a-2
  gRNA
cuuagguaguuucauguugu

SEQ ID NO: 63447 - RNA, 20 nt, Artificial Sequence
  MKO10063447_A_mmu-mir-196a-2
  gRNA
uugggauugaguuuugaacu

SEQ ID NO: 63448 - RNA, 20 nt, Artificial Sequence
  MKO10063448_A_mmu-mir-196a-2
  gRNA
acugccugaguuacaucagu

SEQ ID NO: 63449 - RNA, 20 nt, Artificial Sequence
  MKO10063449_A_mmu-mir-196a-2
  gRNA
aaaaccgacugauguaacuc

SEQ ID NO: 63450 - RNA, 20 nt, Artificial Sequence
  MKO10063450_A_mmu-mir-615
  gRNA
ggauuccagcgacucgggag

SEQ ID NO: 63451 - RNA, 20 nt, Artificial Sequence
  MKO10063451_A_mmu-mir-615
  gRNA
cgacucgggaggggcgggag

SEQ ID NO: 63452 - RNA, 20 nt, Artificial Sequence
  MKO10063452_A_mmu-mir-615
  gRNA
acucgggaggggcgggaggg

SEQ ID NO: 63453 - RNA, 20 nt, Artificial Sequence
  MKO10063453_A_mmu-mir-615
  gRNA
ucucgagggugcuuauuguu

SEQ ID NO: 63454 - RNA, 20 nt, Artificial Sequence
  MKO10063454_A_mmu-mir-148b
  gRNA
acaggcacccuuagcauuug

SEQ ID NO: 63455 - RNA, 20 nt, Artificial Sequence
  MKO10063455_A_mmu-mir-148b
  gRNA
ugaaguucuguuauacacuc

SEQ ID NO: 63456 - RNA, 20 nt, Artificial Sequence
  MKO10063456_A_mmu-mir-148b
  gRNA
aacuucaccucaaaugcuaa

SEQ ID NO: 63457 - RNA, 20 nt, Artificial Sequence
  MKO10063457_A_mmu-mir-148b
  gRNA
ucuguuauacacucaggcug

SEQ ID NO: 63458 - RNA, 20 nt, Artificial Sequence
  MKO10063458_A_mmu-mir-6963
  gRNA
uucagguucuugcuguggga

SEQ ID NO: 63459 - RNA, 20 nt, Artificial Sequence
  MKO10063459_A_mmu-mir-6963
  gRNA
agguucuugcugugggaugg

SEQ ID NO: 63460 - RNA, 20 nt, Artificial Sequence
  MKO10063460_A_mmu-mir-6963
  gRNA
ugcugugggauggaggcaag

SEQ ID NO: 63461 - RNA, 20 nt, Artificial Sequence
  MKO10063461_A_mmu-mir-6963
  gRNA
gcaguuugacaagaaucucc

SEQ ID NO: 63462 - RNA, 20 nt, Artificial Sequence
  MKO10063462_A_mmu-mir-6364
  gRNA
uggccuuuucacaggagugc

SEQ ID NO: 63463 - RNA, 20 nt, Artificial Sequence
  MKO10063463_A_mmu-mir-6364
  gRNA
gccuuuucacaggagugcug

SEQ ID NO: 63464 - RNA, 20 nt, Artificial Sequence
  MKO10063464_A_mmu-mir-6364
  gRNA
acacagaagcuauagggcug

SEQ ID NO: 63465 - RNA, 20 nt, Artificial Sequence
  MKO10063465_A_mmu-mir-6364
  gRNA
cuccugugaaaaggccacgu

SEQ ID NO: 63466 - RNA, 20 nt, Artificial Sequence
  MKO10063466_A_mmu-mir-1945
  gRNA
cgacaguacccgcgaagacc

SEQ ID NO: 63467 - RNA, 20 nt, Artificial Sequence
  MKO10063467_A_mmu-mir-1945
  gRNA
aagacccggugcgguuuucu

SEQ ID NO: 63468 - RNA, 20 nt, Artificial Sequence
  MKO10063468_A_mmu-mir-1945
  gRNA
gacccggugcgguuuucucg

SEQ ID NO: 63469 - RNA, 20 nt, Artificial Sequence
  MKO10063469_A_mmu-mir-1945
  gRNA
gcgguuuucucgggggcuga

SEQ ID NO: 63470 - RNA, 20 nt, Artificial Sequence
  MKO10063470_A_mmu-mir-193b
  gRNA
ggaggcggugggcccagaau

SEQ ID NO: 63471 - RNA, 20 nt, Artificial Sequence
  MKO10063471_A_mmu-mir-193b
  gRNA
aggcggugggcccagaaucg

SEQ ID NO: 63472 - RNA, 20 nt, Artificial Sequence
  MKO10063472_A_mmu-mir-193b
  gRNA
ggcccagaaucgggguuuug

SEQ ID NO: 63473 - RNA, 20 nt, Artificial Sequence
  MKO10063473_A_mmu-mir-193b
  gRNA
gaguuuguguuuuauccaac

SEQ ID NO: 63474 - RNA, 20 nt, Artificial Sequence
  MKO10063474_A_mmu-mir-365-1
  gRNA
ugguuaccgcagggaaaaug

SEQ ID NO: 63475 - RNA, 20 nt, Artificial Sequence
  MKO10063475_A_mmu-mir-365-1
  gRNA
gggaaaaugagggacuuuug

SEQ ID NO: 63476 - RNA, 20 nt, Artificial Sequence
  MKO10063476_A_mmu-mir-365-1
  gRNA
aaagucccucauuuucccug

SEQ ID NO: 63477 - RNA, 20 nt, Artificial Sequence
  MKO10063477_A_mmu-mir-365-1
  gRNA
uuuuaggggcauuaugauag

SEQ ID NO: 63478 - RNA, 20 nt, Artificial Sequence
  MKO10063478_A_mmu-mir-6365
  gRNA
cuaagccagauuucuaaccc

SEQ ID NO: 63479 - RNA, 20 nt, Artificial Sequence
  MKO10063479_A_mmu-mir-6365
  gRNA
aggucuucuacuauuagaau

SEQ ID NO: 63480 - RNA, 20 nt, Artificial Sequence
  MKO10063480_A_mmu-mir-6365
  gRNA
gaagaccuggguuagaaauc

SEQ ID NO: 63481 - RNA, 20 nt, Artificial Sequence
  MKO10063481_A_mmu-mir-6365
  gRNA
auucuaauaguagaagaccu

SEQ ID NO: 63482 - RNA, 20 nt, Artificial Sequence
  MKO10063482_A_mmu-mir-484
  gRNA
cgcggcccugcagccucguc

SEQ ID NO: 63483 - RNA, 20 nt, Artificial Sequence
  MKO10063483_A_mmu-mir-484
  gRNA
caaaauagggucuuaccuag

SEQ ID NO: 63484 - RNA, 20 nt, Artificial Sequence
  MKO10063484_A_mmu-mir-484
  gRNA
uagggucuuaccuagggggc

SEQ ID NO: 63485 - RNA, 20 nt, Artificial Sequence
  MKO10063485_A_mmu-mir-484
  gRNA
ggucuuaccuagggggcugg

SEQ ID NO: 63486 - RNA, 20 nt, Artificial Sequence
  MKO10063486_A_mmu-mir-130b
  gRNA
aucauugcacugcuucccag

SEQ ID NO: 63487 - RNA, 20 nt, Artificial Sequence
  MKO10063487_A_mmu-mir-130b
  gRNA
gaggcccacaguagugcaac

SEQ ID NO: 63488 - RNA, 20 nt, Artificial Sequence
  MKO10063488_A_mmu-mir-130b
  gRNA
gaagcagugcaaugaugaaa

SEQ ID NO: 63489 - RNA, 20 nt, Artificial Sequence
  MKO10063489_A_mmu-mir-130b
  gRNA
uuucccuguugcacuacugu

SEQ ID NO: 63490 - RNA, 20 nt, Artificial Sequence
  MKO10063490_A_mmu-mir-301b
  gRNA
ucagagcacccgcagccagc

SEQ ID NO: 63491 - RNA, 20 nt, Artificial Sequence
  MKO10063491_A_mmu-mir-301b
  gRNA
ugcugugagaagcagugcaa

SEQ ID NO: 63492 - RNA, 20 nt, Artificial Sequence
  MKO10063492_A_mmu-mir-301b
  gRNA
uggcugcgggugcucugacu

SEQ ID NO: 63493 - RNA, 20 nt, Artificial Sequence
  MKO10063493_A_mmu-mir-301b
  gRNA
ggugagguggucuucgaggc

SEQ ID NO: 63494 - RNA, 20 nt, Artificial Sequence
  MKO10063494_A_mmu-mir-6366
  gRNA
uaaggggcccggggagccag

SEQ ID NO: 63495 - RNA, 20 nt, Artificial Sequence
  MKO10063495_A_mmu-mir-6366
  gRNA
auucucagcuaaggggcccg

SEQ ID NO: 63496 - RNA, 20 nt, Artificial Sequence
  MKO10063496_A_mmu-mir-6366
  gRNA
cuaucagucauucucagcua

SEQ ID NO: 63497 - RNA, 20 nt, Artificial Sequence
  MKO10063497_A_mmu-mir-6366
  gRNA
ucuggcaagugggucuccug

SEQ ID NO: 63498 - RNA, 20 nt, Artificial Sequence
  MKO10063498_A_mmu-mir-1306
  gRNA
cugcaucacuggacguuugc

SEQ ID NO: 63499 - RNA, 20 nt, Artificial Sequence
  MKO10063499_A_mmu-mir-1306
  gRNA
gcaucacuggacguuugcag

SEQ ID NO: 63500 - RNA, 20 nt, Artificial Sequence
  MKO10063500_A_mmu-mir-1306
  gRNA
cuggacguuugcaggggagg

SEQ ID NO: 63501 - RNA, 20 nt, Artificial Sequence
  MKO10063501_A_mmu-mir-1306
  gRNA
gacguuugcaggggaggugg

SEQ ID NO: 63502 - RNA, 20 nt, Artificial Sequence
  MKO10063502_A_mmu-mir-185
  gRNA
gaggaaagccagccccuggg

SEQ ID NO: 63503 - RNA, 20 nt, Artificial Sequence
  MKO10063503_A_mmu-mir-185
  gRNA
ggaaagccagccccugggag

SEQ ID NO: 63504 - RNA, 20 nt, Artificial Sequence
  MKO10063504_A_mmu-mir-185
  gRNA
cccaggggcuggcuuuccuc

SEQ ID NO: 63505 - RNA, 20 nt, Artificial Sequence
  MKO10063505_A_mmu-mir-185
  gRNA
uccugaugguccccucccag

SEQ ID NO: 63506 - RNA, 20 nt, Artificial Sequence
  MKO10063506_A_mmu-mir-1224
  gRNA
uaccugccucuggugaggac

SEQ ID NO: 63507 - RNA, 20 nt, Artificial Sequence
  MKO10063507_A_mmu-mir-1224
  gRNA
ccugccucuggugaggacug

SEQ ID NO: 63508 - RNA, 20 nt, Artificial Sequence
  MKO10063508_A_mmu-mir-1224
  gRNA
gccucuggugaggacugggg

SEQ ID NO: 63509 - RNA, 20 nt, Artificial Sequence
  MKO10063509_A_mmu-mir-1224
  gRNA
ucuggugaggacuggggagg

SEQ ID NO: 63510 - RNA, 20 nt, Artificial Sequence
  MKO10063510_A_mmu-mir-7680
  gRNA
auaccgaacugcuuguucac

SEQ ID NO: 63511 - RNA, 20 nt, Artificial Sequence
  MKO10063511_A_mmu-mir-7680
  gRNA
aacugcuuguucacuggaau

SEQ ID NO: 63512 - RNA, 20 nt, Artificial Sequence
  MKO10063512_A_mmu-mir-7680
  gRNA
ugcacgaacugcuuguucac

SEQ ID NO: 63513 - RNA, 20 nt, Artificial Sequence
  MKO10063513_A_mmu-mir-7680
  gRNA
auuccagugaacaagcaguu

SEQ ID NO: 63514 - RNA, 20 nt, Artificial Sequence
  MKO10063514_A_mmu-mir-8095
  gRNA
ggcuacaaaguagaacuguc

SEQ ID NO: 63515 - RNA, 20 nt, Artificial Sequence
  MKO10063515_A_mmu-mir-8095
  gRNA
cuacaaaguagaacugucug

SEQ ID NO: 63516 - RNA, 20 nt, Artificial Sequence
  MKO10063516_A_mmu-mir-8095
  gRNA
uucuacuuuguagcccuggu

SEQ ID NO: 63517 - RNA, 20 nt, Artificial Sequence
  MKO10063517_A_mmu-mir-8095
  gRNA
acaguucuacuuuguagccc

SEQ ID NO: 63518 - RNA, 20 nt, Artificial Sequence
  MKO10063518_A_mmu-mir-6362
  gRNA
auuauucauucuuuugcugg

SEQ ID NO: 63519 - RNA, 20 nt, Artificial Sequence
  MKO10063519_A_mmu-mir-6362
  gRNA
aucuaggcuaguucuguucu

SEQ ID NO: 63520 - RNA, 20 nt, Artificial Sequence
  MKO10063520_A_mmu-mir-6362
  gRNA
guucuguucuugggcuguga

SEQ ID NO: 63521 - RNA, 20 nt, Artificial Sequence
  MKO10063521_A_mmu-mir-6362
  gRNA
uggacaggacaacaacaagc

SEQ ID NO: 63522 - RNA, 20 nt, Artificial Sequence
  MKO10063522_A_mmu-mir-28a
  gRNA
agagguggucccuaccuuca

SEQ ID NO: 63523 - RNA, 20 nt, Artificial Sequence
  MKO10063523_A_mmu-mir-28a
  gRNA
cccacuagauugugagcugc

SEQ ID NO: 63524 - RNA, 20 nt, Artificial Sequence
  MKO10063524_A_mmu-mir-28a
  gRNA
acuagauugugagcugcugg

SEQ ID NO: 63525 - RNA, 20 nt, Artificial Sequence
  MKO10063525_A_mmu-mir-28a
  gRNA
auugugagcugcuggagggc

SEQ ID NO: 63526 - RNA, 20 nt, Artificial Sequence
  MKO10063526_A_mmu-mir-690
  gRNA
ugagccaucucuccagcugg

SEQ ID NO: 63527 - RNA, 20 nt, Artificial Sequence
  MKO10063527_A_mmu-mir-690
  gRNA
uggcucagcuguuaaaggcu

SEQ ID NO: 63528 - RNA, 20 nt, Artificial Sequence
  MKO10063528_A_mmu-mir-690
  gRNA
aagaaacauucuccuccagc

SEQ ID NO: 63529 - RNA, 20 nt, Artificial Sequence
  MKO10063529_A_mmu-mir-690
  gRNA
gaagagugguucuuauauuu

SEQ ID NO: 63530 - RNA, 20 nt, Artificial Sequence
  MKO10063530_A_mmu-mir-1946a
  gRNA
ugagauuaacaaaaaaggag

SEQ ID NO: 63531 - RNA, 20 nt, Artificial Sequence
  MKO10063531_A_mmu-mir-1946a
  gRNA
gaggagaaagccgagagugg

SEQ ID NO: 63532 - RNA, 20 nt, Artificial Sequence
  MKO10063532_A_mmu-mir-1946a
  gRNA
ugccugugccucacaagugu

SEQ ID NO: 63533 - RNA, 20 nt, Artificial Sequence
  MKO10063533_A_mmu-mir-1946a
  gRNA
aagugugugccaccacugcc

SEQ ID NO: 63534 - RNA, 20 nt, Artificial Sequence
  MKO10063534_A_mmu-mir-1947
  gRNA
cugaaagaugaacaaggugg

SEQ ID NO: 63535 - RNA, 20 nt, Artificial Sequence
  MKO10063535_A_mmu-mir-1947
  gRNA
aaagaugaacaagguggugg

SEQ ID NO: 63536 - RNA, 20 nt, Artificial Sequence
  MKO10063536_A_mmu-mir-1947
  gRNA
acgauugagcagggcaugga

SEQ ID NO: 63537 - RNA, 20 nt, Artificial Sequence
  MKO10063537_A_mmu-mir-1947
  gRNA
caucugaaagaugaacaagg

SEQ ID NO: 63538 - RNA, 20 nt, Artificial Sequence
  MKO10063538_A_mmu-mir-6540
  gRNA
cgggacaagguacagggcua

SEQ ID NO: 63539 - RNA, 20 nt, Artificial Sequence
  MKO10063539_A_mmu-mir-6540
  gRNA
aagguacagggcuauggcaa

SEQ ID NO: 63540 - RNA, 20 nt, Artificial Sequence
  MKO10063540_A_mmu-mir-6540
  gRNA
cuauggcaaaggcccuuugg

SEQ ID NO: 63541 - RNA, 20 nt, Artificial Sequence
  MKO10063541_A_mmu-mir-6540
  gRNA
cacugaagucugccugccuu

SEQ ID NO: 63542 - RNA, 20 nt, Artificial Sequence
  MKO10063542_A_mmu-mir-568
  gRNA
uauauauguccacauauaug

SEQ ID NO: 63543 - RNA, 20 nt, Artificial Sequence
  MKO10063543_A_mmu-mir-568
  gRNA
augcgguguguguauuauac

SEQ ID NO: 63544 - RNA, 20 nt, Artificial Sequence
  MKO10063544_A_mmu-mir-568
  gRNA
auacacacaccgcauauaug

SEQ ID NO: 63545 - RNA, 20 nt, Artificial Sequence
  MKO10063545_A_mmu-mir-568
  gRNA
uguguguauuauacagguau

SEQ ID NO: 63546 - RNA, 20 nt, Artificial Sequence
  MKO10063546_A_mmu-mir-3470b
  gRNA
agggauucucuguguagccu

SEQ ID NO: 63547 - RNA, 20 nt, Artificial Sequence
  MKO10063547_A_mmu-mir-3470b
  gRNA
cuguguagccuuggcugucc

SEQ ID NO: 63548 - RNA, 20 nt, Artificial Sequence
  MKO10063548_A_mmu-mir-3470b
  gRNA
uggcacucacucuguagacc

SEQ ID NO: 63549 - RNA, 20 nt, Artificial Sequence
  MKO10063549_A_mmu-mir-3470b
  gRNA
acucacucuguagaccaggc

SEQ ID NO: 63550 - RNA, 20 nt, Artificial Sequence
  MKO10063550_A_mmu-mir-3081
  gRNA
caagagcccagcucagagau

SEQ ID NO: 63551 - RNA, 20 nt, Artificial Sequence
  MKO10063551_A_mmu-mir-3081
  gRNA
cucugagcugggcucuugcc

SEQ ID NO: 63552 - RNA, 20 nt, Artificial Sequence
  MKO10063552_A_mmu-mir-3081
  gRNA
ugcgcuccgaucucugagcu

SEQ ID NO: 63553 - RNA, 20 nt, Artificial Sequence
  MKO10063553_A_mmu-mir-3081
  gRNA
uggagcggugagcuggacuc

SEQ ID NO: 63554 - RNA, 20 nt, Artificial Sequence
  MKO10063554_A_mmu-mir-6363
  gRNA
gugcgucagaggacaaucac

SEQ ID NO: 63555 - RNA, 20 nt, Artificial Sequence
  MKO10063555_A_mmu-mir-6363
  gRNA
cagucuacagagugcgucag

SEQ ID NO: 63556 - RNA, 20 nt, Artificial Sequence
  MKO10063556_A_mmu-mir-6363
  gRNA
agcacuugggagauggaggc

SEQ ID NO: 63557 - RNA, 20 nt, Artificial Sequence
  MKO10063557_A_mmu-mir-6363
  gRNA
cgagauaaaauuccucuacg

SEQ ID NO: 63558 - RNA, 20 nt, Artificial Sequence
  MKO10063558_A_mmu-mir-5118
  gRNA
uccuaguacuuaggaggcag

SEQ ID NO: 63559 - RNA, 20 nt, Artificial Sequence
  MKO10063559_A_mmu-mir-5118
  gRNA
aguacuuaggaggcagaggu

SEQ ID NO: 63560 - RNA, 20 nt, Artificial Sequence
  MKO10063560_A_mmu-mir-5118
  gRNA
guucgaagguuaggccagcc

SEQ ID NO: 63561 - RNA, 20 nt, Artificial Sequence
  MKO10063561_A_mmu-mir-5118
  gRNA
acucucuuuggagaccaggc

SEQ ID NO: 63562 - RNA, 20 nt, Artificial Sequence
  MKO10063562_A_mmu-mir-691
  gRNA
aacauuuucugccucucuuc

SEQ ID NO: 63563 - RNA, 20 nt, Artificial Sequence
  MKO10063563_A_mmu-mir-691
  gRNA
cuuugaauauuccugaagag

SEQ ID NO: 63564 - RNA, 20 nt, Artificial Sequence
  MKO10063564_A_mmu-mir-691
  gRNA
gaauauucaaagcagaccca

SEQ ID NO: 63565 - RNA, 20 nt, Artificial Sequence
  MKO10063565_A_mmu-mir-691
  gRNA
guuauauuuaauauccauau

SEQ ID NO: 63566 - RNA, 20 nt, Artificial Sequence
  MKO10063566_A_mmu-mir-99a
  gRNA
accgcgcaagcucguuucua

SEQ ID NO: 63567 - RNA, 20 nt, Artificial Sequence
  MKO10063567_A_mmu-mir-99a
  gRNA
agcucguuucuaugggucug

SEQ ID NO: 63568 - RNA, 20 nt, Artificial Sequence
  MKO10063568_A_mmu-mir-99a
  gRNA
caccacaagaucggaucuac

SEQ ID NO: 63569 - RNA, 20 nt, Artificial Sequence
  MKO10063569_A_mmu-mir-99a
  gRNA
aacccguagauccgaucuug

SEQ ID NO: 63570 - RNA, 20 nt, Artificial Sequence
  MKO10063570_A_mmu-let-7c-1
  gRNA
cauuggaagcugugugcauc

SEQ ID NO: 63571 - RNA, 20 nt, Artificial Sequence
  MKO10063571_A_mmu-let-7c-1
  gRNA
ugcauccggguugagguagu

SEQ ID NO: 63572 - RNA, 20 nt, Artificial Sequence
  MKO10063572_A_mmu-let-7c-1
  gRNA
gguugagguaguagguugua

SEQ ID NO: 63573 - RNA, 20 nt, Artificial Sequence
  MKO10063573_A_mmu-let-7c-1
  gRNA
gguuguacaguuaacuccca

SEQ ID NO: 63574 - RNA, 20 nt, Artificial Sequence
  MKO10063574_A_mmu-mir-125b-2
  gRNA
cccugagacccuaacuugug

SEQ ID NO: 63575 - RNA, 20 nt, Artificial Sequence
  MKO10063575_A_mmu-mir-125b-2
  gRNA
uuuuaguaacaucacaaguc

SEQ ID NO: 63576 - RNA, 20 nt, Artificial Sequence
  MKO10063576_A_mmu-mir-125b-2
  gRNA
ucagguucuugggaccuagg

SEQ ID NO: 63577 - RNA, 20 nt, Artificial Sequence
  MKO10063577_A_mmu-mir-125b-2
  gRNA
gguucuugggaccuaggcgg

SEQ ID NO: 63578 - RNA, 20 nt, Artificial Sequence
  MKO10063578_A_mmu-mir-155
  gRNA
gcuaauugugauagggguuu

SEQ ID NO: 63579 - RNA, 20 nt, Artificial Sequence
  MKO10063579_A_mmu-mir-155
  gRNA
uccuaccuguuagcauuaac

SEQ ID NO: 63580 - RNA, 20 nt, Artificial Sequence
  MKO10063580_A_mmu-mir-155
  gRNA
uccuguuaaugcuaacaggu

SEQ ID NO: 63581 - RNA, 20 nt, Artificial Sequence
  MKO10063581_A_mmu-mir-155
  gRNA
uguguccuguuaaugcuaac

SEQ ID NO: 63582 - RNA, 20 nt, Artificial Sequence
  MKO10063582_A_mmu-mir-6367
  gRNA
ccgagcacacuuccccccag

SEQ ID NO: 63583 - RNA, 20 nt, Artificial Sequence
  MKO10063583_A_mmu-mir-6367
  gRNA
ucuugcuucuacuucccaca

SEQ ID NO: 63584 - RNA, 20 nt, Artificial Sequence
  MKO10063584_A_mmu-mir-6367
  gRNA
gcuucuacuucccacacggc

SEQ ID NO: 63585 - RNA, 20 nt, Artificial Sequence
  MKO10063585_A_mmu-mir-6367
  gRNA
auuuauaacgguccacuggg

SEQ ID NO: 63586 - RNA, 20 nt, Artificial Sequence
  MKO10063586_A_mmu-mir-802
  gRNA
cuugugucaaucauacaaca

SEQ ID NO: 63587 - RNA, 20 nt, Artificial Sequence
  MKO10063587_A_mmu-mir-802
  gRNA
uguuacugauugcaaauaau

SEQ ID NO: 63588 - RNA, 20 nt, Artificial Sequence
  MKO10063588_A_mmu-mir-802
  gRNA
cguguuguaugauugacaca

SEQ ID NO: 63589 - RNA, 20 nt, Artificial Sequence
  MKO10063589_A_mmu-mir-802
  gRNA
uuaauagccuucaccucgaa

SEQ ID NO: 63590 - RNA, 20 nt, Artificial Sequence
  MKO10063590_A_mmu-mir-6964
  gRNA
uauccccaacagaccuagag

SEQ ID NO: 63591 - RNA, 20 nt, Artificial Sequence
  MKO10063591_A_mmu-mir-6964
  gRNA
guuuccagucucacacccca

SEQ ID NO: 63592 - RNA, 20 nt, Artificial Sequence
  MKO10063592_A_mmu-mir-6964
  gRNA
ucuuucuugucuuccacucu

SEQ ID NO: 63593 - RNA, 20 nt, Artificial Sequence
  MKO10063593_A_mmu-mir-6964
  gRNA
ccccccuuggggugugagac

SEQ ID NO: 63594 - RNA, 20 nt, Artificial Sequence
  MKO10063594_A_mmu-mir-692-1
  gRNA
gggagccccuuggaaggcag

SEQ ID NO: 63595 - RNA, 20 nt, Artificial Sequence
  MKO10063595_A_mmu-mir-692-1
  gRNA
gcgccagucugcgcugguug

SEQ ID NO: 63596 - RNA, 20 nt, Artificial Sequence
  MKO10063596_A_mmu-mir-692-1
  gRNA
gcgcagacuggcgcgcccca

SEQ ID NO: 63597 - RNA, 20 nt, Artificial Sequence
  MKO10063597_A_mmu-mir-692-1
  gRNA
ccaaccuccgcaggguggca

SEQ ID NO: 63598 - RNA, 20 nt, Artificial Sequence
  MKO10063598_A_mmu-mir-99b
  gRNA
cacccguagaaccgaccuug

SEQ ID NO: 63599 - RNA, 20 nt, Artificial Sequence
  MKO10063599_A_mmu-mir-99b
  gRNA
cccguagaaccgaccuugcg

SEQ ID NO: 63600 - RNA, 20 nt, Artificial Sequence
  MKO10063600_A_mmu-mir-99b
  gRNA
cgcacacaagcucgugucug

SEQ ID NO: 63601 - RNA, 20 nt, Artificial Sequence
  MKO10063601_A_mmu-mir-99b
  gRNA
ucgugucuguggguccgugu

SEQ ID NO: 63602 - RNA, 20 nt, Artificial Sequence
  MKO10063602_A_mmu-let-7e
  gRNA
cugccgcgccccccgggcug

SEQ ID NO: 63603 - RNA, 20 nt, Artificial Sequence
  MKO10063603_A_mmu-let-7e
  gRNA
cgcgccccccgggcugaggu

SEQ ID NO: 63604 - RNA, 20 nt, Artificial Sequence
  MKO10063604_A_mmu-let-7e
  gRNA
gccccccgggcugagguagg

SEQ ID NO: 63605 - RNA, 20 nt, Artificial Sequence
  MKO10063605_A_mmu-let-7e
  gRNA
gguaggagguuguauaguug

SEQ ID NO: 63606 - RNA, 20 nt, Artificial Sequence
  MKO10063606_A_mmu-mir-125a
  gRNA
cugagacccuuuaaccugug

SEQ ID NO: 63607 - RNA, 20 nt, Artificial Sequence
  MKO10063607_A_mmu-mir-125a
  gRNA
gugaggacguccagggucac

SEQ ID NO: 63608 - RNA, 20 nt, Artificial Sequence
  MKO10063608_A_mmu-mir-125a
  gRNA
gacguccagggucacaggug

SEQ ID NO: 63609 - RNA, 20 nt, Artificial Sequence
  MKO10063609_A_mmu-mir-125a
  gRNA
aaagggucucagggacccag

SEQ ID NO: 63610 - RNA, 20 nt, Artificial Sequence
  MKO10063610_A_mmu-mir-5125
  gRNA
uaaggagagccccaugccuu

SEQ ID NO: 63611 - RNA, 20 nt, Artificial Sequence
  MKO10063611_A_mmu-mir-5125
  gRNA
cugggauuuccuugucugcc

SEQ ID NO: 63612 - RNA, 20 nt, Artificial Sequence
  MKO10063612_A_mmu-mir-5125
  gRNA
ggggcucuccuuagacugca

SEQ ID NO: 63613 - RNA, 20 nt, Artificial Sequence
  MKO10063613_A_mmu-mir-5125
  gRNA
gaacagcauguccaaaggca

SEQ ID NO: 63614 - RNA, 20 nt, Artificial Sequence
  MKO10063614_A_mmu-mir-5134
  gRNA
uagaauguaccugcagaaag

SEQ ID NO: 63615 - RNA, 20 nt, Artificial Sequence
  MKO10063615_A_mmu-mir-5134
  gRNA
acggguggcccucuuucugc

SEQ ID NO: 63616 - RNA, 20 nt, Artificial Sequence
  MKO10063616_A_mmu-mir-5134
  gRNA
cuuguccuaguuuucacggg

SEQ ID NO: 63617 - RNA, 20 nt, Artificial Sequence
  MKO10063617_A_mmu-mir-5134
  gRNA
cugaacagacuuggcagaaa

SEQ ID NO: 63618 - RNA, 20 nt, Artificial Sequence
  MKO10063618_A_mmu-mir-6965
  gRNA
ucugugcucggucucgcucc

SEQ ID NO: 63619 - RNA, 20 nt, Artificial Sequence
  MKO10063619_A_mmu-mir-6965
  gRNA
aggcuauugggcaggagaug

SEQ ID NO: 63620 - RNA, 20 nt, Artificial Sequence
  MKO10063620_A_mmu-mir-6965
  gRNA
ggagcgagaccgagcacaga

SEQ ID NO: 63621 - RNA, 20 nt, Artificial Sequence
  MKO10063621_A_mmu-mir-6965
  gRNA
gaggaagaaccuucugugcu

SEQ ID NO: 63622 - RNA, 20 nt, Artificial Sequence
  MKO10063622_A_mmu-mir-3547
  gRNA
ucggccaccaucugagagag

SEQ ID NO: 63623 - RNA, 20 nt, Artificial Sequence
  MKO10063623_A_mmu-mir-3547
  gRNA
gccaccaucugagagagggg

SEQ ID NO: 63624 - RNA, 20 nt, Artificial Sequence
  MKO10063624_A_mmu-mir-3547
  gRNA
ugggaagagggguggggccc

SEQ ID NO: 63625 - RNA, 20 nt, Artificial Sequence
  MKO10063625_A_mmu-mir-3547
  gRNA
ccaaggugggaagaggggug

SEQ ID NO: 63626 - RNA, 20 nt, Artificial Sequence
  MKO10063626_A_mmu-mir-6966
  gRNA
guaagugucccucggggaug

SEQ ID NO: 63627 - RNA, 20 nt, Artificial Sequence
  MKO10063627_A_mmu-mir-6966
  gRNA
gugcugugugcuuccucugc

SEQ ID NO: 63628 - RNA, 20 nt, Artificial Sequence
  MKO10063628_A_mmu-mir-6966
  gRNA
ugugcuguccacauccccga

SEQ ID NO: 63629 - RNA, 20 nt, Artificial Sequence
  MKO10063629_A_mmu-mir-6966
  gRNA
augcucucauugaucugaga

SEQ ID NO: 63630 - RNA, 20 nt, Artificial Sequence
  MKO10063630_A_mmu-mir-3082
  gRNA
gcagaguugagugccaugug

SEQ ID NO: 63631 - RNA, 20 nt, Artificial Sequence
  MKO10063631_A_mmu-mir-3082
  gRNA
cacauggcacucaacucugc

SEQ ID NO: 63632 - RNA, 20 nt, Artificial Sequence
  MKO10063632_A_mmu-mir-3082
  gRNA
agacaggaguugcccacaca

SEQ ID NO: 63633 - RNA, 20 nt, Artificial Sequence
  MKO10063633_A_mmu-mir-3082
  gRNA
acagagugugugugucugug

SEQ ID NO: 63634 - RNA, 20 nt, Artificial Sequence
  MKO10063634_A_mmu-mir-6967
  gRNA
augcagagaguaagaaaggc

SEQ ID NO: 63635 - RNA, 20 nt, Artificial Sequence
  MKO10063635_A_mmu-mir-6967
  gRNA
agagaguaagaaaggcaggg

SEQ ID NO: 63636 - RNA, 20 nt, Artificial Sequence
  MKO10063636_A_mmu-mir-6967
  gRNA
gggauaaagaccagucacua

SEQ ID NO: 63637 - RNA, 20 nt, Artificial Sequence
  MKO10063637_A_mmu-mir-6967
  gRNA
ucuuuaucucuccccagaaa

SEQ ID NO: 63638 - RNA, 20 nt, Artificial Sequence
  MKO10063638_A_mmu-mir-6968
  gRNA
aaaugggugaacagggggcg

SEQ ID NO: 63639 - RNA, 20 nt, Artificial Sequence
  MKO10063639_A_mmu-mir-6968
  gRNA
gguuucaagaaggcugucug

SEQ ID NO: 63640 - RNA, 20 nt, Artificial Sequence
  MKO10063640_A_mmu-mir-6968
  gRNA
acaagcgcugucuccccucc

SEQ ID NO: 63641 - RNA, 20 nt, Artificial Sequence
  MKO10063641_A_mmu-mir-6968
  gRNA
agcgcugucuccccuccagg

SEQ ID NO: 63642 - RNA, 20 nt, Artificial Sequence
  MKO10063642_A_mmu-mir-3083
  gRNA
uauuggggcuuaguaaaggc

SEQ ID NO: 63643 - RNA, 20 nt, Artificial Sequence
  MKO10063643_A_mmu-mir-3083
  gRNA
aguaaaggcugggaauguuu

SEQ ID NO: 63644 - RNA, 20 nt, Artificial Sequence
  MKO10063644_A_mmu-mir-3083
  gRNA
auauauauaaaguaaaggcu

SEQ ID NO: 63645 - RNA, 20 nt, Artificial Sequence
  MKO10063645_A_mmu-mir-3083
  gRNA
uauauauauauauaaaguaa

SEQ ID NO: 63646 - RNA, 20 nt, Artificial Sequence
  MKO10063646_A_mmu-mir-7677
  gRNA
uggugagcagaaagcagccg

SEQ ID NO: 63647 - RNA, 20 nt, Artificial Sequence
  MKO10063647_A_mmu-mir-7677
  gRNA
cagaaagcagccgcggugug

SEQ ID NO: 63648 - RNA, 20 nt, Artificial Sequence
  MKO10063648_A_mmu-mir-7677
  gRNA
ccggcuguguccucucaccu

SEQ ID NO: 63649 - RNA, 20 nt, Artificial Sequence
  MKO10063649_A_mmu-mir-7677
  gRNA
agcgacggugccacacaccg

SEQ ID NO: 63650 - RNA, 20 nt, Artificial Sequence
  MKO10063650_A_mmu-mir-7214
  gRNA
uuuagugcgcucaagggguc

SEQ ID NO: 63651 - RNA, 20 nt, Artificial Sequence
  MKO10063651_A_mmu-mir-7214
  gRNA
cgcucaaggggucaggacug

SEQ ID NO: 63652 - RNA, 20 nt, Artificial Sequence
  MKO10063652_A_mmu-mir-7214
  gRNA
caaggggucaggacugaggg

SEQ ID NO: 63653 - RNA, 20 nt, Artificial Sequence
  MKO10063653_A_mmu-mir-7214
  gRNA
aggggucaggacugagggug

SEQ ID NO: 63654 - RNA, 20 nt, Artificial Sequence
  MKO10063654_A_mmu-mir-7216
  gRNA
ugagguuggagagcuggcag

SEQ ID NO: 63655 - RNA, 20 nt, Artificial Sequence
  MKO10063655_A_mmu-mir-7216
  gRNA
agccaccugcgaaagcaauu

SEQ ID NO: 63656 - RNA, 20 nt, Artificial Sequence
  MKO10063656_A_mmu-mir-7216
  gRNA
cgaaagcaauuuggcuucuu

SEQ ID NO: 63657 - RNA, 20 nt, Artificial Sequence
  MKO10063657_A_mmu-mir-7216
  gRNA
cuuuggaauuuggucuuuuc

SEQ ID NO: 63658 - RNA, 20 nt, Artificial Sequence
  MKO10063658_A_mmu-mir-7217
  gRNA
ucugcucucuucuugcuugu

SEQ ID NO: 63659 - RNA, 20 nt, Artificial Sequence
  MKO10063659_A_mmu-mir-7217
  gRNA
cuuguaucuugugagacaga

SEQ ID NO: 63660 - RNA, 20 nt, Artificial Sequence
  MKO10063660_A_mmu-mir-7217
  gRNA
gagacagaagggcacgccua

SEQ ID NO: 63661 - RNA, 20 nt, Artificial Sequence
  MKO10063661_A_mmu-mir-7217
  gRNA
uuguggguucucagggccgu

SEQ ID NO: 63662 - RNA, 20 nt, Artificial Sequence
  MKO10063662_A_mmu-mir-7218
  gRNA
gccugcaggguuuaguguag

SEQ ID NO: 63663 - RNA, 20 nt, Artificial Sequence
  MKO10063663_A_mmu-mir-7218
  gRNA
ucuaaccugucauucuagcc

SEQ ID NO: 63664 - RNA, 20 nt, Artificial Sequence
  MKO10063664_A_mmu-mir-7218
  gRNA
uaaccugucauucuagccug

SEQ ID NO: 63665 - RNA, 20 nt, Artificial Sequence
  MKO10063665_A_mmu-mir-7218
  gRNA
cccucuacacuaaacccugc

SEQ ID NO: 63666 - RNA, 20 nt, Artificial Sequence
  MKO10063666_A_mmu-mir-6969
  gRNA
ccauagagggucugcagaga

SEQ ID NO: 63667 - RNA, 20 nt, Artificial Sequence
  MKO10063667_A_mmu-mir-6969
  gRNA
augggaacaacagagucacu

SEQ ID NO: 63668 - RNA, 20 nt, Artificial Sequence
  MKO10063668_A_mmu-mir-6969
  gRNA
ucuuuugcucccuacucugc

SEQ ID NO: 63669 - RNA, 20 nt, Artificial Sequence
  MKO10063669_A_mmu-mir-6969
  gRNA
agccaguucccagcagagua

SEQ ID NO: 63670 - RNA, 20 nt, Artificial Sequence
  MKO10063670_A_mmu-mir-7667
  gRNA
ugcuucagggacugcagaga

SEQ ID NO: 63671 - RNA, 20 nt, Artificial Sequence
  MKO10063671_A_mmu-mir-7667
  gRNA
agggacugcagagauggcac

SEQ ID NO: 63672 - RNA, 20 nt, Artificial Sequence
  MKO10063672_A_mmu-mir-7667
  gRNA
uauaucaggggcuagagaga

SEQ ID NO: 63673 - RNA, 20 nt, Artificial Sequence
  MKO10063673_A_mmu-mir-7667
  gRNA
gcauauuaaaaguauaucag

SEQ ID NO: 63674 - RNA, 20 nt, Artificial Sequence
  MKO10063674_A_mmu-mir-6967
  gRNA
gagaguaagaaaggcaggga

SEQ ID NO: 63675 - RNA, 20 nt, Artificial Sequence
  MKO10063675_A_mmu-mir-6967
  gRNA
agaugaguuuccauagugac

SEQ ID NO: 63676 - RNA, 20 nt, Artificial Sequence
  MKO10063676_A_mmu-mir-6967
  gRNA
ucuuuaucucuccccagaaa

SEQ ID NO: 63677 - RNA, 20 nt, Artificial Sequence
  MKO10063677_A_mmu-mir-6967
  gRNA
gggauaaagaccagucacua

SEQ ID NO: 63678 - RNA, 20 nt, Artificial Sequence
  MKO10063678_A_mmu-mir-219a-1
  gRNA
cgcccggccucucccccucg

SEQ ID NO: 63679 - RNA, 20 nt, Artificial Sequence
  MKO10063679_A_mmu-mir-219a-1
  gRNA
ucccccucgagguuuggggg

SEQ ID NO: 63680 - RNA, 20 nt, Artificial Sequence
  MKO10063680_A_mmu-mir-219a-1
  gRNA
cccucgagguuugggggcgg

SEQ ID NO: 63681 - RNA, 20 nt, Artificial Sequence
  MKO10063681_A_mmu-mir-219a-1
  gRNA
gagguuugggggcggcggcu

SEQ ID NO: 63682 - RNA, 20 nt, Artificial Sequence
  MKO10063682_A_mmu-mir-219c
  gRNA
guccagacgcaacucucggc

SEQ ID NO: 63683 - RNA, 20 nt, Artificial Sequence
  MKO10063683_A_mmu-mir-219c
  gRNA
agagacucgagaauugcguu

SEQ ID NO: 63684 - RNA, 20 nt, Artificial Sequence
  MKO10063684_A_mmu-mir-219c
  gRNA
cuccggccgagaguugcguc

SEQ ID NO: 63685 - RNA, 20 nt, Artificial Sequence
  MKO10063685_A_mmu-mir-219c
  gRNA
aauucucgagucucuggcuc

SEQ ID NO: 63686 - RNA, 20 nt, Artificial Sequence
  MKO10063686_A_mmu-mir-6971
  gRNA
ugggggaggguguagaggcu

SEQ ID NO: 63687 - RNA, 20 nt, Artificial Sequence
  MKO10063687_A_mmu-mir-6971
  gRNA
augggccugagaagaagcag

SEQ ID NO: 63688 - RNA, 20 nt, Artificial Sequence
  MKO10063688_A_mmu-mir-6971
  gRNA
uucuucucaggcccaugagc

SEQ ID NO: 63689 - RNA, 20 nt, Artificial Sequence
  MKO10063689_A_mmu-mir-6971
  gRNA
cacagccucugcuucuucuc

SEQ ID NO: 63690 - RNA, 20 nt, Artificial Sequence
  MKO10063690_A_mmu-mir-6970
  gRNA
gcagcauaguaccugagcac

SEQ ID NO: 63691 - RNA, 20 nt, Artificial Sequence
  MKO10063691_A_mmu-mir-6970
  gRNA
cauaguaccugagcacaggg

SEQ ID NO: 63692 - RNA, 20 nt, Artificial Sequence
  MKO10063692_A_mmu-mir-6970
  gRNA
guaccugagcacaggguggg

SEQ ID NO: 63693 - RNA, 20 nt, Artificial Sequence
  MKO10063693_A_mmu-mir-6970
  gRNA
gguggcgugagaccucgcac

SEQ ID NO: 63694 - RNA, 20 nt, Artificial Sequence
  MKO10063694_A_mmu-mir-6972
  gRNA
cuauggagacagguacagua

SEQ ID NO: 63695 - RNA, 20 nt, Artificial Sequence
  MKO10063695_A_mmu-mir-6972
  gRNA
cuuacuguaccugucuccau

SEQ ID NO: 63696 - RNA, 20 nt, Artificial Sequence
  MKO10063696_A_mmu-mir-6972
  gRNA
cuggaggcacagggcagaac

SEQ ID NO: 63697 - RNA, 20 nt, Artificial Sequence
  MKO10063697_A_mmu-mir-6972
  gRNA
aagguugggcuggaggcaca

SEQ ID NO: 63698 - RNA, 20 nt, Artificial Sequence
  MKO10063698_A_mmu-mir-6973a
  gRNA
gggcugggcucuacgguggg

SEQ ID NO: 63699 - RNA, 20 nt, Artificial Sequence
  MKO10063699_A_mmu-mir-6973a
  gRNA
gcugggcucuacggugggag

SEQ ID NO: 63700 - RNA, 20 nt, Artificial Sequence
  MKO10063700_A_mmu-mir-6973a
  gRNA
gggcucuacggugggagggg

SEQ ID NO: 63701 - RNA, 20 nt, Artificial Sequence
  MKO10063701_A_mmu-mir-6973a
  gRNA
cauuagccaaaucugaccuc

SEQ ID NO: 63702 - RNA, 20 nt, Artificial Sequence
  MKO10063702_A_mmu-mir-6974
  gRNA
gucccugggacagaagagag

SEQ ID NO: 63703 - RNA, 20 nt, Artificial Sequence
  MKO10063703_A_mmu-mir-6974
  gRNA
ugggacagaagagaguggag

SEQ ID NO: 63704 - RNA, 20 nt, Artificial Sequence
  MKO10063704_A_mmu-mir-6974
  gRNA
aagagaguggagaggacucu

SEQ ID NO: 63705 - RNA, 20 nt, Artificial Sequence
  MKO10063705_A_mmu-mir-6974
  gRNA
caaucucuugcugccucacc

SEQ ID NO: 63706 - RNA, 20 nt, Artificial Sequence
  MKO10063706_A_mmu-mir-6975
  gRNA
gaugagucggcuggggagaa

SEQ ID NO: 63707 - RNA, 20 nt, Artificial Sequence
  MKO10063707_A_mmu-mir-6975
  gRNA
ugagucggcuggggagaaag

SEQ ID NO: 63708 - RNA, 20 nt, Artificial Sequence
  MKO10063708_A_mmu-mir-6975
  gRNA
cggcuggggagaaagggguu

SEQ ID NO: 63709 - RNA, 20 nt, Artificial Sequence
  MKO10063709_A_mmu-mir-6975
  gRNA
ggggagaaagggguuuggca

SEQ ID NO: 63710 - RNA, 20 nt, Artificial Sequence
  MKO10063710_A_mmu-mir-8094
  gRNA
gcaguacuacgugaaacuga

SEQ ID NO: 63711 - RNA, 20 nt, Artificial Sequence
  MKO10063711_A_mmu-mir-8094
  gRNA
ugaaggacaacgagaagaac

SEQ ID NO: 63712 - RNA, 20 nt, Artificial Sequence
  MKO10063712_A_mmu-mir-8094
  gRNA
ucaguaucgagggucugugu

SEQ ID NO: 63713 - RNA, 20 nt, Artificial Sequence
  MKO10063713_A_mmu-mir-8094
  gRNA
uacugaccugguugaacucg

SEQ ID NO: 63714 - RNA, 20 nt, Artificial Sequence
  MKO10063714_A_mmu-mir-1894
  gRNA
caccugccucuucccugcug

SEQ ID NO: 63715 - RNA, 20 nt, Artificial Sequence
  MKO10063715_A_mmu-mir-1894
  gRNA
ucccugcuguggagcaggca

SEQ ID NO: 63716 - RNA, 20 nt, Artificial Sequence
  MKO10063716_A_mmu-mir-1894
  gRNA
cuguggagcaggcaagggag

SEQ ID NO: 63717 - RNA, 20 nt, Artificial Sequence
  MKO10063717_A_mmu-mir-1894
  gRNA
gcaggcaagggagaggguga

SEQ ID NO: 63718 - RNA, 20 nt, Artificial Sequence
  MKO10063718_A_mmu-mir-877
  gRNA
uuccucauacaccugggagg

SEQ ID NO: 63719 - RNA, 20 nt, Artificial Sequence
  MKO10063719_A_mmu-mir-877
  gRNA
caccugggaggagggagaag

SEQ ID NO: 63720 - RNA, 20 nt, Artificial Sequence
  MKO10063720_A_mmu-mir-877
  gRNA
caaggguccacagacccgca

SEQ ID NO: 63721 - RNA, 20 nt, Artificial Sequence
  MKO10063721_A_mmu-mir-877
  gRNA
guccucuucucccuccuccc

SEQ ID NO: 63722 - RNA, 20 nt, Artificial Sequence
  MKO10063722_A_mmu-mir-693
  gRNA
ggguagaaauccugaguugu

SEQ ID NO: 63723 - RNA, 20 nt, Artificial Sequence
  MKO10063723_A_mmu-mir-693
  gRNA
gcuagggcagcuuucagaug

SEQ ID NO: 63724 - RNA, 20 nt, Artificial Sequence
  MKO10063724_A_mmu-mir-693
  gRNA
aaugagcaugcucccagcaa

SEQ ID NO: 63725 - RNA, 20 nt, Artificial Sequence
  MKO10063725_A_mmu-mir-693
  gRNA
aaugagcaugccuacaacuc

SEQ ID NO: 63726 - RNA, 20 nt, Artificial Sequence
  MKO10063726_A_mmu-mir-6976
  gRNA
agcucauaggccuggggagu

SEQ ID NO: 63727 - RNA, 20 nt, Artificial Sequence
  MKO10063727_A_mmu-mir-6976
  gRNA
cauaggccuggggaguuggg

SEQ ID NO: 63728 - RNA, 20 nt, Artificial Sequence
  MKO10063728_A_mmu-mir-6976
  gRNA
cuggggaguugggagggaga

SEQ ID NO: 63729 - RNA, 20 nt, Artificial Sequence
  MKO10063729_A_mmu-mir-6976
  gRNA
aauuuuccucucaacuuccc

SEQ ID NO: 63730 - RNA, 20 nt, Artificial Sequence
  MKO10063730_A_mmu-mir-7b
  gRNA
guacgugagccagugcuaug

SEQ ID NO: 63731 - RNA, 20 nt, Artificial Sequence
  MKO10063731_A_mmu-mir-7b
  gRNA
ucacagccagccucauagcg

SEQ ID NO: 63732 - RNA, 20 nt, Artificial Sequence
  MKO10063732_A_mmu-mir-7b
  gRNA
acaagucuuccacauagcac

SEQ ID NO: 63733 - RNA, 20 nt, Artificial Sequence
  MKO10063733_A_mmu-mir-7b
  gRNA
aggaguccacgcuaugaggc

SEQ ID NO: 63734 - RNA, 20 nt, Artificial Sequence
  MKO10063734_A_mmu-mir-6977
  gRNA
ccagacagggagaugagguc

SEQ ID NO: 63735 - RNA, 20 nt, Artificial Sequence
  MKO10063735_A_mmu-mir-6977
  gRNA
agggagaugaggucaggguc

SEQ ID NO: 63736 - RNA, 20 nt, Artificial Sequence
  MKO10063736_A_mmu-mir-6977
  gRNA
gucagggucaggcaacgccu

SEQ ID NO: 63737 - RNA, 20 nt, Artificial Sequence
  MKO10063737_A_mmu-mir-6977
  gRNA
gcuuggccccgaggcuucca

SEQ ID NO: 63738 - RNA, 20 nt, Artificial Sequence
  MKO10063738_A_mmu-mir-6978
  gRNA
gcagggugagagugaagccg

SEQ ID NO: 63739 - RNA, 20 nt, Artificial Sequence
  MKO10063739_A_mmu-mir-6978
  gRNA
ggugagagugaagccgugga

SEQ ID NO: 63740 - RNA, 20 nt, Artificial Sequence
  MKO10063740_A_mmu-mir-6978
  gRNA
ggaaggggugagagagaagc

SEQ ID NO: 63741 - RNA, 20 nt, Artificial Sequence
  MKO10063741_A_mmu-mir-6978
  gRNA
cuucacucucacccugcagg

SEQ ID NO: 63742 - RNA, 20 nt, Artificial Sequence
  MKO10063742_A_mmu-mir-6420
  gRNA
gaaaguugggggugggaugg

SEQ ID NO: 63743 - RNA, 20 nt, Artificial Sequence
  MKO10063743_A_mmu-mir-6420
  gRNA
gauggagggaaaguuggggg

SEQ ID NO: 63744 - RNA, 20 nt, Artificial Sequence
  MKO10063744_A_mmu-mir-6420
  gRNA
aaguauuaauaagagaugag

SEQ ID NO: 63745 - RNA, 20 nt, Artificial Sequence
  MKO10063745_A_mmu-mir-6420
  gRNA
gggugggauggagggaaagu

SEQ ID NO: 63746 - RNA, 20 nt, Artificial Sequence
  MKO10063746_A_mmu-mir-5709
  gRNA
uaaaagcuucuggcauugcu

SEQ ID NO: 63747 - RNA, 20 nt, Artificial Sequence
  MKO10063747_A_mmu-mir-5709
  gRNA
gucuuaagugugcguauugc

SEQ ID NO: 63748 - RNA, 20 nt, Artificial Sequence
  MKO10063748_A_mmu-mir-5709
  gRNA
gucuuaaggguguguauugc

SEQ ID NO: 63749 - RNA, 20 nt, Artificial Sequence
  MKO10063749_A_mmu-mir-5709
  gRNA
cucucagacuaaagucuuaa

SEQ ID NO: 63750 - RNA, 20 nt, Artificial Sequence
  MKO10063750_A_mmu-mir-1195
  gRNA
acuuuuuaccuucuugagac

SEQ ID NO: 63751 - RNA, 20 nt, Artificial Sequence
  MKO10063751_A_mmu-mir-1195
  gRNA
aggguuucucuguguguucc

SEQ ID NO: 63752 - RNA, 20 nt, Artificial Sequence
  MKO10063752_A_mmu-mir-1195
  gRNA
uagaacucauucuguugagc

SEQ ID NO: 63753 - RNA, 20 nt, Artificial Sequence
  MKO10063753_A_mmu-mir-1195
  gRNA
acucauucuguugagcaggc

SEQ ID NO: 63754 - RNA, 20 nt, Artificial Sequence
  MKO10063754_A_mmu-mir-1893
  gRNA
gaagaccggcagcggcuucg

SEQ ID NO: 63755 - RNA, 20 nt, Artificial Sequence
  MKO10063755_A_mmu-mir-1893
  gRNA
cagcagauaccucuccgcuc

SEQ ID NO: 63756 - RNA, 20 nt, Artificial Sequence
  MKO10063756_A_mmu-mir-1893
  gRNA
gcagauaccucuccgcucug

SEQ ID NO: 63757 - RNA, 20 nt, Artificial Sequence
  MKO10063757_A_mmu-mir-1893
  gRNA
ggacgccucgaagccgcugc

SEQ ID NO: 63758 - RNA, 20 nt, Artificial Sequence
  MKO10063758_A_mmu-mir-133a-1
  gRNA
gcauagcuacagcugguuga

SEQ ID NO: 63759 - RNA, 20 nt, Artificial Sequence
  MKO10063759_A_mmu-mir-133a-1
  gRNA
aauccauugaagaggcgauu

SEQ ID NO: 63760 - RNA, 20 nt, Artificial Sequence
  MKO10063760_A_mmu-mir-133a-1
  gRNA
aaucgccucuucaauggauu

SEQ ID NO: 63761 - RNA, 20 nt, Artificial Sequence
  MKO10063761_A_mmu-mir-133a-1
  gRNA
cggcaaugcuuugcuaaagc

SEQ ID NO: 63762 - RNA, 20 nt, Artificial Sequence
  MKO10063762_A_mmu-mir-1b
  gRNA
aagaaguaugugcucugagu

SEQ ID NO: 63763 - RNA, 20 nt, Artificial Sequence
  MKO10063763_A_mmu-mir-1b
  gRNA
uguaaagaaguauguauuuu

SEQ ID NO: 63764 - RNA, 20 nt, Artificial Sequence
  MKO10063764_A_mmu-mir-1b
  gRNA
aguuuccuuuagcuucuucu

SEQ ID NO: 63765 - RNA, 20 nt, Artificial Sequence
  MKO10063765_A_mmu-mir-1b
  gRNA
uuccuuuagcuucuucuugg

SEQ ID NO: 63766 - RNA, 20 nt, Artificial Sequence
  MKO10063766_A_mmu-mir-1a-2
  gRNA
cauagcacugaauguucaua

SEQ ID NO: 63767 - RNA, 20 nt, Artificial Sequence
  MKO10063767_A_mmu-mir-1a-2
  gRNA
aagaaguaugugcucugagu

SEQ ID NO: 63768 - RNA, 20 nt, Artificial Sequence
  MKO10063768_A_mmu-mir-1a-2
  gRNA
aagaaguauguauuuugggu

SEQ ID NO: 63769 - RNA, 20 nt, Artificial Sequence
  MKO10063769_A_mmu-mir-1a-2
  gRNA
uguaaagaaguauguauuuu

SEQ ID NO: 63770 - RNA, 20 nt, Artificial Sequence
  MKO10063770_A_mmu-mir-1901
  gRNA
ucggccagcuuuuugggcuc

SEQ ID NO: 63771 - RNA, 20 nt, Artificial Sequence
  MKO10063771_A_mmu-mir-1901
  gRNA
gggacccccgggaguacgag

SEQ ID NO: 63772 - RNA, 20 nt, Artificial Sequence
  MKO10063772_A_mmu-mir-1901
  gRNA
ccgggaguacgagcggcagu

SEQ ID NO: 63773 - RNA, 20 nt, Artificial Sequence
  MKO10063773_A_mmu-mir-1901
  gRNA
gggaguacgagcggcagucg

SEQ ID NO: 63774 - RNA, 20 nt, Artificial Sequence
  MKO10063774_A_mmu-mir-1948
  gRNA
augaguauucugccuaaaug

SEQ ID NO: 63775 - RNA, 20 nt, Artificial Sequence
  MKO10063775_A_mmu-mir-1948
  gRNA
ugugguguacggauacauuu

SEQ ID NO: 63776 - RNA, 20 nt, Artificial Sequence
  MKO10063776_A_mmu-mir-1948
  gRNA
ggcagagcacucguacagua

SEQ ID NO: 63777 - RNA, 20 nt, Artificial Sequence
  MKO10063777_A_mmu-mir-1948
  gRNA
cguacaguaaggugagaauc

SEQ ID NO: 63778 - RNA, 20 nt, Artificial Sequence
  MKO10063778_A_mmu-mir-6360
  gRNA
cagaagauggacagcuucug

SEQ ID NO: 63779 - RNA, 20 nt, Artificial Sequence
  MKO10063779_A_mmu-mir-6360
  gRNA
augaccacccucccagaugc

SEQ ID NO: 63780 - RNA, 20 nt, Artificial Sequence
  MKO10063780_A_mmu-mir-6360
  gRNA
ggccugcaucugggggucau

SEQ ID NO: 63781 - RNA, 20 nt, Artificial Sequence
  MKO10063781_A_mmu-mir-6360
  gRNA
agugugcaugugugcagggu

SEQ ID NO: 63782 - RNA, 20 nt, Artificial Sequence
  MKO10063782_A_mmu-mir-187
  gRNA
cggcugcaacacaagacacg

SEQ ID NO: 63783 - RNA, 20 nt, Artificial Sequence
  MKO10063783_A_mmu-mir-187
  gRNA
ggguccuguguuguagccug

SEQ ID NO: 63784 - RNA, 20 nt, Artificial Sequence
  MKO10063784_A_mmu-mir-187
  gRNA
cucgugucuuguguugcagc

SEQ ID NO: 63785 - RNA, 20 nt, Artificial Sequence
  MKO10063785_A_mmu-mir-187
  gRNA
caggcuacaacacaggaccc

SEQ ID NO: 63786 - RNA, 20 nt, Artificial Sequence
  MKO10063786_A_mmu-mir-6361
  gRNA
ggaaguacagcccuugucag

SEQ ID NO: 63787 - RNA, 20 nt, Artificial Sequence
  MKO10063787_A_mmu-mir-6361
  gRNA
ccacuuccuggagagcugcc

SEQ ID NO: 63788 - RNA, 20 nt, Artificial Sequence
  MKO10063788_A_mmu-mir-6361
  gRNA
gugaggagcuccucugacaa

SEQ ID NO: 63789 - RNA, 20 nt, Artificial Sequence
  MKO10063789_A_mmu-mir-6361
  gRNA
acauggggcugaauacuguu

SEQ ID NO: 63790 - RNA, 20 nt, Artificial Sequence
  MKO10063790_A_mmu-mir-1949
  gRNA
ccaauagcugguuggcauuc

SEQ ID NO: 63791 - RNA, 20 nt, Artificial Sequence
  MKO10063791_A_mmu-mir-1949
  gRNA
gcugguuggcauucugggcc

SEQ ID NO: 63792 - RNA, 20 nt, Artificial Sequence
  MKO10063792_A_mmu-mir-1949
  gRNA
caacagagguggcaugaacc

SEQ ID NO: 63793 - RNA, 20 nt, Artificial Sequence
  MKO10063793_A_mmu-mir-1949
  gRNA
ccugguauaguuaacaacag

SEQ ID NO: 63794 - RNA, 20 nt, Artificial Sequence
  MKO10063794_A_mmu-mir-6979
  gRNA
uaagcagggcggcugggggg

SEQ ID NO: 63795 - RNA, 20 nt, Artificial Sequence
  MKO10063795_A_mmu-mir-6979
  gRNA
agugcgcgcuugugucuguc

SEQ ID NO: 63796 - RNA, 20 nt, Artificial Sequence
  MKO10063796_A_mmu-mir-6981
  gRNA
cugaggagacaguaggcugu

SEQ ID NO: 63797 - RNA, 20 nt, Artificial Sequence
  MKO10063797_A_mmu-mir-6981
  gRNA
agacaguaggcuguuggcac

SEQ ID NO: 63798 - RNA, 20 nt, Artificial Sequence
  MKO10063798_A_mmu-mir-6981
  gRNA
aguaggcuguuggcacuggu

SEQ ID NO: 63799 - RNA, 20 nt, Artificial Sequence
  MKO10063799_A_mmu-mir-6981
  gRNA
cuggucggccuggguggcac

SEQ ID NO: 63800 - RNA, 20 nt, Artificial Sequence
  MKO10063800_A_mmu-mir-6980
  gRNA
uaggucacgcugagcugggg

SEQ ID NO: 63801 - RNA, 20 nt, Artificial Sequence
  MKO10063801_A_mmu-mir-6980
  gRNA
ucacgcugagcuggggugga

SEQ ID NO: 63802 - RNA, 20 nt, Artificial Sequence
  MKO10063802_A_mmu-mir-6980
  gRNA
uggaaggcaagucagcuggg

SEQ ID NO: 63803 - RNA, 20 nt, Artificial Sequence
  MKO10063803_A_mmu-mir-6980
  gRNA
uuaggguggggggggaggcu

SEQ ID NO: 63804 - RNA, 20 nt, Artificial Sequence
  MKO10063804_A_mmu-mir-1258
  gRNA
ugcuauguggagcugcaguu

SEQ ID NO: 63805 - RNA, 20 nt, Artificial Sequence
  MKO10063805_A_mmu-mir-1258
  gRNA
gcagcuccacauagcaguua

SEQ ID NO: 63806 - RNA, 20 nt, Artificial Sequence
  MKO10063806_A_mmu-mir-1258
  gRNA
cuaauucccuaacugcuaug

SEQ ID NO: 63807 - RNA, 20 nt, Artificial Sequence
  MKO10063807_A_mmu-mir-1258
  gRNA
ggaauuagcucagcaguaua

SEQ ID NO: 63808 - RNA, 20 nt, Artificial Sequence
  MKO10063808_A_mmu-mir-6355
  gRNA
auggaguugugauaucacau

SEQ ID NO: 63809 - RNA, 20 nt, Artificial Sequence
  MKO10063809_A_mmu-mir-6355
  gRNA
agcacuguguuggcacaaua

SEQ ID NO: 63810 - RNA, 20 nt, Artificial Sequence
  MKO10063810_A_mmu-mir-6355
  gRNA
aaaacaguacagcacugugu

SEQ ID NO: 63811 - RNA, 20 nt, Artificial Sequence
  MKO10063811_A_mmu-mir-6355
  gRNA
aucauaaucgagcacuaugc

SEQ ID NO: 63812 - RNA, 20 nt, Artificial Sequence
  MKO10063812_A_mmu-mir-5107
  gRNA
aguuccaagauguugggcag

SEQ ID NO: 63813 - RNA, 20 nt, Artificial Sequence
  MKO10063813_A_mmu-mir-5107
  gRNA
uccaagauguugggcagagg

SEQ ID NO: 63814 - RNA, 20 nt, Artificial Sequence
  MKO10063814_A_mmu-mir-5107
  gRNA
agauguugggcagaggaggc

SEQ ID NO: 63815 - RNA, 20 nt, Artificial Sequence
  MKO10063815_A_mmu-mir-5107
  gRNA
aggaggcagggacaacaaac

SEQ ID NO: 63816 - RNA, 20 nt, Artificial Sequence
  MKO10063816_A_mmu-mir-7220
  gRNA
ggcgacaagaaggugagccc

SEQ ID NO: 63817 - RNA, 20 nt, Artificial Sequence
  MKO10063817_A_mmu-mir-7220
  gRNA
ggcucaccuucuugucgcca

SEQ ID NO: 63818 - RNA, 20 nt, Artificial Sequence
  MKO10063818_A_mmu-mir-7220
  gRNA
cggacugagaccuuguuccu

SEQ ID NO: 63819 - RNA, 20 nt, Artificial Sequence
  MKO10063819_A_mmu-mir-7220
  gRNA
cugugcccuaggugagcucu

SEQ ID NO: 63820 - RNA, 20 nt, Artificial Sequence
  MKO10063820_A_mmu-mir-6982
  gRNA
cccugccagucaggggcugg

SEQ ID NO: 63821 - RNA, 20 nt, Artificial Sequence
  MKO10063821_A_mmu-mir-6982
  gRNA
caggggcuggaggaucgcag

SEQ ID NO: 63822 - RNA, 20 nt, Artificial Sequence
  MKO10063822_A_mmu-mir-6982
  gRNA
gggcuggaggaucgcagggg

SEQ ID NO: 63823 - RNA, 20 nt, Artificial Sequence
  MKO10063823_A_mmu-mir-6982
  gRNA
aggaucgcagggguggccug

SEQ ID NO: 63824 - RNA, 20 nt, Artificial Sequence
  MKO10063824_A_mmu-mir-6983
  gRNA
uugcguacccaugacuugga

SEQ ID NO: 63825 - RNA, 20 nt, Artificial Sequence
  MKO10063825_A_mmu-mir-6983
  gRNA
cuuggaagggcauacugauu

SEQ ID NO: 63826 - RNA, 20 nt, Artificial Sequence
  MKO10063826_A_mmu-mir-6983
  gRNA
gaaucaaagucuguuguucc

SEQ ID NO: 63827 - RNA, 20 nt, Artificial Sequence
  MKO10063827_A_mmu-mir-6983
  gRNA
ggaacaacagacuuugauuc

SEQ ID NO: 63828 - RNA, 20 nt, Artificial Sequence
  MKO10063828_A_mmu-mir-378a
  gRNA
ccaaguccagugcuauuucg

SEQ ID NO: 63829 - RNA, 20 nt, Artificial Sequence
  MKO10063829_A_mmu-mir-378a
  gRNA
gcuauuucgagguaacacac

SEQ ID NO: 63830 - RNA, 20 nt, Artificial Sequence
  MKO10063830_A_mmu-mir-378a
  gRNA
ucgagguaacacacaggacc

SEQ ID NO: 63831 - RNA, 20 nt, Artificial Sequence
  MKO10063831_A_mmu-mir-378a
  gRNA
aacacacaggaccuggaguc

SEQ ID NO: 63832 - RNA, 20 nt, Artificial Sequence
  MKO10063832_A_mmu-mir-145a
  gRNA
accucaagaacaguauuucc

SEQ ID NO: 63833 - RNA, 20 nt, Artificial Sequence
  MKO10063833_A_mmu-mir-145a
  gRNA
cuuagcauccaagggauucc

SEQ ID NO: 63834 - RNA, 20 nt, Artificial Sequence
  MKO10063834_A_mmu-mir-145a
  gRNA
gaugcuaagauggggauucc

SEQ ID NO: 63835 - RNA, 20 nt, Artificial Sequence
  MKO10063835_A_mmu-mir-145a
  gRNA
caguuuucccaggaaucccu

SEQ ID NO: 63836 - RNA, 20 nt, Artificial Sequence
  MKO10063836_A_mmu-mir-143
  gRNA
ugcagcacugcaccucaggc

SEQ ID NO: 63837 - RNA, 20 nt, Artificial Sequence
  MKO10063837_A_mmu-mir-143
  gRNA
gagaugaagcacuguagcuc

SEQ ID NO: 63838 - RNA, 20 nt, Artificial Sequence
  MKO10063838_A_mmu-mir-143
  gRNA
gaggugcagugcugcaucuc

SEQ ID NO: 63839 - RNA, 20 nt, Artificial Sequence
  MKO10063839_A_mmu-mir-143
  gRNA
agcgccugucucccagccug

SEQ ID NO: 63840 - RNA, 20 nt, Artificial Sequence
  MKO10063840_A_mmu-mir-122
  gRNA
agagcuguggagugugacaa

SEQ ID NO: 63841 - RNA, 20 nt, Artificial Sequence
  MKO10063841_A_mmu-mir-122
  gRNA
gauaauggcguuugaugguu

SEQ ID NO: 63842 - RNA, 20 nt, Artificial Sequence
  MKO10063842_A_mmu-mir-122
  gRNA
agugugauaauggcguuuga

SEQ ID NO: 63843 - RNA, 20 nt, Artificial Sequence
  MKO10063843_A_mmu-mir-122
  gRNA
cacacuaaauagcuacugcu

SEQ ID NO: 63844 - RNA, 20 nt, Artificial Sequence
  MKO10063844_A_mmu-mir-694
  gRNA
uucaggcaacauuuucagcc

SEQ ID NO: 63845 - RNA, 20 nt, Artificial Sequence
  MKO10063845_A_mmu-mir-694
  gRNA
guugaaagcgaugccugagc

SEQ ID NO: 63846 - RNA, 20 nt, Artificial Sequence
  MKO10063846_A_mmu-mir-694
  gRNA
ugggagucaaaggccagcuc

SEQ ID NO: 63847 - RNA, 20 nt, Artificial Sequence
  MKO10063847_A_mmu-mir-694
  gRNA
cagaaggcagagacugcuuc

SEQ ID NO: 63848 - RNA, 20 nt, Artificial Sequence
  MKO10063848_A_mmu-mir-7219
  gRNA
ucaacccugagcucuaacac

SEQ ID NO: 63849 - RNA, 20 nt, Artificial Sequence
  MKO10063849_A_mmu-mir-7219
  gRNA
uuucuaguguguuagaaacc

SEQ ID NO: 63850 - RNA, 20 nt, Artificial Sequence
  MKO10063850_A_mmu-mir-7219
  gRNA
uaacacaggacauucagaac

SEQ ID NO: 63851 - RNA, 20 nt, Artificial Sequence
  MKO10063851_A_mmu-mir-7219
  gRNA
ugagaucaugugaucuaucc

SEQ ID NO: 63852 - RNA, 20 nt, Artificial Sequence
  MKO10063852_A_mmu-mir-6356
  gRNA
ggcagccugugugugacagc

SEQ ID NO: 63853 - RNA, 20 nt, Artificial Sequence
  MKO10063853_A_mmu-mir-6356
  gRNA
aagucauuguuaggacucug

SEQ ID NO: 63854 - RNA, 20 nt, Artificial Sequence
  MKO10063854_A_mmu-mir-6356
  gRNA
auaagucauuguuaggacuc

SEQ ID NO: 63855 - RNA, 20 nt, Artificial Sequence
  MKO10063855_A_mmu-mir-6356
  gRNA
agugcccugcugucacacac

SEQ ID NO: 63856 - RNA, 20 nt, Artificial Sequence
  MKO10063856_A_mmu-mir-145b
  gRNA
accaauuucucaagccagac

SEQ ID NO: 63857 - RNA, 20 nt, Artificial Sequence
  MKO10063857_A_mmu-mir-145b
  gRNA
caagccagacuggagucucc

SEQ ID NO: 63858 - RNA, 20 nt, Artificial Sequence
  MKO10063858_A_mmu-mir-145b
  gRNA
cuggagucuccugggaaaac

SEQ ID NO: 63859 - RNA, 20 nt, Artificial Sequence
  MKO10063859_A_mmu-mir-145b
  gRNA
aaaacuggacugacuucaac

SEQ ID NO: 63860 - RNA, 20 nt, Artificial Sequence
  MKO10063860_A_mmu-mir-6357
  gRNA
cagggguugagagggacguu

SEQ ID NO: 63861 - RNA, 20 nt, Artificial Sequence
  MKO10063861_A_mmu-mir-6357
  gRNA
gacguuagguagcaguccau

SEQ ID NO: 63862 - RNA, 20 nt, Artificial Sequence
  MKO10063862_A_mmu-mir-6357
  gRNA
uagcacugcucagggcuuuc

SEQ ID NO: 63863 - RNA, 20 nt, Artificial Sequence
  MKO10063863_A_mmu-mir-6357
  gRNA
cccugagcagugcuaagaaa

SEQ ID NO: 63864 - RNA, 20 nt, Artificial Sequence
  MKO10063864_A_mmu-mir-6358
  gRNA
cacccauaaucccagugugg

SEQ ID NO: 63865 - RNA, 20 nt, Artificial Sequence
  MKO10063865_A_mmu-mir-6358
  gRNA
gguggcaugucccuauguga

SEQ ID NO: 63866 - RNA, 20 nt, Artificial Sequence
  MKO10063866_A_mmu-mir-6358
  gRNA
gguuuguauauccuuggacc

SEQ ID NO: 63867 - RNA, 20 nt, Artificial Sequence
  MKO10063867_A_mmu-mir-6358
  gRNA
uagcuguauacugccacacu

SEQ ID NO: 63868 - RNA, 20 nt, Artificial Sequence
  MKO10063868_A_mmu-mir-5127
  gRNA
ggacaaagaucccucucucc

SEQ ID NO: 63869 - RNA, 20 nt, Artificial Sequence
  MKO10063869_A_mmu-mir-5127
  gRNA
cucucuccugggaaaagggu

SEQ ID NO: 63870 - RNA, 20 nt, Artificial Sequence
  MKO10063870_A_mmu-mir-5127
  gRNA
aacccuuuucccaggagaga

SEQ ID NO: 63871 - RNA, 20 nt, Artificial Sequence
  MKO10063871_A_mmu-mir-5127
  gRNA
uuucucuacuuggugaaaug

SEQ ID NO: 63872 - RNA, 20 nt, Artificial Sequence
  MKO10063872_A_mmu-mir-5112
  gRNA
aauguagcuggggaugaagc

SEQ ID NO: 63873 - RNA, 20 nt, Artificial Sequence
  MKO10063873_A_mmu-mir-5112
  gRNA
uggcacuggaaauguagcug

SEQ ID NO: 63874 - RNA, 20 nt, Artificial Sequence
  MKO10063874_A_mmu-mir-5112
  gRNA
gguggcacuggaaauguagc

SEQ ID NO: 63875 - RNA, 20 nt, Artificial Sequence
  MKO10063875_A_mmu-mir-5112
  gRNA
agggcugggguguagcucag

SEQ ID NO: 63876 - RNA, 20 nt, Artificial Sequence
  MKO10063876_A_mmu-mir-6359
  gRNA
ucuccggcggcgacugauug

SEQ ID NO: 63877 - RNA, 20 nt, Artificial Sequence
  MKO10063877_A_mmu-mir-6359
  gRNA
uuguggcggagagaugguuc

SEQ ID NO: 63878 - RNA, 20 nt, Artificial Sequence
  MKO10063878_A_mmu-mir-6359
  gRNA
gcggggcucaucaggaagcu

SEQ ID NO: 63879 - RNA, 20 nt, Artificial Sequence
  MKO10063879_A_mmu-mir-6359
  gRNA
gguaacugucgauguugccc

SEQ ID NO: 63880 - RNA, 20 nt, Artificial Sequence
  MKO10063880_A_mmu-mir-6984
  gRNA
aaacugaaaggcaaugaagg

SEQ ID NO: 63881 - RNA, 20 nt, Artificial Sequence
  MKO10063881_A_mmu-mir-6984
  gRNA
aagcuccuuucuagaaagac

SEQ ID NO: 63882 - RNA, 20 nt, Artificial Sequence
  MKO10063882_A_mmu-mir-6984
  gRNA
aaguugugcgugaaacugaa

SEQ ID NO: 63883 - RNA, 20 nt, Artificial Sequence
  MKO10063883_A_mmu-mir-6984
  gRNA
gugaaacugaaaggcaauga

SEQ ID NO: 63884 - RNA, 20 nt, Artificial Sequence
  MKO10063884_A_mmu-mir-6985
  gRNA
uggcucugccggcugugagg

SEQ ID NO: 63885 - RNA, 20 nt, Artificial Sequence
  MKO10063885_A_mmu-mir-6985
  gRNA
cucugccggcugugaggagg

SEQ ID NO: 63886 - RNA, 20 nt, Artificial Sequence
  MKO10063886_A_mmu-mir-6985
  gRNA
guguuguguauacugagggg

SEQ ID NO: 63887 - RNA, 20 nt, Artificial Sequence
  MKO10063887_A_mmu-mir-6985
  gRNA
gcgguguuguguauacugag

SEQ ID NO: 63888 - RNA, 20 nt, Artificial Sequence
  MKO10063888_A_mmu-mir-6986
  gRNA
gugaaaaugggcugggagga

SEQ ID NO: 63889 - RNA, 20 nt, Artificial Sequence
  MKO10063889_A_mmu-mir-6986
  gRNA
ggagcuagguagaaagccag

SEQ ID NO: 63890 - RNA, 20 nt, Artificial Sequence
  MKO10063890_A_mmu-mir-6986
  gRNA
ggcuuugggugaggggagcu

SEQ ID NO: 63891 - RNA, 20 nt, Artificial Sequence
  MKO10063891_A_mmu-mir-6986
  gRNA
gugaaaaccacauaugccuc

SEQ ID NO: 63892 - RNA, 20 nt, Artificial Sequence
  MKO10063892_A_mmu-mir-6987
  gRNA
cagcuggaagcagggagaaa

SEQ ID NO: 63893 - RNA, 20 nt, Artificial Sequence
  MKO10063893_A_mmu-mir-6987
  gRNA
aacagugggacagggugaca

SEQ ID NO: 63894 - RNA, 20 nt, Artificial Sequence
  MKO10063894_A_mmu-mir-6987
  gRNA
aauggaggaacagugggaca

SEQ ID NO: 63895 - RNA, 20 nt, Artificial Sequence
  MKO10063895_A_mmu-mir-6987
  gRNA
ggcugguggcagcuggaagc

SEQ ID NO: 63896 - RNA, 20 nt, Artificial Sequence
  MKO10063896_A_mmu-mir-6988
  gRNA
acucucugggauaucugggg

SEQ ID NO: 63897 - RNA, 20 nt, Artificial Sequence
  MKO10063897_A_mmu-mir-6988
  gRNA
gggguggagagcugaggccc

SEQ ID NO: 63898 - RNA, 20 nt, Artificial Sequence
  MKO10063898_A_mmu-mir-6988
  gRNA
gaggucaggcugagcuaccu

SEQ ID NO: 63899 - RNA, 20 nt, Artificial Sequence
  MKO10063899_A_mmu-mir-6988
  gRNA
uggcaggagauacagagguc

SEQ ID NO: 63900 - RNA, 20 nt, Artificial Sequence
  MKO10063900_A_mmu-mir-194-2
  gRNA
ucuguaacagcaacuccaug

SEQ ID NO: 63901 - RNA, 20 nt, Artificial Sequence
  MKO10063901_A_mmu-mir-194-2
  gRNA
cuccauguggaagugcccac

SEQ ID NO: 63902 - RNA, 20 nt, Artificial Sequence
  MKO10063902_A_mmu-mir-194-2
  gRNA
agugcccacugguuccagug

SEQ ID NO: 63903 - RNA, 20 nt, Artificial Sequence
  MKO10063903_A_mmu-mir-194-2
  gRNA
ccaguggggcugcuguuauc

SEQ ID NO: 63904 - RNA, 20 nt, Artificial Sequence
  MKO10063904_A_mmu-mir-192
  gRNA
gcugccaagauggcgugcac

SEQ ID NO: 63905 - RNA, 20 nt, Artificial Sequence
  MKO10063905_A_mmu-mir-192
  gRNA
cugccaauuccauaggucac

SEQ ID NO: 63906 - RNA, 20 nt, Artificial Sequence
  MKO10063906_A_mmu-mir-192
  gRNA
aguacuggcugucaauucau

SEQ ID NO: 63907 - RNA, 20 nt, Artificial Sequence
  MKO10063907_A_mmu-mir-192
  gRNA
ccuauggaauuggcagccag

SEQ ID NO: 63908 - RNA, 20 nt, Artificial Sequence
  MKO10063908_A_mmu-mir-6989
  gRNA
gcuguuggggacagaggcac

SEQ ID NO: 63909 - RNA, 20 nt, Artificial Sequence
  MKO10063909_A_mmu-mir-6989
  gRNA
gggacagaggcacaggaugc

SEQ ID NO: 63910 - RNA, 20 nt, Artificial Sequence
  MKO10063910_A_mmu-mir-6989
  gRNA
gaccaccuguccacugucuc

SEQ ID NO: 63911 - RNA, 20 nt, Artificial Sequence
  MKO10063911_A_mmu-mir-6989
  gRNA
ugggaccagagacaguggac

SEQ ID NO: 63912 - RNA, 20 nt, Artificial Sequence
  MKO10063912_A_mmu-mir-5046
  gRNA
ugguggcagcaccaggcucc

SEQ ID NO: 63913 - RNA, 20 nt, Artificial Sequence
  MKO10063913_A_mmu-mir-5046
  gRNA
gcagcaccaggcucccggau

SEQ ID NO: 63914 - RNA, 20 nt, Artificial Sequence
  MKO10063914_A_mmu-mir-5046
  gRNA
ucccggaucggagcuccuaa

SEQ ID NO: 63915 - RNA, 20 nt, Artificial Sequence
  MKO10063915_A_mmu-mir-5046
  gRNA
agguaagggggucacagugg

SEQ ID NO: 63916 - RNA, 20 nt, Artificial Sequence
  MKO10063916_A_mmu-mir-6990
  gRNA
cgaugcucccugccaggaag

SEQ ID NO: 63917 - RNA, 20 nt, Artificial Sequence
  MKO10063917_A_mmu-mir-6990
  gRNA
gcucccugccaggaagaggc

SEQ ID NO: 63918 - RNA, 20 nt, Artificial Sequence
  MKO10063918_A_mmu-mir-6990
  gRNA
aggaagaggcagggcuccag

SEQ ID NO: 63919 - RNA, 20 nt, Artificial Sequence
  MKO10063919_A_mmu-mir-6990
  gRNA
cggccucccagagcccggag

SEQ ID NO: 63920 - RNA, 20 nt, Artificial Sequence
  MKO10063920_A_mmu-mir-6991
  gRNA
ccugaagagcaguggagaac

SEQ ID NO: 63921 - RNA, 20 nt, Artificial Sequence
  MKO10063921_A_mmu-mir-6991
  gRNA
gagcaguggagaacagggac

SEQ ID NO: 63922 - RNA, 20 nt, Artificial Sequence
  MKO10063922_A_mmu-mir-6991
  gRNA
cagggacugggccugauuga

SEQ ID NO: 63923 - RNA, 20 nt, Artificial Sequence
  MKO10063923_A_mmu-mir-6991
  gRNA
gauugauggcacucgcucca

SEQ ID NO: 63924 - RNA, 20 nt, Artificial Sequence
  MKO10063924_A_mmu-mir-6992
  gRNA
uuaaguauaucugccuguga

SEQ ID NO: 63925 - RNA, 20 nt, Artificial Sequence
  MKO10063925_A_mmu-mir-6992
  gRNA
ccugugaugguuuggcugag

SEQ ID NO: 63926 - RNA, 20 nt, Artificial Sequence
  MKO10063926_A_mmu-mir-6992
  gRNA
cugaguggaauugguugugu

SEQ ID NO: 63927 - RNA, 20 nt, Artificial Sequence
  MKO10063927_A_mmu-mir-6992
  gRNA
auugguuguguuggagguua

SEQ ID NO: 63928 - RNA, 20 nt, Artificial Sequence
  MKO10063928_A_mmu-mir-5136
  gRNA
acucacgugaaaaccacccu

SEQ ID NO: 63929 - RNA, 20 nt, Artificial Sequence
  MKO10063929_A_mmu-mir-5136
  gRNA
cgugaaaaccacccuuggaa

SEQ ID NO: 63930 - RNA, 20 nt, Artificial Sequence
  MKO10063930_A_mmu-mir-5136
  gRNA
cgagggaacuacugggaacu

SEQ ID NO: 63931 - RNA, 20 nt, Artificial Sequence
  MKO10063931_A_mmu-mir-5136
  gRNA
gauuuugucuuuauaugcga

SEQ ID NO: 63932 - RNA, 20 nt, Artificial Sequence
  MKO10063932_A_mmu-mir-6993
  gRNA
agggaaaguugguggcucag

SEQ ID NO: 63933 - RNA, 20 nt, Artificial Sequence
  MKO10063933_A_mmu-mir-6993
  gRNA
ugguggcucagugggagaaa

SEQ ID NO: 63934 - RNA, 20 nt, Artificial Sequence
  MKO10063934_A_mmu-mir-6993
  gRNA
gggagaaacgggugucuguc

SEQ ID NO: 63935 - RNA, 20 nt, Artificial Sequence
  MKO10063935_A_mmu-mir-6993
  gRNA
gcguuuguuuccucacagcu

SEQ ID NO: 63936 - RNA, 20 nt, Artificial Sequence
  MKO10063936_A_mmu-mir-6994
  gRNA
auaaagagacccugucacaa

SEQ ID NO: 63937 - RNA, 20 nt, Artificial Sequence
  MKO10063937_A_mmu-mir-6994
  gRNA
gucacaaaggugggugaagc

SEQ ID NO: 63938 - RNA, 20 nt, Artificial Sequence
  MKO10063938_A_mmu-mir-6994
  gRNA
cuucacccaccuuugugaca

SEQ ID NO: 63939 - RNA, 20 nt, Artificial Sequence
  MKO10063939_A_mmu-mir-6994
  gRNA
gaagaacuagcaaucgucac

SEQ ID NO: 63940 - RNA, 20 nt, Artificial Sequence
  MKO10063940_A_mmu-mir-496b
  gRNA
uaauacgagaugaaaggaau

SEQ ID NO: 63941 - RNA, 20 nt, Artificial Sequence
  MKO10063941_A_mmu-mir-496b
  gRNA
uucucaacgagguuaguuaa

SEQ ID NO: 63942 - RNA, 20 nt, Artificial Sequence
  MKO10063942_A_mmu-mir-496b
  gRNA
guacaaaaaaauucucaacg

SEQ ID NO: 63943 - RNA, 20 nt, Artificial Sequence
  MKO10063943_A_mmu-mir-496b
  gRNA
uaugcuuaauacgagaugaa

SEQ ID NO: 63944 - RNA, 20 nt, Artificial Sequence
  MKO10063944_A_mmu-mir-204
  gRNA
ugagaauauaugaaggaggc

SEQ ID NO: 63945 - RNA, 20 nt, Artificial Sequence
  MKO10063945_A_mmu-mir-204
  gRNA
gaaggaggcugggaaggcaa

SEQ ID NO: 63946 - RNA, 20 nt, Artificial Sequence
  MKO10063946_A_mmu-mir-204
  gRNA
cucaggcauaggaugacaaa

SEQ ID NO: 63947 - RNA, 20 nt, Artificial Sequence
  MKO10063947_A_mmu-mir-204
  gRNA
cuucauauauucucaggcau

SEQ ID NO: 63948 - RNA, 20 nt, Artificial Sequence
  MKO10063948_A_mmu-mir-1192
  gRNA
uuguguuuugagacaggguc

SEQ ID NO: 63949 - RNA, 20 nt, Artificial Sequence
  MKO10063949_A_mmu-mir-1192
  gRNA
guuuguuuuuacuguuugga

SEQ ID NO: 63950 - RNA, 20 nt, Artificial Sequence
  MKO10063950_A_mmu-mir-1192
  gRNA
cgaaacaacaaugacaaauu

SEQ ID NO: 63951 - RNA, 20 nt, Artificial Sequence
  MKO10063951_A_mmu-mir-1192
  gRNA
uugcuuuuguguuuugagac

SEQ ID NO: 63952 - RNA, 20 nt, Artificial Sequence
  MKO10063952_A_mmu-mir-3084-1
  gRNA
ugugcuauacaaauaguuga

SEQ ID NO: 63953 - RNA, 20 nt, Artificial Sequence
  MKO10063953_A_mmu-mir-3084-1
  gRNA
uucuaauucuuuuugucuga

SEQ ID NO: 63954 - RNA, 20 nt, Artificial Sequence
  MKO10063954_A_mmu-mir-3084-1
  gRNA
ucuuuuugucugaaggagac

SEQ ID NO: 63955 - RNA, 20 nt, Artificial Sequence
  MKO10063955_A_mmu-mir-101b
  gRNA
gagacugaacugcccuuuuu

SEQ ID NO: 63956 - RNA, 20 nt, Artificial Sequence
  MKO10063956_A_mmu-mir-101b
  gRNA
cugcccuuuuucgguuauca

SEQ ID NO: 63957 - RNA, 20 nt, Artificial Sequence
  MKO10063957_A_mmu-mir-101b
  gRNA
guacugugauagcugaagaa

SEQ ID NO: 63958 - RNA, 20 nt, Artificial Sequence
  MKO10063958_A_mmu-mir-101b
  gRNA
cugugauagcugaagaaugg

SEQ ID NO: 63959 - RNA, 20 nt, Artificial Sequence
  MKO10063959_A_mmu-mir-3970
  gRNA
ugcaauuuucuaggaauuug

SEQ ID NO: 63960 - RNA, 20 nt, Artificial Sequence
  MKO10063960_A_mmu-mir-3970
  gRNA
cagcaucacccuuuuguuua

SEQ ID NO: 63961 - RNA, 20 nt, Artificial Sequence
  MKO10063961_A_mmu-mir-3970
  gRNA
cauaaacaaaagggugaugc

SEQ ID NO: 63962 - RNA, 20 nt, Artificial Sequence
  MKO10063962_A_mmu-mir-3970
  gRNA
caucacccuuuuguuuaugg

SEQ ID NO: 63963 - RNA, 20 nt, Artificial Sequence
  MKO10063963_A_mmu-mir-107
  gRNA
uucuuuacaguguugccuug

SEQ ID NO: 63964 - RNA, 20 nt, Artificial Sequence
  MKO10063964_A_mmu-mir-107
  gRNA
ugcuugaacuccaugccaca

SEQ ID NO: 63965 - RNA, 20 nt, Artificial Sequence
  MKO10063965_A_mmu-mir-107
  gRNA
aguucaagcagcauuguaca

SEQ ID NO: 63966 - RNA, 20 nt, Artificial Sequence
  MKO10063966_A_mmu-mir-107
  gRNA
uacaguguugccuuguggca

SEQ ID NO: 63967 - RNA, 20 nt, Artificial Sequence
  MKO10063967_A_mmu-mir-1950
  gRNA
aaaugcuuuuucugcaucua

SEQ ID NO: 63968 - RNA, 20 nt, Artificial Sequence
  MKO10063968_A_mmu-mir-1950
  gRNA
uuuuucugcaucuaaggaua

SEQ ID NO: 63969 - RNA, 20 nt, Artificial Sequence
  MKO10063969_A_mmu-mir-1950
  gRNA
ugcauuuaaggagaugauca

SEQ ID NO: 63970 - RNA, 20 nt, Artificial Sequence
  MKO10063970_A_mmu-mir-1950
  gRNA
ugcagaaaaagcauuuggcc

SEQ ID NO: 63971 - RNA, 20 nt, Artificial Sequence
  MKO10063971_A_mmu-mir-8092
  gRNA
gcugccggcagcgcggcgcu

SEQ ID NO: 63972 - RNA, 20 nt, Artificial Sequence
  MKO10063972_A_mmu-mir-8092
  gRNA
cucggcuuuccggcaguacc

SEQ ID NO: 63973 - RNA, 20 nt, Artificial Sequence
  MKO10063973_A_mmu-mir-8092
  gRNA
gcuuuccggcaguacccgga

SEQ ID NO: 63974 - RNA, 20 nt, Artificial Sequence
  MKO10063974_A_mmu-mir-8092
  gRNA
uuccggcaguacccggaugg

SEQ ID NO: 63975 - RNA, 20 nt, Artificial Sequence
  MKO10063975_A_mmu-mir-8091
  gRNA
cuaccuggagauuuccuugu

SEQ ID NO: 63976 - RNA, 20 nt, Artificial Sequence
  MKO10063976_A_mmu-mir-8091
  gRNA
uagggugcuuggauuagguu

SEQ ID NO: 63977 - RNA, 20 nt, Artificial Sequence
  MKO10063977_A_mmu-mir-8091
  gRNA
agguuagggggaggagugag

SEQ ID NO: 63978 - RNA, 20 nt, Artificial Sequence
  MKO10063978_A_mmu-mir-8091
  gRNA
gggaggagugagugguaagc

SEQ ID NO: 63979 - RNA, 20 nt, Artificial Sequence
  MKO10063979_A_mmu-mir-3085
  gRNA
ugugaugcccaagcccuggg

SEQ ID NO: 63980 - RNA, 20 nt, Artificial Sequence
  MKO10063980_A_mmu-mir-3085
  gRNA
ugaugcccaagcccugggag

SEQ ID NO: 63981 - RNA, 20 nt, Artificial Sequence
  MKO10063981_A_mmu-mir-3085
  gRNA
auauucagacucuuggcccu

SEQ ID NO: 63982 - RNA, 20 nt, Artificial Sequence
  MKO10063982_A_mmu-mir-3085
  gRNA
cagacucuuggcccucggaa

SEQ ID NO: 63983 - RNA, 20 nt, Artificial Sequence
  MKO10063983_A_mmu-mir-5114
  gRNA
aggauuaagagaacuggaga

SEQ ID NO: 63984 - RNA, 20 nt, Artificial Sequence
  MKO10063984_A_mmu-mir-5114
  gRNA
gccaagcuggcuucuggaac

SEQ ID NO: 63985 - RNA, 20 nt, Artificial Sequence
  MKO10063985_A_mmu-mir-5114
  gRNA
ggagacggaagcugcaagag

SEQ ID NO: 63986 - RNA, 20 nt, Artificial Sequence
  MKO10063986_A_mmu-mir-5114
  gRNA
gcugcaagagcggcugagug

SEQ ID NO: 63987 - RNA, 20 nt, Artificial Sequence
  MKO10063987_A_mmu-mir-6405
  gRNA
ucaccccauccagcuuucca

SEQ ID NO: 63988 - RNA, 20 nt, Artificial Sequence
  MKO10063988_A_mmu-mir-6405
  gRNA
cauggugagaccagacccca

SEQ ID NO: 63989 - RNA, 20 nt, Artificial Sequence
  MKO10063989_A_mmu-mir-6405
  gRNA
gaguuugaagugggaagcag

SEQ ID NO: 63990 - RNA, 20 nt, Artificial Sequence
  MKO10063990_A_mmu-mir-6405
  gRNA
ugggaagcagugggaagcag

SEQ ID NO: 63991 - RNA, 20 nt, Artificial Sequence
  MKO10063991_A_mmu-mir-146b
  gRNA
cucugagaacugaauuccau

SEQ ID NO: 63992 - RNA, 20 nt, Artificial Sequence
  MKO10063992_A_mmu-mir-146b
  gRNA
acgcccuagggacucaguuc

SEQ ID NO: 63993 - RNA, 20 nt, Artificial Sequence
  MKO10063993_A_mmu-mir-146b
  gRNA
ggaauucaguucucagagcc

SEQ ID NO: 63994 - RNA, 20 nt, Artificial Sequence
  MKO10063994_A_mmu-mir-146b
  gRNA
cugcuagagcucacagccua

SEQ ID NO: 63995 - RNA, 20 nt, Artificial Sequence
  MKO10063995_A_mmu-mir-6995
  gRNA
gagguaccugugagaggaag

SEQ ID NO: 63996 - RNA, 20 nt, Artificial Sequence
  MKO10063996_A_mmu-mir-6995
  gRNA
gguuucccccuucuacuccc

SEQ ID NO: 63997 - RNA, 20 nt, Artificial Sequence
  MKO10063997_A_mmu-mir-6995
  gRNA
guguguccccuuccucucac

SEQ ID NO: 63998 - RNA, 20 nt, Artificial Sequence
  MKO10063998_A_mmu-mir-6995
  gRNA
acagaccugggaguagaagg

SEQ ID NO: 63999 - RNA, 20 nt, Artificial Sequence
  MKO10063999_A_mmu-mir-8090
  gRNA
uauaaaagcaggaagagacg

SEQ ID NO: 64000 - RNA, 20 nt, Artificial Sequence
  MKO10064000_A_mmu-mir-8090
  gRNA
ugcacaucaggagcccagug

SEQ ID NO: 64001 - RNA, 20 nt, Artificial Sequence
  MKO10064001_A_mmu-mir-8090
  gRNA
aggagcccagugcggaggcc

SEQ ID NO: 64002 - RNA, 20 nt, Artificial Sequence
  MKO10064002_A_mmu-mir-8090
  gRNA
augugcagucagaagcgcag

SEQ ID NO: 64003 - RNA, 20 nt, Artificial Sequence
  MKO10064003_A_mmu-mir-6407
  gRNA
caaaugacacuugcccuguc

SEQ ID NO: 64004 - RNA, 20 nt, Artificial Sequence
  MKO10064004_A_mmu-mir-6407
  gRNA
ugcccugucagggacagcca

SEQ ID NO: 64005 - RNA, 20 nt, Artificial Sequence
  MKO10064005_A_mmu-mir-6407
  gRNA
agaaugcaauguggcacccg

SEQ ID NO: 64006 - RNA, 20 nt, Artificial Sequence
  MKO10064006_A_mmu-mir-6407
  gRNA
cgaggaagucaccucaccac

SEQ ID NO: 64007 - RNA, 20 nt, Artificial Sequence
  MKO10064007_A_mmu-mir-6715
  gRNA
gcuguguccacaggcaccac

SEQ ID NO: 64008 - RNA, 20 nt, Artificial Sequence
  MKO10064008_A_mmu-mir-6715
  gRNA
uuugauugaauugccaaacc

SEQ ID NO: 64009 - RNA, 20 nt, Artificial Sequence
  MKO10064009_A_mmu-mir-6715
  gRNA
ugccaaaccaggcgugccug

SEQ ID NO: 64010 - RNA, 20 nt, Artificial Sequence
  MKO10064010_A_mmu-mir-6715
  gRNA
gcucaaaccuguggugccug

SEQ ID NO: 64011 - RNA, 20 nt, Artificial Sequence
  MKO10064011_A_mmu-mir-5623
  gRNA
caggucucagauguggcagc

SEQ ID NO: 64012 - RNA, 20 nt, Artificial Sequence
  MKO10064012_A_mmu-mir-5623
  gRNA
aaugcaggugugaauggaca

SEQ ID NO: 64013 - RNA, 20 nt, Artificial Sequence
  MKO10064013_A_mmu-mir-5623
  gRNA
ugcaggugugaauggacaug

SEQ ID NO: 64014 - RNA, 20 nt, Artificial Sequence
  MKO10064014_A_mmu-mir-5623
  gRNA
cagcuggcaagucagaaugc

SEQ ID NO: 64015 - RNA, 20 nt, Artificial Sequence
  MKO10064015_A_mmu-mir-3086
  gRNA
cacuuagacuguaggcucau

SEQ ID NO: 64016 - RNA, 20 nt, Artificial Sequence
  MKO10064016_A_mmu-mir-3086
  gRNA
cuuagacuguaggcucauug

SEQ ID NO: 64017 - RNA, 20 nt, Artificial Sequence
  MKO10064017_A_mmu-mir-3086
  gRNA
caagacgcuaacccuuccaa

SEQ ID NO: 64018 - RNA, 20 nt, Artificial Sequence
  MKO10064018_A_mmu-mir-3086
  gRNA
ugggccuacaaucuaagugu

SEQ ID NO: 64019 - RNA, 20 nt, Artificial Sequence
  MKO10064019_A_mmu-mir-3084-2
  gRNA
ugugcuauacaaauaguuga

SEQ ID NO: 64020 - RNA, 20 nt, Artificial Sequence
  MKO10064020_A_mmu-mir-3084-2
  gRNA
uucuaauucuuuuugucuga

SEQ ID NO: 64021 - RNA, 20 nt, Artificial Sequence
  MKO10064021_A_mmu-mir-3084-2
  gRNA
ucuuuuugucugaaggagac

SEQ ID NO: 64022 - RNA, 20 nt, Artificial Sequence
  MKO10064022_A_mmu-mir-466m
  gRNA
gcacacacaagaacacacac

SEQ ID NO: 64023 - RNA, 20 nt, Artificial Sequence
  MKO10064023_A_mmu-mir-466m
  gRNA
acacacacaggcacauacau

SEQ ID NO: 64024 - RNA, 20 nt, Artificial Sequence
  MKO10064024_A_mmu-mir-669f
  gRNA
gcaagcacaaacacacacag

SEQ ID NO: 64025 - RNA, 20 nt, Artificial Sequence
  MKO10064025_A_mmu-mir-669f
  gRNA
cacaaacacacacagaggaa

SEQ ID NO: 64026 - RNA, 20 nt, Artificial Sequence
  MKO10064026_A_mmu-mir-669f
  gRNA
uauacacacaggcacauaca

SEQ ID NO: 64027 - RNA, 20 nt, Artificial Sequence
  MKO10064027_A_mmu-mir-669f
  gRNA
gcacacacaacuauacacac

SEQ ID NO: 64028 - RNA, 20 nt, Artificial Sequence
  MKO10064028_A_mmu-mir-669e
  gRNA
aaagaucagccugggauuca

SEQ ID NO: 64029 - RNA, 20 nt, Artificial Sequence
  MKO10064029_A_mmu-mir-669e
  gRNA
caugggcuguacccuauaua

SEQ ID NO: 64030 - RNA, 20 nt, Artificial Sequence
  MKO10064030_A_mmu-mir-669e
  gRNA
cacacaccugcccauauaua

SEQ ID NO: 64031 - RNA, 20 nt, Artificial Sequence
  MKO10064031_A_mmu-mir-669e
  gRNA
gcuguacccuauauaugggc

SEQ ID NO: 64032 - RNA, 20 nt, Artificial Sequence
  MKO10064032_A_mmu-mir-669b
  gRNA
acaugcacauacauucaugg

SEQ ID NO: 64033 - RNA, 20 nt, Artificial Sequence
  MKO10064033_A_mmu-mir-669b
  gRNA
acacaugcacauacauucau

SEQ ID NO: 64034 - RNA, 20 nt, Artificial Sequence
  MKO10064034_A_mmu-mir-669d
  gRNA
gcaugcaugcguguguauau

SEQ ID NO: 64035 - RNA, 20 nt, Artificial Sequence
  MKO10064035_A_mmu-mir-669d
  gRNA
gcaagcaacacacaaauccc

SEQ ID NO: 64036 - RNA, 20 nt, Artificial Sequence
  MKO10064036_A_mmu-mir-466f-2
  gRNA
cacacacacacacacacgaa

SEQ ID NO: 64037 - RNA, 20 nt, Artificial Sequence
  MKO10064037_A_mmu-mir-466f-2
  gRNA
aaacacacauucacauacau

SEQ ID NO: 64038 - RNA, 20 nt, Artificial Sequence
  MKO10064038_A_mmu-mir-669l
  gRNA
cgcacaugcacaaacauggg

SEQ ID NO: 64039 - RNA, 20 nt, Artificial Sequence
  MKO10064039_A_mmu-mir-669l
  gRNA
uacgcacaugcacaaacaug

SEQ ID NO: 64040 - RNA, 20 nt, Artificial Sequence
  MKO10064040_A_mmu-mir-669l
  gRNA
uauacgcacaugcacaaaca

SEQ ID NO: 64041 - RNA, 20 nt, Artificial Sequence
  MKO10064041_A_mmu-mir-669l
  gRNA
auaugaaugcguguauauau

SEQ ID NO: 64042 - RNA, 20 nt, Artificial Sequence
  MKO10064042_A_mmu-mir-669d-2
  gRNA
cccauauacacacgcaugca

SEQ ID NO: 64043 - RNA, 20 nt, Artificial Sequence
  MKO10064043_A_mmu-mir-669d-2
  gRNA
cacacaugcacauauauagg

SEQ ID NO: 64044 - RNA, 20 nt, Artificial Sequence
  MKO10064044_A_mmu-mir-669d-2
  gRNA
uacacacaugcacauauaua

SEQ ID NO: 64045 - RNA, 20 nt, Artificial Sequence
  MKO10064045_A_mmu-mir-669d-2
  gRNA
ccgugcaugcguguguauau

SEQ ID NO: 64046 - RNA, 20 nt, Artificial Sequence
  MKO10064046_A_mmu-mir-466f-3
  gRNA
acacacaugcacauacauga

SEQ ID NO: 64047 - RNA, 20 nt, Artificial Sequence
  MKO10064047_A_mmu-mir-297a-2
  gRNA
gcacacauacauauacacac

SEQ ID NO: 64048 - RNA, 20 nt, Artificial Sequence
  MKO10064048_A_mmu-mir-297a-2
  gRNA
guuugugugcaugcuuguau

SEQ ID NO: 64049 - RNA, 20 nt, Artificial Sequence
  MKO10064049_A_mmu-mir-297a-2
  gRNA
uacacacaggcacauacacu

SEQ ID NO: 64050 - RNA, 20 nt, Artificial Sequence
  MKO10064050_A_mmu-mir-466o
  gRNA
auaugagcacauagacacac

SEQ ID NO: 64051 - RNA, 20 nt, Artificial Sequence
  MKO10064051_A_mmu-mir-466o
  gRNA
acacauacacacauacauag

SEQ ID NO: 64052 - RNA, 20 nt, Artificial Sequence
  MKO10064052_A_mmu-mir-466o
  gRNA
caacacauacacacauacau

SEQ ID NO: 64053 - RNA, 20 nt, Artificial Sequence
  MKO10064053_A_mmu-mir-467c
  gRNA
augcacgcacuuaugcacaa

SEQ ID NO: 64054 - RNA, 20 nt, Artificial Sequence
  MKO10064054_A_mmu-mir-467c
  gRNA
ugcacacagacaugcgagaa

SEQ ID NO: 64055 - RNA, 20 nt, Artificial Sequence
  MKO10064055_A_mmu-mir-467c
  gRNA
acaugcgagaauggcccuca

SEQ ID NO: 64056 - RNA, 20 nt, Artificial Sequence
  MKO10064056_A_mmu-mir-467c
  gRNA
gcacaaaggcacaugcauag

SEQ ID NO: 64057 - RNA, 20 nt, Artificial Sequence
  MKO10064057_A_mmu-mir-466b-1
  gRNA
cauaugagcacacagacaca

SEQ ID NO: 64058 - RNA, 20 nt, Artificial Sequence
  MKO10064058_A_mmu-mir-466b-1
  gRNA
acacauacacacauucauag

SEQ ID NO: 64059 - RNA, 20 nt, Artificial Sequence
  MKO10064059_A_mmu-mir-466b-1
  gRNA
caacacauacacacauucau

SEQ ID NO: 64060 - RNA, 20 nt, Artificial Sequence
  MKO10064060_A_mmu-mir-669a-3
  gRNA
aagcacacauacacagacac

SEQ ID NO: 64061 - RNA, 20 nt, Artificial Sequence
  MKO10064061_A_mmu-mir-669a-3
  gRNA
cacauacacagacacaggaa

SEQ ID NO: 64062 - RNA, 20 nt, Artificial Sequence
  MKO10064062_A_mmu-mir-669a-3
  gRNA
cacauacauggaggaaucac

SEQ ID NO: 64063 - RNA, 20 nt, Artificial Sequence
  MKO10064063_A_mmu-mir-669a-3
  gRNA
acacacaugcacauacaugg

SEQ ID NO: 64064 - RNA, 20 nt, Artificial Sequence
  MKO10064064_A_mmu-mir-669k
  gRNA
acgcaugcaaacacauucau

SEQ ID NO: 64065 - RNA, 20 nt, Artificial Sequence
  MKO10064065_A_mmu-mir-669k
  gRNA
uccuaacugagauauagcuc

SEQ ID NO: 64066 - RNA, 20 nt, Artificial Sequence
  MKO10064066_A_mmu-mir-669k
  gRNA
ugcaaacacauucauaggaa

SEQ ID NO: 64067 - RNA, 20 nt, Artificial Sequence
  MKO10064067_A_mmu-mir-669k
  gRNA
gccagagcuauaucucaguu

SEQ ID NO: 64068 - RNA, 20 nt, Artificial Sequence
  MKO10064068_A_mmu-mir-467a-1
  gRNA
augcaggcacuuacgcacac

SEQ ID NO: 64069 - RNA, 20 nt, Artificial Sequence
  MKO10064069_A_mmu-mir-467a-1
  gRNA
auauacacgcauauacaugc

SEQ ID NO: 64070 - RNA, 20 nt, Artificial Sequence
  MKO10064070_A_mmu-mir-467a-1
  gRNA
cacacaugcacacagacaug

SEQ ID NO: 64071 - RNA, 20 nt, Artificial Sequence
  MKO10064071_A_mmu-mir-467a-1
  gRNA
cgcacacaggcacguacaua

SEQ ID NO: 64072 - RNA, 20 nt, Artificial Sequence
  MKO10064072_A_mmu-mir-466b-8
  gRNA
cauaugagcacacagacaca

SEQ ID NO: 64073 - RNA, 20 nt, Artificial Sequence
  MKO10064073_A_mmu-mir-466b-8
  gRNA
acacauacacacauacauag

SEQ ID NO: 64074 - RNA, 20 nt, Artificial Sequence
  MKO10064074_A_mmu-mir-466b-8
  gRNA
caacacauacacacauacau

SEQ ID NO: 64075 - RNA, 20 nt, Artificial Sequence
  MKO10064075_A_mmu-mir-669a-1
  gRNA
aagcacacauacacagacac

SEQ ID NO: 64076 - RNA, 20 nt, Artificial Sequence
  MKO10064076_A_mmu-mir-669a-1
  gRNA
cacauacacagacacaggaa

SEQ ID NO: 64077 - RNA, 20 nt, Artificial Sequence
  MKO10064077_A_mmu-mir-669a-1
  gRNA
acacacaugcacauacaugg

SEQ ID NO: 64078 - RNA, 20 nt, Artificial Sequence
  MKO10064078_A_mmu-mir-669a-1
  gRNA
uauacacacaugcacauaca

SEQ ID NO: 64079 - RNA, 20 nt, Artificial Sequence
  MKO10064079_A_mmu-mir-669g
  gRNA
aucugcaagcacacacacac

SEQ ID NO: 64080 - RNA, 20 nt, Artificial Sequence
  MKO10064080_A_mmu-mir-669g
  gRNA
aagcacacaugcacauaaau

SEQ ID NO: 64081 - RNA, 20 nt, Artificial Sequence
  MKO10064081_A_mmu-mir-669j
  gRNA
ucauagcucgggccauucgu

SEQ ID NO: 64082 - RNA, 20 nt, Artificial Sequence
  MKO10064082_A_mmu-mir-669j
  gRNA
ugcaaacauacucccacgaa

SEQ ID NO: 64083 - RNA, 20 nt, Artificial Sequence
  MKO10064083_A_mmu-mir-669j
  gRNA
acacacaugcacauucuugg

SEQ ID NO: 64084 - RNA, 20 nt, Artificial Sequence
  MKO10064084_A_mmu-mir-669j
  gRNA
uauacacacaugcacauucu

SEQ ID NO: 64085 - RNA, 20 nt, Artificial Sequence
  MKO10064085_A_mmu-mir-467a-2
  gRNA
augcaggcacuuacgcacac

SEQ ID NO: 64086 - RNA, 20 nt, Artificial Sequence
  MKO10064086_A_mmu-mir-467a-2
  gRNA
auauacacgcauauacaugc

SEQ ID NO: 64087 - RNA, 20 nt, Artificial Sequence
  MKO10064087_A_mmu-mir-467a-2
  gRNA
cacacaugcacacagacaug

SEQ ID NO: 64088 - RNA, 20 nt, Artificial Sequence
  MKO10064088_A_mmu-mir-467a-2
  gRNA
gcacacaggcacauacauag

SEQ ID NO: 64089 - RNA, 20 nt, Artificial Sequence
  MKO10064089_A_mmu-mir-466e
  gRNA
cauaugagcacacagacaca

SEQ ID NO: 64090 - RNA, 20 nt, Artificial Sequence
  MKO10064090_A_mmu-mir-466e
  gRNA
acacauacacacauacauag

SEQ ID NO: 64091 - RNA, 20 nt, Artificial Sequence
  MKO10064091_A_mmu-mir-466e
  gRNA
caacacauacacacauacau

SEQ ID NO: 64092 - RNA, 20 nt, Artificial Sequence
  MKO10064092_A_mmu-mir-669a-4
  gRNA
aagcacacauacacagacac

SEQ ID NO: 64093 - RNA, 20 nt, Artificial Sequence
  MKO10064093_A_mmu-mir-669a-4
  gRNA
acacacaugcacauacaugg

SEQ ID NO: 64094 - RNA, 20 nt, Artificial Sequence
  MKO10064094_A_mmu-mir-669a-4
  gRNA
uauacacacaugcacauaca

SEQ ID NO: 64095 - RNA, 20 nt, Artificial Sequence
  MKO10064095_A_mmu-mir-467b
  gRNA
augcaggcacuuacgcacac

SEQ ID NO: 64096 - RNA, 20 nt, Artificial Sequence
  MKO10064096_A_mmu-mir-467b
  gRNA
auauacacgcauauacaugc

SEQ ID NO: 64097 - RNA, 20 nt, Artificial Sequence
  MKO10064097_A_mmu-mir-467b
  gRNA
cacacaugcacacagacaug

SEQ ID NO: 64098 - RNA, 20 nt, Artificial Sequence
  MKO10064098_A_mmu-mir-467b
  gRNA
cgcacacgggcacauacaaa

SEQ ID NO: 64099 - RNA, 20 nt, Artificial Sequence
  MKO10064099_A_mmu-mir-466c-1
  gRNA
acauaugagcacacagacac

SEQ ID NO: 64100 - RNA, 20 nt, Artificial Sequence
  MKO10064100_A_mmu-mir-466c-1
  gRNA
auaugagcacacagacacag

SEQ ID NO: 64101 - RNA, 20 nt, Artificial Sequence
  MKO10064101_A_mmu-mir-466c-1
  gRNA
acacauauacacauacauag

SEQ ID NO: 64102 - RNA, 20 nt, Artificial Sequence
  MKO10064102_A_mmu-mir-466c-1
  gRNA
caacacauauacacauacau

SEQ ID NO: 64103 - RNA, 20 nt, Artificial Sequence
  MKO10064103_A_mmu-mir-669a-5
  gRNA
aagcacacauacacagacac

SEQ ID NO: 64104 - RNA, 20 nt, Artificial Sequence
  MKO10064104_A_mmu-mir-669a-5
  gRNA
acacacaugcacauacaugg

SEQ ID NO: 64105 - RNA, 20 nt, Artificial Sequence
  MKO10064105_A_mmu-mir-669a-5
  gRNA
uauacacacaugcacauaca

SEQ ID NO: 64106 - RNA, 20 nt, Artificial Sequence
  MKO10064106_A_mmu-mir-467a-3
  gRNA
augcaggcacuuacgcacac

SEQ ID NO: 64107 - RNA, 20 nt, Artificial Sequence
  MKO10064107_A_mmu-mir-467a-3
  gRNA
auauacacgcauauacaugc

SEQ ID NO: 64108 - RNA, 20 nt, Artificial Sequence
  MKO10064108_A_mmu-mir-467a-3
  gRNA
cacacaugcacacagacaug

SEQ ID NO: 64109 - RNA, 20 nt, Artificial Sequence
  MKO10064109_A_mmu-mir-467a-3
  gRNA
gcacacgggcacauacauag

SEQ ID NO: 64110 - RNA, 20 nt, Artificial Sequence
  MKO10064110_A_mmu-mir-466c-2
  gRNA
acauaugagcacacagacac

SEQ ID NO: 64111 - RNA, 20 nt, Artificial Sequence
  MKO10064111_A_mmu-mir-466c-2
  gRNA
auaugagcacacagacacag

SEQ ID NO: 64112 - RNA, 20 nt, Artificial Sequence
  MKO10064112_A_mmu-mir-466c-2
  gRNA
acacauauacacauacguag

SEQ ID NO: 64113 - RNA, 20 nt, Artificial Sequence
  MKO10064113_A_mmu-mir-466c-2
  gRNA
caacacauauacacauacgu

SEQ ID NO: 64114 - RNA, 20 nt, Artificial Sequence
  MKO10064114_A_mmu-mir-669a-6
  gRNA
aagcacacauacacagacac

SEQ ID NO: 64115 - RNA, 20 nt, Artificial Sequence
  MKO10064115_A_mmu-mir-669a-6
  gRNA
acacacaugcacauacaugg

SEQ ID NO: 64116 - RNA, 20 nt, Artificial Sequence
  MKO10064116_A_mmu-mir-669a-6
  gRNA
uauacacacaugcacauaca

SEQ ID NO: 64117 - RNA, 20 nt, Artificial Sequence
  MKO10064117_A_mmu-mir-467a-4
  gRNA
augcaggcacuuacgcacac

SEQ ID NO: 64118 - RNA, 20 nt, Artificial Sequence
  MKO10064118_A_mmu-mir-467a-4
  gRNA
auauacacgcauauacaugc

SEQ ID NO: 64119 - RNA, 20 nt, Artificial Sequence
  MKO10064119_A_mmu-mir-467a-4
  gRNA
cacacaugcacacagacaug

SEQ ID NO: 64120 - RNA, 20 nt, Artificial Sequence
  MKO10064120_A_mmu-mir-467a-4
  gRNA
gcacacaggcacauacauag

SEQ ID NO: 64121 - RNA, 20 nt, Artificial Sequence
  MKO10064121_A_mmu-mir-466b-4
  gRNA
cauaugagcacacagacaca

SEQ ID NO: 64122 - RNA, 20 nt, Artificial Sequence
  MKO10064122_A_mmu-mir-466b-4
  gRNA
acacauacacacauacauag

SEQ ID NO: 64123 - RNA, 20 nt, Artificial Sequence
  MKO10064123_A_mmu-mir-466b-4
  gRNA
caacacauacacacauacau

SEQ ID NO: 64124 - RNA, 20 nt, Artificial Sequence
  MKO10064124_A_mmu-mir-669a-7
  gRNA
aagcacacauacacagacac

SEQ ID NO: 64125 - RNA, 20 nt, Artificial Sequence
  MKO10064125_A_mmu-mir-669a-7
  gRNA
acacacaugcacauacaugg

SEQ ID NO: 64126 - RNA, 20 nt, Artificial Sequence
  MKO10064126_A_mmu-mir-669a-7
  gRNA
uauacacacaugcacauaca

SEQ ID NO: 64127 - RNA, 20 nt, Artificial Sequence
  MKO10064127_A_mmu-mir-467a-5
  gRNA
augcaggcacuuacgcacac

SEQ ID NO: 64128 - RNA, 20 nt, Artificial Sequence
  MKO10064128_A_mmu-mir-467a-5
  gRNA
auauacacgcauauacaugc

SEQ ID NO: 64129 - RNA, 20 nt, Artificial Sequence
  MKO10064129_A_mmu-mir-467a-5
  gRNA
cacacaugcacacagacaug

SEQ ID NO: 64130 - RNA, 20 nt, Artificial Sequence
  MKO10064130_A_mmu-mir-467a-5
  gRNA
gcacacaggcacauacauag

SEQ ID NO: 64131 - RNA, 20 nt, Artificial Sequence
  MKO10064131_A_mmu-mir-466b-5
  gRNA
cauaugagcacacagacaca

SEQ ID NO: 64132 - RNA, 20 nt, Artificial Sequence
  MKO10064132_A_mmu-mir-466b-5
  gRNA
acacauacacauauucauag

SEQ ID NO: 64133 - RNA, 20 nt, Artificial Sequence
  MKO10064133_A_mmu-mir-466b-5
  gRNA
caacacauacacauauucau

SEQ ID NO: 64134 - RNA, 20 nt, Artificial Sequence
  MKO10064134_A_mmu-mir-669p-1
  gRNA
acacacaugcacauacaugg

SEQ ID NO: 64135 - RNA, 20 nt, Artificial Sequence
  MKO10064135_A_mmu-mir-669p-1
  gRNA
uauacacacaugcacauaca

SEQ ID NO: 64136 - RNA, 20 nt, Artificial Sequence
  MKO10064136_A_mmu-mir-467a-6
  gRNA
augcaggcacuuacgcacac

SEQ ID NO: 64137 - RNA, 20 nt, Artificial Sequence
  MKO10064137_A_mmu-mir-467a-6
  gRNA
auauacacgcauauacaugc

SEQ ID NO: 64138 - RNA, 20 nt, Artificial Sequence
  MKO10064138_A_mmu-mir-467a-6
  gRNA
cacacaugcacacagacaug

SEQ ID NO: 64139 - RNA, 20 nt, Artificial Sequence
  MKO10064139_A_mmu-mir-467a-6
  gRNA
gcacacgggcacauacauag

SEQ ID NO: 64140 - RNA, 20 nt, Artificial Sequence
  MKO10064140_A_mmu-mir-669a-8
  gRNA
aagcacacauacacagacac

SEQ ID NO: 64141 - RNA, 20 nt, Artificial Sequence
  MKO10064141_A_mmu-mir-669a-8
  gRNA
acacacaugcacauacaugg

SEQ ID NO: 64142 - RNA, 20 nt, Artificial Sequence
  MKO10064142_A_mmu-mir-669a-8
  gRNA
uauacacacaugcacauaca

SEQ ID NO: 64143 - RNA, 20 nt, Artificial Sequence
  MKO10064143_A_mmu-mir-467a-7
  gRNA
augcaggcacuuacgcacac

SEQ ID NO: 64144 - RNA, 20 nt, Artificial Sequence
  MKO10064144_A_mmu-mir-467a-7
  gRNA
auauacacgcauauacaugc

SEQ ID NO: 64145 - RNA, 20 nt, Artificial Sequence
  MKO10064145_A_mmu-mir-467a-7
  gRNA
cacacaugcacacagacaug

SEQ ID NO: 64146 - RNA, 20 nt, Artificial Sequence
  MKO10064146_A_mmu-mir-467a-7
  gRNA
gcacacaggcacauacauag

SEQ ID NO: 64147 - RNA, 20 nt, Artificial Sequence
  MKO10064147_A_mmu-mir-466b-6
  gRNA
cauaugagcacacagacaca

SEQ ID NO: 64148 - RNA, 20 nt, Artificial Sequence
  MKO10064148_A_mmu-mir-466b-6
  gRNA
acacauacacacauacauag

SEQ ID NO: 64149 - RNA, 20 nt, Artificial Sequence
  MKO10064149_A_mmu-mir-466b-6
  gRNA
caacacauacacacauacau

SEQ ID NO: 64150 - RNA, 20 nt, Artificial Sequence
  MKO10064150_A_mmu-mir-669a-9
  gRNA
aagcacacauacacagacac

SEQ ID NO: 64151 - RNA, 20 nt, Artificial Sequence
  MKO10064151_A_mmu-mir-669a-9
  gRNA
acacacaugcacauacaugg

SEQ ID NO: 64152 - RNA, 20 nt, Artificial Sequence
  MKO10064152_A_mmu-mir-669a-9
  gRNA
uauacacacaugcacauaca

SEQ ID NO: 64153 - RNA, 20 nt, Artificial Sequence
  MKO10064153_A_mmu-mir-467a-8
  gRNA
augcaggcacuuacgcacac

SEQ ID NO: 64154 - RNA, 20 nt, Artificial Sequence
  MKO10064154_A_mmu-mir-467a-8
  gRNA
auauacacgcauauacaugc

SEQ ID NO: 64155 - RNA, 20 nt, Artificial Sequence
  MKO10064155_A_mmu-mir-467a-8
  gRNA
cacacaugcacacagacaug

SEQ ID NO: 64156 - RNA, 20 nt, Artificial Sequence
  MKO10064156_A_mmu-mir-467a-8
  gRNA
gcacacaggcacauacauag

SEQ ID NO: 64157 - RNA, 20 nt, Artificial Sequence
  MKO10064157_A_mmu-mir-466b-7
  gRNA
cauaugagcacacagacaca

SEQ ID NO: 64158 - RNA, 20 nt, Artificial Sequence
  MKO10064158_A_mmu-mir-466b-7
  gRNA
acacauacacauauucauag

SEQ ID NO: 64159 - RNA, 20 nt, Artificial Sequence
  MKO10064159_A_mmu-mir-466b-7
  gRNA
caacacauacacauauucau

SEQ ID NO: 64160 - RNA, 20 nt, Artificial Sequence
  MKO10064160_A_mmu-mir-669p-2
  gRNA
acacacaugcacauacaugg

SEQ ID NO: 64161 - RNA, 20 nt, Artificial Sequence
  MKO10064161_A_mmu-mir-669p-2
  gRNA
uauacacacaugcacauaca

SEQ ID NO: 64162 - RNA, 20 nt, Artificial Sequence
  MKO10064162_A_mmu-mir-467a-9
  gRNA
augcaggcacuuacgcacac

SEQ ID NO: 64163 - RNA, 20 nt, Artificial Sequence
  MKO10064163_A_mmu-mir-467a-9
  gRNA
auauacacgcauauacaugc

SEQ ID NO: 64164 - RNA, 20 nt, Artificial Sequence
  MKO10064164_A_mmu-mir-467a-9
  gRNA
cacacaugcacacagacaug

SEQ ID NO: 64165 - RNA, 20 nt, Artificial Sequence
  MKO10064165_A_mmu-mir-467a-9
  gRNA
gcacacaggcacauacauag

SEQ ID NO: 64166 - RNA, 20 nt, Artificial Sequence
  MKO10064166_A_mmu-mir-466b-2
  gRNA
cauaugagcacacagacaca

SEQ ID NO: 64167 - RNA, 20 nt, Artificial Sequence
  MKO10064167_A_mmu-mir-466b-2
  gRNA
acacauacacacauacauag

SEQ ID NO: 64168 - RNA, 20 nt, Artificial Sequence
  MKO10064168_A_mmu-mir-466b-2
  gRNA
caacacauacacacauacau

SEQ ID NO: 64169 - RNA, 20 nt, Artificial Sequence
  MKO10064169_A_mmu-mir-669a-10
  gRNA
aagcacacauacacagacac

SEQ ID NO: 64170 - RNA, 20 nt, Artificial Sequence
  MKO10064170_A_mmu-mir-669a-10
  gRNA
acacacaugcacauacaugg

SEQ ID NO: 64171 - RNA, 20 nt, Artificial Sequence
  MKO10064171_A_mmu-mir-669a-10
  gRNA
uauacacacaugcacauaca

SEQ ID NO: 64172 - RNA, 20 nt, Artificial Sequence
  MKO10064172_A_mmu-mir-669a-11
  gRNA
aagcacacauacacagacac

SEQ ID NO: 64173 - RNA, 20 nt, Artificial Sequence
  MKO10064173_A_mmu-mir-669a-11
  gRNA
acacacaugcacauacaugg

SEQ ID NO: 64174 - RNA, 20 nt, Artificial Sequence
  MKO10064174_A_mmu-mir-669a-11
  gRNA
uauacacacaugcacauaca

SEQ ID NO: 64175 - RNA, 20 nt, Artificial Sequence
  MKO10064175_A_mmu-mir-467a-10
  gRNA
augcaggcacuuacgcacac

SEQ ID NO: 64176 - RNA, 20 nt, Artificial Sequence
  MKO10064176_A_mmu-mir-467a-10
  gRNA
auauacacgcauauacaugc

SEQ ID NO: 64177 - RNA, 20 nt, Artificial Sequence
  MKO10064177_A_mmu-mir-467a-10
  gRNA
cacacaugcacacagacaug

SEQ ID NO: 64178 - RNA, 20 nt, Artificial Sequence
  MKO10064178_A_mmu-mir-467a-10
  gRNA
gcacacgggcacauacauag

SEQ ID NO: 64179 - RNA, 20 nt, Artificial Sequence
  MKO10064179_A_mmu-mir-466b-3
  gRNA
cauaugagcacacagacaca

SEQ ID NO: 64180 - RNA, 20 nt, Artificial Sequence
  MKO10064180_A_mmu-mir-466b-3
  gRNA
acacauauacacauacacag

SEQ ID NO: 64181 - RNA, 20 nt, Artificial Sequence
  MKO10064181_A_mmu-mir-466b-3
  gRNA
caacacauauacacauacac

SEQ ID NO: 64182 - RNA, 20 nt, Artificial Sequence
  MKO10064182_A_mmu-mir-669a-12
  gRNA
aagcacacauacacagauac

SEQ ID NO: 64183 - RNA, 20 nt, Artificial Sequence
  MKO10064183_A_mmu-mir-669a-12
  gRNA
acacacaugcacauacaugg

SEQ ID NO: 64184 - RNA, 20 nt, Artificial Sequence
  MKO10064184_A_mmu-mir-669a-12
  gRNA
uauacacacaugcacauaca

SEQ ID NO: 64185 - RNA, 20 nt, Artificial Sequence
  MKO10064185_A_mmu-mir-467e
  gRNA
augcucacacuuaugcacac

SEQ ID NO: 64186 - RNA, 20 nt, Artificial Sequence
  MKO10064186_A_mmu-mir-467e
  gRNA
gucugugugcauguguauau

SEQ ID NO: 64187 - RNA, 20 nt, Artificial Sequence
  MKO10064187_A_mmu-mir-467e
  gRNA
uacacaugcacacagacaug

SEQ ID NO: 64188 - RNA, 20 nt, Artificial Sequence
  MKO10064188_A_mmu-mir-467e
  gRNA
ugcacacagacaugcgggaa

SEQ ID NO: 64189 - RNA, 20 nt, Artificial Sequence
  MKO10064189_A_mmu-mir-466p
  gRNA
auaugagcacacagacacac

SEQ ID NO: 64190 - RNA, 20 nt, Artificial Sequence
  MKO10064190_A_mmu-mir-466p
  gRNA
acacauauacacauacauag

SEQ ID NO: 64191 - RNA, 20 nt, Artificial Sequence
  MKO10064191_A_mmu-mir-466p
  gRNA
aaacacauauacacauacau

SEQ ID NO: 64192 - RNA, 20 nt, Artificial Sequence
  MKO10064192_A_mmu-mir-467d
  gRNA
augcgcgcacuuaugcacac

SEQ ID NO: 64193 - RNA, 20 nt, Artificial Sequence
  MKO10064193_A_mmu-mir-467d
  gRNA
cacacaugcacacagacaug

SEQ ID NO: 64194 - RNA, 20 nt, Artificial Sequence
  MKO10064194_A_mmu-mir-467d
  gRNA
ugcacacagacaugcgggaa

SEQ ID NO: 64195 - RNA, 20 nt, Artificial Sequence
  MKO10064195_A_mmu-mir-467d
  gRNA
gcacacaggcacauacauag

SEQ ID NO: 64196 - RNA, 20 nt, Artificial Sequence
  MKO10064196_A_mmu-mir-466a
  gRNA
uaugugugcguguauguaua

SEQ ID NO: 64197 - RNA, 20 nt, Artificial Sequence
  MKO10064197_A_mmu-mir-466a
  gRNA
acacauauacacauacauag

SEQ ID NO: 64198 - RNA, 20 nt, Artificial Sequence
  MKO10064198_A_mmu-mir-466a
  gRNA
aaacacauauacacauacau

SEQ ID NO: 64199 - RNA, 20 nt, Artificial Sequence
  MKO10064199_A_mmu-mir-297c
  gRNA
gcacacauacauauacacac

SEQ ID NO: 64200 - RNA, 20 nt, Artificial Sequence
  MKO10064200_A_mmu-mir-297c
  gRNA
guuuguaugcauguuuguau

SEQ ID NO: 64201 - RNA, 20 nt, Artificial Sequence
  MKO10064201_A_mmu-mir-297c
  gRNA
gcauacaaacacacaaaaau

SEQ ID NO: 64202 - RNA, 20 nt, Artificial Sequence
  MKO10064202_A_mmu-mir-297c
  gRNA
uacacacaggcauauauacu

SEQ ID NO: 64203 - RNA, 20 nt, Artificial Sequence
  MKO10064203_A_mmu-mir-669c
  gRNA
cauguguguauaguugugug

SEQ ID NO: 64204 - RNA, 20 nt, Artificial Sequence
  MKO10064204_A_mmu-mir-669c
  gRNA
uauacacacaugcacauaca

SEQ ID NO: 64205 - RNA, 20 nt, Artificial Sequence
  MKO10064205_A_mmu-mir-669c
  gRNA
acaagugcacaaacagacac

SEQ ID NO: 64206 - RNA, 20 nt, Artificial Sequence
  MKO10064206_A_mmu-mir-669c
  gRNA
acacacaugcacauacaugg

SEQ ID NO: 64207 - RNA, 20 nt, Artificial Sequence
  MKO10064207_A_mmu-mir-669a-2
  gRNA
uauacacacaugcacauaca

SEQ ID NO: 64208 - RNA, 20 nt, Artificial Sequence
  MKO10064208_A_mmu-mir-669a-2
  gRNA
gcaagcacacacacagacac

SEQ ID NO: 64209 - RNA, 20 nt, Artificial Sequence
  MKO10064209_A_mmu-mir-669a-2
  gRNA
cacacacacagacacaggaa

SEQ ID NO: 64210 - RNA, 20 nt, Artificial Sequence
  MKO10064210_A_mmu-mir-669a-2
  gRNA
cacauacauggaggaaucuc

SEQ ID NO: 64211 - RNA, 20 nt, Artificial Sequence
  MKO10064211_A_mmu-mir-297b
  gRNA
gcauacaaacacacagaaaa

SEQ ID NO: 64212 - RNA, 20 nt, Artificial Sequence
  MKO10064212_A_mmu-mir-297b
  gRNA
cacacaagcaaauagauugg

SEQ ID NO: 64213 - RNA, 20 nt, Artificial Sequence
  MKO10064213_A_mmu-mir-297b
  gRNA
uacacacaagcaaauagauu

SEQ ID NO: 64214 - RNA, 20 nt, Artificial Sequence
  MKO10064214_A_mmu-mir-297b
  gRNA
guuuguaugcauguuuguau

SEQ ID NO: 64215 - RNA, 20 nt, Artificial Sequence
  MKO10064215_A_mmu-mir-466d
  gRNA
acgcacgcacacacacacac

SEQ ID NO: 64216 - RNA, 20 nt, Artificial Sequence
  MKO10064216_A_mmu-mir-466d
  gRNA
cgcacacacacacacaggga

SEQ ID NO: 64217 - RNA, 20 nt, Artificial Sequence
  MKO10064217_A_mmu-mir-466d
  gRNA
acacacaugcacauacacag

SEQ ID NO: 64218 - RNA, 20 nt, Artificial Sequence
  MKO10064218_A_mmu-mir-466d
  gRNA
aaacacacaugcacauacac

SEQ ID NO: 64219 - RNA, 20 nt, Artificial Sequence
  MKO10064219_A_mmu-mir-669m-1
  gRNA
cuugcuuguauauguuugug

SEQ ID NO: 64220 - RNA, 20 nt, Artificial Sequence
  MKO10064220_A_mmu-mir-669m-1
  gRNA
gcaagcacagauacacacac

SEQ ID NO: 64221 - RNA, 20 nt, Artificial Sequence
  MKO10064221_A_mmu-mir-669m-1
  gRNA
cacagauacacacacaggaa

SEQ ID NO: 64222 - RNA, 20 nt, Artificial Sequence
  MKO10064222_A_mmu-mir-669m-1
  gRNA
cacaugcacauacauugggg

SEQ ID NO: 64223 - RNA, 20 nt, Artificial Sequence
  MKO10064223_A_mmu-mir-669m-2
  gRNA
caugcuuguauauguuugug

SEQ ID NO: 64224 - RNA, 20 nt, Artificial Sequence
  MKO10064224_A_mmu-mir-669m-2
  gRNA
gauauacacacacacagaaa

SEQ ID NO: 64225 - RNA, 20 nt, Artificial Sequence
  MKO10064225_A_mmu-mir-669m-2
  gRNA
acacaugcaaauauauugug

SEQ ID NO: 64226 - RNA, 20 nt, Artificial Sequence
  MKO10064226_A_mmu-mir-669m-2
  gRNA
acacacaugcaaauauauug

SEQ ID NO: 64227 - RNA, 20 nt, Artificial Sequence
  MKO10064227_A_mmu-mir-466n
  gRNA
aaacacacaugcacauacac

SEQ ID NO: 64228 - RNA, 20 nt, Artificial Sequence
  MKO10064228_A_mmu-mir-669o
  gRNA
acacacaugcacaugcaugg

SEQ ID NO: 64229 - RNA, 20 nt, Artificial Sequence
  MKO10064229_A_mmu-mir-669o
  gRNA
uauacacacaugcacaugca

SEQ ID NO: 64230 - RNA, 20 nt, Artificial Sequence
  MKO10064230_A_mmu-mir-466g
  gRNA
uguuuucgugugugugcaug

SEQ ID NO: 64231 - RNA, 20 nt, Artificial Sequence
  MKO10064231_A_mmu-mir-466g
  gRNA
cagacacaugcacacacaug

SEQ ID NO: 64232 - RNA, 20 nt, Artificial Sequence
  MKO10064232_A_mmu-mir-466h
  gRNA
cacacacaaauauacacaca

SEQ ID NO: 64233 - RNA, 20 nt, Artificial Sequence
  MKO10064233_A_mmu-mir-297a-3
  gRNA
gcacacauacauauacacac

SEQ ID NO: 64234 - RNA, 20 nt, Artificial Sequence
  MKO10064234_A_mmu-mir-297a-3
  gRNA
guuugugugcauguuuguau

SEQ ID NO: 64235 - RNA, 20 nt, Artificial Sequence
  MKO10064235_A_mmu-mir-297a-3
  gRNA
uacacacaggcacauacacu

SEQ ID NO: 64236 - RNA, 20 nt, Artificial Sequence
  MKO10064236_A_mmu-mir-466l
  gRNA
aaacacacaugcacauacau

SEQ ID NO: 64237 - RNA, 20 nt, Artificial Sequence
  MKO10064237_A_mmu-mir-466l
  gRNA
caugcacacgcacacauuaa

SEQ ID NO: 64238 - RNA, 20 nt, Artificial Sequence
  MKO10064238_A_mmu-mir-466l
  gRNA
acacacaugcacauacauag

SEQ ID NO: 64239 - RNA, 20 nt, Artificial Sequence
  MKO10064239_A_mmu-mir-297a-4
  gRNA
gcacacauacauauacacac

SEQ ID NO: 64240 - RNA, 20 nt, Artificial Sequence
  MKO10064240_A_mmu-mir-297a-4
  gRNA
acacgcaaaaucgccacuca

SEQ ID NO: 64241 - RNA, 20 nt, Artificial Sequence
  MKO10064241_A_mmu-mir-297a-4
  gRNA
uacacacaggcacauacacu

SEQ ID NO: 64242 - RNA, 20 nt, Artificial Sequence
  MKO10064242_A_mmu-mir-297a-4
  gRNA
auuugugugcaugcuuguau

SEQ ID NO: 64243 - RNA, 20 nt, Artificial Sequence
  MKO10064243_A_mmu-mir-669i
  gRNA
augcauacaaacucacauac

SEQ ID NO: 64244 - RNA, 20 nt, Artificial Sequence
  MKO10064244_A_mmu-mir-669i
  gRNA
cacacaugcacauuauuggu

SEQ ID NO: 64245 - RNA, 20 nt, Artificial Sequence
  MKO10064245_A_mmu-mir-669i
  gRNA
gugggcaucacaugaaugcc

SEQ ID NO: 64246 - RNA, 20 nt, Artificial Sequence
  MKO10064246_A_mmu-mir-669i
  gRNA
uauacacacaugcacauuau

SEQ ID NO: 64247 - RNA, 20 nt, Artificial Sequence
  MKO10064247_A_mmu-mir-669h
  gRNA
augcccaccaaaaauaugca

SEQ ID NO: 64248 - RNA, 20 nt, Artificial Sequence
  MKO10064248_A_mmu-mir-669h
  gRNA
cacccaugcauauuuuuggu

SEQ ID NO: 64249 - RNA, 20 nt, Artificial Sequence
  MKO10064249_A_mmu-mir-669h
  gRNA
acacacacacacucacacac

SEQ ID NO: 64250 - RNA, 20 nt, Artificial Sequence
  MKO10064250_A_mmu-mir-669h
  gRNA
cacucguuuauccuuuugaa

SEQ ID NO: 64251 - RNA, 20 nt, Artificial Sequence
  MKO10064251_A_mmu-mir-511
  gRNA
gugaauguguagcaaaagac

SEQ ID NO: 64252 - RNA, 20 nt, Artificial Sequence
  MKO10064252_A_mmu-mir-511
  gRNA
auguguagcaaaagacagga

SEQ ID NO: 64253 - RNA, 20 nt, Artificial Sequence
  MKO10064253_A_mmu-mir-511
  gRNA
guguagcaaaagacaggaug

SEQ ID NO: 64254 - RNA, 20 nt, Artificial Sequence
  MKO10064254_A_mmu-mir-511
  gRNA
ugcagagcaaaaggcauggu

SEQ ID NO: 64255 - RNA, 20 nt, Artificial Sequence
  MKO10064255_A_mmu-mir-6419
  gRNA
agcagcagcaaucugacaca

SEQ ID NO: 64256 - RNA, 20 nt, Artificial Sequence
  MKO10064256_A_mmu-mir-6419
  gRNA
aagugaacaguagaugagau

SEQ ID NO: 64257 - RNA, 20 nt, Artificial Sequence
  MKO10064257_A_mmu-mir-6419
  gRNA
auuuugaagcagugugagug

SEQ ID NO: 64258 - RNA, 20 nt, Artificial Sequence
  MKO10064258_A_mmu-mir-6419
  gRNA
aguagaugagauaggaaaca

SEQ ID NO: 64259 - RNA, 20 nt, Artificial Sequence
  MKO10064259_A_mmu-mir-7655
  gRNA
ccacuuccgccugcggccca

SEQ ID NO: 64260 - RNA, 20 nt, Artificial Sequence
  MKO10064260_A_mmu-mir-7655
  gRNA
gccggguuuaugacgcuccg

SEQ ID NO: 64261 - RNA, 20 nt, Artificial Sequence
  MKO10064261_A_mmu-mir-7655
  gRNA
uuaggagcuccgugggccgc

SEQ ID NO: 64262 - RNA, 20 nt, Artificial Sequence
  MKO10064262_A_mmu-mir-7655
  gRNA
cgagucuuuaggagcuccgu

SEQ ID NO: 64263 - RNA, 20 nt, Artificial Sequence
  MKO10064263_A_mmu-mir-3967
  gRNA
ugagcuugucugacugaugu

SEQ ID NO: 64264 - RNA, 20 nt, Artificial Sequence
  MKO10064264_A_mmu-mir-3967
  gRNA
ucacuggcugcaccugacuc

SEQ ID NO: 64265 - RNA, 20 nt, Artificial Sequence
  MKO10064265_A_mmu-mir-3967
  gRNA
gaauucuugcugccugaguc

SEQ ID NO: 64266 - RNA, 20 nt, Artificial Sequence
  MKO10064266_A_mmu-mir-7664
  gRNA
caguuuaccugucuaugaga

SEQ ID NO: 64267 - RNA, 20 nt, Artificial Sequence
  MKO10064267_A_mmu-mir-7664
  gRNA
gucuaugagauggaaguacu

SEQ ID NO: 64268 - RNA, 20 nt, Artificial Sequence
  MKO10064268_A_mmu-mir-7664
  gRNA
uacuugguauccuaucucuu

SEQ ID NO: 64269 - RNA, 20 nt, Artificial Sequence
  MKO10064269_A_mmu-mir-7664
  gRNA
ugguauccuaucucuuaggc

SEQ ID NO: 64270 - RNA, 20 nt, Artificial Sequence
  MKO10064270_A_mmu-mir-3087
  gRNA
cuggggcuguagcacagggc

SEQ ID NO: 64271 - RNA, 20 nt, Artificial Sequence
  MKO10064271_A_mmu-mir-3087
  gRNA
ugaggacaugacagugaguu

SEQ ID NO: 64272 - RNA, 20 nt, Artificial Sequence
  MKO10064272_A_mmu-mir-3087
  gRNA
agggcaagaguugagacuua

SEQ ID NO: 64273 - RNA, 20 nt, Artificial Sequence
  MKO10064273_A_mmu-mir-3087
  gRNA
acugucauguccucagauua

SEQ ID NO: 64274 - RNA, 20 nt, Artificial Sequence
  MKO10064274_A_mmu-mir-6996
  gRNA
agagugaccagagacaccgu

SEQ ID NO: 64275 - RNA, 20 nt, Artificial Sequence
  MKO10064275_A_mmu-mir-6996
  gRNA
ggugucucuggucacucugc

SEQ ID NO: 64276 - RNA, 20 nt, Artificial Sequence
  MKO10064276_A_mmu-mir-6996
  gRNA
gcaucauccgacggugucuc

SEQ ID NO: 64277 - RNA, 20 nt, Artificial Sequence
  MKO10064277_A_mmu-mir-6996
  gRNA
gcacagucagcaucauccga

SEQ ID NO: 64278 - RNA, 20 nt, Artificial Sequence
  MKO10064278_A_mmu-mir-126a
  gRNA
ugacagcacauuauuacuuu

SEQ ID NO: 64279 - RNA, 20 nt, Artificial Sequence
  MKO10064279_A_mmu-mir-126a
  gRNA
guaccgugaguaauaaugcg

SEQ ID NO: 64280 - RNA, 20 nt, Artificial Sequence
  MKO10064280_A_mmu-mir-126a
  gRNA
aaguaauaaugugcugucac

SEQ ID NO: 64281 - RNA, 20 nt, Artificial Sequence
  MKO10064281_A_mmu-mir-126a
  gRNA
ugaccgcgcauuauuacuca

SEQ ID NO: 64282 - RNA, 20 nt, Artificial Sequence
  MKO10064282_A_mmu-mir-126b
  gRNA
ugacagcacauuauuacuuu

SEQ ID NO: 64283 - RNA, 20 nt, Artificial Sequence
  MKO10064283_A_mmu-mir-126b
  gRNA
guaccgugaguaauaaugcg

SEQ ID NO: 64284 - RNA, 20 nt, Artificial Sequence
  MKO10064284_A_mmu-mir-126b
  gRNA
ugaccgcgcauuauuacuca

SEQ ID NO: 64285 - RNA, 20 nt, Artificial Sequence
  MKO10064285_A_mmu-mir-126b
  gRNA
aaguaauaaugugcugucac

SEQ ID NO: 64286 - RNA, 20 nt, Artificial Sequence
  MKO10064286_A_mmu-mir-7578
  gRNA
aggcagaagacagagccaug

SEQ ID NO: 64287 - RNA, 20 nt, Artificial Sequence
  MKO10064287_A_mmu-mir-7578
  gRNA
ugaaggagaaaggggcuagg

SEQ ID NO: 64288 - RNA, 20 nt, Artificial Sequence
  MKO10064288_A_mmu-mir-7578
  gRNA
uagugaaggagaaaggggcu

SEQ ID NO: 64289 - RNA, 20 nt, Artificial Sequence
  MKO10064289_A_mmu-mir-7578
  gRNA
gucuuuagugaaggagaaag

SEQ ID NO: 64290 - RNA, 20 nt, Artificial Sequence
  MKO10064290_A_mmu-mir-3088
  gRNA
augcaguuguucaugagcuc

SEQ ID NO: 64291 - RNA, 20 nt, Artificial Sequence
  MKO10064291_A_mmu-mir-3088
  gRNA
agguucaugagcagcugcaa

SEQ ID NO: 64292 - RNA, 20 nt, Artificial Sequence
  MKO10064292_A_mmu-mir-3088
  gRNA
ugcagcugcucaugaaccuu

SEQ ID NO: 64293 - RNA, 20 nt, Artificial Sequence
  MKO10064293_A_mmu-mir-3088
  gRNA
uucaugagcucuggcuccga

SEQ ID NO: 64294 - RNA, 20 nt, Artificial Sequence
  MKO10064294_A_mmu-mir-133c
  gRNA
aaccagccagccgacugcug

SEQ ID NO: 64295 - RNA, 20 nt, Artificial Sequence
  MKO10064295_A_mmu-mir-133c
  gRNA
acugcuggggaugucuccuu

SEQ ID NO: 64296 - RNA, 20 nt, Artificial Sequence
  MKO10064296_A_mmu-mir-133c
  gRNA
ugguccccuucaaggaguca

SEQ ID NO: 64297 - RNA, 20 nt, Artificial Sequence
  MKO10064297_A_mmu-mir-133c
  gRNA
uuucaguuugguccccuuca

SEQ ID NO: 64298 - RNA, 20 nt, Artificial Sequence
  MKO10064298_A_mmu-mir-219a-2
  gRNA
acucguacaagaauugcguu

SEQ ID NO: 64299 - RNA, 20 nt, Artificial Sequence
  MKO10064299_A_mmu-mir-219a-2
  gRNA
aauugcguuuggacaaucag

SEQ ID NO: 64300 - RNA, 20 nt, Artificial Sequence
  MKO10064300_A_mmu-mir-219a-2
  gRNA
gaauuguggcuggacaucug

SEQ ID NO: 64301 - RNA, 20 nt, Artificial Sequence
  MKO10064301_A_mmu-mir-219a-2
  gRNA
gcaauucuuguacgagucug

SEQ ID NO: 64302 - RNA, 20 nt, Artificial Sequence
  MKO10064302_A_mmu-mir-219b
  gRNA
agauguccagccacaauucu

SEQ ID NO: 64303 - RNA, 20 nt, Artificial Sequence
  MKO10064303_A_mmu-mir-219b
  gRNA
ggccaaccgagaauuguggc

SEQ ID NO: 64304 - RNA, 20 nt, Artificial Sequence
  MKO10064304_A_mmu-mir-219b
  gRNA
cugcggccaaccgagaauug

SEQ ID NO: 64305 - RNA, 20 nt, Artificial Sequence
  MKO10064305_A_mmu-mir-219b
  gRNA
guccagccacaauucucggu

SEQ ID NO: 64306 - RNA, 20 nt, Artificial Sequence
  MKO10064306_A_mmu-mir-6997
  gRNA
cucauccccaaguaacaggc

SEQ ID NO: 64307 - RNA, 20 nt, Artificial Sequence
  MKO10064307_A_mmu-mir-6997
  gRNA
ccccaaguaacaggcuggag

SEQ ID NO: 64308 - RNA, 20 nt, Artificial Sequence
  MKO10064308_A_mmu-mir-6997
  gRNA
gaggugcagaacagagucuc

SEQ ID NO: 64309 - RNA, 20 nt, Artificial Sequence
  MKO10064309_A_mmu-mir-6997
  gRNA
aaccuuacccuccuguuucc

SEQ ID NO: 64310 - RNA, 20 nt, Artificial Sequence
  MKO10064310_A_mmu-mir-3089
  gRNA
gguggcuugcaacugaguuc

SEQ ID NO: 64311 - RNA, 20 nt, Artificial Sequence
  MKO10064311_A_mmu-mir-3089
  gRNA
ugcagcuaaaaacacagcuc

SEQ ID NO: 64312 - RNA, 20 nt, Artificial Sequence
  MKO10064312_A_mmu-mir-3089
  gRNA
guuuuuagcugcagaaaccc

SEQ ID NO: 64313 - RNA, 20 nt, Artificial Sequence
  MKO10064313_A_mmu-mir-6998
  gRNA
cccugggugggccugggcag

SEQ ID NO: 64314 - RNA, 20 nt, Artificial Sequence
  MKO10064314_A_mmu-mir-6998
  gRNA
gagcugcucugugcccacac

SEQ ID NO: 64315 - RNA, 20 nt, Artificial Sequence
  MKO10064315_A_mmu-mir-6998
  gRNA
agucacuuugcccucugccc

SEQ ID NO: 64316 - RNA, 20 nt, Artificial Sequence
  MKO10064316_A_mmu-mir-6998
  gRNA
guggcuucccugggugggcc

SEQ ID NO: 64317 - RNA, 20 nt, Artificial Sequence
  MKO10064317_A_mmu-mir-7674
  gRNA
aggugacagugagugaggug

SEQ ID NO: 64318 - RNA, 20 nt, Artificial Sequence
  MKO10064318_A_mmu-mir-7674
  gRNA
gugugggcagcaugaggacu

SEQ ID NO: 64319 - RNA, 20 nt, Artificial Sequence
  MKO10064319_A_mmu-mir-7674
  gRNA
gucccauucucaccgcaccc

SEQ ID NO: 64320 - RNA, 20 nt, Artificial Sequence
  MKO10064320_A_mmu-mir-7674
  gRNA
gcugcucccgaaccugggug

SEQ ID NO: 64321 - RNA, 20 nt, Artificial Sequence
  MKO10064321_A_mmu-mir-199b
  gRNA
aguguuuagacuaccuguuc

SEQ ID NO: 64322 - RNA, 20 nt, Artificial Sequence
  MKO10064322_A_mmu-mir-199b
  gRNA
uuguacaguagucugcacau

SEQ ID NO: 64323 - RNA, 20 nt, Artificial Sequence
  MKO10064323_A_mmu-mir-199b
  gRNA
caguagucugcacauugguu

SEQ ID NO: 64324 - RNA, 20 nt, Artificial Sequence
  MKO10064324_A_mmu-mir-199b
  gRNA
agucugcacauugguuaggc

SEQ ID NO: 64325 - RNA, 20 nt, Artificial Sequence
  MKO10064325_A_mmu-mir-1954
  gRNA
uuguuuguuuguuugagacg

SEQ ID NO: 64326 - RNA, 20 nt, Artificial Sequence
  MKO10064326_A_mmu-mir-1954
  gRNA
gggguuucucuguguagccc

SEQ ID NO: 64327 - RNA, 20 nt, Artificial Sequence
  MKO10064327_A_mmu-mir-1954
  gRNA
aaacaaacaaacaaacaaca

SEQ ID NO: 64328 - RNA, 20 nt, Artificial Sequence
  MKO10064328_A_mmu-mir-1954
  gRNA
agugaguucuaggauagcca

SEQ ID NO: 64329 - RNA, 20 nt, Artificial Sequence
  MKO10064329_A_mmu-mir-8093
  gRNA
ccacugccagguccaccugu

SEQ ID NO: 64330 - RNA, 20 nt, Artificial Sequence
  MKO10064330_A_mmu-mir-8093
  gRNA
gcagaaagcacacagggagc

SEQ ID NO: 64331 - RNA, 20 nt, Artificial Sequence
  MKO10064331_A_mmu-mir-8093
  gRNA
cacucaugcucugcucccca

SEQ ID NO: 64332 - RNA, 20 nt, Artificial Sequence
  MKO10064332_A_mmu-mir-8093
  gRNA
aaggacucagacacagggcu

SEQ ID NO: 64333 - RNA, 20 nt, Artificial Sequence
  MKO10064333_A_mmu-mir-2861
  gRNA
ggugccgagcccgccucuuc

SEQ ID NO: 64334 - RNA, 20 nt, Artificial Sequence
  MKO10064334_A_mmu-mir-2861
  gRNA
uccggucuccgcccgccgcc

SEQ ID NO: 64335 - RNA, 20 nt, Artificial Sequence
  MKO10064335_A_mmu-mir-2861
  gRNA
ccgcccgccgccaggccccc

SEQ ID NO: 64336 - RNA, 20 nt, Artificial Sequence
  MKO10064336_A_mmu-mir-2861
  gRNA
ugggacuuguaguucccggg

SEQ ID NO: 64337 - RNA, 20 nt, Artificial Sequence
  MKO10064337_A_mmu-mir-3960
  gRNA
gccgccgccagcgcuguugg

SEQ ID NO: 64338 - RNA, 20 nt, Artificial Sequence
  MKO10064338_A_mmu-mir-3960
  gRNA
gcgcuguuggcggccccgau

SEQ ID NO: 64339 - RNA, 20 nt, Artificial Sequence
  MKO10064339_A_mmu-mir-3960
  gRNA
gcggccccgaucgggggcgc

SEQ ID NO: 64340 - RNA, 20 nt, Artificial Sequence
  MKO10064340_A_mmu-mir-3960
  gRNA
aucgggggcgcaggaagccg

SEQ ID NO: 64341 - RNA, 20 nt, Artificial Sequence
  MKO10064341_A_mmu-mir-5128
  gRNA
ugcaauuggggcuggcgaga

SEQ ID NO: 64342 - RNA, 20 nt, Artificial Sequence
  MKO10064342_A_mmu-mir-5128
  gRNA
acuaauuuaaaaagugcaau

SEQ ID NO: 64343 - RNA, 20 nt, Artificial Sequence
  MKO10064343_A_mmu-mir-5128
  gRNA
guaaacauucuuaauuacug

SEQ ID NO: 64344 - RNA, 20 nt, Artificial Sequence
  MKO10064344_A_mmu-mir-5128
  gRNA
acuuuuuaaauuaguaaaac

SEQ ID NO: 64345 - RNA, 20 nt, Artificial Sequence
  MKO10064345_A_mmu-mir-181a-2
  gRNA
cgacagcguugaauguucca

SEQ ID NO: 64346 - RNA, 20 nt, Artificial Sequence
  MKO10064346_A_mmu-mir-181a-2
  gRNA
aagguacagucaacggucgg

SEQ ID NO: 64347 - RNA, 20 nt, Artificial Sequence
  MKO10064347_A_mmu-mir-181a-2
  gRNA
gaaucccaagguacagucaa

SEQ ID NO: 64348 - RNA, 20 nt, Artificial Sequence
  MKO10064348_A_mmu-mir-181a-2
  gRNA
cauggaacauucaacgcugu

SEQ ID NO: 64349 - RNA, 20 nt, Artificial Sequence
  MKO10064349_A_mmu-mir-181b-2
  gRNA
ucaacauucauugcugucgg

SEQ ID NO: 64350 - RNA, 20 nt, Artificial Sequence
  MKO10064350_A_mmu-mir-181b-2
  gRNA
gcauucauugaucagugagu

SEQ ID NO: 64351 - RNA, 20 nt, Artificial Sequence
  MKO10064351_A_mmu-mir-181b-2
  gRNA
cacucaacauucauugcugu

SEQ ID NO: 64352 - RNA, 20 nt, Artificial Sequence
  MKO10064352_A_mmu-mir-181b-2
  gRNA
ugaucaaugaaugcaaacug

SEQ ID NO: 64353 - RNA, 20 nt, Artificial Sequence
  MKO10064353_A_mmu-mir-6336
  gRNA
cacaagugucuuucaugaga

SEQ ID NO: 64354 - RNA, 20 nt, Artificial Sequence
  MKO10064354_A_mmu-mir-6336
  gRNA
gcuuacauggauuaaggaug

SEQ ID NO: 64355 - RNA, 20 nt, Artificial Sequence
  MKO10064355_A_mmu-mir-6336
  gRNA
gggcuuacauggauuaagga

SEQ ID NO: 64356 - RNA, 20 nt, Artificial Sequence
  MKO10064356_A_mmu-mir-6336
  gRNA
uguaaaauugagggcuuaca

SEQ ID NO: 64357 - RNA, 20 nt, Artificial Sequence
  MKO10064357_A_mmu-mir-5129
  gRNA
cacugugggaagagaugcac

SEQ ID NO: 64358 - RNA, 20 nt, Artificial Sequence
  MKO10064358_A_mmu-mir-5129
  gRNA
cugugcaucucuucccacag

SEQ ID NO: 64359 - RNA, 20 nt, Artificial Sequence
  MKO10064359_A_mmu-mir-5129
  gRNA
accugaauaugugggggcau

SEQ ID NO: 64360 - RNA, 20 nt, Artificial Sequence
  MKO10064360_A_mmu-mir-5129
  gRNA
cuauucaccugaauaugugg

SEQ ID NO: 64361 - RNA, 20 nt, Artificial Sequence
  MKO10064361_A_mmu-mir-195b
  gRNA
aaaacacagcccaacagcuu

SEQ ID NO: 64362 - RNA, 20 nt, Artificial Sequence
  MKO10064362_A_mmu-mir-195b
  gRNA
aguccuuucuguccccuuuc

SEQ ID NO: 64363 - RNA, 20 nt, Artificial Sequence
  MKO10064363_A_mmu-mir-195b
  gRNA
uaauucaagccaaagcuguu

SEQ ID NO: 64364 - RNA, 20 nt, Artificial Sequence
  MKO10064364_A_mmu-mir-195b
  gRNA
aaaaagacuauaucaguuac

SEQ ID NO: 64365 - RNA, 20 nt, Artificial Sequence
  MKO10064365_A_mmu-mir-6337
  gRNA
cacagagugacauuguuuac

SEQ ID NO: 64366 - RNA, 20 nt, Artificial Sequence
  MKO10064366_A_mmu-mir-6337
  gRNA
caccucuucuuggauagaaa

SEQ ID NO: 64367 - RNA, 20 nt, Artificial Sequence
  MKO10064367_A_mmu-mir-6337
  gRNA
augagggcugcuggguugcu

SEQ ID NO: 64368 - RNA, 20 nt, Artificial Sequence
  MKO10064368_A_mmu-mir-6337
  gRNA
cuguggagaugagggcugcu

SEQ ID NO: 64369 - RNA, 20 nt, Artificial Sequence
  MKO10064369_A_mmu-mir-7224
  gRNA
ggccccucagugaagauuuc

SEQ ID NO: 64370 - RNA, 20 nt, Artificial Sequence
  MKO10064370_A_mmu-mir-7224
  gRNA
acacuuagaucuccacugag

SEQ ID NO: 64371 - RNA, 20 nt, Artificial Sequence
  MKO10064371_A_mmu-mir-7224
  gRNA
guccugaaaucuucacugag

SEQ ID NO: 64372 - RNA, 20 nt, Artificial Sequence
  MKO10064372_A_mmu-mir-7224
  gRNA
guguccugaaaucuucacug

SEQ ID NO: 64373 - RNA, 20 nt, Artificial Sequence
  MKO10064373_A_mmu-mir-6335
  gRNA
auacacagugauauucugca

SEQ ID NO: 64374 - RNA, 20 nt, Artificial Sequence
  MKO10064374_A_mmu-mir-6335
  gRNA
auauucugcauggacagugu

SEQ ID NO: 64375 - RNA, 20 nt, Artificial Sequence
  MKO10064375_A_mmu-mir-6335
  gRNA
aguguagaaugaguuacaug

SEQ ID NO: 64376 - RNA, 20 nt, Artificial Sequence
  MKO10064376_A_mmu-mir-6335
  gRNA
gaaugaguuacaugaggaca

SEQ ID NO: 64377 - RNA, 20 nt, Artificial Sequence
  MKO10064377_A_mmu-mir-10b
  gRNA
ccuguagaaccgaauuugug

SEQ ID NO: 64378 - RNA, 20 nt, Artificial Sequence
  MKO10064378_A_mmu-mir-10b
  gRNA
auagucacagauucgauucu

SEQ ID NO: 64379 - RNA, 20 nt, Artificial Sequence
  MKO10064379_A_mmu-mir-10b
  gRNA
agucacagauucgauucuag

SEQ ID NO: 64380 - RNA, 20 nt, Artificial Sequence
  MKO10064380_A_mmu-mir-10b
  gRNA
cacacaaauucgguucuaca

SEQ ID NO: 64381 - RNA, 20 nt, Artificial Sequence
  MKO10064381_A_mmu-mir-684-1
  gRNA
cagcaagacgcuugacuuga

SEQ ID NO: 64382 - RNA, 20 nt, Artificial Sequence
  MKO10064382_A_mmu-mir-684-1
  gRNA
gggcaaucugucuuuaagua

SEQ ID NO: 64383 - RNA, 20 nt, Artificial Sequence
  MKO10064383_A_mmu-mir-684-1
  gRNA
acuugaagggaaaacuaucu

SEQ ID NO: 64384 - RNA, 20 nt, Artificial Sequence
  MKO10064384_A_mmu-mir-130a
  gRNA
ccuuuuaacauugcacugcu

SEQ ID NO: 64385 - RNA, 20 nt, Artificial Sequence
  MKO10064385_A_mmu-mir-130a
  gRNA
gcacaaugugaaaagagcuc

SEQ ID NO: 64386 - RNA, 20 nt, Artificial Sequence
  MKO10064386_A_mmu-mir-130a
  gRNA
gugcaauguuaaaagggcau

SEQ ID NO: 64387 - RNA, 20 nt, Artificial Sequence
  MKO10064387_A_mmu-mir-130a
  gRNA
cgagcagugcaauguuaaaa

SEQ ID NO: 64388 - RNA, 20 nt, Artificial Sequence
  MKO10064388_A_mmu-mir-6999
  gRNA
gugauggcuuuccuacagaa

SEQ ID NO: 64389 - RNA, 20 nt, Artificial Sequence
  MKO10064389_A_mmu-mir-6999
  gRNA
auggcuuuccuacagaaagg

SEQ ID NO: 64390 - RNA, 20 nt, Artificial Sequence
  MKO10064390_A_mmu-mir-6999
  gRNA
ucagcuguccuccuuucugu

SEQ ID NO: 64391 - RNA, 20 nt, Artificial Sequence
  MKO10064391_A_mmu-mir-6999
  gRNA
agagucagcaagcaccuggc

SEQ ID NO: 64392 - RNA, 20 nt, Artificial Sequence
  MKO10064392_A_mmu-mir-1955
  gRNA
guuuacuuacuacaaguccc

SEQ ID NO: 64393 - RNA, 20 nt, Artificial Sequence
  MKO10064393_A_mmu-mir-1955
  gRNA
cagauaagagcauugcaugc

SEQ ID NO: 64394 - RNA, 20 nt, Artificial Sequence
  MKO10064394_A_mmu-mir-1955
  gRNA
ugcaugcugggacauguagu

SEQ ID NO: 64395 - RNA, 20 nt, Artificial Sequence
  MKO10064395_A_mmu-mir-1955
  gRNA
uguaguugguuuaaauagca

SEQ ID NO: 64396 - RNA, 20 nt, Artificial Sequence
  MKO10064396_A_mmu-mir-7000
  gRNA
cgucuguucuccuggaggac

SEQ ID NO: 64397 - RNA, 20 nt, Artificial Sequence
  MKO10064397_A_mmu-mir-7000
  gRNA
ucuccuggaggacaggcagg

SEQ ID NO: 64398 - RNA, 20 nt, Artificial Sequence
  MKO10064398_A_mmu-mir-7000
  gRNA
ggacaggcaggugggugcug

SEQ ID NO: 64399 - RNA, 20 nt, Artificial Sequence
  MKO10064399_A_mmu-mir-7000
  gRNA
cacccaccugccuguccucc

SEQ ID NO: 64400 - RNA, 20 nt, Artificial Sequence
  MKO10064400_A_mmu-mir-7221
  gRNA
uuuaaccuggguccgucucu

SEQ ID NO: 64401 - RNA, 20 nt, Artificial Sequence
  MKO10064401_A_mmu-mir-7221
  gRNA
uggguccgucucuuggucac

SEQ ID NO: 64402 - RNA, 20 nt, Artificial Sequence
  MKO10064402_A_mmu-mir-7221
  gRNA
guccgucucuuggucacagg

SEQ ID NO: 64403 - RNA, 20 nt, Artificial Sequence
  MKO10064403_A_mmu-mir-7221
  gRNA
ggucagcccugacugugggc

SEQ ID NO: 64404 - RNA, 20 nt, Artificial Sequence
  MKO10064404_A_mmu-mir-7222
  gRNA
uccucucucuggcacuugcc

SEQ ID NO: 64405 - RNA, 20 nt, Artificial Sequence
  MKO10064405_A_mmu-mir-7222
  gRNA
aagugucucauccaggacag

SEQ ID NO: 64406 - RNA, 20 nt, Artificial Sequence
  MKO10064406_A_mmu-mir-7222
  gRNA
ucucauccaggacagugggc

SEQ ID NO: 64407 - RNA, 20 nt, Artificial Sequence
  MKO10064407_A_mmu-mir-7222
  gRNA
aggacagugggcaggagcag

SEQ ID NO: 64408 - RNA, 20 nt, Artificial Sequence
  MKO10064408_A_mmu-mir-7001
  gRNA
aucuccuucuucagcugcag

SEQ ID NO: 64409 - RNA, 20 nt, Artificial Sequence
  MKO10064409_A_mmu-mir-7001
  gRNA
gcagagggagugugagcguc

SEQ ID NO: 64410 - RNA, 20 nt, Artificial Sequence
  MKO10064410_A_mmu-mir-7001
  gRNA
gggagugugagcgucagggc

SEQ ID NO: 64411 - RNA, 20 nt, Artificial Sequence
  MKO10064411_A_mmu-mir-7001
  gRNA
uggacuugaaccugggccuc

SEQ ID NO: 64412 - RNA, 20 nt, Artificial Sequence
  MKO10064412_A_mmu-mir-129-2
  gRNA
cgcccuccgcgaaugcuuuu

SEQ ID NO: 64413 - RNA, 20 nt, Artificial Sequence
  MKO10064413_A_mmu-mir-129-2
  gRNA
cccuccgcgaaugcuuuuug

SEQ ID NO: 64414 - RNA, 20 nt, Artificial Sequence
  MKO10064414_A_mmu-mir-129-2
  gRNA
cgcgaaugcuuuuuggggua

SEQ ID NO: 64415 - RNA, 20 nt, Artificial Sequence
  MKO10064415_A_mmu-mir-129-2
  gRNA
cuuuuugggguaagggcuuc

SEQ ID NO: 64416 - RNA, 20 nt, Artificial Sequence
  MKO10064416_A_mmu-mir-129b
  gRNA
cgcccuccgcgaaugcuuuu

SEQ ID NO: 64417 - RNA, 20 nt, Artificial Sequence
  MKO10064417_A_mmu-mir-129b
  gRNA
cccuccgcgaaugcuuuuug

SEQ ID NO: 64418 - RNA, 20 nt, Artificial Sequence
  MKO10064418_A_mmu-mir-129b
  gRNA
cgcgaaugcuuuuuggggua

SEQ ID NO: 64419 - RNA, 20 nt, Artificial Sequence
  MKO10064419_A_mmu-mir-129b
  gRNA
cuuuuugggguaagggcuuc

SEQ ID NO: 64420 - RNA, 20 nt, Artificial Sequence
  MKO10064420_A_mmu-mir-670
  gRNA
aggcagcugacacuccugaa

SEQ ID NO: 64421 - RNA, 20 nt, Artificial Sequence
  MKO10064421_A_mmu-mir-670
  gRNA
gaauggauaugaggaaaccc

SEQ ID NO: 64422 - RNA, 20 nt, Artificial Sequence
  MKO10064422_A_mmu-mir-670
  gRNA
cagguucaccacauacacuc

SEQ ID NO: 64423 - RNA, 20 nt, Artificial Sequence
  MKO10064423_A_mmu-mir-670
  gRNA
cacauacacucagggauguc

SEQ ID NO: 64424 - RNA, 20 nt, Artificial Sequence
  MKO10064424_A_mmu-mir-1902
  gRNA
aacacucccaaaauaaacuu

SEQ ID NO: 64425 - RNA, 20 nt, Artificial Sequence
  MKO10064425_A_mmu-mir-1902
  gRNA
ugacuugaguagauaaugag

SEQ ID NO: 64426 - RNA, 20 nt, Artificial Sequence
  MKO10064426_A_mmu-mir-1902
  gRNA
aaaauguuuagaggugcagu

SEQ ID NO: 64427 - RNA, 20 nt, Artificial Sequence
  MKO10064427_A_mmu-mir-1902
  gRNA
ggacuugauaaaauguuuag

SEQ ID NO: 64428 - RNA, 20 nt, Artificial Sequence
  MKO10064428_A_mmu-mir-7002
  gRNA
guggggaguagagccuggca

SEQ ID NO: 64429 - RNA, 20 nt, Artificial Sequence
  MKO10064429_A_mmu-mir-7002
  gRNA
ggggaguagagccuggcaag

SEQ ID NO: 64430 - RNA, 20 nt, Artificial Sequence
  MKO10064430_A_mmu-mir-7002
  gRNA
gcuuugugcuuccccuugcc

SEQ ID NO: 64431 - RNA, 20 nt, Artificial Sequence
  MKO10064431_A_mmu-mir-7002
  gRNA
cuuuggcuucggggaguacg

SEQ ID NO: 64432 - RNA, 20 nt, Artificial Sequence
  MKO10064432_A_mmu-mir-1951
  gRNA
uguauagagugcugugggug

SEQ ID NO: 64433 - RNA, 20 nt, Artificial Sequence
  MKO10064433_A_mmu-mir-1951
  gRNA
acuuacuucugaaaguuaaa

SEQ ID NO: 64434 - RNA, 20 nt, Artificial Sequence
  MKO10064434_A_mmu-mir-1951
  gRNA
aguuaaaagguaguggagac

SEQ ID NO: 64435 - RNA, 20 nt, Artificial Sequence
  MKO10064435_A_mmu-mir-1951
  gRNA
aaagguaguggagacuggug

SEQ ID NO: 64436 - RNA, 20 nt, Artificial Sequence
  MKO10064436_A_mmu-mir-674
  gRNA
cccugagccuugcacugaga

SEQ ID NO: 64437 - RNA, 20 nt, Artificial Sequence
  MKO10064437_A_mmu-mir-674
  gRNA
gccuugcacugagaugggag

SEQ ID NO: 64438 - RNA, 20 nt, Artificial Sequence
  MKO10064438_A_mmu-mir-674
  gRNA
acugagaugggaguggugua

SEQ ID NO: 64439 - RNA, 20 nt, Artificial Sequence
  MKO10064439_A_mmu-mir-674
  gRNA
augggagugguguaaggcuc

SEQ ID NO: 64440 - RNA, 20 nt, Artificial Sequence
  MKO10064440_A_mmu-mir-7665
  gRNA
ccauuggggaaaauaaggga

SEQ ID NO: 64441 - RNA, 20 nt, Artificial Sequence
  MKO10064441_A_mmu-mir-7665
  gRNA
aauaagggaaggcaggagaa

SEQ ID NO: 64442 - RNA, 20 nt, Artificial Sequence
  MKO10064442_A_mmu-mir-7665
  gRNA
ggagaaaggcugccuucaua

SEQ ID NO: 64443 - RNA, 20 nt, Artificial Sequence
  MKO10064443_A_mmu-mir-7665
  gRNA
uucauaugguggaagcagcc

SEQ ID NO: 64444 - RNA, 20 nt, Artificial Sequence
  MKO10064444_A_mmu-mir-147
  gRNA
uagauguugaugccagugug

SEQ ID NO: 64445 - RNA, 20 nt, Artificial Sequence
  MKO10064445_A_mmu-mir-147
  gRNA
aaugcuucugcuacauuugu

SEQ ID NO: 64446 - RNA, 20 nt, Artificial Sequence
  MKO10064446_A_mmu-mir-147
  gRNA
gcagaagcauuuccgcacac

SEQ ID NO: 64447 - RNA, 20 nt, Artificial Sequence
  MKO10064447_A_mmu-mir-147
  gRNA
agaacacucuaugaaucuag

SEQ ID NO: 64448 - RNA, 20 nt, Artificial Sequence
  MKO10064448_A_mmu-mir-3473g
  gRNA
acaaauacaaauaugaaggu

SEQ ID NO: 64449 - RNA, 20 nt, Artificial Sequence
  MKO10064449_A_mmu-mir-3473g
  gRNA
aaauaugaagguuggagaga

SEQ ID NO: 64450 - RNA, 20 nt, Artificial Sequence
  MKO10064450_A_mmu-mir-3473g
  gRNA
ugaagguuggagagauggcu

SEQ ID NO: 64451 - RNA, 20 nt, Artificial Sequence
  MKO10064451_A_mmu-mir-3473g
  gRNA
agcacuugcuccacuugcag

SEQ ID NO: 64452 - RNA, 20 nt, Artificial Sequence
  MKO10064452_A_mmu-mir-6339
  gRNA
agaccagcuucccaagcuuu

SEQ ID NO: 64453 - RNA, 20 nt, Artificial Sequence
  MKO10064453_A_mmu-mir-6339
  gRNA
cagccuaacacugaggacaa

SEQ ID NO: 64454 - RNA, 20 nt, Artificial Sequence
  MKO10064454_A_mmu-mir-6339
  gRNA
aggccuaaagcuugggaagc

SEQ ID NO: 64455 - RNA, 20 nt, Artificial Sequence
  MKO10064455_A_mmu-mir-6339
  gRNA
ucacugcaggccuaaagcuu

SEQ ID NO: 64456 - RNA, 20 nt, Artificial Sequence
  MKO10064456_A_mmu-mir-6973b
  gRNA
aggccacucgugccuugccu

SEQ ID NO: 64457 - RNA, 20 nt, Artificial Sequence
  MKO10064457_A_mmu-mir-6973b
  gRNA
guaagagagcacagauggga

SEQ ID NO: 64458 - RNA, 20 nt, Artificial Sequence
  MKO10064458_A_mmu-mir-6973b
  gRNA
gagcacagaugggaaggauu

SEQ ID NO: 64459 - RNA, 20 nt, Artificial Sequence
  MKO10064459_A_mmu-mir-6973b
  gRNA
ucucuuacccuuccuaggca

SEQ ID NO: 64460 - RNA, 20 nt, Artificial Sequence
  MKO10064460_A_mmu-mir-103-2
  gRNA
caggucaagcagcauuguac

SEQ ID NO: 64461 - RNA, 20 nt, Artificial Sequence
  MKO10064461_A_mmu-mir-103-2
  gRNA
ggcuaugaaagaaccaagaa

SEQ ID NO: 64462 - RNA, 20 nt, Artificial Sequence
  MKO10064462_A_mmu-mir-103-2
  gRNA
cccuaagggcagcccauucu

SEQ ID NO: 64463 - RNA, 20 nt, Artificial Sequence
  MKO10064463_A_mmu-mir-103-2
  gRNA
agugcugccuuguagcauuc

SEQ ID NO: 64464 - RNA, 20 nt, Artificial Sequence
  MKO10064464_A_mmu-mir-3090
  gRNA
ugauuccugucccagugguc

SEQ ID NO: 64465 - RNA, 20 nt, Artificial Sequence
  MKO10064465_A_mmu-mir-3090
  gRNA
cccacccagaccacugggac

SEQ ID NO: 64466 - RNA, 20 nt, Artificial Sequence
  MKO10064466_A_mmu-mir-3090
  gRNA
caggccccacccagaccacu

SEQ ID NO: 64467 - RNA, 20 nt, Artificial Sequence
  MKO10064467_A_mmu-mir-3090
  gRNA
cauuagaaauucaggaucuc

SEQ ID NO: 64468 - RNA, 20 nt, Artificial Sequence
  MKO10064468_A_mmu-mir-1952
  gRNA
ucuccacccuccuucugugc

SEQ ID NO: 64469 - RNA, 20 nt, Artificial Sequence
  MKO10064469_A_mmu-mir-1952
  gRNA
uuauuuccugcuccaaggug

SEQ ID NO: 64470 - RNA, 20 nt, Artificial Sequence
  MKO10064470_A_mmu-mir-1952
  gRNA
gguguggaugacaaaagaga

SEQ ID NO: 64471 - RNA, 20 nt, Artificial Sequence
  MKO10064471_A_mmu-mir-1952
  gRNA
ggguggagaucaauaagaga

SEQ ID NO: 64472 - RNA, 20 nt, Artificial Sequence
  MKO10064472_A_mmu-mir-1953
  gRNA
ccccagaucuuagggcugcc

SEQ ID NO: 64473 - RNA, 20 nt, Artificial Sequence
  MKO10064473_A_mmu-mir-1953
  gRNA
aucuuagggcugccaggaag

SEQ ID NO: 64474 - RNA, 20 nt, Artificial Sequence
  MKO10064474_A_mmu-mir-1953
  gRNA
cugagaacuuucccaagacc

SEQ ID NO: 64475 - RNA, 20 nt, Artificial Sequence
  MKO10064475_A_mmu-mir-1953
  gRNA
ucccaagaccaggcagcacc

SEQ ID NO: 64476 - RNA, 20 nt, Artificial Sequence
  MKO10064476_A_mmu-mir-5622
  gRNA
aaauauucuuagcuggguag

SEQ ID NO: 64477 - RNA, 20 nt, Artificial Sequence
  MKO10064477_A_mmu-mir-5622
  gRNA
uauucuuagcuggguagugg

SEQ ID NO: 64478 - RNA, 20 nt, Artificial Sequence
  MKO10064478_A_mmu-mir-5622
  gRNA
aacuuucuuuaagcugggug

SEQ ID NO: 64479 - RNA, 20 nt, Artificial Sequence
  MKO10064479_A_mmu-mir-5622
  gRNA
uuuuaaacuuucuuuaagcu

SEQ ID NO: 64480 - RNA, 20 nt, Artificial Sequence
  MKO10064480_A_mmu-mir-695
  gRNA
cuucacgaggaauccuagau

SEQ ID NO: 64481 - RNA, 20 nt, Artificial Sequence
  MKO10064481_A_mmu-mir-695
  gRNA
aggaauccuagauugggcau

SEQ ID NO: 64482 - RNA, 20 nt, Artificial Sequence
  MKO10064482_A_mmu-mir-695
  gRNA
ugccuuucuuacaaaggcac

SEQ ID NO: 64483 - RNA, 20 nt, Artificial Sequence
  MKO10064483_A_mmu-mir-695
  gRNA
uacaaaggcacugguuaccu

SEQ ID NO: 64484 - RNA, 20 nt, Artificial Sequence
  MKO10064484_A_mmu-mir-499
  gRNA
gcugugauguucacaugcag

SEQ ID NO: 64485 - RNA, 20 nt, Artificial Sequence
  MKO10064485_A_mmu-mir-499
  gRNA
agcugcccacccaagacaca

SEQ ID NO: 64486 - RNA, 20 nt, Artificial Sequence
  MKO10064486_A_mmu-mir-7685
  gRNA
cagcaagggcuugcuccagc

SEQ ID NO: 64487 - RNA, 20 nt, Artificial Sequence
  MKO10064487_A_mmu-mir-7685
  gRNA
cagccggaagccaagucucc

SEQ ID NO: 64488 - RNA, 20 nt, Artificial Sequence
  MKO10064488_A_mmu-mir-7685
  gRNA
ggagacuugaagaaaccgga

SEQ ID NO: 64489 - RNA, 20 nt, Artificial Sequence
  MKO10064489_A_mmu-mir-7685
  gRNA
uccugcaaugccaggagacu

SEQ ID NO: 64490 - RNA, 20 nt, Artificial Sequence
  MKO10064490_A_mmu-mir-3474
  gRNA
acugggccgggagcccuggg

SEQ ID NO: 64491 - RNA, 20 nt, Artificial Sequence
  MKO10064491_A_mmu-mir-3474
  gRNA
gggagcccugggaggagacg

SEQ ID NO: 64492 - RNA, 20 nt, Artificial Sequence
  MKO10064492_A_mmu-mir-3474
  gRNA
gugcaucugcgucuuguucc

SEQ ID NO: 64493 - RNA, 20 nt, Artificial Sequence
  MKO10064493_A_mmu-mir-3474
  gRNA
agaauccacgucuccuccca

SEQ ID NO: 64494 - RNA, 20 nt, Artificial Sequence
  MKO10064494_A_mmu-mir-7003
  gRNA
gcccuucacguucaggugug

SEQ ID NO: 64495 - RNA, 20 nt, Artificial Sequence
  MKO10064495_A_mmu-mir-7003
  gRNA
agccgagagcugcgugucag

SEQ ID NO: 64496 - RNA, 20 nt, Artificial Sequence
  MKO10064496_A_mmu-mir-7003
  gRNA
gagcugcgugucagaggccc

SEQ ID NO: 64497 - RNA, 20 nt, Artificial Sequence
  MKO10064497_A_mmu-mir-7003
  gRNA
aggccccggguuuuccccac

SEQ ID NO: 64498 - RNA, 20 nt, Artificial Sequence
  MKO10064498_A_mmu-mir-7678
  gRNA
auuccuauccagcccuugua

SEQ ID NO: 64499 - RNA, 20 nt, Artificial Sequence
  MKO10064499_A_mmu-mir-7678
  gRNA
cucagcaugcucccuuacaa

SEQ ID NO: 64500 - RNA, 20 nt, Artificial Sequence
  MKO10064500_A_mmu-mir-7678
  gRNA
ucaggcuacaagagaaagua

SEQ ID NO: 64501 - RNA, 20 nt, Artificial Sequence
  MKO10064501_A_mmu-mir-7678
  gRNA
uaaggaaagaccuucaacau

SEQ ID NO: 64502 - RNA, 20 nt, Artificial Sequence
  MKO10064502_A_mmu-mir-7004
  gRNA
cgagaagacagccugcguga

SEQ ID NO: 64503 - RNA, 20 nt, Artificial Sequence
  MKO10064503_A_mmu-mir-7004
  gRNA
agccugcgugaaggagggag

SEQ ID NO: 64504 - RNA, 20 nt, Artificial Sequence
  MKO10064504_A_mmu-mir-7004
  gRNA
gucacugagagucacggcac

SEQ ID NO: 64505 - RNA, 20 nt, Artificial Sequence
  MKO10064505_A_mmu-mir-7004
  gRNA
gcacaggccucauccacgga

SEQ ID NO: 64506 - RNA, 20 nt, Artificial Sequence
  MKO10064506_A_mmu-mir-6340
  gRNA
acugaugccaacccagcguc

SEQ ID NO: 64507 - RNA, 20 nt, Artificial Sequence
  MKO10064507_A_mmu-mir-6340
  gRNA
gaugccaacccagcgucugg

SEQ ID NO: 64508 - RNA, 20 nt, Artificial Sequence
  MKO10064508_A_mmu-mir-6340
  gRNA
caacccagcgucuggcggca

SEQ ID NO: 64509 - RNA, 20 nt, Artificial Sequence
  MKO10064509_A_mmu-mir-6340
  gRNA
cgacccagggccugaccuug

SEQ ID NO: 64510 - RNA, 20 nt, Artificial Sequence
  MKO10064510_A_mmu-mir-296
  gRNA
gacgcucugcggacaccuuc

SEQ ID NO: 64511 - RNA, 20 nt, Artificial Sequence
  MKO10064511_A_mmu-mir-296
  gRNA
gcgagcacaacaggauugag

SEQ ID NO: 64512 - RNA, 20 nt, Artificial Sequence
  MKO10064512_A_mmu-mir-296
  gRNA
gcucgcuucagaggguuggg

SEQ ID NO: 64513 - RNA, 20 nt, Artificial Sequence
  MKO10064513_A_mmu-mir-296
  gRNA
gacaagagggccuuucugga

SEQ ID NO: 64514 - RNA, 20 nt, Artificial Sequence
  MKO10064514_A_mmu-mir-298
  gRNA
cccacuccuaagcugagaga

SEQ ID NO: 64515 - RNA, 20 nt, Artificial Sequence
  MKO10064515_A_mmu-mir-298
  gRNA
gcccuccucugccaaaggcc

SEQ ID NO: 64516 - RNA, 20 nt, Artificial Sequence
  MKO10064516_A_mmu-mir-298
  gRNA
aacuagccuucucucagcuu

SEQ ID NO: 64517 - RNA, 20 nt, Artificial Sequence
  MKO10064517_A_mmu-mir-298
  gRNA
ccuugaguuuuaugacuggg

SEQ ID NO: 64518 - RNA, 20 nt, Artificial Sequence
  MKO10064518_A_mmu-mir-7005
  gRNA
acacuuggaucugcaaggga

SEQ ID NO: 64519 - RNA, 20 nt, Artificial Sequence
  MKO10064519_A_mmu-mir-7005
  gRNA
aagggauggguagcaggcac

SEQ ID NO: 64520 - RNA, 20 nt, Artificial Sequence
  MKO10064520_A_mmu-mir-7005
  gRNA
cugcugguccucccaucccc

SEQ ID NO: 64521 - RNA, 20 nt, Artificial Sequence
  MKO10064521_A_mmu-mir-7005
  gRNA
ggaggaccagcagagaaauu

SEQ ID NO: 64522 - RNA, 20 nt, Artificial Sequence
  MKO10064522_A_mmu-mir-3091
  gRNA
ccgagagugcuugcgggcca

SEQ ID NO: 64523 - RNA, 20 nt, Artificial Sequence
  MKO10064523_A_mmu-mir-3091
  gRNA
gugcuugcgggccauggguc

SEQ ID NO: 64524 - RNA, 20 nt, Artificial Sequence
  MKO10064524_A_mmu-mir-3091
  gRNA
uugcgggccaugggucuggu

SEQ ID NO: 64525 - RNA, 20 nt, Artificial Sequence
  MKO10064525_A_mmu-mir-3091
  gRNA
gaccagucucaagaccugcg

SEQ ID NO: 64526 - RNA, 20 nt, Artificial Sequence
  MKO10064526_A_mmu-mir-1a-1
  gRNA
agaaguauguauuucaggcu

SEQ ID NO: 64527 - RNA, 20 nt, Artificial Sequence
  MKO10064527_A_mmu-mir-1a-1
  gRNA
aagaaguaugugucccaagc

SEQ ID NO: 64528 - RNA, 20 nt, Artificial Sequence
  MKO10064528_A_mmu-mir-1a-1
  gRNA
auagcuuagcagguucauau

SEQ ID NO: 64529 - RNA, 20 nt, Artificial Sequence
  MKO10064529_A_mmu-mir-1a-1
  gRNA
cauaugaaccugcuaagcua

SEQ ID NO: 64530 - RNA, 20 nt, Artificial Sequence
  MKO10064530_A_mmu-mir-133a-2
  gRNA
aauggaaccaaaucagcugu

SEQ ID NO: 64531 - RNA, 20 nt, Artificial Sequence
  MKO10064531_A_mmu-mir-133a-2
  gRNA
aaucagcuguuggauggauu

SEQ ID NO: 64532 - RNA, 20 nt, Artificial Sequence
  MKO10064532_A_mmu-mir-133a-2
  gRNA
accagcuucagcaaagcauu

SEQ ID NO: 64533 - RNA, 20 nt, Artificial Sequence
  MKO10064533_A_mmu-mir-133a-2
  gRNA
aauccauccaacagcugauu

SEQ ID NO: 64534 - RNA, 20 nt, Artificial Sequence
  MKO10064534_A_mmu-mir-124-3
  gRNA
gccccucugcguguucacag

SEQ ID NO: 64535 - RNA, 20 nt, Artificial Sequence
  MKO10064535_A_mmu-mir-124-3
  gRNA
auuuaaugucuauacaauua

SEQ ID NO: 64536 - RNA, 20 nt, Artificial Sequence
  MKO10064536_A_mmu-mir-124-3
  gRNA
cacgcggugaaugccaagag

SEQ ID NO: 64537 - RNA, 20 nt, Artificial Sequence
  MKO10064537_A_mmu-mir-124-3
  gRNA
uccgcugugaacacgcagag

SEQ ID NO: 64538 - RNA, 20 nt, Artificial Sequence
  MKO10064538_A_mmu-mir-7006
  gRNA
ccccacagcccuggggaucc

SEQ ID NO: 64539 - RNA, 20 nt, Artificial Sequence
  MKO10064539_A_mmu-mir-7006
  gRNA
guuucugaccuggaucccca

SEQ ID NO: 64540 - RNA, 20 nt, Artificial Sequence
  MKO10064540_A_mmu-mir-7006
  gRNA
uucuuaccugguuucugacc

SEQ ID NO: 64541 - RNA, 20 nt, Artificial Sequence
  MKO10064541_A_mmu-mir-7006
  gRNA
aaccuggcugauuucuuacc

SEQ ID NO: 64542 - RNA, 20 nt, Artificial Sequence
  MKO10064542_A_mmu-mir-124-2
  gRNA
ucugcucuccguguucacag

SEQ ID NO: 64543 - RNA, 20 nt, Artificial Sequence
  MKO10064543_A_mmu-mir-124-2
  gRNA
gauuuaaugucauacaauua

SEQ ID NO: 64544 - RNA, 20 nt, Artificial Sequence
  MKO10064544_A_mmu-mir-124-2
  gRNA
cacgcggugaaugccaagag

SEQ ID NO: 64545 - RNA, 20 nt, Artificial Sequence
  MKO10064545_A_mmu-mir-124-2
  gRNA
gagccuacggcugcacuuga

SEQ ID NO: 64546 - RNA, 20 nt, Artificial Sequence
  MKO10064546_A_mmu-mir-7007
  gRNA
agcuacagaagaaacgugga

SEQ ID NO: 64547 - RNA, 20 nt, Artificial Sequence
  MKO10064547_A_mmu-mir-7007
  gRNA
cuccacugccucuucugaug

SEQ ID NO: 64548 - RNA, 20 nt, Artificial Sequence
  MKO10064548_A_mmu-mir-7007
  gRNA
agaagaggcaguggaggaga

SEQ ID NO: 64549 - RNA, 20 nt, Artificial Sequence
  MKO10064549_A_mmu-mir-7007
  gRNA
cacaucagaagaggcagugg

SEQ ID NO: 64550 - RNA, 20 nt, Artificial Sequence
  MKO10064550_A_mmu-mir-3092
  gRNA
cuggaauaagauugcaggac

SEQ ID NO: 64551 - RNA, 20 nt, Artificial Sequence
  MKO10064551_A_mmu-mir-3092
  gRNA
gaauaagauugcaggacagg

SEQ ID NO: 64552 - RNA, 20 nt, Artificial Sequence
  MKO10064552_A_mmu-mir-3092
  gRNA
agaucaggaaacugggagaa

SEQ ID NO: 64553 - RNA, 20 nt, Artificial Sequence
  MKO10064553_A_mmu-mir-3092
  gRNA
gagaaaggcauuuuccccuc

SEQ ID NO: 64554 - RNA, 20 nt, Artificial Sequence
  MKO10064554_A_mmu-mir-466q
  gRNA
agaugagauauggcaugcau

SEQ ID NO: 64555 - RNA, 20 nt, Artificial Sequence
  MKO10064555_A_mmu-mir-551b
  gRNA
uauucccagaugugcucuug

SEQ ID NO: 64556 - RNA, 20 nt, Artificial Sequence
  MKO10064556_A_mmu-mir-551b
  gRNA
guggcccaugaaaucaagcu

SEQ ID NO: 64557 - RNA, 20 nt, Artificial Sequence
  MKO10064557_A_mmu-mir-551b
  gRNA
aaucaagcuugggugagacc

SEQ ID NO: 64558 - RNA, 20 nt, Artificial Sequence
  MKO10064558_A_mmu-mir-551b
  gRNA
agaccuggugcagaacagga

SEQ ID NO: 64559 - RNA, 20 nt, Artificial Sequence
  MKO10064559_A_mmu-mir-21b
  gRNA
uuugaggauacucuugcaua

SEQ ID NO: 64560 - RNA, 20 nt, Artificial Sequence
  MKO10064560_A_mmu-mir-21b
  gRNA
auccuucuguacuaucuuuc

SEQ ID NO: 64561 - RNA, 20 nt, Artificial Sequence
  MKO10064561_A_mmu-mir-21b
  gRNA
agccagaaagauaguacaga

SEQ ID NO: 64562 - RNA, 20 nt, Artificial Sequence
  MKO10064562_A_mmu-mir-21b
  gRNA
auuuucucauacuugucuua

SEQ ID NO: 64563 - RNA, 20 nt, Artificial Sequence
  MKO10064563_A_mmu-mir-7008
  gRNA
ugugcuucuugccucuucuc

SEQ ID NO: 64564 - RNA, 20 nt, Artificial Sequence
  MKO10064564_A_mmu-mir-7008
  gRNA
ucaguuagucguacggcucc

SEQ ID NO: 64565 - RNA, 20 nt, Artificial Sequence
  MKO10064565_A_mmu-mir-7008
  gRNA
gcacacgucaguuagucgua

SEQ ID NO: 64566 - RNA, 20 nt, Artificial Sequence
  MKO10064566_A_mmu-mir-7008
  gRNA
acaaaaaacaaccugagaag

SEQ ID NO: 64567 - RNA, 20 nt, Artificial Sequence
  MKO10064567_A_mmu-mir-1897
  gRNA
uggauucuccgugcuuugga

SEQ ID NO: 64568 - RNA, 20 nt, Artificial Sequence
  MKO10064568_A_mmu-mir-1897
  gRNA
ugcuuuggauggagaaagag

SEQ ID NO: 64569 - RNA, 20 nt, Artificial Sequence
  MKO10064569_A_mmu-mir-1897
  gRNA
cuccuucaacucguucuguc

SEQ ID NO: 64570 - RNA, 20 nt, Artificial Sequence
  MKO10064570_A_mmu-mir-1897
  gRNA
ucaacucguucuguccggug

SEQ ID NO: 64571 - RNA, 20 nt, Artificial Sequence
  MKO10064571_A_mmu-mir-6378
  gRNA
uccuuacaaugugggaacaa

SEQ ID NO: 64572 - RNA, 20 nt, Artificial Sequence
  MKO10064572_A_mmu-mir-6378
  gRNA
gccugauuuucucugaaaua

SEQ ID NO: 64573 - RNA, 20 nt, Artificial Sequence
  MKO10064573_A_mmu-mir-6378
  gRNA
cacgcguuucuguuggugau

SEQ ID NO: 64574 - RNA, 20 nt, Artificial Sequence
  MKO10064574_A_mmu-mir-6378
  gRNA
guggcucucgcaugguucac

SEQ ID NO: 64575 - RNA, 20 nt, Artificial Sequence
  MKO10064575_A_mmu-mir-7009
  gRNA
uggacuggagcugcagggag

SEQ ID NO: 64576 - RNA, 20 nt, Artificial Sequence
  MKO10064576_A_mmu-mir-7009
  gRNA
cucagggcccuuuugggguc

SEQ ID NO: 64577 - RNA, 20 nt, Artificial Sequence
  MKO10064577_A_mmu-mir-7009
  gRNA
gacuggagcugcagggagag

SEQ ID NO: 64578 - RNA, 20 nt, Artificial Sequence
  MKO10064578_A_mmu-mir-7009
  gRNA
ggagaggggaaaagagagac

SEQ ID NO: 64579 - RNA, 20 nt, Artificial Sequence
  MKO10064579_A_mmu-mir-6379
  gRNA
ugacucaaccaacuguuugc

SEQ ID NO: 64580 - RNA, 20 nt, Artificial Sequence
  MKO10064580_A_mmu-mir-6379
  gRNA
guuuuacagcuagauaaguc

SEQ ID NO: 64581 - RNA, 20 nt, Artificial Sequence
  MKO10064581_A_mmu-mir-6379
  gRNA
cuuugggaaaaugucuuccc

SEQ ID NO: 64582 - RNA, 20 nt, Artificial Sequence
  MKO10064582_A_mmu-mir-6379
  gRNA
agcaaacaguugguugaguc

SEQ ID NO: 64583 - RNA, 20 nt, Artificial Sequence
  MKO10064583_A_mmu-mir-6377
  gRNA
aguacuugucuuugugaguc

SEQ ID NO: 64584 - RNA, 20 nt, Artificial Sequence
  MKO10064584_A_mmu-mir-6377
  gRNA
cuuaacauaauaauauucag

SEQ ID NO: 64585 - RNA, 20 nt, Artificial Sequence
  MKO10064585_A_mmu-mir-6377
  gRNA
cucacaaagacaaguacuuc

SEQ ID NO: 64586 - RNA, 20 nt, Artificial Sequence
  MKO10064586_A_mmu-mir-8120
  gRNA
ggaaacuuccuggccggcua

SEQ ID NO: 64587 - RNA, 20 nt, Artificial Sequence
  MKO10064587_A_mmu-mir-8120
  gRNA
gcacccccuccggcuagaga

SEQ ID NO: 64588 - RNA, 20 nt, Artificial Sequence
  MKO10064588_A_mmu-mir-8120
  gRNA
cuccggcuagagaaggcguc

SEQ ID NO: 64589 - RNA, 20 nt, Artificial Sequence
  MKO10064589_A_mmu-mir-8120
  gRNA
cuagagaaggcguccggaau

SEQ ID NO: 64590 - RNA, 20 nt, Artificial Sequence
  MKO10064590_A_mmu-mir-15b
  gRNA
aguacuguagcagcacauca

SEQ ID NO: 64591 - RNA, 20 nt, Artificial Sequence
  MKO10064591_A_mmu-mir-15b
  gRNA
uuugcugcucuagaaauuua

SEQ ID NO: 64592 - RNA, 20 nt, Artificial Sequence
  MKO10064592_A_mmu-mir-15b
  gRNA
ugugcugcuacaguacuuua

SEQ ID NO: 64593 - RNA, 20 nt, Artificial Sequence
  MKO10064593_A_mmu-mir-16-2
  gRNA
cucuagcagcacguaaauau

SEQ ID NO: 64594 - RNA, 20 nt, Artificial Sequence
  MKO10064594_A_mmu-mir-16-2
  gRNA
cuaaagcagcacaauaauau

SEQ ID NO: 64595 - RNA, 20 nt, Artificial Sequence
  MKO10064595_A_mmu-mir-16-2
  gRNA
uugugcugcuuuagugugac

SEQ ID NO: 64596 - RNA, 20 nt, Artificial Sequence
  MKO10064596_A_mmu-mir-16-2
  gRNA
auauuuacgugcugcuagag

SEQ ID NO: 64597 - RNA, 20 nt, Artificial Sequence
  MKO10064597_A_mmu-mir-7010
  gRNA
auccauaaccugcaaaggaa

SEQ ID NO: 64598 - RNA, 20 nt, Artificial Sequence
  MKO10064598_A_mmu-mir-7010
  gRNA
ugggaaacuugacuaaugca

SEQ ID NO: 64599 - RNA, 20 nt, Artificial Sequence
  MKO10064599_A_mmu-mir-7010
  gRNA
cucugguuucggaaaggauu

SEQ ID NO: 64600 - RNA, 20 nt, Artificial Sequence
  MKO10064600_A_mmu-mir-7010
  gRNA
uuuccucucugguuucggaa

SEQ ID NO: 64601 - RNA, 20 nt, Artificial Sequence
  MKO10064601_A_mmu-mir-466k
  gRNA
ugcaugugcaugugugugua

SEQ ID NO: 64602 - RNA, 20 nt, Artificial Sequence
  MKO10064602_A_mmu-mir-466k
  gRNA
cauguguguguauggugagu

SEQ ID NO: 64603 - RNA, 20 nt, Artificial Sequence
  MKO10064603_A_mmu-mir-3093
  gRNA
ucggagcagcucugcgagcu

SEQ ID NO: 64604 - RNA, 20 nt, Artificial Sequence
  MKO10064604_A_mmu-mir-3093
  gRNA
cucggcucugccgcaccccg

SEQ ID NO: 64605 - RNA, 20 nt, Artificial Sequence
  MKO10064605_A_mmu-mir-3093
  gRNA
cacacucgaccuuccagaga

SEQ ID NO: 64606 - RNA, 20 nt, Artificial Sequence
  MKO10064606_A_mmu-mir-3093
  gRNA
cgaccuuccagagaagggug

SEQ ID NO: 64607 - RNA, 20 nt, Artificial Sequence
  MKO10064607_A_mmu-mir-9-1
  gRNA
aggcggccaggaggcggggu

SEQ ID NO: 64608 - RNA, 20 nt, Artificial Sequence
  MKO10064608_A_mmu-mir-9-1
  gRNA
gcgggguugguuguuaucuu

SEQ ID NO: 64609 - RNA, 20 nt, Artificial Sequence
  MKO10064609_A_mmu-mir-9-1
  gRNA
ugguuaucuagcuguaugag

SEQ ID NO: 64610 - RNA, 20 nt, Artificial Sequence
  MKO10064610_A_mmu-mir-9-1
  gRNA
aucuagcuguaugaguggug

SEQ ID NO: 64611 - RNA, 20 nt, Artificial Sequence
  MKO10064611_A_mmu-mir-7011
  gRNA
ggcccauggagcacuagagg

SEQ ID NO: 64612 - RNA, 20 nt, Artificial Sequence
  MKO10064612_A_mmu-mir-7011
  gRNA
ccauggagcacuagaggagg

SEQ ID NO: 64613 - RNA, 20 nt, Artificial Sequence
  MKO10064613_A_mmu-mir-7011
  gRNA
agggaggugugcacccacuc

SEQ ID NO: 64614 - RNA, 20 nt, Artificial Sequence
  MKO10064614_A_mmu-mir-7011
  gRNA
cagaggaggaugggagaggg

SEQ ID NO: 64615 - RNA, 20 nt, Artificial Sequence
  MKO10064615_A_mmu-mir-1905
  gRNA
uguacgaguacccuaccgcg

SEQ ID NO: 64616 - RNA, 20 nt, Artificial Sequence
  MKO10064616_A_mmu-mir-1905
  gRNA
acccuaccgcguggugggac

SEQ ID NO: 64617 - RNA, 20 nt, Artificial Sequence
  MKO10064617_A_mmu-mir-1905
  gRNA
cuaccgcguggugggacugg

SEQ ID NO: 64618 - RNA, 20 nt, Artificial Sequence
  MKO10064618_A_mmu-mir-1905
  gRNA
gggacugguggugggcccca

SEQ ID NO: 64619 - RNA, 20 nt, Artificial Sequence
  MKO10064619_A_mmu-mir-92b
  gRNA
gccgggggggccgagggggc

SEQ ID NO: 64620 - RNA, 20 nt, Artificial Sequence
  MKO10064620_A_mmu-mir-92b
  gRNA
gggggggccgagggggccgg

SEQ ID NO: 64621 - RNA, 20 nt, Artificial Sequence
  MKO10064621_A_mmu-mir-92b
  gRNA
gggccgagggggccggaggc

SEQ ID NO: 64622 - RNA, 20 nt, Artificial Sequence
  MKO10064622_A_mmu-mir-92b
  gRNA
gggacgagugcaauauuggc

SEQ ID NO: 64623 - RNA, 20 nt, Artificial Sequence
  MKO10064623_A_mmu-mir-7669
  gRNA
guaagacgagcugggugugg

SEQ ID NO: 64624 - RNA, 20 nt, Artificial Sequence
  MKO10064624_A_mmu-mir-7669
  gRNA
guuguaagacgagcugggug

SEQ ID NO: 64625 - RNA, 20 nt, Artificial Sequence
  MKO10064625_A_mmu-mir-7669
  gRNA
uuguuguuguaagacgagcu

SEQ ID NO: 64626 - RNA, 20 nt, Artificial Sequence
  MKO10064626_A_mmu-mir-7669
  gRNA
acaacaacaaaagcugugua

SEQ ID NO: 64627 - RNA, 20 nt, Artificial Sequence
  MKO10064627_A_mmu-mir-190b
  gRNA
cugugugauauguuugauau

SEQ ID NO: 64628 - RNA, 20 nt, Artificial Sequence
  MKO10064628_A_mmu-mir-190b
  gRNA
agcauacucucacagcagua

SEQ ID NO: 64629 - RNA, 20 nt, Artificial Sequence
  MKO10064629_A_mmu-mir-190b
  gRNA
caaacauaucacacagaagc

SEQ ID NO: 64630 - RNA, 20 nt, Artificial Sequence
  MKO10064630_A_mmu-mir-190b
  gRNA
gaguaugcuugacauucagu

SEQ ID NO: 64631 - RNA, 20 nt, Artificial Sequence
  MKO10064631_A_mmu-mir-7012
  gRNA
gcugggcuggacggaaggag

SEQ ID NO: 64632 - RNA, 20 nt, Artificial Sequence
  MKO10064632_A_mmu-mir-7012
  gRNA
cuggacggaaggagaggagu

SEQ ID NO: 64633 - RNA, 20 nt, Artificial Sequence
  MKO10064633_A_mmu-mir-7012
  gRNA
gcuaugagcauccugaccug

SEQ ID NO: 64634 - RNA, 20 nt, Artificial Sequence
  MKO10064634_A_mmu-mir-7012
  gRNA
ugggagaggagccacagguc

SEQ ID NO: 64635 - RNA, 20 nt, Artificial Sequence
  MKO10064635_A_mmu-mir-7013
  gRNA
cuccccuguucgguaugaag

SEQ ID NO: 64636 - RNA, 20 nt, Artificial Sequence
  MKO10064636_A_mmu-mir-7013
  gRNA
cuuacuguugccucuuccuc

SEQ ID NO: 64637 - RNA, 20 nt, Artificial Sequence
  MKO10064637_A_mmu-mir-7013
  gRNA
uggaucucaagcuacaacac

SEQ ID NO: 64638 - RNA, 20 nt, Artificial Sequence
  MKO10064638_A_mmu-mir-7013
  gRNA
ggcaacaguaaguguggcuu

SEQ ID NO: 64639 - RNA, 20 nt, Artificial Sequence
  MKO10064639_A_mmu-mir-8099-2
  gRNA
uuuccccacucccaagguaa

SEQ ID NO: 64640 - RNA, 20 nt, Artificial Sequence
  MKO10064640_A_mmu-mir-8099-2
  gRNA
cacgccuuggcucugagaga

SEQ ID NO: 64641 - RNA, 20 nt, Artificial Sequence
  MKO10064641_A_mmu-mir-8099-2
  gRNA
ggcucugagagaaggcagcg

SEQ ID NO: 64642 - RNA, 20 nt, Artificial Sequence
  MKO10064642_A_mmu-mir-8099-2
  gRNA
ucugagagaaggcagcgugg

SEQ ID NO: 64643 - RNA, 20 nt, Artificial Sequence
  MKO10064643_A_mmu-mir-7014
  gRNA
ccacagcacccaaagccugc

SEQ ID NO: 64644 - RNA, 20 nt, Artificial Sequence
  MKO10064644_A_mmu-mir-7014
  gRNA
ccagcaggcuuugggugcug

SEQ ID NO: 64645 - RNA, 20 nt, Artificial Sequence
  MKO10064645_A_mmu-mir-7014
  gRNA
caccgaccccagcaggcuuu

SEQ ID NO: 64646 - RNA, 20 nt, Artificial Sequence
  MKO10064646_A_mmu-mir-7014
  gRNA
cggaaucuguuuacuguggu

SEQ ID NO: 64647 - RNA, 20 nt, Artificial Sequence
  MKO10064647_A_mmu-mir-7225
  gRNA
aggugggcaccgugcugcag

SEQ ID NO: 64648 - RNA, 20 nt, Artificial Sequence
  MKO10064648_A_mmu-mir-7225
  gRNA
ugucuagaagcagugccaag

SEQ ID NO: 64649 - RNA, 20 nt, Artificial Sequence
  MKO10064649_A_mmu-mir-7225
  gRNA
ucuagacagccucugcagca

SEQ ID NO: 64650 - RNA, 20 nt, Artificial Sequence
  MKO10064650_A_mmu-mir-7225
  gRNA
agacuguguagaagcccucu

SEQ ID NO: 64651 - RNA, 20 nt, Artificial Sequence
  MKO10064651_A_mmu-mir-6481
  gRNA
ggagcaagccuuuauuuuua

SEQ ID NO: 64652 - RNA, 20 nt, Artificial Sequence
  MKO10064652_A_mmu-mir-6481
  gRNA
cauuaccugaguuuguuaau

SEQ ID NO: 64653 - RNA, 20 nt, Artificial Sequence
  MKO10064653_A_mmu-mir-6481
  gRNA
uaaauccuauuaguuuaguu

SEQ ID NO: 64654 - RNA, 20 nt, Artificial Sequence
  MKO10064654_A_mmu-mir-6481
  gRNA
cacuuaucccauaaaaauaa

SEQ ID NO: 64655 - RNA, 20 nt, Artificial Sequence
  MKO10064655_A_mmu-mir-669n
  gRNA
cagaucuuuacauuugugug

SEQ ID NO: 64656 - RNA, 20 nt, Artificial Sequence
  MKO10064656_A_mmu-mir-669n
  gRNA
aucccacagcacaugugcag

SEQ ID NO: 64657 - RNA, 20 nt, Artificial Sequence
  MKO10064657_A_mmu-mir-669n
  gRNA
agcacaugugcagagggcau

SEQ ID NO: 64658 - RNA, 20 nt, Artificial Sequence
  MKO10064658_A_mmu-mir-669n
  gRNA
gcccucugcacaugugcugu

SEQ ID NO: 64659 - RNA, 20 nt, Artificial Sequence
  MKO10064659_A_mmu-mir-137
  gRNA
ccucugacucucuucgguga

SEQ ID NO: 64660 - RNA, 20 nt, Artificial Sequence
  MKO10064660_A_mmu-mir-137
  gRNA
ucuucggugacggguauucu

SEQ ID NO: 64661 - RNA, 20 nt, Artificial Sequence
  MKO10064661_A_mmu-mir-137
  gRNA
cggugacggguauucuuggg

SEQ ID NO: 64662 - RNA, 20 nt, Artificial Sequence
  MKO10064662_A_mmu-mir-137
  gRNA
guauucuuggguggauaaua

SEQ ID NO: 64663 - RNA, 20 nt, Artificial Sequence
  MKO10064663_A_mmu-mir-760
  gRNA
ggcuucggggaaacgggguu

SEQ ID NO: 64664 - RNA, 20 nt, Artificial Sequence
  MKO10064664_A_mmu-mir-760
  gRNA
gacccagagccgaauuucug

SEQ ID NO: 64665 - RNA, 20 nt, Artificial Sequence
  MKO10064665_A_mmu-mir-760
  gRNA
uuucugagguauccgggcuc

SEQ ID NO: 64666 - RNA, 20 nt, Artificial Sequence
  MKO10064666_A_mmu-mir-760
  gRNA
cugagguauccgggcucugg

SEQ ID NO: 64667 - RNA, 20 nt, Artificial Sequence
  MKO10064667_A_mmu-mir-7657
  gRNA
aaaccaaguugggaauagca

SEQ ID NO: 64668 - RNA, 20 nt, Artificial Sequence
  MKO10064668_A_mmu-mir-7657
  gRNA
uuuccuugcuauucccaacu

SEQ ID NO: 64669 - RNA, 20 nt, Artificial Sequence
  MKO10064669_A_mmu-mir-7657
  gRNA
gaaguaauaguuggauaguu

SEQ ID NO: 64670 - RNA, 20 nt, Artificial Sequence
  MKO10064670_A_mmu-mir-7657
  gRNA
cuagggcgagaaguaauagu

SEQ ID NO: 64671 - RNA, 20 nt, Artificial Sequence
  MKO10064671_A_mmu-mir-302b
  gRNA
gguucccuucaacuuuaaca

SEQ ID NO: 64672 - RNA, 20 nt, Artificial Sequence
  MKO10064672_A_mmu-mir-302b
  gRNA
auucccauguuaaaguugaa

SEQ ID NO: 64673 - RNA, 20 nt, Artificial Sequence
  MKO10064673_A_mmu-mir-302b
  gRNA
aauucacuucuacuaaaaca

SEQ ID NO: 64674 - RNA, 20 nt, Artificial Sequence
  MKO10064674_A_mmu-mir-302b
  gRNA
uugaagggaacccacccaca

SEQ ID NO: 64675 - RNA, 20 nt, Artificial Sequence
  MKO10064675_A_mmu-mir-302c
  gRNA
gaguccccucugcuuuaaca

SEQ ID NO: 64676 - RNA, 20 nt, Artificial Sequence
  MKO10064676_A_mmu-mir-302c
  gRNA
guccccucugcuuuaacaug

SEQ ID NO: 64677 - RNA, 20 nt, Artificial Sequence
  MKO10064677_A_mmu-mir-302c
  gRNA
agugcuuccauguuucagug

SEQ ID NO: 64678 - RNA, 20 nt, Artificial Sequence
  MKO10064678_A_mmu-mir-302c
  gRNA
aaccccauguuaaagcagag

SEQ ID NO: 64679 - RNA, 20 nt, Artificial Sequence
  MKO10064679_A_mmu-mir-302a
  gRNA
ggcuucccaccacuuaaacg

SEQ ID NO: 64680 - RNA, 20 nt, Artificial Sequence
  MKO10064680_A_mmu-mir-302a
  gRNA
aaguaagugcuuccauguuu

SEQ ID NO: 64681 - RNA, 20 nt, Artificial Sequence
  MKO10064681_A_mmu-mir-302a
  gRNA
gugcuuccauguuuugguga

SEQ ID NO: 64682 - RNA, 20 nt, Artificial Sequence
  MKO10064682_A_mmu-mir-302a
  gRNA
uacaaccacguuuaaguggu

SEQ ID NO: 64683 - RNA, 20 nt, Artificial Sequence
  MKO10064683_A_mmu-mir-302d
  gRNA
ccuccuuuacuuuaacaugg

SEQ ID NO: 64684 - RNA, 20 nt, Artificial Sequence
  MKO10064684_A_mmu-mir-302d
  gRNA
agugcuuccauguuugagug

SEQ ID NO: 64685 - RNA, 20 nt, Artificial Sequence
  MKO10064685_A_mmu-mir-302d
  gRNA
ccuccauguuaaaguaaagg

SEQ ID NO: 64686 - RNA, 20 nt, Artificial Sequence
  MKO10064686_A_mmu-mir-302d
  gRNA
gugccuccauguuaaaguaa

SEQ ID NO: 64687 - RNA, 20 nt, Artificial Sequence
  MKO10064687_A_mmu-mir-367
  gRNA
uuggaauugcacuuuagcaa

SEQ ID NO: 64688 - RNA, 20 nt, Artificial Sequence
  MKO10064688_A_mmu-mir-367
  gRNA
uugcacuuuagcaaugguga

SEQ ID NO: 64689 - RNA, 20 nt, Artificial Sequence
  MKO10064689_A_mmu-mir-367
  gRNA
uugcauguuagcaacaguga

SEQ ID NO: 64690 - RNA, 20 nt, Artificial Sequence
  MKO10064690_A_mmu-mir-367
  gRNA
caacucuguugaauagaaau

SEQ ID NO: 64691 - RNA, 20 nt, Artificial Sequence
  MKO10064691_A_mmu-mir-1895
  gRNA
cuccuccuccucguccuccu

SEQ ID NO: 64692 - RNA, 20 nt, Artificial Sequence
  MKO10064692_A_mmu-mir-1895
  gRNA
ccuccuccucguccuccucg

SEQ ID NO: 64693 - RNA, 20 nt, Artificial Sequence
  MKO10064693_A_mmu-mir-1895
  gRNA
ucguccuccucggggggagc

SEQ ID NO: 64694 - RNA, 20 nt, Artificial Sequence
  MKO10064694_A_mmu-mir-1895
  gRNA
ccaacccggccaagaagaag

SEQ ID NO: 64695 - RNA, 20 nt, Artificial Sequence
  MKO10064695_A_mmu-mir-6380
  gRNA
gcaguuaaaagcacuuacag

SEQ ID NO: 64696 - RNA, 20 nt, Artificial Sequence
  MKO10064696_A_mmu-mir-6380
  gRNA
aaagcacuuacagaggaccc

SEQ ID NO: 64697 - RNA, 20 nt, Artificial Sequence
  MKO10064697_A_mmu-mir-6380
  gRNA
ggauacugggaaucagaccu

SEQ ID NO: 64698 - RNA, 20 nt, Artificial Sequence
  MKO10064698_A_mmu-mir-6380
  gRNA
ggugguuguaagcaacuaug

SEQ ID NO: 64699 - RNA, 20 nt, Artificial Sequence
  MKO10064699_A_mmu-mir-1956
  gRNA
cgacuccugaccuucagucc

SEQ ID NO: 64700 - RNA, 20 nt, Artificial Sequence
  MKO10064700_A_mmu-mir-1956
  gRNA
ucaguccagggcugagucag

SEQ ID NO: 64701 - RNA, 20 nt, Artificial Sequence
  MKO10064701_A_mmu-mir-1956
  gRNA
ggagccccgaguggcuuccc

SEQ ID NO: 64702 - RNA, 20 nt, Artificial Sequence
  MKO10064702_A_mmu-mir-1956
  gRNA
ccccgaguggcuucccuggc

SEQ ID NO: 64703 - RNA, 20 nt, Artificial Sequence
  MKO10064703_A_mmu-let-7j
  gRNA
cugaucaugauaauuuccug

SEQ ID NO: 64704 - RNA, 20 nt, Artificial Sequence
  MKO10064704_A_mmu-let-7j
  gRNA
acagcacaaacuaauaccuc

SEQ ID NO: 64705 - RNA, 20 nt, Artificial Sequence
  MKO10064705_A_mmu-let-7j
  gRNA
caggcuuuuaaucugagcaa

SEQ ID NO: 64706 - RNA, 20 nt, Artificial Sequence
  MKO10064706_A_mmu-let-7j
  gRNA
cacuugauuuuuuuaacucc

SEQ ID NO: 64707 - RNA, 20 nt, Artificial Sequence
  MKO10064707_A_mmu-mir-6381
  gRNA
aagcuagcugggaagaggac

SEQ ID NO: 64708 - RNA, 20 nt, Artificial Sequence
  MKO10064708_A_mmu-mir-6381
  gRNA
gccaccaacaaaucugugcu

SEQ ID NO: 64709 - RNA, 20 nt, Artificial Sequence
  MKO10064709_A_mmu-mir-6381
  gRNA
ggaaccaagcacagauuugu

SEQ ID NO: 64710 - RNA, 20 nt, Artificial Sequence
  MKO10064710_A_mmu-mir-6381
  gRNA
uggugacaugagugaacaga

SEQ ID NO: 64711 - RNA, 20 nt, Artificial Sequence
  MKO10064711_A_mmu-mir-3963
  gRNA
aauaucaccagugucagaag

SEQ ID NO: 64712 - RNA, 20 nt, Artificial Sequence
  MKO10064712_A_mmu-mir-3963
  gRNA
gauacaucccacagaguugu

SEQ ID NO: 64713 - RNA, 20 nt, Artificial Sequence
  MKO10064713_A_mmu-mir-3963
  gRNA
aauaucuuacagguuuuagg

SEQ ID NO: 64714 - RNA, 20 nt, Artificial Sequence
  MKO10064714_A_mmu-mir-3963
  gRNA
uuuaauaucuuacagguuuu

SEQ ID NO: 64715 - RNA, 20 nt, Artificial Sequence
  MKO10064715_A_mmu-mir-186
  gRNA
uuuccaaagaauucuccuuu

SEQ ID NO: 64716 - RNA, 20 nt, Artificial Sequence
  MKO10064716_A_mmu-mir-186
  gRNA
ucauuuuauuuuaagcccua

SEQ ID NO: 64717 - RNA, 20 nt, Artificial Sequence
  MKO10064717_A_mmu-mir-186
  gRNA
aagcccuaaggugaauuuuu

SEQ ID NO: 64718 - RNA, 20 nt, Artificial Sequence
  MKO10064718_A_mmu-mir-186
  gRNA
agcccaaaaggagaauucuu

SEQ ID NO: 64719 - RNA, 20 nt, Artificial Sequence
  MKO10064719_A_mmu-mir-3471-2
  gRNA
uuucccaauuagugauaaag

SEQ ID NO: 64720 - RNA, 20 nt, Artificial Sequence
  MKO10064720_A_mmu-mir-3471-2
  gRNA
aauuagugauaaaggggaaa

SEQ ID NO: 64721 - RNA, 20 nt, Artificial Sequence
  MKO10064721_A_mmu-mir-3471-2
  gRNA
aaaggggaaaaggccccuug

SEQ ID NO: 64722 - RNA, 20 nt, Artificial Sequence
  MKO10064722_A_mmu-mir-3471-2
  gRNA
cuugugggugggacaaucuc

SEQ ID NO: 64723 - RNA, 20 nt, Artificial Sequence
  MKO10064723_A_mmu-mir-3471-1
  gRNA
uugaggaaaugccuuacagu

SEQ ID NO: 64724 - RNA, 20 nt, Artificial Sequence
  MKO10064724_A_mmu-mir-3471-1
  gRNA
ugccuuacaguuggaucuca

SEQ ID NO: 64725 - RNA, 20 nt, Artificial Sequence
  MKO10064725_A_mmu-mir-3471-1
  gRNA
ucuguccaguuucuuuuugg

SEQ ID NO: 64726 - RNA, 20 nt, Artificial Sequence
  MKO10064726_A_mmu-mir-3471-1
  gRNA
cuccaugagauccaacugua

SEQ ID NO: 64727 - RNA, 20 nt, Artificial Sequence
  MKO10064727_A_mmu-mir-684-2
  gRNA
acuugaagggaaaacuaucu

SEQ ID NO: 64728 - RNA, 20 nt, Artificial Sequence
  MKO10064728_A_mmu-mir-684-2
  gRNA
agggcaaucugucuuuaagu

SEQ ID NO: 64729 - RNA, 20 nt, Artificial Sequence
  MKO10064729_A_mmu-mir-684-2
  gRNA
aacaagacacuugacuugaa

SEQ ID NO: 64730 - RNA, 20 nt, Artificial Sequence
  MKO10064730_A_mmu-mir-6400
  gRNA
caagcagcaagaaucuccca

SEQ ID NO: 64731 - RNA, 20 nt, Artificial Sequence
  MKO10064731_A_mmu-mir-6400
  gRNA
aggugagcacaugcucacua

SEQ ID NO: 64732 - RNA, 20 nt, Artificial Sequence
  MKO10064732_A_mmu-mir-6400
  gRNA
cuugggagauucuugcugcu

SEQ ID NO: 64733 - RNA, 20 nt, Artificial Sequence
  MKO10064733_A_mmu-mir-6400
  gRNA
agugagcaugugcucaccuu

SEQ ID NO: 64734 - RNA, 20 nt, Artificial Sequence
  MKO10064734_A_mmu-mir-8118
  gRNA
acaaguccccauuccugugu

SEQ ID NO: 64735 - RNA, 20 nt, Artificial Sequence
  MKO10064735_A_mmu-mir-8118
  gRNA
agaaugcuugcagggaccag

SEQ ID NO: 64736 - RNA, 20 nt, Artificial Sequence
  MKO10064736_A_mmu-mir-8118
  gRNA
acuaugccgacacaggaaug

SEQ ID NO: 64737 - RNA, 20 nt, Artificial Sequence
  MKO10064737_A_mmu-mir-8118
  gRNA
ugacuaugccgacacaggaa

SEQ ID NO: 64738 - RNA, 20 nt, Artificial Sequence
  MKO10064738_A_mmu-mir-876
  gRNA
uaucaaaucuagugugguag

SEQ ID NO: 64739 - RNA, 20 nt, Artificial Sequence
  MKO10064739_A_mmu-mir-876
  gRNA
acauaaacugucacgugcua

SEQ ID NO: 64740 - RNA, 20 nt, Artificial Sequence
  MKO10064740_A_mmu-mir-876
  gRNA
aguaauucauagugcuucac

SEQ ID NO: 64741 - RNA, 20 nt, Artificial Sequence
  MKO10064741_A_mmu-mir-876
  gRNA
ucacuauaucaaaucuagug

SEQ ID NO: 64742 - RNA, 20 nt, Artificial Sequence
  MKO10064742_A_mmu-mir-873b
  gRNA
ggaagauuuguggguguucc

SEQ ID NO: 64743 - RNA, 20 nt, Artificial Sequence
  MKO10064743_A_mmu-mir-873b
  gRNA
caggagacugacaaguuccc

SEQ ID NO: 64744 - RNA, 20 nt, Artificial Sequence
  MKO10064744_A_mmu-mir-873b
  gRNA
gucuccugucuauuuucaau

SEQ ID NO: 64745 - RNA, 20 nt, Artificial Sequence
  MKO10064745_A_mmu-mir-873b
  gRNA
acacccacaaaucuuccuac

SEQ ID NO: 64746 - RNA, 20 nt, Artificial Sequence
  MKO10064746_A_mmu-mir-873a
  gRNA
ggaagauuuguggguguucc

SEQ ID NO: 64747 - RNA, 20 nt, Artificial Sequence
  MKO10064747_A_mmu-mir-873a
  gRNA
caggagacugacaaguuccc

SEQ ID NO: 64748 - RNA, 20 nt, Artificial Sequence
  MKO10064748_A_mmu-mir-873a
  gRNA
gucuccugucuauuuucaau

SEQ ID NO: 64749 - RNA, 20 nt, Artificial Sequence
  MKO10064749_A_mmu-mir-873a
  gRNA
acacccacaaaucuuccuac

SEQ ID NO: 64750 - RNA, 20 nt, Artificial Sequence
  MKO10064750_A_mmu-mir-207
  gRNA
gcacgcgcggagcaaggcag

SEQ ID NO: 64751 - RNA, 20 nt, Artificial Sequence
  MKO10064751_A_mmu-mir-207
  gRNA
cgcggagcaaggcaggggug

SEQ ID NO: 64752 - RNA, 20 nt, Artificial Sequence
  MKO10064752_A_mmu-mir-207
  gRNA
caggggugaggggcugcggg

SEQ ID NO: 64753 - RNA, 20 nt, Artificial Sequence
  MKO10064753_A_mmu-mir-207
  gRNA
ugaggggcugcgggaggagc

SEQ ID NO: 64754 - RNA, 20 nt, Artificial Sequence
  MKO10064754_A_mmu-mir-5123
  gRNA
guguguagauccauaugcca

SEQ ID NO: 64755 - RNA, 20 nt, Artificial Sequence
  MKO10064755_A_mmu-mir-5123
  gRNA
guguguagacccauaugcca

SEQ ID NO: 64756 - RNA, 20 nt, Artificial Sequence
  MKO10064756_A_mmu-mir-5123
  gRNA
guguguagauccauaugcca

SEQ ID NO: 64757 - RNA, 20 nt, Artificial Sequence
  MKO10064757_A_mmu-mir-5123
  gRNA
guguguagacccauaugcca

SEQ ID NO: 64758 - RNA, 20 nt, Artificial Sequence
  MKO10064758_A_mmu-mir-3094
  gRNA
uuggggacauuuuuaaagca

SEQ ID NO: 64759 - RNA, 20 nt, Artificial Sequence
  MKO10064759_A_mmu-mir-3094
  gRNA
gacauuuuuaaagcauggau

SEQ ID NO: 64760 - RNA, 20 nt, Artificial Sequence
  MKO10064760_A_mmu-mir-3094
  gRNA
cacuugaggacacaauuuaa

SEQ ID NO: 64761 - RNA, 20 nt, Artificial Sequence
  MKO10064761_A_mmu-mir-3094
  gRNA
cugccacaguagcacacuug

SEQ ID NO: 64762 - RNA, 20 nt, Artificial Sequence
  MKO10064762_A_mmu-mir-5106
  gRNA
uacagaccuaggcccuagau

SEQ ID NO: 64763 - RNA, 20 nt, Artificial Sequence
  MKO10064763_A_mmu-mir-5106
  gRNA
cgagagccuaucuagggccu

SEQ ID NO: 64764 - RNA, 20 nt, Artificial Sequence
  MKO10064764_A_mmu-mir-5106
  gRNA
acaacccgagagccuaucua

SEQ ID NO: 64765 - RNA, 20 nt, Artificial Sequence
  MKO10064765_A_mmu-mir-5106
  gRNA
gccaacugagcuacagaccu

SEQ ID NO: 64766 - RNA, 20 nt, Artificial Sequence
  MKO10064766_A_mmu-mir-5120
  gRNA
gaccauggaagccugucuga

SEQ ID NO: 64767 - RNA, 20 nt, Artificial Sequence
  MKO10064767_A_mmu-mir-5120
  gRNA
cuccacucugucacagcugg

SEQ ID NO: 64768 - RNA, 20 nt, Artificial Sequence
  MKO10064768_A_mmu-mir-5120
  gRNA
ugguggcaccacagccccaa

SEQ ID NO: 64769 - RNA, 20 nt, Artificial Sequence
  MKO10064769_A_mmu-mir-5120
  gRNA
uggcagcagccccuucagac

SEQ ID NO: 64770 - RNA, 20 nt, Artificial Sequence
  MKO10064770_A_mmu-mir-1958
  gRNA
gcaguuagaaauuaaacuau

SEQ ID NO: 64771 - RNA, 20 nt, Artificial Sequence
  MKO10064771_A_mmu-mir-1958
  gRNA
gaaauuaaacuauaggaaag

SEQ ID NO: 64772 - RNA, 20 nt, Artificial Sequence
  MKO10064772_A_mmu-mir-1958
  gRNA
gaagcaguaaguucucuucu

SEQ ID NO: 64773 - RNA, 20 nt, Artificial Sequence
  MKO10064773_A_mmu-mir-1958
  gRNA
gaagcaguaaguucucuucu

SEQ ID NO: 64774 - RNA, 20 nt, Artificial Sequence
  MKO10064774_A_mmu-mir-32
  gRNA
acacacacuaaauugcauug

SEQ ID NO: 64775 - RNA, 20 nt, Artificial Sequence
  MKO10064775_A_mmu-mir-32
  gRNA
uacuaaguugcauguuguca

SEQ ID NO: 64776 - RNA, 20 nt, Artificial Sequence
  MKO10064776_A_mmu-mir-3095
  gRNA
agaugagaaagcuugugcac

SEQ ID NO: 64777 - RNA, 20 nt, Artificial Sequence
  MKO10064777_A_mmu-mir-3095
  gRNA
aaagcuugugcacagggcuc

SEQ ID NO: 64778 - RNA, 20 nt, Artificial Sequence
  MKO10064778_A_mmu-mir-3095
  gRNA
ugguuucagggaguggacac

SEQ ID NO: 64779 - RNA, 20 nt, Artificial Sequence
  MKO10064779_A_mmu-mir-3095
  gRNA
cucgagaugguuucagggag

SEQ ID NO: 64780 - RNA, 20 nt, Artificial Sequence
  MKO10064780_A_mmu-mir-455
  gRNA
ggugugagcguaugugccuu

SEQ ID NO: 64781 - RNA, 20 nt, Artificial Sequence
  MKO10064781_A_mmu-mir-455
  gRNA
acgcagcaccaugcagucca

SEQ ID NO: 64782 - RNA, 20 nt, Artificial Sequence
  MKO10064782_A_mmu-mir-455
  gRNA
gcguucacgauguaguccaa

SEQ ID NO: 64783 - RNA, 20 nt, Artificial Sequence
  MKO10064783_A_mmu-mir-455
  gRNA
gaggcaaguguauaugcccg

SEQ ID NO: 64784 - RNA, 20 nt, Artificial Sequence
  MKO10064784_A_mmu-mir-491
  gRNA
gcugugggaauugacuuagc

SEQ ID NO: 64785 - RNA, 20 nt, Artificial Sequence
  MKO10064785_A_mmu-mir-491
  gRNA
gaauugacuuagcugggaag

SEQ ID NO: 64786 - RNA, 20 nt, Artificial Sequence
  MKO10064786_A_mmu-mir-491
  gRNA
auugacuuagcugggaagug

SEQ ID NO: 64787 - RNA, 20 nt, Artificial Sequence
  MKO10064787_A_mmu-mir-491
  gRNA
aaguggggaacccuuccaug

SEQ ID NO: 64788 - RNA, 20 nt, Artificial Sequence
  MKO10064788_A_mmu-mir-31
  gRNA
caggaaagauggcaauaugu

SEQ ID NO: 64789 - RNA, 20 nt, Artificial Sequence
  MKO10064789_A_mmu-mir-31
  gRNA
uggcaauauguuggcauagc

SEQ ID NO: 64790 - RNA, 20 nt, Artificial Sequence
  MKO10064790_A_mmu-mir-31
  gRNA
uuuccugucugacagcagcu

SEQ ID NO: 64791 - RNA, 20 nt, Artificial Sequence
  MKO10064791_A_mmu-mir-31
  gRNA
cuggagaggaggcaagaugc

SEQ ID NO: 64792 - RNA, 20 nt, Artificial Sequence
  MKO10064792_A_mmu-mir-6402
  gRNA
gcucucugagcaguuuuccc

SEQ ID NO: 64793 - RNA, 20 nt, Artificial Sequence
  MKO10064793_A_mmu-mir-6402
  gRNA
caauaaugcaugccugggau

SEQ ID NO: 64794 - RNA, 20 nt, Artificial Sequence
  MKO10064794_A_mmu-mir-6402
  gRNA
acugacuuugugcggguucc

SEQ ID NO: 64795 - RNA, 20 nt, Artificial Sequence
  MKO10064795_A_mmu-mir-6402
  gRNA
aguuauaauauucccauccc

SEQ ID NO: 64796 - RNA, 20 nt, Artificial Sequence
  MKO10064796_A_mmu-mir-872
  gRNA
guagaugguaacuuguuaga

SEQ ID NO: 64797 - RNA, 20 nt, Artificial Sequence
  MKO10064797_A_mmu-mir-872
  gRNA
agaagguuacuuguuaguuc

SEQ ID NO: 64798 - RNA, 20 nt, Artificial Sequence
  MKO10064798_A_mmu-mir-872
  gRNA
uauugcaguagccuccuaac

SEQ ID NO: 64799 - RNA, 20 nt, Artificial Sequence
  MKO10064799_A_mmu-mir-872
  gRNA
ggaggcuacugcaauaguuc

SEQ ID NO: 64800 - RNA, 20 nt, Artificial Sequence
  MKO10064800_A_mmu-mir-101a
  gRNA
agcacugugauaacugagcc

SEQ ID NO: 64801 - RNA, 20 nt, Artificial Sequence
  MKO10064801_A_mmu-mir-101a
  gRNA
uacaguacugugauaacuga

SEQ ID NO: 64802 - RNA, 20 nt, Artificial Sequence
  MKO10064802_A_mmu-mir-101a
  gRNA
cggugacugacaggcugccc

SEQ ID NO: 64803 - RNA, 20 nt, Artificial Sequence
  MKO10064803_A_mmu-mir-101a
  gRNA
acaguacuguaccuuuagaa

SEQ ID NO: 64804 - RNA, 20 nt, Artificial Sequence
  MKO10064804_A_mmu-mir-6397
  gRNA
aagaauccuggauaugcaug

SEQ ID NO: 64805 - RNA, 20 nt, Artificial Sequence
  MKO10064805_A_mmu-mir-6397
  gRNA
cgauuucuggagacuuucag

SEQ ID NO: 64806 - RNA, 20 nt, Artificial Sequence
  MKO10064806_A_mmu-mir-6397
  gRNA
uucuuucagugagaauuuga

SEQ ID NO: 64807 - RNA, 20 nt, Artificial Sequence
  MKO10064807_A_mmu-mir-6397
  gRNA
aaaucgccucaugcauaucc

SEQ ID NO: 64808 - RNA, 20 nt, Artificial Sequence
  MKO10064808_A_mmu-mir-761
  gRNA
auggcaaguggaggagcagc

SEQ ID NO: 64809 - RNA, 20 nt, Artificial Sequence
  MKO10064809_A_mmu-mir-761
  gRNA
gcauuuggcaggauggcaag

SEQ ID NO: 64810 - RNA, 20 nt, Artificial Sequence
  MKO10064810_A_mmu-mir-761
  gRNA
uuuggcaggauggcaagugg

SEQ ID NO: 64811 - RNA, 20 nt, Artificial Sequence
  MKO10064811_A_mmu-mir-761
  gRNA
gggugaaacugacacagugc

SEQ ID NO: 64812 - RNA, 20 nt, Artificial Sequence
  MKO10064812_A_mmu-mir-7226
  gRNA
caccagcacugcucagagaa

SEQ ID NO: 64813 - RNA, 20 nt, Artificial Sequence
  MKO10064813_A_mmu-mir-7226
  gRNA
gcucagagaauggcuguguc

SEQ ID NO: 64814 - RNA, 20 nt, Artificial Sequence
  MKO10064814_A_mmu-mir-7226
  gRNA
cuucacacaaucaacuuccc

SEQ ID NO: 64815 - RNA, 20 nt, Artificial Sequence
  MKO10064815_A_mmu-mir-7226
  gRNA
caaucaacuucccuggccuu

SEQ ID NO: 64816 - RNA, 20 nt, Artificial Sequence
  MKO10064816_A_mmu-mir-1957a
  gRNA
acagcuggaaaguagcucag

SEQ ID NO: 64817 - RNA, 20 nt, Artificial Sequence
  MKO10064817_A_mmu-mir-1957a
  gRNA
gcauaugaccagcaugugca

SEQ ID NO: 64818 - RNA, 20 nt, Artificial Sequence
  MKO10064818_A_mmu-mir-1957a
  gRNA
acucagggccuugcacaugc

SEQ ID NO: 64819 - RNA, 20 nt, Artificial Sequence
  MKO10064819_A_mmu-mir-1957a
  gRNA
cagugcuggggauaaacuca

SEQ ID NO: 64820 - RNA, 20 nt, Artificial Sequence
  MKO10064820_A_mmu-mir-30c-1
  gRNA
gagcucacagcugagagugu

SEQ ID NO: 64821 - RNA, 20 nt, Artificial Sequence
  MKO10064821_A_mmu-mir-30c-1
  gRNA
agcucaagguggcugggaga

SEQ ID NO: 64822 - RNA, 20 nt, Artificial Sequence
  MKO10064822_A_mmu-mir-30c-1
  gRNA
gcugugagcucaagguggcu

SEQ ID NO: 64823 - RNA, 20 nt, Artificial Sequence
  MKO10064823_A_mmu-mir-30c-1
  gRNA
cugacguuuuccauggcaga

SEQ ID NO: 64824 - RNA, 20 nt, Artificial Sequence
  MKO10064824_A_mmu-mir-30e
  gRNA
caccuuacagcuuccaguca

SEQ ID NO: 64825 - RNA, 20 nt, Artificial Sequence
  MKO10064825_A_mmu-mir-30e
  gRNA
uuucagucggauguuuacag

SEQ ID NO: 64826 - RNA, 20 nt, Artificial Sequence
  MKO10064826_A_mmu-mir-30e
  gRNA
uguugagaggagcuuucagu

SEQ ID NO: 64827 - RNA, 20 nt, Artificial Sequence
  MKO10064827_A_mmu-mir-30e
  gRNA
caggcugccacagucguccc

SEQ ID NO: 64828 - RNA, 20 nt, Artificial Sequence
  MKO10064828_A_mmu-mir-30f
  gRNA
caccuuacagcuuccaguca

SEQ ID NO: 64829 - RNA, 20 nt, Artificial Sequence
  MKO10064829_A_mmu-mir-30f
  gRNA
uuucagucggauguuuacag

SEQ ID NO: 64830 - RNA, 20 nt, Artificial Sequence
  MKO10064830_A_mmu-mir-30f
  gRNA
uguugagaggagcuuucagu

SEQ ID NO: 64831 - RNA, 20 nt, Artificial Sequence
  MKO10064831_A_mmu-mir-30f
  gRNA
caggcugccacagucguccc

SEQ ID NO: 64832 - RNA, 20 nt, Artificial Sequence
  MKO10064832_A_mmu-mir-7015
  gRNA
gaaccuacagccuagugcag

SEQ ID NO: 64833 - RNA, 20 nt, Artificial Sequence
  MKO10064833_A_mmu-mir-7015
  gRNA
ccuacugcacagagggcaac

SEQ ID NO: 64834 - RNA, 20 nt, Artificial Sequence
  MKO10064834_A_mmu-mir-7015
  gRNA
uucucacuguccucugcacu

SEQ ID NO: 64835 - RNA, 20 nt, Artificial Sequence
  MKO10064835_A_mmu-mir-7015
  gRNA
ccuguugcccucugugcagu

SEQ ID NO: 64836 - RNA, 20 nt, Artificial Sequence
  MKO10064836_A_mmu-mir-6398
  gRNA
aaggauagucuuuuuuuuug

SEQ ID NO: 64837 - RNA, 20 nt, Artificial Sequence
  MKO10064837_A_mmu-mir-6398
  gRNA
ggauagucuuuuuuuuuggg

SEQ ID NO: 64838 - RNA, 20 nt, Artificial Sequence
  MKO10064838_A_mmu-mir-6398
  gRNA
auagucuuuuuuuuuggggg

SEQ ID NO: 64839 - RNA, 20 nt, Artificial Sequence
  MKO10064839_A_mmu-mir-6398
  gRNA
auuuuuguuuaugaguggag

SEQ ID NO: 64840 - RNA, 20 nt, Artificial Sequence
  MKO10064840_A_mmu-mir-697
  gRNA
uggggauguguccuggaugu

SEQ ID NO: 64841 - RNA, 20 nt, Artificial Sequence
  MKO10064841_A_mmu-mir-697
  gRNA
uccuggauguuggucuugac

SEQ ID NO: 64842 - RNA, 20 nt, Artificial Sequence
  MKO10064842_A_mmu-mir-697
  gRNA
uuggucuugacaggucucag

SEQ ID NO: 64843 - RNA, 20 nt, Artificial Sequence
  MKO10064843_A_mmu-mir-697
  gRNA
acuaccacacauugaagggg

SEQ ID NO: 64844 - RNA, 20 nt, Artificial Sequence
  MKO10064844_A_mmu-mir-698
  gRNA
ucaucucugcccucacugua

SEQ ID NO: 64845 - RNA, 20 nt, Artificial Sequence
  MKO10064845_A_mmu-mir-698
  gRNA
cucugcccucacuguaaggg

SEQ ID NO: 64846 - RNA, 20 nt, Artificial Sequence
  MKO10064846_A_mmu-mir-698
  gRNA
gcccucacuguaagggaggg

SEQ ID NO: 64847 - RNA, 20 nt, Artificial Sequence
  MKO10064847_A_mmu-mir-698
  gRNA
cucacuguaagggagggugg

SEQ ID NO: 64848 - RNA, 20 nt, Artificial Sequence
  MKO10064848_A_mmu-mir-692-3
  gRNA
accaaccuccgcaggguggc

SEQ ID NO: 64849 - RNA, 20 nt, Artificial Sequence
  MKO10064849_A_mmu-mir-692-3
  gRNA
gggccacaaccagcgcagac

SEQ ID NO: 64850 - RNA, 20 nt, Artificial Sequence
  MKO10064850_A_mmu-mir-692-3
  gRNA
agcgcagacuggcgcgcccc

SEQ ID NO: 64851 - RNA, 20 nt, Artificial Sequence
  MKO10064851_A_mmu-mir-692-3
  gRNA
cacucucaagcacgacuagg

SEQ ID NO: 64852 - RNA, 20 nt, Artificial Sequence
  MKO10064852_A_mmu-mir-7119
  gRNA
aggacaaaggacugggggau

SEQ ID NO: 64853 - RNA, 20 nt, Artificial Sequence
  MKO10064853_A_mmu-mir-7119
  gRNA
uuuuucuuuuuuuaaaaaga

SEQ ID NO: 64854 - RNA, 20 nt, Artificial Sequence
  MKO10064854_A_mmu-mir-7119
  gRNA
ucaucagaaucuggaggaaa

SEQ ID NO: 64855 - RNA, 20 nt, Artificial Sequence
  MKO10064855_A_mmu-mir-7119
  gRNA
aucucuucaucagaaucugg

SEQ ID NO: 64856 - RNA, 20 nt, Artificial Sequence
  MKO10064856_A_mmu-mir-8119
  gRNA
cggaugggcagcugcggggu

SEQ ID NO: 64857 - RNA, 20 nt, Artificial Sequence
  MKO10064857_A_mmu-mir-8119
  gRNA
cgggguaggaaaugaggcug

SEQ ID NO: 64858 - RNA, 20 nt, Artificial Sequence
  MKO10064858_A_mmu-mir-8119
  gRNA
uucuuuccguuucuccagcc

SEQ ID NO: 64859 - RNA, 20 nt, Artificial Sequence
  MKO10064859_A_mmu-mir-8119
  gRNA
gaggagaggagagggagcua

SEQ ID NO: 64860 - RNA, 20 nt, Artificial Sequence
  MKO10064860_A_mmu-mir-7016
  gRNA
auguguauucuggggagagc

SEQ ID NO: 64861 - RNA, 20 nt, Artificial Sequence
  MKO10064861_A_mmu-mir-7016
  gRNA
uucuggggagagcaggaggc

SEQ ID NO: 64862 - RNA, 20 nt, Artificial Sequence
  MKO10064862_A_mmu-mir-7016
  gRNA
gggagagcaggaggcagguc

SEQ ID NO: 64863 - RNA, 20 nt, Artificial Sequence
  MKO10064863_A_mmu-mir-7016
  gRNA
ggagcgagaguaggccacua

SEQ ID NO: 64864 - RNA, 20 nt, Artificial Sequence
  MKO10064864_A_mmu-mir-7017
  gRNA
ucccagaggguugugagacu

SEQ ID NO: 64865 - RNA, 20 nt, Artificial Sequence
  MKO10064865_A_mmu-mir-7017
  gRNA
aacccugcuccucucccucc

SEQ ID NO: 64866 - RNA, 20 nt, Artificial Sequence
  MKO10064866_A_mmu-mir-7017
  gRNA
cccuagucucacaacccucu

SEQ ID NO: 64867 - RNA, 20 nt, Artificial Sequence
  MKO10064867_A_mmu-mir-7017
  gRNA
ggagggagaggagcaggguu

SEQ ID NO: 64868 - RNA, 20 nt, Artificial Sequence
  MKO10064868_A_mmu-mir-5122
  gRNA
gaggcaucaguccgcuaccg

SEQ ID NO: 64869 - RNA, 20 nt, Artificial Sequence
  MKO10064869_A_mmu-mir-5122
  gRNA
guccgcuaccgcgggacccg

SEQ ID NO: 64870 - RNA, 20 nt, Artificial Sequence
  MKO10064870_A_mmu-mir-5122
  gRNA
gcgggacccggggcuguguc

SEQ ID NO: 64871 - RNA, 20 nt, Artificial Sequence
  MKO10064871_A_mmu-mir-5122
  gRNA
acccggggcugugucagguc

SEQ ID NO: 64872 - RNA, 20 nt, Artificial Sequence
  MKO10064872_A_mmu-mir-7227
  gRNA
auuucucugaaaagggucau

SEQ ID NO: 64873 - RNA, 20 nt, Artificial Sequence
  MKO10064873_A_mmu-mir-7227
  gRNA
acuugcuauuucucugaaaa

SEQ ID NO: 64874 - RNA, 20 nt, Artificial Sequence
  MKO10064874_A_mmu-mir-7227
  gRNA
augaaaaagucaucagagua

SEQ ID NO: 64875 - RNA, 20 nt, Artificial Sequence
  MKO10064875_A_mmu-mir-6403
  gRNA
gccccgcccccagauggcuc

SEQ ID NO: 64876 - RNA, 20 nt, Artificial Sequence
  MKO10064876_A_mmu-mir-6403
  gRNA
cccgcccccagauggcucag

SEQ ID NO: 64877 - RNA, 20 nt, Artificial Sequence
  MKO10064877_A_mmu-mir-6403
  gRNA
uggcucaggggcucugccac

SEQ ID NO: 64878 - RNA, 20 nt, Artificial Sequence
  MKO10064878_A_mmu-mir-6403
  gRNA
cgccuuugccaaguugcuaa

SEQ ID NO: 64879 - RNA, 20 nt, Artificial Sequence
  MKO10064879_A_mmu-mir-700
  gRNA
gugcaccaccacacuggggg

SEQ ID NO: 64880 - RNA, 20 nt, Artificial Sequence
  MKO10064880_A_mmu-mir-700
  gRNA
ucuccccugcaagcacagga

SEQ ID NO: 64881 - RNA, 20 nt, Artificial Sequence
  MKO10064881_A_mmu-mir-700
  gRNA
aggagccuuacucccaguga

SEQ ID NO: 64882 - RNA, 20 nt, Artificial Sequence
  MKO10064882_A_mmu-mir-700
  gRNA
aaccgaguccacccccagug

SEQ ID NO: 64883 - RNA, 20 nt, Artificial Sequence
  MKO10064883_A_mmu-mir-7018
  gRNA
caaagugagcagacagggag

SEQ ID NO: 64884 - RNA, 20 nt, Artificial Sequence
  MKO10064884_A_mmu-mir-7018
  gRNA
agugagcagacagggagugg

SEQ ID NO: 64885 - RNA, 20 nt, Artificial Sequence
  MKO10064885_A_mmu-mir-7018
  gRNA
ugagcagacagggaguggug

SEQ ID NO: 64886 - RNA, 20 nt, Artificial Sequence
  MKO10064886_A_mmu-mir-7018
  gRNA
uggugggggaagucuucucc

SEQ ID NO: 64887 - RNA, 20 nt, Artificial Sequence
  MKO10064887_A_mmu-mir-6399
  gRNA
guugcaaugaugguauucug

SEQ ID NO: 64888 - RNA, 20 nt, Artificial Sequence
  MKO10064888_A_mmu-mir-6399
  gRNA
uugauccuugaaccuuuuag

SEQ ID NO: 64889 - RNA, 20 nt, Artificial Sequence
  MKO10064889_A_mmu-mir-6399
  gRNA
agguaaagcuguugcaauga

SEQ ID NO: 64890 - RNA, 20 nt, Artificial Sequence
  MKO10064890_A_mmu-mir-6399
  gRNA
auaaacuaccacugcaaccc

SEQ ID NO: 64891 - RNA, 20 nt, Artificial Sequence
  MKO10064891_A_mmu-mir-7019
  gRNA
gacagccaucugcagagagg

SEQ ID NO: 64892 - RNA, 20 nt, Artificial Sequence
  MKO10064892_A_mmu-mir-7019
  gRNA
agagaggcggccaaggugag

SEQ ID NO: 64893 - RNA, 20 nt, Artificial Sequence
  MKO10064893_A_mmu-mir-7019
  gRNA
gccaaggugagcggugcagu

SEQ ID NO: 64894 - RNA, 20 nt, Artificial Sequence
  MKO10064894_A_mmu-mir-7019
  gRNA
gccgacugcaccgcucaccu

SEQ ID NO: 64895 - RNA, 20 nt, Artificial Sequence
  MKO10064895_A_mmu-mir-7020
  gRNA
gugugggcugaggucuggga

SEQ ID NO: 64896 - RNA, 20 nt, Artificial Sequence
  MKO10064896_A_mmu-mir-7020
  gRNA
ugggcugaggucugggaugg

SEQ ID NO: 64897 - RNA, 20 nt, Artificial Sequence
  MKO10064897_A_mmu-mir-7020
  gRNA
ugaggucugggaugguggag

SEQ ID NO: 64898 - RNA, 20 nt, Artificial Sequence
  MKO10064898_A_mmu-mir-7020
  gRNA
ugguggagagggugaccaga

SEQ ID NO: 64899 - RNA, 20 nt, Artificial Sequence
  MKO10064899_A_mmu-mir-2139
  gRNA
uaccaggagcagcgcagcug

SEQ ID NO: 64900 - RNA, 20 nt, Artificial Sequence
  MKO10064900_A_mmu-mir-2139
  gRNA
guccgcagcugcgcugcucc

SEQ ID NO: 64901 - RNA, 20 nt, Artificial Sequence
  MKO10064901_A_mmu-mir-2139
  gRNA
ggacaugcagcugcccagca

SEQ ID NO: 64902 - RNA, 20 nt, Artificial Sequence
  MKO10064902_A_mmu-mir-2139
  gRNA
uggagaaggagcagagggcc

SEQ ID NO: 64903 - RNA, 20 nt, Artificial Sequence
  MKO10064903_A_mmu-mir-7021
  gRNA
ucucugugcuucugcuccuu

SEQ ID NO: 64904 - RNA, 20 nt, Artificial Sequence
  MKO10064904_A_mmu-mir-7021
  gRNA
gcuucuagcaaucgagucau

SEQ ID NO: 64905 - RNA, 20 nt, Artificial Sequence
  MKO10064905_A_mmu-mir-7022
  gRNA
gaggcacauccugggggcag

SEQ ID NO: 64906 - RNA, 20 nt, Artificial Sequence
  MKO10064906_A_mmu-mir-7022
  gRNA
agagcccuuccuugccaggu

SEQ ID NO: 64907 - RNA, 20 nt, Artificial Sequence
  MKO10064907_A_mmu-mir-7022
  gRNA
caagccugaccucugccccc

SEQ ID NO: 64908 - RNA, 20 nt, Artificial Sequence
  MKO10064908_A_mmu-mir-7022
  gRNA
aagggcucuguuuagcaugc

SEQ ID NO: 64909 - RNA, 20 nt, Artificial Sequence
  MKO10064909_A_mmu-mir-5616
  gRNA
agacagaucaacuugugaug

SEQ ID NO: 64910 - RNA, 20 nt, Artificial Sequence
  MKO10064910_A_mmu-mir-5616
  gRNA
uauucucaacuugugaugag

SEQ ID NO: 64911 - RNA, 20 nt, Artificial Sequence
  MKO10064911_A_mmu-mir-7023
  gRNA
ugaggggcgcagacagggug

SEQ ID NO: 64912 - RNA, 20 nt, Artificial Sequence
  MKO10064912_A_mmu-mir-7023
  gRNA
cugggauugggcguggagcu

SEQ ID NO: 64913 - RNA, 20 nt, Artificial Sequence
  MKO10064913_A_mmu-mir-7023
  gRNA
gggggagcugggauugggcg

SEQ ID NO: 64914 - RNA, 20 nt, Artificial Sequence
  MKO10064914_A_mmu-mir-7023
  gRNA
ggaaugggggagcugggauu

SEQ ID NO: 64915 - RNA, 20 nt, Artificial Sequence
  MKO10064915_A_mmu-mir-34a
  gRNA
gccagcugugaguaauucuu

SEQ ID NO: 64916 - RNA, 20 nt, Artificial Sequence
  MKO10064916_A_mmu-mir-34a
  gRNA
uucuuuggcagugucuuagc

SEQ ID NO: 64917 - RNA, 20 nt, Artificial Sequence
  MKO10064917_A_mmu-mir-34a
  gRNA
guuguugugaguauuagcua

SEQ ID NO: 64918 - RNA, 20 nt, Artificial Sequence
  MKO10064918_A_mmu-mir-34a
  gRNA
aacaaugugcagcacuucua

SEQ ID NO: 64919 - RNA, 20 nt, Artificial Sequence
  MKO10064919_A_mmu-mir-429
  gRNA
agcggugauaaggccgugga

SEQ ID NO: 64920 - RNA, 20 nt, Artificial Sequence
  MKO10064920_A_mmu-mir-429
  gRNA
gugauaaggccguggaugga

SEQ ID NO: 64921 - RNA, 20 nt, Artificial Sequence
  MKO10064921_A_mmu-mir-429
  gRNA
cauccagaucuaaccauguc

SEQ ID NO: 64922 - RNA, 20 nt, Artificial Sequence
  MKO10064922_A_mmu-mir-429
  gRNA
cugguaagacauccaucagc

SEQ ID NO: 64923 - RNA, 20 nt, Artificial Sequence
  MKO10064923_A_mmu-mir-200a
  gRNA
ccaagaaauccagcacuguc

SEQ ID NO: 64924 - RNA, 20 nt, Artificial Sequence
  MKO10064924_A_mmu-mir-200a
  gRNA
guccgguaagaugcccacag

SEQ ID NO: 64925 - RNA, 20 nt, Artificial Sequence
  MKO10064925_A_mmu-mir-200a
  gRNA
uaagaugcccacagaggccc

SEQ ID NO: 64926 - RNA, 20 nt, Artificial Sequence
  MKO10064926_A_mmu-mir-200a
  gRNA
ugucugguaacgauguucaa

SEQ ID NO: 64927 - RNA, 20 nt, Artificial Sequence
  MKO10064927_A_mmu-mir-200b
  gRNA
gcuccgccgucaucauuacc

SEQ ID NO: 64928 - RNA, 20 nt, Artificial Sequence
  MKO10064928_A_mmu-mir-200b
  gRNA
uccaaugcugcccaguaaga

SEQ ID NO: 64929 - RNA, 20 nt, Artificial Sequence
  MKO10064929_A_mmu-mir-200b
  gRNA
gcugcccaguaagauggcca

SEQ ID NO: 64930 - RNA, 20 nt, Artificial Sequence
  MKO10064930_A_mmu-mir-200b
  gRNA
cugccugguaaugaugacgg

SEQ ID NO: 64931 - RNA, 20 nt, Artificial Sequence
  MKO10064931_A_mmu-mir-7658
  gRNA
ggacacagacagcgugggug

SEQ ID NO: 64932 - RNA, 20 nt, Artificial Sequence
  MKO10064932_A_mmu-mir-7658
  gRNA
agcgugggugaggaaggugg

SEQ ID NO: 64933 - RNA, 20 nt, Artificial Sequence
  MKO10064933_A_mmu-mir-7658
  gRNA
cagugugggcguggcggugc

SEQ ID NO: 64934 - RNA, 20 nt, Artificial Sequence
  MKO10064934_A_mmu-mir-7658
  gRNA
aagacgcagcagugugggcg

SEQ ID NO: 64935 - RNA, 20 nt, Artificial Sequence
  MKO10064935_A_mmu-mir-879
  gRNA
agacaaguuucuagguccag

SEQ ID NO: 64936 - RNA, 20 nt, Artificial Sequence
  MKO10064936_A_mmu-mir-879
  gRNA
aggcuuauagcucuaagccu

SEQ ID NO: 64937 - RNA, 20 nt, Artificial Sequence
  MKO10064937_A_mmu-mir-879
  gRNA
ccuuggaugaaagaggcuua

SEQ ID NO: 64938 - RNA, 20 nt, Artificial Sequence
  MKO10064938_A_mmu-mir-879
  gRNA
ggcuuauggcuucaagcuuu

SEQ ID NO: 64939 - RNA, 20 nt, Artificial Sequence
  MKO10064939_A_mmu-mir-671
  gRNA
ggcuggcgaacuggcaggcc

SEQ ID NO: 64940 - RNA, 20 nt, Artificial Sequence
  MKO10064940_A_mmu-mir-671
  gRNA
cgaacuggcaggccaggaag

SEQ ID NO: 64941 - RNA, 20 nt, Artificial Sequence
  MKO10064941_A_mmu-mir-671
  gRNA
acuggcaggccaggaagagg

SEQ ID NO: 64942 - RNA, 20 nt, Artificial Sequence
  MKO10064942_A_mmu-mir-671
  gRNA
ccaggaagaggaggaagccc

SEQ ID NO: 64943 - RNA, 20 nt, Artificial Sequence
  MKO10064943_A_mmu-mir-1960
  gRNA
cagcccucuucuaacagcac

SEQ ID NO: 64944 - RNA, 20 nt, Artificial Sequence
  MKO10064944_A_mmu-mir-1960
  gRNA
gcagccagugcuguuagaag

SEQ ID NO: 64945 - RNA, 20 nt, Artificial Sequence
  MKO10064945_A_mmu-mir-1960
  gRNA
guuagaagagggcugagagc

SEQ ID NO: 64946 - RNA, 20 nt, Artificial Sequence
  MKO10064946_A_mmu-mir-1960
  gRNA
cacugacuuuuccucugcau

SEQ ID NO: 64947 - RNA, 20 nt, Artificial Sequence
  MKO10064947_A_mmu-mir-5625
  gRNA
cggcccggaaguucuugagu

SEQ ID NO: 64948 - RNA, 20 nt, Artificial Sequence
  MKO10064948_A_mmu-mir-5625
  gRNA
acaucccgggugacccgggu

SEQ ID NO: 64949 - RNA, 20 nt, Artificial Sequence
  MKO10064949_A_mmu-mir-5625
  gRNA
guuggagcugcugauucaag

SEQ ID NO: 64950 - RNA, 20 nt, Artificial Sequence
  MKO10064950_A_mmu-mir-5625
  gRNA
agcuccaacccgggucaccc

SEQ ID NO: 64951 - RNA, 20 nt, Artificial Sequence
  MKO10064951_A_mmu-mir-3473e
  gRNA
gcaaaugguugucugccuug

SEQ ID NO: 64952 - RNA, 20 nt, Artificial Sequence
  MKO10064952_A_mmu-mir-3473e
  gRNA
uggguacuggaaauugaccu

SEQ ID NO: 64953 - RNA, 20 nt, Artificial Sequence
  MKO10064953_A_mmu-mir-3473e
  gRNA
gcccagugucagucucuuga

SEQ ID NO: 64954 - RNA, 20 nt, Artificial Sequence
  MKO10064954_A_mmu-mir-3473e
  gRNA
gucaauuuccaguacccaca

SEQ ID NO: 64955 - RNA, 20 nt, Artificial Sequence
  MKO10064955_A_mmu-mir-7024
  gRNA
auggguucucuguagggagc

SEQ ID NO: 64956 - RNA, 20 nt, Artificial Sequence
  MKO10064956_A_mmu-mir-7024
  gRNA
gggagcagggacugcugggc

SEQ ID NO: 64957 - RNA, 20 nt, Artificial Sequence
  MKO10064957_A_mmu-mir-7024
  gRNA
ggacugcugggcaggugccu

SEQ ID NO: 64958 - RNA, 20 nt, Artificial Sequence
  MKO10064958_A_mmu-mir-7024
  gRNA
aacccaucccccaacccaug

SEQ ID NO: 64959 - RNA, 20 nt, Artificial Sequence
  MKO10064959_A_mmu-mir-7036b
  gRNA
cgcgggguucucuguggaag

SEQ ID NO: 64960 - RNA, 20 nt, Artificial Sequence
  MKO10064960_A_mmu-mir-7036b
  gRNA
uugcucggcucugagcuucc

SEQ ID NO: 64961 - RNA, 20 nt, Artificial Sequence
  MKO10064961_A_mmu-mir-7036b
  gRNA
cucggcucugagcuuccugg

SEQ ID NO: 64962 - RNA, 20 nt, Artificial Sequence
  MKO10064962_A_mmu-mir-7036b
  gRNA
cugagcuuccuggugggccu

SEQ ID NO: 64963 - RNA, 20 nt, Artificial Sequence
  MKO10064963_A_mmu-mir-467g
  gRNA
auauaugcaugcacaagacc

SEQ ID NO: 64964 - RNA, 20 nt, Artificial Sequence
  MKO10064964_A_mmu-mir-3097
  gRNA
gaauguuugagugacacagg

SEQ ID NO: 64965 - RNA, 20 nt, Artificial Sequence
  MKO10064965_A_mmu-mir-3097
  gRNA
agaucuguagacacacccac

SEQ ID NO: 64966 - RNA, 20 nt, Artificial Sequence
  MKO10064966_A_mmu-mir-3097
  gRNA
aagagagcugacagguagaa

SEQ ID NO: 64967 - RNA, 20 nt, Artificial Sequence
  MKO10064967_A_mmu-mir-3097
  gRNA
ggugggaaguguguguccag

SEQ ID NO: 64968 - RNA, 20 nt, Artificial Sequence
  MKO10064968_A_mmu-mir-7689
  gRNA
gggacuacaccgaggcagcc

SEQ ID NO: 64969 - RNA, 20 nt, Artificial Sequence
  MKO10064969_A_mmu-mir-7689
  gRNA
accgaggcagccuggcuuag

SEQ ID NO: 64970 - RNA, 20 nt, Artificial Sequence
  MKO10064970_A_mmu-mir-7689
  gRNA
gcagccuggcuuaguggaaa

SEQ ID NO: 64971 - RNA, 20 nt, Artificial Sequence
  MKO10064971_A_mmu-mir-7689
  gRNA
ggcuuuagagccagacugcc

SEQ ID NO: 64972 - RNA, 20 nt, Artificial Sequence
  MKO10064972_A_mmu-mir-6414
  gRNA
uuuucagacccugcucuuug

SEQ ID NO: 64973 - RNA, 20 nt, Artificial Sequence
  MKO10064973_A_mmu-mir-6414
  gRNA
uuugggggcuuguagcuccc

SEQ ID NO: 64974 - RNA, 20 nt, Artificial Sequence
  MKO10064974_A_mmu-mir-6414
  gRNA
acuuagacuggggaaaaccu

SEQ ID NO: 64975 - RNA, 20 nt, Artificial Sequence
  MKO10064975_A_mmu-mir-6414
  gRNA
ucagcucagaacuuagacug

SEQ ID NO: 64976 - RNA, 20 nt, Artificial Sequence
  MKO10064976_A_mmu-mir-218-1
  gRNA
gaucuaaccaugugcuugcg

SEQ ID NO: 64977 - RNA, 20 nt, Artificial Sequence
  MKO10064977_A_mmu-mir-218-1
  gRNA
caugguuccgucaagcacca

SEQ ID NO: 64978 - RNA, 20 nt, Artificial Sequence
  MKO10064978_A_mmu-mir-218-1
  gRNA
ucucauaccucgcaagcaca

SEQ ID NO: 64979 - RNA, 20 nt, Artificial Sequence
  MKO10064979_A_mmu-mir-218-1
  gRNA
ugacguuccauggugcuuga

SEQ ID NO: 64980 - RNA, 20 nt, Artificial Sequence
  MKO10064980_A_mmu-mir-8117
  gRNA
auccaguggggauuccugug

SEQ ID NO: 64981 - RNA, 20 nt, Artificial Sequence
  MKO10064981_A_mmu-mir-8117
  gRNA
gugugggcccuugcaggugu

SEQ ID NO: 64982 - RNA, 20 nt, Artificial Sequence
  MKO10064982_A_mmu-mir-8117
  gRNA
gguguugggcgagacuccgc

SEQ ID NO: 64983 - RNA, 20 nt, Artificial Sequence
  MKO10064983_A_mmu-mir-8117
  gRNA
ugggcgagacuccgcuggca

SEQ ID NO: 64984 - RNA, 20 nt, Artificial Sequence
  MKO10064984_A_mmu-mir-6417
  gRNA
gcuagcugucguuugcuacu

SEQ ID NO: 64985 - RNA, 20 nt, Artificial Sequence
  MKO10064985_A_mmu-mir-6417
  gRNA
auagcugugucugugagaca

SEQ ID NO: 64986 - RNA, 20 nt, Artificial Sequence
  MKO10064986_A_mmu-mir-6417
  gRNA
ugcaagcucacacucagcgg

SEQ ID NO: 64987 - RNA, 20 nt, Artificial Sequence
  MKO10064987_A_mmu-mir-6417
  gRNA
ggaggaacuaguacacacag

SEQ ID NO: 64988 - RNA, 20 nt, Artificial Sequence
  MKO10064988_A_mmu-mir-574
  gRNA
ugugugcaugagcguggacu

SEQ ID NO: 64989 - RNA, 20 nt, Artificial Sequence
  MKO10064989_A_mmu-mir-574
  gRNA
ugugggugugugcaugagcg

SEQ ID NO: 64990 - RNA, 20 nt, Artificial Sequence
  MKO10064990_A_mmu-mir-574
  gRNA
gaccgggcgugcgggcgugu

SEQ ID NO: 64991 - RNA, 20 nt, Artificial Sequence
  MKO10064991_A_mmu-mir-574
  gRNA
cacccacacgcccgcacgcc

SEQ ID NO: 64992 - RNA, 20 nt, Artificial Sequence
  MKO10064992_A_mmu-mir-7025
  gRNA
cucccagugaguuucucagu

SEQ ID NO: 64993 - RNA, 20 nt, Artificial Sequence
  MKO10064993_A_mmu-mir-7025
  gRNA
agccaccagcuucagcucac

SEQ ID NO: 64994 - RNA, 20 nt, Artificial Sequence
  MKO10064994_A_mmu-mir-7025
  gRNA
ugccuacugagaaacucacu

SEQ ID NO: 64995 - RNA, 20 nt, Artificial Sequence
  MKO10064995_A_mmu-mir-7025
  gRNA
acagggcguggcuggugagc

SEQ ID NO: 64996 - RNA, 20 nt, Artificial Sequence
  MKO10064996_A_mmu-mir-5098
  gRNA
uaggauuagccagaguuaca

SEQ ID NO: 64997 - RNA, 20 nt, Artificial Sequence
  MKO10064997_A_mmu-mir-5098
  gRNA
uuuuguuuuguuuuugagac

SEQ ID NO: 64998 - RNA, 20 nt, Artificial Sequence
  MKO10064998_A_mmu-mir-5098
  gRNA
aggguuucucuguguagccc

SEQ ID NO: 64999 - RNA, 20 nt, Artificial Sequence
  MKO10064999_A_mmu-mir-5098
  gRNA
cuguguagcccuggcugucc

SEQ ID NO: 65000 - RNA, 20 nt, Artificial Sequence
  MKO10065000_A_mmu-mir-1187
  gRNA
aaaaauaaauugugucuaua

SEQ ID NO: 65001 - RNA, 20 nt, Artificial Sequence
  MKO10065001_A_mmu-mir-1187
  gRNA
ugucuauaaggaaaacaguu

SEQ ID NO: 65002 - RNA, 20 nt, Artificial Sequence
  MKO10065002_A_mmu-mir-3969
  gRNA
ucuauagugauuucuacuuu

SEQ ID NO: 65003 - RNA, 20 nt, Artificial Sequence
  MKO10065003_A_mmu-mir-3969
  gRNA
uauagugauuucuacuuuag

SEQ ID NO: 65004 - RNA, 20 nt, Artificial Sequence
  MKO10065004_A_mmu-mir-3969
  gRNA
auagaguugcaugguuacag

SEQ ID NO: 65005 - RNA, 20 nt, Artificial Sequence
  MKO10065005_A_mmu-mir-3969
  gRNA
auuuagauuagcuacuuaca

SEQ ID NO: 65006 - RNA, 20 nt, Artificial Sequence
  MKO10065006_A_mmu-mir-6415
  gRNA
gacaauaaucggagcuuuug

SEQ ID NO: 65007 - RNA, 20 nt, Artificial Sequence
  MKO10065007_A_mmu-mir-6415
  gRNA
uuuugagggccccaugcaua

SEQ ID NO: 65008 - RNA, 20 nt, Artificial Sequence
  MKO10065008_A_mmu-mir-6415
  gRNA
gacccagcaggccauaugca

SEQ ID NO: 65009 - RNA, 20 nt, Artificial Sequence
  MKO10065009_A_mmu-mir-6415
  gRNA
gccccaugcauauggccugc

SEQ ID NO: 65010 - RNA, 20 nt, Artificial Sequence
  MKO10065010_A_mmu-mir-1961
  gRNA
aacuacuaccucaucucuca

SEQ ID NO: 65011 - RNA, 20 nt, Artificial Sequence
  MKO10065011_A_mmu-mir-1961
  gRNA
accucaucucucaagguaua

SEQ ID NO: 65012 - RNA, 20 nt, Artificial Sequence
  MKO10065012_A_mmu-mir-1961
  gRNA
ucaucucucaagguauaugg

SEQ ID NO: 65013 - RNA, 20 nt, Artificial Sequence
  MKO10065013_A_mmu-mir-1961
  gRNA
cuccauagacguauaggaag

SEQ ID NO: 65014 - RNA, 20 nt, Artificial Sequence
  MKO10065014_A_mmu-mir-703
  gRNA
cugccacacacaaaaaaaaa

SEQ ID NO: 65015 - RNA, 20 nt, Artificial Sequence
  MKO10065015_A_mmu-mir-703
  gRNA
guuuaauaaaaguaaaagac

SEQ ID NO: 65016 - RNA, 20 nt, Artificial Sequence
  MKO10065016_A_mmu-mir-703
  gRNA
acaacauucuuuccuucuga

SEQ ID NO: 65017 - RNA, 20 nt, Artificial Sequence
  MKO10065017_A_mmu-mir-703
  gRNA
ucaaaaucaguacuuuuuaa

SEQ ID NO: 65018 - RNA, 20 nt, Artificial Sequence
  MKO10065018_A_mmu-mir-5619
  gRNA
ugcucucuggaagucacuaa

SEQ ID NO: 65019 - RNA, 20 nt, Artificial Sequence
  MKO10065019_A_mmu-mir-5619
  gRNA
gucacuaauggcauuuuugu

SEQ ID NO: 65020 - RNA, 20 nt, Artificial Sequence
  MKO10065020_A_mmu-mir-5619
  gRNA
cagaacaacgaaaagcucau

SEQ ID NO: 65021 - RNA, 20 nt, Artificial Sequence
  MKO10065021_A_mmu-mir-5619
  gRNA
uuggugauuucuagcacgac

SEQ ID NO: 65022 - RNA, 20 nt, Artificial Sequence
  MKO10065022_A_mmu-mir-7026
  gRNA
uaacaugugcuuucuggucu

SEQ ID NO: 65023 - RNA, 20 nt, Artificial Sequence
  MKO10065023_A_mmu-mir-7026
  gRNA
agaccaugggguauaugcag

SEQ ID NO: 65024 - RNA, 20 nt, Artificial Sequence
  MKO10065024_A_mmu-mir-7026
  gRNA
gcugcguuucugagaccaug

SEQ ID NO: 65025 - RNA, 20 nt, Artificial Sequence
  MKO10065025_A_mmu-mir-7026
  gRNA
ucgcugcguuucugagacca

SEQ ID NO: 65026 - RNA, 20 nt, Artificial Sequence
  MKO10065026_A_mmu-mir-701
  gRNA
uaauuagccgcugaaauaga

SEQ ID NO: 65027 - RNA, 20 nt, Artificial Sequence
  MKO10065027_A_mmu-mir-701
  gRNA
agcggcuaauuacuugcuca

SEQ ID NO: 65028 - RNA, 20 nt, Artificial Sequence
  MKO10065028_A_mmu-mir-701
  gRNA
ggcuguuagcacuugauaag

SEQ ID NO: 65029 - RNA, 20 nt, Artificial Sequence
  MKO10065029_A_mmu-mir-701
  gRNA
auagauggauuguauagaug

SEQ ID NO: 65030 - RNA, 20 nt, Artificial Sequence
  MKO10065030_A_mmu-mir-7229
  gRNA
gaaagcgugcagaaagucac

SEQ ID NO: 65031 - RNA, 20 nt, Artificial Sequence
  MKO10065031_A_mmu-mir-7229
  gRNA
cacuggucuguguagccuug

SEQ ID NO: 65032 - RNA, 20 nt, Artificial Sequence
  MKO10065032_A_mmu-mir-7229
  gRNA
guguagccuugaggcuaucc

SEQ ID NO: 65033 - RNA, 20 nt, Artificial Sequence
  MKO10065033_A_mmu-mir-7229
  gRNA
gccucaguaguagacauccc

SEQ ID NO: 65034 - RNA, 20 nt, Artificial Sequence
  MKO10065034_A_mmu-mir-7230
  gRNA
cuugaguugagacugucagu

SEQ ID NO: 65035 - RNA, 20 nt, Artificial Sequence
  MKO10065035_A_mmu-mir-7230
  gRNA
ugucaguagguguugcccga

SEQ ID NO: 65036 - RNA, 20 nt, Artificial Sequence
  MKO10065036_A_mmu-mir-7230
  gRNA
uuucucugaguggcuucugg

SEQ ID NO: 65037 - RNA, 20 nt, Artificial Sequence
  MKO10065037_A_mmu-mir-7230
  gRNA
uguuucucugaguggcuucu

SEQ ID NO: 65038 - RNA, 20 nt, Artificial Sequence
  MKO10065038_A_mmu-mir-7027
  gRNA
aagaaacagcagagcagcug

SEQ ID NO: 65039 - RNA, 20 nt, Artificial Sequence
  MKO10065039_A_mmu-mir-7027
  gRNA
ucggguuucucuccucuucc

SEQ ID NO: 65040 - RNA, 20 nt, Artificial Sequence
  MKO10065040_A_mmu-mir-7027
  gRNA
agguacguaagaccuggaag

SEQ ID NO: 65041 - RNA, 20 nt, Artificial Sequence
  MKO10065041_A_mmu-mir-7027
  gRNA
ggugugcuuuuccccuggaa

SEQ ID NO: 65042 - RNA, 20 nt, Artificial Sequence
  MKO10065042_A_mmu-mir-7028
  gRNA
augcggcuguagcugggcug

SEQ ID NO: 65043 - RNA, 20 nt, Artificial Sequence
  MKO10065043_A_mmu-mir-7028
  gRNA
gcuguagcugggcugaggcu

SEQ ID NO: 65044 - RNA, 20 nt, Artificial Sequence
  MKO10065044_A_mmu-mir-7028
  gRNA
gcugggcugaggcuuggguc

SEQ ID NO: 65045 - RNA, 20 nt, Artificial Sequence
  MKO10065045_A_mmu-mir-7028
  gRNA
ccuucucuucccccucggcc

SEQ ID NO: 65046 - RNA, 20 nt, Artificial Sequence
  MKO10065046_A_mmu-mir-6240
  gRNA
aaaaccccaaagcaucgcga

SEQ ID NO: 65047 - RNA, 20 nt, Artificial Sequence
  MKO10065047_A_mmu-mir-6240
  gRNA
caaagcaucgcgaaggccca

SEQ ID NO: 65048 - RNA, 20 nt, Artificial Sequence
  MKO10065048_A_mmu-mir-6240
  gRNA
auuucugcccagugcucuga

SEQ ID NO: 65049 - RNA, 20 nt, Artificial Sequence
  MKO10065049_A_mmu-mir-6240
  gRNA
gaagaaaugugacucucuua

SEQ ID NO: 65050 - RNA, 20 nt, Artificial Sequence
  MKO10065050_A_mmu-mir-7029
  gRNA
gagagguaagucuggacgcu

SEQ ID NO: 65051 - RNA, 20 nt, Artificial Sequence
  MKO10065051_A_mmu-mir-7029
  gRNA
gcugccagcgcccugagcug

SEQ ID NO: 65052 - RNA, 20 nt, Artificial Sequence
  MKO10065052_A_mmu-mir-7029
  gRNA
agagccacagcucagggcgc

SEQ ID NO: 65053 - RNA, 20 nt, Artificial Sequence
  MKO10065053_A_mmu-mir-7029
  gRNA
cuguuggacuucagcugauc

SEQ ID NO: 65054 - RNA, 20 nt, Artificial Sequence
  MKO10065054_A_mmu-mir-7030
  gRNA
gaaauagaaauauccugggg

SEQ ID NO: 65055 - RNA, 20 nt, Artificial Sequence
  MKO10065055_A_mmu-mir-7030
  gRNA
auagaaauauccuggggagg

SEQ ID NO: 65056 - RNA, 20 nt, Artificial Sequence
  MKO10065056_A_mmu-mir-7030
  gRNA
acuagcacagccaccucccc

SEQ ID NO: 65057 - RNA, 20 nt, Artificial Sequence
  MKO10065057_A_mmu-mir-7030
  gRNA
acagagcaaggcugaccccg

SEQ ID NO: 65058 - RNA, 20 nt, Artificial Sequence
  MKO10065058_A_mmu-mir-7031
  gRNA
gagcucuaggagagggcaag

SEQ ID NO: 65059 - RNA, 20 nt, Artificial Sequence
  MKO10065059_A_mmu-mir-7031
  gRNA
cuaggagagggcaagagggu

SEQ ID NO: 65060 - RNA, 20 nt, Artificial Sequence
  MKO10065060_A_mmu-mir-7031
  gRNA
caaggcugcucccacccuuc

SEQ ID NO: 65061 - RNA, 20 nt, Artificial Sequence
  MKO10065061_A_mmu-mir-7031
  gRNA
ucccacccuucaggccucuc

SEQ ID NO: 65062 - RNA, 20 nt, Artificial Sequence
  MKO10065062_A_mmu-mir-8115
  gRNA
gaacuggaacugcagguggu

SEQ ID NO: 65063 - RNA, 20 nt, Artificial Sequence
  MKO10065063_A_mmu-mir-8115
  gRNA
caggugguugggagccacca

SEQ ID NO: 65064 - RNA, 20 nt, Artificial Sequence
  MKO10065064_A_mmu-mir-8115
  gRNA
gggagccaccaugguggugu

SEQ ID NO: 65065 - RNA, 20 nt, Artificial Sequence
  MKO10065065_A_mmu-mir-8115
  gRNA
uucacuucccaacaccacca

SEQ ID NO: 65066 - RNA, 20 nt, Artificial Sequence
  MKO10065066_A_mmu-mir-7647
  gRNA
aaguguguacuaccaccucc

SEQ ID NO: 65067 - RNA, 20 nt, Artificial Sequence
  MKO10065067_A_mmu-mir-7647
  gRNA
acuaccaccuccuggacuuu

SEQ ID NO: 65068 - RNA, 20 nt, Artificial Sequence
  MKO10065068_A_mmu-mir-7647
  gRNA
ugcuuuuuaaaaaaaaggcc

SEQ ID NO: 65069 - RNA, 20 nt, Artificial Sequence
  MKO10065069_A_mmu-mir-7647
  gRNA
uuuuuaaaaaaaaggccagg

SEQ ID NO: 65070 - RNA, 20 nt, Artificial Sequence
  MKO10065070_A_mmu-mir-7032
  gRNA
gugaggggcguggcccaggg

SEQ ID NO: 65071 - RNA, 20 nt, Artificial Sequence
  MKO10065071_A_mmu-mir-7032
  gRNA
ggcccagggugguccccgag

SEQ ID NO: 65072 - RNA, 20 nt, Artificial Sequence
  MKO10065072_A_mmu-mir-7032
  gRNA
cagggugguccccgagaggg

SEQ ID NO: 65073 - RNA, 20 nt, Artificial Sequence
  MKO10065073_A_mmu-mir-7032
  gRNA
ccgagagggugguccccaca

SEQ ID NO: 65074 - RNA, 20 nt, Artificial Sequence
  MKO10065074_A_mmu-mir-3965
  gRNA
gcugcagcugagugcacaga

SEQ ID NO: 65075 - RNA, 20 nt, Artificial Sequence
  MKO10065075_A_mmu-mir-3965
  gRNA
gcuuaucagccugauguuca

SEQ ID NO: 65076 - RNA, 20 nt, Artificial Sequence
  MKO10065076_A_mmu-mir-3965
  gRNA
cugauguucaaggcuugcuc

SEQ ID NO: 65077 - RNA, 20 nt, Artificial Sequence
  MKO10065077_A_mmu-mir-3965
  gRNA
auguucaaggcuugcucagg

SEQ ID NO: 65078 - RNA, 20 nt, Artificial Sequence
  MKO10065078_A_mmu-mir-7228
  gRNA
ugaacagaugucgcaguguu

SEQ ID NO: 65079 - RNA, 20 nt, Artificial Sequence
  MKO10065079_A_mmu-mir-7228
  gRNA
aguguucggucuccaguguu

SEQ ID NO: 65080 - RNA, 20 nt, Artificial Sequence
  MKO10065080_A_mmu-mir-7228
  gRNA
gucuccaguguuuggagcuc

SEQ ID NO: 65081 - RNA, 20 nt, Artificial Sequence
  MKO10065081_A_mmu-mir-7228
  gRNA
gaacacugcgacaucuguuc

SEQ ID NO: 65082 - RNA, 20 nt, Artificial Sequence
  MKO10065082_A_mmu-mir-7033
  gRNA
guggaggcugcccaagagaa

SEQ ID NO: 65083 - RNA, 20 nt, Artificial Sequence
  MKO10065083_A_mmu-mir-7033
  gRNA
caagagaauggaggcagguu

SEQ ID NO: 65084 - RNA, 20 nt, Artificial Sequence
  MKO10065084_A_mmu-mir-7033
  gRNA
gacccugccccucagacucc

SEQ ID NO: 65085 - RNA, 20 nt, Artificial Sequence
  MKO10065085_A_mmu-mir-7033
  gRNA
uaaccugccuccauucucuu

SEQ ID NO: 65086 - RNA, 20 nt, Artificial Sequence
  MKO10065086_A_mmu-mir-7034
  gRNA
cacaugagcaccuguagggu

SEQ ID NO: 65087 - RNA, 20 nt, Artificial Sequence
  MKO10065087_A_mmu-mir-7034
  gRNA
gagcaccuguaggguaggga

SEQ ID NO: 65088 - RNA, 20 nt, Artificial Sequence
  MKO10065088_A_mmu-mir-7034
  gRNA
aggguagggaaggaaggcca

SEQ ID NO: 65089 - RNA, 20 nt, Artificial Sequence
  MKO10065089_A_mmu-mir-7034
  gRNA
ggccaaggucaggacaguca

SEQ ID NO: 65090 - RNA, 20 nt, Artificial Sequence
  MKO10065090_A_mmu-mir-7035
  gRNA
ucugugaggggcugggagag

SEQ ID NO: 65091 - RNA, 20 nt, Artificial Sequence
  MKO10065091_A_mmu-mir-7035
  gRNA
guggcucagaagagaguacc

SEQ ID NO: 65092 - RNA, 20 nt, Artificial Sequence
  MKO10065092_A_mmu-mir-7035
  gRNA
gaagagaguaccuggcucug

SEQ ID NO: 65093 - RNA, 20 nt, Artificial Sequence
  MKO10065093_A_mmu-mir-7035
  gRNA
guaccuggcucuggggagga

SEQ ID NO: 65094 - RNA, 20 nt, Artificial Sequence
  MKO10065094_A_mmu-mir-721
  gRNA
auaguucuuccaagcaggag

SEQ ID NO: 65095 - RNA, 20 nt, Artificial Sequence
  MKO10065095_A_mmu-mir-721
  gRNA
ugaaauucucagaacauccc

SEQ ID NO: 65096 - RNA, 20 nt, Artificial Sequence
  MKO10065096_A_mmu-mir-721
  gRNA
uuguuauugccacuccugcu

SEQ ID NO: 65097 - RNA, 20 nt, Artificial Sequence
  MKO10065097_A_mmu-mir-721
  gRNA
aaagggggaaaaaaguaccu

SEQ ID NO: 65098 - RNA, 20 nt, Artificial Sequence
  MKO10065098_A_mmu-mir-702
  gRNA
cguccgggacaaggugagug

SEQ ID NO: 65099 - RNA, 20 nt, Artificial Sequence
  MKO10065099_A_mmu-mir-702
  gRNA
ccgggacaaggugagugggg

SEQ ID NO: 65100 - RNA, 20 nt, Artificial Sequence
  MKO10065100_A_mmu-mir-702
  gRNA
ggugaguggggugguuggca

SEQ ID NO: 65101 - RNA, 20 nt, Artificial Sequence
  MKO10065101_A_mmu-mir-702
  gRNA
guuggcauggguugcccaug

SEQ ID NO: 65102 - RNA, 20 nt, Artificial Sequence
  MKO10065102_A_mmu-mir-8116
  gRNA
agccugguguugaggggaga

SEQ ID NO: 65103 - RNA, 20 nt, Artificial Sequence
  MKO10065103_A_mmu-mir-8116
  gRNA
guguugaggggagaaggauc

SEQ ID NO: 65104 - RNA, 20 nt, Artificial Sequence
  MKO10065104_A_mmu-mir-8116
  gRNA
gagaaggauccggggcuagu

SEQ ID NO: 65105 - RNA, 20 nt, Artificial Sequence
  MKO10065105_A_mmu-mir-8116
  gRNA
ggcuaguuggcgucagccaa

SEQ ID NO: 65106 - RNA, 20 nt, Artificial Sequence
  MKO10065106_A_mmu-mir-7036
  gRNA
ggcccugggaggagcggaug

SEQ ID NO: 65107 - RNA, 20 nt, Artificial Sequence
  MKO10065107_A_mmu-mir-7036
  gRNA
ucuuccccaccgaaccccgc

SEQ ID NO: 65108 - RNA, 20 nt, Artificial Sequence
  MKO10065108_A_mmu-mir-7036
  gRNA
guccucauccgcuccuccca

SEQ ID NO: 65109 - RNA, 20 nt, Artificial Sequence
  MKO10065109_A_mmu-mir-7036
  gRNA
ccuuccagcgggguucggug

SEQ ID NO: 65110 - RNA, 20 nt, Artificial Sequence
  MKO10065110_A_mmu-mir-6418
  gRNA
uuugguugucguccaggaag

SEQ ID NO: 65111 - RNA, 20 nt, Artificial Sequence
  MKO10065111_A_mmu-mir-6418
  gRNA
augacagguacccuggagaa

SEQ ID NO: 65112 - RNA, 20 nt, Artificial Sequence
  MKO10065112_A_mmu-mir-6418
  gRNA
acugcaaccuccuuucucca

SEQ ID NO: 65113 - RNA, 20 nt, Artificial Sequence
  MKO10065113_A_mmu-mir-6418
  gRNA
agaggcaagaacacggucag

SEQ ID NO: 65114 - RNA, 20 nt, Artificial Sequence
  MKO10065114_A_mmu-mir-25
  gRNA
ccgagacaagugcaaugccc

SEQ ID NO: 65115 - RNA, 20 nt, Artificial Sequence
  MKO10065115_A_mmu-mir-25
  gRNA
ccugggcauugcacuugucu

SEQ ID NO: 65116 - RNA, 20 nt, Artificial Sequence
  MKO10065116_A_mmu-mir-25
  gRNA
caauugcuggacgcugcccu

SEQ ID NO: 65117 - RNA, 20 nt, Artificial Sequence
  MKO10065117_A_mmu-mir-25
  gRNA
guguugagaggcggagacuu

SEQ ID NO: 65118 - RNA, 20 nt, Artificial Sequence
  MKO10065118_A_mmu-mir-93
  gRNA
cuaucagagguuguguccug

SEQ ID NO: 65119 - RNA, 20 nt, Artificial Sequence
  MKO10065119_A_mmu-mir-93
  gRNA
gagguuguguccugggggcu

SEQ ID NO: 65120 - RNA, 20 nt, Artificial Sequence
  MKO10065120_A_mmu-mir-93
  gRNA
ggaagugcuagcucagcagu

SEQ ID NO: 65121 - RNA, 20 nt, Artificial Sequence
  MKO10065121_A_mmu-mir-93
  gRNA
ugcuagcucagcaguagguc

SEQ ID NO: 65122 - RNA, 20 nt, Artificial Sequence
  MKO10065122_A_mmu-mir-106b
  gRNA
agcagcaaguacccacagug

SEQ ID NO: 65123 - RNA, 20 nt, Artificial Sequence
  MKO10065123_A_mmu-mir-106b
  gRNA
gucagcacuuuagucccagc

SEQ ID NO: 65124 - RNA, 20 nt, Artificial Sequence
  MKO10065124_A_mmu-mir-106b
  gRNA
cacuuuagucccagcagggc

SEQ ID NO: 65125 - RNA, 20 nt, Artificial Sequence
  MKO10065125_A_mmu-mir-106b
  gRNA
ggguacuugcugcuccagca

SEQ ID NO: 65126 - RNA, 20 nt, Artificial Sequence
  MKO10065126_A_mmu-mir-339
  gRNA
gucuguggacagugcagggg

SEQ ID NO: 65127 - RNA, 20 nt, Artificial Sequence
  MKO10065127_A_mmu-mir-339
  gRNA
ucugucgccgaggcgcucac

SEQ ID NO: 65128 - RNA, 20 nt, Artificial Sequence
  MKO10065128_A_mmu-mir-339
  gRNA
ggcaggcauacgugagcucc

SEQ ID NO: 65129 - RNA, 20 nt, Artificial Sequence
  MKO10065129_A_mmu-mir-339
  gRNA
aggcauacgugagcuccugg

SEQ ID NO: 65130 - RNA, 20 nt, Artificial Sequence
  MKO10065130_A_mmu-mir-7037
  gRNA
aagaaacugcaggugacauu

SEQ ID NO: 65131 - RNA, 20 nt, Artificial Sequence
  MKO10065131_A_mmu-mir-7037
  gRNA
ugcaggugacauuaggagac

SEQ ID NO: 65132 - RNA, 20 nt, Artificial Sequence
  MKO10065132_A_mmu-mir-7037
  gRNA
acauuaggagacagguggua

SEQ ID NO: 65133 - RNA, 20 nt, Artificial Sequence
  MKO10065133_A_mmu-mir-7037
  gRNA
ggagccaccaugaucuccug

SEQ ID NO: 65134 - RNA, 20 nt, Artificial Sequence
  MKO10065134_A_mmu-mir-7038
  gRNA
augagaagaugcgguguaga

SEQ ID NO: 65135 - RNA, 20 nt, Artificial Sequence
  MKO10065135_A_mmu-mir-7038
  gRNA
cucuguccaucucuguaaga

SEQ ID NO: 65136 - RNA, 20 nt, Artificial Sequence
  MKO10065136_A_mmu-mir-7038
  gRNA
gaagaugcgguguagaagga

SEQ ID NO: 65137 - RNA, 20 nt, Artificial Sequence
  MKO10065137_A_mmu-mir-7038
  gRNA
cuccugccuucuuacagaga

SEQ ID NO: 65138 - RNA, 20 nt, Artificial Sequence
  MKO10065138_A_mmu-mir-7039
  gRNA
acagucacucguuagaggga

SEQ ID NO: 65139 - RNA, 20 nt, Artificial Sequence
  MKO10065139_A_mmu-mir-7039
  gRNA
cauacacuguucuggaaggg

SEQ ID NO: 65140 - RNA, 20 nt, Artificial Sequence
  MKO10065140_A_mmu-mir-7039
  gRNA
ucuggaagggagggcagaac

SEQ ID NO: 65141 - RNA, 20 nt, Artificial Sequence
  MKO10065141_A_mmu-mir-7039
  gRNA
aagggagggcagaacaggcg

SEQ ID NO: 65142 - RNA, 20 nt, Artificial Sequence
  MKO10065142_A_mmu-let-7k
  gRNA
uauuguuuuguguuguguug

SEQ ID NO: 65143 - RNA, 20 nt, Artificial Sequence
  MKO10065143_A_mmu-let-7k
  gRNA
aaaggcucucuguguacuau

SEQ ID NO: 65144 - RNA, 20 nt, Artificial Sequence
  MKO10065144_A_mmu-let-7k
  gRNA
cucuguguacuauagguuag

SEQ ID NO: 65145 - RNA, 20 nt, Artificial Sequence
  MKO10065145_A_mmu-let-7k
  gRNA
ugcacacaaccuccuaccuc

SEQ ID NO: 65146 - RNA, 20 nt, Artificial Sequence
  MKO10065146_A_mmu-mir-653
  gRNA
aaacuccagugaacucgcuu

SEQ ID NO: 65147 - RNA, 20 nt, Artificial Sequence
  MKO10065147_A_mmu-mir-653
  gRNA
agugaacucgcuuuggagcu

SEQ ID NO: 65148 - RNA, 20 nt, Artificial Sequence
  MKO10065148_A_mmu-mir-653
  gRNA
aagcuccaaagcgaguucac

SEQ ID NO: 65149 - RNA, 20 nt, Artificial Sequence
  MKO10065149_A_mmu-mir-653
  gRNA
ggaguuuguuucaguauugc

SEQ ID NO: 65150 - RNA, 20 nt, Artificial Sequence
  MKO10065150_A_mmu-mir-489
  gRNA
caguuuagcugccauauaug

SEQ ID NO: 65151 - RNA, 20 nt, Artificial Sequence
  MKO10065151_A_mmu-mir-489
  gRNA
ccauauauguggugucauuc

SEQ ID NO: 65152 - RNA, 20 nt, Artificial Sequence
  MKO10065152_A_mmu-mir-489
  gRNA
auggcagcuaaacuguuaca

SEQ ID NO: 65153 - RNA, 20 nt, Artificial Sequence
  MKO10065153_A_mmu-mir-489
  gRNA
ccagaaugacaccacauaua

SEQ ID NO: 65154 - RNA, 20 nt, Artificial Sequence
  MKO10065154_A_mmu-mir-6370
  gRNA
uuggcugcugaugucuugua

SEQ ID NO: 65155 - RNA, 20 nt, Artificial Sequence
  MKO10065155_A_mmu-mir-6370
  gRNA
cuugggagcaauguagcaga

SEQ ID NO: 65156 - RNA, 20 nt, Artificial Sequence
  MKO10065156_A_mmu-mir-6370
  gRNA
cauagagaugcaaccaaggc

SEQ ID NO: 65157 - RNA, 20 nt, Artificial Sequence
  MKO10065157_A_mmu-mir-6370
  gRNA
aaccaaggcaggaacagcaa

SEQ ID NO: 65158 - RNA, 20 nt, Artificial Sequence
  MKO10065158_A_mmu-mir-592
  gRNA
cgcauauugacacaauguca

SEQ ID NO: 65159 - RNA, 20 nt, Artificial Sequence
  MKO10065159_A_mmu-mir-592
  gRNA
aaugucauggcauaauauca

SEQ ID NO: 65160 - RNA, 20 nt, Artificial Sequence
  MKO10065160_A_mmu-mir-592
  gRNA
gauggcacagcgucaucacg

SEQ ID NO: 65161 - RNA, 20 nt, Artificial Sequence
  MKO10065161_A_mmu-mir-592
  gRNA
uaugcgaugauguguuguga

SEQ ID NO: 65162 - RNA, 20 nt, Artificial Sequence
  MKO10065162_A_mmu-mir-129-1
  gRNA
gucuccuuuggaucuuuuug

SEQ ID NO: 65163 - RNA, 20 nt, Artificial Sequence
  MKO10065163_A_mmu-mir-129-1
  gRNA
cuuuggaucuuuuugcgguc

SEQ ID NO: 65164 - RNA, 20 nt, Artificial Sequence
  MKO10065164_A_mmu-mir-129-1
  gRNA
cuuaccccaaaaaguaucua

SEQ ID NO: 65165 - RNA, 20 nt, Artificial Sequence
  MKO10065165_A_mmu-mir-129-1
  gRNA
cagaccgcaaaaagauccaa

SEQ ID NO: 65166 - RNA, 20 nt, Artificial Sequence
  MKO10065166_A_mmu-mir-182
  gRNA
cucagcacuuacaccauagu

SEQ ID NO: 65167 - RNA, 20 nt, Artificial Sequence
  MKO10065167_A_mmu-mir-182
  gRNA
guuggcaagucuagaaccac

SEQ ID NO: 65168 - RNA, 20 nt, Artificial Sequence
  MKO10065168_A_mmu-mir-182
  gRNA
aguucuaccauugccaaaaa

SEQ ID NO: 65169 - RNA, 20 nt, Artificial Sequence
  MKO10065169_A_mmu-mir-182
  gRNA
ucuaccauugccaaaaaugg

SEQ ID NO: 65170 - RNA, 20 nt, Artificial Sequence
  MKO10065170_A_mmu-mir-96
  gRNA
gcagcccgcuuuucccauau

SEQ ID NO: 65171 - RNA, 20 nt, Artificial Sequence
  MKO10065171_A_mmu-mir-96
  gRNA
gccaaaaucggccaagcaga

SEQ ID NO: 65172 - RNA, 20 nt, Artificial Sequence
  MKO10065172_A_mmu-mir-96
  gRNA
aucggccaagcagaugguac

SEQ ID NO: 65173 - RNA, 20 nt, Artificial Sequence
  MKO10065173_A_mmu-mir-96
  gRNA
augggaaaagcgggcugcug

SEQ ID NO: 65174 - RNA, 20 nt, Artificial Sequence
  MKO10065174_A_mmu-mir-183
  gRNA
aucugucucugcucuguuua

SEQ ID NO: 65175 - RNA, 20 nt, Artificial Sequence
  MKO10065175_A_mmu-mir-183
  gRNA
uccuguccuguguauggcac

SEQ ID NO: 65176 - RNA, 20 nt, Artificial Sequence
  MKO10065176_A_mmu-mir-183
  gRNA
cugcucuguuuauggcccuu

SEQ ID NO: 65177 - RNA, 20 nt, Artificial Sequence
  MKO10065177_A_mmu-mir-183
  gRNA
auucuaccagugccauacac

SEQ ID NO: 65178 - RNA, 20 nt, Artificial Sequence
  MKO10065178_A_mmu-mir-335
  gRNA
uggaaaagauuucuuuuggg

SEQ ID NO: 65179 - RNA, 20 nt, Artificial Sequence
  MKO10065179_A_mmu-mir-335
  gRNA
gaaaagauuucuuuugggcg

SEQ ID NO: 65180 - RNA, 20 nt, Artificial Sequence
  MKO10065180_A_mmu-mir-335
  gRNA
uugcuccugacccccucuca

SEQ ID NO: 65181 - RNA, 20 nt, Artificial Sequence
  MKO10065181_A_mmu-mir-335
  gRNA
ucaggagcaauaaugaaaaa

SEQ ID NO: 65182 - RNA, 20 nt, Artificial Sequence
  MKO10065182_A_mmu-mir-29a
  gRNA
ucauuauaaccgauuucaga

SEQ ID NO: 65183 - RNA, 20 nt, Artificial Sequence
  MKO10065183_A_mmu-mir-29a
  gRNA
uuucuagcaccaucugaaau

SEQ ID NO: 65184 - RNA, 20 nt, Artificial Sequence
  MKO10065184_A_mmu-mir-29a
  gRNA
aagaaaucagucauccucua

SEQ ID NO: 65185 - RNA, 20 nt, Artificial Sequence
  MKO10065185_A_mmu-mir-29a
  gRNA
gaaaucagucauccucuaag

SEQ ID NO: 65186 - RNA, 20 nt, Artificial Sequence
  MKO10065186_A_mmu-mir-29b-1
  gRNA
ccaagaacacugauuucaaa

SEQ ID NO: 65187 - RNA, 20 nt, Artificial Sequence
  MKO10065187_A_mmu-mir-29b-1
  gRNA
ccauuugaaaucaguguucu

SEQ ID NO: 65188 - RNA, 20 nt, Artificial Sequence
  MKO10065188_A_mmu-mir-29b-1
  gRNA
aggaagcugguuucauaugg

SEQ ID NO: 65189 - RNA, 20 nt, Artificial Sequence
  MKO10065189_A_mmu-mir-29b-1
  gRNA
uucaggaagcugguuucaua

SEQ ID NO: 65190 - RNA, 20 nt, Artificial Sequence
  MKO10065190_A_mmu-mir-490
  gRNA
aaguucauuguucgacacca

SEQ ID NO: 65191 - RNA, 20 nt, Artificial Sequence
  MKO10065191_A_mmu-mir-490
  gRNA
guucgacaccauggaucucc

SEQ ID NO: 65192 - RNA, 20 nt, Artificial Sequence
  MKO10065192_A_mmu-mir-490
  gRNA
cgacaccauggaucuccagg

SEQ ID NO: 65193 - RNA, 20 nt, Artificial Sequence
  MKO10065193_A_mmu-mir-490
  gRNA
uuagauauacaccaaccugg

SEQ ID NO: 65194 - RNA, 20 nt, Artificial Sequence
  MKO10065194_A_mmu-mir-7670
  gRNA
uugcuuugaguugauucaga

SEQ ID NO: 65195 - RNA, 20 nt, Artificial Sequence
  MKO10065195_A_mmu-mir-7670
  gRNA
guugauucagaugggcagau

SEQ ID NO: 65196 - RNA, 20 nt, Artificial Sequence
  MKO10065196_A_mmu-mir-7670
  gRNA
guagucuuugcacaugaugc

SEQ ID NO: 65197 - RNA, 20 nt, Artificial Sequence
  MKO10065197_A_mmu-mir-7670
  gRNA
cuucuacagauauucagaaa

SEQ ID NO: 65198 - RNA, 20 nt, Artificial Sequence
  MKO10065198_A_mmu-mir-704
  gRNA
aggagcagagcacaugucug

SEQ ID NO: 65199 - RNA, 20 nt, Artificial Sequence
  MKO10065199_A_mmu-mir-704
  gRNA
agacaugugcucugcuccua

SEQ ID NO: 65200 - RNA, 20 nt, Artificial Sequence
  MKO10065200_A_mmu-mir-704
  gRNA
ucauguagucaacaaucccu

SEQ ID NO: 65201 - RNA, 20 nt, Artificial Sequence
  MKO10065201_A_mmu-mir-704
  gRNA
cucuagcucccagcugugca

SEQ ID NO: 65202 - RNA, 20 nt, Artificial Sequence
  MKO10065202_A_mmu-mir-6371
  gRNA
gaaguaguuugucaugcugg

SEQ ID NO: 65203 - RNA, 20 nt, Artificial Sequence
  MKO10065203_A_mmu-mir-6371
  gRNA
guucauuuaggcaguucaag

SEQ ID NO: 65204 - RNA, 20 nt, Artificial Sequence
  MKO10065204_A_mmu-mir-6371
  gRNA
caaguggcuugaagcucuuc

SEQ ID NO: 65205 - RNA, 20 nt, Artificial Sequence
  MKO10065205_A_mmu-mir-6371
  gRNA
gaucagcccagcuacaugau

SEQ ID NO: 65206 - RNA, 20 nt, Artificial Sequence
  MKO10065206_A_mmu-mir-148a
  gRNA
acuucuaucauacucagagu

SEQ ID NO: 65207 - RNA, 20 nt, Artificial Sequence
  MKO10065207_A_mmu-mir-148a
  gRNA
aacuuugucucuagaggcug

SEQ ID NO: 65208 - RNA, 20 nt, Artificial Sequence
  MKO10065208_A_mmu-mir-148a
  gRNA
ccagaggaagacagccaguu

SEQ ID NO: 65209 - RNA, 20 nt, Artificial Sequence
  MKO10065209_A_mmu-mir-148a
  gRNA
uuugucucaaaagaccaaac

SEQ ID NO: 65210 - RNA, 20 nt, Artificial Sequence
  MKO10065210_A_mmu-mir-196b
  gRNA
gugucgugcugucgagagaa

SEQ ID NO: 65211 - RNA, 20 nt, Artificial Sequence
  MKO10065211_A_mmu-mir-196b
  gRNA
cccgcagcaucagaacuggu

SEQ ID NO: 65212 - RNA, 20 nt, Artificial Sequence
  MKO10065212_A_mmu-mir-196b
  gRNA
gcuuucaacugaaguaauga

SEQ ID NO: 65213 - RNA, 20 nt, Artificial Sequence
  MKO10065213_A_mmu-mir-196b
  gRNA
ucgugcugucgagagaaagg

SEQ ID NO: 65214 - RNA, 20 nt, Artificial Sequence
  MKO10065214_A_mmu-mir-8112
  gRNA
cucccaccccgccugcucug

SEQ ID NO: 65215 - RNA, 20 nt, Artificial Sequence
  MKO10065215_A_mmu-mir-8112
  gRNA
ccaccccgccugcucugcgg

SEQ ID NO: 65216 - RNA, 20 nt, Artificial Sequence
  MKO10065216_A_mmu-mir-8112
  gRNA
ccccgccugcucugcggcgg

SEQ ID NO: 65217 - RNA, 20 nt, Artificial Sequence
  MKO10065217_A_mmu-mir-8112
  gRNA
cgccugcucugcggcggagg

SEQ ID NO: 65218 - RNA, 20 nt, Artificial Sequence
  MKO10065218_A_mmu-mir-7232
  gRNA
ugugcuugcuacgaaagccu

SEQ ID NO: 65219 - RNA, 20 nt, Artificial Sequence
  MKO10065219_A_mmu-mir-7232
  gRNA
cauggaugauuguuuuucca

SEQ ID NO: 65220 - RNA, 20 nt, Artificial Sequence
  MKO10065220_A_mmu-mir-7232
  gRNA
cuugguugaauucgacuuug

SEQ ID NO: 65221 - RNA, 20 nt, Artificial Sequence
  MKO10065221_A_mmu-mir-7232
  gRNA
gucuugguugaauucgacuu

SEQ ID NO: 65222 - RNA, 20 nt, Artificial Sequence
  MKO10065222_A_mmu-mir-468
  gRNA
ugaugugcgugugucugucu

SEQ ID NO: 65223 - RNA, 20 nt, Artificial Sequence
  MKO10065223_A_mmu-mir-468
  gRNA
agaaagacugauaagaaacu

SEQ ID NO: 65224 - RNA, 20 nt, Artificial Sequence
  MKO10065224_A_mmu-mir-468
  gRNA
guuucuuaucagucuuucuc

SEQ ID NO: 65225 - RNA, 20 nt, Artificial Sequence
  MKO10065225_A_mmu-mir-468
  gRNA
ugugcgugugucugucuggg

SEQ ID NO: 65226 - RNA, 20 nt, Artificial Sequence
  MKO10065226_A_mmu-mir-7040
  gRNA
gucucccauacggagggaga

SEQ ID NO: 65227 - RNA, 20 nt, Artificial Sequence
  MKO10065227_A_mmu-mir-7040
  gRNA
ucccauacggagggagaugg

SEQ ID NO: 65228 - RNA, 20 nt, Artificial Sequence
  MKO10065228_A_mmu-mir-7040
  gRNA
aagcagcuacgugagagaga

SEQ ID NO: 65229 - RNA, 20 nt, Artificial Sequence
  MKO10065229_A_mmu-mir-7040
  gRNA
agagaagccagucucccaua

SEQ ID NO: 65230 - RNA, 20 nt, Artificial Sequence
  MKO10065230_A_mmu-mir-3470a
  gRNA
ugccuuuaaucccagcacuc

SEQ ID NO: 65231 - RNA, 20 nt, Artificial Sequence
  MKO10065231_A_mmu-mir-3470a
  gRNA
cuuuaaucccagcacucagg

SEQ ID NO: 65232 - RNA, 20 nt, Artificial Sequence
  MKO10065232_A_mmu-mir-3470a
  gRNA
ucccagcacucaggaggcag

SEQ ID NO: 65233 - RNA, 20 nt, Artificial Sequence
  MKO10065233_A_mmu-mir-3470a
  gRNA
agcacucaggaggcagaggc

SEQ ID NO: 65234 - RNA, 20 nt, Artificial Sequence
  MKO10065234_A_mmu-mir-6374
  gRNA
acuucuuacguagccugggu

SEQ ID NO: 65235 - RNA, 20 nt, Artificial Sequence
  MKO10065235_A_mmu-mir-6374
  gRNA
uuuucuuagguguuugaaug

SEQ ID NO: 65236 - RNA, 20 nt, Artificial Sequence
  MKO10065236_A_mmu-mir-6374
  gRNA
gguuuucuuagguguuugaa

SEQ ID NO: 65237 - RNA, 20 nt, Artificial Sequence
  MKO10065237_A_mmu-mir-6374
  gRNA
aaaacuauuaugguuuucuu

SEQ ID NO: 65238 - RNA, 20 nt, Artificial Sequence
  MKO10065238_A_mmu-mir-705
  gRNA
ggguuucauguuagggaggu

SEQ ID NO: 65239 - RNA, 20 nt, Artificial Sequence
  MKO10065239_A_mmu-mir-705
  gRNA
cucccaccacuacugggaca

SEQ ID NO: 65240 - RNA, 20 nt, Artificial Sequence
  MKO10065240_A_mmu-mir-705
  gRNA
ggagguggggugggcacaga

SEQ ID NO: 65241 - RNA, 20 nt, Artificial Sequence
  MKO10065241_A_mmu-mir-705
  gRNA
guaguggugggagguggggu

SEQ ID NO: 65242 - RNA, 20 nt, Artificial Sequence
  MKO10065242_A_mmu-mir-6375
  gRNA
gcugacuguauuccaaagug

SEQ ID NO: 65243 - RNA, 20 nt, Artificial Sequence
  MKO10065243_A_mmu-mir-6375
  gRNA
uggcugacuguauuccaaag

SEQ ID NO: 65244 - RNA, 20 nt, Artificial Sequence
  MKO10065244_A_mmu-mir-6375
  gRNA
aacuccaggcaugugugaau

SEQ ID NO: 65245 - RNA, 20 nt, Artificial Sequence
  MKO10065245_A_mmu-mir-6375
  gRNA
ccaacagaaaguuuacacug

SEQ ID NO: 65246 - RNA, 20 nt, Artificial Sequence
  MKO10065246_A_mmu-mir-6376
  gRNA
cugagcauuagaaacuguga

SEQ ID NO: 65247 - RNA, 20 nt, Artificial Sequence
  MKO10065247_A_mmu-mir-6376
  gRNA
cugugaugggcgagcaguca

SEQ ID NO: 65248 - RNA, 20 nt, Artificial Sequence
  MKO10065248_A_mmu-mir-6376
  gRNA
cuccaauuggccacacugug

SEQ ID NO: 65249 - RNA, 20 nt, Artificial Sequence
  MKO10065249_A_mmu-mir-6376
  gRNA
gccacacugugaggaaguca

SEQ ID NO: 65250 - RNA, 20 nt, Artificial Sequence
  MKO10065250_A_mmu-mir-7041
  gRNA
auagugccucugagagggaa

SEQ ID NO: 65251 - RNA, 20 nt, Artificial Sequence
  MKO10065251_A_mmu-mir-7041
  gRNA
ugagggaagaagagaaccag

SEQ ID NO: 65252 - RNA, 20 nt, Artificial Sequence
  MKO10065252_A_mmu-mir-7041
  gRNA
gagucuccauucccucucag

SEQ ID NO: 65253 - RNA, 20 nt, Artificial Sequence
  MKO10065253_A_mmu-mir-7041
  gRNA
uucccucucagaggcacuau

SEQ ID NO: 65254 - RNA, 20 nt, Artificial Sequence
  MKO10065254_A_mmu-mir-6373
  gRNA
auuuuucauucauuuuccug

SEQ ID NO: 65255 - RNA, 20 nt, Artificial Sequence
  MKO10065255_A_mmu-mir-6373
  gRNA
gcuuuaugggaauaucuagg

SEQ ID NO: 65256 - RNA, 20 nt, Artificial Sequence
  MKO10065256_A_mmu-mir-6373
  gRNA
uaucuaggaggugaagauug

SEQ ID NO: 65257 - RNA, 20 nt, Artificial Sequence
  MKO10065257_A_mmu-mir-6373
  gRNA
agauauucccauaaagccac

SEQ ID NO: 65258 - RNA, 20 nt, Artificial Sequence
  MKO10065258_A_mmu-mir-7661
  gRNA
acaugagaaagaaagaaacc

SEQ ID NO: 65259 - RNA, 20 nt, Artificial Sequence
  MKO10065259_A_mmu-mir-7661
  gRNA
caagagcuacuuuaaacucc

SEQ ID NO: 65260 - RNA, 20 nt, Artificial Sequence
  MKO10065260_A_mmu-mir-7661
  gRNA
cagagagaaacugggaguca

SEQ ID NO: 65261 - RNA, 20 nt, Artificial Sequence
  MKO10065261_A_mmu-mir-7661
  gRNA
accacaagcagagagaaacu

SEQ ID NO: 65262 - RNA, 20 nt, Artificial Sequence
  MKO10065262_A_mmu-mir-7042
  gRNA
aaagaauuagagacagcaga

SEQ ID NO: 65263 - RNA, 20 nt, Artificial Sequence
  MKO10065263_A_mmu-mir-7042
  gRNA
uugucccuuuguuuucucuc

SEQ ID NO: 65264 - RNA, 20 nt, Artificial Sequence
  MKO10065264_A_mmu-mir-7042
  gRNA
aacaccugagagaaaacaaa

SEQ ID NO: 65265 - RNA, 20 nt, Artificial Sequence
  MKO10065265_A_mmu-mir-7042
  gRNA
uuuucucucagguguuugag

SEQ ID NO: 65266 - RNA, 20 nt, Artificial Sequence
  MKO10065266_A_mmu-mir-7660
  gRNA
gggcuugggauccuuugccc

SEQ ID NO: 65267 - RNA, 20 nt, Artificial Sequence
  MKO10065267_A_mmu-mir-7660
  gRNA
cuaacuagaucuguaaguga

SEQ ID NO: 65268 - RNA, 20 nt, Artificial Sequence
  MKO10065268_A_mmu-mir-7660
  gRNA
gagaucugaagccagggcaa

SEQ ID NO: 65269 - RNA, 20 nt, Artificial Sequence
  MKO10065269_A_mmu-mir-7660
  gRNA
cuuacagaucuaguuaguga

SEQ ID NO: 65270 - RNA, 20 nt, Artificial Sequence
  MKO10065270_A_mmu-mir-7043
  gRNA
cuuccuuucugaaaacagag

SEQ ID NO: 65271 - RNA, 20 nt, Artificial Sequence
  MKO10065271_A_mmu-mir-7043
  gRNA
aaaugccucucugcuuucac

SEQ ID NO: 65272 - RNA, 20 nt, Artificial Sequence
  MKO10065272_A_mmu-mir-7043
  gRNA
uccugccugugaaagcagag

SEQ ID NO: 65273 - RNA, 20 nt, Artificial Sequence
  MKO10065273_A_mmu-mir-7043
  gRNA
gccucucugcuuucacaggc

SEQ ID NO: 65274 - RNA, 20 nt, Artificial Sequence
  MKO10065274_A_mmu-mir-7044
  gRNA
cgugagauggggcucuugug

SEQ ID NO: 65275 - RNA, 20 nt, Artificial Sequence
  MKO10065275_A_mmu-mir-7044
  gRNA
gagauggggcucuugugugg

SEQ ID NO: 65276 - RNA, 20 nt, Artificial Sequence
  MKO10065276_A_mmu-mir-7044
  gRNA
auggggcucuuguguggugg

SEQ ID NO: 65277 - RNA, 20 nt, Artificial Sequence
  MKO10065277_A_mmu-mir-7044
  gRNA
gggcucuugugugguggugg

SEQ ID NO: 65278 - RNA, 20 nt, Artificial Sequence
  MKO10065278_A_mmu-mir-706
  gRNA
guuuuuuuguuuuuugagac

SEQ ID NO: 65279 - RNA, 20 nt, Artificial Sequence
  MKO10065279_A_mmu-mir-706
  gRNA
guuuauuuuguuuuuugaga

SEQ ID NO: 65280 - RNA, 20 nt, Artificial Sequence
  MKO10065280_A_mmu-mir-706
  gRNA
caaacaaaauuacuuuuagu

SEQ ID NO: 65281 - RNA, 20 nt, Artificial Sequence
  MKO10065281_A_mmu-mir-706
  gRNA
aggguuucucuguauagccc

SEQ ID NO: 65282 - RNA, 20 nt, Artificial Sequence
  MKO10065282_A_mmu-mir-7231
  gRNA
augccccaguguuccccaaa

SEQ ID NO: 65283 - RNA, 20 nt, Artificial Sequence
  MKO10065283_A_mmu-mir-7231
  gRNA
gcaaguuaggucugagcauu

SEQ ID NO: 65284 - RNA, 20 nt, Artificial Sequence
  MKO10065284_A_mmu-mir-7231
  gRNA
ugugucccuuuggggaacac

SEQ ID NO: 65285 - RNA, 20 nt, Artificial Sequence
  MKO10065285_A_mmu-mir-7231
  gRNA
ugucccuuuggggaacacug

SEQ ID NO: 65286 - RNA, 20 nt, Artificial Sequence
  MKO10065286_A_mmu-mir-141
  gRNA
caucuuuaccagacaguguu

SEQ ID NO: 65287 - RNA, 20 nt, Artificial Sequence
  MKO10065287_A_mmu-mir-141
  gRNA
ucaaccauccaacacugcac

SEQ ID NO: 65288 - RNA, 20 nt, Artificial Sequence
  MKO10065288_A_mmu-mir-141
  gRNA
cuaacacugucugguaaaga

SEQ ID NO: 65289 - RNA, 20 nt, Artificial Sequence
  MKO10065289_A_mmu-mir-141
  gRNA
augaagcuccuaacacuguc

SEQ ID NO: 65290 - RNA, 20 nt, Artificial Sequence
  MKO10065290_A_mmu-mir-200c
  gRNA
caggggccuccaucauuacc

SEQ ID NO: 65291 - RNA, 20 nt, Artificial Sequence
  MKO10065291_A_mmu-mir-200c
  gRNA
aaccagcacccaaacacugc

SEQ ID NO: 65292 - RNA, 20 nt, Artificial Sequence
  MKO10065292_A_mmu-mir-200c
  gRNA
ugggagucucuaauacugcc

SEQ ID NO: 65293 - RNA, 20 nt, Artificial Sequence
  MKO10065293_A_mmu-mir-200c
  gRNA
aaacacugcuggguaagacg

SEQ ID NO: 65294 - RNA, 20 nt, Artificial Sequence
  MKO10065294_A_mmu-mir-7045
  gRNA
gcggaaagagcggguggggg

SEQ ID NO: 65295 - RNA, 20 nt, Artificial Sequence
  MKO10065295_A_mmu-mir-7045
  gRNA
ggaaagagcgggugggggag

SEQ ID NO: 65296 - RNA, 20 nt, Artificial Sequence
  MKO10065296_A_mmu-mir-7045
  gRNA
agucacugugcgggggaggg

SEQ ID NO: 65297 - RNA, 20 nt, Artificial Sequence
  MKO10065297_A_mmu-mir-7045
  gRNA
cgagucacugugcgggggag

SEQ ID NO: 65298 - RNA, 20 nt, Artificial Sequence
  MKO10065298_A_mmu-mir-3098
  gRNA
ggcccuccacacauuguggu

SEQ ID NO: 65299 - RNA, 20 nt, Artificial Sequence
  MKO10065299_A_mmu-mir-3098
  gRNA
ggaguccuaacagcaggagu

SEQ ID NO: 65300 - RNA, 20 nt, Artificial Sequence
  MKO10065300_A_mmu-mir-3098
  gRNA
uaggacccuuuccccacaac

SEQ ID NO: 65301 - RNA, 20 nt, Artificial Sequence
  MKO10065301_A_mmu-mir-3098
  gRNA
aaggcaggcagcagaagcag

SEQ ID NO: 65302 - RNA, 20 nt, Artificial Sequence
  MKO10065302_A_mmu-mir-8113
  gRNA
aguugcggauaagaaaaccu

SEQ ID NO: 65303 - RNA, 20 nt, Artificial Sequence
  MKO10065303_A_mmu-mir-8113
  gRNA
auaagaaaaccuugggagag

SEQ ID NO: 65304 - RNA, 20 nt, Artificial Sequence
  MKO10065304_A_mmu-mir-8113
  gRNA
ccuugggagagaggagagcc

SEQ ID NO: 65305 - RNA, 20 nt, Artificial Sequence
  MKO10065305_A_mmu-mir-8113
  gRNA
accacagaucuuuagagacc

SEQ ID NO: 65306 - RNA, 20 nt, Artificial Sequence
  MKO10065306_A_mmu-mir-7233
  gRNA
uugcaaggcaguagaccuaa

SEQ ID NO: 65307 - RNA, 20 nt, Artificial Sequence
  MKO10065307_A_mmu-mir-7233
  gRNA
agaaguuagggacagauaga

SEQ ID NO: 65308 - RNA, 20 nt, Artificial Sequence
  MKO10065308_A_mmu-mir-7233
  gRNA
uuuaggucuacugccuugca

SEQ ID NO: 65309 - RNA, 20 nt, Artificial Sequence
  MKO10065309_A_mmu-mir-7233
  gRNA
gaucuauauugucugccuuu

SEQ ID NO: 65310 - RNA, 20 nt, Artificial Sequence
  MKO10065310_A_mmu-mir-7649
  gRNA
augucagaaacaagcagugc

SEQ ID NO: 65311 - RNA, 20 nt, Artificial Sequence
  MKO10065311_A_mmu-mir-7649
  gRNA
ugacagcagugcuguagaca

SEQ ID NO: 65312 - RNA, 20 nt, Artificial Sequence
  MKO10065312_A_mmu-mir-680-1
  gRNA
gaagugggcaucugcugaca

SEQ ID NO: 65313 - RNA, 20 nt, Artificial Sequence
  MKO10065313_A_mmu-mir-680-1
  gRNA
agugggcaucugcugacaug

SEQ ID NO: 65314 - RNA, 20 nt, Artificial Sequence
  MKO10065314_A_mmu-mir-680-1
  gRNA
cgaagucaggcgccaggaag

SEQ ID NO: 65315 - RNA, 20 nt, Artificial Sequence
  MKO10065315_A_mmu-mir-680-1
  gRNA
aucgauccucuugacagccu

SEQ ID NO: 65316 - RNA, 20 nt, Artificial Sequence
  MKO10065316_A_mmu-mir-290a
  gRNA
gucuggaccgccucaucuug

SEQ ID NO: 65317 - RNA, 20 nt, Artificial Sequence
  MKO10065317_A_mmu-mir-290a
  gRNA
aucuugcgguacucaaacua

SEQ ID NO: 65318 - RNA, 20 nt, Artificial Sequence
  MKO10065318_A_mmu-mir-290a
  gRNA
cuugcgguacucaaacuaug

SEQ ID NO: 65319 - RNA, 20 nt, Artificial Sequence
  MKO10065319_A_mmu-mir-290a
  gRNA
cgccuaguuuuaagccccgc

SEQ ID NO: 65320 - RNA, 20 nt, Artificial Sequence
  MKO10065320_A_mmu-mir-290b
  gRNA
aucuugcgguacucaaacua

SEQ ID NO: 65321 - RNA, 20 nt, Artificial Sequence
  MKO10065321_A_mmu-mir-290b
  gRNA
aaccggcggggcuuaaaacu

SEQ ID NO: 65322 - RNA, 20 nt, Artificial Sequence
  MKO10065322_A_mmu-mir-290b
  gRNA
cuugcgguacucaaacuaug

SEQ ID NO: 65323 - RNA, 20 nt, Artificial Sequence
  MKO10065323_A_mmu-mir-290b
  gRNA
cgccuaguuuuaagccccgc

SEQ ID NO: 65324 - RNA, 20 nt, Artificial Sequence
  MKO10065324_A_mmu-mir-291a
  gRNA
gagcuguuacaccuauguag

SEQ ID NO: 65325 - RNA, 20 nt, Artificial Sequence
  MKO10065325_A_mmu-mir-291a
  gRNA
cuauguagcggccaucaaag

SEQ ID NO: 65326 - RNA, 20 nt, Artificial Sequence
  MKO10065326_A_mmu-mir-291a
  gRNA
uguagcggccaucaaagugg

SEQ ID NO: 65327 - RNA, 20 nt, Artificial Sequence
  MKO10065327_A_mmu-mir-291a
  gRNA
ccacuuugugugccacugca

SEQ ID NO: 65328 - RNA, 20 nt, Artificial Sequence
  MKO10065328_A_mmu-mir-292
  gRNA
ccagccugugauacucaaac

SEQ ID NO: 65329 - RNA, 20 nt, Artificial Sequence
  MKO10065329_A_mmu-mir-292
  gRNA
acucaaacugggggcucuuu

SEQ ID NO: 65330 - RNA, 20 nt, Artificial Sequence
  MKO10065330_A_mmu-mir-292
  gRNA
gggcucuuuuggauuuucau

SEQ ID NO: 65331 - RNA, 20 nt, Artificial Sequence
  MKO10065331_A_mmu-mir-292
  gRNA
aucggaagaaaagugccgcc

SEQ ID NO: 65332 - RNA, 20 nt, Artificial Sequence
  MKO10065332_A_mmu-mir-292b
  gRNA
ccagccugugauacucaaac

SEQ ID NO: 65333 - RNA, 20 nt, Artificial Sequence
  MKO10065333_A_mmu-mir-292b
  gRNA
acucaaacugggggcucuuu

SEQ ID NO: 65334 - RNA, 20 nt, Artificial Sequence
  MKO10065334_A_mmu-mir-292b
  gRNA
gggcucuuuuggauuuucau

SEQ ID NO: 65335 - RNA, 20 nt, Artificial Sequence
  MKO10065335_A_mmu-mir-292b
  gRNA
aucggaagaaaagugccgcc

SEQ ID NO: 65336 - RNA, 20 nt, Artificial Sequence
  MKO10065336_A_mmu-mir-291b
  gRNA
acauacagugucgaucaaag

SEQ ID NO: 65337 - RNA, 20 nt, Artificial Sequence
  MKO10065337_A_mmu-mir-291b
  gRNA
uacagugucgaucaaagugg

SEQ ID NO: 65338 - RNA, 20 nt, Artificial Sequence
  MKO10065338_A_mmu-mir-291b
  gRNA
caaaguggaggcccucuccg

SEQ ID NO: 65339 - RNA, 20 nt, Artificial Sequence
  MKO10065339_A_mmu-mir-291b
  gRNA
uucccgccaagccgcggaga

SEQ ID NO: 65340 - RNA, 20 nt, Artificial Sequence
  MKO10065340_A_mmu-mir-293
  gRNA
uguggaaaugcuucaaucug

SEQ ID NO: 65341 - RNA, 20 nt, Artificial Sequence
  MKO10065341_A_mmu-mir-293
  gRNA
gccaacugcaguuucucaau

SEQ ID NO: 65342 - RNA, 20 nt, Artificial Sequence
  MKO10065342_A_mmu-mir-293
  gRNA
gccgauugagaaacugcagu

SEQ ID NO: 65343 - RNA, 20 nt, Artificial Sequence
  MKO10065343_A_mmu-mir-293
  gRNA
cagauugaagcauuuccaca

SEQ ID NO: 65344 - RNA, 20 nt, Artificial Sequence
  MKO10065344_A_mmu-mir-294
  gRNA
ccauauagccauacucaaaa

SEQ ID NO: 65345 - RNA, 20 nt, Artificial Sequence
  MKO10065345_A_mmu-mir-294
  gRNA
uauagccauacucaaaaugg

SEQ ID NO: 65346 - RNA, 20 nt, Artificial Sequence
  MKO10065346_A_mmu-mir-294
  gRNA
ccauuuugaguauggcuaua

SEQ ID NO: 65347 - RNA, 20 nt, Artificial Sequence
  MKO10065347_A_mmu-mir-294
  gRNA
uagggccuccauuuugagua

SEQ ID NO: 65348 - RNA, 20 nt, Artificial Sequence
  MKO10065348_A_mmu-mir-295
  gRNA
aucuuggugagacucaaaug

SEQ ID NO: 65349 - RNA, 20 nt, Artificial Sequence
  MKO10065349_A_mmu-mir-295
  gRNA
cuuggugagacucaaaugug

SEQ ID NO: 65350 - RNA, 20 nt, Artificial Sequence
  MKO10065350_A_mmu-mir-295
  gRNA
ucaaauguggggcacacuuc

SEQ ID NO: 65351 - RNA, 20 nt, Artificial Sequence
  MKO10065351_A_mmu-mir-295
  gRNA
cuacuuuugagucucuccug

SEQ ID NO: 65352 - RNA, 20 nt, Artificial Sequence
  MKO10065352_A_mmu-mir-3572
  gRNA
caaguaaguggagaccaguu

SEQ ID NO: 65353 - RNA, 20 nt, Artificial Sequence
  MKO10065353_A_mmu-mir-3572
  gRNA
aguaaguggagaccaguuug

SEQ ID NO: 65354 - RNA, 20 nt, Artificial Sequence
  MKO10065354_A_mmu-mir-3572
  gRNA
uggagaccaguuuggggaac

SEQ ID NO: 65355 - RNA, 20 nt, Artificial Sequence
  MKO10065355_A_mmu-mir-3572
  gRNA
ccaguuuggggaacagggca

SEQ ID NO: 65356 - RNA, 20 nt, Artificial Sequence
  MKO10065356_A_mmu-mir-3099
  gRNA
uacgcacauaggcuagagag

SEQ ID NO: 65357 - RNA, 20 nt, Artificial Sequence
  MKO10065357_A_mmu-mir-3099
  gRNA
cacauaggcuagagagaggu

SEQ ID NO: 65358 - RNA, 20 nt, Artificial Sequence
  MKO10065358_A_mmu-mir-3099
  gRNA
cauaggcuagagagagguug

SEQ ID NO: 65359 - RNA, 20 nt, Artificial Sequence
  MKO10065359_A_mmu-mir-3099
  gRNA
cuagagagagguuggggaug

SEQ ID NO: 65360 - RNA, 20 nt, Artificial Sequence
  MKO10065360_A_mmu-mir-5620
  gRNA
ugggaaagcugucacgaggc

SEQ ID NO: 65361 - RNA, 20 nt, Artificial Sequence
  MKO10065361_A_mmu-mir-5620
  gRNA
ggaaagcugucacgaggcag

SEQ ID NO: 65362 - RNA, 20 nt, Artificial Sequence
  MKO10065362_A_mmu-mir-5620
  gRNA
gagugacugugugaggcagg

SEQ ID NO: 65363 - RNA, 20 nt, Artificial Sequence
  MKO10065363_A_mmu-mir-5620
  gRNA
gcgagugacugugugaggca

SEQ ID NO: 65364 - RNA, 20 nt, Artificial Sequence
  MKO10065364_A_mmu-mir-3100
  gRNA
ggguccucugugcuugggaa

SEQ ID NO: 65365 - RNA, 20 nt, Artificial Sequence
  MKO10065365_A_mmu-mir-3100
  gRNA
guccucugugcuugggaacg

SEQ ID NO: 65366 - RNA, 20 nt, Artificial Sequence
  MKO10065366_A_mmu-mir-3100
  gRNA
gcuugggaacggggugucuu

SEQ ID NO: 65367 - RNA, 20 nt, Artificial Sequence
  MKO10065367_A_mmu-mir-3100
  gRNA
cggggugucuuugggagucu

SEQ ID NO: 65368 - RNA, 20 nt, Artificial Sequence
  MKO10065368_A_mmu-mir-330
  gRNA
uuuggcgaucucugccucuc

SEQ ID NO: 65369 - RNA, 20 nt, Artificial Sequence
  MKO10065369_A_mmu-mir-330
  gRNA
ccucucugggccugugucuu

SEQ ID NO: 65370 - RNA, 20 nt, Artificial Sequence
  MKO10065370_A_mmu-mir-330
  gRNA
agauccaacgagcaaagcac

SEQ ID NO: 65371 - RNA, 20 nt, Artificial Sequence
  MKO10065371_A_mmu-mir-330
  gRNA
ccuaagacacaggcccagag

SEQ ID NO: 65372 - RNA, 20 nt, Artificial Sequence
  MKO10065372_A_mmu-mir-343
  gRNA
uaccugggauagagugggug

SEQ ID NO: 65373 - RNA, 20 nt, Artificial Sequence
  MKO10065373_A_mmu-mir-343
  gRNA
gggauagaguggguguggcg

SEQ ID NO: 65374 - RNA, 20 nt, Artificial Sequence
  MKO10065374_A_mmu-mir-343
  gRNA
uggcggggguagcagagccc

SEQ ID NO: 65375 - RNA, 20 nt, Artificial Sequence
  MKO10065375_A_mmu-mir-343
  gRNA
cgccacacccacucuauccc

SEQ ID NO: 65376 - RNA, 20 nt, Artificial Sequence
  MKO10065376_A_mmu-mir-7046
  gRNA
uaccagcguggcuccuguag

SEQ ID NO: 65377 - RNA, 20 nt, Artificial Sequence
  MKO10065377_A_mmu-mir-7046
  gRNA
gcguggcuccuguaggggga

SEQ ID NO: 65378 - RNA, 20 nt, Artificial Sequence
  MKO10065378_A_mmu-mir-7046
  gRNA
uguagggggaugggugguuc

SEQ ID NO: 65379 - RNA, 20 nt, Artificial Sequence
  MKO10065379_A_mmu-mir-7046
  gRNA
ugaaccacccaucccccuac

SEQ ID NO: 65380 - RNA, 20 nt, Artificial Sequence
  MKO10065380_A_mmu-mir-7047
  gRNA
cacaauugcucccuggaagg

SEQ ID NO: 65381 - RNA, 20 nt, Artificial Sequence
  MKO10065381_A_mmu-mir-7047
  gRNA
auugcucccuggaaggagga

SEQ ID NO: 65382 - RNA, 20 nt, Artificial Sequence
  MKO10065382_A_mmu-mir-7047
  gRNA
ccucacccuuccuccuucca

SEQ ID NO: 65383 - RNA, 20 nt, Artificial Sequence
  MKO10065383_A_mmu-mir-7047
  gRNA
gagggcugggucugaagagu

SEQ ID NO: 65384 - RNA, 20 nt, Artificial Sequence
  MKO10065384_A_mmu-mir-6537
  gRNA
uucugguucuacaggcagag

SEQ ID NO: 65385 - RNA, 20 nt, Artificial Sequence
  MKO10065385_A_mmu-mir-6537
  gRNA
guucuacaggcagagagggu

SEQ ID NO: 65386 - RNA, 20 nt, Artificial Sequence
  MKO10065386_A_mmu-mir-6537
  gRNA
agugggagaaacucaccgcu

SEQ ID NO: 65387 - RNA, 20 nt, Artificial Sequence
  MKO10065387_A_mmu-mir-6537
  gRNA
cgcuaggaaacucuucucua

SEQ ID NO: 65388 - RNA, 20 nt, Artificial Sequence
  MKO10065388_A_mmu-mir-7048
  gRNA
gggacacuggggaaagagaa

SEQ ID NO: 65389 - RNA, 20 nt, Artificial Sequence
  MKO10065389_A_mmu-mir-7048
  gRNA
uccuaggaugcggggcugag

SEQ ID NO: 65390 - RNA, 20 nt, Artificial Sequence
  MKO10065390_A_mmu-mir-7048
  gRNA
gagaauggaagaagcuaucu

SEQ ID NO: 65391 - RNA, 20 nt, Artificial Sequence
  MKO10065391_A_mmu-mir-7048
  gRNA
accucucagccccgcauccu

SEQ ID NO: 65392 - RNA, 20 nt, Artificial Sequence
  MKO10065392_A_mmu-mir-3101
  gRNA
agaccauccaccaaagcuag

SEQ ID NO: 65393 - RNA, 20 nt, Artificial Sequence
  MKO10065393_A_mmu-mir-3101
  gRNA
auaguacuagcuuuagucaa

SEQ ID NO: 65394 - RNA, 20 nt, Artificial Sequence
  MKO10065394_A_mmu-mir-3101
  gRNA
aggcuugccucuagcuuugg

SEQ ID NO: 65395 - RNA, 20 nt, Artificial Sequence
  MKO10065395_A_mmu-mir-3101
  gRNA
uauaggcuugccucuagcuu

SEQ ID NO: 65396 - RNA, 20 nt, Artificial Sequence
  MKO10065396_A_mmu-mir-1191
  gRNA
cugugaguuuggaaccagcc

SEQ ID NO: 65397 - RNA, 20 nt, Artificial Sequence
  MKO10065397_A_mmu-mir-1191
  gRNA
uagcaacaucuaagccagcc

SEQ ID NO: 65398 - RNA, 20 nt, Artificial Sequence
  MKO10065398_A_mmu-mir-1191
  gRNA
ucuuacuauguagcccuaga

SEQ ID NO: 65399 - RNA, 20 nt, Artificial Sequence
  MKO10065399_A_mmu-mir-1191
  gRNA
uagauguugcuauguagacc

SEQ ID NO: 65400 - RNA, 20 nt, Artificial Sequence
  MKO10065400_A_mmu-mir-7049
  gRNA
cagcuucaccugaggcagac

SEQ ID NO: 65401 - RNA, 20 nt, Artificial Sequence
  MKO10065401_A_mmu-mir-7049
  gRNA
agacaggggcugcaggucag

SEQ ID NO: 65402 - RNA, 20 nt, Artificial Sequence
  MKO10065402_A_mmu-mir-7049
  gRNA
gugucugaaggcagucaggu

SEQ ID NO: 65403 - RNA, 20 nt, Artificial Sequence
  MKO10065403_A_mmu-mir-7049
  gRNA
ccgugugucugaaggcaguc

SEQ ID NO: 65404 - RNA, 20 nt, Artificial Sequence
  MKO10065404_A_mmu-mir-1963
  gRNA
cacccaucaccugcgggaca

SEQ ID NO: 65405 - RNA, 20 nt, Artificial Sequence
  MKO10065405_A_mmu-mir-1963
  gRNA
aagggccgaguccuucccag

SEQ ID NO: 65406 - RNA, 20 nt, Artificial Sequence
  MKO10065406_A_mmu-mir-1963
  gRNA
ccgaguccuucccaguggcc

SEQ ID NO: 65407 - RNA, 20 nt, Artificial Sequence
  MKO10065407_A_mmu-mir-1963
  gRNA
guccuucccaguggccagga

SEQ ID NO: 65408 - RNA, 20 nt, Artificial Sequence
  MKO10065408_A_mmu-mir-1964
  gRNA
cuuaaccuuucuugcgaagc

SEQ ID NO: 65409 - RNA, 20 nt, Artificial Sequence
  MKO10065409_A_mmu-mir-1964
  gRNA
cgaagcuggagcacaaaagc

SEQ ID NO: 65410 - RNA, 20 nt, Artificial Sequence
  MKO10065410_A_mmu-mir-1964
  gRNA
uggagcacaaaagccggugc

SEQ ID NO: 65411 - RNA, 20 nt, Artificial Sequence
  MKO10065411_A_mmu-mir-1964
  gRNA
gugaugccuacaccgacuuc

SEQ ID NO: 65412 - RNA, 20 nt, Artificial Sequence
  MKO10065412_A_mmu-mir-7668
  gRNA
ucugaauaaccugcucucug

SEQ ID NO: 65413 - RNA, 20 nt, Artificial Sequence
  MKO10065413_A_mmu-mir-7668
  gRNA
ucucuguggaagaaaccaug

SEQ ID NO: 65414 - RNA, 20 nt, Artificial Sequence
  MKO10065414_A_mmu-mir-7668
  gRNA
uggaagaaaccaugcggugc

SEQ ID NO: 65415 - RNA, 20 nt, Artificial Sequence
  MKO10065415_A_mmu-mir-7668
  gRNA
gaagaaaccaugcggugcag

SEQ ID NO: 65416 - RNA, 20 nt, Artificial Sequence
  MKO10065416_A_mmu-mir-3569
  gRNA
uuacucggaggagagcagac

SEQ ID NO: 65417 - RNA, 20 nt, Artificial Sequence
  MKO10065417_A_mmu-mir-3569
  gRNA
cucggaggagagcagaccgg

SEQ ID NO: 65418 - RNA, 20 nt, Artificial Sequence
  MKO10065418_A_mmu-mir-3569
  gRNA
gagguccggauuucgaccac

SEQ ID NO: 65419 - RNA, 20 nt, Artificial Sequence
  MKO10065419_A_mmu-mir-3569
  gRNA
gaggagcgcagacugagguc

SEQ ID NO: 65420 - RNA, 20 nt, Artificial Sequence
  MKO10065420_A_mmu-mir-7050
  gRNA
ugucugcccuggggagauaa

SEQ ID NO: 65421 - RNA, 20 nt, Artificial Sequence
  MKO10065421_A_mmu-mir-7050
  gRNA
auaaaggcugagaguucagg

SEQ ID NO: 65422 - RNA, 20 nt, Artificial Sequence
  MKO10065422_A_mmu-mir-7050
  gRNA
ucucagccuuuaucucccca

SEQ ID NO: 65423 - RNA, 20 nt, Artificial Sequence
  MKO10065423_A_mmu-mir-7050
  gRNA
ugggacagaagacaggagaa

SEQ ID NO: 65424 - RNA, 20 nt, Artificial Sequence
  MKO10065424_A_mmu-mir-7051
  gRNA
aacaugcacuacucaccagg

SEQ ID NO: 65425 - RNA, 20 nt, Artificial Sequence
  MKO10065425_A_mmu-mir-7051
  gRNA
caccaggaggaaguuggguc

SEQ ID NO: 65426 - RNA, 20 nt, Artificial Sequence
  MKO10065426_A_mmu-mir-7051
  gRNA
ggaggaaguugggucaggua

SEQ ID NO: 65427 - RNA, 20 nt, Artificial Sequence
  MKO10065427_A_mmu-mir-7051
  gRNA
uaccugacccaacuuccucc

SEQ ID NO: 65428 - RNA, 20 nt, Artificial Sequence
  MKO10065428_A_mmu-mir-7052
  gRNA
gccucuccuaucauguggga

SEQ ID NO: 65429 - RNA, 20 nt, Artificial Sequence
  MKO10065429_A_mmu-mir-7052
  gRNA
ucuccuaucaugugggaagg

SEQ ID NO: 65430 - RNA, 20 nt, Artificial Sequence
  MKO10065430_A_mmu-mir-7052
  gRNA
ccuaucaugugggaaggugg

SEQ ID NO: 65431 - RNA, 20 nt, Artificial Sequence
  MKO10065431_A_mmu-mir-7052
  gRNA
ggcucugcccccuccuuccc

SEQ ID NO: 65432 - RNA, 20 nt, Artificial Sequence
  MKO10065432_A_mmu-mir-7053
  gRNA
aucugguuuaaggcugggga

SEQ ID NO: 65433 - RNA, 20 nt, Artificial Sequence
  MKO10065433_A_mmu-mir-7053
  gRNA
aggcaggcuacuggggagcu

SEQ ID NO: 65434 - RNA, 20 nt, Artificial Sequence
  MKO10065434_A_mmu-mir-7053
  gRNA
uggggaaaggcaggcuacug

SEQ ID NO: 65435 - RNA, 20 nt, Artificial Sequence
  MKO10065435_A_mmu-mir-7053
  gRNA
ugggggagcuggggaaaggc

SEQ ID NO: 65436 - RNA, 20 nt, Artificial Sequence
  MKO10065436_A_mmu-mir-707
  gRNA
ugccuacgcuugugugagca

SEQ ID NO: 65437 - RNA, 20 nt, Artificial Sequence
  MKO10065437_A_mmu-mir-707
  gRNA
cuugugugagcaugggcaug

SEQ ID NO: 65438 - RNA, 20 nt, Artificial Sequence
  MKO10065438_A_mmu-mir-707
  gRNA
cucacacaagcguaggcaag

SEQ ID NO: 65439 - RNA, 20 nt, Artificial Sequence
  MKO10065439_A_mmu-mir-707
  gRNA
gcccaugcucacacaagcgu

SEQ ID NO: 65440 - RNA, 20 nt, Artificial Sequence
  MKO10065440_A_mmu-mir-7054
  gRNA
cuguguccaauaccuggaag

SEQ ID NO: 65441 - RNA, 20 nt, Artificial Sequence
  MKO10065441_A_mmu-mir-7054
  gRNA
aguccaacuuggccccuucc

SEQ ID NO: 65442 - RNA, 20 nt, Artificial Sequence
  MKO10065442_A_mmu-mir-7054
  gRNA
ucacagaacagaguccaacu

SEQ ID NO: 65443 - RNA, 20 nt, Artificial Sequence
  MKO10065443_A_mmu-mir-7054
  gRNA
cuggaacuaggaaggugguu

SEQ ID NO: 65444 - RNA, 20 nt, Artificial Sequence
  MKO10065444_A_mmu-mir-150
  gRNA
ugugccucagacccugguac

SEQ ID NO: 65445 - RNA, 20 nt, Artificial Sequence
  MKO10065445_A_mmu-mir-150
  gRNA
cucagacccugguacaggcc

SEQ ID NO: 65446 - RNA, 20 nt, Artificial Sequence
  MKO10065446_A_mmu-mir-150
  gRNA
cugguacaggccugggggau

SEQ ID NO: 65447 - RNA, 20 nt, Artificial Sequence
  MKO10065447_A_mmu-mir-150
  gRNA
gguacaaggguugggagaca

SEQ ID NO: 65448 - RNA, 20 nt, Artificial Sequence
  MKO10065448_A_mmu-mir-5121
  gRNA
auguaggacaggguaggcuc

SEQ ID NO: 65449 - RNA, 20 nt, Artificial Sequence
  MKO10065449_A_mmu-mir-5121
  gRNA
auguggugacauguaggaca

SEQ ID NO: 65450 - RNA, 20 nt, Artificial Sequence
  MKO10065450_A_mmu-mir-5121
  gRNA
uuggugauguggugacaugu

SEQ ID NO: 65451 - RNA, 20 nt, Artificial Sequence
  MKO10065451_A_mmu-mir-5121
  gRNA
ugcgaggugaguuggugaug

SEQ ID NO: 65452 - RNA, 20 nt, Artificial Sequence
  MKO10065452_A_mmu-mir-7055
  gRNA
cuucaguggguuaucugagu

SEQ ID NO: 65453 - RNA, 20 nt, Artificial Sequence
  MKO10065453_A_mmu-mir-7055
  gRNA
ugcuacuuugauaccccacc

SEQ ID NO: 65454 - RNA, 20 nt, Artificial Sequence
  MKO10065454_A_mmu-mir-7055
  gRNA
guucacguuaaacccuggug

SEQ ID NO: 65455 - RNA, 20 nt, Artificial Sequence
  MKO10065455_A_mmu-mir-7055
  gRNA
ugguucacguuaaacccugg

SEQ ID NO: 65456 - RNA, 20 nt, Artificial Sequence
  MKO10065456_A_mmu-mir-7056
  gRNA
ccugcugugaggaucugugg

SEQ ID NO: 65457 - RNA, 20 nt, Artificial Sequence
  MKO10065457_A_mmu-mir-7056
  gRNA
ucuguggugggagacaggug

SEQ ID NO: 65458 - RNA, 20 nt, Artificial Sequence
  MKO10065458_A_mmu-mir-7056
  gRNA
uggaggaggacagagagguu

SEQ ID NO: 65459 - RNA, 20 nt, Artificial Sequence
  MKO10065459_A_mmu-mir-7056
  gRNA
aggaaaugugggugcugugg

SEQ ID NO: 65460 - RNA, 20 nt, Artificial Sequence
  MKO10065460_A_mmu-mir-6238
  gRNA
gaauauuuucacaccuggcu

SEQ ID NO: 65461 - RNA, 20 nt, Artificial Sequence
  MKO10065461_A_mmu-mir-6238
  gRNA
cuaguucacucaggucagau

SEQ ID NO: 65462 - RNA, 20 nt, Artificial Sequence
  MKO10065462_A_mmu-mir-6238
  gRNA
ggcaauaacuugagugcuua

SEQ ID NO: 65463 - RNA, 20 nt, Artificial Sequence
  MKO10065463_A_mmu-mir-6238
  gRNA
uaaagaccuuuauuagucag

SEQ ID NO: 65464 - RNA, 20 nt, Artificial Sequence
  MKO10065464_A_mmu-mir-6389
  gRNA
aagcuaguuuugccuagcuu

SEQ ID NO: 65465 - RNA, 20 nt, Artificial Sequence
  MKO10065465_A_mmu-mir-6389
  gRNA
aguuuaacauugcacugcuu

SEQ ID NO: 65466 - RNA, 20 nt, Artificial Sequence
  MKO10065466_A_mmu-mir-6389
  gRNA
agcuaggcaaaacuagcuug

SEQ ID NO: 65467 - RNA, 20 nt, Artificial Sequence
  MKO10065467_A_mmu-mir-6389
  gRNA
aaagcuaggcaaaacuagcu

SEQ ID NO: 65468 - RNA, 20 nt, Artificial Sequence
  MKO10065468_A_mmu-mir-344d-1
  gRNA
cucuuuagcaccuuucaguc

SEQ ID NO: 65469 - RNA, 20 nt, Artificial Sequence
  MKO10065469_A_mmu-mir-344d-1
  gRNA
agcaccuuucagucuggcag

SEQ ID NO: 65470 - RNA, 20 nt, Artificial Sequence
  MKO10065470_A_mmu-mir-344d-1
  gRNA
auccaggaccagauaagucc

SEQ ID NO: 65471 - RNA, 20 nt, Artificial Sequence
  MKO10065471_A_mmu-mir-344d-1
  gRNA
auaaccacugccagacugaa

SEQ ID NO: 65472 - RNA, 20 nt, Artificial Sequence
  MKO10065472_A_mmu-mir-344d-2
  gRNA
cucuuuagcaccauucaguc

SEQ ID NO: 65473 - RNA, 20 nt, Artificial Sequence
  MKO10065473_A_mmu-mir-344d-2
  gRNA
agcaccauucagucuggcag

SEQ ID NO: 65474 - RNA, 20 nt, Artificial Sequence
  MKO10065474_A_mmu-mir-344d-2
  gRNA
auccaggaccagauaagucc

SEQ ID NO: 65475 - RNA, 20 nt, Artificial Sequence
  MKO10065475_A_mmu-mir-344d-2
  gRNA
uuccaggacuuaucuggucc

SEQ ID NO: 65476 - RNA, 20 nt, Artificial Sequence
  MKO10065476_A_mmu-mir-344d-3
  gRNA
cucuuuagcaccauucaguc

SEQ ID NO: 65477 - RNA, 20 nt, Artificial Sequence
  MKO10065477_A_mmu-mir-344d-3
  gRNA
agcaccauucagucuggcag

SEQ ID NO: 65478 - RNA, 20 nt, Artificial Sequence
  MKO10065478_A_mmu-mir-344d-3
  gRNA
auccaggaccagauaagucc

SEQ ID NO: 65479 - RNA, 20 nt, Artificial Sequence
  MKO10065479_A_mmu-mir-344d-3
  gRNA
auaaccacugccagacugaa

SEQ ID NO: 65480 - RNA, 20 nt, Artificial Sequence
  MKO10065480_A_mmu-mir-344e
  gRNA
gucuuuagcaccauauaguc

SEQ ID NO: 65481 - RNA, 20 nt, Artificial Sequence
  MKO10065481_A_mmu-mir-344e
  gRNA
agcaccauauagucaggcuu

SEQ ID NO: 65482 - RNA, 20 nt, Artificial Sequence
  MKO10065482_A_mmu-mir-344e
  gRNA
cuuugguuauauccaggacc

SEQ ID NO: 65483 - RNA, 20 nt, Artificial Sequence
  MKO10065483_A_mmu-mir-344e
  gRNA
auccaggaccagguaagucc

SEQ ID NO: 65484 - RNA, 20 nt, Artificial Sequence
  MKO10065484_A_mmu-mir-344h-1
  gRNA
aguaccauacagucgggcuu

SEQ ID NO: 65485 - RNA, 20 nt, Artificial Sequence
  MKO10065485_A_mmu-mir-344h-1
  gRNA
gucgggcuuugguuauaccc

SEQ ID NO: 65486 - RNA, 20 nt, Artificial Sequence
  MKO10065486_A_mmu-mir-344h-1
  gRNA
cuuugguuauacccaggacc

SEQ ID NO: 65487 - RNA, 20 nt, Artificial Sequence
  MKO10065487_A_mmu-mir-344h-1
  gRNA
acccaggaccagguaugucc

SEQ ID NO: 65488 - RNA, 20 nt, Artificial Sequence
  MKO10065488_A_mmu-mir-344h-2
  gRNA
aguaccauacagucgggcuu

SEQ ID NO: 65489 - RNA, 20 nt, Artificial Sequence
  MKO10065489_A_mmu-mir-344h-2
  gRNA
gucgggcuuugguuauaccc

SEQ ID NO: 65490 - RNA, 20 nt, Artificial Sequence
  MKO10065490_A_mmu-mir-344h-2
  gRNA
cuuugguuauacccaggacc

SEQ ID NO: 65491 - RNA, 20 nt, Artificial Sequence
  MKO10065491_A_mmu-mir-344h-2
  gRNA
acccaggaccagguaugucc

SEQ ID NO: 65492 - RNA, 20 nt, Artificial Sequence
  MKO10065492_A_mmu-mir-344b
  gRNA
gucuggagcagcuuacaguc

SEQ ID NO: 65493 - RNA, 20 nt, Artificial Sequence
  MKO10065493_A_mmu-mir-344b
  gRNA
agcagcuuacagucaggcuu

SEQ ID NO: 65494 - RNA, 20 nt, Artificial Sequence
  MKO10065494_A_mmu-mir-344b
  gRNA
cugaaagcugaacuuuagcc

SEQ ID NO: 65495 - RNA, 20 nt, Artificial Sequence
  MKO10065495_A_mmu-mir-344b
  gRNA
auuuucaucagucaggcucc

SEQ ID NO: 65496 - RNA, 20 nt, Artificial Sequence
  MKO10065496_A_mmu-mir-344c
  gRNA
gcuagaguacagcuaucagc

SEQ ID NO: 65497 - RNA, 20 nt, Artificial Sequence
  MKO10065497_A_mmu-mir-344c
  gRNA
guuuuuuucagucaggcugc

SEQ ID NO: 65498 - RNA, 20 nt, Artificial Sequence
  MKO10065498_A_mmu-mir-344c
  gRNA
ugcaaggguuuuuuucaguc

SEQ ID NO: 65499 - RNA, 20 nt, Artificial Sequence
  MKO10065499_A_mmu-mir-344c
  gRNA
cucuggagcaguuuacuguc

SEQ ID NO: 65500 - RNA, 20 nt, Artificial Sequence
  MKO10065500_A_mmu-mir-344-1
  gRNA
uguguucagggcuuacaguc

SEQ ID NO: 65501 - RNA, 20 nt, Artificial Sequence
  MKO10065501_A_mmu-mir-344-1
  gRNA
cagggcuuacagucaggcuu

SEQ ID NO: 65502 - RNA, 20 nt, Artificial Sequence
  MKO10065502_A_mmu-mir-344-1
  gRNA
aucagguaccagcugguacc

SEQ ID NO: 65503 - RNA, 20 nt, Artificial Sequence
  MKO10065503_A_mmu-mir-344-1
  gRNA
cugguaccuggaaucuagcc

SEQ ID NO: 65504 - RNA, 20 nt, Artificial Sequence
  MKO10065504_A_mmu-mir-344-2
  gRNA
uucuuuugcagcuuacaguc

SEQ ID NO: 65505 - RNA, 20 nt, Artificial Sequence
  MKO10065505_A_mmu-mir-344-2
  gRNA
ugcagcuuacagucaggcuu

SEQ ID NO: 65506 - RNA, 20 nt, Artificial Sequence
  MKO10065506_A_mmu-mir-344-2
  gRNA
uugguaccuggaaucuagcc

SEQ ID NO: 65507 - RNA, 20 nt, Artificial Sequence
  MKO10065507_A_mmu-mir-344-2
  gRNA
aaucuagccaggagccugac

SEQ ID NO: 65508 - RNA, 20 nt, Artificial Sequence
  MKO10065508_A_mmu-mir-344g
  gRNA
gcagcuugcagucaagcccc

SEQ ID NO: 65509 - RNA, 20 nt, Artificial Sequence
  MKO10065509_A_mmu-mir-344g
  gRNA
ucaagccccuggcuagagcc

SEQ ID NO: 65510 - RNA, 20 nt, Artificial Sequence
  MKO10065510_A_mmu-mir-344g
  gRNA
ugguuccaggcucuagccag

SEQ ID NO: 65511 - RNA, 20 nt, Artificial Sequence
  MKO10065511_A_mmu-mir-344g
  gRNA
gcugguuccaggcucuagcc

SEQ ID NO: 65512 - RNA, 20 nt, Artificial Sequence
  MKO10065512_A_mmu-mir-344f
  gRNA
cugcuaaguagguuguaguc

SEQ ID NO: 65513 - RNA, 20 nt, Artificial Sequence
  MKO10065513_A_mmu-mir-344f
  gRNA
gucagguccuggcuagagcc

SEQ ID NO: 65514 - RNA, 20 nt, Artificial Sequence
  MKO10065514_A_mmu-mir-344f
  gRNA
cuuagagcuggacuccagcc

SEQ ID NO: 65515 - RNA, 20 nt, Artificial Sequence
  MKO10065515_A_mmu-mir-344f
  gRNA
acuccagccaggagacugac

SEQ ID NO: 65516 - RNA, 20 nt, Artificial Sequence
  MKO10065516_A_mmu-mir-344i
  gRNA
cugagagcuggacuccagcc

SEQ ID NO: 65517 - RNA, 20 nt, Artificial Sequence
  MKO10065517_A_mmu-mir-344i
  gRNA
uccagcucucagcugggucc

SEQ ID NO: 65518 - RNA, 20 nt, Artificial Sequence
  MKO10065518_A_mmu-mir-344i
  gRNA
cuggaguccagcucucagcu

SEQ ID NO: 65519 - RNA, 20 nt, Artificial Sequence
  MKO10065519_A_mmu-mir-344i
  gRNA
uugcaagucaggcuccuggc

SEQ ID NO: 65520 - RNA, 20 nt, Artificial Sequence
  MKO10065520_A_mmu-mir-211
  gRNA
cugcuuggaccugugaccug

SEQ ID NO: 65521 - RNA, 20 nt, Artificial Sequence
  MKO10065521_A_mmu-mir-211
  gRNA
cuaggccucugagugaggca

SEQ ID NO: 65522 - RNA, 20 nt, Artificial Sequence
  MKO10065522_A_mmu-mir-211
  gRNA
gagugaggcaaggacagcaa

SEQ ID NO: 65523 - RNA, 20 nt, Artificial Sequence
  MKO10065523_A_mmu-mir-211
  gRNA
gugaggcaaggacagcaaag

SEQ ID NO: 65524 - RNA, 20 nt, Artificial Sequence
  MKO10065524_A_mmu-mir-6416
  gRNA
ccuuuugcugcucuuugcca

SEQ ID NO: 65525 - RNA, 20 nt, Artificial Sequence
  MKO10065525_A_mmu-mir-6416
  gRNA
gacucacaggugaacgcucu

SEQ ID NO: 65526 - RNA, 20 nt, Artificial Sequence
  MKO10065526_A_mmu-mir-6416
  gRNA
aggugaacgcucuaggggag

SEQ ID NO: 65527 - RNA, 20 nt, Artificial Sequence
  MKO10065527_A_mmu-mir-6416
  gRNA
ugaacgcucuaggggagagg

SEQ ID NO: 65528 - RNA, 20 nt, Artificial Sequence
  MKO10065528_A_mmu-mir-7057
  gRNA
caacuugaguccucuccugc

SEQ ID NO: 65529 - RNA, 20 nt, Artificial Sequence
  MKO10065529_A_mmu-mir-7057
  gRNA
cugcaggagaggacucaagu

SEQ ID NO: 65530 - RNA, 20 nt, Artificial Sequence
  MKO10065530_A_mmu-mir-7057
  gRNA
ucuuaaagggccugcaggag

SEQ ID NO: 65531 - RNA, 20 nt, Artificial Sequence
  MKO10065531_A_mmu-mir-7057
  gRNA
gaauaucuuaaagggccugc

SEQ ID NO: 65532 - RNA, 20 nt, Artificial Sequence
  MKO10065532_A_mmu-mir-7234
  gRNA
uuuucuccaaagacguuucu

SEQ ID NO: 65533 - RNA, 20 nt, Artificial Sequence
  MKO10065533_A_mmu-mir-7234
  gRNA
cuagguagaaacgucuuucu

SEQ ID NO: 65534 - RNA, 20 nt, Artificial Sequence
  MKO10065534_A_mmu-mir-7234
  gRNA
uuucuaccuagaaacgucuu

SEQ ID NO: 65535 - RNA, 20 nt, Artificial Sequence
  MKO10065535_A_mmu-mir-7234
  gRNA
aaacgucuuucuaggguaga

SEQ ID NO: 65536 - RNA, 20 nt, Artificial Sequence
  MKO10065536_A_mmu-mir-7a-2
  gRNA
acggucgggccagccccguu

SEQ ID NO: 65537 - RNA, 20 nt, Artificial Sequence
  MKO10065537_A_mmu-mir-7a-2
  gRNA
acaagucccagucugccaca

SEQ ID NO: 65538 - RNA, 20 nt, Artificial Sequence
  MKO10065538_A_mmu-mir-7a-2
  gRNA
cccagucugccacauggugc

SEQ ID NO: 65539 - RNA, 20 nt, Artificial Sequence
  MKO10065539_A_mmu-mir-7a-2
  gRNA
aaaaucacuagucuuccaaa

SEQ ID NO: 65540 - RNA, 20 nt, Artificial Sequence
  MKO10065540_A_mmu-mir-9-3
  gRNA
gggaggcccguuucucucuu

SEQ ID NO: 65541 - RNA, 20 nt, Artificial Sequence
  MKO10065541_A_mmu-mir-9-3
  gRNA
agauaaccaaagagagaaac

SEQ ID NO: 65542 - RNA, 20 nt, Artificial Sequence
  MKO10065542_A_mmu-mir-9-3
  gRNA
ucgguuaucuagcuuuauga

SEQ ID NO: 65543 - RNA, 20 nt, Artificial Sequence
  MKO10065543_A_mmu-mir-9-3
  gRNA
gaaacgggccucccauucgc

SEQ ID NO: 65544 - RNA, 20 nt, Artificial Sequence
  MKO10065544_A_mmu-mir-1839
  gRNA
caugaaaagguagauagaac

SEQ ID NO: 65545 - RNA, 20 nt, Artificial Sequence
  MKO10065545_A_mmu-mir-1839
  gRNA
auggcuguugguagauaagu

SEQ ID NO: 65546 - RNA, 20 nt, Artificial Sequence
  MKO10065546_A_mmu-mir-1839
  gRNA
uaucuaccuuuucauguagg

SEQ ID NO: 65547 - RNA, 20 nt, Artificial Sequence
  MKO10065547_A_mmu-mir-1839
  gRNA
uucuaucuaccuuuucaugu

SEQ ID NO: 65548 - RNA, 20 nt, Artificial Sequence
  MKO10065548_A_mmu-mir-708
  gRNA
ugaaauggggacugcccuca

SEQ ID NO: 65549 - RNA, 20 nt, Artificial Sequence
  MKO10065549_A_mmu-mir-708
  gRNA
caaggagcuuacaaucuagc

SEQ ID NO: 65550 - RNA, 20 nt, Artificial Sequence
  MKO10065550_A_mmu-mir-708
  gRNA
aggagcuuacaaucuagcug

SEQ ID NO: 65551 - RNA, 20 nt, Artificial Sequence
  MKO10065551_A_mmu-mir-708
  gRNA
acuagacugugagcuucuag

SEQ ID NO: 65552 - RNA, 20 nt, Artificial Sequence
  MKO10065552_A_mmu-mir-6394
  gRNA
ucagcuguugccuuucccag

SEQ ID NO: 65553 - RNA, 20 nt, Artificial Sequence
  MKO10065553_A_mmu-mir-6394
  gRNA
guugccuuucccaggggccg

SEQ ID NO: 65554 - RNA, 20 nt, Artificial Sequence
  MKO10065554_A_mmu-mir-6394
  gRNA
cuccuugcugugucccugag

SEQ ID NO: 65555 - RNA, 20 nt, Artificial Sequence
  MKO10065555_A_mmu-mir-6394
  gRNA
cugugucccugaguggggcc

SEQ ID NO: 65556 - RNA, 20 nt, Artificial Sequence
  MKO10065556_A_mmu-mir-326
  gRNA
uccgagccucaucugucugu

SEQ ID NO: 65557 - RNA, 20 nt, Artificial Sequence
  MKO10065557_A_mmu-mir-326
  gRNA
gccucaucugucuguugggc

SEQ ID NO: 65558 - RNA, 20 nt, Artificial Sequence
  MKO10065558_A_mmu-mir-326
  gRNA
cucaucugucuguugggcug

SEQ ID NO: 65559 - RNA, 20 nt, Artificial Sequence
  MKO10065559_A_mmu-mir-326
  gRNA
cugucuguugggcugggggc

SEQ ID NO: 65560 - RNA, 20 nt, Artificial Sequence
  MKO10065560_A_mmu-mir-3102
  gRNA
guguaccuguggguagccaa

SEQ ID NO: 65561 - RNA, 20 nt, Artificial Sequence
  MKO10065561_A_mmu-mir-3102
  gRNA
guaccuguggguagccaaug

SEQ ID NO: 65562 - RNA, 20 nt, Artificial Sequence
  MKO10065562_A_mmu-mir-3102
  gRNA
uggggugcucuggcuggggc

SEQ ID NO: 65563 - RNA, 20 nt, Artificial Sequence
  MKO10065563_A_mmu-mir-3102
  gRNA
gccccacccuggccacucac

SEQ ID NO: 65564 - RNA, 20 nt, Artificial Sequence
  MKO10065564_A_mmu-mir-139
  gRNA
cagugcacgugucuccagug

SEQ ID NO: 65565 - RNA, 20 nt, Artificial Sequence
  MKO10065565_A_mmu-mir-139
  gRNA
cuccaguguggcucggaggc

SEQ ID NO: 65566 - RNA, 20 nt, Artificial Sequence
  MKO10065566_A_mmu-mir-139
  gRNA
uggcucggaggcuggagacg

SEQ ID NO: 65567 - RNA, 20 nt, Artificial Sequence
  MKO10065567_A_mmu-mir-139
  gRNA
ggcuggagacgcggcccugu

SEQ ID NO: 65568 - RNA, 20 nt, Artificial Sequence
  MKO10065568_A_mmu-mir-7058
  gRNA
gcagcaccacucuggaagaa

SEQ ID NO: 65569 - RNA, 20 nt, Artificial Sequence
  MKO10065569_A_mmu-mir-7058
  gRNA
uaaagggcacacaacuucca

SEQ ID NO: 65570 - RNA, 20 nt, Artificial Sequence
  MKO10065570_A_mmu-mir-7058
  gRNA
cuaccugugaguggguagag

SEQ ID NO: 65571 - RNA, 20 nt, Artificial Sequence
  MKO10065571_A_mmu-mir-7058
  gRNA
caccacucuggaagaaagga

SEQ ID NO: 65572 - RNA, 20 nt, Artificial Sequence
  MKO10065572_A_mmu-mir-7059
  gRNA
aggcuguaaacaaaccaccg

SEQ ID NO: 65573 - RNA, 20 nt, Artificial Sequence
  MKO10065573_A_mmu-mir-7059
  gRNA
ugaggcuguaaacaaaccac

SEQ ID NO: 65574 - RNA, 20 nt, Artificial Sequence
  MKO10065574_A_mmu-mir-7059
  gRNA
uaacugaaagccgcaguccc

SEQ ID NO: 65575 - RNA, 20 nt, Artificial Sequence
  MKO10065575_A_mmu-mir-7059
  gRNA
cugaaagccgcaguccccgg

SEQ ID NO: 65576 - RNA, 20 nt, Artificial Sequence
  MKO10065576_A_mmu-mir-7060
  gRNA
gccccacauucagugagugc

SEQ ID NO: 65577 - RNA, 20 nt, Artificial Sequence
  MKO10065577_A_mmu-mir-7060
  gRNA
ucagugagugcuggguagaa

SEQ ID NO: 65578 - RNA, 20 nt, Artificial Sequence
  MKO10065578_A_mmu-mir-7060
  gRNA
gcuggguagaaugggaaaug

SEQ ID NO: 65579 - RNA, 20 nt, Artificial Sequence
  MKO10065579_A_mmu-mir-7060
  gRNA
ggauggaagcugcaaccgag

SEQ ID NO: 65580 - RNA, 20 nt, Artificial Sequence
  MKO10065580_A_mmu-mir-762
  gRNA
ugucaucuuuggcccggcuc

SEQ ID NO: 65581 - RNA, 20 nt, Artificial Sequence
  MKO10065581_A_mmu-mir-762
  gRNA
uuuggcccggcuccgggucu

SEQ ID NO: 65582 - RNA, 20 nt, Artificial Sequence
  MKO10065582_A_mmu-mir-762
  gRNA
gcuccgggucucggcccgca

SEQ ID NO: 65583 - RNA, 20 nt, Artificial Sequence
  MKO10065583_A_mmu-mir-762
  gRNA
gggucucggcccgcacgguc

SEQ ID NO: 65584 - RNA, 20 nt, Artificial Sequence
  MKO10065584_A_mmu-mir-3103
  gRNA
ucggcaaagagccuguggga

SEQ ID NO: 65585 - RNA, 20 nt, Artificial Sequence
  MKO10065585_A_mmu-mir-3103
  gRNA
gagccugugggaaggaucag

SEQ ID NO: 65586 - RNA, 20 nt, Artificial Sequence
  MKO10065586_A_mmu-mir-3103
  gRNA
ugggaaggaucagagguuag

SEQ ID NO: 65587 - RNA, 20 nt, Artificial Sequence
  MKO10065587_A_mmu-mir-3103
  gRNA
uaaccucugauccuucccac

SEQ ID NO: 65588 - RNA, 20 nt, Artificial Sequence
  MKO10065588_A_mmu-mir-7061
  gRNA
gguacagaauuuauggaaau

SEQ ID NO: 65589 - RNA, 20 nt, Artificial Sequence
  MKO10065589_A_mmu-mir-7061
  gRNA
acagaauuuauggaaauagg

SEQ ID NO: 65590 - RNA, 20 nt, Artificial Sequence
  MKO10065590_A_mmu-mir-7061
  gRNA
cagccuaaaaggaaauaaaa

SEQ ID NO: 65591 - RNA, 20 nt, Artificial Sequence
  MKO10065591_A_mmu-mir-7061
  gRNA
uugccaagguacagaauuua

SEQ ID NO: 65592 - RNA, 20 nt, Artificial Sequence
  MKO10065592_A_mmu-mir-1962
  gRNA
cucguucaguuuccauggag

SEQ ID NO: 65593 - RNA, 20 nt, Artificial Sequence
  MKO10065593_A_mmu-mir-1962
  gRNA
uucaguuuccauggagaggc

SEQ ID NO: 65594 - RNA, 20 nt, Artificial Sequence
  MKO10065594_A_mmu-mir-1962
  gRNA
uuccauggagaggcuggcac

SEQ ID NO: 65595 - RNA, 20 nt, Artificial Sequence
  MKO10065595_A_mmu-mir-1962
  gRNA
auaguuugcaaaugccacag

SEQ ID NO: 65596 - RNA, 20 nt, Artificial Sequence
  MKO10065596_A_mmu-mir-6401
  gRNA
augauaccauaacugggcac

SEQ ID NO: 65597 - RNA, 20 nt, Artificial Sequence
  MKO10065597_A_mmu-mir-6401
  gRNA
cuguuacacuccaguggugu

SEQ ID NO: 65598 - RNA, 20 nt, Artificial Sequence
  MKO10065598_A_mmu-mir-6401
  gRNA
acuccaguggugucggguac

SEQ ID NO: 65599 - RNA, 20 nt, Artificial Sequence
  MKO10065599_A_mmu-mir-6401
  gRNA
auuucagauggaaauguuug

SEQ ID NO: 65600 - RNA, 20 nt, Artificial Sequence
  MKO10065600_A_mmu-mir-7686
  gRNA
uuacagugccccgagcagac

SEQ ID NO: 65601 - RNA, 20 nt, Artificial Sequence
  MKO10065601_A_mmu-mir-7686
  gRNA
acaggaaagcgcccagcccc

SEQ ID NO: 65602 - RNA, 20 nt, Artificial Sequence
  MKO10065602_A_mmu-mir-7686
  gRNA
gcgcccagccccagguccag

SEQ ID NO: 65603 - RNA, 20 nt, Artificial Sequence
  MKO10065603_A_mmu-mir-7686
  gRNA
ccagccccagguccagugga

SEQ ID NO: 65604 - RNA, 20 nt, Artificial Sequence
  MKO10065604_A_mmu-mir-202
  gRNA
ccacaaagaaguauaugcau

SEQ ID NO: 65605 - RNA, 20 nt, Artificial Sequence
  MKO10065605_A_mmu-mir-202
  gRNA
gaaguauaugcauaggaaaa

SEQ ID NO: 65606 - RNA, 20 nt, Artificial Sequence
  MKO10065606_A_mmu-mir-202
  gRNA
ucuaaagagguauagcgcau

SEQ ID NO: 65607 - RNA, 20 nt, Artificial Sequence
  MKO10065607_A_mmu-mir-202
  gRNA
uuuguggaucuggucuaaag

SEQ ID NO: 65608 - RNA, 20 nt, Artificial Sequence
  MKO10065608_A_mmu-mir-7062
  gRNA
aggagaaguuagucugguuu

SEQ ID NO: 65609 - RNA, 20 nt, Artificial Sequence
  MKO10065609_A_mmu-mir-7062
  gRNA
cuaacuucuccuggccccac

SEQ ID NO: 65610 - RNA, 20 nt, Artificial Sequence
  MKO10065610_A_mmu-mir-7062
  gRNA
cagacaugagcauaggaugg

SEQ ID NO: 65611 - RNA, 20 nt, Artificial Sequence
  MKO10065611_A_mmu-mir-7062
  gRNA
acccgagcaccuguggggcc

SEQ ID NO: 65612 - RNA, 20 nt, Artificial Sequence
  MKO10065612_A_mmu-mir-210
  gRNA
agccgcugucacacgcacag

SEQ ID NO: 65613 - RNA, 20 nt, Artificial Sequence
  MKO10065613_A_mmu-mir-210
  gRNA
guccggagcaacgcagugug

SEQ ID NO: 65614 - RNA, 20 nt, Artificial Sequence
  MKO10065614_A_mmu-mir-210
  gRNA
cggagcaacgcagugugcgg

SEQ ID NO: 65615 - RNA, 20 nt, Artificial Sequence
  MKO10065615_A_mmu-mir-210
  gRNA
acgcagugugcggugggcag

SEQ ID NO: 65616 - RNA, 20 nt, Artificial Sequence
  MKO10065616_A_mmu-mir-7063
  gRNA
aaggaggugguccccaugag

SEQ ID NO: 65617 - RNA, 20 nt, Artificial Sequence
  MKO10065617_A_mmu-mir-7063
  gRNA
gugguccccaugagaggugc

SEQ ID NO: 65618 - RNA, 20 nt, Artificial Sequence
  MKO10065618_A_mmu-mir-7063
  gRNA
agaggugcaggcugagcaca

SEQ ID NO: 65619 - RNA, 20 nt, Artificial Sequence
  MKO10065619_A_mmu-mir-7063
  gRNA
cucagccugcaccucucaug

SEQ ID NO: 65620 - RNA, 20 nt, Artificial Sequence
  MKO10065620_A_mmu-mir-3104
  gRNA
ggaaaggccaacuagggggc

SEQ ID NO: 65621 - RNA, 20 nt, Artificial Sequence
  MKO10065621_A_mmu-mir-3104
  gRNA
gccaacuagggggcaggagc

SEQ ID NO: 65622 - RNA, 20 nt, Artificial Sequence
  MKO10065622_A_mmu-mir-3104
  gRNA
gucaguucagcagagggcuc

SEQ ID NO: 65623 - RNA, 20 nt, Artificial Sequence
  MKO10065623_A_mmu-mir-3104
  gRNA
gcgucugucaguucagcaga

SEQ ID NO: 65624 - RNA, 20 nt, Artificial Sequence
  MKO10065624_A_mmu-mir-675
  gRNA
ugccagacccagggacugag

SEQ ID NO: 65625 - RNA, 20 nt, Artificial Sequence
  MKO10065625_A_mmu-mir-675
  gRNA
gacccagggacugagcgguu

SEQ ID NO: 65626 - RNA, 20 nt, Artificial Sequence
  MKO10065626_A_mmu-mir-675
  gRNA
acaguguaccaaguccacug

SEQ ID NO: 65627 - RNA, 20 nt, Artificial Sequence
  MKO10065627_A_mmu-mir-675
  gRNA
gcccuuuccgcaccaguccc

SEQ ID NO: 65628 - RNA, 20 nt, Artificial Sequence
  MKO10065628_A_mmu-mir-483
  gRNA
uagggcaggagagaacaaga

SEQ ID NO: 65629 - RNA, 20 nt, Artificial Sequence
  MKO10065629_A_mmu-mir-483
  gRNA
gcaggagagaacaagacggg

SEQ ID NO: 65630 - RNA, 20 nt, Artificial Sequence
  MKO10065630_A_mmu-mir-483
  gRNA
aggagagaacaagacgggag

SEQ ID NO: 65631 - RNA, 20 nt, Artificial Sequence
  MKO10065631_A_mmu-mir-483
  gRNA
agagaacaagacgggagggg

SEQ ID NO: 65632 - RNA, 20 nt, Artificial Sequence
  MKO10065632_A_mmu-mir-7064
  gRNA
acgacccuagagagacauaa

SEQ ID NO: 65633 - RNA, 20 nt, Artificial Sequence
  MKO10065633_A_mmu-mir-7064
  gRNA
cagguuuggaauggucagca

SEQ ID NO: 65634 - RNA, 20 nt, Artificial Sequence
  MKO10065634_A_mmu-mir-7064
  gRNA
aguaaaggccugggcagguu

SEQ ID NO: 65635 - RNA, 20 nt, Artificial Sequence
  MKO10065635_A_mmu-mir-7064
  gRNA
ugcuucaguaguaaaggccu

SEQ ID NO: 65636 - RNA, 20 nt, Artificial Sequence
  MKO10065636_A_mmu-mir-6404
  gRNA
agaggacagugaagucucug

SEQ ID NO: 65637 - RNA, 20 nt, Artificial Sequence
  MKO10065637_A_mmu-mir-6404
  gRNA
agucucugugggaagugaca

SEQ ID NO: 65638 - RNA, 20 nt, Artificial Sequence
  MKO10065638_A_mmu-mir-6404
  gRNA
ugggaagugacaagggguag

SEQ ID NO: 65639 - RNA, 20 nt, Artificial Sequence
  MKO10065639_A_mmu-mir-6404
  gRNA
agugacaagggguagggggc

SEQ ID NO: 65640 - RNA, 20 nt, Artificial Sequence
  MKO10065640_A_mmu-mir-3105
  gRNA
uaagaaagcugagcaggcuc

SEQ ID NO: 65641 - RNA, 20 nt, Artificial Sequence
  MKO10065641_A_mmu-mir-3105
  gRNA
caguaacuuacgcugcuuac

SEQ ID NO: 65642 - RNA, 20 nt, Artificial Sequence
  MKO10065642_A_mmu-mir-3105
  gRNA
aggaguggaagcagaggcua

SEQ ID NO: 65643 - RNA, 20 nt, Artificial Sequence
  MKO10065643_A_mmu-mir-3105
  gRNA
agaggcaggaguggaagcag

SEQ ID NO: 65644 - RNA, 20 nt, Artificial Sequence
  MKO10065644_A_mmu-mir-7654
  gRNA
aggcgcgcucccgcucgcgc

SEQ ID NO: 65645 - RNA, 20 nt, Artificial Sequence
  MKO10065645_A_mmu-mir-7654
  gRNA
gcgccgggaugccgccgcgu

SEQ ID NO: 65646 - RNA, 20 nt, Artificial Sequence
  MKO10065646_A_mmu-mir-7654
  gRNA
ccgcguugguggagcgcgag

SEQ ID NO: 65647 - RNA, 20 nt, Artificial Sequence
  MKO10065647_A_mmu-mir-7654
  gRNA
ggcggcaucccggcgcgagc

SEQ ID NO: 65648 - RNA, 20 nt, Artificial Sequence
  MKO10065648_A_mmu-mir-7238
  gRNA
gccacucgaacacaaaggac

SEQ ID NO: 65649 - RNA, 20 nt, Artificial Sequence
  MKO10065649_A_mmu-mir-7238
  gRNA
gcucggaugcggaugggacg

SEQ ID NO: 65650 - RNA, 20 nt, Artificial Sequence
  MKO10065650_A_mmu-mir-7238
  gRNA
cugccgccacucgaacacaa

SEQ ID NO: 65651 - RNA, 20 nt, Artificial Sequence
  MKO10065651_A_mmu-mir-7238
  gRNA
uguccuuuguguucgagugg

SEQ ID NO: 65652 - RNA, 20 nt, Artificial Sequence
  MKO10065652_A_mmu-mir-7065
  gRNA
uuuuguccauggaguguagc

SEQ ID NO: 65653 - RNA, 20 nt, Artificial Sequence
  MKO10065653_A_mmu-mir-7065
  gRNA
guaaaccaggaaucucucuc

SEQ ID NO: 65654 - RNA, 20 nt, Artificial Sequence
  MKO10065654_A_mmu-mir-7065
  gRNA
caggaaucucucucaggucu

SEQ ID NO: 65655 - RNA, 20 nt, Artificial Sequence
  MKO10065655_A_mmu-mir-7065
  gRNA
cuugguuuuccuguuugcac

SEQ ID NO: 65656 - RNA, 20 nt, Artificial Sequence
  MKO10065656_A_mmu-mir-1968
  gRNA
acccuccuuaacagcugcag

SEQ ID NO: 65657 - RNA, 20 nt, Artificial Sequence
  MKO10065657_A_mmu-mir-1968
  gRNA
cuccuuaacagcugcagagg

SEQ ID NO: 65658 - RNA, 20 nt, Artificial Sequence
  MKO10065658_A_mmu-mir-1968
  gRNA
cuuaacagcugcagaggugg

SEQ ID NO: 65659 - RNA, 20 nt, Artificial Sequence
  MKO10065659_A_mmu-mir-1968
  gRNA
accauccuuaacagcugcag

SEQ ID NO: 65660 - RNA, 20 nt, Artificial Sequence
  MKO10065660_A_mmu-mir-3106
  gRNA
uggcaacaggagaggagcac

SEQ ID NO: 65661 - RNA, 20 nt, Artificial Sequence
  MKO10065661_A_mmu-mir-3106
  gRNA
augagccaccugugcuuccc

SEQ ID NO: 65662 - RNA, 20 nt, Artificial Sequence
  MKO10065662_A_mmu-mir-3106
  gRNA
gcagccauacacucagagag

SEQ ID NO: 65663 - RNA, 20 nt, Artificial Sequence
  MKO10065663_A_mmu-mir-3106
  gRNA
uguccccagggaagcacagg

SEQ ID NO: 65664 - RNA, 20 nt, Artificial Sequence
  MKO10065664_A_mmu-mir-486
  gRNA
cucugaucucgcccucccug

SEQ ID NO: 65665 - RNA, 20 nt, Artificial Sequence
  MKO10065665_A_mmu-mir-486
  gRNA
cugaucucgcccucccugag

SEQ ID NO: 65666 - RNA, 20 nt, Artificial Sequence
  MKO10065666_A_mmu-mir-486
  gRNA
uccuguacugagcugccccg

SEQ ID NO: 65667 - RNA, 20 nt, Artificial Sequence
  MKO10065667_A_mmu-mir-486
  gRNA
guccuucacugugcucagcu

SEQ ID NO: 65668 - RNA, 20 nt, Artificial Sequence
  MKO10065668_A_mmu-mir-3107
  gRNA
cucugaucucgcccucccug

SEQ ID NO: 65669 - RNA, 20 nt, Artificial Sequence
  MKO10065669_A_mmu-mir-3107
  gRNA
cugaucucgcccucccugag

SEQ ID NO: 65670 - RNA, 20 nt, Artificial Sequence
  MKO10065670_A_mmu-mir-3107
  gRNA
uccuguacugagcugccccg

SEQ ID NO: 65671 - RNA, 20 nt, Artificial Sequence
  MKO10065671_A_mmu-mir-3107
  gRNA
guccuucacugugcucagcu

SEQ ID NO: 65672 - RNA, 20 nt, Artificial Sequence
  MKO10065672_A_mmu-mir-8108
  gRNA
guaacuacgcuccuccccag

SEQ ID NO: 65673 - RNA, 20 nt, Artificial Sequence
  MKO10065673_A_mmu-mir-8108
  gRNA
gucuuaucuggauaugccuc

SEQ ID NO: 65674 - RNA, 20 nt, Artificial Sequence
  MKO10065674_A_mmu-mir-8108
  gRNA
cuuaucuggauaugccucag

SEQ ID NO: 65675 - RNA, 20 nt, Artificial Sequence
  MKO10065675_A_mmu-mir-8108
  gRNA
guaguuacagaaagaaaugu

SEQ ID NO: 65676 - RNA, 20 nt, Artificial Sequence
  MKO10065676_A_mmu-mir-6395
  gRNA
gcugacagaagacucauguc

SEQ ID NO: 65677 - RNA, 20 nt, Artificial Sequence
  MKO10065677_A_mmu-mir-6395
  gRNA
acucuuuaaacagggcagag

SEQ ID NO: 65678 - RNA, 20 nt, Artificial Sequence
  MKO10065678_A_mmu-mir-6395
  gRNA
aaaagacaaacucuuuaaac

SEQ ID NO: 65679 - RNA, 20 nt, Artificial Sequence
  MKO10065679_A_mmu-mir-6395
  gRNA
ggcagagagggccagcuaaa

SEQ ID NO: 65680 - RNA, 20 nt, Artificial Sequence
  MKO10065680_A_mmu-mir-383
  gRNA
gacacuugcucuuucugacc

SEQ ID NO: 65681 - RNA, 20 nt, Artificial Sequence
  MKO10065681_A_mmu-mir-383
  gRNA
uuucugaccaggcagugcug

SEQ ID NO: 65682 - RNA, 20 nt, Artificial Sequence
  MKO10065682_A_mmu-mir-383
  gRNA
cacagucaccuucugaucug

SEQ ID NO: 65683 - RNA, 20 nt, Artificial Sequence
  MKO10065683_A_mmu-mir-383
  gRNA
cucagaucagaaggugacug

SEQ ID NO: 65684 - RNA, 20 nt, Artificial Sequence
  MKO10065684_A_mmu-mir-7666
  gRNA
cgcccgugcgcugcauccca

SEQ ID NO: 65685 - RNA, 20 nt, Artificial Sequence
  MKO10065685_A_mmu-mir-7666
  gRNA
gcaucccacggcgacucucg

SEQ ID NO: 65686 - RNA, 20 nt, Artificial Sequence
  MKO10065686_A_mmu-mir-7666
  gRNA
acucucggggaagcaccgcc

SEQ ID NO: 65687 - RNA, 20 nt, Artificial Sequence
  MKO10065687_A_mmu-mir-7666
  gRNA
gggaagcaccgcccgggcua

SEQ ID NO: 65688 - RNA, 20 nt, Artificial Sequence
  MKO10065688_A_mmu-mir-710
  gRNA
ccuaaguucuaaagaguuga

SEQ ID NO: 65689 - RNA, 20 nt, Artificial Sequence
  MKO10065689_A_mmu-mir-710
  gRNA
uaaguucuaaagaguugaag

SEQ ID NO: 65690 - RNA, 20 nt, Artificial Sequence
  MKO10065690_A_mmu-mir-710
  gRNA
gcucaacucuccccaagacu

SEQ ID NO: 65691 - RNA, 20 nt, Artificial Sequence
  MKO10065691_A_mmu-mir-710
  gRNA
cuuagguaucugaaguggag

SEQ ID NO: 65692 - RNA, 20 nt, Artificial Sequence
  MKO10065692_A_mmu-mir-7066
  gRNA
aaugucugggaggcaggcaa

SEQ ID NO: 65693 - RNA, 20 nt, Artificial Sequence
  MKO10065693_A_mmu-mir-7066
  gRNA
gggaggcaggcaauggguag

SEQ ID NO: 65694 - RNA, 20 nt, Artificial Sequence
  MKO10065694_A_mmu-mir-7066
  gRNA
aggcaauggguagaggucag

SEQ ID NO: 65695 - RNA, 20 nt, Artificial Sequence
  MKO10065695_A_mmu-mir-7066
  gRNA
cuacucauuucccaacccac

SEQ ID NO: 65696 - RNA, 20 nt, Artificial Sequence
  MKO10065696_A_mmu-mir-7240
  gRNA
acacauugaccguguuggag

SEQ ID NO: 65697 - RNA, 20 nt, Artificial Sequence
  MKO10065697_A_mmu-mir-7240
  gRNA
gggcaggaggaguccgacgg

SEQ ID NO: 65698 - RNA, 20 nt, Artificial Sequence
  MKO10065698_A_mmu-mir-7240
  gRNA
gcagggcaggaggaguccga

SEQ ID NO: 65699 - RNA, 20 nt, Artificial Sequence
  MKO10065699_A_mmu-mir-7240
  gRNA
uguuggagaggaccaacggc

SEQ ID NO: 65700 - RNA, 20 nt, Artificial Sequence
  MKO10065700_A_mmu-mir-7067
  gRNA
gaucuuggaguccugugggg

SEQ ID NO: 65701 - RNA, 20 nt, Artificial Sequence
  MKO10065701_A_mmu-mir-7067
  gRNA
cugauugcuucccuccccac

SEQ ID NO: 65702 - RNA, 20 nt, Artificial Sequence
  MKO10065702_A_mmu-mir-7067
  gRNA
cugcagggggugguugcaca

SEQ ID NO: 65703 - RNA, 20 nt, Artificial Sequence
  MKO10065703_A_mmu-mir-7067
  gRNA
ugacgcagggcugcaggggg

SEQ ID NO: 65704 - RNA, 20 nt, Artificial Sequence
  MKO10065704_A_mmu-mir-1969
  gRNA
caucucccugauagugcuag

SEQ ID NO: 65705 - RNA, 20 nt, Artificial Sequence
  MKO10065705_A_mmu-mir-1969
  gRNA
auccaugcugccuccauuuc

SEQ ID NO: 65706 - RNA, 20 nt, Artificial Sequence
  MKO10065706_A_mmu-mir-1969
  gRNA
ugucuacagaccagaaaugg

SEQ ID NO: 65707 - RNA, 20 nt, Artificial Sequence
  MKO10065707_A_mmu-mir-1969
  gRNA
ugaugucuacagaccagaaa

SEQ ID NO: 65708 - RNA, 20 nt, Artificial Sequence
  MKO10065708_A_mmu-mir-6769b
  gRNA
caccagagccugggugggac

SEQ ID NO: 65709 - RNA, 20 nt, Artificial Sequence
  MKO10065709_A_mmu-mir-6769b
  gRNA
uaggcucuuccccacccacc

SEQ ID NO: 65710 - RNA, 20 nt, Artificial Sequence
  MKO10065710_A_mmu-mir-6769b
  gRNA
gcaucuucccugucccaccc

SEQ ID NO: 65711 - RNA, 20 nt, Artificial Sequence
  MKO10065711_A_mmu-mir-6769b
  gRNA
gagggugcuccuggugggug

SEQ ID NO: 65712 - RNA, 20 nt, Artificial Sequence
  MKO10065712_A_mmu-mir-7068
  gRNA
cccagccugagagucagucc

SEQ ID NO: 65713 - RNA, 20 nt, Artificial Sequence
  MKO10065713_A_mmu-mir-7068
  gRNA
gagagucaguccagggugag

SEQ ID NO: 65714 - RNA, 20 nt, Artificial Sequence
  MKO10065714_A_mmu-mir-7068
  gRNA
gaguggguggucagucgggc

SEQ ID NO: 65715 - RNA, 20 nt, Artificial Sequence
  MKO10065715_A_mmu-mir-7068
  gRNA
cucacccuggacugacucuc

SEQ ID NO: 65716 - RNA, 20 nt, Artificial Sequence
  MKO10065716_A_mmu-mir-28b
  gRNA
cucacaaucuauuuaguggc

SEQ ID NO: 65717 - RNA, 20 nt, Artificial Sequence
  MKO10065717_A_mmu-mir-28b
  gRNA
gcacacugccagaaugugug

SEQ ID NO: 65718 - RNA, 20 nt, Artificial Sequence
  MKO10065718_A_mmu-mir-28b
  gRNA
uuaagaugccucacacauuc

SEQ ID NO: 65719 - RNA, 20 nt, Artificial Sequence
  MKO10065719_A_mmu-mir-28b
  gRNA
ggucacauggacuauagaaa

SEQ ID NO: 65720 - RNA, 20 nt, Artificial Sequence
  MKO10065720_A_mmu-mir-1668
  gRNA
ccuucacaucccugauucug

SEQ ID NO: 65721 - RNA, 20 nt, Artificial Sequence
  MKO10065721_A_mmu-mir-1668
  gRNA
gaccugagagccugcagaga

SEQ ID NO: 65722 - RNA, 20 nt, Artificial Sequence
  MKO10065722_A_mmu-mir-1668
  gRNA
ugcagagaaggaggccuuug

SEQ ID NO: 65723 - RNA, 20 nt, Artificial Sequence
  MKO10065723_A_mmu-mir-1668
  gRNA
cuuugaggcugagcucaccu

SEQ ID NO: 65724 - RNA, 20 nt, Artificial Sequence
  MKO10065724_A_mmu-mir-8111
  gRNA
uaccucugccucaugagugc

SEQ ID NO: 65725 - RNA, 20 nt, Artificial Sequence
  MKO10065725_A_mmu-mir-8111
  gRNA
cucaugagugcugggauuaa

SEQ ID NO: 65726 - RNA, 20 nt, Artificial Sequence
  MKO10065726_A_mmu-mir-8111
  gRNA
uaauuuuuauacaccgggca

SEQ ID NO: 65727 - RNA, 20 nt, Artificial Sequence
  MKO10065727_A_mmu-mir-8111
  gRNA
gcacucagagaaacugaggc

SEQ ID NO: 65728 - RNA, 20 nt, Artificial Sequence
  MKO10065728_A_mmu-mir-1199
  gRNA
cgagcgcgcuccagggcgcg

SEQ ID NO: 65729 - RNA, 20 nt, Artificial Sequence
  MKO10065729_A_mmu-mir-1199
  gRNA
cggcagcggaguaccggagc

SEQ ID NO: 65730 - RNA, 20 nt, Artificial Sequence
  MKO10065730_A_mmu-mir-1199
  gRNA
gagccgggccgacugagcac

SEQ ID NO: 65731 - RNA, 20 nt, Artificial Sequence
  MKO10065731_A_mmu-mir-1199
  gRNA
gaguuccucgcccgcgcgac

SEQ ID NO: 65732 - RNA, 20 nt, Artificial Sequence
  MKO10065732_A_mmu-mir-709
  gRNA
cuguccuguuugagcagcac

SEQ ID NO: 65733 - RNA, 20 nt, Artificial Sequence
  MKO10065733_A_mmu-mir-709
  gRNA
cuguuugagcagcacugggg

SEQ ID NO: 65734 - RNA, 20 nt, Artificial Sequence
  MKO10065734_A_mmu-mir-709
  gRNA
gagcagcacuggggaggcag

SEQ ID NO: 65735 - RNA, 20 nt, Artificial Sequence
  MKO10065735_A_mmu-mir-709
  gRNA
agcacuggggaggcagaggc

SEQ ID NO: 65736 - RNA, 20 nt, Artificial Sequence
  MKO10065736_A_mmu-mir-181d
  gRNA
cauucaucccccgguggguc

SEQ ID NO: 65737 - RNA, 20 nt, Artificial Sequence
  MKO10065737_A_mmu-mir-181d
  gRNA
ccgggggaugaaugucacug

SEQ ID NO: 65738 - RNA, 20 nt, Artificial Sequence
  MKO10065738_A_mmu-mir-181d
  gRNA
gaggcagccagacccaccgg

SEQ ID NO: 65739 - RNA, 20 nt, Artificial Sequence
  MKO10065739_A_mmu-mir-181d
  gRNA
aggaggcagccagacccacc

SEQ ID NO: 65740 - RNA, 20 nt, Artificial Sequence
  MKO10065740_A_mmu-mir-181c
  gRNA
cggguggcaguuccaggccu

SEQ ID NO: 65741 - RNA, 20 nt, Artificial Sequence
  MKO10065741_A_mmu-mir-181c
  gRNA
aggccucgggguccacucaa

SEQ ID NO: 65742 - RNA, 20 nt, Artificial Sequence
  MKO10065742_A_mmu-mir-181c
  gRNA
gggguccacucaacggucga

SEQ ID NO: 65743 - RNA, 20 nt, Artificial Sequence
  MKO10065743_A_mmu-mir-181c
  gRNA
agcugcccaaacucaccgac

SEQ ID NO: 65744 - RNA, 20 nt, Artificial Sequence
  MKO10065744_A_mmu-mir-23a
  gRNA
cucacugugccucggacggc

SEQ ID NO: 65745 - RNA, 20 nt, Artificial Sequence
  MKO10065745_A_mmu-mir-23a
  gRNA
cacugugccucggacggcug

SEQ ID NO: 65746 - RNA, 20 nt, Artificial Sequence
  MKO10065746_A_mmu-mir-23a
  gRNA
ccaggaaccccagccguccg

SEQ ID NO: 65747 - RNA, 20 nt, Artificial Sequence
  MKO10065747_A_mmu-mir-23a
  gRNA
cagggucaguuggaaauccc

SEQ ID NO: 65748 - RNA, 20 nt, Artificial Sequence
  MKO10065748_A_mmu-mir-27a
  gRNA
ugacaacuggccugaggagc

SEQ ID NO: 65749 - RNA, 20 nt, Artificial Sequence
  MKO10065749_A_mmu-mir-27a
  gRNA
ggcuuagcugcuugugagca

SEQ ID NO: 65750 - RNA, 20 nt, Artificial Sequence
  MKO10065750_A_mmu-mir-27a
  gRNA
cagcaaagucguguucacag

SEQ ID NO: 65751 - RNA, 20 nt, Artificial Sequence
  MKO10065751_A_mmu-mir-27a
  gRNA
gcagcuaagcccugcuccuc

SEQ ID NO: 65752 - RNA, 20 nt, Artificial Sequence
  MKO10065752_A_mmu-mir-24-2
  gRNA
ggcagggcucugccucucuc

SEQ ID NO: 65753 - RNA, 20 nt, Artificial Sequence
  MKO10065753_A_mmu-mir-24-2
  gRNA
gugcacuggcucaguucagc

SEQ ID NO: 65754 - RNA, 20 nt, Artificial Sequence
  MKO10065754_A_mmu-mir-24-2
  gRNA
uggcucaguucagcaggaac

SEQ ID NO: 65755 - RNA, 20 nt, Artificial Sequence
  MKO10065755_A_mmu-mir-24-2
  gRNA
gaacaggaguccagcccccu

SEQ ID NO: 65756 - RNA, 20 nt, Artificial Sequence
  MKO10065756_A_mmu-mir-3074-2
  gRNA
gugcacuggcucaguucagc

SEQ ID NO: 65757 - RNA, 20 nt, Artificial Sequence
  MKO10065757_A_mmu-mir-3074-2
  gRNA
uggcucaguucagcaggaac

SEQ ID NO: 65758 - RNA, 20 nt, Artificial Sequence
  MKO10065758_A_mmu-mir-3074-2
  gRNA
uaggcacgggaggcggagcc

SEQ ID NO: 65759 - RNA, 20 nt, Artificial Sequence
  MKO10065759_A_mmu-mir-3074-2
  gRNA
agcucaguaggcacgggagg

SEQ ID NO: 65760 - RNA, 20 nt, Artificial Sequence
  MKO10065760_A_mmu-mir-7069
  gRNA
gcaggcaguguuugggggcc

SEQ ID NO: 65761 - RNA, 20 nt, Artificial Sequence
  MKO10065761_A_mmu-mir-7069
  gRNA
gcaguguuugggggccuggg

SEQ ID NO: 65762 - RNA, 20 nt, Artificial Sequence
  MKO10065762_A_mmu-mir-7069
  gRNA
ccugcccugccaaccccuac

SEQ ID NO: 65763 - RNA, 20 nt, Artificial Sequence
  MKO10065763_A_mmu-mir-7069
  gRNA
ccuguagggguuggcagggc

SEQ ID NO: 65764 - RNA, 20 nt, Artificial Sequence
  MKO10065764_A_mmu-mir-7070
  gRNA
gcuccaggugaggggagcug

SEQ ID NO: 65765 - RNA, 20 nt, Artificial Sequence
  MKO10065765_A_mmu-mir-7070
  gRNA
caggugaggggagcugaggc

SEQ ID NO: 65766 - RNA, 20 nt, Artificial Sequence
  MKO10065766_A_mmu-mir-7070
  gRNA
gugaggggagcugaggcagg

SEQ ID NO: 65767 - RNA, 20 nt, Artificial Sequence
  MKO10065767_A_mmu-mir-7070
  gRNA
ggcaggaggccaagcaggcu

SEQ ID NO: 65768 - RNA, 20 nt, Artificial Sequence
  MKO10065768_A_mmu-mir-8109
  gRNA
guggcgcgcgccgggagccc

SEQ ID NO: 65769 - RNA, 20 nt, Artificial Sequence
  MKO10065769_A_mmu-mir-8109
  gRNA
gcgagcgcagcgccgcgugc

SEQ ID NO: 65770 - RNA, 20 nt, Artificial Sequence
  MKO10065770_A_mmu-mir-8109
  gRNA
gcagcgccgcgugccggccg

SEQ ID NO: 65771 - RNA, 20 nt, Artificial Sequence
  MKO10065771_A_mmu-mir-8109
  gRNA
cccgcccgccacucgcuucc

SEQ ID NO: 65772 - RNA, 20 nt, Artificial Sequence
  MKO10065772_A_mmu-mir-7071
  gRNA
cggccgggggcccgggggcc

SEQ ID NO: 65773 - RNA, 20 nt, Artificial Sequence
  MKO10065773_A_mmu-mir-7071
  gRNA
ggcccgggggcccgggagcg

SEQ ID NO: 65774 - RNA, 20 nt, Artificial Sequence
  MKO10065774_A_mmu-mir-7071
  gRNA
caccucgcucccgggccccc

SEQ ID NO: 65775 - RNA, 20 nt, Artificial Sequence
  MKO10065775_A_mmu-mir-7071
  gRNA
cgcugcagcaccucgcuccc

SEQ ID NO: 65776 - RNA, 20 nt, Artificial Sequence
  MKO10065776_A_mmu-mir-8110
  gRNA
ugcccuaacagccguuuguu

SEQ ID NO: 65777 - RNA, 20 nt, Artificial Sequence
  MKO10065777_A_mmu-mir-8110
  gRNA
uuaaucugaauugagaagcg

SEQ ID NO: 65778 - RNA, 20 nt, Artificial Sequence
  MKO10065778_A_mmu-mir-8110
  gRNA
cugaauugagaagcguggau

SEQ ID NO: 65779 - RNA, 20 nt, Artificial Sequence
  MKO10065779_A_mmu-mir-8110
  gRNA
gaauugagaagcguggauug

SEQ ID NO: 65780 - RNA, 20 nt, Artificial Sequence
  MKO10065780_A_mmu-mir-138-2
  gRNA
ugcagcugguguugugaauc

SEQ ID NO: 65781 - RNA, 20 nt, Artificial Sequence
  MKO10065781_A_mmu-mir-138-2
  gRNA
cccggcuauuucacgacacc

SEQ ID NO: 65782 - RNA, 20 nt, Artificial Sequence
  MKO10065782_A_mmu-mir-138-2
  gRNA
uaagaggaugcgcugcucgu

SEQ ID NO: 65783 - RNA, 20 nt, Artificial Sequence
  MKO10065783_A_mmu-mir-138-2
  gRNA
ccuggugucgugaaauagcc

SEQ ID NO: 65784 - RNA, 20 nt, Artificial Sequence
  MKO10065784_A_mmu-mir-7072
  gRNA
gggaggggagacaagaggca

SEQ ID NO: 65785 - RNA, 20 nt, Artificial Sequence
  MKO10065785_A_mmu-mir-7072
  gRNA
gcuggggaagaagagaagcu

SEQ ID NO: 65786 - RNA, 20 nt, Artificial Sequence
  MKO10065786_A_mmu-mir-7072
  gRNA
uucuuggacauugaaauggg

SEQ ID NO: 65787 - RNA, 20 nt, Artificial Sequence
  MKO10065787_A_mmu-mir-7072
  gRNA
cuuggacauugaaaugggag

SEQ ID NO: 65788 - RNA, 20 nt, Artificial Sequence
  MKO10065788_A_mmu-mir-7073
  gRNA
agacaagucggcuguugggg

SEQ ID NO: 65789 - RNA, 20 nt, Artificial Sequence
  MKO10065789_A_mmu-mir-7073
  gRNA
cugagacaagucggcuguug

SEQ ID NO: 65790 - RNA, 20 nt, Artificial Sequence
  MKO10065790_A_mmu-mir-7073
  gRNA
gucggcuguuggggaggaaa

SEQ ID NO: 65791 - RNA, 20 nt, Artificial Sequence
  MKO10065791_A_mmu-mir-7073
  gRNA
uagucuuucuagcuuucugg

SEQ ID NO: 65792 - RNA, 20 nt, Artificial Sequence
  MKO10065792_A_mmu-mir-328
  gRNA
gguccaguguacuuggggac

SEQ ID NO: 65793 - RNA, 20 nt, Artificial Sequence
  MKO10065793_A_mmu-mir-328
  gRNA
guguacuuggggacagggga

SEQ ID NO: 65794 - RNA, 20 nt, Artificial Sequence
  MKO10065794_A_mmu-mir-328
  gRNA
caggggacggaagggcagag

SEQ ID NO: 65795 - RNA, 20 nt, Artificial Sequence
  MKO10065795_A_mmu-mir-328
  gRNA
acggaagggcagagagggcc

SEQ ID NO: 65796 - RNA, 20 nt, Artificial Sequence
  MKO10065796_A_mmu-mir-1966
  gRNA
guaugcauguagaauagugu

SEQ ID NO: 65797 - RNA, 20 nt, Artificial Sequence
  MKO10065797_A_mmu-mir-1966
  gRNA
gcauguagaauaguguugga

SEQ ID NO: 65798 - RNA, 20 nt, Artificial Sequence
  MKO10065798_A_mmu-mir-1966
  gRNA
gaauaguguuggaagggagc

SEQ ID NO: 65799 - RNA, 20 nt, Artificial Sequence
  MKO10065799_A_mmu-mir-1966
  gRNA
ucagaaagagccuaaaucuc

SEQ ID NO: 65800 - RNA, 20 nt, Artificial Sequence
  MKO10065800_A_mmu-mir-7074
  gRNA
cauacacacccugcagggag

SEQ ID NO: 65801 - RNA, 20 nt, Artificial Sequence
  MKO10065801_A_mmu-mir-7074
  gRNA
cacccugcagggagaggaga

SEQ ID NO: 65802 - RNA, 20 nt, Artificial Sequence
  MKO10065802_A_mmu-mir-7074
  gRNA
cuccaguccagcagguaacu

SEQ ID NO: 65803 - RNA, 20 nt, Artificial Sequence
  MKO10065803_A_mmu-mir-7074
  gRNA
cugauugcuugggugggaag

SEQ ID NO: 65804 - RNA, 20 nt, Artificial Sequence
  MKO10065804_A_mmu-mir-7075
  gRNA
caacgcugggaaagaagaca

SEQ ID NO: 65805 - RNA, 20 nt, Artificial Sequence
  MKO10065805_A_mmu-mir-7075
  gRNA
gcugggaaagaagacauggu

SEQ ID NO: 65806 - RNA, 20 nt, Artificial Sequence
  MKO10065806_A_mmu-mir-7075
  gRNA
augguuggcuccgcgagccc

SEQ ID NO: 65807 - RNA, 20 nt, Artificial Sequence
  MKO10065807_A_mmu-mir-7075
  gRNA
aaaccauguccuccuccccg

SEQ ID NO: 65808 - RNA, 20 nt, Artificial Sequence
  MKO10065808_A_mmu-mir-140
  gRNA
cugccagugguuuuacccua

SEQ ID NO: 65809 - RNA, 20 nt, Artificial Sequence
  MKO10065809_A_mmu-mir-140
  gRNA
cagugguuuuacccuauggu

SEQ ID NO: 65810 - RNA, 20 nt, Artificial Sequence
  MKO10065810_A_mmu-mir-140
  gRNA
acgucaugcuguucuaccac

SEQ ID NO: 65811 - RNA, 20 nt, Artificial Sequence
  MKO10065811_A_mmu-mir-140
  gRNA
ucuaccacaggguagaacca

SEQ ID NO: 65812 - RNA, 20 nt, Artificial Sequence
  MKO10065812_A_mmu-mir-3108
  gRNA
gucucuaaagcuagacguuc

SEQ ID NO: 65813 - RNA, 20 nt, Artificial Sequence
  MKO10065813_A_mmu-mir-3108
  gRNA
auuuuuuuauuucggcgucu

SEQ ID NO: 65814 - RNA, 20 nt, Artificial Sequence
  MKO10065814_A_mmu-mir-3108
  gRNA
cgucuaggucuagagucuca

SEQ ID NO: 65815 - RNA, 20 nt, Artificial Sequence
  MKO10065815_A_mmu-mir-3108
  gRNA
ggucuagagucucaaggaag

SEQ ID NO: 65816 - RNA, 20 nt, Artificial Sequence
  MKO10065816_A_mmu-mir-3473d
  gRNA
caaauaaguuuucaaagggc

SEQ ID NO: 65817 - RNA, 20 nt, Artificial Sequence
  MKO10065817_A_mmu-mir-3473d
  gRNA
guuuucaaagggcuggaaag

SEQ ID NO: 65818 - RNA, 20 nt, Artificial Sequence
  MKO10065818_A_mmu-mir-3473d
  gRNA
agggcuggaaaguggcucag

SEQ ID NO: 65819 - RNA, 20 nt, Artificial Sequence
  MKO10065819_A_mmu-mir-3473d
  gRNA
gggcuggagagguggcucag

SEQ ID NO: 65820 - RNA, 20 nt, Artificial Sequence
  MKO10065820_A_mmu-mir-1957b
  gRNA
uacaucuuaaguuucuuaug

SEQ ID NO: 65821 - RNA, 20 nt, Artificial Sequence
  MKO10065821_A_mmu-mir-1957b
  gRNA
ucuuaaguuucuuauggggc

SEQ ID NO: 65822 - RNA, 20 nt, Artificial Sequence
  MKO10065822_A_mmu-mir-1957b
  gRNA
ucuuuuucuugguacagggc

SEQ ID NO: 65823 - RNA, 20 nt, Artificial Sequence
  MKO10065823_A_mmu-mir-1957b
  gRNA
gcauucuuuuucuugguaca

SEQ ID NO: 65824 - RNA, 20 nt, Artificial Sequence
  MKO10065824_A_mmu-mir-7076
  gRNA
ucauguugucacagccaacc

SEQ ID NO: 65825 - RNA, 20 nt, Artificial Sequence
  MKO10065825_A_mmu-mir-7076
  gRNA
ugagaccauaccaccucccc

SEQ ID NO: 65826 - RNA, 20 nt, Artificial Sequence
  MKO10065826_A_mmu-mir-7076
  gRNA
augacuaccacugucucccc

SEQ ID NO: 65827 - RNA, 20 nt, Artificial Sequence
  MKO10065827_A_mmu-mir-7076
  gRNA
guauggucucagcggggucc

SEQ ID NO: 65828 - RNA, 20 nt, Artificial Sequence
  MKO10065828_A_mmu-mir-7077
  gRNA
uucggaaacggcauaggcca

SEQ ID NO: 65829 - RNA, 20 nt, Artificial Sequence
  MKO10065829_A_mmu-mir-7077
  gRNA
auaggccaaggucccauggc

SEQ ID NO: 65830 - RNA, 20 nt, Artificial Sequence
  MKO10065830_A_mmu-mir-7077
  gRNA
aauagccugccaugggaccu

SEQ ID NO: 65831 - RNA, 20 nt, Artificial Sequence
  MKO10065831_A_mmu-mir-7077
  gRNA
gucagggaauagccugccau

SEQ ID NO: 65832 - RNA, 20 nt, Artificial Sequence
  MKO10065832_A_mmu-mir-7078
  gRNA
cauaguggacaggguguggg

SEQ ID NO: 65833 - RNA, 20 nt, Artificial Sequence
  MKO10065833_A_mmu-mir-7078
  gRNA
guggacaggguguggguggu

SEQ ID NO: 65834 - RNA, 20 nt, Artificial Sequence
  MKO10065834_A_mmu-mir-7078
  gRNA
gugugggugguaggagacgc

SEQ ID NO: 65835 - RNA, 20 nt, Artificial Sequence
  MKO10065835_A_mmu-mir-7078
  gRNA
gggugguaggagacgcuggc

SEQ ID NO: 65836 - RNA, 20 nt, Artificial Sequence
  MKO10065836_A_mmu-mir-7687
  gRNA
ccacucagucgccccgccac

SEQ ID NO: 65837 - RNA, 20 nt, Artificial Sequence
  MKO10065837_A_mmu-mir-7687
  gRNA
ucagacacagccugcgccuc

SEQ ID NO: 65838 - RNA, 20 nt, Artificial Sequence
  MKO10065838_A_mmu-mir-7687
  gRNA
ccuguggcggggcgacugag

SEQ ID NO: 65839 - RNA, 20 nt, Artificial Sequence
  MKO10065839_A_mmu-mir-7687
  gRNA
ggccccccucaccuguggcg

SEQ ID NO: 65840 - RNA, 20 nt, Artificial Sequence
  MKO10065840_A_mmu-mir-7237
  gRNA
uguacaugguagcuugugac

SEQ ID NO: 65841 - RNA, 20 nt, Artificial Sequence
  MKO10065841_A_mmu-mir-7237
  gRNA
augguagcuugugacaggac

SEQ ID NO: 65842 - RNA, 20 nt, Artificial Sequence
  MKO10065842_A_mmu-mir-7237
  gRNA
cuugugacaggacuggcccu

SEQ ID NO: 65843 - RNA, 20 nt, Artificial Sequence
  MKO10065843_A_mmu-mir-7237
  gRNA
ggauggcuuugcucucccaa

SEQ ID NO: 65844 - RNA, 20 nt, Artificial Sequence
  MKO10065844_A_mmu-mir-6396
  gRNA
uguagccauaguccaggacu

SEQ ID NO: 65845 - RNA, 20 nt, Artificial Sequence
  MKO10065845_A_mmu-mir-6396
  gRNA
uaguccaggacuaggagcua

SEQ ID NO: 65846 - RNA, 20 nt, Artificial Sequence
  MKO10065846_A_mmu-mir-6396
  gRNA
ggacuaggagcuaaggcccc

SEQ ID NO: 65847 - RNA, 20 nt, Artificial Sequence
  MKO10065847_A_mmu-mir-6396
  gRNA
ccuagucagagaggccucug

SEQ ID NO: 65848 - RNA, 20 nt, Artificial Sequence
  MKO10065848_A_mmu-mir-7079
  gRNA
guucugcgcccggagggcug

SEQ ID NO: 65849 - RNA, 20 nt, Artificial Sequence
  MKO10065849_A_mmu-mir-7079
  gRNA
guccugugcacagguccugu

SEQ ID NO: 65850 - RNA, 20 nt, Artificial Sequence
  MKO10065850_A_mmu-mir-7079
  gRNA
acucacugccucagcccucc

SEQ ID NO: 65851 - RNA, 20 nt, Artificial Sequence
  MKO10065851_A_mmu-mir-7079
  gRNA
cuggaaagagaacagaaguc

SEQ ID NO: 65852 - RNA, 20 nt, Artificial Sequence
  MKO10065852_A_mmu-mir-7080
  gRNA
augagugugaagguaggagc

SEQ ID NO: 65853 - RNA, 20 nt, Artificial Sequence
  MKO10065853_A_mmu-mir-7080
  gRNA
agugugaagguaggagcugg

SEQ ID NO: 65854 - RNA, 20 nt, Artificial Sequence
  MKO10065854_A_mmu-mir-7080
  gRNA
gugaagguaggagcuggagg

SEQ ID NO: 65855 - RNA, 20 nt, Artificial Sequence
  MKO10065855_A_mmu-mir-7080
  gRNA
guaggagcuggagguggguu

SEQ ID NO: 65856 - RNA, 20 nt, Artificial Sequence
  MKO10065856_A_mmu-mir-1967
  gRNA
ccuuuugucugacauucaug

SEQ ID NO: 65857 - RNA, 20 nt, Artificial Sequence
  MKO10065857_A_mmu-mir-1967
  gRNA
ucugacauucaugaggaucc

SEQ ID NO: 65858 - RNA, 20 nt, Artificial Sequence
  MKO10065858_A_mmu-mir-1967
  gRNA
ugacauucaugaggauccug

SEQ ID NO: 65859 - RNA, 20 nt, Artificial Sequence
  MKO10065859_A_mmu-mir-1967
  gRNA
ggagaagaugcagaauuccc

SEQ ID NO: 65860 - RNA, 20 nt, Artificial Sequence
  MKO10065860_A_mmu-mir-21c
  gRNA
ucuguucagcuauucucagg

SEQ ID NO: 65861 - RNA, 20 nt, Artificial Sequence
  MKO10065861_A_mmu-mir-21c
  gRNA
uguagcuuagcuuaucagac

SEQ ID NO: 65862 - RNA, 20 nt, Artificial Sequence
  MKO10065862_A_mmu-mir-21c
  gRNA
gcucuguucagcuauucuca

SEQ ID NO: 65863 - RNA, 20 nt, Artificial Sequence
  MKO10065863_A_mmu-mir-1903
  gRNA
uucuucuucuuccugagaca

SEQ ID NO: 65864 - RNA, 20 nt, Artificial Sequence
  MKO10065864_A_mmu-mir-1903
  gRNA
cugagacauggcccgggcag

SEQ ID NO: 65865 - RNA, 20 nt, Artificial Sequence
  MKO10065865_A_mmu-mir-1903
  gRNA
auggcccgggcaguggcucc

SEQ ID NO: 65866 - RNA, 20 nt, Artificial Sequence
  MKO10065866_A_mmu-mir-1903
  gRNA
cgggcaguggcuccuggaag

SEQ ID NO: 65867 - RNA, 20 nt, Artificial Sequence
  MKO10065867_A_mmu-mir-101c
  gRNA
guugagcagucagucaucac

SEQ ID NO: 65868 - RNA, 20 nt, Artificial Sequence
  MKO10065868_A_mmu-mir-101c
  gRNA
ucaucacaggacugugcagu

SEQ ID NO: 65869 - RNA, 20 nt, Artificial Sequence
  MKO10065869_A_mmu-mir-101c
  gRNA
aguagggcaucagucaucac

SEQ ID NO: 65870 - RNA, 20 nt, Artificial Sequence
  MKO10065870_A_mmu-mir-5618
  gRNA
aaacacacuauaccauguaa

SEQ ID NO: 65871 - RNA, 20 nt, Artificial Sequence
  MKO10065871_A_mmu-mir-5618
  gRNA
aggucacuacacgguguaaa

SEQ ID NO: 65872 - RNA, 20 nt, Artificial Sequence
  MKO10065872_A_mmu-mir-5618
  gRNA
guguguuucaggucacuaca

SEQ ID NO: 65873 - RNA, 20 nt, Artificial Sequence
  MKO10065873_A_mmu-mir-5618
  gRNA
gucugaaacuacccuuuaca

SEQ ID NO: 65874 - RNA, 20 nt, Artificial Sequence
  MKO10065874_A_mmu-mir-1899
  gRNA
ggauaaaucuuagucagcga

SEQ ID NO: 65875 - RNA, 20 nt, Artificial Sequence
  MKO10065875_A_mmu-mir-1899
  gRNA
uggccgaaucugcuuccucc

SEQ ID NO: 65876 - RNA, 20 nt, Artificial Sequence
  MKO10065876_A_mmu-mir-1899
  gRNA
guuagaaugaaugugcuaag

SEQ ID NO: 65877 - RNA, 20 nt, Artificial Sequence
  MKO10065877_A_mmu-mir-1899
  gRNA
uaaccaggaggaagcagauu

SEQ ID NO: 65878 - RNA, 20 nt, Artificial Sequence
  MKO10065878_A_mmu-mir-6237
  gRNA
cagugucuucaaugugggac

SEQ ID NO: 65879 - RNA, 20 nt, Artificial Sequence
  MKO10065879_A_mmu-mir-6237
  gRNA
ucaaguuacccuuuaacuua

SEQ ID NO: 65880 - RNA, 20 nt, Artificial Sequence
  MKO10065880_A_mmu-mir-6237
  gRNA
uuacccuuuaacuuaaggau

SEQ ID NO: 65881 - RNA, 20 nt, Artificial Sequence
  MKO10065881_A_mmu-mir-6237
  gRNA
uuaacuuaaggauugggucu

SEQ ID NO: 65882 - RNA, 20 nt, Artificial Sequence
  MKO10065882_A_mmu-mir-7650
  gRNA
gaguuuugauauauacaaga

SEQ ID NO: 65883 - RNA, 20 nt, Artificial Sequence
  MKO10065883_A_mmu-mir-7650
  gRNA
aaugaguucuggguugcaag

SEQ ID NO: 65884 - RNA, 20 nt, Artificial Sequence
  MKO10065884_A_mmu-mir-7650
  gRNA
cauacugagcaaugaguucu

SEQ ID NO: 65885 - RNA, 20 nt, Artificial Sequence
  MKO10065885_A_mmu-mir-7650
  gRNA
aagaaggaauauaagcacaa

SEQ ID NO: 65886 - RNA, 20 nt, Artificial Sequence
  MKO10065886_A_mmu-mir-7081
  gRNA
guauucucaggccugugagg

SEQ ID NO: 65887 - RNA, 20 nt, Artificial Sequence
  MKO10065887_A_mmu-mir-7081
  gRNA
uaccacagauuuauaauccc

SEQ ID NO: 65888 - RNA, 20 nt, Artificial Sequence
  MKO10065888_A_mmu-mir-7081
  gRNA
uccccugguauccuccucac

SEQ ID NO: 65889 - RNA, 20 nt, Artificial Sequence
  MKO10065889_A_mmu-mir-7081
  gRNA
gugguaaaguaguauucccc

SEQ ID NO: 65890 - RNA, 20 nt, Artificial Sequence
  MKO10065890_A_mmu-mir-1900
  gRNA
aauugaaggaccagagaggg

SEQ ID NO: 65891 - RNA, 20 nt, Artificial Sequence
  MKO10065891_A_mmu-mir-1900
  gRNA
aaggaccagagagggcggcc

SEQ ID NO: 65892 - RNA, 20 nt, Artificial Sequence
  MKO10065892_A_mmu-mir-1900
  gRNA
gacacccgggccgcccucuc

SEQ ID NO: 65893 - RNA, 20 nt, Artificial Sequence
  MKO10065893_A_mmu-mir-1900
  gRNA
ggagccuggaggggacaccc

SEQ ID NO: 65894 - RNA, 20 nt, Artificial Sequence
  MKO10065894_A_mmu-mir-7082
  gRNA
gucuggagacagacagcaag

SEQ ID NO: 65895 - RNA, 20 nt, Artificial Sequence
  MKO10065895_A_mmu-mir-7082
  gRNA
gacagacagcaaggggggcc

SEQ ID NO: 65896 - RNA, 20 nt, Artificial Sequence
  MKO10065896_A_mmu-mir-7082
  gRNA
gucaguggccucccagagcc

SEQ ID NO: 65897 - RNA, 20 nt, Artificial Sequence
  MKO10065897_A_mmu-mir-7082
  gRNA
ugggcaacccuggcucuggg

SEQ ID NO: 65898 - RNA, 20 nt, Artificial Sequence
  MKO10065898_A_mmu-mir-199a-1
  gRNA
ugaacagguagucugaacac

SEQ ID NO: 65899 - RNA, 20 nt, Artificial Sequence
  MKO10065899_A_mmu-mir-199a-1
  gRNA
agguagucugaacacuggga

SEQ ID NO: 65900 - RNA, 20 nt, Artificial Sequence
  MKO10065900_A_mmu-mir-199a-1
  gRNA
uagucugaacacugggaugg

SEQ ID NO: 65901 - RNA, 20 nt, Artificial Sequence
  MKO10065901_A_mmu-mir-199a-1
  gRNA
gucugaacacugggauggcg

SEQ ID NO: 65902 - RNA, 20 nt, Artificial Sequence
  MKO10065902_A_mmu-mir-1946b
  gRNA
aagcaugugccaccacugcc

SEQ ID NO: 65903 - RNA, 20 nt, Artificial Sequence
  MKO10065903_A_mmu-mir-1946b
  gRNA
cucaaauucacucugaaagc

SEQ ID NO: 65904 - RNA, 20 nt, Artificial Sequence
  MKO10065904_A_mmu-mir-1946b
  gRNA
ucacucugaaagcugggcag

SEQ ID NO: 65905 - RNA, 20 nt, Artificial Sequence
  MKO10065905_A_mmu-mir-1946b
  gRNA
cucugaaagcugggcagugg

SEQ ID NO: 65906 - RNA, 20 nt, Artificial Sequence
  MKO10065906_A_mmu-mir-7083
  gRNA
cccgagcaauucuggggucc

SEQ ID NO: 65907 - RNA, 20 nt, Artificial Sequence
  MKO10065907_A_mmu-mir-7083
  gRNA
ucugggguccaggagagcag

SEQ ID NO: 65908 - RNA, 20 nt, Artificial Sequence
  MKO10065908_A_mmu-mir-7083
  gRNA
gugcaggggagggucggggc

SEQ ID NO: 65909 - RNA, 20 nt, Artificial Sequence
  MKO10065909_A_mmu-mir-7083
  gRNA
augggugcaggggagggucg

SEQ ID NO: 65910 - RNA, 20 nt, Artificial Sequence
  MKO10065910_A_mmu-mir-7084
  gRNA
aaaccuguggugcagaggac

SEQ ID NO: 65911 - RNA, 20 nt, Artificial Sequence
  MKO10065911_A_mmu-mir-7084
  gRNA
accuguggugcagaggacag

SEQ ID NO: 65912 - RNA, 20 nt, Artificial Sequence
  MKO10065912_A_mmu-mir-7084
  gRNA
gugcagaggacaggggucag

SEQ ID NO: 65913 - RNA, 20 nt, Artificial Sequence
  MKO10065913_A_mmu-mir-7084
  gRNA
gaauaaaaccuguggugcag

SEQ ID NO: 65914 - RNA, 20 nt, Artificial Sequence
  MKO10065914_A_mmu-mir-100
  gRNA
gcacacaagcuugugucuau

SEQ ID NO: 65915 - RNA, 20 nt, Artificial Sequence
  MKO10065915_A_mmu-mir-100
  gRNA
cagcacaaguucggaucuac

SEQ ID NO: 65916 - RNA, 20 nt, Artificial Sequence
  MKO10065916_A_mmu-mir-100
  gRNA
gugcagaaucagcacaaguu

SEQ ID NO: 65917 - RNA, 20 nt, Artificial Sequence
  MKO10065917_A_mmu-mir-100
  gRNA
ucuauagguaugugucuguu

SEQ ID NO: 65918 - RNA, 20 nt, Artificial Sequence
  MKO10065918_A_mmu-let-7a-2
  gRNA
cauugugacugcauguuccc

SEQ ID NO: 65919 - RNA, 20 nt, Artificial Sequence
  MKO10065919_A_mmu-let-7a-2
  gRNA
gacugcauguucccagguug

SEQ ID NO: 65920 - RNA, 20 nt, Artificial Sequence
  MKO10065920_A_mmu-let-7a-2
  gRNA
uguucccagguugagguagu

SEQ ID NO: 65921 - RNA, 20 nt, Artificial Sequence
  MKO10065921_A_mmu-let-7a-2
  gRNA
uauaguuuagaguuacauca

SEQ ID NO: 65922 - RNA, 20 nt, Artificial Sequence
  MKO10065922_A_mmu-mir-125b-1
  gRNA
auguuuaccguuuaaaucca

SEQ ID NO: 65923 - RNA, 20 nt, Artificial Sequence
  MKO10065923_A_mmu-mir-125b-1
  gRNA
accguuuaaauccacggguu

SEQ ID NO: 65924 - RNA, 20 nt, Artificial Sequence
  MKO10065924_A_mmu-mir-125b-1
  gRNA
gguuaggcucuugggagcug

SEQ ID NO: 65925 - RNA, 20 nt, Artificial Sequence
  MKO10065925_A_mmu-mir-125b-1
  gRNA
uuagggucucagggacugag

SEQ ID NO: 65926 - RNA, 20 nt, Artificial Sequence
  MKO10065926_A_mmu-mir-7085
  gRNA
ggugguggugcagugggggc

SEQ ID NO: 65927 - RNA, 20 nt, Artificial Sequence
  MKO10065927_A_mmu-mir-7085
  gRNA
ugcagugggggcaggccagc

SEQ ID NO: 65928 - RNA, 20 nt, Artificial Sequence
  MKO10065928_A_mmu-mir-7085
  gRNA
agcagagcccaaguccuagc

SEQ ID NO: 65929 - RNA, 20 nt, Artificial Sequence
  MKO10065929_A_mmu-mir-7085
  gRNA
ggagaggccagcuaggacuu

SEQ ID NO: 65930 - RNA, 20 nt, Artificial Sequence
  MKO10065930_A_mmu-mir-7086
  gRNA
uaccugaggagauaucagaa

SEQ ID NO: 65931 - RNA, 20 nt, Artificial Sequence
  MKO10065931_A_mmu-mir-7086
  gRNA
guccguucugauaucuccuc

SEQ ID NO: 65932 - RNA, 20 nt, Artificial Sequence
  MKO10065932_A_mmu-mir-7086
  gRNA
cuccccucuuaagaggagaa

SEQ ID NO: 65933 - RNA, 20 nt, Artificial Sequence
  MKO10065933_A_mmu-mir-7086
  gRNA
agauaucagaacggacacug

SEQ ID NO: 65934 - RNA, 20 nt, Artificial Sequence
  MKO10065934_A_mmu-mir-7087
  gRNA
cugcggggguuuucuggcag

SEQ ID NO: 65935 - RNA, 20 nt, Artificial Sequence
  MKO10065935_A_mmu-mir-7087
  gRNA
gagcagacucaguaggcugc

SEQ ID NO: 65936 - RNA, 20 nt, Artificial Sequence
  MKO10065936_A_mmu-mir-7087
  gRNA
cucugcagagcagacucagu

SEQ ID NO: 65937 - RNA, 20 nt, Artificial Sequence
  MKO10065937_A_mmu-mir-7087
  gRNA
guuggaggcagguguggagc

SEQ ID NO: 65938 - RNA, 20 nt, Artificial Sequence
  MKO10065938_A_mmu-mir-34c
  gRNA
ggaauuucagucuuuuuacc

SEQ ID NO: 65939 - RNA, 20 nt, Artificial Sequence
  MKO10065939_A_mmu-mir-34c
  gRNA
cuggcugugugguuagugau

SEQ ID NO: 65940 - RNA, 20 nt, Artificial Sequence
  MKO10065940_A_mmu-mir-34c
  gRNA
caaucacuaaccacacagcc

SEQ ID NO: 65941 - RNA, 20 nt, Artificial Sequence
  MKO10065941_A_mmu-mir-34c
  gRNA
uuuuucugagucuaguuacu

SEQ ID NO: 65942 - RNA, 20 nt, Artificial Sequence
  MKO10065942_A_mmu-mir-34b
  gRNA
gaugcugugccuuguuuuga

SEQ ID NO: 65943 - RNA, 20 nt, Artificial Sequence
  MKO10065943_A_mmu-mir-34b
  gRNA
gugccuuguuuugauggcag

SEQ ID NO: 65944 - RNA, 20 nt, Artificial Sequence
  MKO10065944_A_mmu-mir-34b
  gRNA
acugccuacaaaccgagcac

SEQ ID NO: 65945 - RNA, 20 nt, Artificial Sequence
  MKO10065945_A_mmu-mir-34b
  gRNA
gcgcccggugcucgguuugu

SEQ ID NO: 65946 - RNA, 20 nt, Artificial Sequence
  MKO10065946_A_mmu-mir-6244
  gRNA
ccugcugcucaggcaggcuc

SEQ ID NO: 65947 - RNA, 20 nt, Artificial Sequence
  MKO10065947_A_mmu-mir-6244
  gRNA
cgacucauagcaugggggcg

SEQ ID NO: 65948 - RNA, 20 nt, Artificial Sequence
  MKO10065948_A_mmu-mir-6244
  gRNA
gcaugggggcguggaauuau

SEQ ID NO: 65949 - RNA, 20 nt, Artificial Sequence
  MKO10065949_A_mmu-mir-6244
  gRNA
gggcguggaauuaucgggua

SEQ ID NO: 65950 - RNA, 20 nt, Artificial Sequence
  MKO10065950_A_mmu-mir-130c
  gRNA
cacaccuuggaacauugcac

SEQ ID NO: 65951 - RNA, 20 nt, Artificial Sequence
  MKO10065951_A_mmu-mir-130c
  gRNA
uuugacacacaaaccugcag

SEQ ID NO: 65952 - RNA, 20 nt, Artificial Sequence
  MKO10065952_A_mmu-mir-130c
  gRNA
guguccagugcaauguucca

SEQ ID NO: 65953 - RNA, 20 nt, Artificial Sequence
  MKO10065953_A_mmu-mir-130c
  gRNA
ggauguaaaauguccccugc

SEQ ID NO: 65954 - RNA, 20 nt, Artificial Sequence
  MKO10065954_A_mmu-mir-5710
  gRNA
uccggccuccagaagagucu

SEQ ID NO: 65955 - RNA, 20 nt, Artificial Sequence
  MKO10065955_A_mmu-mir-5710
  gRNA
cauaguguaaggcagugguc

SEQ ID NO: 65956 - RNA, 20 nt, Artificial Sequence
  MKO10065956_A_mmu-mir-5710
  gRNA
gucuggcuagucccacuaac

SEQ ID NO: 65957 - RNA, 20 nt, Artificial Sequence
  MKO10065957_A_mmu-mir-5710
  gRNA
cuaacuggcucuuugucccu

SEQ ID NO: 65958 - RNA, 20 nt, Artificial Sequence
  MKO10065958_A_mmu-mir-6385
  gRNA
agagcugaggaaccagggca

SEQ ID NO: 65959 - RNA, 20 nt, Artificial Sequence
  MKO10065959_A_mmu-mir-6385
  gRNA
ggaugacagagaggaagacu

SEQ ID NO: 65960 - RNA, 20 nt, Artificial Sequence
  MKO10065960_A_mmu-mir-6385
  gRNA
augacagagaggaagacuag

SEQ ID NO: 65961 - RNA, 20 nt, Artificial Sequence
  MKO10065961_A_mmu-mir-6385
  gRNA
gacuaggggcuuccaggaca

SEQ ID NO: 65962 - RNA, 20 nt, Artificial Sequence
  MKO10065962_A_mmu-mir-5133
  gRNA
cugaggaaaacugaagcgag

SEQ ID NO: 65963 - RNA, 20 nt, Artificial Sequence
  MKO10065963_A_mmu-mir-5133
  gRNA
ugaagcgagcggcagagaca

SEQ ID NO: 65964 - RNA, 20 nt, Artificial Sequence
  MKO10065964_A_mmu-mir-5133
  gRNA
gcagcuccagccucucggcg

SEQ ID NO: 65965 - RNA, 20 nt, Artificial Sequence
  MKO10065965_A_mmu-mir-5133
  gRNA
gcucgcuucaguuuuccuca

SEQ ID NO: 65966 - RNA, 20 nt, Artificial Sequence
  MKO10065966_A_mmu-mir-190a
  gRNA
gaauaugcuugauauauagu

SEQ ID NO: 65967 - RNA, 20 nt, Artificial Sequence
  MKO10065967_A_mmu-mir-190a
  gRNA
ugugauauguuugauauauu

SEQ ID NO: 65968 - RNA, 20 nt, Artificial Sequence
  MKO10065968_A_mmu-mir-190a
  gRNA
auaucaaacauaucacacag

SEQ ID NO: 65969 - RNA, 20 nt, Artificial Sequence
  MKO10065969_A_mmu-mir-190a
  gRNA
cacacagaggccugcagaaa

SEQ ID NO: 65970 - RNA, 20 nt, Artificial Sequence
  MKO10065970_A_mmu-mir-7241
  gRNA
cccaugaguaucuacuacgc

SEQ ID NO: 65971 - RNA, 20 nt, Artificial Sequence
  MKO10065971_A_mmu-mir-7241
  gRNA
uacgcaggcuggagauagcc

SEQ ID NO: 65972 - RNA, 20 nt, Artificial Sequence
  MKO10065972_A_mmu-mir-7241
  gRNA
gcaggcuggagauagccagg

SEQ ID NO: 65973 - RNA, 20 nt, Artificial Sequence
  MKO10065973_A_mmu-mir-7241
  gRNA
ccugcguaguagauacucau

SEQ ID NO: 65974 - RNA, 20 nt, Artificial Sequence
  MKO10065974_A_mmu-mir-7242
  gRNA
ugccaaggugagccccuuca

SEQ ID NO: 65975 - RNA, 20 nt, Artificial Sequence
  MKO10065975_A_mmu-mir-7242
  gRNA
gagccccuucauggagaagg

SEQ ID NO: 65976 - RNA, 20 nt, Artificial Sequence
  MKO10065976_A_mmu-mir-7242
  gRNA
uuggcagcucggcucuacuc

SEQ ID NO: 65977 - RNA, 20 nt, Artificial Sequence
  MKO10065977_A_mmu-mir-7242
  gRNA
cuccaugaaggggcucaccu

SEQ ID NO: 65978 - RNA, 20 nt, Artificial Sequence
  MKO10065978_A_mmu-mir-3109
  gRNA
ucucugccugcuccuguaaa

SEQ ID NO: 65979 - RNA, 20 nt, Artificial Sequence
  MKO10065979_A_mmu-mir-3109
  gRNA
gcuccuguaaauggaugcga

SEQ ID NO: 65980 - RNA, 20 nt, Artificial Sequence
  MKO10065980_A_mmu-mir-3109
  gRNA
gccaucucauccagauacug

SEQ ID NO: 65981 - RNA, 20 nt, Artificial Sequence
  MKO10065981_A_mmu-mir-3109
  gRNA
ucauccagauacuguggaga

SEQ ID NO: 65982 - RNA, 20 nt, Artificial Sequence
  MKO10065982_A_mmu-mir-5626
  gRNA
ucacaucacucaacugcugc

SEQ ID NO: 65983 - RNA, 20 nt, Artificial Sequence
  MKO10065983_A_mmu-mir-5626
  gRNA
ugcugccgggucaugagaac

SEQ ID NO: 65984 - RNA, 20 nt, Artificial Sequence
  MKO10065984_A_mmu-mir-5626
  gRNA
caggaagcaguuaaucgaug

SEQ ID NO: 65985 - RNA, 20 nt, Artificial Sequence
  MKO10065985_A_mmu-mir-5626
  gRNA
ugcuuccuguucucaugacc

SEQ ID NO: 65986 - RNA, 20 nt, Artificial Sequence
  MKO10065986_A_mmu-mir-184
  gRNA
cuuagagucacaaagcuggc

SEQ ID NO: 65987 - RNA, 20 nt, Artificial Sequence
  MKO10065987_A_mmu-mir-184
  gRNA
agcuggcuggaaaagugaua

SEQ ID NO: 65988 - RNA, 20 nt, Artificial Sequence
  MKO10065988_A_mmu-mir-184
  gRNA
gcuggaaaagugauaaggaa

SEQ ID NO: 65989 - RNA, 20 nt, Artificial Sequence
  MKO10065989_A_mmu-mir-184
  gRNA
gacggagaacugauaagggu

SEQ ID NO: 65990 - RNA, 20 nt, Artificial Sequence
  MKO10065990_A_mmu-mir-6386
  gRNA
ucucacuugcugaugcagca

SEQ ID NO: 65991 - RNA, 20 nt, Artificial Sequence
  MKO10065991_A_mmu-mir-6386
  gRNA
aaggccuuauuuuugagaca

SEQ ID NO: 65992 - RNA, 20 nt, Artificial Sequence
  MKO10065992_A_mmu-mir-6386
  gRNA
acaagagugguuuagggcua

SEQ ID NO: 65993 - RNA, 20 nt, Artificial Sequence
  MKO10065993_A_mmu-mir-6386
  gRNA
gugcuuaucagcaugccuua

SEQ ID NO: 65994 - RNA, 20 nt, Artificial Sequence
  MKO10065994_A_mmu-mir-7656
  gRNA
cuguuaguguuauccuacac

SEQ ID NO: 65995 - RNA, 20 nt, Artificial Sequence
  MKO10065995_A_mmu-mir-7656
  gRNA
guacaggcugucugauccca

SEQ ID NO: 65996 - RNA, 20 nt, Artificial Sequence
  MKO10065996_A_mmu-mir-7656
  gRNA
cagacagccuguaccagugu

SEQ ID NO: 65997 - RNA, 20 nt, Artificial Sequence
  MKO10065997_A_mmu-mir-7656
  gRNA
guguuauccuacacugguac

SEQ ID NO: 65998 - RNA, 20 nt, Artificial Sequence
  MKO10065998_A_mmu-mir-7243
  gRNA
gaacagcugacagcagaauc

SEQ ID NO: 65999 - RNA, 20 nt, Artificial Sequence
  MKO10065999_A_mmu-mir-7243
  gRNA
cugacagcagaaucaggccu

SEQ ID NO: 66000 - RNA, 20 nt, Artificial Sequence
  MKO10066000_A_mmu-mir-2136
  gRNA
gcauauccgcguauccaguc

SEQ ID NO: 66001 - RNA, 20 nt, Artificial Sequence
  MKO10066001_A_mmu-mir-2136
  gRNA
uauccagucaggagucaguu

SEQ ID NO: 66002 - RNA, 20 nt, Artificial Sequence
  MKO10066002_A_mmu-mir-2136
  gRNA
ggguguugacugagaugugg

SEQ ID NO: 66003 - RNA, 20 nt, Artificial Sequence
  MKO10066003_A_mmu-mir-2136
  gRNA
guguugacugagauguggug

SEQ ID NO: 66004 - RNA, 20 nt, Artificial Sequence
  MKO10066004_A_mmu-mir-135a-1
  gRNA
auucuauugcucgcucauau

SEQ ID NO: 66005 - RNA, 20 nt, Artificial Sequence
  MKO10066005_A_mmu-mir-135a-1
  gRNA
uugcucgcucauauagggau

SEQ ID NO: 66006 - RNA, 20 nt, Artificial Sequence
  MKO10066006_A_mmu-mir-135a-1
  gRNA
ucauauagggauuggagccg

SEQ ID NO: 66007 - RNA, 20 nt, Artificial Sequence
  MKO10066007_A_mmu-mir-135a-1
  gRNA
uggagccguggcguacggug

SEQ ID NO: 66008 - RNA, 20 nt, Artificial Sequence
  MKO10066008_A_mmu-let-7g
  gRNA
uuuugccugauuccaggcug

SEQ ID NO: 66009 - RNA, 20 nt, Artificial Sequence
  MKO10066009_A_mmu-let-7g
  gRNA
guaguaguuuguacaguuug

SEQ ID NO: 66010 - RNA, 20 nt, Artificial Sequence
  MKO10066010_A_mmu-let-7g
  gRNA
ugagggucuaugauaccacc

SEQ ID NO: 66011 - RNA, 20 nt, Artificial Sequence
  MKO10066011_A_mmu-let-7g
  gRNA
ucuaugauaccacccgguac

SEQ ID NO: 66012 - RNA, 20 nt, Artificial Sequence
  MKO10066012_A_mmu-mir-7088
  gRNA
uccagaagaaaggcaagugg

SEQ ID NO: 66013 - RNA, 20 nt, Artificial Sequence
  MKO10066013_A_mmu-mir-7088
  gRNA
aagaaaggcaagugguggug

SEQ ID NO: 66014 - RNA, 20 nt, Artificial Sequence
  MKO10066014_A_mmu-mir-7088
  gRNA
aggcaagugguggugaggag

SEQ ID NO: 66015 - RNA, 20 nt, Artificial Sequence
  MKO10066015_A_mmu-mir-7088
  gRNA
gcugaguaacaggggccacg

SEQ ID NO: 66016 - RNA, 20 nt, Artificial Sequence
  MKO10066016_A_mmu-mir-191
  gRNA
aauggcuggacagcgggcaa

SEQ ID NO: 66017 - RNA, 20 nt, Artificial Sequence
  MKO10066017_A_mmu-mir-191
  gRNA
cagagcauuccagcugcacu

SEQ ID NO: 66018 - RNA, 20 nt, Artificial Sequence
  MKO10066018_A_mmu-mir-191
  gRNA
caagugcagcuggaaugcuc

SEQ ID NO: 66019 - RNA, 20 nt, Artificial Sequence
  MKO10066019_A_mmu-mir-191
  gRNA
gaacgaaauccaagugcagc

SEQ ID NO: 66020 - RNA, 20 nt, Artificial Sequence
  MKO10066020_A_mmu-mir-425
  gRNA
ccacagcauggaaagugcuu

SEQ ID NO: 66021 - RNA, 20 nt, Artificial Sequence
  MKO10066021_A_mmu-mir-425
  gRNA
acacgaucacucccguugag

SEQ ID NO: 66022 - RNA, 20 nt, Artificial Sequence
  MKO10066022_A_mmu-mir-425
  gRNA
guguccgcccagugcucuuu

SEQ ID NO: 66023 - RNA, 20 nt, Artificial Sequence
  MKO10066023_A_mmu-mir-425
  gRNA
uucuugggugcccacucaac

SEQ ID NO: 66024 - RNA, 20 nt, Artificial Sequence
  MKO10066024_A_mmu-mir-711
  gRNA
cuaacuuugaaucucuucuu

SEQ ID NO: 66025 - RNA, 20 nt, Artificial Sequence
  MKO10066025_A_mmu-mir-711
  gRNA
aucucuucuuagggugcuuc

SEQ ID NO: 66026 - RNA, 20 nt, Artificial Sequence
  MKO10066026_A_mmu-mir-711
  gRNA
uucaggcaaagcuggggacc

SEQ ID NO: 66027 - RNA, 20 nt, Artificial Sequence
  MKO10066027_A_mmu-mir-711
  gRNA
caggcaaagcuggggacccg

SEQ ID NO: 66028 - RNA, 20 nt, Artificial Sequence
  MKO10066028_A_mmu-mir-7089
  gRNA
ccgugggaccuacagacucc

SEQ ID NO: 66029 - RNA, 20 nt, Artificial Sequence
  MKO10066029_A_mmu-mir-7089
  gRNA
gaccuacagacuccugggug

SEQ ID NO: 66030 - RNA, 20 nt, Artificial Sequence
  MKO10066030_A_mmu-mir-7089
  gRNA
ucagugucugcugucuccac

SEQ ID NO: 66031 - RNA, 20 nt, Artificial Sequence
  MKO10066031_A_mmu-mir-7089
  gRNA
ccaggagucuguagguccca

SEQ ID NO: 66032 - RNA, 20 nt, Artificial Sequence
  MKO10066032_A_mmu-mir-6236
  gRNA
gaaucaacuagcccugaaaa

SEQ ID NO: 66033 - RNA, 20 nt, Artificial Sequence
  MKO10066033_A_mmu-mir-6236
  gRNA
caacuagcccugaaaaugga

SEQ ID NO: 66034 - RNA, 20 nt, Artificial Sequence
  MKO10066034_A_mmu-mir-6236
  gRNA
gcccugaaaauggauggcgc

SEQ ID NO: 66035 - RNA, 20 nt, Artificial Sequence
  MKO10066035_A_mmu-mir-6236
  gRNA
cccagccgucgccggcaguc

SEQ ID NO: 66036 - RNA, 20 nt, Artificial Sequence
  MKO10066036_A_mmu-mir-8107
  gRNA
auucauauccauggccgaac

SEQ ID NO: 66037 - RNA, 20 nt, Artificial Sequence
  MKO10066037_A_mmu-mir-8107
  gRNA
uggggaccugagggaaacag

SEQ ID NO: 66038 - RNA, 20 nt, Artificial Sequence
  MKO10066038_A_mmu-mir-8107
  gRNA
aaacagagggcugagauguc

SEQ ID NO: 66039 - RNA, 20 nt, Artificial Sequence
  MKO10066039_A_mmu-mir-8107
  gRNA
cuaguuuccaguuuucccag

SEQ ID NO: 66040 - RNA, 20 nt, Artificial Sequence
  MKO10066040_A_mmu-mir-128-2
  gRNA
cucacucucuuacagugcau

SEQ ID NO: 66041 - RNA, 20 nt, Artificial Sequence
  MKO10066041_A_mmu-mir-128-2
  gRNA
agccacugugcagugggaag

SEQ ID NO: 66042 - RNA, 20 nt, Artificial Sequence
  MKO10066042_A_mmu-mir-128-2
  gRNA
gcagccacugugcaguggga

SEQ ID NO: 66043 - RNA, 20 nt, Artificial Sequence
  MKO10066043_A_mmu-mir-128-2
  gRNA
gacacaguagggaaagagac

SEQ ID NO: 66044 - RNA, 20 nt, Artificial Sequence
  MKO10066044_A_mmu-mir-467h
  gRNA
cauguauauguguaugugug

SEQ ID NO: 66045 - RNA, 20 nt, Artificial Sequence
  MKO10066045_A_mmu-mir-467h
  gRNA
uaucuaugugugcauguaug

SEQ ID NO: 66046 - RNA, 20 nt, Artificial Sequence
  MKO10066046_A_mmu-mir-467h
  gRNA
ugcauguauaugugugugug

SEQ ID NO: 66047 - RNA, 20 nt, Artificial Sequence
  MKO10066047_A_mmu-mir-26a-1
  gRNA
cgaggcccuggcgaaggccg

SEQ ID NO: 66048 - RNA, 20 nt, Artificial Sequence
  MKO10066048_A_mmu-mir-26a-1
  gRNA
uaauccaggauaggcugugc

SEQ ID NO: 66049 - RNA, 20 nt, Artificial Sequence
  MKO10066049_A_mmu-mir-26a-1
  gRNA
uaggcugugcaggucccaag

SEQ ID NO: 66050 - RNA, 20 nt, Artificial Sequence
  MKO10066050_A_mmu-mir-26a-1
  gRNA
ggucccaaggggccuauucu

SEQ ID NO: 66051 - RNA, 20 nt, Artificial Sequence
  MKO10066051_A_mmu-mir-7090
  gRNA
ggaaauaaaguucucagagu

SEQ ID NO: 66052 - RNA, 20 nt, Artificial Sequence
  MKO10066052_A_mmu-mir-7090
  gRNA
ccuuugaugucugacuuugc

SEQ ID NO: 66053 - RNA, 20 nt, Artificial Sequence
  MKO10066053_A_mmu-mir-7090
  gRNA
caaagucagacaucaaaggc

SEQ ID NO: 66054 - RNA, 20 nt, Artificial Sequence
  MKO10066054_A_mmu-mir-7090
  gRNA
ccugcaaagucagacaucaa

SEQ ID NO: 66055 - RNA, 20 nt, Artificial Sequence
  MKO10066055_A_mmu-mir-8106
  gRNA
gauuucucaucgagcagcug

SEQ ID NO: 66056 - RNA, 20 nt, Artificial Sequence
  MKO10066056_A_mmu-mir-8106
  gRNA
agcugaggugacucuguaca

SEQ ID NO: 66057 - RNA, 20 nt, Artificial Sequence
  MKO10066057_A_mmu-mir-8106
  gRNA
guguuggaagacagucuugu

SEQ ID NO: 66058 - RNA, 20 nt, Artificial Sequence
  MKO10066058_A_mmu-mir-8106
  gRNA
cuacucagugacucugcaca

SEQ ID NO: 66059 - RNA, 20 nt, Artificial Sequence
  MKO10066059_A_mmu-mir-138-1
  gRNA
gacagcugguguugugaauc

SEQ ID NO: 66060 - RNA, 20 nt, Artificial Sequence
  MKO10066060_A_mmu-mir-138-1
  gRNA
aacggcuacuucacaacacc

SEQ ID NO: 66061 - RNA, 20 nt, Artificial Sequence
  MKO10066061_A_mmu-mir-138-1
  gRNA
uacuucagagaccucuagca

SEQ ID NO: 66062 - RNA, 20 nt, Artificial Sequence
  MKO10066062_A_mmu-mir-138-1
  gRNA
agaccucuagcaugguguug

SEQ ID NO: 66063 - RNA, 20 nt, Artificial Sequence
  MKO10066063_A_mmu-mir-500
  gRNA
ccuucucugaacccuugccc

SEQ ID NO: 66064 - RNA, 20 nt, Artificial Sequence
  MKO10066064_A_mmu-mir-500
  gRNA
ccagauagcaaggauuagag

SEQ ID NO: 66065 - RNA, 20 nt, Artificial Sequence
  MKO10066065_A_mmu-mir-500
  gRNA
agauagcaaggauuagagag

SEQ ID NO: 66066 - RNA, 20 nt, Artificial Sequence
  MKO10066066_A_mmu-mir-500
  gRNA
ggauuagagagggggagcag

SEQ ID NO: 66067 - RNA, 20 nt, Artificial Sequence
  MKO10066067_A_mmu-mir-501
  gRNA
accuuccccaaauccuugcc

SEQ ID NO: 66068 - RNA, 20 nt, Artificial Sequence
  MKO10066068_A_mmu-mir-501
  gRNA
uacaaauagcauuuucaccc

SEQ ID NO: 66069 - RNA, 20 nt, Artificial Sequence
  MKO10066069_A_mmu-mir-501
  gRNA
gagaggaugagcagagcaga

SEQ ID NO: 66070 - RNA, 20 nt, Artificial Sequence
  MKO10066070_A_mmu-mir-501
  gRNA
gaaggugagccugaucugca

SEQ ID NO: 66071 - RNA, 20 nt, Artificial Sequence
  MKO10066071_A_mmu-mir-362
  gRNA
gccucuuugaauccuugaac

SEQ ID NO: 66072 - RNA, 20 nt, Artificial Sequence
  MKO10066072_A_mmu-mir-362
  gRNA
cugaagcagcauucacaccu

SEQ ID NO: 66073 - RNA, 20 nt, Artificial Sequence
  MKO10066073_A_mmu-mir-362
  gRNA
cuagguuccaaggauucgag

SEQ ID NO: 66074 - RNA, 20 nt, Artificial Sequence
  MKO10066074_A_mmu-mir-362
  gRNA
agguuccaaggauucgagag

SEQ ID NO: 66075 - RNA, 20 nt, Artificial Sequence
  MKO10066075_A_mmu-mir-188
  gRNA
cauccugcaaacccugcaug

SEQ ID NO: 66076 - RNA, 20 nt, Artificial Sequence
  MKO10066076_A_mmu-mir-188
  gRNA
gcaaacccugcaugugggag

SEQ ID NO: 66077 - RNA, 20 nt, Artificial Sequence
  MKO10066077_A_mmu-mir-188
  gRNA
agcucacccuccaccaugca

SEQ ID NO: 66078 - RNA, 20 nt, Artificial Sequence
  MKO10066078_A_mmu-mir-188
  gRNA
cucccacaugcaggguuugc

SEQ ID NO: 66079 - RNA, 20 nt, Artificial Sequence
  MKO10066079_A_mmu-mir-532
  gRNA
gcuugcucuccugcaagccu

SEQ ID NO: 66080 - RNA, 20 nt, Artificial Sequence
  MKO10066080_A_mmu-mir-532
  gRNA
ucuccugcaagccuugggug

SEQ ID NO: 66081 - RNA, 20 nt, Artificial Sequence
  MKO10066081_A_mmu-mir-532
  gRNA
cugcaagccuuggguguggg

SEQ ID NO: 66082 - RNA, 20 nt, Artificial Sequence
  MKO10066082_A_mmu-mir-532
  gRNA
ugucaacgguccuacacuca

SEQ ID NO: 66083 - RNA, 20 nt, Artificial Sequence
  MKO10066083_A_mmu-mir-1198
  gRNA
aguugucuguuauguguucc

SEQ ID NO: 66084 - RNA, 20 nt, Artificial Sequence
  MKO10066084_A_mmu-mir-1198
  gRNA
uuauguguuccuggcuggcu

SEQ ID NO: 66085 - RNA, 20 nt, Artificial Sequence
  MKO10066085_A_mmu-mir-1198
  gRNA
ccaagcuagccucuaacuca

SEQ ID NO: 66086 - RNA, 20 nt, Artificial Sequence
  MKO10066086_A_mmu-mir-1198
  gRNA
acaugaguaccaagccagcc

SEQ ID NO: 66087 - RNA, 20 nt, Artificial Sequence
  MKO10066087_A_mmu-mir-221
  gRNA
agaaaucuacauuguaugcc

SEQ ID NO: 66088 - RNA, 20 nt, Artificial Sequence
  MKO10066088_A_mmu-mir-221
  gRNA
cugcuggguuucaggcuacc

SEQ ID NO: 66089 - RNA, 20 nt, Artificial Sequence
  MKO10066089_A_mmu-mir-221
  gRNA
uacauugucugcuggguuuc

SEQ ID NO: 66090 - RNA, 20 nt, Artificial Sequence
  MKO10066090_A_mmu-mir-221
  gRNA
caacagcuacauugucugcu

SEQ ID NO: 66091 - RNA, 20 nt, Artificial Sequence
  MKO10066091_A_mmu-mir-222
  gRNA
accaaagacaggaucuacac

SEQ ID NO: 66092 - RNA, 20 nt, Artificial Sequence
  MKO10066092_A_mmu-mir-222
  gRNA
ucuggcuacugggucucugg

SEQ ID NO: 66093 - RNA, 20 nt, Artificial Sequence
  MKO10066093_A_mmu-mir-222
  gRNA
acaucuggcuacugggucuc

SEQ ID NO: 66094 - RNA, 20 nt, Artificial Sequence
  MKO10066094_A_mmu-mir-222
  gRNA
agcagcuacaucuggcuacu

SEQ ID NO: 66095 - RNA, 20 nt, Artificial Sequence
  MKO10066095_A_mmu-mir-5617
  gRNA
gugagagugagugagagcug

SEQ ID NO: 66096 - RNA, 20 nt, Artificial Sequence
  MKO10066096_A_mmu-mir-5617
  gRNA
gagugagagcugaggccgcc

SEQ ID NO: 66097 - RNA, 20 nt, Artificial Sequence
  MKO10066097_A_mmu-mir-5617
  gRNA
agagcugaggccgccuggga

SEQ ID NO: 66098 - RNA, 20 nt, Artificial Sequence
  MKO10066098_A_mmu-mir-5617
  gRNA
ugggaugguaggaacccaga

SEQ ID NO: 66099 - RNA, 20 nt, Artificial Sequence
  MKO10066099_A_mmu-mir-3110
  gRNA
ugucacucugggcacuccau

SEQ ID NO: 66100 - RNA, 20 nt, Artificial Sequence
  MKO10066100_A_mmu-mir-3110
  gRNA
gguugagugucugccuccga

SEQ ID NO: 66101 - RNA, 20 nt, Artificial Sequence
  MKO10066101_A_mmu-mir-3110
  gRNA
auggaagauggcaaagugug

SEQ ID NO: 66102 - RNA, 20 nt, Artificial Sequence
  MKO10066102_A_mmu-mir-3110
  gRNA
cuguguucugccuccccuga

SEQ ID NO: 66103 - RNA, 20 nt, Artificial Sequence
  MKO10066103_A_mmu-mir-6384
  gRNA
uaaaguuccaucuccccacg

SEQ ID NO: 66104 - RNA, 20 nt, Artificial Sequence
  MKO10066104_A_mmu-mir-6384
  gRNA
acguggcucacugagauuac

SEQ ID NO: 66105 - RNA, 20 nt, Artificial Sequence
  MKO10066105_A_mmu-mir-6384
  gRNA
cagugagccacguggggaga

SEQ ID NO: 66106 - RNA, 20 nt, Artificial Sequence
  MKO10066106_A_mmu-mir-6384
  gRNA
ugagauuacagggaaacagu

SEQ ID NO: 66107 - RNA, 20 nt, Artificial Sequence
  MKO10066107_A_mmu-mir-717
  gRNA
acuucugaaucccuucggaa

SEQ ID NO: 66108 - RNA, 20 nt, Artificial Sequence
  MKO10066108_A_mmu-mir-717
  gRNA
aaaugacgguacagugauag

SEQ ID NO: 66109 - RNA, 20 nt, Artificial Sequence
  MKO10066109_A_mmu-mir-717
  gRNA
aagcugcucuccguuccgaa

SEQ ID NO: 66110 - RNA, 20 nt, Artificial Sequence
  MKO10066110_A_mmu-mir-717
  gRNA
uuaucacuucugaaucccuu

SEQ ID NO: 66111 - RNA, 20 nt, Artificial Sequence
  MKO10066111_A_mmu-mir-363
  gRNA
uagguccugcgguuuacaga

SEQ ID NO: 66112 - RNA, 20 nt, Artificial Sequence
  MKO10066112_A_mmu-mir-363
  gRNA
guaauaggaggaaaauugca

SEQ ID NO: 66113 - RNA, 20 nt, Artificial Sequence
  MKO10066113_A_mmu-mir-363
  gRNA
gguggaacacgaugcaauuu

SEQ ID NO: 66114 - RNA, 20 nt, Artificial Sequence
  MKO10066114_A_mmu-mir-363
  gRNA
acuguuuugcuguuaucagg

SEQ ID NO: 66115 - RNA, 20 nt, Artificial Sequence
  MKO10066115_A_mmu-mir-92a-2
  gRNA
aaaaacccucuuucuuccuc

SEQ ID NO: 66116 - RNA, 20 nt, Artificial Sequence
  MKO10066116_A_mmu-mir-92a-2
  gRNA
acccucuuucuuccucaggc

SEQ ID NO: 66117 - RNA, 20 nt, Artificial Sequence
  MKO10066117_A_mmu-mir-92a-2
  gRNA
augccaccaauccccaccug

SEQ ID NO: 66118 - RNA, 20 nt, Artificial Sequence
  MKO10066118_A_mmu-mir-92a-2
  gRNA
caccuguggaugaaugggca

SEQ ID NO: 66119 - RNA, 20 nt, Artificial Sequence
  MKO10066119_A_mmu-mir-19b-2
  gRNA
uucccacaaucaguuuugca

SEQ ID NO: 66120 - RNA, 20 nt, Artificial Sequence
  MKO10066120_A_mmu-mir-19b-2
  gRNA
ucagcguauaugugaauaua

SEQ ID NO: 66121 - RNA, 20 nt, Artificial Sequence
  MKO10066121_A_mmu-mir-19b-2
  gRNA
auccaugcaaaacugauugu

SEQ ID NO: 66122 - RNA, 20 nt, Artificial Sequence
  MKO10066122_A_mmu-mir-20b
  gRNA
uaccugcacuaugagcacuu

SEQ ID NO: 66123 - RNA, 20 nt, Artificial Sequence
  MKO10066123_A_mmu-mir-20b
  gRNA
augagcacuuuggcacuacu

SEQ ID NO: 66124 - RNA, 20 nt, Artificial Sequence
  MKO10066124_A_mmu-mir-20b
  gRNA
gugagcacuucuaguacucc

SEQ ID NO: 66125 - RNA, 20 nt, Artificial Sequence
  MKO10066125_A_mmu-mir-20b
  gRNA
ugccaaagugcucauagugc

SEQ ID NO: 66126 - RNA, 20 nt, Artificial Sequence
  MKO10066126_A_mmu-mir-18b
  gRNA
cugugcgagaaggggcauuu

SEQ ID NO: 66127 - RNA, 20 nt, Artificial Sequence
  MKO10066127_A_mmu-mir-18b
  gRNA
cuaaaugccccuucucgcac

SEQ ID NO: 66128 - RNA, 20 nt, Artificial Sequence
  MKO10066128_A_mmu-mir-18b
  gRNA
aagaaguagccugugcgaga

SEQ ID NO: 66129 - RNA, 20 nt, Artificial Sequence
  MKO10066129_A_mmu-mir-18b
  gRNA
gaaguagccugugcgagaag

SEQ ID NO: 66130 - RNA, 20 nt, Artificial Sequence
  MKO10066130_A_mmu-mir-106a
  gRNA
caugguaauguaagaagugc

SEQ ID NO: 66131 - RNA, 20 nt, Artificial Sequence
  MKO10066131_A_mmu-mir-106a
  gRNA
ugucaaagugcuaacagugc

SEQ ID NO: 66132 - RNA, 20 nt, Artificial Sequence
  MKO10066132_A_mmu-mir-106a
  gRNA
gcacuguuagcacuuugaca

SEQ ID NO: 66133 - RNA, 20 nt, Artificial Sequence
  MKO10066133_A_mmu-mir-106a
  gRNA
uuagcacuuugacauggcca

SEQ ID NO: 66134 - RNA, 20 nt, Artificial Sequence
  MKO10066134_A_mmu-mir-450b
  gRNA
uacgcuuauguuauguauuc

SEQ ID NO: 66135 - RNA, 20 nt, Artificial Sequence
  MKO10066135_A_mmu-mir-450b
  gRNA
auacauaacauaagcguauu

SEQ ID NO: 66136 - RNA, 20 nt, Artificial Sequence
  MKO10066136_A_mmu-mir-450b
  gRNA
auuuuguaucaauauauggg

SEQ ID NO: 66137 - RNA, 20 nt, Artificial Sequence
  MKO10066137_A_mmu-mir-450b
  gRNA
uaauuuuguaucaauauaug

SEQ ID NO: 66138 - RNA, 20 nt, Artificial Sequence
  MKO10066138_A_mmu-mir-450a-1
  gRNA
auauaauuauagcacauauu

SEQ ID NO: 66139 - RNA, 20 nt, Artificial Sequence
  MKO10066139_A_mmu-mir-450a-1
  gRNA
auaugugcuauaauuauauu

SEQ ID NO: 66140 - RNA, 20 nt, Artificial Sequence
  MKO10066140_A_mmu-mir-450a-1
  gRNA
aacagcucaguaucucucuu

SEQ ID NO: 66141 - RNA, 20 nt, Artificial Sequence
  MKO10066141_A_mmu-mir-450a-1
  gRNA
caguaucucucuuuggucac

SEQ ID NO: 66142 - RNA, 20 nt, Artificial Sequence
  MKO10066142_A_mmu-mir-450a-2
  gRNA
auauacucauaguacauauu

SEQ ID NO: 66143 - RNA, 20 nt, Artificial Sequence
  MKO10066143_A_mmu-mir-450a-2
  gRNA
uauguacuaugaguauauug

SEQ ID NO: 66144 - RNA, 20 nt, Artificial Sequence
  MKO10066144_A_mmu-mir-450a-2
  gRNA
gcaaaaauaguucagcaucu

SEQ ID NO: 66145 - RNA, 20 nt, Artificial Sequence
  MKO10066145_A_mmu-mir-450a-2
  gRNA
uuggggaugcuuugcauuca

SEQ ID NO: 66146 - RNA, 20 nt, Artificial Sequence
  MKO10066146_A_mmu-mir-542
  gRNA
ucaguuaucaaucugucaca

SEQ ID NO: 66147 - RNA, 20 nt, Artificial Sequence
  MKO10066147_A_mmu-mir-542
  gRNA
aaucugucacaagggcacag

SEQ ID NO: 66148 - RNA, 20 nt, Artificial Sequence
  MKO10066148_A_mmu-mir-542
  gRNA
gauugauaacugaaaggucu

SEQ ID NO: 66149 - RNA, 20 nt, Artificial Sequence
  MKO10066149_A_mmu-mir-542
  gRNA
gugacagauugauaacugaa

SEQ ID NO: 66150 - RNA, 20 nt, Artificial Sequence
  MKO10066150_A_mmu-mir-351
  gRNA
aacacucuucuccaguuccc

SEQ ID NO: 66151 - RNA, 20 nt, Artificial Sequence
  MKO10066151_A_mmu-mir-351
  gRNA
ccaggcucaaagggcuccuc

SEQ ID NO: 66152 - RNA, 20 nt, Artificial Sequence
  MKO10066152_A_mmu-mir-351
  gRNA
caaagggcuccucagggaaa

SEQ ID NO: 66153 - RNA, 20 nt, Artificial Sequence
  MKO10066153_A_mmu-mir-351
  gRNA
gucaagaggcgccugggaac

SEQ ID NO: 66154 - RNA, 20 nt, Artificial Sequence
  MKO10066154_A_mmu-mir-503
  gRNA
acccagacuuacccaggcag

SEQ ID NO: 66155 - RNA, 20 nt, Artificial Sequence
  MKO10066155_A_mmu-mir-503
  gRNA
ggcaguggaaacaauacucc

SEQ ID NO: 66156 - RNA, 20 nt, Artificial Sequence
  MKO10066156_A_mmu-mir-503
  gRNA
gcaguacuguucccgcugcu

SEQ ID NO: 66157 - RNA, 20 nt, Artificial Sequence
  MKO10066157_A_mmu-mir-503
  gRNA
gaguauuguuuccacugccu

SEQ ID NO: 66158 - RNA, 20 nt, Artificial Sequence
  MKO10066158_A_mmu-mir-322
  gRNA
cuucuacauuccccacgaag

SEQ ID NO: 66159 - RNA, 20 nt, Artificial Sequence
  MKO10066159_A_mmu-mir-322
  gRNA
gaauugcugcugcagcccuu

SEQ ID NO: 66160 - RNA, 20 nt, Artificial Sequence
  MKO10066160_A_mmu-mir-322
  gRNA
cgcugcaacaccccuucgug

SEQ ID NO: 66161 - RNA, 20 nt, Artificial Sequence
  MKO10066161_A_mmu-mir-322
  gRNA
agcgcugcaacaccccuucg

SEQ ID NO: 66162 - RNA, 20 nt, Artificial Sequence
  MKO10066162_A_mmu-mir-5116
  gRNA
acaaaccaaaaagcaucagg

SEQ ID NO: 66163 - RNA, 20 nt, Artificial Sequence
  MKO10066163_A_mmu-mir-5116
  gRNA
aaaccaaaaagcaucaggcg

SEQ ID NO: 66164 - RNA, 20 nt, Artificial Sequence
  MKO10066164_A_mmu-mir-5116
  gRNA
uuuuugguuuguuucaggca

SEQ ID NO: 66165 - RNA, 20 nt, Artificial Sequence
  MKO10066165_A_mmu-mir-5116
  gRNA
gaaacaaaccaaaaagcauc

SEQ ID NO: 66166 - RNA, 20 nt, Artificial Sequence
  MKO10066166_A_mmu-mir-504
  gRNA
aguagccugugcccucugua

SEQ ID NO: 66167 - RNA, 20 nt, Artificial Sequence
  MKO10066167_A_mmu-mir-504
  gRNA
uuacagauagagugcagacc

SEQ ID NO: 66168 - RNA, 20 nt, Artificial Sequence
  MKO10066168_A_mmu-mir-504
  gRNA
gcagaccagggucucccaac

SEQ ID NO: 66169 - RNA, 20 nt, Artificial Sequence
  MKO10066169_A_mmu-mir-504
  gRNA
ggcaggguuucccauacaga

SEQ ID NO: 66170 - RNA, 20 nt, Artificial Sequence
  MKO10066170_A_mmu-mir-505
  gRNA
agcaaguguugacgcuaacc

SEQ ID NO: 66171 - RNA, 20 nt, Artificial Sequence
  MKO10066171_A_mmu-mir-505
  gRNA
gcagaaacaucaauacuucc

SEQ ID NO: 66172 - RNA, 20 nt, Artificial Sequence
  MKO10066172_A_mmu-mir-505
  gRNA
acacuugcugguuuucucuc

SEQ ID NO: 66173 - RNA, 20 nt, Artificial Sequence
  MKO10066173_A_mmu-mir-505
  gRNA
agguuagcgucaacacuugc

SEQ ID NO: 66174 - RNA, 20 nt, Artificial Sequence
  MKO10066174_A_mmu-mir-743a
  gRNA
aagcccuacucuacucagcu

SEQ ID NO: 66175 - RNA, 20 nt, Artificial Sequence
  MKO10066175_A_mmu-mir-743a
  gRNA
uucauucuuauaaacaugac

SEQ ID NO: 66176 - RNA, 20 nt, Artificial Sequence
  MKO10066176_A_mmu-mir-743a
  gRNA
acaccaagcugaguagagua

SEQ ID NO: 66177 - RNA, 20 nt, Artificial Sequence
  MKO10066177_A_mmu-mir-743a
  gRNA
augcagugcuguauucagau

SEQ ID NO: 66178 - RNA, 20 nt, Artificial Sequence
  MKO10066178_A_mmu-mir-743b
  gRNA
acaucaugcugaauagagua

SEQ ID NO: 66179 - RNA, 20 nt, Artificial Sequence
  MKO10066179_A_mmu-mir-743b
  gRNA
gugcagugcuguguucagac

SEQ ID NO: 66180 - RNA, 20 nt, Artificial Sequence
  MKO10066180_A_mmu-mir-743b
  gRNA
uucacaaauauuucacauga

SEQ ID NO: 66181 - RNA, 20 nt, Artificial Sequence
  MKO10066181_A_mmu-mir-742
  gRNA
cuuuacuuuacccagcaugg

SEQ ID NO: 66182 - RNA, 20 nt, Artificial Sequence
  MKO10066182_A_mmu-mir-742
  gRNA
uaggugaaagccaccaugcu

SEQ ID NO: 66183 - RNA, 20 nt, Artificial Sequence
  MKO10066183_A_mmu-mir-742
  gRNA
ugggcagugcucuacucaca

SEQ ID NO: 66184 - RNA, 20 nt, Artificial Sequence
  MKO10066184_A_mmu-mir-742
  gRNA
gagcuuuacuuuacccagca

SEQ ID NO: 66185 - RNA, 20 nt, Artificial Sequence
  MKO10066185_A_mmu-mir-883a
  gRNA
uguaaggcucaacaaacgca

SEQ ID NO: 66186 - RNA, 20 nt, Artificial Sequence
  MKO10066186_A_mmu-mir-883a
  gRNA
caacagcucucaguauugua

SEQ ID NO: 66187 - RNA, 20 nt, Artificial Sequence
  MKO10066187_A_mmu-mir-883b
  gRNA
caacaucucucaguauugua

SEQ ID NO: 66188 - RNA, 20 nt, Artificial Sequence
  MKO10066188_A_mmu-mir-883b
  gRNA
ugcaaugcauuacugagaau

SEQ ID NO: 66189 - RNA, 20 nt, Artificial Sequence
  MKO10066189_A_mmu-mir-883b
  gRNA
guaagguucaacaaauacaa

SEQ ID NO: 66190 - RNA, 20 nt, Artificial Sequence
  MKO10066190_A_mmu-mir-471
  gRNA
aagccuuccuauacauagua

SEQ ID NO: 66191 - RNA, 20 nt, Artificial Sequence
  MKO10066191_A_mmu-mir-471
  gRNA
gugccauacuauguauagga

SEQ ID NO: 66192 - RNA, 20 nt, Artificial Sequence
  MKO10066192_A_mmu-mir-471
  gRNA
aaaggugccauacuauguau

SEQ ID NO: 66193 - RNA, 20 nt, Artificial Sequence
  MKO10066193_A_mmu-mir-471
  gRNA
cacauuaaacaaaaagugaa

SEQ ID NO: 66194 - RNA, 20 nt, Artificial Sequence
  MKO10066194_A_mmu-mir-741
  gRNA
gagccuuaaucuacauagaa

SEQ ID NO: 66195 - RNA, 20 nt, Artificial Sequence
  MKO10066195_A_mmu-mir-741
  gRNA
gcuuacaugauuuacaugau

SEQ ID NO: 66196 - RNA, 20 nt, Artificial Sequence
  MKO10066196_A_mmu-mir-741
  gRNA
augccauucuauguagauua

SEQ ID NO: 66197 - RNA, 20 nt, Artificial Sequence
  MKO10066197_A_mmu-mir-741
  gRNA
gugcauugaucuacguagau

SEQ ID NO: 66198 - RNA, 20 nt, Artificial Sequence
  MKO10066198_A_mmu-mir-463
  gRNA
aucauuuauguuuuacauga

SEQ ID NO: 66199 - RNA, 20 nt, Artificial Sequence
  MKO10066199_A_mmu-mir-463
  gRNA
acaccauauaagguagagga

SEQ ID NO: 66200 - RNA, 20 nt, Artificial Sequence
  MKO10066200_A_mmu-mir-463
  gRNA
auagacaccauauaagguag

SEQ ID NO: 66201 - RNA, 20 nt, Artificial Sequence
  MKO10066201_A_mmu-mir-463
  gRNA
augaugauagacaccauaua

SEQ ID NO: 66202 - RNA, 20 nt, Artificial Sequence
  MKO10066202_A_mmu-mir-880
  gRNA
gugccuuacucuacucagag

SEQ ID NO: 66203 - RNA, 20 nt, Artificial Sequence
  MKO10066203_A_mmu-mir-880
  gRNA
aggauggaguaacaugcaau

SEQ ID NO: 66204 - RNA, 20 nt, Artificial Sequence
  MKO10066204_A_mmu-mir-880
  gRNA
cauccucucugaguagagua

SEQ ID NO: 66205 - RNA, 20 nt, Artificial Sequence
  MKO10066205_A_mmu-mir-880
  gRNA
cuuacucuacucagagagga

SEQ ID NO: 66206 - RNA, 20 nt, Artificial Sequence
  MKO10066206_A_mmu-mir-878
  gRNA
gagcccuccucuacccagug

SEQ ID NO: 66207 - RNA, 20 nt, Artificial Sequence
  MKO10066207_A_mmu-mir-878
  gRNA
acaccacacuggguagagga

SEQ ID NO: 66208 - RNA, 20 nt, Artificial Sequence
  MKO10066208_A_mmu-mir-878
  gRNA
caugacaccacacuggguag

SEQ ID NO: 66209 - RNA, 20 nt, Artificial Sequence
  MKO10066209_A_mmu-mir-878
  gRNA
uaagugcaugacaccacacu

SEQ ID NO: 66210 - RNA, 20 nt, Artificial Sequence
  MKO10066210_A_mmu-mir-871
  gRNA
gagcauuacauuauccagaa

SEQ ID NO: 66211 - RNA, 20 nt, Artificial Sequence
  MKO10066211_A_mmu-mir-871
  gRNA
ucauauguauuucacaugac

SEQ ID NO: 66212 - RNA, 20 nt, Artificial Sequence
  MKO10066212_A_mmu-mir-871
  gRNA
ucaugugaaauacauaugac

SEQ ID NO: 66213 - RNA, 20 nt, Artificial Sequence
  MKO10066213_A_mmu-mir-871
  gRNA
acauaugacuggcaccauuc

SEQ ID NO: 66214 - RNA, 20 nt, Artificial Sequence
  MKO10066214_A_mmu-mir-470
  gRNA
uacucuucucagaaagguac

SEQ ID NO: 66215 - RNA, 20 nt, Artificial Sequence
  MKO10066215_A_mmu-mir-470
  gRNA
ugcucuucuuggacuggcac

SEQ ID NO: 66216 - RNA, 20 nt, Artificial Sequence
  MKO10066216_A_mmu-mir-470
  gRNA
gugcagugcucuucuuggac

SEQ ID NO: 66217 - RNA, 20 nt, Artificial Sequence
  MKO10066217_A_mmu-mir-470
  gRNA
guggugugcagugcucuucu

SEQ ID NO: 66218 - RNA, 20 nt, Artificial Sequence
  MKO10066218_A_mmu-mir-465d
  gRNA
gugguaagccuuacucagaa

SEQ ID NO: 66219 - RNA, 20 nt, Artificial Sequence
  MKO10066219_A_mmu-mir-465d
  gRNA
augaaauaaaaaauugauca

SEQ ID NO: 66220 - RNA, 20 nt, Artificial Sequence
  MKO10066220_A_mmu-mir-465d
  gRNA
augcagugcccuauuuagaa

SEQ ID NO: 66221 - RNA, 20 nt, Artificial Sequence
  MKO10066221_A_mmu-mir-465d
  gRNA
acaucaguaccauucuaaau

SEQ ID NO: 66222 - RNA, 20 nt, Artificial Sequence
  MKO10066222_A_mmu-mir-465c-1
  gRNA
aagccuuacucuacuuagaa

SEQ ID NO: 66223 - RNA, 20 nt, Artificial Sequence
  MKO10066223_A_mmu-mir-465c-1
  gRNA
agaucagcgccauucuaaau

SEQ ID NO: 66224 - RNA, 20 nt, Artificial Sequence
  MKO10066224_A_mmu-mir-465c-1
  gRNA
gggccuuucuaaguagagua

SEQ ID NO: 66225 - RNA, 20 nt, Artificial Sequence
  MKO10066225_A_mmu-mir-465c-1
  gRNA
gaauaaaaaaaaaaugauca

SEQ ID NO: 66226 - RNA, 20 nt, Artificial Sequence
  MKO10066226_A_mmu-mir-465b-1
  gRNA
aagccuuacucuacuuagaa

SEQ ID NO: 66227 - RNA, 20 nt, Artificial Sequence
  MKO10066227_A_mmu-mir-465b-1
  gRNA
agaucagcaccauucuaaau

SEQ ID NO: 66228 - RNA, 20 nt, Artificial Sequence
  MKO10066228_A_mmu-mir-465b-1
  gRNA
gggccuuucuaaguagagua

SEQ ID NO: 66229 - RNA, 20 nt, Artificial Sequence
  MKO10066229_A_mmu-mir-465b-1
  gRNA
augaaauaaaaaauugauca

SEQ ID NO: 66230 - RNA, 20 nt, Artificial Sequence
  MKO10066230_A_mmu-mir-465c-2
  gRNA
aagccuuacucuacuuagaa

SEQ ID NO: 66231 - RNA, 20 nt, Artificial Sequence
  MKO10066231_A_mmu-mir-465c-2
  gRNA
agaucagcgccauucuaaau

SEQ ID NO: 66232 - RNA, 20 nt, Artificial Sequence
  MKO10066232_A_mmu-mir-465c-2
  gRNA
gggccuuucuaaguagagua

SEQ ID NO: 66233 - RNA, 20 nt, Artificial Sequence
  MKO10066233_A_mmu-mir-465c-2
  gRNA
gaauaaaaaaaaaaugauca

SEQ ID NO: 66234 - RNA, 20 nt, Artificial Sequence
  MKO10066234_A_mmu-mir-465b-2
  gRNA
aagccuuacucuacuuagaa

SEQ ID NO: 66235 - RNA, 20 nt, Artificial Sequence
  MKO10066235_A_mmu-mir-465b-2
  gRNA
agaucagcaccauucuaaau

SEQ ID NO: 66236 - RNA, 20 nt, Artificial Sequence
  MKO10066236_A_mmu-mir-465b-2
  gRNA
gggccuuucuaaguagagua

SEQ ID NO: 66237 - RNA, 20 nt, Artificial Sequence
  MKO10066237_A_mmu-mir-465b-2
  gRNA
augaaauaaaaaauugauca

SEQ ID NO: 66238 - RNA, 20 nt, Artificial Sequence
  MKO10066238_A_mmu-mir-465a
  gRNA
aagccuuacucuacuuagaa

SEQ ID NO: 66239 - RNA, 20 nt, Artificial Sequence
  MKO10066239_A_mmu-mir-465a
  gRNA
acaucagugccauucuaaau

SEQ ID NO: 66240 - RNA, 20 nt, Artificial Sequence
  MKO10066240_A_mmu-mir-465a
  gRNA
gggccuuucuaaguagagua

SEQ ID NO: 66241 - RNA, 20 nt, Artificial Sequence
  MKO10066241_A_mmu-mir-465a
  gRNA
auaaaauaaaaaauugauca

SEQ ID NO: 66242 - RNA, 20 nt, Artificial Sequence
  MKO10066242_A_mmu-mir-201
  gRNA
gcacauuacccuacacagaa

SEQ ID NO: 66243 - RNA, 20 nt, Artificial Sequence
  MKO10066243_A_mmu-mir-201
  gRNA
gaacagugccuuucugugua

SEQ ID NO: 66244 - RNA, 20 nt, Artificial Sequence
  MKO10066244_A_mmu-mir-201
  gRNA
guacaguaccuuacucagua

SEQ ID NO: 66245 - RNA, 20 nt, Artificial Sequence
  MKO10066245_A_mmu-mir-201
  gRNA
gaacaaugccuuacugagua

SEQ ID NO: 66246 - RNA, 20 nt, Artificial Sequence
  MKO10066246_A_mmu-mir-547
  gRNA
cauguuuccuguuaaauggg

SEQ ID NO: 66247 - RNA, 20 nt, Artificial Sequence
  MKO10066247_A_mmu-mir-547
  gRNA
cauuuaacaggaaacaugcu

SEQ ID NO: 66248 - RNA, 20 nt, Artificial Sequence
  MKO10066248_A_mmu-mir-547
  gRNA
agugugugauguaucacuug

SEQ ID NO: 66249 - RNA, 20 nt, Artificial Sequence
  MKO10066249_A_mmu-mir-547
  gRNA
caagcauguuuccuguuaaa

SEQ ID NO: 66250 - RNA, 20 nt, Artificial Sequence
  MKO10066250_A_mmu-mir-509
  gRNA
uaugcaugauugccacauuc

SEQ ID NO: 66251 - RNA, 20 nt, Artificial Sequence
  MKO10066251_A_mmu-mir-509
  gRNA
ggaguaacacaugugauaua

SEQ ID NO: 66252 - RNA, 20 nt, Artificial Sequence
  MKO10066252_A_mmu-mir-509
  gRNA
ugugauugacauuucuguaa

SEQ ID NO: 66253 - RNA, 20 nt, Artificial Sequence
  MKO10066253_A_mmu-mir-509
  gRNA
ugguucuuuacuccagaaug

SEQ ID NO: 66254 - RNA, 20 nt, Artificial Sequence
  MKO10066254_A_mmu-mir-224
  gRNA
ucuggggcuuuguagucacu

SEQ ID NO: 66255 - RNA, 20 nt, Artificial Sequence
  MKO10066255_A_mmu-mir-224
  gRNA
acuagugacuuaaaagcccc

SEQ ID NO: 66256 - RNA, 20 nt, Artificial Sequence
  MKO10066256_A_mmu-mir-224
  gRNA
gggggcuuuuaagucacuag

SEQ ID NO: 66257 - RNA, 20 nt, Artificial Sequence
  MKO10066257_A_mmu-mir-224
  gRNA
ugcacaaaccaucuacuaaa

SEQ ID NO: 66258 - RNA, 20 nt, Artificial Sequence
  MKO10066258_A_mmu-mir-452
  gRNA
ucucagucucaucugcaaag

SEQ ID NO: 66259 - RNA, 20 nt, Artificial Sequence
  MKO10066259_A_mmu-mir-452
  gRNA
gcaguuacaacuguuugcag

SEQ ID NO: 66260 - RNA, 20 nt, Artificial Sequence
  MKO10066260_A_mmu-mir-452
  gRNA
cugcuuagcauauauaagag

SEQ ID NO: 66261 - RNA, 20 nt, Artificial Sequence
  MKO10066261_A_mmu-mir-767
  gRNA
gauuccucuucaggaaccau

SEQ ID NO: 66262 - RNA, 20 nt, Artificial Sequence
  MKO10066262_A_mmu-mir-767
  gRNA
guuaugugcucagacaacca

SEQ ID NO: 66263 - RNA, 20 nt, Artificial Sequence
  MKO10066263_A_mmu-mir-767
  gRNA
ugcaugaguaaaaaccuaua

SEQ ID NO: 66264 - RNA, 20 nt, Artificial Sequence
  MKO10066264_A_mmu-mir-767
  gRNA
auacccuaugguuccugaag

SEQ ID NO: 66265 - RNA, 20 nt, Artificial Sequence
  MKO10066265_A_mmu-mir-105
  gRNA
agcacaugcucaagcauucg

SEQ ID NO: 66266 - RNA, 20 nt, Artificial Sequence
  MKO10066266_A_mmu-mir-105
  gRNA
accacaagcaucugagcacu

SEQ ID NO: 66267 - RNA, 20 nt, Artificial Sequence
  MKO10066267_A_mmu-mir-105
  gRNA
gaaugcuugagcaugugcua

SEQ ID NO: 66268 - RNA, 20 nt, Artificial Sequence
  MKO10066268_A_mmu-mir-105
  gRNA
aagugcucagaugcuugugg

SEQ ID NO: 66269 - RNA, 20 nt, Artificial Sequence
  MKO10066269_A_mmu-mir-2137
  gRNA
ggcuugccggcgggagcccc

SEQ ID NO: 66270 - RNA, 20 nt, Artificial Sequence
  MKO10066270_A_mmu-mir-2137
  gRNA
ccaacaaggcagcaggaagg

SEQ ID NO: 66271 - RNA, 20 nt, Artificial Sequence
  MKO10066271_A_mmu-mir-2137
  gRNA
aagccaacaaggcagcagga

SEQ ID NO: 66272 - RNA, 20 nt, Artificial Sequence
  MKO10066272_A_mmu-mir-2137
  gRNA
cugcaaugcucuacucccug

SEQ ID NO: 66273 - RNA, 20 nt, Artificial Sequence
  MKO10066273_A_mmu-mir-5132
  gRNA
gcgcacgaucaaggccgcug

SEQ ID NO: 66274 - RNA, 20 nt, Artificial Sequence
  MKO10066274_A_mmu-mir-5132
  gRNA
cgaucaaggccgcugcggga

SEQ ID NO: 66275 - RNA, 20 nt, Artificial Sequence
  MKO10066275_A_mmu-mir-5132
  gRNA
aucaaggccgcugcgggaug

SEQ ID NO: 66276 - RNA, 20 nt, Artificial Sequence
  MKO10066276_A_mmu-mir-5132
  gRNA
ugauguuccccaucccgcag

SEQ ID NO: 66277 - RNA, 20 nt, Artificial Sequence
  MKO10066277_A_mmu-mir-718
  gRNA
ggccucgugcgacacccggc

SEQ ID NO: 66278 - RNA, 20 nt, Artificial Sequence
  MKO10066278_A_mmu-mir-718
  gRNA
gacacccggccgggcggaag

SEQ ID NO: 66279 - RNA, 20 nt, Artificial Sequence
  MKO10066279_A_mmu-mir-718
  gRNA
acccggccgggcggaagagg

SEQ ID NO: 66280 - RNA, 20 nt, Artificial Sequence
  MKO10066280_A_mmu-mir-718
  gRNA
cuccgcggccuuccgccaca

SEQ ID NO: 66281 - RNA, 20 nt, Artificial Sequence
  MKO10066281_A_mmu-mir-7091
  gRNA
agccacugcgucuugcuaaa

SEQ ID NO: 66282 - RNA, 20 nt, Artificial Sequence
  MKO10066282_A_mmu-mir-7091
  gRNA
uugcaccauccccucugcca

SEQ ID NO: 66283 - RNA, 20 nt, Artificial Sequence
  MKO10066283_A_mmu-mir-7091
  gRNA
ugccuuuuagcaagacgcag

SEQ ID NO: 66284 - RNA, 20 nt, Artificial Sequence
  MKO10066284_A_mmu-mir-7091
  gRNA
ggugauagauuccauggcag

SEQ ID NO: 66285 - RNA, 20 nt, Artificial Sequence
  MKO10066285_A_mmu-mir-7092
  gRNA
auaaacgugauuaugucuaa

SEQ ID NO: 66286 - RNA, 20 nt, Artificial Sequence
  MKO10066286_A_mmu-mir-1906-2
  gRNA
auucucacaacaacccuagg

SEQ ID NO: 66287 - RNA, 20 nt, Artificial Sequence
  MKO10066287_A_mmu-mir-1906-2
  gRNA
cagcagccugaggcagggcu

SEQ ID NO: 66288 - RNA, 20 nt, Artificial Sequence
  MKO10066288_A_mmu-mir-1906-2
  gRNA
aaaugaacugcagcagccug

SEQ ID NO: 66289 - RNA, 20 nt, Artificial Sequence
  MKO10066289_A_mmu-mir-1906-2
  gRNA
acauuaggagcaaccuccua

SEQ ID NO: 66290 - RNA, 20 nt, Artificial Sequence
  MKO10066290_A_mmu-mir-7673
  gRNA
ucagcuuugacugagaggua

SEQ ID NO: 66291 - RNA, 20 nt, Artificial Sequence
  MKO10066291_A_mmu-mir-7673
  gRNA
auuccuuaccucaccgucaa

SEQ ID NO: 66292 - RNA, 20 nt, Artificial Sequence
  MKO10066292_A_mmu-mir-7673
  gRNA
guuccuuugacggugaggua

SEQ ID NO: 66293 - RNA, 20 nt, Artificial Sequence
  MKO10066293_A_mmu-mir-7673
  gRNA
agucaguuccuuugacggug

SEQ ID NO: 66294 - RNA, 20 nt, Artificial Sequence
  MKO10066294_A_mmu-mir-223
  gRNA
gcugaguuggacacucugug

SEQ ID NO: 66295 - RNA, 20 nt, Artificial Sequence
  MKO10066295_A_mmu-mir-223
  gRNA
uuugucaaauaccccaagug

SEQ ID NO: 66296 - RNA, 20 nt, Artificial Sequence
  MKO10066296_A_mmu-mir-223
  gRNA
aacucagcuugucaaauaca

SEQ ID NO: 66297 - RNA, 20 nt, Artificial Sequence
  MKO10066297_A_mmu-mir-223
  gRNA
auaggcaugagccacacuug

SEQ ID NO: 66298 - RNA, 20 nt, Artificial Sequence
  MKO10066298_A_mmu-mir-676
  gRNA
augcaugacucuacaaccuu

SEQ ID NO: 66299 - RNA, 20 nt, Artificial Sequence
  MKO10066299_A_mmu-mir-676
  gRNA
auuaaaggaaugccguccug

SEQ ID NO: 66300 - RNA, 20 nt, Artificial Sequence
  MKO10066300_A_mmu-mir-676
  gRNA
guuguugagcugugcguuuc

SEQ ID NO: 66301 - RNA, 20 nt, Artificial Sequence
  MKO10066301_A_mmu-mir-676
  gRNA
gguuguagagucaugcauuc

SEQ ID NO: 66302 - RNA, 20 nt, Artificial Sequence
  MKO10066302_A_mmu-mir-421
  gRNA
cauucaacaaacauuuaaug

SEQ ID NO: 66303 - RNA, 20 nt, Artificial Sequence
  MKO10066303_A_mmu-mir-421
  gRNA
aucaucaacagacauuaauu

SEQ ID NO: 66304 - RNA, 20 nt, Artificial Sequence
  MKO10066304_A_mmu-mir-421
  gRNA
gcccauggagaucacagagc

SEQ ID NO: 66305 - RNA, 20 nt, Artificial Sequence
  MKO10066305_A_mmu-mir-421
  gRNA
augaggccuacaaugugcac

SEQ ID NO: 66306 - RNA, 20 nt, Artificial Sequence
  MKO10066306_A_mmu-mir-374b
  gRNA
uaagugcuagaacacuuagc

SEQ ID NO: 66307 - RNA, 20 nt, Artificial Sequence
  MKO10066307_A_mmu-mir-374b
  gRNA
uguauuauauccacccgagu

SEQ ID NO: 66308 - RNA, 20 nt, Artificial Sequence
  MKO10066308_A_mmu-mir-374b
  gRNA
gguuguauuaucauuguccg

SEQ ID NO: 66309 - RNA, 20 nt, Artificial Sequence
  MKO10066309_A_mmu-mir-374b
  gRNA
uaaguguucuagcacuuagc

SEQ ID NO: 66310 - RNA, 20 nt, Artificial Sequence
  MKO10066310_A_mmu-mir-374c
  gRNA
uaagugcuagaacacuuagc

SEQ ID NO: 66311 - RNA, 20 nt, Artificial Sequence
  MKO10066311_A_mmu-mir-374c
  gRNA
uaaguguucuagcacuuagc

SEQ ID NO: 66312 - RNA, 20 nt, Artificial Sequence
  MKO10066312_A_mmu-mir-374c
  gRNA
uguauuauauccacccgagu

SEQ ID NO: 66313 - RNA, 20 nt, Artificial Sequence
  MKO10066313_A_mmu-mir-374c
  gRNA
gguuguauuaucauuguccg

SEQ ID NO: 66314 - RNA, 20 nt, Artificial Sequence
  MKO10066314_A_mmu-mir-672
  gRNA
gucacuaucuucgaaaguga

SEQ ID NO: 66315 - RNA, 20 nt, Artificial Sequence
  MKO10066315_A_mmu-mir-672
  gRNA
uacaccaaccucaaaacuaa

SEQ ID NO: 66316 - RNA, 20 nt, Artificial Sequence
  MKO10066316_A_mmu-mir-672
  gRNA
uagcccuuuaguuuugaggu

SEQ ID NO: 66317 - RNA, 20 nt, Artificial Sequence
  MKO10066317_A_mmu-mir-672
  gRNA
gaucuagcccuuuaguuuug

SEQ ID NO: 66318 - RNA, 20 nt, Artificial Sequence
  MKO10066318_A_mmu-mir-384
  gRNA
aggcauugugaacaauuucu

SEQ ID NO: 66319 - RNA, 20 nt, Artificial Sequence
  MKO10066319_A_mmu-mir-384
  gRNA
aggaauuguaaacaauuccu

SEQ ID NO: 66320 - RNA, 20 nt, Artificial Sequence
  MKO10066320_A_mmu-mir-384
  gRNA
gcuagcugaauauauguuac

SEQ ID NO: 66321 - RNA, 20 nt, Artificial Sequence
  MKO10066321_A_mmu-mir-384
  gRNA
caacauuauacacauugccu

SEQ ID NO: 66322 - RNA, 20 nt, Artificial Sequence
  MKO10066322_A_mmu-mir-325
  gRNA
uagcacagugcuugauugau

SEQ ID NO: 66323 - RNA, 20 nt, Artificial Sequence
  MKO10066323_A_mmu-mir-325
  gRNA
cacagugcuugauugauagg

SEQ ID NO: 66324 - RNA, 20 nt, Artificial Sequence
  MKO10066324_A_mmu-mir-325
  gRNA
acacuuacugagcaccuacu

SEQ ID NO: 66325 - RNA, 20 nt, Artificial Sequence
  MKO10066325_A_mmu-mir-325
  gRNA
uauagugcuugguuccuagu

SEQ ID NO: 66326 - RNA, 20 nt, Artificial Sequence
  MKO10066326_A_mmu-mir-6382
  gRNA
aaagacauagucuaaccacu

SEQ ID NO: 66327 - RNA, 20 nt, Artificial Sequence
  MKO10066327_A_mmu-mir-6382
  gRNA
ugucacauauucuaaucaua

SEQ ID NO: 66328 - RNA, 20 nt, Artificial Sequence
  MKO10066328_A_mmu-mir-6382
  gRNA
gacuugcaagcugcauuuuu

SEQ ID NO: 66329 - RNA, 20 nt, Artificial Sequence
  MKO10066329_A_mmu-mir-6382
  gRNA
gaauguaaagagagcacaca

SEQ ID NO: 66330 - RNA, 20 nt, Artificial Sequence
  MKO10066330_A_mmu-mir-361
  gRNA
acaaaucagaaucacaccug

SEQ ID NO: 66331 - RNA, 20 nt, Artificial Sequence
  MKO10066331_A_mmu-mir-361
  gRNA
uuucaaauacuaaguacccc

SEQ ID NO: 66332 - RNA, 20 nt, Artificial Sequence
  MKO10066332_A_mmu-mir-361
  gRNA
uaguauuugaaaaguccccc

SEQ ID NO: 66333 - RNA, 20 nt, Artificial Sequence
  MKO10066333_A_mmu-mir-361
  gRNA
aagcuuaucagaaucuccag

SEQ ID NO: 66334 - RNA, 20 nt, Artificial Sequence
  MKO10066334_A_mmu-mir-3112
  gRNA
aaugaacagugacauagaaa

SEQ ID NO: 66335 - RNA, 20 nt, Artificial Sequence
  MKO10066335_A_mmu-mir-3112
  gRNA
aaggcagucugcauuuauuc

SEQ ID NO: 66336 - RNA, 20 nt, Artificial Sequence
  MKO10066336_A_mmu-mir-3112
  gRNA
ucuucuuugucucugucagu

SEQ ID NO: 66337 - RNA, 20 nt, Artificial Sequence
  MKO10066337_A_mmu-mir-7093
  gRNA
gcggugggcaggaugacaga

SEQ ID NO: 66338 - RNA, 20 nt, Artificial Sequence
  MKO10066338_A_mmu-mir-7093
  gRNA
uuuuccaucugucauccugc

SEQ ID NO: 66339 - RNA, 20 nt, Artificial Sequence
  MKO10066339_A_mmu-mir-7093
  gRNA
aggaugacagauggaaaaca

SEQ ID NO: 66340 - RNA, 20 nt, Artificial Sequence
  MKO10066340_A_mmu-mir-7093
  gRNA
cagaccugcaggaugacaga

SEQ ID NO: 66341 - RNA, 20 nt, Artificial Sequence
  MKO10066341_A_mmu-mir-7646
  gRNA
gugaaagagagcgaccagug

SEQ ID NO: 66342 - RNA, 20 nt, Artificial Sequence
  MKO10066342_A_mmu-mir-7646
  gRNA
ugcugaaguaauguccucac

SEQ ID NO: 66343 - RNA, 20 nt, Artificial Sequence
  MKO10066343_A_mmu-mir-1970
  gRNA
caggaagagugagugccacu

SEQ ID NO: 66344 - RNA, 20 nt, Artificial Sequence
  MKO10066344_A_mmu-mir-1970
  gRNA
gucacuggggauaggcuuug

SEQ ID NO: 66345 - RNA, 20 nt, Artificial Sequence
  MKO10066345_A_mmu-mir-1970
  gRNA
uuggaggaaaugugucacug

SEQ ID NO: 66346 - RNA, 20 nt, Artificial Sequence
  MKO10066346_A_mmu-mir-1970
  gRNA
uguuggaggaaaugugucac

SEQ ID NO: 66347 - RNA, 20 nt, Artificial Sequence
  MKO10066347_A_mmu-mir-6383
  gRNA
acuuccaguuauccagcaug

SEQ ID NO: 66348 - RNA, 20 nt, Artificial Sequence
  MKO10066348_A_mmu-mir-6383
  gRNA
cacuguaaagugcuguguca

SEQ ID NO: 66349 - RNA, 20 nt, Artificial Sequence
  MKO10066349_A_mmu-mir-6383
  gRNA
caguaagucagucugcuuag

SEQ ID NO: 66350 - RNA, 20 nt, Artificial Sequence
  MKO10066350_A_mmu-mir-6383
  gRNA
ucagucugcuuagaggucag

SEQ ID NO: 66351 - RNA, 20 nt, Artificial Sequence
  MKO10066351_A_mmu-mir-3475
  gRNA
acccccacagaggguccaga

SEQ ID NO: 66352 - RNA, 20 nt, Artificial Sequence
  MKO10066352_A_mmu-mir-3475
  gRNA
cagaugguucuuaguucuuc

SEQ ID NO: 66353 - RNA, 20 nt, Artificial Sequence
  MKO10066353_A_mmu-mir-3475
  gRNA
augguucuuaguucuucugg

SEQ ID NO: 66354 - RNA, 20 nt, Artificial Sequence
  MKO10066354_A_mmu-mir-3475
  gRNA
cuguggggguacaugauuug

SEQ ID NO: 66355 - RNA, 20 nt, Artificial Sequence
  MKO10066355_A_mmu-mir-652
  gRNA
gcuauguacugcacaacccu

SEQ ID NO: 66356 - RNA, 20 nt, Artificial Sequence
  MKO10066356_A_mmu-mir-652
  gRNA
auguacugcacaacccuagg

SEQ ID NO: 66357 - RNA, 20 nt, Artificial Sequence
  MKO10066357_A_mmu-mir-652
  gRNA
guacugcacaacccuaggag

SEQ ID NO: 66358 - RNA, 20 nt, Artificial Sequence
  MKO10066358_A_mmu-mir-652
  gRNA
ucacauagaguauaauugaa

SEQ ID NO: 66359 - RNA, 20 nt, Artificial Sequence
  MKO10066359_A_mmu-mir-680-2
  gRNA
gaagugggcaucugcugaca

SEQ ID NO: 66360 - RNA, 20 nt, Artificial Sequence
  MKO10066360_A_mmu-mir-680-2
  gRNA
agugggcaucugcugacaug

SEQ ID NO: 66361 - RNA, 20 nt, Artificial Sequence
  MKO10066361_A_mmu-mir-680-2
  gRNA
ggcacucuggaucuuaucuc

SEQ ID NO: 66362 - RNA, 20 nt, Artificial Sequence
  MKO10066362_A_mmu-mir-680-2
  gRNA
uugauccuccuugacagccu

SEQ ID NO: 66363 - RNA, 20 nt, Artificial Sequence
  MKO10066363_A_mmu-mir-3472
  gRNA
uuuggguucuuuccagcuuc

SEQ ID NO: 66364 - RNA, 20 nt, Artificial Sequence
  MKO10066364_A_mmu-mir-3472
  gRNA
gcuucuggcuauuauaaaua

SEQ ID NO: 66365 - RNA, 20 nt, Artificial Sequence
  MKO10066365_A_mmu-mir-3472
  gRNA
uauuuauaauagccagaagc

SEQ ID NO: 66366 - RNA, 20 nt, Artificial Sequence
  MKO10066366_A_mmu-mir-3472
  gRNA
uauaauagccagaagcugga

SEQ ID NO: 66367 - RNA, 20 nt, Artificial Sequence
  MKO10066367_A_mmu-mir-764
  gRNA
uaucaacacaaucugaaucu

SEQ ID NO: 66368 - RNA, 20 nt, Artificial Sequence
  MKO10066368_A_mmu-mir-764
  gRNA
ccaugcuuauaaauacaugg

SEQ ID NO: 66369 - RNA, 20 nt, Artificial Sequence
  MKO10066369_A_mmu-mir-764
  gRNA
ugcuuauaaauacauggagg

SEQ ID NO: 66370 - RNA, 20 nt, Artificial Sequence
  MKO10066370_A_mmu-mir-764
  gRNA
auacauggaggaggccauag

SEQ ID NO: 66371 - RNA, 20 nt, Artificial Sequence
  MKO10066371_A_mmu-mir-1912
  gRNA
ucacaagcauauuagucucu

SEQ ID NO: 66372 - RNA, 20 nt, Artificial Sequence
  MKO10066372_A_mmu-mir-1912
  gRNA
ucuaggaugugcucauugca

SEQ ID NO: 66373 - RNA, 20 nt, Artificial Sequence
  MKO10066373_A_mmu-mir-1912
  gRNA
agugagaacuugauagagau

SEQ ID NO: 66374 - RNA, 20 nt, Artificial Sequence
  MKO10066374_A_mmu-mir-1264
  gRNA
cuucaugccuggcauauagc

SEQ ID NO: 66375 - RNA, 20 nt, Artificial Sequence
  MKO10066375_A_mmu-mir-1264
  gRNA
uuauuugagcaccuguuaug

SEQ ID NO: 66376 - RNA, 20 nt, Artificial Sequence
  MKO10066376_A_mmu-mir-1264
  gRNA
uuugagcaccuguuaugugg

SEQ ID NO: 66377 - RNA, 20 nt, Artificial Sequence
  MKO10066377_A_mmu-mir-1264
  gRNA
uugaggaccugcuauaugcc

SEQ ID NO: 66378 - RNA, 20 nt, Artificial Sequence
  MKO10066378_A_mmu-mir-1298
  gRNA
ugagggguuaagaguucauu

SEQ ID NO: 66379 - RNA, 20 nt, Artificial Sequence
  MKO10066379_A_mmu-mir-1298
  gRNA
uacccaaguacccuguuauu

SEQ ID NO: 66380 - RNA, 20 nt, Artificial Sequence
  MKO10066380_A_mmu-mir-1298
  gRNA
uauuuggcaauacauacauc

SEQ ID NO: 66381 - RNA, 20 nt, Artificial Sequence
  MKO10066381_A_mmu-mir-1298
  gRNA
acaggguacuuggguacauc

SEQ ID NO: 66382 - RNA, 20 nt, Artificial Sequence
  MKO10066382_A_mmu-mir-448
  gRNA
aaucccuacuucauacuaag

SEQ ID NO: 66383 - RNA, 20 nt, Artificial Sequence
  MKO10066383_A_mmu-mir-448
  gRNA
cauacuaagagggggcuggc

SEQ ID NO: 66384 - RNA, 20 nt, Artificial Sequence
  MKO10066384_A_mmu-mir-448
  gRNA
ggcuggcugguugcauaugu

SEQ ID NO: 66385 - RNA, 20 nt, Artificial Sequence
  MKO10066385_A_mmu-mir-448
  gRNA
auguaggaugucccaucucc

SEQ ID NO: 66386 - RNA, 20 nt, Artificial Sequence
  MKO10066386_A_mmu-mir-3620
  gRNA
aggggguggggugggguggg

SEQ ID NO: 66387 - RNA, 20 nt, Artificial Sequence
  MKO10066387_A_mmu-mir-3620
  gRNA
ggggugggguggggugggcg

SEQ ID NO: 66388 - RNA, 20 nt, Artificial Sequence
  MKO10066388_A_mmu-mir-3620
  gRNA
uggggugggcggggcugagc

SEQ ID NO: 66389 - RNA, 20 nt, Artificial Sequence
  MKO10066389_A_mmu-mir-3620
  gRNA
ugagugcugugggcugggcu

SEQ ID NO: 66390 - RNA, 20 nt, Artificial Sequence
  MKO10066390_A_mmu-mir-3113
  gRNA
uagcaucucuggcccuggcc

SEQ ID NO: 66391 - RNA, 20 nt, Artificial Sequence
  MKO10066391_A_mmu-mir-3113
  gRNA
ucuggcccuggcccgggucc

SEQ ID NO: 66392 - RNA, 20 nt, Artificial Sequence
  MKO10066392_A_mmu-mir-3113
  gRNA
ccuggcccggguccuggccc

SEQ ID NO: 66393 - RNA, 20 nt, Artificial Sequence
  MKO10066393_A_mmu-mir-3113
  gRNA
cccggguccuggcccugguc

SEQ ID NO: 66394 - RNA, 20 nt, Artificial Sequence
  MKO10066394_A_mmu-let-7f-2
  gRNA
cacuggugcucugugggaug

SEQ ID NO: 66395 - RNA, 20 nt, Artificial Sequence
  MKO10066395_A_mmu-let-7f-2
  gRNA
guaguagauuguauaguuuu

SEQ ID NO: 66396 - RNA, 20 nt, Artificial Sequence
  MKO10066396_A_mmu-let-7f-2
  gRNA
uuuagggucauaccccaucu

SEQ ID NO: 66397 - RNA, 20 nt, Artificial Sequence
  MKO10066397_A_mmu-let-7f-2
  gRNA
acagucuacugucuuuccca

SEQ ID NO: 66398 - RNA, 20 nt, Artificial Sequence
  MKO10066398_A_mmu-mir-98
  gRNA
agacacaucugcacaugcug

SEQ ID NO: 66399 - RNA, 20 nt, Artificial Sequence
  MKO10066399_A_mmu-mir-98
  gRNA
caucugcacaugcuggggug

SEQ ID NO: 66400 - RNA, 20 nt, Artificial Sequence
  MKO10066400_A_mmu-mir-98
  gRNA
gguaguaaguuguauuguug

SEQ ID NO: 66401 - RNA, 20 nt, Artificial Sequence
  MKO10066401_A_mmu-mir-98
  gRNA
uaguaaguuguauuguugug

SEQ ID NO: 66402 - RNA, 20 nt, Artificial Sequence
  MKO10066402_A_mmu-mir-3473a
  gRNA
uuuaaaaauauuuucugggc

SEQ ID NO: 66403 - RNA, 20 nt, Artificial Sequence
  MKO10066403_A_mmu-mir-3473a
  gRNA
uauuuucugggcuggugaga

SEQ ID NO: 66404 - RNA, 20 nt, Artificial Sequence
  MKO10066404_A_mmu-mir-3473a
  gRNA
ggcuggugagauggcucaac

SEQ ID NO: 66405 - RNA, 20 nt, Artificial Sequence
  MKO10066405_A_mmu-mir-3473a
  gRNA
auugucuuaagcuggagaga

SEQ ID NO: 66406 - RNA, 20 nt, Artificial Sequence
  MKO10066406_A_NTCmmu_0001
  gRNA
gcgagguauucggcuccgcg

SEQ ID NO: 66407 - RNA, 20 nt, Artificial Sequence
  MKO10066407_A_NTCmmu_0002
  gRNA
gcuuucacggagguucgacg

SEQ ID NO: 66408 - RNA, 20 nt, Artificial Sequence
  MKO10066408_A_NTCmmu_0003
  gRNA
auguugcaguucggcucgau

SEQ ID NO: 66409 - RNA, 20 nt, Artificial Sequence
  MKO10066409_A_NTCmmu_0004
  gRNA
acguguaaggcgaacgccuu

SEQ ID NO: 66410 - RNA, 20 nt, Artificial Sequence
  MKO10066410_A_NTCmmu_0005
  gRNA
gacuccggguacuaaauguc

SEQ ID NO: 66411 - RNA, 20 nt, Artificial Sequence
  MKO10066411_A_NTCmmu_0006
  gRNA
ccgcgccguuagggaacgag

SEQ ID NO: 66412 - RNA, 20 nt, Artificial Sequence
  MKO10066412_A_NTCmmu_0007
  gRNA
auuguucgaccgucuacggg

SEQ ID NO: 66413 - RNA, 20 nt, Artificial Sequence
  MKO10066413_A_NTCmmu_0008
  gRNA
acccaucgggugcgauaugg

SEQ ID NO: 66414 - RNA, 20 nt, Artificial Sequence
  MKO10066414_A_NTCmmu_0009
  gRNA
cgggcgucaccugcuaguaa

SEQ ID NO: 66415 - RNA, 20 nt, Artificial Sequence
  MKO10066415_A_NTCmmu_0010
  gRNA
gcuucuacucgcaacguauu

SEQ ID NO: 66416 - RNA, 20 nt, Artificial Sequence
  MKO10066416_A_NTCmmu_0011
  gRNA
uacaguuauacgucgcggug

SEQ ID NO: 66417 - RNA, 20 nt, Artificial Sequence
  MKO10066417_A_NTCmmu_0012
  gRNA
aagcacaagaacgguccgcc

SEQ ID NO: 66418 - RNA, 20 nt, Artificial Sequence
  MKO10066418_A_NTCmmu_0013
  gRNA
cagccaccgcaccggcguaa

SEQ ID NO: 66419 - RNA, 20 nt, Artificial Sequence
  MKO10066419_A_NTCmmu_0014
  gRNA
gucaagccgaacgcugccgg

SEQ ID NO: 66420 - RNA, 20 nt, Artificial Sequence
  MKO10066420_A_NTCmmu_0015
  gRNA
ccuuagaccggguguaccuc

SEQ ID NO: 66421 - RNA, 20 nt, Artificial Sequence
  MKO10066421_A_NTCmmu_0016
  gRNA
aagucuaugcggggcucgua

SEQ ID NO: 66422 - RNA, 20 nt, Artificial Sequence
  MKO10066422_A_NTCmmu_0017
  gRNA
uugucaacuucggccaacgc

SEQ ID NO: 66423 - RNA, 20 nt, Artificial Sequence
  MKO10066423_A_NTCmmu_0018
  gRNA
auagaugucuacgcgccguu

SEQ ID NO: 66424 - RNA, 20 nt, Artificial Sequence
  MKO10066424_A_NTCmmu_0019
  gRNA
cucgggcuauucagcgauag

SEQ ID NO: 66425 - RNA, 20 nt, Artificial Sequence
  MKO10066425_A_NTCmmu_0020
  gRNA
gcgguuaccgcgaaaaccau

SEQ ID NO: 66426 - RNA, 20 nt, Artificial Sequence
  MKO10066426_A_NTCmmu_0021
  gRNA
accaacgcuacgaucccgga

SEQ ID NO: 66427 - RNA, 20 nt, Artificial Sequence
  MKO10066427_A_NTCmmu_0022
  gRNA
cccuauaugcgagauccaua

SEQ ID NO: 66428 - RNA, 20 nt, Artificial Sequence
  MKO10066428_A_NTCmmu_0023
  gRNA
agaaaggcacgugcgacguc

SEQ ID NO: 66429 - RNA, 20 nt, Artificial Sequence
  MKO10066429_A_NTCmmu_0024
  gRNA
gaccaaccuuacgguaacuc

SEQ ID NO: 66430 - RNA, 20 nt, Artificial Sequence
  MKO10066430_A_NTCmmu_0025
  gRNA
auuauuccuccggaugacga

SEQ ID NO: 66431 - RNA, 20 nt, Artificial Sequence
  MKO10066431_A_NTCmmu_0026
  gRNA
ucucaguucguagcgaacga

SEQ ID NO: 66432 - RNA, 20 nt, Artificial Sequence
  MKO10066432_A_NTCmmu_0027
  gRNA
ucccgggagguacgguguac

SEQ ID NO: 66433 - RNA, 20 nt, Artificial Sequence
  MKO10066433_A_NTCmmu_0028
  gRNA
ggggauggccuuacgucgcg

SEQ ID NO: 66434 - RNA, 20 nt, Artificial Sequence
  MKO10066434_A_NTCmmu_0029
  gRNA
guauccuccuuacggcccgu

SEQ ID NO: 66435 - RNA, 20 nt, Artificial Sequence
  MKO10066435_A_NTCmmu_0030
  gRNA
gcucggaccuuuuagacguc

SEQ ID NO: 66436 - RNA, 20 nt, Artificial Sequence
  MKO10066436_A_NTCmmu_0031
  gRNA
gugguuacguuaacgacuac

SEQ ID NO: 66437 - RNA, 20 nt, Artificial Sequence
  MKO10066437_A_NTCmmu_0032
  gRNA
ugcaacgaugguuacgguac

SEQ ID NO: 66438 - RNA, 20 nt, Artificial Sequence
  MKO10066438_A_NTCmmu_0033
  gRNA
aacgggcgcaauacccuuuu

SEQ ID NO: 66439 - RNA, 20 nt, Artificial Sequence
  MKO10066439_A_NTCmmu_0034
  gRNA
ucgugucuagcuaucgagug

SEQ ID NO: 66440 - RNA, 20 nt, Artificial Sequence
  MKO10066440_A_NTCmmu_0035
  gRNA
gacgucuaauuucuggccgu

SEQ ID NO: 66441 - RNA, 20 nt, Artificial Sequence
  MKO10066441_A_NTCmmu_0036
  gRNA
uaguccuaguuagauucgcg

SEQ ID NO: 66442 - RNA, 20 nt, Artificial Sequence
  MKO10066442_A_NTCmmu_0037
  gRNA
aaggccuuaacacgucgacc

SEQ ID NO: 66443 - RNA, 20 nt, Artificial Sequence
  MKO10066443_A_NTCmmu_0038
  gRNA
auucgugcaucgcgggguuu

SEQ ID NO: 66444 - RNA, 20 nt, Artificial Sequence
  MKO10066444_A_NTCmmu_0039
  gRNA
caccucgcgucauaucacua

SEQ ID NO: 66445 - RNA, 20 nt, Artificial Sequence
  MKO10066445_A_NTCmmu_0040
  gRNA
gaccucgcaauugagcgcuc

SEQ ID NO: 66446 - RNA, 20 nt, Artificial Sequence
  MKO10066446_A_NTCmmu_0041
  gRNA
uguauccaccgugacccggu

SEQ ID NO: 66447 - RNA, 20 nt, Artificial Sequence
  MKO10066447_A_NTCmmu_0042
  gRNA
gaucuuaccacucgucguag

SEQ ID NO: 66448 - RNA, 20 nt, Artificial Sequence
  MKO10066448_A_NTCmmu_0043
  gRNA
uucgccggcgacgaagugca

SEQ ID NO: 66449 - RNA, 20 nt, Artificial Sequence
  MKO10066449_A_NTCmmu_0044
  gRNA
agcacuaggaucgcggccuu

SEQ ID NO: 66450 - RNA, 20 nt, Artificial Sequence
  MKO10066450_A_NTCmmu_0045
  gRNA
gcguaucuacccuaccgccg

SEQ ID NO: 66451 - RNA, 20 nt, Artificial Sequence
  MKO10066451_A_NTCmmu_0046
  gRNA
gcgcgagggcaccgacaagu

SEQ ID NO: 66452 - RNA, 20 nt, Artificial Sequence
  MKO10066452_A_NTCmmu_0047
  gRNA
cgcguauaugucacacggca

SEQ ID NO: 66453 - RNA, 20 nt, Artificial Sequence
  MKO10066453_A_NTCmmu_0048
  gRNA
uaaaaccgaucacgauacga

SEQ ID NO: 66454 - RNA, 20 nt, Artificial Sequence
  MKO10066454_A_NTCmmu_0049
  gRNA
uccugcgcgaugaccgucgg

SEQ ID NO: 66455 - RNA, 20 nt, Artificial Sequence
  MKO10066455_A_NTCmmu_0050
  gRNA
uggcccacaaggugcgauau

SEQ ID NO: 66456 - RNA, 20 nt, Artificial Sequence
  MKO10066456_A_NTCmmu_0051
  gRNA
gggguaggccuaauuacgga

SEQ ID NO: 66457 - RNA, 20 nt, Artificial Sequence
  MKO10066457_A_NTCmmu_0052
  gRNA
cgcuucgucucucgcaaaca

SEQ ID NO: 66458 - RNA, 20 nt, Artificial Sequence
  MKO10066458_A_NTCmmu_0053
  gRNA
uuaugugccucucggcgcau

SEQ ID NO: 66459 - RNA, 20 nt, Artificial Sequence
  MKO10066459_A_NTCmmu_0054
  gRNA
ccguucugacgacgcuaaag

SEQ ID NO: 66460 - RNA, 20 nt, Artificial Sequence
  MKO10066460_A_NTCmmu_0055
  gRNA
aaacucccgugucaaccgau

SEQ ID NO: 66461 - RNA, 20 nt, Artificial Sequence
  MKO10066461_A_NTCmmu_0056
  gRNA
guuugcgagucaaaguacgc

SEQ ID NO: 66462 - RNA, 20 nt, Artificial Sequence
  MKO10066462_A_NTCmmu_0057
  gRNA
gggugcacacgccggccuau

SEQ ID NO: 66463 - RNA, 20 nt, Artificial Sequence
  MKO10066463_A_NTCmmu_0058
  gRNA
cuuuauaccgcgcgucggca

SEQ ID NO: 66464 - RNA, 20 nt, Artificial Sequence
  MKO10066464_A_NTCmmu_0059
  gRNA
ucaaacgcccgggcgcccca

SEQ ID NO: 66465 - RNA, 20 nt, Artificial Sequence
  MKO10066465_A_NTCmmu_0060
  gRNA
gaccgguguguuuacgcgug

SEQ ID NO: 66466 - RNA, 20 nt, Artificial Sequence
  MKO10066466_A_NTCmmu_0061
  gRNA
cggugaggaucccucuugcg

SEQ ID NO: 66467 - RNA, 20 nt, Artificial Sequence
  MKO10066467_A_NTCmmu_0062
  gRNA
acggucccaacgagcgccgg

SEQ ID NO: 66468 - RNA, 20 nt, Artificial Sequence
  MKO10066468_A_NTCmmu_0063
  gRNA
cgcuucauugcccgaacgcu

SEQ ID NO: 66469 - RNA, 20 nt, Artificial Sequence
  MKO10066469_A_NTCmmu_0064
  gRNA
uuauaccgucacgagugccc

SEQ ID NO: 66470 - RNA, 20 nt, Artificial Sequence
  MKO10066470_A_NTCmmu_0065
  gRNA
ugcaccgguacgggcgacuc

SEQ ID NO: 66471 - RNA, 20 nt, Artificial Sequence
  MKO10066471_A_NTCmmu_0066
  gRNA
gaggcguacuucggcucuaa

SEQ ID NO: 66472 - RNA, 20 nt, Artificial Sequence
  MKO10066472_A_NTCmmu_0067
  gRNA
uucgagacggauacgucugc

SEQ ID NO: 66473 - RNA, 20 nt, Artificial Sequence
  MKO10066473_A_NTCmmu_0068
  gRNA
uagcccgucgaguacucccc

SEQ ID NO: 66474 - RNA, 20 nt, Artificial Sequence
  MKO10066474_A_NTCmmu_0069
  gRNA
agcuuagaucgugcgucgua

SEQ ID NO: 66475 - RNA, 20 nt, Artificial Sequence
  MKO10066475_A_NTCmmu_0070
  gRNA
cgccggaugacugguggaua

SEQ ID NO: 66476 - RNA, 20 nt, Artificial Sequence
  MKO10066476_A_NTCmmu_0071
  gRNA
ccguuucgccuauuggugcg

SEQ ID NO: 66477 - RNA, 20 nt, Artificial Sequence
  MKO10066477_A_NTCmmu_0072
  gRNA
uucgacgugcggcguauugg

SEQ ID NO: 66478 - RNA, 20 nt, Artificial Sequence
  MKO10066478_A_NTCmmu_0073
  gRNA
uucaauuguucgcccgaaca

SEQ ID NO: 66479 - RNA, 20 nt, Artificial Sequence
  MKO10066479_A_NTCmmu_0074
  gRNA
gcggaucugacgguuacuua

SEQ ID NO: 66480 - RNA, 20 nt, Artificial Sequence
  MKO10066480_A_NTCmmu_0075
  gRNA
aaugaagcaccgauugcgga

SEQ ID NO: 66481 - RNA, 20 nt, Artificial Sequence
  MKO10066481_A_NTCmmu_0076
  gRNA
uccuauaauugagcgaacgg

SEQ ID NO: 66482 - RNA, 20 nt, Artificial Sequence
  MKO10066482_A_NTCmmu_0077
  gRNA
gcuacagauuugcguucgag

SEQ ID NO: 66483 - RNA, 20 nt, Artificial Sequence
  MKO10066483_A_NTCmmu_0078
  gRNA
ggacugaaaccgauaguauc

SEQ ID NO: 66484 - RNA, 20 nt, Artificial Sequence
  MKO10066484_A_NTCmmu_0079
  gRNA
gcaauucugcaacgcacguc

SEQ ID NO: 66485 - RNA, 20 nt, Artificial Sequence
  MKO10066485_A_NTCmmu_0080
  gRNA
cacccgacucggccguaaag

SEQ ID NO: 66486 - RNA, 20 nt, Artificial Sequence
  MKO10066486_A_NTCmmu_0081
  gRNA
caaccgugcgaugcgcgcua

SEQ ID NO: 66487 - RNA, 20 nt, Artificial Sequence
  MKO10066487_A_NTCmmu_0082
  gRNA
ugauggacgcgauacguuua

SEQ ID NO: 66488 - RNA, 20 nt, Artificial Sequence
  MKO10066488_A_NTCmmu_0083
  gRNA
uaccccuugaggggcgcaua

SEQ ID NO: 66489 - RNA, 20 nt, Artificial Sequence
  MKO10066489_A_NTCmmu_0084
  gRNA
ccguauacguaucuaugccg

SEQ ID NO: 66490 - RNA, 20 nt, Artificial Sequence
  MKO10066490_A_NTCmmu_0085
  gRNA
acagcggccuaauacuucgc

SEQ ID NO: 66491 - RNA, 20 nt, Artificial Sequence
  MKO10066491_A_NTCmmu_0086
  gRNA
uaucgaacugcacacgcaac

SEQ ID NO: 66492 - RNA, 20 nt, Artificial Sequence
  MKO10066492_A_NTCmmu_0087
  gRNA
ugucggacccauugucgaac

SEQ ID NO: 66493 - RNA, 20 nt, Artificial Sequence
  MKO10066493_A_NTCmmu_0088
  gRNA
aaaccuagcguagauucggc

SEQ ID NO: 66494 - RNA, 20 nt, Artificial Sequence
  MKO10066494_A_NTCmmu_0089
  gRNA
uagauggugcuucugucgcg

SEQ ID NO: 66495 - RNA, 20 nt, Artificial Sequence
  MKO10066495_A_NTCmmu_0090
  gRNA
caucguaacacacguacgag

SEQ ID NO: 66496 - RNA, 20 nt, Artificial Sequence
  MKO10066496_A_NTCmmu_0091
  gRNA
caacgaucaggcguguuauc

SEQ ID NO: 66497 - RNA, 20 nt, Artificial Sequence
  MKO10066497_A_NTCmmu_0092
  gRNA
acagcaggggccgcgaauaa

SEQ ID NO: 66498 - RNA, 20 nt, Artificial Sequence
  MKO10066498_A_NTCmmu_0093
  gRNA
agccgggcuuuccgucaagc

SEQ ID NO: 66499 - RNA, 20 nt, Artificial Sequence
  MKO10066499_A_NTCmmu_0094
  gRNA
acggucccucucgggucaau

SEQ ID NO: 66500 - RNA, 20 nt, Artificial Sequence
  MKO10066500_A_NTCmmu_0095
  gRNA
ucaauaguucugcgcgaauu

SEQ ID NO: 66501 - RNA, 20 nt, Artificial Sequence
  MKO10066501_A_NTCmmu_0096
  gRNA
ucguuacauaccccgcggaa

SEQ ID NO: 66502 - RNA, 20 nt, Artificial Sequence
  MKO10066502_A_NTCmmu_0097
  gRNA
cauucgguccguucaucucg

SEQ ID NO: 66503 - RNA, 20 nt, Artificial Sequence
  MKO10066503_A_NTCmmu_0098
  gRNA
uucggcucaauggcgcgagc

SEQ ID NO: 66504 - RNA, 20 nt, Artificial Sequence
  MKO10066504_A_NTCmmu_0099
  gRNA
cauacccgcgccgugacucc

SEQ ID NO: 66505 - RNA, 20 nt, Artificial Sequence
  MKO10066505_A_NTCmmu_0100
  gRNA
ggacggaugggacgacuagu

SEQ ID NO: 66506 - RNA, 20 nt, Artificial Sequence
  MKO10066506_A_NTCmmu_0101
  gRNA
gugcaacgacugacccgcgg

SEQ ID NO: 66507 - RNA, 20 nt, Artificial Sequence
  MKO10066507_A_NTCmmu_0102
  gRNA
cgacacuugggcugacgcgc

SEQ ID NO: 66508 - RNA, 20 nt, Artificial Sequence
  MKO10066508_A_NTCmmu_0103
  gRNA
uguguaauuacguuucgcgg

SEQ ID NO: 66509 - RNA, 20 nt, Artificial Sequence
  MKO10066509_A_NTCmmu_0104
  gRNA
aaccguacugcgaggagcau

SEQ ID NO: 66510 - RNA, 20 nt, Artificial Sequence
  MKO10066510_A_NTCmmu_0105
  gRNA
gauauuuaccggcgauaaga

SEQ ID NO: 66511 - RNA, 20 nt, Artificial Sequence
  MKO10066511_A_NTCmmu_0106
  gRNA
gcgacguguaucgaucacuc

SEQ ID NO: 66512 - RNA, 20 nt, Artificial Sequence
  MKO10066512_A_NTCmmu_0107
  gRNA
uaauggaagaugcgcgauac

SEQ ID NO: 66513 - RNA, 20 nt, Artificial Sequence
  MKO10066513_A_NTCmmu_0108
  gRNA
uguccuaccgaaugaaccgu

SEQ ID NO: 66514 - RNA, 20 nt, Artificial Sequence
  MKO10066514_A_NTCmmu_0109
  gRNA
acgcgaagugucgcagagug

SEQ ID NO: 66515 - RNA, 20 nt, Artificial Sequence
  MKO10066515_A_NTCmmu_0110
  gRNA
gcagagcguaaucggcaucg

SEQ ID NO: 66516 - RNA, 20 nt, Artificial Sequence
  MKO10066516_A_NTCmmu_0111
  gRNA
gccgcgccauaauaugccau

SEQ ID NO: 66517 - RNA, 20 nt, Artificial Sequence
  MKO10066517_A_NTCmmu_0112
  gRNA
cgaaugcgccggagaauauu

SEQ ID NO: 66518 - RNA, 20 nt, Artificial Sequence
  MKO10066518_A_NTCmmu_0113
  gRNA
cccgccuggcgauucacggg

SEQ ID NO: 66519 - RNA, 20 nt, Artificial Sequence
  MKO10066519_A_NTCmmu_0114
  gRNA
agccuagucgcgcuaauauu

SEQ ID NO: 66520 - RNA, 20 nt, Artificial Sequence
  MKO10066520_A_NTCmmu_0115
  gRNA
gugugccucgacagcguaag

SEQ ID NO: 66521 - RNA, 20 nt, Artificial Sequence
  MKO10066521_A_NTCmmu_0116
  gRNA
ucaugcgccucguaauaccu

SEQ ID NO: 66522 - RNA, 20 nt, Artificial Sequence
  MKO10066522_A_NTCmmu_0117
  gRNA
ugugccacgccgcugcaacg

SEQ ID NO: 66523 - RNA, 20 nt, Artificial Sequence
  MKO10066523_A_NTCmmu_0118
  gRNA
gcaaauaggucggagcgugu

SEQ ID NO: 66524 - RNA, 20 nt, Artificial Sequence
  MKO10066524_A_NTCmmu_0119
  gRNA
ggauagcccgguuggugcgu

SEQ ID NO: 66525 - RNA, 20 nt, Artificial Sequence
  MKO10066525_A_NTCmmu_0120
  gRNA
ucgcaaaaugcggauuccgu

SEQ ID NO: 66526 - RNA, 20 nt, Artificial Sequence
  MKO10066526_A_NTCmmu_0121
  gRNA
ggugcaguccguuuagucgg

SEQ ID NO: 66527 - RNA, 20 nt, Artificial Sequence
  MKO10066527_A_NTCmmu_0122
  gRNA
uggguuccggccccauguac

SEQ ID NO: 66528 - RNA, 20 nt, Artificial Sequence
  MKO10066528_A_NTCmmu_0123
  gRNA
ccuucggauucguaggcugg

SEQ ID NO: 66529 - RNA, 20 nt, Artificial Sequence
  MKO10066529_A_NTCmmu_0124
  gRNA
ucccccguacguguaugucg

SEQ ID NO: 66530 - RNA, 20 nt, Artificial Sequence
  MKO10066530_A_NTCmmu_0125
  gRNA
aggugcgugucaaccgguag

SEQ ID NO: 66531 - RNA, 20 nt, Artificial Sequence
  MKO10066531_A_NTCmmu_0126
  gRNA
aaaaaguccgcgauuacguc

SEQ ID NO: 66532 - RNA, 20 nt, Artificial Sequence
  MKO10066532_A_NTCmmu_0127
  gRNA
uuaucgcacaaccccgaaag

SEQ ID NO: 66533 - RNA, 20 nt, Artificial Sequence
  MKO10066533_A_NTCmmu_0128
  gRNA
caccccguagcaacgauaaa

SEQ ID NO: 66534 - RNA, 20 nt, Artificial Sequence
  MKO10066534_A_NTCmmu_0129
  gRNA
uaacagcuuccgcguaauau

SEQ ID NO: 66535 - RNA, 20 nt, Artificial Sequence
  MKO10066535_A_NTCmmu_0130
  gRNA
gccauagccaaucgcuaguu

SEQ ID NO: 66536 - RNA, 20 nt, Artificial Sequence
  MKO10066536_A_NTCmmu_0131
  gRNA
caucuaugagacgugcguac

SEQ ID NO: 66537 - RNA, 20 nt, Artificial Sequence
  MKO10066537_A_NTCmmu_0132
  gRNA
uugauaaaccgcggccgaaa

SEQ ID NO: 66538 - RNA, 20 nt, Artificial Sequence
  MKO10066538_A_NTCmmu_0133
  gRNA
guauccucgcaaucguuagg

SEQ ID NO: 66539 - RNA, 20 nt, Artificial Sequence
  MKO10066539_A_NTCmmu_0134
  gRNA
uggcgcuccugcgcacacga

SEQ ID NO: 66540 - RNA, 20 nt, Artificial Sequence
  MKO10066540_A_NTCmmu_0135
  gRNA
uucgaagucuaacccgcggg

SEQ ID NO: 66541 - RNA, 20 nt, Artificial Sequence
  MKO10066541_A_NTCmmu_0136
  gRNA
guuucccgggacugucgcgu

SEQ ID NO: 66542 - RNA, 20 nt, Artificial Sequence
  MKO10066542_A_NTCmmu_0137
  gRNA
aacgccccggauuucguuga

SEQ ID NO: 66543 - RNA, 20 nt, Artificial Sequence
  MKO10066543_A_NTCmmu_0138
  gRNA
acaacacgccgacacgucua

SEQ ID NO: 66544 - RNA, 20 nt, Artificial Sequence
  MKO10066544_A_NTCmmu_0139
  gRNA
uaagcggcgucaugucgccc

SEQ ID NO: 66545 - RNA, 20 nt, Artificial Sequence
  MKO10066545_A_NTCmmu_0140
  gRNA
ccgccccugcgaacugcguu

SEQ ID NO: 66546 - RNA, 20 nt, Artificial Sequence
  MKO10066546_A_NTCmmu_0141
  gRNA
uaucuaaucgcggagucgua

SEQ ID NO: 66547 - RNA, 20 nt, Artificial Sequence
  MKO10066547_A_NTCmmu_0142
  gRNA
acgcuauaguguacgucuaa

SEQ ID NO: 66548 - RNA, 20 nt, Artificial Sequence
  MKO10066548_A_NTCmmu_0143
  gRNA
guagacauauugcguaaucg

SEQ ID NO: 66549 - RNA, 20 nt, Artificial Sequence
  MKO10066549_A_NTCmmu_0144
  gRNA
cguaaaccauaacguugguc

SEQ ID NO: 66550 - RNA, 20 nt, Artificial Sequence
  MKO10066550_A_NTCmmu_0145
  gRNA
ggacguagauuagggcguaa

SEQ ID NO: 66551 - RNA, 20 nt, Artificial Sequence
  MKO10066551_A_NTCmmu_0146
  gRNA
cgggcaauaugaucguaggc

SEQ ID NO: 66552 - RNA, 20 nt, Artificial Sequence
  MKO10066552_A_NTCmmu_0147
  gRNA
ggaccaauguuaccguaggu

SEQ ID NO: 66553 - RNA, 20 nt, Artificial Sequence
  MKO10066553_A_NTCmmu_0148
  gRNA
cagggacguagccgccguua

SEQ ID NO: 66554 - RNA, 20 nt, Artificial Sequence
  MKO10066554_A_NTCmmu_0149
  gRNA
aaccccggcugucaucgccg

SEQ ID NO: 66555 - RNA, 20 nt, Artificial Sequence
  MKO10066555_A_NTCmmu_0150
  gRNA
gauucauuaucggcauacgg

SEQ ID NO: 66556 - RNA, 20 nt, Artificial Sequence
  MKO10066556_A_NTCmmu_0151
  gRNA
agucauccucuaugcgcgua

SEQ ID NO: 66557 - RNA, 20 nt, Artificial Sequence
  MKO10066557_A_NTCmmu_0152
  gRNA
cguacgggcgcgccguccau

SEQ ID NO: 66558 - RNA, 20 nt, Artificial Sequence
  MKO10066558_A_NTCmmu_0153
  gRNA
uugcgugugcguuguuaacg

SEQ ID NO: 66559 - RNA, 20 nt, Artificial Sequence
  MKO10066559_A_NTCmmu_0154
  gRNA
gaccauacgccucguaugcc

SEQ ID NO: 66560 - RNA, 20 nt, Artificial Sequence
  MKO10066560_A_NTCmmu_0155
  gRNA
cggcaauguguggcgaccgc

SEQ ID NO: 66561 - RNA, 20 nt, Artificial Sequence
  MKO10066561_A_NTCmmu_0156
  gRNA
ucgcuaagccggguaauacu

SEQ ID NO: 66562 - RNA, 20 nt, Artificial Sequence
  MKO10066562_A_NTCmmu_0157
  gRNA
uuucuaauuacccgauacgu

SEQ ID NO: 66563 - RNA, 20 nt, Artificial Sequence
  MKO10066563_A_NTCmmu_0158
  gRNA
accaggacugccgcgugagg

SEQ ID NO: 66564 - RNA, 20 nt, Artificial Sequence
  MKO10066564_A_NTCmmu_0159
  gRNA
gcgcguacauauaaauaggu

SEQ ID NO: 66565 - RNA, 20 nt, Artificial Sequence
  MKO10066565_A_NTCmmu_0160
  gRNA
cuuauccauaauaggcggcg

SEQ ID NO: 66566 - RNA, 20 nt, Artificial Sequence
  MKO10066566_A_NTCmmu_0161
  gRNA
guuauugcgccuuggccgua

SEQ ID NO: 66567 - RNA, 20 nt, Artificial Sequence
  MKO10066567_A_NTCmmu_0162
  gRNA
uaaaaguggugcgucgucgu

SEQ ID NO: 66568 - RNA, 20 nt, Artificial Sequence
  MKO10066568_A_NTCmmu_0163
  gRNA
cucgugaaacaagauccgac

SEQ ID NO: 66569 - RNA, 20 nt, Artificial Sequence
  MKO10066569_A_NTCmmu_0164
  gRNA
uaaacgauucaccgauaaca

SEQ ID NO: 66570 - RNA, 20 nt, Artificial Sequence
  MKO10066570_A_NTCmmu_0165
  gRNA
cggccguagugacgaaugga

SEQ ID NO: 66571 - RNA, 20 nt, Artificial Sequence
  MKO10066571_A_NTCmmu_0166
  gRNA
accggucgaagucugggauu

SEQ ID NO: 66572 - RNA, 20 nt, Artificial Sequence
  MKO10066572_A_NTCmmu_0167
  gRNA
uccguacaucgaccuauuac

SEQ ID NO: 66573 - RNA, 20 nt, Artificial Sequence
  MKO10066573_A_NTCmmu_0168
  gRNA
cgacacgauggucauacuac

SEQ ID NO: 66574 - RNA, 20 nt, Artificial Sequence
  MKO10066574_A_NTCmmu_0169
  gRNA
acucgaccuaacgucgaugu

SEQ ID NO: 66575 - RNA, 20 nt, Artificial Sequence
  MKO10066575_A_NTCmmu_0170
  gRNA
ugcagaucgcgaagcgacua

SEQ ID NO: 66576 - RNA, 20 nt, Artificial Sequence
  MKO10066576_A_NTCmmu_0171
  gRNA
ucuaggauacucuuaacggg

SEQ ID NO: 66577 - RNA, 20 nt, Artificial Sequence
  MKO10066577_A_NTCmmu_0172
  gRNA
ggucuguccguugcgaccac

SEQ ID NO: 66578 - RNA, 20 nt, Artificial Sequence
  MKO10066578_A_NTCmmu_0173
  gRNA
accggacugcgauaugccgu

SEQ ID NO: 66579 - RNA, 20 nt, Artificial Sequence
  MKO10066579_A_NTCmmu_0174
  gRNA
cucguauaguauugcguggu

SEQ ID NO: 66580 - RNA, 20 nt, Artificial Sequence
  MKO10066580_A_NTCmmu_0175
  gRNA
cuuuagucacgauauacguc

SEQ ID NO: 66581 - RNA, 20 nt, Artificial Sequence
  MKO10066581_A_NTCmmu_0176
  gRNA
gcggcccgugaccguucaau

SEQ ID NO: 66582 - RNA, 20 nt, Artificial Sequence
  MKO10066582_A_NTCmmu_0177
  gRNA
ccgguuuauaaauuacgugg

SEQ ID NO: 66583 - RNA, 20 nt, Artificial Sequence
  MKO10066583_A_NTCmmu_0178
  gRNA
cagcucacccugcguacggu

SEQ ID NO: 66584 - RNA, 20 nt, Artificial Sequence
  MKO10066584_A_NTCmmu_0179
  gRNA
cucggcuuuacgaucgauca

SEQ ID NO: 66585 - RNA, 20 nt, Artificial Sequence
  MKO10066585_A_NTCmmu_0180
  gRNA
ucugcaccgcgacuuagcuu

SEQ ID NO: 66586 - RNA, 20 nt, Artificial Sequence
  MKO10066586_A_NTCmmu_0181
  gRNA
ggcuuauagacgagacucga

SEQ ID NO: 66587 - RNA, 20 nt, Artificial Sequence
  MKO10066587_A_NTCmmu_0182
  gRNA
accggaugugggcgccucuc

SEQ ID NO: 66588 - RNA, 20 nt, Artificial Sequence
  MKO10066588_A_NTCmmu_0183
  gRNA
cauuacgugucgagcuccgg

SEQ ID NO: 66589 - RNA, 20 nt, Artificial Sequence
  MKO10066589_A_NTCmmu_0184
  gRNA
gaugcggguggaaaacguua

SEQ ID NO: 66590 - RNA, 20 nt, Artificial Sequence
  MKO10066590_A_NTCmmu_0185
  gRNA
gcaaaaagcggacacgcgac

SEQ ID NO: 66591 - RNA, 20 nt, Artificial Sequence
  MKO10066591_A_NTCmmu_0186
  gRNA
cgaggauguacauacguaaa

SEQ ID NO: 66592 - RNA, 20 nt, Artificial Sequence
  MKO10066592_A_NTCmmu_0187
  gRNA
acacgucuucggcuauacgc

SEQ ID NO: 66593 - RNA, 20 nt, Artificial Sequence
  MKO10066593_A_NTCmmu_0188
  gRNA
ucgugccuagcucgguugag

SEQ ID NO: 66594 - RNA, 20 nt, Artificial Sequence
  MKO10066594_A_NTCmmu_0189
  gRNA
ucacacgggaucucgccggu

SEQ ID NO: 66595 - RNA, 20 nt, Artificial Sequence
  MKO10066595_A_NTCmmu_0190
  gRNA
cgugcguucguaauaaaagg

SEQ ID NO: 66596 - RNA, 20 nt, Artificial Sequence
  MKO10066596_A_NTCmmu_0191
  gRNA
ccccuucgauauccgaugac

SEQ ID NO: 66597 - RNA, 20 nt, Artificial Sequence
  MKO10066597_A_NTCmmu_0192
  gRNA
cgugauuccuaagcccccgc

SEQ ID NO: 66598 - RNA, 20 nt, Artificial Sequence
  MKO10066598_A_NTCmmu_0193
  gRNA
gcgugccaugggaggccguu

SEQ ID NO: 66599 - RNA, 20 nt, Artificial Sequence
  MKO10066599_A_NTCmmu_0194
  gRNA
ggcuuuacguaaggagcgua

SEQ ID NO: 66600 - RNA, 20 nt, Artificial Sequence
  MKO10066600_A_NTCmmu_0195
  gRNA
acccuagccucaucgcgacc

SEQ ID NO: 66601 - RNA, 20 nt, Artificial Sequence
  MKO10066601_A_NTCmmu_0196
  gRNA
gcugauuagacccggcguaa

SEQ ID NO: 66602 - RNA, 20 nt, Artificial Sequence
  MKO10066602_A_NTCmmu_0197
  gRNA
guuaccccuuuggccggaag

SEQ ID NO: 66603 - RNA, 20 nt, Artificial Sequence
  MKO10066603_A_NTCmmu_0198
  gRNA
uaacguuaugucaaacgcuc

SEQ ID NO: 66604 - RNA, 20 nt, Artificial Sequence
  MKO10066604_A_NTCmmu_0199
  gRNA
ggaucgauccgaggaacgug

SEQ ID NO: 66605 - RNA, 20 nt, Artificial Sequence
  MKO10066605_A_NTCmmu_0200
  gRNA
cugcacggcacgacauccaa

SEQ ID NO: 66606 - RNA, 20 nt, Artificial Sequence
  MKO10066606_A_NTCmmu_0201
  gRNA
ggucaaagcgauguuagccg

SEQ ID NO: 66607 - RNA, 20 nt, Artificial Sequence
  MKO10066607_A_NTCmmu_0202
  gRNA
gcuuguaaucuaaagacgcg

SEQ ID NO: 66608 - RNA, 20 nt, Artificial Sequence
  MKO10066608_A_NTCmmu_0203
  gRNA
gagauuaaauuaacgccggc

SEQ ID NO: 66609 - RNA, 20 nt, Artificial Sequence
  MKO10066609_A_NTCmmu_0204
  gRNA
cgaaucgggaaggcgcgugu

SEQ ID NO: 66610 - RNA, 20 nt, Artificial Sequence
  MKO10066610_A_NTCmmu_0205
  gRNA
gggacgcucaucgagugacg

SEQ ID NO: 66611 - RNA, 20 nt, Artificial Sequence
  MKO10066611_A_NTCmmu_0206
  gRNA
agcgcguaaggcguaguuac

SEQ ID NO: 66612 - RNA, 20 nt, Artificial Sequence
  MKO10066612_A_NTCmmu_0207
  gRNA
guuucagcgcgaguugcgcg

SEQ ID NO: 66613 - RNA, 20 nt, Artificial Sequence
  MKO10066613_A_NTCmmu_0208
  gRNA
uccugcguuccacucguacu

SEQ ID NO: 66614 - RNA, 20 nt, Artificial Sequence
  MKO10066614_A_NTCmmu_0209
  gRNA
guuauuugucugucgaaacg

SEQ ID NO: 66615 - RNA, 20 nt, Artificial Sequence
  MKO10066615_A_NTCmmu_0210
  gRNA
aauaagccuacccggcgaga

SEQ ID NO: 66616 - RNA, 20 nt, Artificial Sequence
  MKO10066616_A_NTCmmu_0211
  gRNA
guacaugcggcaagucgacu

SEQ ID NO: 66617 - RNA, 20 nt, Artificial Sequence
  MKO10066617_A_NTCmmu_0212
  gRNA
agcaguucggguaacgccca

SEQ ID NO: 66618 - RNA, 20 nt, Artificial Sequence
  MKO10066618_A_NTCmmu_0213
  gRNA
uguacucgcauagcgggggc

SEQ ID NO: 66619 - RNA, 20 nt, Artificial Sequence
  MKO10066619_A_NTCmmu_0214
  gRNA
aacucgcgugggaaguccgg

SEQ ID NO: 66620 - RNA, 20 nt, Artificial Sequence
  MKO10066620_A_NTCmmu_0215
  gRNA
ccuuguggcgugccaaacga

SEQ ID NO: 66621 - RNA, 20 nt, Artificial Sequence
  MKO10066621_A_NTCmmu_0216
  gRNA
ugccgacgcgacgcagcgua

SEQ ID NO: 66622 - RNA, 20 nt, Artificial Sequence
  MKO10066622_A_NTCmmu_0217
  gRNA
ugcggcaauguuaacccuua

SEQ ID NO: 66623 - RNA, 20 nt, Artificial Sequence
  MKO10066623_A_NTCmmu_0218
  gRNA
uguauagucaucgccguaau

SEQ ID NO: 66624 - RNA, 20 nt, Artificial Sequence
  MKO10066624_A_NTCmmu_0219
  gRNA
uaggcggacgguuacauaua

SEQ ID NO: 66625 - RNA, 20 nt, Artificial Sequence
  MKO10066625_A_NTCmmu_0220
  gRNA
gauaagacuccgcgagcuuc

SEQ ID NO: 66626 - RNA, 20 nt, Artificial Sequence
  MKO10066626_A_NTCmmu_0221
  gRNA
ucgugccggaauaaccacua

SEQ ID NO: 66627 - RNA, 20 nt, Artificial Sequence
  MKO10066627_A_NTCmmu_0222
  gRNA
cgaguaauuauuugcggucg

SEQ ID NO: 66628 - RNA, 20 nt, Artificial Sequence
  MKO10066628_A_NTCmmu_0223
  gRNA
uacuuaccgaccgacaaacg

SEQ ID NO: 66629 - RNA, 20 nt, Artificial Sequence
  MKO10066629_A_NTCmmu_0224
  gRNA
augguggcuguacucguaac

SEQ ID NO: 66630 - RNA, 20 nt, Artificial Sequence
  MKO10066630_A_NTCmmu_0225
  gRNA
ucguaaguucgcuauaugcc

SEQ ID NO: 66631 - RNA, 20 nt, Artificial Sequence
  MKO10066631_A_NTCmmu_0226
  gRNA
ccggcuugaauaccgugcgg

SEQ ID NO: 66632 - RNA, 20 nt, Artificial Sequence
  MKO10066632_A_NTCmmu_0227
  gRNA
ggcccaacgaaacuagcgug

SEQ ID NO: 66633 - RNA, 20 nt, Artificial Sequence
  MKO10066633_A_NTCmmu_0228
  gRNA
agccgcgccgcaaagcuuuu

SEQ ID NO: 66634 - RNA, 20 nt, Artificial Sequence
  MKO10066634_A_NTCmmu_0229
  gRNA
acacgaccgaccgguggaau

SEQ ID NO: 66635 - RNA, 20 nt, Artificial Sequence
  MKO10066635_A_NTCmmu_0230
  gRNA
aaacucauacguagcgaauc

SEQ ID NO: 66636 - RNA, 20 nt, Artificial Sequence
  MKO10066636_A_NTCmmu_0231
  gRNA
cgauugacguugggcucuca

SEQ ID NO: 66637 - RNA, 20 nt, Artificial Sequence
  MKO10066637_A_NTCmmu_0232
  gRNA
aaccagcauuugaccgcgcu

SEQ ID NO: 66638 - RNA, 20 nt, Artificial Sequence
  MKO10066638_A_NTCmmu_0233
  gRNA
acgucggucuagaguuaagu

SEQ ID NO: 66639 - RNA, 20 nt, Artificial Sequence
  MKO10066639_A_NTCmmu_0234
  gRNA
cuccggacgugcauccgaga

SEQ ID NO: 66640 - RNA, 20 nt, Artificial Sequence
  MKO10066640_A_NTCmmu_0235
  gRNA
auaaagucccaggugcgcgc

SEQ ID NO: 66641 - RNA, 20 nt, Artificial Sequence
  MKO10066641_A_NTCmmu_0236
  gRNA
gccgcucuugauaacgacgc

SEQ ID NO: 66642 - RNA, 20 nt, Artificial Sequence
  MKO10066642_A_NTCmmu_0237
  gRNA
cgaaaccauaccuccuucga

SEQ ID NO: 66643 - RNA, 20 nt, Artificial Sequence
  MKO10066643_A_NTCmmu_0238
  gRNA
cgcgccuacccuuuuaccgc

SEQ ID NO: 66644 - RNA, 20 nt, Artificial Sequence
  MKO10066644_A_NTCmmu_0239
  gRNA
uaccccucugcgaugccggu

SEQ ID NO: 66645 - RNA, 20 nt, Artificial Sequence
  MKO10066645_A_NTCmmu_0240
  gRNA
auauugucccauacgaucgg

SEQ ID NO: 66646 - RNA, 20 nt, Artificial Sequence
  MKO10066646_A_NTCmmu_0241
  gRNA
ggauugacgagacgauaucg

SEQ ID NO: 66647 - RNA, 20 nt, Artificial Sequence
  MKO10066647_A_NTCmmu_0242
  gRNA
cacguaagacgcuccacuua

SEQ ID NO: 66648 - RNA, 20 nt, Artificial Sequence
  MKO10066648_A_NTCmmu_0243
  gRNA
ggagucucacgcaauuagcg

SEQ ID NO: 66649 - RNA, 20 nt, Artificial Sequence
  MKO10066649_A_NTCmmu_0244
  gRNA
aucgcaggucuacgcagagu

SEQ ID NO: 66650 - RNA, 20 nt, Artificial Sequence
  MKO10066650_A_NTCmmu_0245
  gRNA
cggucgugacagaccuggug

SEQ ID NO: 66651 - RNA, 20 nt, Artificial Sequence
  MKO10066651_A_NTCmmu_0246
  gRNA
gccacuccgcucguucuaga

SEQ ID NO: 66652 - RNA, 20 nt, Artificial Sequence
  MKO10066652_A_NTCmmu_0247
  gRNA
ccgucgagcaaucccgccaa

SEQ ID NO: 66653 - RNA, 20 nt, Artificial Sequence
  MKO10066653_A_NTCmmu_0248
  gRNA
gagucgaguuaauaacgcuc

SEQ ID NO: 66654 - RNA, 20 nt, Artificial Sequence
  MKO10066654_A_NTCmmu_0249
  gRNA
caauaucuaagcgcuaacga

SEQ ID NO: 66655 - RNA, 20 nt, Artificial Sequence
  MKO10066655_A_NTCmmu_0250
  gRNA
acccauccccgcguccgaga

SEQ ID NO: 66656 - RNA, 20 nt, Artificial Sequence
  MKO10066656_A_NTCmmu_0251
  gRNA
uaaugaguaacgcucaucgg

SEQ ID NO: 66657 - RNA, 20 nt, Artificial Sequence
  MKO10066657_A_NTCmmu_0252
  gRNA
aacgguagcguacccgugaa

SEQ ID NO: 66658 - RNA, 20 nt, Artificial Sequence
  MKO10066658_A_NTCmmu_0253
  gRNA
caucgaggguaaacgccauu

SEQ ID NO: 66659 - RNA, 20 nt, Artificial Sequence
  MKO10066659_A_NTCmmu_0254
  gRNA
cgucaccgcuaguaaugaug

SEQ ID NO: 66660 - RNA, 20 nt, Artificial Sequence
  MKO10066660_A_NTCmmu_0255
  gRNA
aaucaccgacaacguaagac

SEQ ID NO: 66661 - RNA, 20 nt, Artificial Sequence
  MKO10066661_A_NTCmmu_0256
  gRNA
cacucagcgguuggacgccc

SEQ ID NO: 66662 - RNA, 20 nt, Artificial Sequence
  MKO10066662_A_NTCmmu_0257
  gRNA
uccguaggacguauauauuc

SEQ ID NO: 66663 - RNA, 20 nt, Artificial Sequence
  MKO10066663_A_NTCmmu_0258
  gRNA
aaaacguaauuauaccgagc

SEQ ID NO: 66664 - RNA, 20 nt, Artificial Sequence
  MKO10066664_A_NTCmmu_0259
  gRNA
uaggccgcucaggccgcacu

SEQ ID NO: 66665 - RNA, 20 nt, Artificial Sequence
  MKO10066665_A_NTCmmu_0260
  gRNA
cccacuuaauaacgccgcuu

SEQ ID NO: 66666 - RNA, 20 nt, Artificial Sequence
  MKO10066666_A_NTCmmu_0261
  gRNA
accauacggggucuugucga

SEQ ID NO: 66667 - RNA, 20 nt, Artificial Sequence
  MKO10066667_A_NTCmmu_0262
  gRNA
acggaacccgaucggaacgg

SEQ ID NO: 66668 - RNA, 20 nt, Artificial Sequence
  MKO10066668_A_NTCmmu_0263
  gRNA
guugcguccauuccgucgcc

SEQ ID NO: 66669 - RNA, 20 nt, Artificial Sequence
  MKO10066669_A_NTCmmu_0264
  gRNA
auuccguuugcagcgagacc

SEQ ID NO: 66670 - RNA, 20 nt, Artificial Sequence
  MKO10066670_A_NTCmmu_0265
  gRNA
ccaucgguucgacuuaccgc

SEQ ID NO: 66671 - RNA, 20 nt, Artificial Sequence
  MKO10066671_A_NTCmmu_0266
  gRNA
caucggcuaugucggggaca

SEQ ID NO: 66672 - RNA, 20 nt, Artificial Sequence
  MKO10066672_A_NTCmmu_0267
  gRNA
aaugagcgucucucgaucgc

SEQ ID NO: 66673 - RNA, 20 nt, Artificial Sequence
  MKO10066673_A_NTCmmu_0268
  gRNA
uuacugaucagucggacgca

SEQ ID NO: 66674 - RNA, 20 nt, Artificial Sequence
  MKO10066674_A_NTCmmu_0269
  gRNA
gauugagaagccgcgguauc

SEQ ID NO: 66675 - RNA, 20 nt, Artificial Sequence
  MKO10066675_A_NTCmmu_0270
  gRNA
gugauggccacguccgaacc

SEQ ID NO: 66676 - RNA, 20 nt, Artificial Sequence
  MKO10066676_A_NTCmmu_0271
  gRNA
uuggacguacacuuucguuc

SEQ ID NO: 66677 - RNA, 20 nt, Artificial Sequence
  MKO10066677_A_NTCmmu_0272
  gRNA
acugcgcguauaggacgcaa

SEQ ID NO: 66678 - RNA, 20 nt, Artificial Sequence
  MKO10066678_A_NTCmmu_0273
  gRNA
uagcuguuuacgccgaccug

SEQ ID NO: 66679 - RNA, 20 nt, Artificial Sequence
  MKO10066679_A_NTCmmu_0274
  gRNA
caugcccgucugcgccgcau

SEQ ID NO: 66680 - RNA, 20 nt, Artificial Sequence
  MKO10066680_A_NTCmmu_0275
  gRNA
ucaacuaugaaccgccgugc

SEQ ID NO: 66681 - RNA, 20 nt, Artificial Sequence
  MKO10066681_A_NTCmmu_0276
  gRNA
cguuacguuucuugccagga

SEQ ID NO: 66682 - RNA, 20 nt, Artificial Sequence
  MKO10066682_A_NTCmmu_0277
  gRNA
ucuauaucuagucucggcgc

SEQ ID NO: 66683 - RNA, 20 nt, Artificial Sequence
  MKO10066683_A_NTCmmu_0278
  gRNA
cuccucgaggcuggcuacgu

SEQ ID NO: 66684 - RNA, 20 nt, Artificial Sequence
  MKO10066684_A_NTCmmu_0279
  gRNA
ucguaccgcacguguaagcc

SEQ ID NO: 66685 - RNA, 20 nt, Artificial Sequence
  MKO10066685_A_NTCmmu_0280
  gRNA
cgggcacuaacccgauacac

SEQ ID NO: 66686 - RNA, 20 nt, Artificial Sequence
  MKO10066686_A_NTCmmu_0281
  gRNA
gaacguaacggcaugcauca

SEQ ID NO: 66687 - RNA, 20 nt, Artificial Sequence
  MKO10066687_A_NTCmmu_0282
  gRNA
gcccgauagaauuacccauu

SEQ ID NO: 66688 - RNA, 20 nt, Artificial Sequence
  MKO10066688_A_NTCmmu_0283
  gRNA
gcccucgagcucacgaugag

SEQ ID NO: 66689 - RNA, 20 nt, Artificial Sequence
  MKO10066689_A_NTCmmu_0284
  gRNA
uuaggacgugcuuccgaggg

SEQ ID NO: 66690 - RNA, 20 nt, Artificial Sequence
  MKO10066690_A_NTCmmu_0285
  gRNA
uaguuaaccguaaagugggc

SEQ ID NO: 66691 - RNA, 20 nt, Artificial Sequence
  MKO10066691_A_NTCmmu_0286
  gRNA
gugggcugaccguucucgac

SEQ ID NO: 66692 - RNA, 20 nt, Artificial Sequence
  MKO10066692_A_NTCmmu_0287
  gRNA
caagaguuaaccucgaccgg

SEQ ID NO: 66693 - RNA, 20 nt, Artificial Sequence
  MKO10066693_A_NTCmmu_0288
  gRNA
uaugacugcacgacucgcua

SEQ ID NO: 66694 - RNA, 20 nt, Artificial Sequence
  MKO10066694_A_NTCmmu_0289
  gRNA
gaaccggcgugcguuagcgg

SEQ ID NO: 66695 - RNA, 20 nt, Artificial Sequence
  MKO10066695_A_NTCmmu_0290
  gRNA
uucgauauaggggacggcgg

SEQ ID NO: 66696 - RNA, 20 nt, Artificial Sequence
  MKO10066696_A_NTCmmu_0291
  gRNA
gccguaagcgggccgguuga

SEQ ID NO: 66697 - RNA, 20 nt, Artificial Sequence
  MKO10066697_A_NTCmmu_0292
  gRNA
cguaaccggagauaauauua

SEQ ID NO: 66698 - RNA, 20 nt, Artificial Sequence
  MKO10066698_A_NTCmmu_0293
  gRNA
cggcgauaacagcgacaucg

SEQ ID NO: 66699 - RNA, 20 nt, Artificial Sequence
  MKO10066699_A_NTCmmu_0294
  gRNA
ucacuucgggcauuacgagc

SEQ ID NO: 66700 - RNA, 20 nt, Artificial Sequence
  MKO10066700_A_NTCmmu_0295
  gRNA
uaauaaacuaugucccgccg

SEQ ID NO: 66701 - RNA, 20 nt, Artificial Sequence
  MKO10066701_A_NTCmmu_0296
  gRNA
uggcacggaguugcauacgc

SEQ ID NO: 66702 - RNA, 20 nt, Artificial Sequence
  MKO10066702_A_NTCmmu_0297
  gRNA
gcuaguucucccgggcgaaa

SEQ ID NO: 66703 - RNA, 20 nt, Artificial Sequence
  MKO10066703_A_NTCmmu_0298
  gRNA
guucgguugcagcuuacacg

SEQ ID NO: 66704 - RNA, 20 nt, Artificial Sequence
  MKO10066704_A_NTCmmu_0299
  gRNA
gcaccucuagcgcgcucggc

SEQ ID NO: 66705 - RNA, 20 nt, Artificial Sequence
  MKO10066705_A_NTCmmu_0300
  gRNA
cauuguagacucguacggau

SEQ ID NO: 66706 - RNA, 20 nt, Artificial Sequence
  MKO10066706_A_NTCmmu_0301
  gRNA
ucggaauuccgcaggccgag

SEQ ID NO: 66707 - RNA, 20 nt, Artificial Sequence
  MKO10066707_A_NTCmmu_0302
  gRNA
gauuacgggguuccguaacu

SEQ ID NO: 66708 - RNA, 20 nt, Artificial Sequence
  MKO10066708_A_NTCmmu_0303
  gRNA
gccuaugugaaucgcgaauu

SEQ ID NO: 66709 - RNA, 20 nt, Artificial Sequence
  MKO10066709_A_NTCmmu_0304
  gRNA
cucggacggcauacgacaau

SEQ ID NO: 66710 - RNA, 20 nt, Artificial Sequence
  MKO10066710_A_NTCmmu_0305
  gRNA
cauaugcucgacgguauaaa

SEQ ID NO: 66711 - RNA, 20 nt, Artificial Sequence
  MKO10066711_A_NTCmmu_0306
  gRNA
cucauguacgccuucgcuac

SEQ ID NO: 66712 - RNA, 20 nt, Artificial Sequence
  MKO10066712_A_NTCmmu_0307
  gRNA
uuacaguucauaccgucgcc

SEQ ID NO: 66713 - RNA, 20 nt, Artificial Sequence
  MKO10066713_A_NTCmmu_0308
  gRNA
gauggccaguaacggcguca

SEQ ID NO: 66714 - RNA, 20 nt, Artificial Sequence
  MKO10066714_A_NTCmmu_0309
  gRNA
auuugaaugcucccgucgac

SEQ ID NO: 66715 - RNA, 20 nt, Artificial Sequence
  MKO10066715_A_NTCmmu_0310
  gRNA
caacggucacgcuagaauaa

SEQ ID NO: 66716 - RNA, 20 nt, Artificial Sequence
  MKO10066716_A_NTCmmu_0311
  gRNA
cuuaaguucgcgacggaaug

SEQ ID NO: 66717 - RNA, 20 nt, Artificial Sequence
  MKO10066717_A_NTCmmu_0312
  gRNA
uacuuagguccgcguaaagc

SEQ ID NO: 66718 - RNA, 20 nt, Artificial Sequence
  MKO10066718_A_NTCmmu_0313
  gRNA
gguuaaaaauuaagcggucc

SEQ ID NO: 66719 - RNA, 20 nt, Artificial Sequence
  MKO10066719_A_NTCmmu_0314
  gRNA
aaaacggcucgaucggugau

SEQ ID NO: 66720 - RNA, 20 nt, Artificial Sequence
  MKO10066720_A_NTCmmu_0315
  gRNA
auguuacguacgugaucucc

SEQ ID NO: 66721 - RNA, 20 nt, Artificial Sequence
  MKO10066721_A_NTCmmu_0316
  gRNA
aguagacgcuauguucgcgc

SEQ ID NO: 66722 - RNA, 20 nt, Artificial Sequence
  MKO10066722_A_NTCmmu_0317
  gRNA
uacugcguaccgcaguaagc

SEQ ID NO: 66723 - RNA, 20 nt, Artificial Sequence
  MKO10066723_A_NTCmmu_0318
  gRNA
cccaucauucgcgcugacgu

SEQ ID NO: 66724 - RNA, 20 nt, Artificial Sequence
  MKO10066724_A_NTCmmu_0319
  gRNA
cgacuauugccguccaucuc

SEQ ID NO: 66725 - RNA, 20 nt, Artificial Sequence
  MKO10066725_A_NTCmmu_0320
  gRNA
auccguaccaaacacgcuac

SEQ ID NO: 66726 - RNA, 20 nt, Artificial Sequence
  MKO10066726_A_NTCmmu_0321
  gRNA
ugcguaaaacuugcgcucga

SEQ ID NO: 66727 - RNA, 20 nt, Artificial Sequence
  MKO10066727_A_NTCmmu_0322
  gRNA
cauaugccuauaaccggcgg

SEQ ID NO: 66728 - RNA, 20 nt, Artificial Sequence
  MKO10066728_A_NTCmmu_0323
  gRNA
guuccggauauauacgguua

SEQ ID NO: 66729 - RNA, 20 nt, Artificial Sequence
  MKO10066729_A_NTCmmu_0324
  gRNA
cuaauacacccggacgguac

SEQ ID NO: 66730 - RNA, 20 nt, Artificial Sequence
  MKO10066730_A_NTCmmu_0325
  gRNA
gggcgggacguaauauuaug

SEQ ID NO: 66731 - RNA, 20 nt, Artificial Sequence
  MKO10066731_A_NTCmmu_0326
  gRNA
acuuuacaucaugucgucgu

SEQ ID NO: 66732 - RNA, 20 nt, Artificial Sequence
  MKO10066732_A_NTCmmu_0327
  gRNA
cugaucggugcauaucucgg

SEQ ID NO: 66733 - RNA, 20 nt, Artificial Sequence
  MKO10066733_A_NTCmmu_0328
  gRNA
gagccccaacgcgcgaagca

SEQ ID NO: 66734 - RNA, 20 nt, Artificial Sequence
  MKO10066734_A_NTCmmu_0329
  gRNA
gcuaagauucauccgaacac

SEQ ID NO: 66735 - RNA, 20 nt, Artificial Sequence
  MKO10066735_A_NTCmmu_0330
  gRNA
guuaccgugacgauaagaau

SEQ ID NO: 66736 - RNA, 20 nt, Artificial Sequence
  MKO10066736_A_NTCmmu_0331
  gRNA
gcuaaacguauuuuacgggc

SEQ ID NO: 66737 - RNA, 20 nt, Artificial Sequence
  MKO10066737_A_NTCmmu_0332
  gRNA
ccgagccgaauugggcgugu

SEQ ID NO: 66738 - RNA, 20 nt, Artificial Sequence
  MKO10066738_A_NTCmmu_0333
  gRNA
guugcguguguccguacaaa

SEQ ID NO: 66739 - RNA, 20 nt, Artificial Sequence
  MKO10066739_A_NTCmmu_0334
  gRNA
cuuuauuccguugcaugucg

SEQ ID NO: 66740 - RNA, 20 nt, Artificial Sequence
  MKO10066740_A_NTCmmu_0335
  gRNA
aagcguaccccacucguuaa

SEQ ID NO: 66741 - RNA, 20 nt, Artificial Sequence
  MKO10066741_A_NTCmmu_0336
  gRNA
auccgagaucugcgaauuau

SEQ ID NO: 66742 - RNA, 20 nt, Artificial Sequence
  MKO10066742_A_NTCmmu_0337
  gRNA
ucuugacuccgacuucgggc

SEQ ID NO: 66743 - RNA, 20 nt, Artificial Sequence
  MKO10066743_A_NTCmmu_0338
  gRNA
accaugaugucaccgccgca

SEQ ID NO: 66744 - RNA, 20 nt, Artificial Sequence
  MKO10066744_A_NTCmmu_0339
  gRNA
ucaacuuaaccucgaguccg

SEQ ID NO: 66745 - RNA, 20 nt, Artificial Sequence
  MKO10066745_A_NTCmmu_0340
  gRNA
cuacgagggccgcgagcggu

SEQ ID NO: 66746 - RNA, 20 nt, Artificial Sequence
  MKO10066746_A_NTCmmu_0341
  gRNA
augugucauagcggcguagg

SEQ ID NO: 66747 - RNA, 20 nt, Artificial Sequence
  MKO10066747_A_NTCmmu_0342
  gRNA
uguaacgaucugggcggucu

SEQ ID NO: 66748 - RNA, 20 nt, Artificial Sequence
  MKO10066748_A_NTCmmu_0343
  gRNA
ccggaucggcuacgcuacgg

SEQ ID NO: 66749 - RNA, 20 nt, Artificial Sequence
  MKO10066749_A_NTCmmu_0344
  gRNA
caauauucgaccuacgcucc

SEQ ID NO: 66750 - RNA, 20 nt, Artificial Sequence
  MKO10066750_A_NTCmmu_0345
  gRNA
ugauaaacgaugcgaacucg

SEQ ID NO: 66751 - RNA, 20 nt, Artificial Sequence
  MKO10066751_A_NTCmmu_0346
  gRNA
ugauugggggucguucgcca

SEQ ID NO: 66752 - RNA, 20 nt, Artificial Sequence
  MKO10066752_A_NTCmmu_0347
  gRNA
uagucagucggccuccgugc

SEQ ID NO: 66753 - RNA, 20 nt, Artificial Sequence
  MKO10066753_A_NTCmmu_0348
  gRNA
aaccggcugcgcguuugcaa

SEQ ID NO: 66754 - RNA, 20 nt, Artificial Sequence
  MKO10066754_A_NTCmmu_0349
  gRNA
gugccugauagugugaagcg

SEQ ID NO: 66755 - RNA, 20 nt, Artificial Sequence
  MKO10066755_A_NTCmmu_0350
  gRNA
cgacgacccauuucgguuau

SEQ ID NO: 66756 - RNA, 20 nt, Artificial Sequence
  MKO10066756_A_NTCmmu_0351
  gRNA
ggggggucuaauaccgauug

SEQ ID NO: 66757 - RNA, 20 nt, Artificial Sequence
  MKO10066757_A_NTCmmu_0352
  gRNA
uuuuuagaccuaauucgcgc

SEQ ID NO: 66758 - RNA, 20 nt, Artificial Sequence
  MKO10066758_A_NTCmmu_0353
  gRNA
ucuacacgcgcguucaaccg

SEQ ID NO: 66759 - RNA, 20 nt, Artificial Sequence
  MKO10066759_A_NTCmmu_0354
  gRNA
cggggcguacauguguggcc

SEQ ID NO: 66760 - RNA, 20 nt, Artificial Sequence
  MKO10066760_A_NTCmmu_0355
  gRNA
cgacucgcuuaaccgugcag

SEQ ID NO: 66761 - RNA, 20 nt, Artificial Sequence
  MKO10066761_A_NTCmmu_0356
  gRNA
gcguaccuaucgauaaacca

SEQ ID NO: 66762 - RNA, 20 nt, Artificial Sequence
  MKO10066762_A_NTCmmu_0357
  gRNA
auaugagcccgaccucucga

SEQ ID NO: 66763 - RNA, 20 nt, Artificial Sequence
  MKO10066763_A_NTCmmu_0358
  gRNA
cgcgccgagggccucguuac

SEQ ID NO: 66764 - RNA, 20 nt, Artificial Sequence
  MKO10066764_A_NTCmmu_0359
  gRNA
cuccgacgacuacgcaagga

SEQ ID NO: 66765 - RNA, 20 nt, Artificial Sequence
  MKO10066765_A_NTCmmu_0360
  gRNA
uaucucuggaugccgucggu

SEQ ID NO: 66766 - RNA, 20 nt, Artificial Sequence
  MKO10066766_A_NTCmmu_0361
  gRNA
uuucaguugucgcgcgacuc

SEQ ID NO: 66767 - RNA, 20 nt, Artificial Sequence
  MKO10066767_A_NTCmmu_0362
  gRNA
aguuuacgugguccgauguc

SEQ ID NO: 66768 - RNA, 20 nt, Artificial Sequence
  MKO10066768_A_NTCmmu_0363
  gRNA
gcgugacgcgaucaaacggu

SEQ ID NO: 66769 - RNA, 20 nt, Artificial Sequence
  MKO10066769_A_NTCmmu_0364
  gRNA
acuagcuccauaacguguac

SEQ ID NO: 66770 - RNA, 20 nt, Artificial Sequence
  MKO10066770_A_NTCmmu_0365
  gRNA
cgcauaguguaccguugcgc

SEQ ID NO: 66771 - RNA, 20 nt, Artificial Sequence
  MKO10066771_A_NTCmmu_0366
  gRNA
ccgcuugggcgcuauuaauu

SEQ ID NO: 66772 - RNA, 20 nt, Artificial Sequence
  MKO10066772_A_NTCmmu_0367
  gRNA
gcuucauuauuaaccggcgu

SEQ ID NO: 66773 - RNA, 20 nt, Artificial Sequence
  MKO10066773_A_NTCmmu_0368
  gRNA
uauacucgccugucacagcg

SEQ ID NO: 66774 - RNA, 20 nt, Artificial Sequence
  MKO10066774_A_NTCmmu_0369
  gRNA
acgcuguucguaaccgcggg

SEQ ID NO: 66775 - RNA, 20 nt, Artificial Sequence
  MKO10066775_A_NTCmmu_0370
  gRNA
agacguugauuuaccggcca

SEQ ID NO: 66776 - RNA, 20 nt, Artificial Sequence
  MKO10066776_A_NTCmmu_0371
  gRNA
aacggucaaauccgugaggg

SEQ ID NO: 66777 - RNA, 20 nt, Artificial Sequence
  MKO10066777_A_NTCmmu_0372
  gRNA
cauagcaacgcccaaacucg

SEQ ID NO: 66778 - RNA, 20 nt, Artificial Sequence
  MKO10066778_A_NTCmmu_0373
  gRNA
cgucaauguguccggacggu

SEQ ID NO: 66779 - RNA, 20 nt, Artificial Sequence
  MKO10066779_A_NTCmmu_0374
  gRNA
acugucccauuguacgacgg

SEQ ID NO: 66780 - RNA, 20 nt, Artificial Sequence
  MKO10066780_A_NTCmmu_0375
  gRNA
cuaucggcccgcagugaugg

SEQ ID NO: 66781 - RNA, 20 nt, Artificial Sequence
  MKO10066781_A_NTCmmu_0376
  gRNA
gaucgagugacacccacccg

SEQ ID NO: 66782 - RNA, 20 nt, Artificial Sequence
  MKO10066782_A_NTCmmu_0377
  gRNA
uccgcggcaacguuuggguc

SEQ ID NO: 66783 - RNA, 20 nt, Artificial Sequence
  MKO10066783_A_NTCmmu_0378
  gRNA
acuuguauacgacggcuaga

SEQ ID NO: 66784 - RNA, 20 nt, Artificial Sequence
  MKO10066784_A_NTCmmu_0379
  gRNA
uucgacugcgcacgccauga

SEQ ID NO: 66785 - RNA, 20 nt, Artificial Sequence
  MKO10066785_A_NTCmmu_0380
  gRNA
agcauggagucaacguccgc

SEQ ID NO: 66786 - RNA, 20 nt, Artificial Sequence
  MKO10066786_A_NTCmmu_0381
  gRNA
ugacuugacacguucgauau

SEQ ID NO: 66787 - RNA, 20 nt, Artificial Sequence
  MKO10066787_A_NTCmmu_0382
  gRNA
ccggacuuguuauacuugau

SEQ ID NO: 66788 - RNA, 20 nt, Artificial Sequence
  MKO10066788_A_NTCmmu_0383
  gRNA
guaccaugauaaccguacua

SEQ ID NO: 66789 - RNA, 20 nt, Artificial Sequence
  MKO10066789_A_NTCmmu_0384
  gRNA
caccgcugcccuaguaccgg

SEQ ID NO: 66790 - RNA, 20 nt, Artificial Sequence
  MKO10066790_A_NTCmmu_0385
  gRNA
ggauauucgcgcggucuuca

SEQ ID NO: 66791 - RNA, 20 nt, Artificial Sequence
  MKO10066791_A_NTCmmu_0386
  gRNA
aggcagcccgcguuagagau

SEQ ID NO: 66792 - RNA, 20 nt, Artificial Sequence
  MKO10066792_A_NTCmmu_0387
  gRNA
uucuccauaccguaacuccg

SEQ ID NO: 66793 - RNA, 20 nt, Artificial Sequence
  MKO10066793_A_NTCmmu_0388
  gRNA
acccgcauaugccgccuaag

SEQ ID NO: 66794 - RNA, 20 nt, Artificial Sequence
  MKO10066794_A_NTCmmu_0389
  gRNA
cgaaguacacgguucucucg

SEQ ID NO: 66795 - RNA, 20 nt, Artificial Sequence
  MKO10066795_A_NTCmmu_0390
  gRNA
cacaauacgcggcagagguc

SEQ ID NO: 66796 - RNA, 20 nt, Artificial Sequence
  MKO10066796_A_NTCmmu_0391
  gRNA
ugagaccaaugccgcggaau

SEQ ID NO: 66797 - RNA, 20 nt, Artificial Sequence
  MKO10066797_A_NTCmmu_0392
  gRNA
cucgacccaguaguagacgg

SEQ ID NO: 66798 - RNA, 20 nt, Artificial Sequence
  MKO10066798_A_NTCmmu_0393
  gRNA
cguaccgacaguaguccaag

SEQ ID NO: 66799 - RNA, 20 nt, Artificial Sequence
  MKO10066799_A_NTCmmu_0394
  gRNA
aauugucugaucgcgccaua

SEQ ID NO: 66800 - RNA, 20 nt, Artificial Sequence
  MKO10066800_A_NTCmmu_0395
  gRNA
uuuagucagacgagccggau

SEQ ID NO: 66801 - RNA, 20 nt, Artificial Sequence
  MKO10066801_A_NTCmmu_0396
  gRNA
ugcgcguccuguuaugaccg

SEQ ID NO: 66802 - RNA, 20 nt, Artificial Sequence
  MKO10066802_A_NTCmmu_0397
  gRNA
cuuaucgauuuggguucaac

SEQ ID NO: 66803 - RNA, 20 nt, Artificial Sequence
  MKO10066803_A_NTCmmu_0398
  gRNA
aacauguuaagucgcguuau

SEQ ID NO: 66804 - RNA, 20 nt, Artificial Sequence
  MKO10066804_A_NTCmmu_0399
  gRNA
uacgacaucgcaugguaacg

SEQ ID NO: 66805 - RNA, 20 nt, Artificial Sequence
  MKO10066805_A_NTCmmu_0400
  gRNA
cagcugaccguuaaucgaua

SEQ ID NO: 66806 - RNA, 20 nt, Artificial Sequence
  MKO10066806_A_NTCmmu_0401
  gRNA
uacacgcccuaagcuaguaa

SEQ ID NO: 66807 - RNA, 20 nt, Artificial Sequence
  MKO10066807_A_NTCmmu_0402
  gRNA
ccgacugccgagcuaggcgu

SEQ ID NO: 66808 - RNA, 20 nt, Artificial Sequence
  MKO10066808_A_NTCmmu_0403
  gRNA
guugcggcgaccuagauauc

SEQ ID NO: 66809 - RNA, 20 nt, Artificial Sequence
  MKO10066809_A_NTCmmu_0404
  gRNA
uagacguccaccgacucuga

SEQ ID NO: 66810 - RNA, 20 nt, Artificial Sequence
  MKO10066810_A_NTCmmu_0405
  gRNA
ucacgcacgacuaagggaau

SEQ ID NO: 66811 - RNA, 20 nt, Artificial Sequence
  MKO10066811_A_NTCmmu_0406
  gRNA
gcuuaucguuccgcuacgau

SEQ ID NO: 66812 - RNA, 20 nt, Artificial Sequence
  MKO10066812_A_NTCmmu_0407
  gRNA
accgguucagccgccggaac

SEQ ID NO: 66813 - RNA, 20 nt, Artificial Sequence
  MKO10066813_A_NTCmmu_0408
  gRNA
cuacccgucuauuacgaucu

SEQ ID NO: 66814 - RNA, 20 nt, Artificial Sequence
  MKO10066814_A_NTCmmu_0409
  gRNA
ugucgccgauggucagucgc

SEQ ID NO: 66815 - RNA, 20 nt, Artificial Sequence
  MKO10066815_A_NTCmmu_0410
  gRNA
cgggcgguaagagcucuacg

SEQ ID NO: 66816 - RNA, 20 nt, Artificial Sequence
  MKO10066816_A_NTCmmu_0411
  gRNA
ggcaccguucggaaaccgac

SEQ ID NO: 66817 - RNA, 20 nt, Artificial Sequence
  MKO10066817_A_NTCmmu_0412
  gRNA
ucucgaauaaauuuucucgc

SEQ ID NO: 66818 - RNA, 20 nt, Artificial Sequence
  MKO10066818_A_NTCmmu_0413
  gRNA
gcauucuugagcuccgcgcc

SEQ ID NO: 66819 - RNA, 20 nt, Artificial Sequence
  MKO10066819_A_NTCmmu_0414
  gRNA
auucggaccguuaucucacc

SEQ ID NO: 66820 - RNA, 20 nt, Artificial Sequence
  MKO10066820_A_NTCmmu_0415
  gRNA
guucuucaaagacgggcggc

SEQ ID NO: 66821 - RNA, 20 nt, Artificial Sequence
  MKO10066821_A_NTCmmu_0416
  gRNA
uuccccgcccgugcggucau

SEQ ID NO: 66822 - RNA, 20 nt, Artificial Sequence
  MKO10066822_A_NTCmmu_0417
  gRNA
uaguagguugaucgcgucgc

SEQ ID NO: 66823 - RNA, 20 nt, Artificial Sequence
  MKO10066823_A_NTCmmu_0418
  gRNA
cgcucggugacguauacacg

SEQ ID NO: 66824 - RNA, 20 nt, Artificial Sequence
  MKO10066824_A_NTCmmu_0419
  gRNA
auuauagcagccccccgaau

SEQ ID NO: 66825 - RNA, 20 nt, Artificial Sequence
  MKO10066825_A_NTCmmu_0420
  gRNA
cggucagucgucuucccgga

SEQ ID NO: 66826 - RNA, 20 nt, Artificial Sequence
  MKO10066826_A_NTCmmu_0421
  gRNA
uggauccgcuucgcacggcg

SEQ ID NO: 66827 - RNA, 20 nt, Artificial Sequence
  MKO10066827_A_NTCmmu_0422
  gRNA
aaacccccgcgcggagcguc

SEQ ID NO: 66828 - RNA, 20 nt, Artificial Sequence
  MKO10066828_A_NTCmmu_0423
  gRNA
cauagauccgcgauuguacg

SEQ ID NO: 66829 - RNA, 20 nt, Artificial Sequence
  MKO10066829_A_NTCmmu_0424
  gRNA
guuucaggaacgacggcgag

SEQ ID NO: 66830 - RNA, 20 nt, Artificial Sequence
  MKO10066830_A_NTCmmu_0425
  gRNA
accgucucuauuauacggca

SEQ ID NO: 66831 - RNA, 20 nt, Artificial Sequence
  MKO10066831_A_NTCmmu_0426
  gRNA
uguucgcccucucacgauug

SEQ ID NO: 66832 - RNA, 20 nt, Artificial Sequence
  MKO10066832_A_NTCmmu_0427
  gRNA
aacuaacucacuacgcacga

SEQ ID NO: 66833 - RNA, 20 nt, Artificial Sequence
  MKO10066833_A_NTCmmu_0428
  gRNA
ucgcuccgcuaguagugggu

SEQ ID NO: 66834 - RNA, 20 nt, Artificial Sequence
  MKO10066834_A_NTCmmu_0429
  gRNA
ucggcgcagccuaauguaua

SEQ ID NO: 66835 - RNA, 20 nt, Artificial Sequence
  MKO10066835_A_NTCmmu_0430
  gRNA
caaccugccuagcgacccgc

SEQ ID NO: 66836 - RNA, 20 nt, Artificial Sequence
  MKO10066836_A_NTCmmu_0431
  gRNA
gucggcucaucggaaaauau

SEQ ID NO: 66837 - RNA, 20 nt, Artificial Sequence
  MKO10066837_A_NTCmmu_0432
  gRNA
gacaguugacgcgacggaga

SEQ ID NO: 66838 - RNA, 20 nt, Artificial Sequence
  MKO10066838_A_NTCmmu_0433
  gRNA
cccugaugugcuauacgcgc

SEQ ID NO: 66839 - RNA, 20 nt, Artificial Sequence
  MKO10066839_A_NTCmmu_0434
  gRNA
uaacccuugaucaaccgaua

SEQ ID NO: 66840 - RNA, 20 nt, Artificial Sequence
  MKO10066840_A_NTCmmu_0435
  gRNA
cuauugggagcggccucucg

SEQ ID NO: 66841 - RNA, 20 nt, Artificial Sequence
  MKO10066841_A_NTCmmu_0436
  gRNA
gcuuaucgucaugcggguga

SEQ ID NO: 66842 - RNA, 20 nt, Artificial Sequence
  MKO10066842_A_NTCmmu_0437
  gRNA
ugaugccgguacccguaacu

SEQ ID NO: 66843 - RNA, 20 nt, Artificial Sequence
  MKO10066843_A_NTCmmu_0438
  gRNA
ggcgcuacuguaaugacggu

SEQ ID NO: 66844 - RNA, 20 nt, Artificial Sequence
  MKO10066844_A_NTCmmu_0439
  gRNA
acggauugcugacgcuauca

SEQ ID NO: 66845 - RNA, 20 nt, Artificial Sequence
  MKO10066845_A_NTCmmu_0440
  gRNA
uaaugcgaaugcgaccucuc

SEQ ID NO: 66846 - RNA, 20 nt, Artificial Sequence
  MKO10066846_A_NTCmmu_0441
  gRNA
uuaacuggggggaccggacg

SEQ ID NO: 66847 - RNA, 20 nt, Artificial Sequence
  MKO10066847_A_NTCmmu_0442
  gRNA
cgcagaguucaaauccgcgc

SEQ ID NO: 66848 - RNA, 20 nt, Artificial Sequence
  MKO10066848_A_NTCmmu_0443
  gRNA
uguuuaugcggaacuuccgc

SEQ ID NO: 66849 - RNA, 20 nt, Artificial Sequence
  MKO10066849_A_NTCmmu_0444
  gRNA
acagaccgaauaaccgacga

SEQ ID NO: 66850 - RNA, 20 nt, Artificial Sequence
  MKO10066850_A_NTCmmu_0445
  gRNA
ugacgcuaaggcccgcuaac

SEQ ID NO: 66851 - RNA, 20 nt, Artificial Sequence
  MKO10066851_A_NTCmmu_0446
  gRNA
acucgcgaaaccguacauga

SEQ ID NO: 66852 - RNA, 20 nt, Artificial Sequence
  MKO10066852_A_NTCmmu_0447
  gRNA
auaggcgcacgggcuacucc

SEQ ID NO: 66853 - RNA, 20 nt, Artificial Sequence
  MKO10066853_A_NTCmmu_0448
  gRNA
agauucucgcguaaccagag

SEQ ID NO: 66854 - RNA, 20 nt, Artificial Sequence
  MKO10066854_A_NTCmmu_0449
  gRNA
acaauucgguuuaugcgcgu

SEQ ID NO: 66855 - RNA, 20 nt, Artificial Sequence
  MKO10066855_A_NTCmmu_0450
  gRNA
cggguuauagauagucgucg

SEQ ID NO: 66856 - RNA, 20 nt, Artificial Sequence
  MKO10066856_A_NTCmmu_0451
  gRNA
aggguuaggcugacccgcga

SEQ ID NO: 66857 - RNA, 20 nt, Artificial Sequence
  MKO10066857_A_NTCmmu_0452
  gRNA
agcuauccccacguucgcgg

SEQ ID NO: 66858 - RNA, 20 nt, Artificial Sequence
  MKO10066858_A_NTCmmu_0453
  gRNA
aucaugccuucgcauuaacc

SEQ ID NO: 66859 - RNA, 20 nt, Artificial Sequence
  MKO10066859_A_NTCmmu_0454
  gRNA
uggguccuaaacgcgguuca

SEQ ID NO: 66860 - RNA, 20 nt, Artificial Sequence
  MKO10066860_A_NTCmmu_0455
  gRNA
cauacuguuaucgacccgca

SEQ ID NO: 66861 - RNA, 20 nt, Artificial Sequence
  MKO10066861_A_NTCmmu_0456
  gRNA
ugagcgcuuucccgauccgg

SEQ ID NO: 66862 - RNA, 20 nt, Artificial Sequence
  MKO10066862_A_NTCmmu_0457
  gRNA
gccuuccucgcagacccgac

SEQ ID NO: 66863 - RNA, 20 nt, Artificial Sequence
  MKO10066863_A_NTCmmu_0458
  gRNA
cccuuaaagugacggacgaa

SEQ ID NO: 66864 - RNA, 20 nt, Artificial Sequence
  MKO10066864_A_NTCmmu_0459
  gRNA
ugguucgaccaacaugguuc

SEQ ID NO: 66865 - RNA, 20 nt, Artificial Sequence
  MKO10066865_A_NTCmmu_0460
  gRNA
ugggccauaguggcgcguga

SEQ ID NO: 66866 - RNA, 20 nt, Artificial Sequence
  MKO10066866_A_NTCmmu_0461
  gRNA
ucauauuagacaaucuccgc

SEQ ID NO: 66867 - RNA, 20 nt, Artificial Sequence
  MKO10066867_A_NTCmmu_0462
  gRNA
uagccgaguucacgccagua

SEQ ID NO: 66868 - RNA, 20 nt, Artificial Sequence
  MKO10066868_A_NTCmmu_0463
  gRNA
accaggcgcggaccgcacau

SEQ ID NO: 66869 - RNA, 20 nt, Artificial Sequence
  MKO10066869_A_NTCmmu_0464
  gRNA
gcgcgagugccaaacgagug

SEQ ID NO: 66870 - RNA, 20 nt, Artificial Sequence
  MKO10066870_A_NTCmmu_0465
  gRNA
aacggcugcgcccgcggcaa

SEQ ID NO: 66871 - RNA, 20 nt, Artificial Sequence
  MKO10066871_A_NTCmmu_0466
  gRNA
acggucgagcacgguuauga

SEQ ID NO: 66872 - RNA, 20 nt, Artificial Sequence
  MKO10066872_A_NTCmmu_0467
  gRNA
ucauguugcgucguccguua

SEQ ID NO: 66873 - RNA, 20 nt, Artificial Sequence
  MKO10066873_A_NTCmmu_0468
  gRNA
cgcuccguauccucucauaa

SEQ ID NO: 66874 - RNA, 20 nt, Artificial Sequence
  MKO10066874_A_NTCmmu_0469
  gRNA
aaacgaggcuguucguacac

SEQ ID NO: 66875 - RNA, 20 nt, Artificial Sequence
  MKO10066875_A_NTCmmu_0470
  gRNA
cacguauacuuaggucagcg

SEQ ID NO: 66876 - RNA, 20 nt, Artificial Sequence
  MKO10066876_A_NTCmmu_0471
  gRNA
aucgagcaccgaguugugau

SEQ ID NO: 66877 - RNA, 20 nt, Artificial Sequence
  MKO10066877_A_NTCmmu_0472
  gRNA
ucacuuuaagcaccccgcgc

SEQ ID NO: 66878 - RNA, 20 nt, Artificial Sequence
  MKO10066878_A_NTCmmu_0473
  gRNA
cuacuugugacgaccucgcg

SEQ ID NO: 66879 - RNA, 20 nt, Artificial Sequence
  MKO10066879_A_NTCmmu_0474
  gRNA
cuacggauaggcgcggguga

SEQ ID NO: 66880 - RNA, 20 nt, Artificial Sequence
  MKO10066880_A_NTCmmu_0475
  gRNA
gcuuaccuacuccgccccgc

SEQ ID NO: 66881 - RNA, 20 nt, Artificial Sequence
  MKO10066881_A_NTCmmu_0476
  gRNA
uaacacgcacucacguccgg

SEQ ID NO: 66882 - RNA, 20 nt, Artificial Sequence
  MKO10066882_A_NTCmmu_0477
  gRNA
acucaccucgcacgaucgua

SEQ ID NO: 66883 - RNA, 20 nt, Artificial Sequence
  MKO10066883_A_NTCmmu_0478
  gRNA
acacccguguaugcaccggg

SEQ ID NO: 66884 - RNA, 20 nt, Artificial Sequence
  MKO10066884_A_NTCmmu_0479
  gRNA
gcauaacggccgagcaccac

SEQ ID NO: 66885 - RNA, 20 nt, Artificial Sequence
  MKO10066885_A_NTCmmu_0480
  gRNA
ccagcggacggcgaacucca

SEQ ID NO: 66886 - RNA, 20 nt, Artificial Sequence
  MKO10066886_A_NTCmmu_0481
  gRNA
ugacccucuuaaucuccggu

SEQ ID NO: 66887 - RNA, 20 nt, Artificial Sequence
  MKO10066887_A_NTCmmu_0482
  gRNA
cccuaaaccauaguuucgcc

SEQ ID NO: 66888 - RNA, 20 nt, Artificial Sequence
  MKO10066888_A_NTCmmu_0483
  gRNA
cccuagcucgguuagagaau

SEQ ID NO: 66889 - RNA, 20 nt, Artificial Sequence
  MKO10066889_A_NTCmmu_0484
  gRNA
gaauugagccgcaacucggc

SEQ ID NO: 66890 - RNA, 20 nt, Artificial Sequence
  MKO10066890_A_NTCmmu_0485
  gRNA
ugcuuagggcccuucggcgg

SEQ ID NO: 66891 - RNA, 20 nt, Artificial Sequence
  MKO10066891_A_NTCmmu_0486
  gRNA
ucuccgggccguguuagacc

SEQ ID NO: 66892 - RNA, 20 nt, Artificial Sequence
  MKO10066892_A_NTCmmu_0487
  gRNA
aucacacguuaaacggggcg

SEQ ID NO: 66893 - RNA, 20 nt, Artificial Sequence
  MKO10066893_A_NTCmmu_0488
  gRNA
gauccccuacgcuucaaccu

SEQ ID NO: 66894 - RNA, 20 nt, Artificial Sequence
  MKO10066894_A_NTCmmu_0489
  gRNA
uuauuuacgcgcugaacuug

SEQ ID NO: 66895 - RNA, 20 nt, Artificial Sequence
  MKO10066895_A_NTCmmu_0490
  gRNA
accguuguuuccgucgaaac

SEQ ID NO: 66896 - RNA, 20 nt, Artificial Sequence
  MKO10066896_A_NTCmmu_0491
  gRNA
cgagacgaauccaucaugcg

SEQ ID NO: 66897 - RNA, 20 nt, Artificial Sequence
  MKO10066897_A_NTCmmu_0492
  gRNA
auaugcucgacccaucgucc

SEQ ID NO: 66898 - RNA, 20 nt, Artificial Sequence
  MKO10066898_A_NTCmmu_0493
  gRNA
aaccucgucucauguacgaa

SEQ ID NO: 66899 - RNA, 20 nt, Artificial Sequence
  MKO10066899_A_NTCmmu_0494
  gRNA
aauuuuuucggaaucuagcg

SEQ ID NO: 66900 - RNA, 20 nt, Artificial Sequence
  MKO10066900_A_NTCmmu_0495
  gRNA
agcgaguguccgugacguuc

SEQ ID NO: 66901 - RNA, 20 nt, Artificial Sequence
  MKO10066901_A_NTCmmu_0496
  gRNA
aacgucaccaaccucgaucc

SEQ ID NO: 66902 - RNA, 20 nt, Artificial Sequence
  MKO10066902_A_NTCmmu_0497
  gRNA
guccuagauccuaucgggag

SEQ ID NO: 66903 - RNA, 20 nt, Artificial Sequence
  MKO10066903_A_NTCmmu_0498
  gRNA
cauauacucuugcgcuagac

SEQ ID NO: 66904 - RNA, 20 nt, Artificial Sequence
  MKO10066904_A_NTCmmu_0499
  gRNA
acgucgaugcuuauccgucu

SEQ ID NO: 66905 - RNA, 20 nt, Artificial Sequence
  MKO10066905_A_NTCmmu_0500
  gRNA
ccgcgcauuaacgaucagua

SEQ ID NO: 66906 - RNA, 20 nt, Artificial Sequence
  MKO10066906_A_NTCmmu_0501
  gRNA
ccuauuaguccgguuuaguc

SEQ ID NO: 66907 - RNA, 20 nt, Artificial Sequence
  MKO10066907_A_NTCmmu_0502
  gRNA
accucgugcaaaucgguggc

SEQ ID NO: 66908 - RNA, 20 nt, Artificial Sequence
  MKO10066908_A_NTCmmu_0503
  gRNA
cacgcaggagcggcgacacu

SEQ ID NO: 66909 - RNA, 20 nt, Artificial Sequence
  MKO10066909_A_NTCmmu_0504
  gRNA
gucggccgcuuaacccuuuc

SEQ ID NO: 66910 - RNA, 20 nt, Artificial Sequence
  MKO10066910_A_NTCmmu_0505
  gRNA
ugaucaacgucgguggacgg

SEQ ID NO: 66911 - RNA, 20 nt, Artificial Sequence
  MKO10066911_A_NTCmmu_0506
  gRNA
gaaccacgagcgagcguaua

SEQ ID NO: 66912 - RNA, 20 nt, Artificial Sequence
  MKO10066912_A_NTCmmu_0507
  gRNA
gaacccgggaaacacguccg

SEQ ID NO: 66913 - RNA, 20 nt, Artificial Sequence
  MKO10066913_A_NTCmmu_0508
  gRNA
ggaaacguuacauucgacgc

SEQ ID NO: 66914 - RNA, 20 nt, Artificial Sequence
  MKO10066914_A_NTCmmu_0509
  gRNA
aauaggaacuccgcacccga

SEQ ID NO: 66915 - RNA, 20 nt, Artificial Sequence
  MKO10066915_A_NTCmmu_0510
  gRNA
guagugcgugugaugucggg

SEQ ID NO: 66916 - RNA, 20 nt, Artificial Sequence
  MKO10066916_A_NTCmmu_0511
  gRNA
uuugacauuuucgucucgcg

SEQ ID NO: 66917 - RNA, 20 nt, Artificial Sequence
  MKO10066917_A_NTCmmu_0512
  gRNA
agguccgcuggcgcaauggg

SEQ ID NO: 66918 - RNA, 20 nt, Artificial Sequence
  MKO10066918_A_NTCmmu_0513
  gRNA
ccgcccgggugugaguugag

SEQ ID NO: 66919 - RNA, 20 nt, Artificial Sequence
  MKO10066919_A_NTCmmu_0514
  gRNA
gccgagaggcguaagcgcga

SEQ ID NO: 66920 - RNA, 20 nt, Artificial Sequence
  MKO10066920_A_NTCmmu_0515
  gRNA
uaauucgcaacucggaucau

SEQ ID NO: 66921 - RNA, 20 nt, Artificial Sequence
  MKO10066921_A_NTCmmu_0516
  gRNA
uaagacugggugucccgcgu

SEQ ID NO: 66922 - RNA, 20 nt, Artificial Sequence
  MKO10066922_A_NTCmmu_0517
  gRNA
uuacgcaaagcugcgaugag

SEQ ID NO: 66923 - RNA, 20 nt, Artificial Sequence
  MKO10066923_A_NTCmmu_0518
  gRNA
ggacacucgccgaccccacu

SEQ ID NO: 66924 - RNA, 20 nt, Artificial Sequence
  MKO10066924_A_NTCmmu_0519
  gRNA
uacgucugcgcaaauagaau

SEQ ID NO: 66925 - RNA, 20 nt, Artificial Sequence
  MKO10066925_A_NTCmmu_0520
  gRNA
auacgcgugaugaccuuaug

SEQ ID NO: 66926 - RNA, 20 nt, Artificial Sequence
  MKO10066926_A_NTCmmu_0521
  gRNA
cgcgcgacugcagcuaaucu

SEQ ID NO: 66927 - RNA, 20 nt, Artificial Sequence
  MKO10066927_A_NTCmmu_0522
  gRNA
acuucccgcgguuccguuga

SEQ ID NO: 66928 - RNA, 20 nt, Artificial Sequence
  MKO10066928_A_NTCmmu_0523
  gRNA
uuaugaccucgaugcgacau

SEQ ID NO: 66929 - RNA, 20 nt, Artificial Sequence
  MKO10066929_A_NTCmmu_0524
  gRNA
ugacgcgccucggaccaacc

SEQ ID NO: 66930 - RNA, 20 nt, Artificial Sequence
  MKO10066930_A_NTCmmu_0525
  gRNA
uaucccgauccggaaacuag

SEQ ID NO: 66931 - RNA, 20 nt, Artificial Sequence
  MKO10066931_A_NTCmmu_0526
  gRNA
aguacacuacaucgacuucg

SEQ ID NO: 66932 - RNA, 20 nt, Artificial Sequence
  MKO10066932_A_NTCmmu_0527
  gRNA
uuccaguauaccgaauucgc

SEQ ID NO: 66933 - RNA, 20 nt, Artificial Sequence
  MKO10066933_A_NTCmmu_0528
  gRNA
cccggcagacuaacuagcgc

SEQ ID NO: 66934 - RNA, 20 nt, Artificial Sequence
  MKO10066934_A_NTCmmu_0529
  gRNA
gcaacggacagucaucgaac

SEQ ID NO: 66935 - RNA, 20 nt, Artificial Sequence
  MKO10066935_A_NTCmmu_0530
  gRNA
gcuagcguucagcccgaugu

SEQ ID NO: 66936 - RNA, 20 nt, Artificial Sequence
  MKO10066936_A_NTCmmu_0531
  gRNA
uaugaacuaggcguaaacgg

SEQ ID NO: 66937 - RNA, 20 nt, Artificial Sequence
  MKO10066937_A_NTCmmu_0532
  gRNA
cgcgcggauauuuaaacuuc

SEQ ID NO: 66938 - RNA, 20 nt, Artificial Sequence
  MKO10066938_A_NTCmmu_0533
  gRNA
aagcagcgacuacucgacgc

SEQ ID NO: 66939 - RNA, 20 nt, Artificial Sequence
  MKO10066939_A_NTCmmu_0534
  gRNA
ccccuauaggcgcgcuaagg

SEQ ID NO: 66940 - RNA, 20 nt, Artificial Sequence
  MKO10066940_A_NTCmmu_0535
  gRNA
ccgagauggcucggauagac

SEQ ID NO: 66941 - RNA, 20 nt, Artificial Sequence
  MKO10066941_A_NTCmmu_0536
  gRNA
agcacgcgcacaagagccgc

SEQ ID NO: 66942 - RNA, 20 nt, Artificial Sequence
  MKO10066942_A_NTCmmu_0537
  gRNA
ucguaaagucgcagcgacgu

SEQ ID NO: 66943 - RNA, 20 nt, Artificial Sequence
  MKO10066943_A_NTCmmu_0538
  gRNA
gucuaacaucggcgcacgug

SEQ ID NO: 66944 - RNA, 20 nt, Artificial Sequence
  MKO10066944_A_NTCmmu_0539
  gRNA
uucaacgacggaagacgcgc

SEQ ID NO: 66945 - RNA, 20 nt, Artificial Sequence
  MKO10066945_A_NTCmmu_0540
  gRNA
cgcucgguaaggucgauugg

SEQ ID NO: 66946 - RNA, 20 nt, Artificial Sequence
  MKO10066946_A_NTCmmu_0541
  gRNA
uaggggugcgcauuagacua

SEQ ID NO: 66947 - RNA, 20 nt, Artificial Sequence
  MKO10066947_A_NTCmmu_0542
  gRNA
gcccgaccuccacguaaauc

SEQ ID NO: 66948 - RNA, 20 nt, Artificial Sequence
  MKO10066948_A_NTCmmu_0543
  gRNA
uaugaaacaucucggcgacg

SEQ ID NO: 66949 - RNA, 20 nt, Artificial Sequence
  MKO10066949_A_NTCmmu_0544
  gRNA
cugcuugaacgccuagacgg

SEQ ID NO: 66950 - RNA, 20 nt, Artificial Sequence
  MKO10066950_A_NTCmmu_0545
  gRNA
gggccggcacucugucggac

SEQ ID NO: 66951 - RNA, 20 nt, Artificial Sequence
  MKO10066951_A_NTCmmu_0546
  gRNA
gccgaccaacgaugaccacg

SEQ ID NO: 66952 - RNA, 20 nt, Artificial Sequence
  MKO10066952_A_NTCmmu_0547
  gRNA
aucgcggcgcguuaaggcag

SEQ ID NO: 66953 - RNA, 20 nt, Artificial Sequence
  MKO10066953_A_NTCmmu_0548
  gRNA
cgacgguugugcugaggcuu

SEQ ID NO: 66954 - RNA, 20 nt, Artificial Sequence
  MKO10066954_A_NTCmmu_0549
  gRNA
cggauccucccguacuaucc

SEQ ID NO: 66955 - RNA, 20 nt, Artificial Sequence
  MKO10066955_A_NTCmmu_0550
  gRNA
ccauuaguacgaacauugcg

SEQ ID NO: 66956 - RNA, 20 nt, Artificial Sequence
  MKO10066956_A_NTCmmu_0551
  gRNA
gcucauacugaugaacgucc

SEQ ID NO: 66957 - RNA, 20 nt, Artificial Sequence
  MKO10066957_A_NTCmmu_0552
  gRNA
gccgaaucgcguuauuccaa

SEQ ID NO: 66958 - RNA, 20 nt, Artificial Sequence
  MKO10066958_A_NTCmmu_0553
  gRNA
caaggaucgugccgugauuu

SEQ ID NO: 66959 - RNA, 20 nt, Artificial Sequence
  MKO10066959_A_NTCmmu_0554
  gRNA
guuaauauuguggcccgcac

SEQ ID NO: 66960 - RNA, 20 nt, Artificial Sequence
  MKO10066960_A_NTCmmu_0555
  gRNA
ccaacccggcaucguccgcu

SEQ ID NO: 66961 - RNA, 20 nt, Artificial Sequence
  MKO10066961_A_NTCmmu_0556
  gRNA
gcgagcgcuaucccggugga

SEQ ID NO: 66962 - RNA, 20 nt, Artificial Sequence
  MKO10066962_A_NTCmmu_0557
  gRNA
guguaugacgagaagcgaag

SEQ ID NO: 66963 - RNA, 20 nt, Artificial Sequence
  MKO10066963_A_NTCmmu_0558
  gRNA
gguguggaccgcuuuuacgc

SEQ ID NO: 66964 - RNA, 20 nt, Artificial Sequence
  MKO10066964_A_NTCmmu_0559
  gRNA
guuauaccaccuacuaugac

SEQ ID NO: 66965 - RNA, 20 nt, Artificial Sequence
  MKO10066965_A_NTCmmu_0560
  gRNA
gauacgugagguugccggug

SEQ ID NO: 66966 - RNA, 20 nt, Artificial Sequence
  MKO10066966_A_NTCmmu_0561
  gRNA
uaugccauaugcccguuuuu

SEQ ID NO: 66967 - RNA, 20 nt, Artificial Sequence
  MKO10066967_A_NTCmmu_0562
  gRNA
ucaucuacgguaucgaaagg

SEQ ID NO: 66968 - RNA, 20 nt, Artificial Sequence
  MKO10066968_A_NTCmmu_0563
  gRNA
agugucacggcaaagucgag

SEQ ID NO: 66969 - RNA, 20 nt, Artificial Sequence
  MKO10066969_A_NTCmmu_0564
  gRNA
caauggcgucugccguucag

SEQ ID NO: 66970 - RNA, 20 nt, Artificial Sequence
  MKO10066970_A_NTCmmu_0565
  gRNA
gcucgcugauguguaauccg

SEQ ID NO: 66971 - RNA, 20 nt, Artificial Sequence
  MKO10066971_A_NTCmmu_0566
  gRNA
ggauacaucggcgcgcuagu

SEQ ID NO: 66972 - RNA, 20 nt, Artificial Sequence
  MKO10066972_A_NTCmmu_0567
  gRNA
cagcaccacgcgucgugcgg

SEQ ID NO: 66973 - RNA, 20 nt, Artificial Sequence
  MKO10066973_A_NTCmmu_0568
  gRNA
cgaugucgaaagucggucaa

SEQ ID NO: 66974 - RNA, 20 nt, Artificial Sequence
  MKO10066974_A_NTCmmu_0569
  gRNA
cgauacgcuauagaauaguc

SEQ ID NO: 66975 - RNA, 20 nt, Artificial Sequence
  MKO10066975_A_NTCmmu_0570
  gRNA
gcguggaguucgucgcucuu

SEQ ID NO: 66976 - RNA, 20 nt, Artificial Sequence
  MKO10066976_A_NTCmmu_0571
  gRNA
cacaacgccuaccagcggac

SEQ ID NO: 66977 - RNA, 20 nt, Artificial Sequence
  MKO10066977_A_NTCmmu_0572
  gRNA
auuugcccguccauacgcgg

SEQ ID NO: 66978 - RNA, 20 nt, Artificial Sequence
  MKO10066978_A_NTCmmu_0573
  gRNA
cgguaagaugguuauaccgu

SEQ ID NO: 66979 - RNA, 20 nt, Artificial Sequence
  MKO10066979_A_NTCmmu_0574
  gRNA
guucgcgggggcuucuauca

SEQ ID NO: 66980 - RNA, 20 nt, Artificial Sequence
  MKO10066980_A_NTCmmu_0575
  gRNA
ggcaccgcguuuauugcacu

SEQ ID NO: 66981 - RNA, 20 nt, Artificial Sequence
  MKO10066981_A_NTCmmu_0576
  gRNA
ugacaaccgcgguaccucua

SEQ ID NO: 66982 - RNA, 20 nt, Artificial Sequence
  MKO10066982_A_NTCmmu_0577
  gRNA
ggucgcucgauuucauuuaa

SEQ ID NO: 66983 - RNA, 20 nt, Artificial Sequence
  MKO10066983_A_NTCmmu_0578
  gRNA
gacgaaagguccuacgaagu

SEQ ID NO: 66984 - RNA, 20 nt, Artificial Sequence
  MKO10066984_A_NTCmmu_0579
  gRNA
guaccacuuaucgaccuugc

SEQ ID NO: 66985 - RNA, 20 nt, Artificial Sequence
  MKO10066985_A_NTCmmu_0580
  gRNA
uucaaguguuauggacgcgc

SEQ ID NO: 66986 - RNA, 20 nt, Artificial Sequence
  MKO10066986_A_NTCmmu_0581
  gRNA
ugagagcaaggcgcauacgc

SEQ ID NO: 66987 - RNA, 20 nt, Artificial Sequence
  MKO10066987_A_NTCmmu_0582
  gRNA
cauucucugacgaaugcgcc

SEQ ID NO: 66988 - RNA, 20 nt, Artificial Sequence
  MKO10066988_A_NTCmmu_0583
  gRNA
auccccccgacuuagggauu

SEQ ID NO: 66989 - RNA, 20 nt, Artificial Sequence
  MKO10066989_A_NTCmmu_0584
  gRNA
cagugccgguagcggcacgg

SEQ ID NO: 66990 - RNA, 20 nt, Artificial Sequence
  MKO10066990_A_NTCmmu_0585
  gRNA
acgacguccgcuguguguau

SEQ ID NO: 66991 - RNA, 20 nt, Artificial Sequence
  MKO10066991_A_NTCmmu_0586
  gRNA
gcgcucgaacaaacaugguc

SEQ ID NO: 66992 - RNA, 20 nt, Artificial Sequence
  MKO10066992_A_NTCmmu_0587
  gRNA
ggcaacgcacgcuggguugu

SEQ ID NO: 66993 - RNA, 20 nt, Artificial Sequence
  MKO10066993_A_NTCmmu_0588
  gRNA
gcuauuccgcucgucaauuu

SEQ ID NO: 66994 - RNA, 20 nt, Artificial Sequence
  MKO10066994_A_NTCmmu_0589
  gRNA
uucaucgcagaucgauuucg

SEQ ID NO: 66995 - RNA, 20 nt, Artificial Sequence
  MKO10066995_A_NTCmmu_0590
  gRNA
uucauccuucguagcgcagc

SEQ ID NO: 66996 - RNA, 20 nt, Artificial Sequence
  MKO10066996_A_NTCmmu_0591
  gRNA
ugguucaccacucgagaucg

SEQ ID NO: 66997 - RNA, 20 nt, Artificial Sequence
  MKO10066997_A_NTCmmu_0592
  gRNA
uugagcggaccccccuacaa

SEQ ID NO: 66998 - RNA, 20 nt, Artificial Sequence
  MKO10066998_A_NTCmmu_0593
  gRNA
auguguaugaagcccgucau

SEQ ID NO: 66999 - RNA, 20 nt, Artificial Sequence
  MKO10066999_A_NTCmmu_0594
  gRNA
uagguggcgcccaaucggac

SEQ ID NO: 67000 - RNA, 20 nt, Artificial Sequence
  MKO10067000_A_NTCmmu_0595
  gRNA
cucgugucacuccucgguuc

SEQ ID NO: 67001 - RNA, 20 nt, Artificial Sequence
  MKO10067001_A_NTCmmu_0596
  gRNA
augccaaugccguuguuagc

SEQ ID NO: 67002 - RNA, 20 nt, Artificial Sequence
  MKO10067002_A_NTCmmu_0597
  gRNA
ccuuacggcggagaacgagu

SEQ ID NO: 67003 - RNA, 20 nt, Artificial Sequence
  MKO10067003_A_NTCmmu_0598
  gRNA
cgcgcggaucuuccguacaa

SEQ ID NO: 67004 - RNA, 20 nt, Artificial Sequence
  MKO10067004_A_NTCmmu_0599
  gRNA
cggcaagcgcauuccuaugg

SEQ ID NO: 67005 - RNA, 20 nt, Artificial Sequence
  MKO10067005_A_NTCmmu_0600
  gRNA
uaugaucguauggcccuucc

SEQ ID NO: 67006 - RNA, 20 nt, Artificial Sequence
  MKO10067006_A_NTCmmu_0601
  gRNA
aucgccuagcccaagcgacg

SEQ ID NO: 67007 - RNA, 20 nt, Artificial Sequence
  MKO10067007_A_NTCmmu_0602
  gRNA
gcgaucgccgguauagcuuu

SEQ ID NO: 67008 - RNA, 20 nt, Artificial Sequence
  MKO10067008_A_NTCmmu_0603
  gRNA
ccguucaauuaugcuggcgu

SEQ ID NO: 67009 - RNA, 20 nt, Artificial Sequence
  MKO10067009_A_NTCmmu_0604
  gRNA
ccagcuaacguuuuaguacg

SEQ ID NO: 67010 - RNA, 20 nt, Artificial Sequence
  MKO10067010_A_NTCmmu_0605
  gRNA
uccccuucgucggcgccagg

SEQ ID NO: 67011 - RNA, 20 nt, Artificial Sequence
  MKO10067011_A_NTCmmu_0606
  gRNA
uucugauuagauacguacga

SEQ ID NO: 67012 - RNA, 20 nt, Artificial Sequence
  MKO10067012_A_NTCmmu_0607
  gRNA
uuuucgucgacuaagucaag

SEQ ID NO: 67013 - RNA, 20 nt, Artificial Sequence
  MKO10067013_A_NTCmmu_0608
  gRNA
ucaauuaguggccgccaagc

SEQ ID NO: 67014 - RNA, 20 nt, Artificial Sequence
  MKO10067014_A_NTCmmu_0609
  gRNA
ucagcuacgaucggacccaa

SEQ ID NO: 67015 - RNA, 20 nt, Artificial Sequence
  MKO10067015_A_NTCmmu_0610
  gRNA
gcacgaacccguucguaugg

SEQ ID NO: 67016 - RNA, 20 nt, Artificial Sequence
  MKO10067016_A_NTCmmu_0611
  gRNA
caauaugcacguagccucgu

SEQ ID NO: 67017 - RNA, 20 nt, Artificial Sequence
  MKO10067017_A_NTCmmu_0612
  gRNA
gaccgacgguauacccuacu

SEQ ID NO: 67018 - RNA, 20 nt, Artificial Sequence
  MKO10067018_A_NTCmmu_0613
  gRNA
uugaaguagggucggauuga

SEQ ID NO: 67019 - RNA, 20 nt, Artificial Sequence
  MKO10067019_A_NTCmmu_0614
  gRNA
aaggcguaaacgaguacacg

SEQ ID NO: 67020 - RNA, 20 nt, Artificial Sequence
  MKO10067020_A_NTCmmu_0615
  gRNA
aaugagcuucgaguucgucu

SEQ ID NO: 67021 - RNA, 20 nt, Artificial Sequence
  MKO10067021_A_NTCmmu_0616
  gRNA
acguguucucguacuuagcu

SEQ ID NO: 67022 - RNA, 20 nt, Artificial Sequence
  MKO10067022_A_NTCmmu_0617
  gRNA
uuagccuugccccgucauac

SEQ ID NO: 67023 - RNA, 20 nt, Artificial Sequence
  MKO10067023_A_NTCmmu_0618
  gRNA
gccuuuuccgcccguucaag

SEQ ID NO: 67024 - RNA, 20 nt, Artificial Sequence
  MKO10067024_A_NTCmmu_0619
  gRNA
cagaaacucuuaccgagcgc

SEQ ID NO: 67025 - RNA, 20 nt, Artificial Sequence
  MKO10067025_A_NTCmmu_0620
  gRNA
cuugaaaaaggggcgacuau

SEQ ID NO: 67026 - RNA, 20 nt, Artificial Sequence
  MKO10067026_A_NTCmmu_0621
  gRNA
ccuacuaacgacgagucaaa

SEQ ID NO: 67027 - RNA, 20 nt, Artificial Sequence
  MKO10067027_A_NTCmmu_0622
  gRNA
cauuuccgggguccgaugca

SEQ ID NO: 67028 - RNA, 20 nt, Artificial Sequence
  MKO10067028_A_NTCmmu_0623
  gRNA
ccgggcgccguauccccuac

SEQ ID NO: 67029 - RNA, 20 nt, Artificial Sequence
  MKO10067029_A_NTCmmu_0624
  gRNA
gagacccauuaugauccuag

SEQ ID NO: 67030 - RNA, 20 nt, Artificial Sequence
  MKO10067030_A_NTCmmu_0625
  gRNA
cgaacuucuaccguugugcg

SEQ ID NO: 67031 - RNA, 20 nt, Artificial Sequence
  MKO10067031_A_NTCmmu_0626
  gRNA
uggcuuaauggacagcgcga

SEQ ID NO: 67032 - RNA, 20 nt, Artificial Sequence
  MKO10067032_A_NTCmmu_0627
  gRNA
ccggcgcugcggucggcuug

SEQ ID NO: 67033 - RNA, 20 nt, Artificial Sequence
  MKO10067033_A_NTCmmu_0628
  gRNA
guuacuuaccugaccggcaa

SEQ ID NO: 67034 - RNA, 20 nt, Artificial Sequence
  MKO10067034_A_NTCmmu_0629
  gRNA
cguuauuguacaccacgcuc

SEQ ID NO: 67035 - RNA, 20 nt, Artificial Sequence
  MKO10067035_A_NTCmmu_0630
  gRNA
cgagcucggcaaauuugauu

SEQ ID NO: 67036 - RNA, 20 nt, Artificial Sequence
  MKO10067036_A_NTCmmu_0631
  gRNA
ugguaccacucgccgaaucu

SEQ ID NO: 67037 - RNA, 20 nt, Artificial Sequence
  MKO10067037_A_NTCmmu_0632
  gRNA
cguguuuuaccucgcuucga

SEQ ID NO: 67038 - RNA, 20 nt, Artificial Sequence
  MKO10067038_A_NTCmmu_0633
  gRNA
cguccucgcagcguagacug

SEQ ID NO: 67039 - RNA, 20 nt, Artificial Sequence
  MKO10067039_A_NTCmmu_0634
  gRNA
guacgcaggguguagcgacc

SEQ ID NO: 67040 - RNA, 20 nt, Artificial Sequence
  MKO10067040_A_NTCmmu_0635
  gRNA
ccuuugaugggcgcguacuc

SEQ ID NO: 67041 - RNA, 20 nt, Artificial Sequence
  MKO10067041_A_NTCmmu_0636
  gRNA
cccucgguugagcagcgcga

SEQ ID NO: 67042 - RNA, 20 nt, Artificial Sequence
  MKO10067042_A_NTCmmu_0637
  gRNA
aagcgugagauucaccgccg

SEQ ID NO: 67043 - RNA, 20 nt, Artificial Sequence
  MKO10067043_A_NTCmmu_0638
  gRNA
gcgggacccccgguauaguc

SEQ ID NO: 67044 - RNA, 20 nt, Artificial Sequence
  MKO10067044_A_NTCmmu_0639
  gRNA
gacagccgguugaccggguc

SEQ ID NO: 67045 - RNA, 20 nt, Artificial Sequence
  MKO10067045_A_NTCmmu_0640
  gRNA
ggaaacucuugcucgacacg

SEQ ID NO: 67046 - RNA, 20 nt, Artificial Sequence
  MKO10067046_A_NTCmmu_0641
  gRNA
uugaacacgacacccgugcc

SEQ ID NO: 67047 - RNA, 20 nt, Artificial Sequence
  MKO10067047_A_NTCmmu_0642
  gRNA
gucgcucgaacucacguagc

SEQ ID NO: 67048 - RNA, 20 nt, Artificial Sequence
  MKO10067048_A_NTCmmu_0643
  gRNA
gggcgcgucauagacacacg

SEQ ID NO: 67049 - RNA, 20 nt, Artificial Sequence
  MKO10067049_A_NTCmmu_0644
  gRNA
cgucgaagauacgcaggcug

SEQ ID NO: 67050 - RNA, 20 nt, Artificial Sequence
  MKO10067050_A_NTCmmu_0645
  gRNA
uaauggcacuuaccgggucu

SEQ ID NO: 67051 - RNA, 20 nt, Artificial Sequence
  MKO10067051_A_NTCmmu_0646
  gRNA
cuaacagcgccguuaucuac

SEQ ID NO: 67052 - RNA, 20 nt, Artificial Sequence
  MKO10067052_A_NTCmmu_0647
  gRNA
uuaguucgaccacuccugau

SEQ ID NO: 67053 - RNA, 20 nt, Artificial Sequence
  MKO10067053_A_NTCmmu_0648
  gRNA
aaugcugcguacgauaaccg

SEQ ID NO: 67054 - RNA, 20 nt, Artificial Sequence
  MKO10067054_A_NTCmmu_0649
  gRNA
uaugacacacaaucugcgac

SEQ ID NO: 67055 - RNA, 20 nt, Artificial Sequence
  MKO10067055_A_NTCmmu_0650
  gRNA
uuggcggcucgcuccugcgu

SEQ ID NO: 67056 - RNA, 20 nt, Artificial Sequence
  MKO10067056_A_NTCmmu_0651
  gRNA
agucagcuccgggguauacg

SEQ ID NO: 67057 - RNA, 20 nt, Artificial Sequence
  MKO10067057_A_NTCmmu_0652
  gRNA
gcgaguuauuucgcuauagg

SEQ ID NO: 67058 - RNA, 20 nt, Artificial Sequence
  MKO10067058_A_NTCmmu_0653
  gRNA
acguugcagcucgcguuucg

SEQ ID NO: 67059 - RNA, 20 nt, Artificial Sequence
  MKO10067059_A_NTCmmu_0654
  gRNA
caucgguagucacuacgccc

SEQ ID NO: 67060 - RNA, 20 nt, Artificial Sequence
  MKO10067060_A_NTCmmu_0655
  gRNA
gaccacuauguacuuaucgc

SEQ ID NO: 67061 - RNA, 20 nt, Artificial Sequence
  MKO10067061_A_NTCmmu_0656
  gRNA
accgcgcaucauugacggug

SEQ ID NO: 67062 - RNA, 20 nt, Artificial Sequence
  MKO10067062_A_NTCmmu_0657
  gRNA
caaacgaggccacguacgug

SEQ ID NO: 67063 - RNA, 20 nt, Artificial Sequence
  MKO10067063_A_NTCmmu_0658
  gRNA
ucacucaaagugcguagucg

SEQ ID NO: 67064 - RNA, 20 nt, Artificial Sequence
  MKO10067064_A_NTCmmu_0659
  gRNA
gugucuuucggucuuacgag

SEQ ID NO: 67065 - RNA, 20 nt, Artificial Sequence
  MKO10067065_A_NTCmmu_0660
  gRNA
ccgugauuucgguagcguac

SEQ ID NO: 67066 - RNA, 20 nt, Artificial Sequence
  MKO10067066_A_NTCmmu_0661
  gRNA
cuuuggcgucgagaagcgca

SEQ ID NO: 67067 - RNA, 20 nt, Artificial Sequence
  MKO10067067_A_NTCmmu_0662
  gRNA
agauagcgcaaucccgcaug

SEQ ID NO: 67068 - RNA, 20 nt, Artificial Sequence
  MKO10067068_A_NTCmmu_0663
  gRNA
caucagcccauuaugacucg

SEQ ID NO: 67069 - RNA, 20 nt, Artificial Sequence
  MKO10067069_A_NTCmmu_0664
  gRNA
ccggagcgcguugcaguucu

SEQ ID NO: 67070 - RNA, 20 nt, Artificial Sequence
  MKO10067070_A_NTCmmu_0665
  gRNA
uuuuaguaggucaacgcugu

SEQ ID NO: 67071 - RNA, 20 nt, Artificial Sequence
  MKO10067071_A_NTCmmu_0666
  gRNA
cuaauuccaauauccgucug

SEQ ID NO: 67072 - RNA, 20 nt, Artificial Sequence
  MKO10067072_A_NTCmmu_0667
  gRNA
aguuaagcgcguaucuacgu

SEQ ID NO: 67073 - RNA, 20 nt, Artificial Sequence
  MKO10067073_A_NTCmmu_0668
  gRNA
aguccggucgaaaucuguau

SEQ ID NO: 67074 - RNA, 20 nt, Artificial Sequence
  MKO10067074_A_NTCmmu_0669
  gRNA
acgcacccauacaggcgcuu

SEQ ID NO: 67075 - RNA, 20 nt, Artificial Sequence
  MKO10067075_A_NTCmmu_0670
  gRNA
aggccccgagacgcgccaca

SEQ ID NO: 67076 - RNA, 20 nt, Artificial Sequence
  MKO10067076_A_NTCmmu_0671
  gRNA
ugacccgucucuucgcgcac

SEQ ID NO: 67077 - RNA, 20 nt, Artificial Sequence
  MKO10067077_A_NTCmmu_0672
  gRNA
uccuccgaucgaccagggua

SEQ ID NO: 67078 - RNA, 20 nt, Artificial Sequence
  MKO10067078_A_NTCmmu_0673
  gRNA
cguuaauccaccguaugggc

SEQ ID NO: 67079 - RNA, 20 nt, Artificial Sequence
  MKO10067079_A_NTCmmu_0674
  gRNA
auuaggugacuggaacacgu

SEQ ID NO: 67080 - RNA, 20 nt, Artificial Sequence
  MKO10067080_A_NTCmmu_0675
  gRNA
ucuucucgagcgugcgggcc

SEQ ID NO: 67081 - RNA, 20 nt, Artificial Sequence
  MKO10067081_A_NTCmmu_0676
  gRNA
cguguguuuacagcccuuac

SEQ ID NO: 67082 - RNA, 20 nt, Artificial Sequence
  MKO10067082_A_NTCmmu_0677
  gRNA
cuaccggucacguugugacc

SEQ ID NO: 67083 - RNA, 20 nt, Artificial Sequence
  MKO10067083_A_NTCmmu_0678
  gRNA
ugcuggccgauacgugcuug

SEQ ID NO: 67084 - RNA, 20 nt, Artificial Sequence
  MKO10067084_A_NTCmmu_0679
  gRNA
auaccuccgcuacaccgucu

SEQ ID NO: 67085 - RNA, 20 nt, Artificial Sequence
  MKO10067085_A_NTCmmu_0680
  gRNA
cucgucggcuuucgugcugc

SEQ ID NO: 67086 - RNA, 20 nt, Artificial Sequence
  MKO10067086_A_NTCmmu_0681
  gRNA
guaggccgcugaucgaauaa

SEQ ID NO: 67087 - RNA, 20 nt, Artificial Sequence
  MKO10067087_A_NTCmmu_0682
  gRNA
uuucuagggccgccgcccgc

SEQ ID NO: 67088 - RNA, 20 nt, Artificial Sequence
  MKO10067088_A_NTCmmu_0683
  gRNA
cacggcaggcaucucgucua

SEQ ID NO: 67089 - RNA, 20 nt, Artificial Sequence
  MKO10067089_A_NTCmmu_0684
  gRNA
gagcgccaagcgugcguuga

SEQ ID NO: 67090 - RNA, 20 nt, Artificial Sequence
  MKO10067090_A_NTCmmu_0685
  gRNA
cucgaugccacggaaggcgg

SEQ ID NO: 67091 - RNA, 20 nt, Artificial Sequence
  MKO10067091_A_NTCmmu_0686
  gRNA
cacgccuucgucaacccuau

SEQ ID NO: 67092 - RNA, 20 nt, Artificial Sequence
  MKO10067092_A_NTCmmu_0687
  gRNA
gcccguugugagcggcaugc

SEQ ID NO: 67093 - RNA, 20 nt, Artificial Sequence
  MKO10067093_A_NTCmmu_0688
  gRNA
gagcgcgggccagcgaacgu

SEQ ID NO: 67094 - RNA, 20 nt, Artificial Sequence
  MKO10067094_A_NTCmmu_0689
  gRNA
ucggaucgguacauaaaguu

SEQ ID NO: 67095 - RNA, 20 nt, Artificial Sequence
  MKO10067095_A_NTCmmu_0690
  gRNA
ugucugccgcauacgcuaua

SEQ ID NO: 67096 - RNA, 20 nt, Artificial Sequence
  MKO10067096_A_NTCmmu_0691
  gRNA
ucacccgcguauacgaccug

SEQ ID NO: 67097 - RNA, 20 nt, Artificial Sequence
  MKO10067097_A_NTCmmu_0692
  gRNA
ugugccuacgccauucggcu

SEQ ID NO: 67098 - RNA, 20 nt, Artificial Sequence
  MKO10067098_A_NTCmmu_0693
  gRNA
accauccgauauuacgagca

SEQ ID NO: 67099 - RNA, 20 nt, Artificial Sequence
  MKO10067099_A_NTCmmu_0694
  gRNA
gcuucggaggcuacguagua

SEQ ID NO: 67100 - RNA, 20 nt, Artificial Sequence
  MKO10067100_A_NTCmmu_0695
  gRNA
ugagccggugcgcucucggu

SEQ ID NO: 67101 - RNA, 20 nt, Artificial Sequence
  MKO10067101_A_NTCmmu_0696
  gRNA
uuuacguaugcugugcgcga

SEQ ID NO: 67102 - RNA, 20 nt, Artificial Sequence
  MKO10067102_A_NTCmmu_0697
  gRNA
uaacucuaaugcguuccaag

SEQ ID NO: 67103 - RNA, 20 nt, Artificial Sequence
  MKO10067103_A_NTCmmu_0698
  gRNA
uaugaaccuccggaucggug

SEQ ID NO: 67104 - RNA, 20 nt, Artificial Sequence
  MKO10067104_A_NTCmmu_0699
  gRNA
cguuaauaaacgcgguuuca

SEQ ID NO: 67105 - RNA, 20 nt, Artificial Sequence
  MKO10067105_A_NTCmmu_0700
  gRNA
cgccccuaguugucccgccc

SEQ ID NO: 67106 - RNA, 20 nt, Artificial Sequence
  MKO10067106_A_NTCmmu_0701
  gRNA
uuguuucagccuugagcgcg

SEQ ID NO: 67107 - RNA, 20 nt, Artificial Sequence
  MKO10067107_A_NTCmmu_0702
  gRNA
cucucugcgagucgaugauu

SEQ ID NO: 67108 - RNA, 20 nt, Artificial Sequence
  MKO10067108_A_NTCmmu_0703
  gRNA
cgaguaucagcaugucgacg

SEQ ID NO: 67109 - RNA, 20 nt, Artificial Sequence
  MKO10067109_A_NTCmmu_0704
  gRNA
agugccggggguguauaccg

SEQ ID NO: 67110 - RNA, 20 nt, Artificial Sequence
  MKO10067110_A_NTCmmu_0705
  gRNA
cgguaccacgccccaccucg

SEQ ID NO: 67111 - RNA, 20 nt, Artificial Sequence
  MKO10067111_A_NTCmmu_0706
  gRNA
guacugacguuacguucaua

SEQ ID NO: 67112 - RNA, 20 nt, Artificial Sequence
  MKO10067112_A_NTCmmu_0707
  gRNA
acgcaagcggaacgcgucua

SEQ ID NO: 67113 - RNA, 20 nt, Artificial Sequence
  MKO10067113_A_NTCmmu_0708
  gRNA
gagcgucccgugauuuaaag

SEQ ID NO: 67114 - RNA, 20 nt, Artificial Sequence
  MKO10067114_A_NTCmmu_0709
  gRNA
gguaaaaagcguaacgagua

SEQ ID NO: 67115 - RNA, 20 nt, Artificial Sequence
  MKO10067115_A_NTCmmu_0710
  gRNA
cgugaaucgacccucaauaa

SEQ ID NO: 67116 - RNA, 20 nt, Artificial Sequence
  MKO10067116_A_NTCmmu_0711
  gRNA
agaggcggagcaauacucgc

SEQ ID NO: 67117 - RNA, 20 nt, Artificial Sequence
  MKO10067117_A_NTCmmu_0712
  gRNA
uagagcagauccccucaacg

SEQ ID NO: 67118 - RNA, 20 nt, Artificial Sequence
  MKO10067118_A_NTCmmu_0713
  gRNA
agaccucguuagccguagcu

SEQ ID NO: 67119 - RNA, 20 nt, Artificial Sequence
  MKO10067119_A_NTCmmu_0714
  gRNA
uaguuaucugcaacgcauag

SEQ ID NO: 67120 - RNA, 20 nt, Artificial Sequence
  MKO10067120_A_NTCmmu_0715
  gRNA
ccucaaauagcgaacgucaa

SEQ ID NO: 67121 - RNA, 20 nt, Artificial Sequence
  MKO10067121_A_NTCmmu_0716
  gRNA
aagcgagccgcagaccguuu

SEQ ID NO: 67122 - RNA, 20 nt, Artificial Sequence
  MKO10067122_A_NTCmmu_0717
  gRNA
caauacaccguuaacccucu

SEQ ID NO: 67123 - RNA, 20 nt, Artificial Sequence
  MKO10067123_A_NTCmmu_0718
  gRNA
uacgcucacuucugcgaagg

SEQ ID NO: 67124 - RNA, 20 nt, Artificial Sequence
  MKO10067124_A_NTCmmu_0719
  gRNA
ugggcgguucaaagcgaauu

SEQ ID NO: 67125 - RNA, 20 nt, Artificial Sequence
  MKO10067125_A_NTCmmu_0720
  gRNA
cguuagaccgaaucuccggg

SEQ ID NO: 67126 - RNA, 20 nt, Artificial Sequence
  MKO10067126_A_NTCmmu_0721
  gRNA
ugcgucucagcuucggcuau

SEQ ID NO: 67127 - RNA, 20 nt, Artificial Sequence
  MKO10067127_A_NTCmmu_0722
  gRNA
aagccuaacggagcucgcgg

SEQ ID NO: 67128 - RNA, 20 nt, Artificial Sequence
  MKO10067128_A_NTCmmu_0723
  gRNA
accaauaacggguacaaguc

SEQ ID NO: 67129 - RNA, 20 nt, Artificial Sequence
  MKO10067129_A_NTCmmu_0724
  gRNA
cacacgccgcgggccgugag

SEQ ID NO: 67130 - RNA, 20 nt, Artificial Sequence
  MKO10067130_A_NTCmmu_0725
  gRNA
uccgaacaggcgcguuucuc

SEQ ID NO: 67131 - RNA, 20 nt, Artificial Sequence
  MKO10067131_A_NTCmmu_0726
  gRNA
caucccccgacuacgacuac

SEQ ID NO: 67132 - RNA, 20 nt, Artificial Sequence
  MKO10067132_A_NTCmmu_0727
  gRNA
ccgagcacccuauuuaucua

SEQ ID NO: 67133 - RNA, 20 nt, Artificial Sequence
  MKO10067133_A_NTCmmu_0728
  gRNA
uuuuggcgacgcaucgcugg

SEQ ID NO: 67134 - RNA, 20 nt, Artificial Sequence
  MKO10067134_A_NTCmmu_0729
  gRNA
uucguggccgaaggcgccgc

SEQ ID NO: 67135 - RNA, 20 nt, Artificial Sequence
  MKO10067135_A_NTCmmu_0730
  gRNA
gacguauuggauucgcaacc

SEQ ID NO: 67136 - RNA, 20 nt, Artificial Sequence
  MKO10067136_A_NTCmmu_0731
  gRNA
cgacuccgggaauauccguu

SEQ ID NO: 67137 - RNA, 20 nt, Artificial Sequence
  MKO10067137_A_NTCmmu_0732
  gRNA
uugaauccgaggcgccgaug

SEQ ID NO: 67138 - RNA, 20 nt, Artificial Sequence
  MKO10067138_A_NTCmmu_0733
  gRNA
cugucuucaacgucuggccg

SEQ ID NO: 67139 - RNA, 20 nt, Artificial Sequence
  MKO10067139_A_NTCmmu_0734
  gRNA
aguuaagcuccaaucgucug

SEQ ID NO: 67140 - RNA, 20 nt, Artificial Sequence
  MKO10067140_A_NTCmmu_0735
  gRNA
gcuaaucgguacuacuccgg

SEQ ID NO: 67141 - RNA, 20 nt, Artificial Sequence
  MKO10067141_A_NTCmmu_0736
  gRNA
ccgcaccgcagucaugguaa

SEQ ID NO: 67142 - RNA, 20 nt, Artificial Sequence
  MKO10067142_A_NTCmmu_0737
  gRNA
gcuugaggcaacgcgacuga

SEQ ID NO: 67143 - RNA, 20 nt, Artificial Sequence
  MKO10067143_A_NTCmmu_0738
  gRNA
gaaccaguaucuaacccgac

SEQ ID NO: 67144 - RNA, 20 nt, Artificial Sequence
  MKO10067144_A_NTCmmu_0739
  gRNA
acgaggagaagucgaguauu

SEQ ID NO: 67145 - RNA, 20 nt, Artificial Sequence
  MKO10067145_A_NTCmmu_0740
  gRNA
gcuucgaccacggguacugc

SEQ ID NO: 67146 - RNA, 20 nt, Artificial Sequence
  MKO10067146_A_NTCmmu_0741
  gRNA
ccgcgugacgcaaucccuug

SEQ ID NO: 67147 - RNA, 20 nt, Artificial Sequence
  MKO10067147_A_NTCmmu_0742
  gRNA
gacuucgacgagaaaacguu

SEQ ID NO: 67148 - RNA, 20 nt, Artificial Sequence
  MKO10067148_A_NTCmmu_0743
  gRNA
cggaauacgccaaaaccuau

SEQ ID NO: 67149 - RNA, 20 nt, Artificial Sequence
  MKO10067149_A_NTCmmu_0744
  gRNA
uacaugcgguugacacguuc

SEQ ID NO: 67150 - RNA, 20 nt, Artificial Sequence
  MKO10067150_A_NTCmmu_0745
  gRNA
cgcgacguacggcuggagca

SEQ ID NO: 67151 - RNA, 20 nt, Artificial Sequence
  MKO10067151_A_NTCmmu_0746
  gRNA
uaguaggccggagcgcaucc

SEQ ID NO: 67152 - RNA, 20 nt, Artificial Sequence
  MKO10067152_A_NTCmmu_0747
  gRNA
ucgcgaauugcugccgaacu

SEQ ID NO: 67153 - RNA, 20 nt, Artificial Sequence
  MKO10067153_A_NTCmmu_0748
  gRNA
gucgauuagaugaugcccgg

SEQ ID NO: 67154 - RNA, 20 nt, Artificial Sequence
  MKO10067154_A_NTCmmu_0749
  gRNA
aacuuauacguaaucugauc

SEQ ID NO: 67155 - RNA, 20 nt, Artificial Sequence
  MKO10067155_A_NTCmmu_0750
  gRNA
gugccagcgucgauugacgc

SEQ ID NO: 67156 - RNA, 20 nt, Artificial Sequence
  MKO10067156_A_NTCmmu_0751
  gRNA
agaaauccagucccgccuaa

SEQ ID NO: 67157 - RNA, 20 nt, Artificial Sequence
  MKO10067157_A_NTCmmu_0752
  gRNA
uacgacgaggacgcaucgag

SEQ ID NO: 67158 - RNA, 20 nt, Artificial Sequence
  MKO10067158_A_NTCmmu_0753
  gRNA
gugugguauauccccguuuu

SEQ ID NO: 67159 - RNA, 20 nt, Artificial Sequence
  MKO10067159_A_NTCmmu_0754
  gRNA
ccuaacucgaagucucguca

SEQ ID NO: 67160 - RNA, 20 nt, Artificial Sequence
  MKO10067160_A_NTCmmu_0755
  gRNA
gcccaugacgcguguuagua

SEQ ID NO: 67161 - RNA, 20 nt, Artificial Sequence
  MKO10067161_A_NTCmmu_0756
  gRNA
acgacgagagauacuuaggc

SEQ ID NO: 67162 - RNA, 20 nt, Artificial Sequence
  MKO10067162_A_NTCmmu_0757
  gRNA
cugcguguaacguguuggga

SEQ ID NO: 67163 - RNA, 20 nt, Artificial Sequence
  MKO10067163_A_NTCmmu_0758
  gRNA
gcauucccgcuuacguaauu

SEQ ID NO: 67164 - RNA, 20 nt, Artificial Sequence
  MKO10067164_A_NTCmmu_0759
  gRNA
cgccaaugguggccgacucg

SEQ ID NO: 67165 - RNA, 20 nt, Artificial Sequence
  MKO10067165_A_NTCmmu_0760
  gRNA
gaucacucccgaaaguagug

SEQ ID NO: 67166 - RNA, 20 nt, Artificial Sequence
  MKO10067166_A_NTCmmu_0761
  gRNA
gcaacccacggacggcaccg

SEQ ID NO: 67167 - RNA, 20 nt, Artificial Sequence
  MKO10067167_A_NTCmmu_0762
  gRNA
guguuguccgagaacccgac

SEQ ID NO: 67168 - RNA, 20 nt, Artificial Sequence
  MKO10067168_A_NTCmmu_0763
  gRNA
gccacgaccugcgaauaauu

SEQ ID NO: 67169 - RNA, 20 nt, Artificial Sequence
  MKO10067169_A_NTCmmu_0764
  gRNA
aggacuauccgcgggauuag

SEQ ID NO: 67170 - RNA, 20 nt, Artificial Sequence
  MKO10067170_A_NTCmmu_0765
  gRNA
gacuagcacgaacugcgguu

SEQ ID NO: 67171 - RNA, 20 nt, Artificial Sequence
  MKO10067171_A_NTCmmu_0766
  gRNA
guagcugaccgcuuaacuaa

SEQ ID NO: 67172 - RNA, 20 nt, Artificial Sequence
  MKO10067172_A_NTCmmu_0767
  gRNA
cguguuuggcggccaacuuu

SEQ ID NO: 67173 - RNA, 20 nt, Artificial Sequence
  MKO10067173_A_NTCmmu_0768
  gRNA
uuacuuggugcaacaaccgg

SEQ ID NO: 67174 - RNA, 20 nt, Artificial Sequence
  MKO10067174_A_NTCmmu_0769
  gRNA
cagcgacucugaucggcgua

SEQ ID NO: 67175 - RNA, 20 nt, Artificial Sequence
  MKO10067175_A_NTCmmu_0770
  gRNA
ugagccuuuguggaccgcgg

SEQ ID NO: 67176 - RNA, 20 nt, Artificial Sequence
  MKO10067176_A_NTCmmu_0771
  gRNA
ucgcacucuaggccguuauu

SEQ ID NO: 67177 - RNA, 20 nt, Artificial Sequence
  MKO10067177_A_NTCmmu_0772
  gRNA
cucccauccccguagcggcc

SEQ ID NO: 67178 - RNA, 20 nt, Artificial Sequence
  MKO10067178_A_NTCmmu_0773
  gRNA
agcguaucuuauguaccgcu

SEQ ID NO: 67179 - RNA, 20 nt, Artificial Sequence
  MKO10067179_A_NTCmmu_0774
  gRNA
agucacuaggcgcucucgcg

SEQ ID NO: 67180 - RNA, 20 nt, Artificial Sequence
  MKO10067180_A_NTCmmu_0775
  gRNA
cagguuuccccuagucgaau

SEQ ID NO: 67181 - RNA, 20 nt, Artificial Sequence
  MKO10067181_A_NTCmmu_0776
  gRNA
aucgauauugauaaacgcga

SEQ ID NO: 67182 - RNA, 20 nt, Artificial Sequence
  MKO10067182_A_NTCmmu_0777
  gRNA
caccuuucgagguaacaccg

SEQ ID NO: 67183 - RNA, 20 nt, Artificial Sequence
  MKO10067183_A_NTCmmu_0778
  gRNA
uagugcgaacagucacggcg

SEQ ID NO: 67184 - RNA, 20 nt, Artificial Sequence
  MKO10067184_A_NTCmmu_0779
  gRNA
acacaaacuggucguagaug

SEQ ID NO: 67185 - RNA, 20 nt, Artificial Sequence
  MKO10067185_A_NTCmmu_0780
  gRNA
cuugacaccucguccgcauc

SEQ ID NO: 67186 - RNA, 20 nt, Artificial Sequence
  MKO10067186_A_NTCmmu_0781
  gRNA
cccggguacaccaauagcca

SEQ ID NO: 67187 - RNA, 20 nt, Artificial Sequence
  MKO10067187_A_NTCmmu_0782
  gRNA
accauaguuucaaccugcgg

SEQ ID NO: 67188 - RNA, 20 nt, Artificial Sequence
  MKO10067188_A_NTCmmu_0783
  gRNA
gcauuggugcucgcgcguuc

SEQ ID NO: 67189 - RNA, 20 nt, Artificial Sequence
  MKO10067189_A_NTCmmu_0784
  gRNA
auaaugcgcgcgaauacuua

SEQ ID NO: 67190 - RNA, 20 nt, Artificial Sequence
  MKO10067190_A_NTCmmu_0785
  gRNA
agcgauguucacgcacagcg

SEQ ID NO: 67191 - RNA, 20 nt, Artificial Sequence
  MKO10067191_A_NTCmmu_0786
  gRNA
cgucgaucccucuauacugg

SEQ ID NO: 67192 - RNA, 20 nt, Artificial Sequence
  MKO10067192_A_NTCmmu_0787
  gRNA
cgaaaggcccgacugcgugg

SEQ ID NO: 67193 - RNA, 20 nt, Artificial Sequence
  MKO10067193_A_NTCmmu_0788
  gRNA
auguugcagcgcuguacgcc

SEQ ID NO: 67194 - RNA, 20 nt, Artificial Sequence
  MKO10067194_A_NTCmmu_0789
  gRNA
ucucuucgcgcccgcuuugc

SEQ ID NO: 67195 - RNA, 20 nt, Artificial Sequence
  MKO10067195_A_NTCmmu_0790
  gRNA
cccguaggggucgugguuuu

SEQ ID NO: 67196 - RNA, 20 nt, Artificial Sequence
  MKO10067196_A_NTCmmu_0791
  gRNA
cguagaugccugcucgagca

SEQ ID NO: 67197 - RNA, 20 nt, Artificial Sequence
  MKO10067197_A_NTCmmu_0792
  gRNA
gcagguaggcucgauacuug

SEQ ID NO: 67198 - RNA, 20 nt, Artificial Sequence
  MKO10067198_A_NTCmmu_0793
  gRNA
ggucucguaauguccuauau

SEQ ID NO: 67199 - RNA, 20 nt, Artificial Sequence
  MKO10067199_A_NTCmmu_0794
  gRNA
uuauugguuucaacgguugu

SEQ ID NO: 67200 - RNA, 20 nt, Artificial Sequence
  MKO10067200_A_NTCmmu_0795
  gRNA
accgcacguucucgcagaga

SEQ ID NO: 67201 - RNA, 20 nt, Artificial Sequence
  MKO10067201_A_NTCmmu_0796
  gRNA
ucuucuagugcgaguuccgc

SEQ ID NO: 67202 - RNA, 20 nt, Artificial Sequence
  MKO10067202_A_NTCmmu_0797
  gRNA
ggaguucaagcguaacuucg

SEQ ID NO: 67203 - RNA, 20 nt, Artificial Sequence
  MKO10067203_A_NTCmmu_0798
  gRNA
uuaacgucugugcgcacuac

SEQ ID NO: 67204 - RNA, 20 nt, Artificial Sequence
  MKO10067204_A_NTCmmu_0799
  gRNA
gucguuaacgacccggauuc

SEQ ID NO: 67205 - RNA, 20 nt, Artificial Sequence
  MKO10067205_A_NTCmmu_0800
  gRNA
gagcuaaucuguagacgucg

SEQ ID NO: 67206 - RNA, 20 nt, Artificial Sequence
  MKO10067206_A_NTCmmu_0801
  gRNA
gcaggguuauuccgcuucua

SEQ ID NO: 67207 - RNA, 20 nt, Artificial Sequence
  MKO10067207_A_NTCmmu_0802
  gRNA
agggcaaucgcgugcccaac

SEQ ID NO: 67208 - RNA, 20 nt, Artificial Sequence
  MKO10067208_A_NTCmmu_0803
  gRNA
cguguagucgggucgcaugu

SEQ ID NO: 67209 - RNA, 20 nt, Artificial Sequence
  MKO10067209_A_NTCmmu_0804
  gRNA
ugagguuaccgccggcuuuu

SEQ ID NO: 67210 - RNA, 20 nt, Artificial Sequence
  MKO10067210_A_NTCmmu_0805
  gRNA
acgcucuuggcagauaaucg

SEQ ID NO: 67211 - RNA, 20 nt, Artificial Sequence
  MKO10067211_A_NTCmmu_0806
  gRNA
aaaauugcaccuucccggcc

SEQ ID NO: 67212 - RNA, 20 nt, Artificial Sequence
  MKO10067212_A_NTCmmu_0807
  gRNA
ugccuacugucguucccgcg

SEQ ID NO: 67213 - RNA, 20 nt, Artificial Sequence
  MKO10067213_A_NTCmmu_0808
  gRNA
gaccggccaacgguagcggc

SEQ ID NO: 67214 - RNA, 20 nt, Artificial Sequence
  MKO10067214_A_NTCmmu_0809
  gRNA
acagagucgugugccgaacg

SEQ ID NO: 67215 - RNA, 20 nt, Artificial Sequence
  MKO10067215_A_NTCmmu_0810
  gRNA
cuaagucgacuguuucgacc

SEQ ID NO: 67216 - RNA, 20 nt, Artificial Sequence
  MKO10067216_A_NTCmmu_0811
  gRNA
ucggauuuuaauccuuacgc

SEQ ID NO: 67217 - RNA, 20 nt, Artificial Sequence
  MKO10067217_A_NTCmmu_0812
  gRNA
ucgaucgucggcggagcgga

SEQ ID NO: 67218 - RNA, 20 nt, Artificial Sequence
  MKO10067218_A_NTCmmu_0813
  gRNA
ucuccguccgaaacggcgac

SEQ ID NO: 67219 - RNA, 20 nt, Artificial Sequence
  MKO10067219_A_NTCmmu_0814
  gRNA
aggucguggacccgcaugua

SEQ ID NO: 67220 - RNA, 20 nt, Artificial Sequence
  MKO10067220_A_NTCmmu_0815
  gRNA
gauuggacggucgcaggaua

SEQ ID NO: 67221 - RNA, 20 nt, Artificial Sequence
  MKO10067221_A_NTCmmu_0816
  gRNA
uaguguugugagcgucguac

SEQ ID NO: 67222 - RNA, 20 nt, Artificial Sequence
  MKO10067222_A_NTCmmu_0817
  gRNA
aguagagucgcgaacgcuac

SEQ ID NO: 67223 - RNA, 20 nt, Artificial Sequence
  MKO10067223_A_NTCmmu_0818
  gRNA
gaugcggacccacguuaagc

SEQ ID NO: 67224 - RNA, 20 nt, Artificial Sequence
  MKO10067224_A_NTCmmu_0819
  gRNA
uuaucguacuaguacguaca

SEQ ID NO: 67225 - RNA, 20 nt, Artificial Sequence
  MKO10067225_A_NTCmmu_0820
  gRNA
cggauccgguacggucaguu

SEQ ID NO: 67226 - RNA, 20 nt, Artificial Sequence
  MKO10067226_A_NTCmmu_0821
  gRNA
gacaaucgacacgccgcuuc

SEQ ID NO: 67227 - RNA, 20 nt, Artificial Sequence
  MKO10067227_A_NTCmmu_0822
  gRNA
augggaaagcccacgacaau

SEQ ID NO: 67228 - RNA, 20 nt, Artificial Sequence
  MKO10067228_A_NTCmmu_0823
  gRNA
gcauuaagacgcccacauau

SEQ ID NO: 67229 - RNA, 20 nt, Artificial Sequence
  MKO10067229_A_NTCmmu_0824
  gRNA
auccgggcauagcguuuaaa

SEQ ID NO: 67230 - RNA, 20 nt, Artificial Sequence
  MKO10067230_A_NTCmmu_0825
  gRNA
gcgcgcguggaucacccgca

SEQ ID NO: 67231 - RNA, 20 nt, Artificial Sequence
  MKO10067231_A_NTCmmu_0826
  gRNA
cuaacgugguagcacuacaa

SEQ ID NO: 67232 - RNA, 20 nt, Artificial Sequence
  MKO10067232_A_NTCmmu_0827
  gRNA
ggauucgugcgggagauacg

SEQ ID NO: 67233 - RNA, 20 nt, Artificial Sequence
  MKO10067233_A_NTCmmu_0828
  gRNA
caagggguggucauugcgac

SEQ ID NO: 67234 - RNA, 20 nt, Artificial Sequence
  MKO10067234_A_NTCmmu_0829
  gRNA
agcguccacgcgucuaugga

SEQ ID NO: 67235 - RNA, 20 nt, Artificial Sequence
  MKO10067235_A_NTCmmu_0830
  gRNA
ccgagagguacuccaauucg

SEQ ID NO: 67236 - RNA, 20 nt, Artificial Sequence
  MKO10067236_A_NTCmmu_0831
  gRNA
acaacaauuacuggccgcga

SEQ ID NO: 67237 - RNA, 20 nt, Artificial Sequence
  MKO10067237_A_NTCmmu_0832
  gRNA
uugcagcaacggcgacggcu

SEQ ID NO: 67238 - RNA, 20 nt, Artificial Sequence
  MKO10067238_A_NTCmmu_0833
  gRNA
gaaccuucgcgcaacuuaac

SEQ ID NO: 67239 - RNA, 20 nt, Artificial Sequence
  MKO10067239_A_NTCmmu_0834
  gRNA
uucgcgaguaagguaggcau

SEQ ID NO: 67240 - RNA, 20 nt, Artificial Sequence
  MKO10067240_A_NTCmmu_0835
  gRNA
uccuaggccugauuuacccg

SEQ ID NO: 67241 - RNA, 20 nt, Artificial Sequence
  MKO10067241_A_NTCmmu_0836
  gRNA
gcccgagcggauucaccgcg

SEQ ID NO: 67242 - RNA, 20 nt, Artificial Sequence
  MKO10067242_A_NTCmmu_0837
  gRNA
accuuguguucgacgguagg

SEQ ID NO: 67243 - RNA, 20 nt, Artificial Sequence
  MKO10067243_A_NTCmmu_0838
  gRNA
acgggucaacuucuugccgc

SEQ ID NO: 67244 - RNA, 20 nt, Artificial Sequence
  MKO10067244_A_NTCmmu_0839
  gRNA
auucaguguaccggucaaau

SEQ ID NO: 67245 - RNA, 20 nt, Artificial Sequence
  MKO10067245_A_NTCmmu_0840
  gRNA
aucguaaauuacacguacag

SEQ ID NO: 67246 - RNA, 20 nt, Artificial Sequence
  MKO10067246_A_NTCmmu_0841
  gRNA
caacacgugcgagcgaacug

SEQ ID NO: 67247 - RNA, 20 nt, Artificial Sequence
  MKO10067247_A_NTCmmu_0842
  gRNA
cggacuuaccgcagauuaua

SEQ ID NO: 67248 - RNA, 20 nt, Artificial Sequence
  MKO10067248_A_NTCmmu_0843
  gRNA
cucaaaccuccguuaccccg

SEQ ID NO: 67249 - RNA, 20 nt, Artificial Sequence
  MKO10067249_A_NTCmmu_0844
  gRNA
cgaaugcacaggcucgcggu

SEQ ID NO: 67250 - RNA, 20 nt, Artificial Sequence
  MKO10067250_A_NTCmmu_0845
  gRNA
agcgugucgagaacggcuug

SEQ ID NO: 67251 - RNA, 20 nt, Artificial Sequence
  MKO10067251_A_NTCmmu_0846
  gRNA
cguuauaucuacacuuugcg

SEQ ID NO: 67252 - RNA, 20 nt, Artificial Sequence
  MKO10067252_A_NTCmmu_0847
  gRNA
gcucgaaaguacgcuuccuu

SEQ ID NO: 67253 - RNA, 20 nt, Artificial Sequence
  MKO10067253_A_NTCmmu_0848
  gRNA
ugucccgacgauguguaaau

SEQ ID NO: 67254 - RNA, 20 nt, Artificial Sequence
  MKO10067254_A_NTCmmu_0849
  gRNA
aacccgccggaacaaucagc

SEQ ID NO: 67255 - RNA, 20 nt, Artificial Sequence
  MKO10067255_A_NTCmmu_0850
  gRNA
aacguuauagcuucgucucu

SEQ ID NO: 67256 - RNA, 20 nt, Artificial Sequence
  MKO10067256_A_NTCmmu_0851
  gRNA
caucgccgacgauccucugg

SEQ ID NO: 67257 - RNA, 20 nt, Artificial Sequence
  MKO10067257_A_NTCmmu_0852
  gRNA
cccauucaacaccguuugua

SEQ ID NO: 67258 - RNA, 20 nt, Artificial Sequence
  MKO10067258_A_NTCmmu_0853
  gRNA
auagcccgguuugcccgucu

SEQ ID NO: 67259 - RNA, 20 nt, Artificial Sequence
  MKO10067259_A_NTCmmu_0854
  gRNA
uaagugacacuucguaucgu

SEQ ID NO: 67260 - RNA, 20 nt, Artificial Sequence
  MKO10067260_A_NTCmmu_0855
  gRNA
cggucgauuguggaguaaug

SEQ ID NO: 67261 - RNA, 20 nt, Artificial Sequence
  MKO10067261_A_NTCmmu_0856
  gRNA
cucggaugguguguugaacc

SEQ ID NO: 67262 - RNA, 20 nt, Artificial Sequence
  MKO10067262_A_NTCmmu_0857
  gRNA
auaacuuacucguuacgacu

SEQ ID NO: 67263 - RNA, 20 nt, Artificial Sequence
  MKO10067263_A_NTCmmu_0858
  gRNA
gggguuggauacgcgauuua

SEQ ID NO: 67264 - RNA, 20 nt, Artificial Sequence
  MKO10067264_A_NTCmmu_0859
  gRNA
gggcaacgucaucuggcgac

SEQ ID NO: 67265 - RNA, 20 nt, Artificial Sequence
  MKO10067265_A_NTCmmu_0860
  gRNA
cgagccucgucuuucauggg

SEQ ID NO: 67266 - RNA, 20 nt, Artificial Sequence
  MKO10067266_A_NTCmmu_0861
  gRNA
gacgguccccccuaugaaau

SEQ ID NO: 67267 - RNA, 20 nt, Artificial Sequence
  MKO10067267_A_NTCmmu_0862
  gRNA
cauacccgguguuuccuagc

SEQ ID NO: 67268 - RNA, 20 nt, Artificial Sequence
  MKO10067268_A_NTCmmu_0863
  gRNA
accaccgugccggggacgcg

SEQ ID NO: 67269 - RNA, 20 nt, Artificial Sequence
  MKO10067269_A_NTCmmu_0864
  gRNA
cgccaguauaccacauucgu

SEQ ID NO: 67270 - RNA, 20 nt, Artificial Sequence
  MKO10067270_A_NTCmmu_0865
  gRNA
ucagucagucggcccccugc

SEQ ID NO: 67271 - RNA, 20 nt, Artificial Sequence
  MKO10067271_A_NTCmmu_0866
  gRNA
aguacagccgacgagugcga

SEQ ID NO: 67272 - RNA, 20 nt, Artificial Sequence
  MKO10067272_A_NTCmmu_0867
  gRNA
ucuggacgcgagaugacggg

SEQ ID NO: 67273 - RNA, 20 nt, Artificial Sequence
  MKO10067273_A_NTCmmu_0868
  gRNA
augacacuuacgguacucgu

SEQ ID NO: 67274 - RNA, 20 nt, Artificial Sequence
  MKO10067274_A_NTCmmu_0869
  gRNA
uccuacaccaccccggccgu

SEQ ID NO: 67275 - RNA, 20 nt, Artificial Sequence
  MKO10067275_A_NTCmmu_0870
  gRNA
aauaccguaccgacucagug

SEQ ID NO: 67276 - RNA, 20 nt, Artificial Sequence
  MKO10067276_A_NTCmmu_0871
  gRNA
gauuucucguaucggauaac

SEQ ID NO: 67277 - RNA, 20 nt, Artificial Sequence
  MKO10067277_A_NTCmmu_0872
  gRNA
gaccgucgggauccuuaauu

SEQ ID NO: 67278 - RNA, 20 nt, Artificial Sequence
  MKO10067278_A_NTCmmu_0873
  gRNA
cgcuacaguaaucgcaacga

SEQ ID NO: 67279 - RNA, 20 nt, Artificial Sequence
  MKO10067279_A_NTCmmu_0874
  gRNA
cguuguuuggagcccgucca

SEQ ID NO: 67280 - RNA, 20 nt, Artificial Sequence
  MKO10067280_A_NTCmmu_0875
  gRNA
aaagacgugcauucagcgag

SEQ ID NO: 67281 - RNA, 20 nt, Artificial Sequence
  MKO10067281_A_NTCmmu_0876
  gRNA
uaauucuuuaguacgugcaa

SEQ ID NO: 67282 - RNA, 20 nt, Artificial Sequence
  MKO10067282_A_NTCmmu_0877
  gRNA
agucccacguuugccgucaa

SEQ ID NO: 67283 - RNA, 20 nt, Artificial Sequence
  MKO10067283_A_NTCmmu_0878
  gRNA
gccguuggaaaacuccggcc

SEQ ID NO: 67284 - RNA, 20 nt, Artificial Sequence
  MKO10067284_A_NTCmmu_0879
  gRNA
aucgcuaauuuacgaaggcg

SEQ ID NO: 67285 - RNA, 20 nt, Artificial Sequence
  MKO10067285_A_NTCmmu_0880
  gRNA
uuaccgugguacgucagguu

SEQ ID NO: 67286 - RNA, 20 nt, Artificial Sequence
  MKO10067286_A_NTCmmu_0881
  gRNA
auaucgaaugauguccgcau

SEQ ID NO: 67287 - RNA, 20 nt, Artificial Sequence
  MKO10067287_A_NTCmmu_0882
  gRNA
uguuaaugccaacgggacau

SEQ ID NO: 67288 - RNA, 20 nt, Artificial Sequence
  MKO10067288_A_NTCmmu_0883
  gRNA
cacgggcagcgaucuaguug

SEQ ID NO: 67289 - RNA, 20 nt, Artificial Sequence
  MKO10067289_A_NTCmmu_0884
  gRNA
augaugugauccuucgccga

SEQ ID NO: 67290 - RNA, 20 nt, Artificial Sequence
  MKO10067290_A_NTCmmu_0885
  gRNA
caaaguaacuaucucgucga

SEQ ID NO: 67291 - RNA, 20 nt, Artificial Sequence
  MKO10067291_A_NTCmmu_0886
  gRNA
ccaaggcgcacgcuacgugg

SEQ ID NO: 67292 - RNA, 20 nt, Artificial Sequence
  MKO10067292_A_NTCmmu_0887
  gRNA
ugucuauguuuggccacgca

SEQ ID NO: 67293 - RNA, 20 nt, Artificial Sequence
  MKO10067293_A_NTCmmu_0888
  gRNA
gcuaaaaacaaccggcgcgg

SEQ ID NO: 67294 - RNA, 20 nt, Artificial Sequence
  MKO10067294_A_NTCmmu_0889
  gRNA
uaguaaaaaauucgcccucc

SEQ ID NO: 67295 - RNA, 20 nt, Artificial Sequence
  MKO10067295_A_NTCmmu_0890
  gRNA
ccaaccuaaggcaauacggu

SEQ ID NO: 67296 - RNA, 20 nt, Artificial Sequence
  MKO10067296_A_NTCmmu_0891
  gRNA
ggcggguuaggccccguuuu

SEQ ID NO: 67297 - RNA, 20 nt, Artificial Sequence
  MKO10067297_A_NTCmmu_0892
  gRNA
aaucaaccgugauagucucg

SEQ ID NO: 67298 - RNA, 20 nt, Artificial Sequence
  MKO10067298_A_NTCmmu_0893
  gRNA
cguugcgaauccacccuauu

SEQ ID NO: 67299 - RNA, 20 nt, Artificial Sequence
  MKO10067299_A_NTCmmu_0894
  gRNA
ucacaacccccgacuaucgc

SEQ ID NO: 67300 - RNA, 20 nt, Artificial Sequence
  MKO10067300_A_NTCmmu_0895
  gRNA
gucacaaaaaacgagcguua

SEQ ID NO: 67301 - RNA, 20 nt, Artificial Sequence
  MKO10067301_A_NTCmmu_0896
  gRNA
gcaauagucgcacgggugau

SEQ ID NO: 67302 - RNA, 20 nt, Artificial Sequence
  MKO10067302_A_NTCmmu_0897
  gRNA
ggcagccuaaucagucgagg

SEQ ID NO: 67303 - RNA, 20 nt, Artificial Sequence
  MKO10067303_A_NTCmmu_0898
  gRNA
ucaaucugcggugacucguu

SEQ ID NO: 67304 - RNA, 20 nt, Artificial Sequence
  MKO10067304_A_NTCmmu_0899
  gRNA
gcgugacgucccacccugag

SEQ ID NO: 67305 - RNA, 20 nt, Artificial Sequence
  MKO10067305_A_NTCmmu_0900
  gRNA
gucgcguauccugacgacac

SEQ ID NO: 67306 - RNA, 20 nt, Artificial Sequence
  MKO10067306_A_NTCmmu_0901
  gRNA
gcaugcgcucgcguggacug

SEQ ID NO: 67307 - RNA, 20 nt, Artificial Sequence
  MKO10067307_A_NTCmmu_0902
  gRNA
gccgcaacguuagauguaua

SEQ ID NO: 67308 - RNA, 20 nt, Artificial Sequence
  MKO10067308_A_NTCmmu_0903
  gRNA
cccggucggggauacuaacu

SEQ ID NO: 67309 - RNA, 20 nt, Artificial Sequence
  MKO10067309_A_NTCmmu_0904
  gRNA
ucagcagaauugggcccgua

SEQ ID NO: 67310 - RNA, 20 nt, Artificial Sequence
  MKO10067310_A_NTCmmu_0905
  gRNA
ugccuucagucgaccguuac

SEQ ID NO: 67311 - RNA, 20 nt, Artificial Sequence
  MKO10067311_A_NTCmmu_0906
  gRNA
gacaguuggauaaccguguc

SEQ ID NO: 67312 - RNA, 20 nt, Artificial Sequence
  MKO10067312_A_NTCmmu_0907
  gRNA
auggacccuucagugcggua

SEQ ID NO: 67313 - RNA, 20 nt, Artificial Sequence
  MKO10067313_A_NTCmmu_0908
  gRNA
cgagagaaucguccgucaua

SEQ ID NO: 67314 - RNA, 20 nt, Artificial Sequence
  MKO10067314_A_NTCmmu_0909
  gRNA
accguacaagacucgcucca

SEQ ID NO: 67315 - RNA, 20 nt, Artificial Sequence
  MKO10067315_A_NTCmmu_0910
  gRNA
ccgaccgugugagaguacgu

SEQ ID NO: 67316 - RNA, 20 nt, Artificial Sequence
  MKO10067316_A_NTCmmu_0911
  gRNA
gguaacauaggcggcgaucu

SEQ ID NO: 67317 - RNA, 20 nt, Artificial Sequence
  MKO10067317_A_NTCmmu_0912
  gRNA
cucuaauaaaccgcacaagc

SEQ ID NO: 67318 - RNA, 20 nt, Artificial Sequence
  MKO10067318_A_NTCmmu_0913
  gRNA
auacgcauagaucgguaagc

SEQ ID NO: 67319 - RNA, 20 nt, Artificial Sequence
  MKO10067319_A_NTCmmu_0914
  gRNA
gcgauuaucaguaguccacg

SEQ ID NO: 67320 - RNA, 20 nt, Artificial Sequence
  MKO10067320_A_NTCmmu_0915
  gRNA
ugguuggcaugucgccagcg

SEQ ID NO: 67321 - RNA, 20 nt, Artificial Sequence
  MKO10067321_A_NTCmmu_0916
  gRNA
gggcuagugcguuguuacga

SEQ ID NO: 67322 - RNA, 20 nt, Artificial Sequence
  MKO10067322_A_NTCmmu_0917
  gRNA
aagccuacuucaccggucgg

SEQ ID NO: 67323 - RNA, 20 nt, Artificial Sequence
  MKO10067323_A_NTCmmu_0918
  gRNA
cgacgaccuuggauuggcag

SEQ ID NO: 67324 - RNA, 20 nt, Artificial Sequence
  MKO10067324_A_NTCmmu_0919
  gRNA
ucgcugagcaacgaagcaac

SEQ ID NO: 67325 - RNA, 20 nt, Artificial Sequence
  MKO10067325_A_NTCmmu_0920
  gRNA
ccaacaucggggcgcauaau

SEQ ID NO: 67326 - RNA, 20 nt, Artificial Sequence
  MKO10067326_A_NTCmmu_0921
  gRNA
agcguucgcagcuggucaac

SEQ ID NO: 67327 - RNA, 20 nt, Artificial Sequence
  MKO10067327_A_NTCmmu_0922
  gRNA
aaguccccuucgggaacucc

SEQ ID NO: 67328 - RNA, 20 nt, Artificial Sequence
  MKO10067328_A_NTCmmu_0923
  gRNA
caugggacccccccucacgu

SEQ ID NO: 67329 - RNA, 20 nt, Artificial Sequence
  MKO10067329_A_NTCmmu_0924
  gRNA
cgucgcauguuguugcucau

SEQ ID NO: 67330 - RNA, 20 nt, Artificial Sequence
  MKO10067330_A_NTCmmu_0925
  gRNA
gcuccaggugcgagauaggc

SEQ ID NO: 67331 - RNA, 20 nt, Artificial Sequence
  MKO10067331_A_NTCmmu_0926
  gRNA
ucggacuauagcgugaacgu

SEQ ID NO: 67332 - RNA, 20 nt, Artificial Sequence
  MKO10067332_A_NTCmmu_0927
  gRNA
gggucgcaccccaauagcug

SEQ ID NO: 67333 - RNA, 20 nt, Artificial Sequence
  MKO10067333_A_NTCmmu_0928
  gRNA
aagacuccuacguaucgagc

SEQ ID NO: 67334 - RNA, 20 nt, Artificial Sequence
  MKO10067334_A_NTCmmu_0929
  gRNA
gccagccucgguauaacucg

SEQ ID NO: 67335 - RNA, 20 nt, Artificial Sequence
  MKO10067335_A_NTCmmu_0930
  gRNA
cgucauggcaagaucgauaa

SEQ ID NO: 67336 - RNA, 20 nt, Artificial Sequence
  MKO10067336_A_NTCmmu_0931
  gRNA
cuaauacacuccuucuccgc

SEQ ID NO: 67337 - RNA, 20 nt, Artificial Sequence
  MKO10067337_A_NTCmmu_0932
  gRNA
gucguggggcacgaugcgua

SEQ ID NO: 67338 - RNA, 20 nt, Artificial Sequence
  MKO10067338_A_NTCmmu_0933
  gRNA
ucgagucuugacucaacgcu

SEQ ID NO: 67339 - RNA, 20 nt, Artificial Sequence
  MKO10067339_A_NTCmmu_0934
  gRNA
cucggagauucguuagaaga

SEQ ID NO: 67340 - RNA, 20 nt, Artificial Sequence
  MKO10067340_A_NTCmmu_0935
  gRNA
uugucgcuaacucagaauag

SEQ ID NO: 67341 - RNA, 20 nt, Artificial Sequence
  MKO10067341_A_NTCmmu_0936
  gRNA
aauucugagauuccgcggcu

SEQ ID NO: 67342 - RNA, 20 nt, Artificial Sequence
  MKO10067342_A_NTCmmu_0937
  gRNA
gauuccguauaguaaucgag

SEQ ID NO: 67343 - RNA, 20 nt, Artificial Sequence
  MKO10067343_A_NTCmmu_0938
  gRNA
gauagaacaacagcggugca

SEQ ID NO: 67344 - RNA, 20 nt, Artificial Sequence
  MKO10067344_A_NTCmmu_0939
  gRNA
cgguaaggucggucuccauc

SEQ ID NO: 67345 - RNA, 20 nt, Artificial Sequence
  MKO10067345_A_NTCmmu_0940
  gRNA
augaccucuucguucgagag

SEQ ID NO: 67346 - RNA, 20 nt, Artificial Sequence
  MKO10067346_A_NTCmmu_0941
  gRNA
ugauccccgucccgaaguua

SEQ ID NO: 67347 - RNA, 20 nt, Artificial Sequence
  MKO10067347_A_NTCmmu_0942
  gRNA
ugcuuuaccgcguuggguaa

SEQ ID NO: 67348 - RNA, 20 nt, Artificial Sequence
  MKO10067348_A_NTCmmu_0943
  gRNA
aucuuaaccagcgcaucccg

SEQ ID NO: 67349 - RNA, 20 nt, Artificial Sequence
  MKO10067349_A_NTCmmu_0944
  gRNA
gcgcuacucccaccgauguu

SEQ ID NO: 67350 - RNA, 20 nt, Artificial Sequence
  MKO10067350_A_NTCmmu_0945
  gRNA
ccugcuauucucgcaugcga

SEQ ID NO: 67351 - RNA, 20 nt, Artificial Sequence
  MKO10067351_A_NTCmmu_0946
  gRNA
gagauucgauacugcgguca

SEQ ID NO: 67352 - RNA, 20 nt, Artificial Sequence
  MKO10067352_A_NTCmmu_0947
  gRNA
ucgcucauuaggagcgcuau

SEQ ID NO: 67353 - RNA, 20 nt, Artificial Sequence
  MKO10067353_A_NTCmmu_0948
  gRNA
ccuccuucaguucgaucugg

SEQ ID NO: 67354 - RNA, 20 nt, Artificial Sequence
  MKO10067354_A_NTCmmu_0949
  gRNA
gcgcucguucgagacgaucu

SEQ ID NO: 67355 - RNA, 20 nt, Artificial Sequence
  MKO10067355_A_NTCmmu_0950
  gRNA
auccacgcuccgcgguacuu

SEQ ID NO: 67356 - RNA, 20 nt, Artificial Sequence
  MKO10067356_A_NTCmmu_0951
  gRNA
ggguagcaccccgccgacac

SEQ ID NO: 67357 - RNA, 20 nt, Artificial Sequence
  MKO10067357_A_NTCmmu_0952
  gRNA
ucacaugacacucguuacga

SEQ ID NO: 67358 - RNA, 20 nt, Artificial Sequence
  MKO10067358_A_NTCmmu_0953
  gRNA
gcgccuaggguuccgacuca

SEQ ID NO: 67359 - RNA, 20 nt, Artificial Sequence
  MKO10067359_A_NTCmmu_0954
  gRNA
cuacgagauucggcuaagcu

SEQ ID NO: 67360 - RNA, 20 nt, Artificial Sequence
  MKO10067360_A_NTCmmu_0955
  gRNA
uacggacgucgaauugagca

SEQ ID NO: 67361 - RNA, 20 nt, Artificial Sequence
  MKO10067361_A_NTCmmu_0956
  gRNA
acuaaggagucccgguccga

SEQ ID NO: 67362 - RNA, 20 nt, Artificial Sequence
  MKO10067362_A_NTCmmu_0957
  gRNA
ugcccugcguccgcuacguc

SEQ ID NO: 67363 - RNA, 20 nt, Artificial Sequence
  MKO10067363_A_NTCmmu_0958
  gRNA
cuggggccgcugaaccgccg

SEQ ID NO: 67364 - RNA, 20 nt, Artificial Sequence
  MKO10067364_A_NTCmmu_0959
  gRNA
agacucgugugccacgagga

SEQ ID NO: 67365 - RNA, 20 nt, Artificial Sequence
  MKO10067365_A_NTCmmu_0960
  gRNA
ucgcuucugauugauccacg

SEQ ID NO: 67366 - RNA, 20 nt, Artificial Sequence
  MKO10067366_A_NTCmmu_0961
  gRNA
uucggcuggugugcguucac

SEQ ID NO: 67367 - RNA, 20 nt, Artificial Sequence
  MKO10067367_A_NTCmmu_0962
  gRNA
cuacccccgcugugcaacgu

SEQ ID NO: 67368 - RNA, 20 nt, Artificial Sequence
  MKO10067368_A_NTCmmu_0963
  gRNA
caccuauuccccuccgcaac

SEQ ID NO: 67369 - RNA, 20 nt, Artificial Sequence
  MKO10067369_A_NTCmmu_0964
  gRNA
ggucuagauaaucuuaccga

SEQ ID NO: 67370 - RNA, 20 nt, Artificial Sequence
  MKO10067370_A_NTCmmu_0965
  gRNA
agcgccauaggacgccaaac

SEQ ID NO: 67371 - RNA, 20 nt, Artificial Sequence
  MKO10067371_A_NTCmmu_0966
  gRNA
ucguugugucgacauccgca

SEQ ID NO: 67372 - RNA, 20 nt, Artificial Sequence
  MKO10067372_A_NTCmmu_0967
  gRNA
uacaucgaacaaccaaccga

SEQ ID NO: 67373 - RNA, 20 nt, Artificial Sequence
  MKO10067373_A_NTCmmu_0968
  gRNA
uugcacccccaguucguugc

SEQ ID NO: 67374 - RNA, 20 nt, Artificial Sequence
  MKO10067374_A_NTCmmu_0969
  gRNA
cucguaucuuuucccacggc

SEQ ID NO: 67375 - RNA, 20 nt, Artificial Sequence
  MKO10067375_A_NTCmmu_0970
  gRNA
acccagauucgcauucggau

SEQ ID NO: 67376 - RNA, 20 nt, Artificial Sequence
  MKO10067376_A_NTCmmu_0971
  gRNA
cgccuaguaucuucggggau

SEQ ID NO: 67377 - RNA, 20 nt, Artificial Sequence
  MKO10067377_A_NTCmmu_0972
  gRNA
aaggguaaguacaguaucgu

SEQ ID NO: 67378 - RNA, 20 nt, Artificial Sequence
  MKO10067378_A_NTCmmu_0973
  gRNA
ugcaguagucgcggauaggc

SEQ ID NO: 67379 - RNA, 20 nt, Artificial Sequence
  MKO10067379_A_NTCmmu_0974
  gRNA
cgcacuucuaguagcugucg

SEQ ID NO: 67380 - RNA, 20 nt, Artificial Sequence
  MKO10067380_A_NTCmmu_0975
  gRNA
gugcgcgcguauagaaaaaa

SEQ ID NO: 67381 - RNA, 20 nt, Artificial Sequence
  MKO10067381_A_NTCmmu_0976
  gRNA
gcgugguacucacaucgcga

SEQ ID NO: 67382 - RNA, 20 nt, Artificial Sequence
  MKO10067382_A_NTCmmu_0977
  gRNA
ggcccgaagggucacaagcg

SEQ ID NO: 67383 - RNA, 20 nt, Artificial Sequence
  MKO10067383_A_NTCmmu_0978
  gRNA
ccgauaccauugucaccaau

SEQ ID NO: 67384 - RNA, 20 nt, Artificial Sequence
  MKO10067384_A_NTCmmu_0979
  gRNA
ccuccaguagcgucauuaac

SEQ ID NO: 67385 - RNA, 20 nt, Artificial Sequence
  MKO10067385_A_NTCmmu_0980
  gRNA
gcgugagauucguugcucga

SEQ ID NO: 67386 - RNA, 20 nt, Artificial Sequence
  MKO10067386_A_NTCmmu_0981
  gRNA
gaggcgggcucuucuaucgu

SEQ ID NO: 67387 - RNA, 20 nt, Artificial Sequence
  MKO10067387_A_NTCmmu_0982
  gRNA
uucgagauuuuaauagcgca

SEQ ID NO: 67388 - RNA, 20 nt, Artificial Sequence
  MKO10067388_A_NTCmmu_0983
  gRNA
accgucugauguucccggcu

SEQ ID NO: 67389 - RNA, 20 nt, Artificial Sequence
  MKO10067389_A_NTCmmu_0984
  gRNA
cucgugaaccuguucgcgca

SEQ ID NO: 67390 - RNA, 20 nt, Artificial Sequence
  MKO10067390_A_NTCmmu_0985
  gRNA
ugagggcucaauacuuccgc

SEQ ID NO: 67391 - RNA, 20 nt, Artificial Sequence
  MKO10067391_A_NTCmmu_0986
  gRNA
gcgacaagcguugaguucgc

SEQ ID NO: 67392 - RNA, 20 nt, Artificial Sequence
  MKO10067392_A_NTCmmu_0987
  gRNA
aacuccucaucguacgcuaa

SEQ ID NO: 67393 - RNA, 20 nt, Artificial Sequence
  MKO10067393_A_NTCmmu_0988
  gRNA
cacgaauaacuacagguugc

SEQ ID NO: 67394 - RNA, 20 nt, Artificial Sequence
  MKO10067394_A_NTCmmu_0989
  gRNA
gaggaccuagguucccggau

SEQ ID NO: 67395 - RNA, 20 nt, Artificial Sequence
  MKO10067395_A_NTCmmu_0990
  gRNA
uaaaaacgcuggcggccuag

SEQ ID NO: 67396 - RNA, 20 nt, Artificial Sequence
  MKO10067396_A_NTCmmu_0991
  gRNA
guuaaguagaucggugacau

SEQ ID NO: 67397 - RNA, 20 nt, Artificial Sequence
  MKO10067397_A_NTCmmu_0992
  gRNA
ggcgucguaacaagaacuug

SEQ ID NO: 67398 - RNA, 20 nt, Artificial Sequence
  MKO10067398_A_NTCmmu_0993
  gRNA
gugcgaauuaaccguuagga

SEQ ID NO: 67399 - RNA, 20 nt, Artificial Sequence
  MKO10067399_A_NTCmmu_0994
  gRNA
guagcuucauguccggucgg

SEQ ID NO: 67400 - RNA, 20 nt, Artificial Sequence
  MKO10067400_A_NTCmmu_0995
  gRNA
ggccaguguggccguuacgc

SEQ ID NO: 67401 - RNA, 20 nt, Artificial Sequence
  MKO10067401_A_NTCmmu_0996
  gRNA
cuucacgccuuggaccgaua

SEQ ID NO: 67402 - RNA, 20 nt, Artificial Sequence
  MKO10067402_A_NTCmmu_0997
  gRNA
auaacuuaugcgcuucgggg

SEQ ID NO: 67403 - RNA, 20 nt, Artificial Sequence
  MKO10067403_A_NTCmmu_0998
  gRNA
acccacguauguacucggga

SEQ ID NO: 67404 - RNA, 20 nt, Artificial Sequence
  MKO10067404_A_NTCmmu_0999
  gRNA
gaacucguuaggccgugaag

SEQ ID NO: 67405 - RNA, 20 nt, Artificial Sequence
  MKO10067405_A_NTCmmu_1000
  gRNA
cgaggcuuaacgccagauuc

SEQ ID NO: 67406 - RNA, 20 nt, Artificial Sequence
  MKO10067406_B_0610007P14Rik
  gRNA
ugucuaagguuucucaaucc

SEQ ID NO: 67407 - RNA, 20 nt, Artificial Sequence
  MKO10067407_B_0610007P14Rik
  gRNA
cagugaauggccuccaagcc

SEQ ID NO: 67408 - RNA, 20 nt, Artificial Sequence
  MKO10067408_B_0610007P14Rik
  gRNA
ggugcuuacuugcuaccauc

SEQ ID NO: 67409 - RNA, 20 nt, Artificial Sequence
  MKO10067409_B_0610009B22Rik
  gRNA
accucgucgacgaaaacaug

SEQ ID NO: 67410 - RNA, 20 nt, Artificial Sequence
  MKO10067410_B_0610009B22Rik
  gRNA
guucauagcucaugcugcuc

SEQ ID NO: 67411 - RNA, 20 nt, Artificial Sequence
  MKO10067411_B_0610009B22Rik
  gRNA
gagcagcaugagcuaugaac

SEQ ID NO: 67412 - RNA, 20 nt, Artificial Sequence
  MKO10067412_B_0610009D07Rik
  gRNA
cguuuguaacagauaccuug

SEQ ID NO: 67413 - RNA, 20 nt, Artificial Sequence
  MKO10067413_B_0610009D07Rik
  gRNA
cgccaagauggcgaugcaag

SEQ ID NO: 67414 - RNA, 20 nt, Artificial Sequence
  MKO10067414_B_0610009D07Rik
  gRNA
guggcugucauucacuuggg

SEQ ID NO: 67415 - RNA, 20 nt, Artificial Sequence
  MKO10067415_B_0610009O20Rik
  gRNA
cacagcucuuccccgccugc

SEQ ID NO: 67416 - RNA, 20 nt, Artificial Sequence
  MKO10067416_B_0610009O20Rik
  gRNA
gauccacuuccacgccccuc

SEQ ID NO: 67417 - RNA, 20 nt, Artificial Sequence
  MKO10067417_B_0610009O20Rik
  gRNA
uucggaggcauguucuuccc

SEQ ID NO: 67418 - RNA, 20 nt, Artificial Sequence
  MKO10067418_B_0610010B08Rik
  gRNA
acuggguuuagguuacauuu

SEQ ID NO: 67419 - RNA, 20 nt, Artificial Sequence
  MKO10067419_B_0610010B08Rik
  gRNA
cuccuguauauguucgcuua

SEQ ID NO: 67420 - RNA, 20 nt, Artificial Sequence
  MKO10067420_B_0610010B08Rik
  gRNA
cccucugaguuuauucaaug

SEQ ID NO: 67421 - RNA, 20 nt, Artificial Sequence
  MKO10067421_B_0610010F05Rik
  gRNA
auauguuaaacggaacacua

SEQ ID NO: 67422 - RNA, 20 nt, Artificial Sequence
  MKO10067422_B_0610010F05Rik
  gRNA
caaccaguauaacccuuuaa

SEQ ID NO: 67423 - RNA, 20 nt, Artificial Sequence
  MKO10067423_B_0610010F05Rik
  gRNA
gacauaguauagcuaccaca

SEQ ID NO: 67424 - RNA, 20 nt, Artificial Sequence
  MKO10067424_B_0610010K14Rik
  gRNA
caugacgucagcguccacca

SEQ ID NO: 67425 - RNA, 20 nt, Artificial Sequence
  MKO10067425_B_0610010K14Rik
  gRNA
gacaccggacgucaucuucu

SEQ ID NO: 67426 - RNA, 20 nt, Artificial Sequence
  MKO10067426_B_0610010K14Rik
  gRNA
cugcuggguggaggggcguu

SEQ ID NO: 67427 - RNA, 20 nt, Artificial Sequence
  MKO10067427_B_0610011F06Rik
  gRNA
ggucaaaguccacguugcuc

SEQ ID NO: 67428 - RNA, 20 nt, Artificial Sequence
  MKO10067428_B_0610011F06Rik
  gRNA
gugucacgaagcccccacuc

SEQ ID NO: 67429 - RNA, 20 nt, Artificial Sequence
  MKO10067429_B_0610011F06Rik
  gRNA
gcuucgugacacaguccuuc

SEQ ID NO: 67430 - RNA, 20 nt, Artificial Sequence
  MKO10067430_B_0610012H03Rik
  gRNA
auuagcacaguuugacacuc

SEQ ID NO: 67431 - RNA, 20 nt, Artificial Sequence
  MKO10067431_B_0610012H03Rik
  gRNA
auuucucagcagccgccuca

SEQ ID NO: 67432 - RNA, 20 nt, Artificial Sequence
  MKO10067432_B_0610012H03Rik
  gRNA
cugcucaaaagauggccaug

SEQ ID NO: 67433 - RNA, 20 nt, Artificial Sequence
  MKO10067433_B_0610030E20Rik
  gRNA
cagggacgacuacgacaaga

SEQ ID NO: 67434 - RNA, 20 nt, Artificial Sequence
  MKO10067434_B_0610030E20Rik
  gRNA
ggcccucagaucgcgaaucc

SEQ ID NO: 67435 - RNA, 20 nt, Artificial Sequence
  MKO10067435_B_0610030E20Rik
  gRNA
guguaccugccgcgccaccg

SEQ ID NO: 67436 - RNA, 20 nt, Artificial Sequence
  MKO10067436_B_0610031J06Rik
  gRNA
cguguuccagguaucuaugg

SEQ ID NO: 67437 - RNA, 20 nt, Artificial Sequence
  MKO10067437_B_0610031J06Rik
  gRNA
cuugaacaauuggugaauga

SEQ ID NO: 67438 - RNA, 20 nt, Artificial Sequence
  MKO10067438_B_0610031J06Rik
  gRNA
auaugcaccugccgucuucc

SEQ ID NO: 67439 - RNA, 20 nt, Artificial Sequence
  MKO10067439_B_0610037L13Rik
  gRNA
cagagaaguggcaauacauc

SEQ ID NO: 67440 - RNA, 20 nt, Artificial Sequence
  MKO10067440_B_0610037L13Rik
  gRNA
accaguugacuuccagcccc

SEQ ID NO: 67441 - RNA, 20 nt, Artificial Sequence
  MKO10067441_B_0610037L13Rik
  gRNA
acuuacguuguaagccuuga

SEQ ID NO: 67442 - RNA, 20 nt, Artificial Sequence
  MKO10067442_B_0610040J01Rik
  gRNA
ucccacucacccuacgccag

SEQ ID NO: 67443 - RNA, 20 nt, Artificial Sequence
  MKO10067443_B_0610040J01Rik
  gRNA
gcauuagaagcugcuaccgc

SEQ ID NO: 67444 - RNA, 20 nt, Artificial Sequence
  MKO10067444_B_0610040J01Rik
  gRNA
ucacuuccagaaucagccgc

SEQ ID NO: 67445 - RNA, 20 nt, Artificial Sequence
  MKO10067445_B_mmuMarch1
  gRNA
cccaggaucugucacugcga

SEQ ID NO: 67446 - RNA, 20 nt, Artificial Sequence
  MKO10067446_B_mmuMarch1
  gRNA
caccagcguggagguuugag

SEQ ID NO: 67447 - RNA, 20 nt, Artificial Sequence
  MKO10067447_B_mmuMarch1
  gRNA
ugccucucaaaccuccacgc

SEQ ID NO: 67448 - RNA, 20 nt, Artificial Sequence
  MKO10067448_B_mmuSep1
  gRNA
ugacagacuugcgaugcagc

SEQ ID NO: 67449 - RNA, 20 nt, Artificial Sequence
  MKO10067449_B_mmuSep1
  gRNA
gcaucgcaagucugucaaga

SEQ ID NO: 67450 - RNA, 20 nt, Artificial Sequence
  MKO10067450_B_mmuSep1
  gRNA
aaacucugaccauugagcgc

SEQ ID NO: 67451 - RNA, 20 nt, Artificial Sequence
  MKO10067451_B_mmuMarch10
  gRNA
ucagcgauguucaguaucua

SEQ ID NO: 67452 - RNA, 20 nt, Artificial Sequence
  MKO10067452_B_mmuMarch10
  gRNA
uaagguggacucagaauauc

SEQ ID NO: 67453 - RNA, 20 nt, Artificial Sequence
  MKO10067453_B_mmuMarch10
  gRNA
aagcccccugagccccuugc

SEQ ID NO: 67454 - RNA, 20 nt, Artificial Sequence
  MKO10067454_B_mmuSep10
  gRNA
guucauugcuccauugaucu

SEQ ID NO: 67455 - RNA, 20 nt, Artificial Sequence
  MKO10067455_B_mmuSep10
  gRNA
ucaagcgaacauugcuuucc

SEQ ID NO: 67456 - RNA, 20 nt, Artificial Sequence
  MKO10067456_B_mmuSep10
  gRNA
ccacacauagacaaggagcg

SEQ ID NO: 67457 - RNA, 20 nt, Artificial Sequence
  MKO10067457_B_mmuMarch11
  gRNA
uuaaauccuugccgauguga

SEQ ID NO: 67458 - RNA, 20 nt, Artificial Sequence
  MKO10067458_B_mmuMarch11
  gRNA
aucgaacagacccaucacau

SEQ ID NO: 67459 - RNA, 20 nt, Artificial Sequence
  MKO10067459_B_mmuMarch11
  gRNA
uaucuuccgauacaucuuca

SEQ ID NO: 67460 - RNA, 20 nt, Artificial Sequence
  MKO10067460_B_mmuSep11
  gRNA
ccuuuacuuuaucgccccca

SEQ ID NO: 67461 - RNA, 20 nt, Artificial Sequence
  MKO10067461_B_mmuSep11
  gRNA
gcgucaauguauuccacuau

SEQ ID NO: 67462 - RNA, 20 nt, Artificial Sequence
  MKO10067462_B_mmuSep11
  gRNA
ugacagucugcccgaccagc

SEQ ID NO: 67463 - RNA, 20 nt, Artificial Sequence
  MKO10067463_B_1100001G20Rik
  gRNA
gcuaggagccuuccuucugu

SEQ ID NO: 67464 - RNA, 20 nt, Artificial Sequence
  MKO10067464_B_1100001G20Rik
  gRNA
accacggcagagcucagcac

SEQ ID NO: 67465 - RNA, 20 nt, Artificial Sequence
  MKO10067465_B_1100001G20Rik
  gRNA
ugaugagggacaccaacaga

SEQ ID NO: 67466 - RNA, 20 nt, Artificial Sequence
  MKO10067466_B_1110001A16Rik
  gRNA
caagaaauuuccauucauuu

SEQ ID NO: 67467 - RNA, 20 nt, Artificial Sequence
  MKO10067467_B_1110001A16Rik
  gRNA
uggaguuagagagaaagaug

SEQ ID NO: 67468 - RNA, 20 nt, Artificial Sequence
  MKO10067468_B_1110001A16Rik
  gRNA
auacauuccagacuguucaa

SEQ ID NO: 67469 - RNA, 20 nt, Artificial Sequence
  MKO10067469_B_1110001J03Rik
  gRNA
cuccaguugccccgucagcc

SEQ ID NO: 67470 - RNA, 20 nt, Artificial Sequence
  MKO10067470_B_1110001J03Rik
  gRNA
gaugccguacccgaugugcu

SEQ ID NO: 67471 - RNA, 20 nt, Artificial Sequence
  MKO10067471_B_1110001J03Rik
  gRNA
agccuuaacgagguaccggu

SEQ ID NO: 67472 - RNA, 20 nt, Artificial Sequence
  MKO10067472_B_1110004E09Rik
  gRNA
gaccuuagacacuaucgccu

SEQ ID NO: 67473 - RNA, 20 nt, Artificial Sequence
  MKO10067473_B_1110004E09Rik
  gRNA
cguaaaaacagacccuccac

SEQ ID NO: 67474 - RNA, 20 nt, Artificial Sequence
  MKO10067474_B_1110004E09Rik
  gRNA
uuucugcccccuaauaugca

SEQ ID NO: 67475 - RNA, 20 nt, Artificial Sequence
  MKO10067475_B_1110004F10Rik
  gRNA
gucucaccucacugaagccg

SEQ ID NO: 67476 - RNA, 20 nt, Artificial Sequence
  MKO10067476_B_1110004F10Rik
  gRNA
uucuuacagaaagaacacac

SEQ ID NO: 67477 - RNA, 20 nt, Artificial Sequence
  MKO10067477_B_1110004F10Rik
  gRNA
acaaaaguucuugagacuca

SEQ ID NO: 67478 - RNA, 20 nt, Artificial Sequence
  MKO10067478_B_1110007C09Rik
  gRNA
cgacccugucccgucaggaa

SEQ ID NO: 67479 - RNA, 20 nt, Artificial Sequence
  MKO10067479_B_1110007C09Rik
  gRNA
agagccgugagcugagugac

SEQ ID NO: 67480 - RNA, 20 nt, Artificial Sequence
  MKO10067480_B_1110007C09Rik
  gRNA
ggagggccaggcccgcugcc

SEQ ID NO: 67481 - RNA, 20 nt, Artificial Sequence
  MKO10067481_B_1110008F13Rik
  gRNA
agggccccguuggccagcug

SEQ ID NO: 67482 - RNA, 20 nt, Artificial Sequence
  MKO10067482_B_1110008F13Rik
  gRNA
uauucccaagaagccucgca

SEQ ID NO: 67483 - RNA, 20 nt, Artificial Sequence
  MKO10067483_B_1110008F13Rik
  gRNA
aaaccagagcgaugaucugu

SEQ ID NO: 67484 - RNA, 20 nt, Artificial Sequence
  MKO10067484_B_1110008J03Rik
  gRNA
agagagcccuucgguggucc

SEQ ID NO: 67485 - RNA, 20 nt, Artificial Sequence
  MKO10067485_B_1110008J03Rik
  gRNA
accgcagucccaccagcuac

SEQ ID NO: 67486 - RNA, 20 nt, Artificial Sequence
  MKO10067486_B_1110008J03Rik
  gRNA
aguccccggccuaacacauc

SEQ ID NO: 67487 - RNA, 20 nt, Artificial Sequence
  MKO10067487_B_1110008L16Rik
  gRNA
ccagcaacuguagauucugc

SEQ ID NO: 67488 - RNA, 20 nt, Artificial Sequence
  MKO10067488_B_1110008L16Rik
  gRNA
guaguaucccuggaagacaa

SEQ ID NO: 67489 - RNA, 20 nt, Artificial Sequence
  MKO10067489_B_1110008L16Rik
  gRNA
ccagcagaaucuacaguugc

SEQ ID NO: 67490 - RNA, 20 nt, Artificial Sequence
  MKO10067490_B_1110008P14Rik
  gRNA
ccuaggcaugccgguggaug

SEQ ID NO: 67491 - RNA, 20 nt, Artificial Sequence
  MKO10067491_B_1110008P14Rik
  gRNA
ccuuccgugcccgcauccac

SEQ ID NO: 67492 - RNA, 20 nt, Artificial Sequence
  MKO10067492_B_1110008P14Rik
  gRNA
agaguugaucugauccaaca

SEQ ID NO: 67493 - RNA, 20 nt, Artificial Sequence
  MKO10067493_B_1110012L19Rik
  gRNA
ugccauccacauugcucaca

SEQ ID NO: 67494 - RNA, 20 nt, Artificial Sequence
  MKO10067494_B_1110012L19Rik
  gRNA
ucaagacucuugagacacgu

SEQ ID NO: 67495 - RNA, 20 nt, Artificial Sequence
  MKO10067495_B_1110012L19Rik
  gRNA
aguuucccugccuauccuuc

SEQ ID NO: 67496 - RNA, 20 nt, Artificial Sequence
  MKO10067496_B_1110017D15Rik
  gRNA
gucaguucgaggaaugccgu

SEQ ID NO: 67497 - RNA, 20 nt, Artificial Sequence
  MKO10067497_B_1110017D15Rik
  gRNA
gaugaccaaaugugccgcac

SEQ ID NO: 67498 - RNA, 20 nt, Artificial Sequence
  MKO10067498_B_1110017D15Rik
  gRNA
ucagacuaugcaccgccacg

SEQ ID NO: 67499 - RNA, 20 nt, Artificial Sequence
  MKO10067499_B_1110025L11Rik
  gRNA
uacuauggcggcagaggcua

SEQ ID NO: 67500 - RNA, 20 nt, Artificial Sequence
  MKO10067500_B_1110025L11Rik
  gRNA
aggagccauagccacagccc

SEQ ID NO: 67501 - RNA, 20 nt, Artificial Sequence
  MKO10067501_B_1110025L11Rik
  gRNA
cugcuguggcuauggaggcc

SEQ ID NO: 67502 - RNA, 20 nt, Artificial Sequence
  MKO10067502_B_1110032A03Rik
  gRNA
caccuacuauguguugauug

SEQ ID NO: 67503 - RNA, 20 nt, Artificial Sequence
  MKO10067503_B_1110032A03Rik
  gRNA
gauuuaaacgagagccucac

SEQ ID NO: 67504 - RNA, 20 nt, Artificial Sequence
  MKO10067504_B_1110032A03Rik
  gRNA
uccaagcgugagccagucuu

SEQ ID NO: 67505 - RNA, 20 nt, Artificial Sequence
  MKO10067505_B_1110032F04Rik
  gRNA
uggcguugguggcgcccucg

SEQ ID NO: 67506 - RNA, 20 nt, Artificial Sequence
  MKO10067506_B_1110032F04Rik
  gRNA
uggccacgcggguaccugcg

SEQ ID NO: 67507 - RNA, 20 nt, Artificial Sequence
  MKO10067507_B_1110032F04Rik
  gRNA
gggugcgggaccgccgggga

SEQ ID NO: 67508 - RNA, 20 nt, Artificial Sequence
  MKO10067508_B_1110034G24Rik
  gRNA
uccuucuucgaaaggccagu

SEQ ID NO: 67509 - RNA, 20 nt, Artificial Sequence
  MKO10067509_B_1110034G24Rik
  gRNA
caggucaucuucagccggga

SEQ ID NO: 67510 - RNA, 20 nt, Artificial Sequence
  MKO10067510_B_1110034G24Rik
  gRNA
ucuucuucgacuacugaucc

SEQ ID NO: 67511 - RNA, 20 nt, Artificial Sequence
  MKO10067511_B_1110037F02Rik
  gRNA
ccacuaugggcucguacucc

SEQ ID NO: 67512 - RNA, 20 nt, Artificial Sequence
  MKO10067512_B_1110037F02Rik
  gRNA
cuucccaaccuaucaaaaac

SEQ ID NO: 67513 - RNA, 20 nt, Artificial Sequence
  MKO10067513_B_1110037F02Rik
  gRNA
agccacagccgacuuugaaa

SEQ ID NO: 67514 - RNA, 20 nt, Artificial Sequence
  MKO10067514_B_1110038F14Rik
  gRNA
caccagccuuuagagcccgu

SEQ ID NO: 67515 - RNA, 20 nt, Artificial Sequence
  MKO10067515_B_1110038F14Rik
  gRNA
ccagguacagcucgucagug

SEQ ID NO: 67516 - RNA, 20 nt, Artificial Sequence
  MKO10067516_B_1110038F14Rik
  gRNA
ccuuccuacagccacccauu

SEQ ID NO: 67517 - RNA, 20 nt, Artificial Sequence
  MKO10067517_B_1110051M20Rik
  gRNA
cugcauccuccauguacgug

SEQ ID NO: 67518 - RNA, 20 nt, Artificial Sequence
  MKO10067518_B_1110051M20Rik
  gRNA
agcaucuccagaaggcccga

SEQ ID NO: 67519 - RNA, 20 nt, Artificial Sequence
  MKO10067519_B_1110051M20Rik
  gRNA
cucccccaggauugugcuca

SEQ ID NO: 67520 - RNA, 20 nt, Artificial Sequence
  MKO10067520_B_1110057K04Rik
  gRNA
ucauauaggugccuacggaa

SEQ ID NO: 67521 - RNA, 20 nt, Artificial Sequence
  MKO10067521_B_1110057K04Rik
  gRNA
ugcaaauggcacguagaaug

SEQ ID NO: 67522 - RNA, 20 nt, Artificial Sequence
  MKO10067522_B_1110057K04Rik
  gRNA
agaaagaacuccucacgcac

SEQ ID NO: 67523 - RNA, 20 nt, Artificial Sequence
  MKO10067523_B_1110058L19Rik
  gRNA
ucccagucuccauaucgugu

SEQ ID NO: 67524 - RNA, 20 nt, Artificial Sequence
  MKO10067524_B_1110058L19Rik
  gRNA
ccacgacccuuuccguuuca

SEQ ID NO: 67525 - RNA, 20 nt, Artificial Sequence
  MKO10067525_B_1110058L19Rik
  gRNA
aagaagucaaagcugccacu

SEQ ID NO: 67526 - RNA, 20 nt, Artificial Sequence
  MKO10067526_B_1110059E24Rik
  gRNA
cacugucaaagccuaagaag

SEQ ID NO: 67527 - RNA, 20 nt, Artificial Sequence
  MKO10067527_B_1110059E24Rik
  gRNA
cuugaaguuugugccaaaug

SEQ ID NO: 67528 - RNA, 20 nt, Artificial Sequence
  MKO10067528_B_1110059E24Rik
  gRNA
accgagucacguugccuuuc

SEQ ID NO: 67529 - RNA, 20 nt, Artificial Sequence
  MKO10067529_B_1110059G10Rik
  gRNA
uaaacuauucuuccaucagc

SEQ ID NO: 67530 - RNA, 20 nt, Artificial Sequence
  MKO10067530_B_1110059G10Rik
  gRNA
ucaugaccucuucagcuguu

SEQ ID NO: 67531 - RNA, 20 nt, Artificial Sequence
  MKO10067531_B_1110059G10Rik
  gRNA
uccucagaugaaaaguguuc

SEQ ID NO: 67532 - RNA, 20 nt, Artificial Sequence
  MKO10067532_B_1110059M19Rik
  gRNA
uauaucccuacgcuuagauc

SEQ ID NO: 67533 - RNA, 20 nt, Artificial Sequence
  MKO10067533_B_1110059M19Rik
  gRNA
aggggaggaccaaaucgcag

SEQ ID NO: 67534 - RNA, 20 nt, Artificial Sequence
  MKO10067534_B_1110059M19Rik
  gRNA
caaggcacccuauggauaau

SEQ ID NO: 67535 - RNA, 20 nt, Artificial Sequence
  MKO10067535_B_1110065P20Rik
  gRNA
gcacugaccccgccaccagc

SEQ ID NO: 67536 - RNA, 20 nt, Artificial Sequence
  MKO10067536_B_1110065P20Rik
  gRNA
cuggggcggcgcuccagacu

SEQ ID NO: 67537 - RNA, 20 nt, Artificial Sequence
  MKO10067537_B_1110065P20Rik
  gRNA
gccgccccagccaucuguau

SEQ ID NO: 67538 - RNA, 20 nt, Artificial Sequence
  MKO10067538_B_1190002N15Rik
  gRNA
uccuccagaagugccgcgcc

SEQ ID NO: 67539 - RNA, 20 nt, Artificial Sequence
  MKO10067539_B_1190002N15Rik
  gRNA
aguugucaaagcugacgucc

SEQ ID NO: 67540 - RNA, 20 nt, Artificial Sequence
  MKO10067540_B_1190002N15Rik
  gRNA
agcuuugacaacuuugcagu

SEQ ID NO: 67541 - RNA, 20 nt, Artificial Sequence
  MKO10067541_B_1190003K10Rik
  gRNA
uccugaugacaaggaaaagc

SEQ ID NO: 67542 - RNA, 20 nt, Artificial Sequence
  MKO10067542_B_1190003K10Rik
  gRNA
ugaacagccaguacaugcgc

SEQ ID NO: 67543 - RNA, 20 nt, Artificial Sequence
  MKO10067543_B_1190003K10Rik
  gRNA
uucucagagcgcuucucccc

SEQ ID NO: 67544 - RNA, 20 nt, Artificial Sequence
  MKO10067544_B_1190005I06Rik
  gRNA
agccccaugcccgucggggu

SEQ ID NO: 67545 - RNA, 20 nt, Artificial Sequence
  MKO10067545_B_1190005I06Rik
  gRNA
gccccauggcgucgccucug

SEQ ID NO: 67546 - RNA, 20 nt, Artificial Sequence
  MKO10067546_B_1190005I06Rik
  gRNA
ggcccgcagaggcgacgcca

SEQ ID NO: 67547 - RNA, 20 nt, Artificial Sequence
  MKO10067547_B_1190007I07Rik
  gRNA
ccugaaauuccaccaaagcc

SEQ ID NO: 67548 - RNA, 20 nt, Artificial Sequence
  MKO10067548_B_1190007I07Rik
  gRNA
ccaugcccgggggcguaccc

SEQ ID NO: 67549 - RNA, 20 nt, Artificial Sequence
  MKO10067549_B_1190007I07Rik
  gRNA
gauaguaccaaugcaccacc

SEQ ID NO: 67550 - RNA, 20 nt, Artificial Sequence
  MKO10067550_B_42625
  gRNA
gagugcagcuccaauguuug

SEQ ID NO: 67551 - RNA, 20 nt, Artificial Sequence
  MKO10067551_B_42625
  gRNA
uucaguugacugccauacuu

SEQ ID NO: 67552 - RNA, 20 nt, Artificial Sequence
  MKO10067552_B_42625
  gRNA
ugucggggauguggcgcugg

SEQ ID NO: 67553 - RNA, 20 nt, Artificial Sequence
  MKO10067553_B_1200014J11Rik
  gRNA
cuaucguaggcaaugugguu

SEQ ID NO: 67554 - RNA, 20 nt, Artificial Sequence
  MKO10067554_B_1200014J11Rik
  gRNA
cuggagacaaucuacauuug

SEQ ID NO: 67555 - RNA, 20 nt, Artificial Sequence
  MKO10067555_B_1200014J11Rik
  gRNA
uccaaccacucaaugugagc

SEQ ID NO: 67556 - RNA, 20 nt, Artificial Sequence
  MKO10067556_B_1300002K09Rik
  gRNA
cuacaggccucuggacuucg

SEQ ID NO: 67557 - RNA, 20 nt, Artificial Sequence
  MKO10067557_B_1300002K09Rik
  gRNA
acaggugauauuuaucugcc

SEQ ID NO: 67558 - RNA, 20 nt, Artificial Sequence
  MKO10067558_B_1300002K09Rik
  gRNA
uccuccaaagacgagagcau

SEQ ID NO: 67559 - RNA, 20 nt, Artificial Sequence
  MKO10067559_B_1300017J02Rik
  gRNA
ccacagccugaaaccuauca

SEQ ID NO: 67560 - RNA, 20 nt, Artificial Sequence
  MKO10067560_B_1300017J02Rik
  gRNA
uuccugagaagaccauacga

SEQ ID NO: 67561 - RNA, 20 nt, Artificial Sequence
  MKO10067561_B_1300017J02Rik
  gRNA
gcuuccaacugaaccagcuc

SEQ ID NO: 67562 - RNA, 20 nt, Artificial Sequence
  MKO10067562_B_42627
  gRNA
cuuugaaagcgagucagcuu

SEQ ID NO: 67563 - RNA, 20 nt, Artificial Sequence
  MKO10067563_B_42627
  gRNA
uugacugucgugaagacagu

SEQ ID NO: 67564 - RNA, 20 nt, Artificial Sequence
  MKO10067564_B_42627
  gRNA
cuuuauuucaucaccccuac

SEQ ID NO: 67565 - RNA, 20 nt, Artificial Sequence
  MKO10067565_B_42628
  gRNA
ugcguuccaacuucucgcuc

SEQ ID NO: 67566 - RNA, 20 nt, Artificial Sequence
  MKO10067566_B_42628
  gRNA
gauaaacccaaacucuucag

SEQ ID NO: 67567 - RNA, 20 nt, Artificial Sequence
  MKO10067567_B_42628
  gRNA
ugcuacauaccuuggacuug

SEQ ID NO: 67568 - RNA, 20 nt, Artificial Sequence
  MKO10067568_B_1500009L16Rik
  gRNA
cgccauguugacagcuucag

SEQ ID NO: 67569 - RNA, 20 nt, Artificial Sequence
  MKO10067569_B_1500009L16Rik
  gRNA
gcccucugaagcugucaaca

SEQ ID NO: 67570 - RNA, 20 nt, Artificial Sequence
  MKO10067570_B_1500012F01Rik
  gRNA
gaauggagcgugaacuccug

SEQ ID NO: 67571 - RNA, 20 nt, Artificial Sequence
  MKO10067571_B_1500012F01Rik
  gRNA
guuggucugaucuugauuuc

SEQ ID NO: 67572 - RNA, 20 nt, Artificial Sequence
  MKO10067572_B_1500012F01Rik
  gRNA
uugcauucugcauagccuug

SEQ ID NO: 67573 - RNA, 20 nt, Artificial Sequence
  MKO10067573_B_1500015O10Rik
  gRNA
cagaccuaccuucucguuuc

SEQ ID NO: 67574 - RNA, 20 nt, Artificial Sequence
  MKO10067574_B_1500015O10Rik
  gRNA
caucuucaucauaaugacgc

SEQ ID NO: 67575 - RNA, 20 nt, Artificial Sequence
  MKO10067575_B_1500015O10Rik
  gRNA
acggucccacagcugucguu

SEQ ID NO: 67576 - RNA, 20 nt, Artificial Sequence
  MKO10067576_B_1600002H07Rik
  gRNA
cuccaacugccgcugccgau

SEQ ID NO: 67577 - RNA, 20 nt, Artificial Sequence
  MKO10067577_B_1600002H07Rik
  gRNA
gucuuugcagggaaccagcc

SEQ ID NO: 67578 - RNA, 20 nt, Artificial Sequence
  MKO10067578_B_1600002H07Rik
  gRNA
acugccuuccugaaguccuc

SEQ ID NO: 67579 - RNA, 20 nt, Artificial Sequence
  MKO10067579_B_1600002K03Rik
  gRNA
cucuucaugcuccuccgugu

SEQ ID NO: 67580 - RNA, 20 nt, Artificial Sequence
  MKO10067580_B_1600002K03Rik
  gRNA
cagugauuacguagaacaag

SEQ ID NO: 67581 - RNA, 20 nt, Artificial Sequence
  MKO10067581_B_1600002K03Rik
  gRNA
cucccguuugugugguuaua

SEQ ID NO: 67582 - RNA, 20 nt, Artificial Sequence
  MKO10067582_B_1600012H06Rik
  gRNA
agcucauagucgucgaagcu

SEQ ID NO: 67583 - RNA, 20 nt, Artificial Sequence
  MKO10067583_B_1600012H06Rik
  gRNA
ucaucucaaagucgcucuca

SEQ ID NO: 67584 - RNA, 20 nt, Artificial Sequence
  MKO10067584_B_1600012H06Rik
  gRNA
ccaggauguggucucuauac

SEQ ID NO: 67585 - RNA, 20 nt, Artificial Sequence
  MKO10067585_B_1600014C10Rik
  gRNA
aaggcggccgucaagcacuc

SEQ ID NO: 67586 - RNA, 20 nt, Artificial Sequence
  MKO10067586_B_1600014C10Rik
  gRNA
accaaccaagccaccgacga

SEQ ID NO: 67587 - RNA, 20 nt, Artificial Sequence
  MKO10067587_B_1600014C10Rik
  gRNA
cccagacuccagcucgguaa

SEQ ID NO: 67588 - RNA, 20 nt, Artificial Sequence
  MKO10067588_B_1600014C23Rik
  gRNA
ugaauucccacugucuggcc

SEQ ID NO: 67589 - RNA, 20 nt, Artificial Sequence
  MKO10067589_B_1600014C23Rik
  gRNA
gacucccaguggguagacug

SEQ ID NO: 67590 - RNA, 20 nt, Artificial Sequence
  MKO10067590_B_1600014C23Rik
  gRNA
cugccaaccgccccccuuuc

SEQ ID NO: 67591 - RNA, 20 nt, Artificial Sequence
  MKO10067591_B_1600014K23Rik
  gRNA
cucccugcugaccgagcgcc

SEQ ID NO: 67592 - RNA, 20 nt, Artificial Sequence
  MKO10067592_B_1600014K23Rik
  gRNA
caugaccaaccugcgccggu

SEQ ID NO: 67593 - RNA, 20 nt, Artificial Sequence
  MKO10067593_B_1600014K23Rik
  gRNA
gcucuucgaccagcucacca

SEQ ID NO: 67594 - RNA, 20 nt, Artificial Sequence
  MKO10067594_B_1600015I10Rik
  gRNA
agcaaccuccauacgaccca

SEQ ID NO: 67595 - RNA, 20 nt, Artificial Sequence
  MKO10067595_B_1600015I10Rik
  gRNA
ccacaacaugccccguucug

SEQ ID NO: 67596 - RNA, 20 nt, Artificial Sequence
  MKO10067596_B_1600015I10Rik
  gRNA
auaaaauccucgaagaccac

SEQ ID NO: 67597 - RNA, 20 nt, Artificial Sequence
  MKO10067597_B_1600016N20Rik
  gRNA
cagcacgcgucccacccaag

SEQ ID NO: 67598 - RNA, 20 nt, Artificial Sequence
  MKO10067598_B_1600016N20Rik
  gRNA
cacguacccugaggcucuua

SEQ ID NO: 67599 - RNA, 20 nt, Artificial Sequence
  MKO10067599_B_1600016N20Rik
  gRNA
ccagguccagaagcuaaccc

SEQ ID NO: 67600 - RNA, 20 nt, Artificial Sequence
  MKO10067600_B_1700001C02Rik
  gRNA
gcccguuguccugguuggau

SEQ ID NO: 67601 - RNA, 20 nt, Artificial Sequence
  MKO10067601_B_1700001C02Rik
  gRNA
caccauggccuuccguagcg

SEQ ID NO: 67602 - RNA, 20 nt, Artificial Sequence
  MKO10067602_B_1700001C02Rik
  gRNA
ccgccuuuggcgcucuugag

SEQ ID NO: 67603 - RNA, 20 nt, Artificial Sequence
  MKO10067603_B_1700001C19Rik
  gRNA
ccuaggugcgccacaagauc

SEQ ID NO: 67604 - RNA, 20 nt, Artificial Sequence
  MKO10067604_B_1700001C19Rik
  gRNA
aagagaagagccaugcccuc

SEQ ID NO: 67605 - RNA, 20 nt, Artificial Sequence
  MKO10067605_B_1700001C19Rik
  gRNA
gaagucucguucagcuucag

SEQ ID NO: 67606 - RNA, 20 nt, Artificial Sequence
  MKO10067606_B_1700001F09Rik
  gRNA
ugaccugaagagaauguccc

SEQ ID NO: 67607 - RNA, 20 nt, Artificial Sequence
  MKO10067607_B_1700001F09Rik
  gRNA
cuaaagaaaaucaauuauac

SEQ ID NO: 67608 - RNA, 20 nt, Artificial Sequence
  MKO10067608_B_1700001F09Rik
  gRNA
accucauccagcacaaaguc

SEQ ID NO: 67609 - RNA, 20 nt, Artificial Sequence
  MKO10067609_B_1700001J03Rik
  gRNA
uucuacacagucaggccgga

SEQ ID NO: 67610 - RNA, 20 nt, Artificial Sequence
  MKO10067610_B_1700001J03Rik
  gRNA
acugcaucuuugagacaaac

SEQ ID NO: 67611 - RNA, 20 nt, Artificial Sequence
  MKO10067611_B_1700001J03Rik
  gRNA
ugucucaaagaugcagucca

SEQ ID NO: 67612 - RNA, 20 nt, Artificial Sequence
  MKO10067612_B_1700001K19Rik
  gRNA
ccagccgacccaccugcauc

SEQ ID NO: 67613 - RNA, 20 nt, Artificial Sequence
  MKO10067613_B_1700001K19Rik
  gRNA
aaccucauggaccuugcuga

SEQ ID NO: 67614 - RNA, 20 nt, Artificial Sequence
  MKO10067614_B_1700001K19Rik
  gRNA
ccccacaggucagcuccaga

SEQ ID NO: 67615 - RNA, 20 nt, Artificial Sequence
  MKO10067615_B_1700001L19Rik
  gRNA
gagccccuaaacagagacua

SEQ ID NO: 67616 - RNA, 20 nt, Artificial Sequence
  MKO10067616_B_1700001L19Rik
  gRNA
aucuuaccuccucauuaaua

SEQ ID NO: 67617 - RNA, 20 nt, Artificial Sequence
  MKO10067617_B_1700001L19Rik
  gRNA
ucuuaaaaacacagucauag

SEQ ID NO: 67618 - RNA, 20 nt, Artificial Sequence
  MKO10067618_B_1700001O22Rik
  gRNA
ccucagcgccacauaacccu

SEQ ID NO: 67619 - RNA, 20 nt, Artificial Sequence
  MKO10067619_B_1700001O22Rik
  gRNA
cuguggccggcuccucauuc

SEQ ID NO: 67620 - RNA, 20 nt, Artificial Sequence
  MKO10067620_B_1700001O22Rik
  gRNA
ugagggacaaaccauugcac

SEQ ID NO: 67621 - RNA, 20 nt, Artificial Sequence
  MKO10067621_B_1700001P01Rik
  gRNA
acgggcuuaaauggccgauu

SEQ ID NO: 67622 - RNA, 20 nt, Artificial Sequence
  MKO10067622_B_1700001P01Rik
  gRNA
aaggacagcgauaucucaau

SEQ ID NO: 67623 - RNA, 20 nt, Artificial Sequence
  MKO10067623_B_1700001P01Rik
  gRNA
gcuguccuugaccaaaaaug

SEQ ID NO: 67624 - RNA, 20 nt, Artificial Sequence
  MKO10067624_B_1700003E16Rik
  gRNA
gucacgaaaaugagucacga

SEQ ID NO: 67625 - RNA, 20 nt, Artificial Sequence
  MKO10067625_B_1700003E16Rik
  gRNA
cguuccauucaccauuagcc

SEQ ID NO: 67626 - RNA, 20 nt, Artificial Sequence
  MKO10067626_B_1700003E16Rik
  gRNA
aggaauccguagugcaugcc

SEQ ID NO: 67627 - RNA, 20 nt, Artificial Sequence
  MKO10067627_B_1700003F12Rik
  gRNA
ggguucucacccacacgggc

SEQ ID NO: 67628 - RNA, 20 nt, Artificial Sequence
  MKO10067628_B_1700003F12Rik
  gRNA
gagaacccccgcaucaaggc

SEQ ID NO: 67629 - RNA, 20 nt, Artificial Sequence
  MKO10067629_B_1700003F12Rik
  gRNA
agcacccaaucaggccaaca

SEQ ID NO: 67630 - RNA, 20 nt, Artificial Sequence
  MKO10067630_B_1700003M02Rik
  gRNA
agcuacgugcuccugcgcuc

SEQ ID NO: 67631 - RNA, 20 nt, Artificial Sequence
  MKO10067631_B_1700003M02Rik
  gRNA
ucugcuaacaaugccuaacc

SEQ ID NO: 67632 - RNA, 20 nt, Artificial Sequence
  MKO10067632_B_1700003M02Rik
  gRNA
aaaguagaccugcaucuuaa

SEQ ID NO: 67633 - RNA, 20 nt, Artificial Sequence
  MKO10067633_B_1700006A11Rik
  gRNA
ucccugccaguuacuaagag

SEQ ID NO: 67634 - RNA, 20 nt, Artificial Sequence
  MKO10067634_B_1700006A11Rik
  gRNA
cgcuguggcaucugucuuaa

SEQ ID NO: 67635 - RNA, 20 nt, Artificial Sequence
  MKO10067635_B_1700006A11Rik
  gRNA
cuucuagacuguaugauaua

SEQ ID NO: 67636 - RNA, 20 nt, Artificial Sequence
  MKO10067636_B_1700006E09Rik
  gRNA
cgucgauaccaaaccuccaa

SEQ ID NO: 67637 - RNA, 20 nt, Artificial Sequence
  MKO10067637_B_1700006E09Rik
  gRNA
cucauuccagcaguccaccu

SEQ ID NO: 67638 - RNA, 20 nt, Artificial Sequence
  MKO10067638_B_1700006E09Rik
  gRNA
uuuaaaauugagcaaaaucc

SEQ ID NO: 67639 - RNA, 20 nt, Artificial Sequence
  MKO10067639_B_1700007B14Rik
  gRNA
cauuuaaucucuugugaugu

SEQ ID NO: 67640 - RNA, 20 nt, Artificial Sequence
  MKO10067640_B_1700007B14Rik
  gRNA
uuaauguaguucaagaacau

SEQ ID NO: 67641 - RNA, 20 nt, Artificial Sequence
  MKO10067641_B_1700007B14Rik
  gRNA
uaugcaaaggcaagcucaug

SEQ ID NO: 67642 - RNA, 20 nt, Artificial Sequence
  MKO10067642_B_1700007G11Rik
  gRNA
uauccucuucccucaucgcc

SEQ ID NO: 67643 - RNA, 20 nt, Artificial Sequence
  MKO10067643_B_1700007G11Rik
  gRNA
ucagcaaucacuugauaauu

SEQ ID NO: 67644 - RNA, 20 nt, Artificial Sequence
  MKO10067644_B_1700007G11Rik
  gRNA
aauucucaauguggacccaa

SEQ ID NO: 67645 - RNA, 20 nt, Artificial Sequence
  MKO10067645_B_1700007K09Rik
  gRNA
acagccauguuucuacugau

SEQ ID NO: 67646 - RNA, 20 nt, Artificial Sequence
  MKO10067646_B_1700007K09Rik
  gRNA
uuucuuaagaaucgcaaagg

SEQ ID NO: 67647 - RNA, 20 nt, Artificial Sequence
  MKO10067647_B_1700007K09Rik
  gRNA
cuccaguguuguaauguaug

SEQ ID NO: 67648 - RNA, 20 nt, Artificial Sequence
  MKO10067648_B_1700007K13Rik
  gRNA
gggcucugcuuccguagguu

SEQ ID NO: 67649 - RNA, 20 nt, Artificial Sequence
  MKO10067649_B_1700007K13Rik
  gRNA
gaaaguucaaacggucauag

SEQ ID NO: 67650 - RNA, 20 nt, Artificial Sequence
  MKO10067650_B_1700007K13Rik
  gRNA
uccaaaagcugcguguuguc

SEQ ID NO: 67651 - RNA, 20 nt, Artificial Sequence
  MKO10067651_B_1700008A04Rik
  gRNA
aauguuaccuggggugucac

SEQ ID NO: 67652 - RNA, 20 nt, Artificial Sequence
  MKO10067652_B_1700008A04Rik
  gRNA
aaccugcugaagagccauua

SEQ ID NO: 67653 - RNA, 20 nt, Artificial Sequence
  MKO10067653_B_1700008A04Rik
  gRNA
gcuguuggcacugcucaucu

SEQ ID NO: 67654 - RNA, 20 nt, Artificial Sequence
  MKO10067654_B_1700008F21Rik
  gRNA
uugaagaaaaaccugcuaga

SEQ ID NO: 67655 - RNA, 20 nt, Artificial Sequence
  MKO10067655_B_1700008F21Rik
  gRNA
uuuguauuucaccuucuagc

SEQ ID NO: 67656 - RNA, 20 nt, Artificial Sequence
  MKO10067656_B_1700008F21Rik
  gRNA
acaaaggcugagagaucccg

SEQ ID NO: 67657 - RNA, 20 nt, Artificial Sequence
  MKO10067657_B_1700008I05Rik
  gRNA
gcuugccucaguaacuguac

SEQ ID NO: 67658 - RNA, 20 nt, Artificial Sequence
  MKO10067658_B_1700008I05Rik
  gRNA
cauuagaaauugcugcaagc

SEQ ID NO: 67659 - RNA, 20 nt, Artificial Sequence
  MKO10067659_B_1700008I05Rik
  gRNA
aagauccaguacaguuacug

SEQ ID NO: 67660 - RNA, 20 nt, Artificial Sequence
  MKO10067660_B_1700008O03Rik
  gRNA
auuccgagaugaccugccgc

SEQ ID NO: 67661 - RNA, 20 nt, Artificial Sequence
  MKO10067661_B_1700008O03Rik
  gRNA
cgcugugcgucaaucuucgu

SEQ ID NO: 67662 - RNA, 20 nt, Artificial Sequence
  MKO10067662_B_1700008O03Rik
  gRNA
ccuuguugaccucgagucua

SEQ ID NO: 67663 - RNA, 20 nt, Artificial Sequence
  MKO10067663_B_1700008P02Rik
  gRNA
caagaaaauggacugauuac

SEQ ID NO: 67664 - RNA, 20 nt, Artificial Sequence
  MKO10067664_B_1700008P02Rik
  gRNA
uaaacaagaauucugacgaa

SEQ ID NO: 67665 - RNA, 20 nt, Artificial Sequence
  MKO10067665_B_1700008P02Rik
  gRNA
gaagaagagaugcaagccuu

SEQ ID NO: 67666 - RNA, 20 nt, Artificial Sequence
  MKO10067666_B_1700009N14Rik
  gRNA
cggcuauuacauccaagccc

SEQ ID NO: 67667 - RNA, 20 nt, Artificial Sequence
  MKO10067667_B_1700009N14Rik
  gRNA
augcucguauuucuuugcua

SEQ ID NO: 67668 - RNA, 20 nt, Artificial Sequence
  MKO10067668_B_1700009N14Rik
  gRNA
acaagcuugaauuggacugg

SEQ ID NO: 67669 - RNA, 20 nt, Artificial Sequence
  MKO10067669_B_1700009P17Rik
  gRNA
gcucagaauaccucuuucgu

SEQ ID NO: 67670 - RNA, 20 nt, Artificial Sequence
  MKO10067670_B_1700009P17Rik
  gRNA
caagagaugcccucgaucgu

SEQ ID NO: 67671 - RNA, 20 nt, Artificial Sequence
  MKO10067671_B_1700009P17Rik
  gRNA
cugccgacaaccucaccaaa

SEQ ID NO: 67672 - RNA, 20 nt, Artificial Sequence
  MKO10067672_B_1700010B08Rik
  gRNA
aagauggcccagaaucauac

SEQ ID NO: 67673 - RNA, 20 nt, Artificial Sequence
  MKO10067673_B_1700010B08Rik
  gRNA
cgggaaacaugauggcaugc

SEQ ID NO: 67674 - RNA, 20 nt, Artificial Sequence
  MKO10067674_B_1700010B08Rik
  gRNA
guuucccgccaugaugaaaa

SEQ ID NO: 67675 - RNA, 20 nt, Artificial Sequence
  MKO10067675_B_1700010D01Rik
  gRNA
uggugaaagcaacuaagaag

SEQ ID NO: 67676 - RNA, 20 nt, Artificial Sequence
  MKO10067676_B_1700010D01Rik
  gRNA
ucuaaucuucuugcuacauu

SEQ ID NO: 67677 - RNA, 20 nt, Artificial Sequence
  MKO10067677_B_1700010D01Rik
  gRNA
cagaugcugugccaucaacc

SEQ ID NO: 67678 - RNA, 20 nt, Artificial Sequence
  MKO10067678_B_1700010I14Rik
  gRNA
acagcccacagcgcaguauc

SEQ ID NO: 67679 - RNA, 20 nt, Artificial Sequence
  MKO10067679_B_1700010I14Rik
  gRNA
gcaacccucagcaguucaac

SEQ ID NO: 67680 - RNA, 20 nt, Artificial Sequence
  MKO10067680_B_1700010I14Rik
  gRNA
uuacuugucguugugcucca

SEQ ID NO: 67681 - RNA, 20 nt, Artificial Sequence
  MKO10067681_B_1700011A15Rik
  gRNA
ggcgcucauguucaggccac

SEQ ID NO: 67682 - RNA, 20 nt, Artificial Sequence
  MKO10067682_B_1700011A15Rik
  gRNA
uagccugguugagccuauuc

SEQ ID NO: 67683 - RNA, 20 nt, Artificial Sequence
  MKO10067683_B_1700011A15Rik
  gRNA
acagcaaggaggcccugaau

SEQ ID NO: 67684 - RNA, 20 nt, Artificial Sequence
  MKO10067684_B_1700011E24Rik
  gRNA
ggaaguaccucguacugucc

SEQ ID NO: 67685 - RNA, 20 nt, Artificial Sequence
  MKO10067685_B_1700011E24Rik
  gRNA
aaacaagucaagaagacgcc

SEQ ID NO: 67686 - RNA, 20 nt, Artificial Sequence
  MKO10067686_B_1700011E24Rik
  gRNA
cuuacaggagugaaauaauu

SEQ ID NO: 67687 - RNA, 20 nt, Artificial Sequence
  MKO10067687_B_1700011H14Rik
  gRNA
cuuucagagguaauugcuug

SEQ ID NO: 67688 - RNA, 20 nt, Artificial Sequence
  MKO10067688_B_1700011H14Rik
  gRNA
caacuuccuauguacacuuc

SEQ ID NO: 67689 - RNA, 20 nt, Artificial Sequence
  MKO10067689_B_1700011H14Rik
  gRNA
gaugucaagauacauggccc

SEQ ID NO: 67690 - RNA, 20 nt, Artificial Sequence
  MKO10067690_B_1700011I03Rik
  gRNA
aauacugucuguccacuguc

SEQ ID NO: 67691 - RNA, 20 nt, Artificial Sequence
  MKO10067691_B_1700011I03Rik
  gRNA
cauggauguuaaguuucucc

SEQ ID NO: 67692 - RNA, 20 nt, Artificial Sequence
  MKO10067692_B_1700011I03Rik
  gRNA
ggcuagagcucuguuggaac

SEQ ID NO: 67693 - RNA, 20 nt, Artificial Sequence
  MKO10067693_B_1700011L22Rik
  gRNA
guggccggguagaguguugu

SEQ ID NO: 67694 - RNA, 20 nt, Artificial Sequence
  MKO10067694_B_1700011L22Rik
  gRNA
gguaugcagcccaaaaagcc

SEQ ID NO: 67695 - RNA, 20 nt, Artificial Sequence
  MKO10067695_B_1700011L22Rik
  gRNA
ucugccuacaacacucuacc

SEQ ID NO: 67696 - RNA, 20 nt, Artificial Sequence
  MKO10067696_B_1700012A03Rik
  gRNA
cgcacccuugccaggaggca

SEQ ID NO: 67697 - RNA, 20 nt, Artificial Sequence
  MKO10067697_B_1700012A03Rik
  gRNA
ucugcgcccucuucugcagc

SEQ ID NO: 67698 - RNA, 20 nt, Artificial Sequence
  MKO10067698_B_1700012A03Rik
  gRNA
uucuccucuaguucaagauc

SEQ ID NO: 67699 - RNA, 20 nt, Artificial Sequence
  MKO10067699_B_1700012B07Rik
  gRNA
ccggcaccuuauggacauga

SEQ ID NO: 67700 - RNA, 20 nt, Artificial Sequence
  MKO10067700_B_1700012B07Rik
  gRNA
gcaugugacagcaaagucgu

SEQ ID NO: 67701 - RNA, 20 nt, Artificial Sequence
  MKO10067701_B_1700012B07Rik
  gRNA
uguccugugacgucaagcuc

SEQ ID NO: 67702 - RNA, 20 nt, Artificial Sequence
  MKO10067702_B_1700012B09Rik
  gRNA
uccgugccucgaguaguacu

SEQ ID NO: 67703 - RNA, 20 nt, Artificial Sequence
  MKO10067703_B_1700012B09Rik
  gRNA
ugaaccgcauaagagaauca

SEQ ID NO: 67704 - RNA, 20 nt, Artificial Sequence
  MKO10067704_B_1700012B09Rik
  gRNA
caugugaaaagcccaccuac

SEQ ID NO: 67705 - RNA, 20 nt, Artificial Sequence
  MKO10067705_B_1700012L04Rik
  gRNA
ucauggccaagaaaaugcaa

SEQ ID NO: 67706 - RNA, 20 nt, Artificial Sequence
  MKO10067706_B_1700012L04Rik
  gRNA
accaccagacguacauccuc

SEQ ID NO: 67707 - RNA, 20 nt, Artificial Sequence
  MKO10067707_B_1700012L04Rik
  gRNA
aaaagaacccgcucccagag

SEQ ID NO: 67708 - RNA, 20 nt, Artificial Sequence
  MKO10067708_B_1700012P22Rik
  gRNA
ugccggugugcgcuaugucc

SEQ ID NO: 67709 - RNA, 20 nt, Artificial Sequence
  MKO10067709_B_1700012P22Rik
  gRNA
uaccaccuagaaacgaaguc

SEQ ID NO: 67710 - RNA, 20 nt, Artificial Sequence
  MKO10067710_B_1700012P22Rik
  gRNA
acacuccccagugcauuuac

SEQ ID NO: 67711 - RNA, 20 nt, Artificial Sequence
  MKO10067711_B_1700013D24Rik
  gRNA
acuuacuugccccucccaga

SEQ ID NO: 67712 - RNA, 20 nt, Artificial Sequence
  MKO10067712_B_1700013D24Rik
  gRNA
ucgccucaaacugcugucac

SEQ ID NO: 67713 - RNA, 20 nt, Artificial Sequence
  MKO10067713_B_1700013D24Rik
  gRNA
ugcccagugacagcaguuug

SEQ ID NO: 67714 - RNA, 20 nt, Artificial Sequence
  MKO10067714_B_1700013F07Rik
  gRNA
agaccauugaggauauccag

SEQ ID NO: 67715 - RNA, 20 nt, Artificial Sequence
  MKO10067715_B_1700013F07Rik
  gRNA
ccauugguggccgcagugug

SEQ ID NO: 67716 - RNA, 20 nt, Artificial Sequence
  MKO10067716_B_1700013F07Rik
  gRNA
ccaccaauggagguuacucc

SEQ ID NO: 67717 - RNA, 20 nt, Artificial Sequence
  MKO10067717_B_1700013G24Rik
  gRNA
uccgaguuaagcaccuccag

SEQ ID NO: 67718 - RNA, 20 nt, Artificial Sequence
  MKO10067718_B_1700013G24Rik
  gRNA
uaggucgucugcccaaguuc

SEQ ID NO: 67719 - RNA, 20 nt, Artificial Sequence
  MKO10067719_B_1700013G24Rik
  gRNA
gagacgagucaccugacgag

SEQ ID NO: 67720 - RNA, 20 nt, Artificial Sequence
  MKO10067720_B_1700013H16Rik
  gRNA
guucaacaucugauucaugu

SEQ ID NO: 67721 - RNA, 20 nt, Artificial Sequence
  MKO10067721_B_1700013H16Rik
  gRNA
gucucuuagcacuaagagca

SEQ ID NO: 67722 - RNA, 20 nt, Artificial Sequence
  MKO10067722_B_1700013H16Rik
  gRNA
uugcaaaucuguuugagcaa

SEQ ID NO: 67723 - RNA, 20 nt, Artificial Sequence
  MKO10067723_B_1700015E13Rik
  gRNA
gcaagugaggacauuauguc

SEQ ID NO: 67724 - RNA, 20 nt, Artificial Sequence
  MKO10067724_B_1700015E13Rik
  gRNA
ccuugaaaccccccuugaug

SEQ ID NO: 67725 - RNA, 20 nt, Artificial Sequence
  MKO10067725_B_1700015E13Rik
  gRNA
uuucagccacguccucaaga

SEQ ID NO: 67726 - RNA, 20 nt, Artificial Sequence
  MKO10067726_B_1700015F17Rik
  gRNA
ucagcaucacgauuccaaac

SEQ ID NO: 67727 - RNA, 20 nt, Artificial Sequence
  MKO10067727_B_1700015F17Rik
  gRNA
cuguugcauguagaaguaau

SEQ ID NO: 67728 - RNA, 20 nt, Artificial Sequence
  MKO10067728_B_1700015F17Rik
  gRNA
uauuuggugccgagaagaaa

SEQ ID NO: 67729 - RNA, 20 nt, Artificial Sequence
  MKO10067729_B_1700015G11Rik
  gRNA
cucacuggguagacuugugc

SEQ ID NO: 67730 - RNA, 20 nt, Artificial Sequence
  MKO10067730_B_1700015G11Rik
  gRNA
cuuaccaagaugccuguauc

SEQ ID NO: 67731 - RNA, 20 nt, Artificial Sequence
  MKO10067731_B_1700015G11Rik
  gRNA
auccuucagauguuucuacc

SEQ ID NO: 67732 - RNA, 20 nt, Artificial Sequence
  MKO10067732_B_1700016C15Rik
  gRNA
gcucuacaaauucucguagu

SEQ ID NO: 67733 - RNA, 20 nt, Artificial Sequence
  MKO10067733_B_1700016C15Rik
  gRNA
uacggaguugugcucuugag

SEQ ID NO: 67734 - RNA, 20 nt, Artificial Sequence
  MKO10067734_B_1700016C15Rik
  gRNA
aggcuauauaucacucacca

SEQ ID NO: 67735 - RNA, 20 nt, Artificial Sequence
  MKO10067735_B_1700016D06Rik
  gRNA
cagguucaagugguaagcaa

SEQ ID NO: 67736 - RNA, 20 nt, Artificial Sequence
  MKO10067736_B_1700016D06Rik
  gRNA
gaugacauagcuacaguguu

SEQ ID NO: 67737 - RNA, 20 nt, Artificial Sequence
  MKO10067737_B_1700016D06Rik
  gRNA
ugcuucugauaugucuuaga

SEQ ID NO: 67738 - RNA, 20 nt, Artificial Sequence
  MKO10067738_B_1700016H13Rik
  gRNA
uugggucacuugggcugaag

SEQ ID NO: 67739 - RNA, 20 nt, Artificial Sequence
  MKO10067739_B_1700016H13Rik
  gRNA
ccuaacaaaacugaaguguc

SEQ ID NO: 67740 - RNA, 20 nt, Artificial Sequence
  MKO10067740_B_1700016H13Rik
  gRNA
auaacagcugcccuucaaaa

SEQ ID NO: 67741 - RNA, 20 nt, Artificial Sequence
  MKO10067741_B_1700016K19Rik
  gRNA
gggaccggugcggcggagua

SEQ ID NO: 67742 - RNA, 20 nt, Artificial Sequence
  MKO10067742_B_1700016K19Rik
  gRNA
ccacgcgcauagcuacuuug

SEQ ID NO: 67743 - RNA, 20 nt, Artificial Sequence
  MKO10067743_B_1700016K19Rik
  gRNA
gcaucuacaagcucaaccga

SEQ ID NO: 67744 - RNA, 20 nt, Artificial Sequence
  MKO10067744_B_1700017B05Rik
  gRNA
uuucuaacagguugcggaag

SEQ ID NO: 67745 - RNA, 20 nt, Artificial Sequence
  MKO10067745_B_1700017B05Rik
  gRNA
ugggccguaguuccacucgg

SEQ ID NO: 67746 - RNA, 20 nt, Artificial Sequence
  MKO10067746_B_1700017B05Rik
  gRNA
cucuaccgucccccgacaga

SEQ ID NO: 67747 - RNA, 20 nt, Artificial Sequence
  MKO10067747_B_1700017D01Rik
  gRNA
aauacccugaguuauacugc

SEQ ID NO: 67748 - RNA, 20 nt, Artificial Sequence
  MKO10067748_B_1700017D01Rik
  gRNA
uacuagcuaacauaaguuua

SEQ ID NO: 67749 - RNA, 20 nt, Artificial Sequence
  MKO10067749_B_1700017D01Rik
  gRNA
guuccuauugauucaaaaau

SEQ ID NO: 67750 - RNA, 20 nt, Artificial Sequence
  MKO10067750_B_1700017N19Rik
  gRNA
acuggcagugaauuacaaga

SEQ ID NO: 67751 - RNA, 20 nt, Artificial Sequence
  MKO10067751_B_1700017N19Rik
  gRNA
agcaaaccccgaaauaucaa

SEQ ID NO: 67752 - RNA, 20 nt, Artificial Sequence
  MKO10067752_B_1700017N19Rik
  gRNA
guuucagagauuccugacuc

SEQ ID NO: 67753 - RNA, 20 nt, Artificial Sequence
  MKO10067753_B_1700018B08Rik
  gRNA
aaggguucguuucagaccuu

SEQ ID NO: 67754 - RNA, 20 nt, Artificial Sequence
  MKO10067754_B_1700018B08Rik
  gRNA
ugccaaugcuacaccaaguu

SEQ ID NO: 67755 - RNA, 20 nt, Artificial Sequence
  MKO10067755_B_1700018B08Rik
  gRNA
gagaauguggaagacacucc

SEQ ID NO: 67756 - RNA, 20 nt, Artificial Sequence
  MKO10067756_B_1700018C11Rik
  gRNA
accuuggcgcucucaauaac

SEQ ID NO: 67757 - RNA, 20 nt, Artificial Sequence
  MKO10067757_B_1700018C11Rik
  gRNA
gaaucuaaaccgcuacuacc

SEQ ID NO: 67758 - RNA, 20 nt, Artificial Sequence
  MKO10067758_B_1700018C11Rik
  gRNA
cucaccuucauaaucacugc

SEQ ID NO: 67759 - RNA, 20 nt, Artificial Sequence
  MKO10067759_B_1700018F24Rik
  gRNA
gugggccagaaagcugaaua

SEQ ID NO: 67760 - RNA, 20 nt, Artificial Sequence
  MKO10067760_B_1700018F24Rik
  gRNA
uugcagucaggcuggaaaga

SEQ ID NO: 67761 - RNA, 20 nt, Artificial Sequence
  MKO10067761_B_1700018F24Rik
  gRNA
acuauccaucagccuauucc

SEQ ID NO: 67762 - RNA, 20 nt, Artificial Sequence
  MKO10067762_B_1700019A02Rik
  gRNA
gguuuauaccucaaacaugu

SEQ ID NO: 67763 - RNA, 20 nt, Artificial Sequence
  MKO10067763_B_1700019A02Rik
  gRNA
ugacuuauugugugcuucuu

SEQ ID NO: 67764 - RNA, 20 nt, Artificial Sequence
  MKO10067764_B_1700019A02Rik
  gRNA
ugaaugacaaguuaagaaac

SEQ ID NO: 67765 - RNA, 20 nt, Artificial Sequence
  MKO10067765_B_1700019B03Rik
  gRNA
gggguccuaacacccugaag

SEQ ID NO: 67766 - RNA, 20 nt, Artificial Sequence
  MKO10067766_B_1700019B03Rik
  gRNA
ucuucaccaugauaagacuc

SEQ ID NO: 67767 - RNA, 20 nt, Artificial Sequence
  MKO10067767_B_1700019B03Rik
  gRNA
caccagccuugauguguaag

SEQ ID NO: 67768 - RNA, 20 nt, Artificial Sequence
  MKO10067768_B_1700019D03Rik
  gRNA
cagcuugucaauguccaaug

SEQ ID NO: 67769 - RNA, 20 nt, Artificial Sequence
  MKO10067769_B_1700019D03Rik
  gRNA
ugaguaucaucaauuaaugg

SEQ ID NO: 67770 - RNA, 20 nt, Artificial Sequence
  MKO10067770_B_1700019D03Rik
  gRNA
ugacaagcugcaugagagug

SEQ ID NO: 67771 - RNA, 20 nt, Artificial Sequence
  MKO10067771_B_1700019G17Rik
  gRNA
guuccucucugaugucaccc

SEQ ID NO: 67772 - RNA, 20 nt, Artificial Sequence
  MKO10067772_B_1700019G17Rik
  gRNA
uacaaguuugcaagcugacc

SEQ ID NO: 67773 - RNA, 20 nt, Artificial Sequence
  MKO10067773_B_1700019G17Rik
  gRNA
gugaccauaguccuaguguc

SEQ ID NO: 67774 - RNA, 20 nt, Artificial Sequence
  MKO10067774_B_1700019L03Rik
  gRNA
ggccaucuuucggaacucug

SEQ ID NO: 67775 - RNA, 20 nt, Artificial Sequence
  MKO10067775_B_1700019L03Rik
  gRNA
ggcacuucucggucagcaug

SEQ ID NO: 67776 - RNA, 20 nt, Artificial Sequence
  MKO10067776_B_1700019L03Rik
  gRNA
cacggagaaguacuuggcac

SEQ ID NO: 67777 - RNA, 20 nt, Artificial Sequence
  MKO10067777_B_1700019N19Rik
  gRNA
aaacgagaagaaaccgcugc

SEQ ID NO: 67778 - RNA, 20 nt, Artificial Sequence
  MKO10067778_B_1700019N19Rik
  gRNA
agagcuagggucacugaauu

SEQ ID NO: 67779 - RNA, 20 nt, Artificial Sequence
  MKO10067779_B_1700019N19Rik
  gRNA
cccgcauuuccagaauucuc

SEQ ID NO: 67780 - RNA, 20 nt, Artificial Sequence
  MKO10067780_B_1700019O17Rik
  gRNA
agcacuucgucgaugucucc

SEQ ID NO: 67781 - RNA, 20 nt, Artificial Sequence
  MKO10067781_B_1700019O17Rik
  gRNA
ucgucuuguagccggucagc

SEQ ID NO: 67782 - RNA, 20 nt, Artificial Sequence
  MKO10067782_B_1700019O17Rik
  gRNA
agucacucggggaaaccguc

SEQ ID NO: 67783 - RNA, 20 nt, Artificial Sequence
  MKO10067783_B_1700020A23Rik
  gRNA
agucccgaggccaucuuugu

SEQ ID NO: 67784 - RNA, 20 nt, Artificial Sequence
  MKO10067784_B_1700020A23Rik
  gRNA
caaggaagcuggucagcaac

SEQ ID NO: 67785 - RNA, 20 nt, Artificial Sequence
  MKO10067785_B_1700020A23Rik
  gRNA
aauucgaaccaucuucucaa

SEQ ID NO: 67786 - RNA, 20 nt, Artificial Sequence
  MKO10067786_B_1700020D05Rik
  gRNA
gaacggcuccacuacguguu

SEQ ID NO: 67787 - RNA, 20 nt, Artificial Sequence
  MKO10067787_B_1700020D05Rik
  gRNA
cuucgugaaacagcguuacc

SEQ ID NO: 67788 - RNA, 20 nt, Artificial Sequence
  MKO10067788_B_1700020D05Rik
  gRNA
gugggguccgcgagcaaauc

SEQ ID NO: 67789 - RNA, 20 nt, Artificial Sequence
  MKO10067789_B_1700020L24Rik
  gRNA
aaccgugcguguuggagacg

SEQ ID NO: 67790 - RNA, 20 nt, Artificial Sequence
  MKO10067790_B_1700020L24Rik
  gRNA
uugggaagaauggauaaaca

SEQ ID NO: 67791 - RNA, 20 nt, Artificial Sequence
  MKO10067791_B_1700020L24Rik
  gRNA
ccucgcgcucuuccgcgucu

SEQ ID NO: 67792 - RNA, 20 nt, Artificial Sequence
  MKO10067792_B_1700020N15Rik
  gRNA
cccaagagcucagacucccu

SEQ ID NO: 67793 - RNA, 20 nt, Artificial Sequence
  MKO10067793_B_1700020N15Rik
  gRNA
aaaguuacaagaauuucaca

SEQ ID NO: 67794 - RNA, 20 nt, Artificial Sequence
  MKO10067794_B_1700020N15Rik
  gRNA
caagaucauacuguacaucc

SEQ ID NO: 67795 - RNA, 20 nt, Artificial Sequence
  MKO10067795_B_1700021F05Rik
  gRNA
agacugagaacgacaagcac

SEQ ID NO: 67796 - RNA, 20 nt, Artificial Sequence
  MKO10067796_B_1700021F05Rik
  gRNA
guagaagaugcauucuacaa

SEQ ID NO: 67797 - RNA, 20 nt, Artificial Sequence
  MKO10067797_B_1700021F05Rik
  gRNA
gacugaauggggagaaguug

SEQ ID NO: 67798 - RNA, 20 nt, Artificial Sequence
  MKO10067798_B_1700021F07Rik
  gRNA
cguuguuaaauauccccacu

SEQ ID NO: 67799 - RNA, 20 nt, Artificial Sequence
  MKO10067799_B_1700021F07Rik
  gRNA
aaagugaagcccggcaaaac

SEQ ID NO: 67800 - RNA, 20 nt, Artificial Sequence
  MKO10067800_B_1700021F07Rik
  gRNA
ucacuggacggacauagaag

SEQ ID NO: 67801 - RNA, 20 nt, Artificial Sequence
  MKO10067801_B_1700021K19Rik
  gRNA
gcgggaauggaucuuggcgg

SEQ ID NO: 67802 - RNA, 20 nt, Artificial Sequence
  MKO10067802_B_1700021K19Rik
  gRNA
cccgcacucagcccuucacg

SEQ ID NO: 67803 - RNA, 20 nt, Artificial Sequence
  MKO10067803_B_1700021K19Rik
  gRNA
ucacgcugucagugucgcuc

SEQ ID NO: 67804 - RNA, 20 nt, Artificial Sequence
  MKO10067804_B_1700022I11Rik
  gRNA
uuuggcagauccgaagaugg

SEQ ID NO: 67805 - RNA, 20 nt, Artificial Sequence
  MKO10067805_B_1700022I11Rik
  gRNA
gguugcggaggauucacugc

SEQ ID NO: 67806 - RNA, 20 nt, Artificial Sequence
  MKO10067806_B_1700022I11Rik
  gRNA
ccccaggaucggccaaggac

SEQ ID NO: 67807 - RNA, 20 nt, Artificial Sequence
  MKO10067807_B_1700022P22Rik
  gRNA
cuuucagauaaugccauauu

SEQ ID NO: 67808 - RNA, 20 nt, Artificial Sequence
  MKO10067808_B_1700022P22Rik
  gRNA
cucuucguugcccuuguuca

SEQ ID NO: 67809 - RNA, 20 nt, Artificial Sequence
  MKO10067809_B_1700022P22Rik
  gRNA
cuucguugcuucuuuccacc

SEQ ID NO: 67810 - RNA, 20 nt, Artificial Sequence
  MKO10067810_B_1700023E05Rik
  gRNA
ggagaucucuccuccugcgc

SEQ ID NO: 67811 - RNA, 20 nt, Artificial Sequence
  MKO10067811_B_1700023E05Rik
  gRNA
cccgugaccuuguaaagaaa

SEQ ID NO: 67812 - RNA, 20 nt, Artificial Sequence
  MKO10067812_B_1700023E05Rik
  gRNA
auucuuaccauuucuuuaca

SEQ ID NO: 67813 - RNA, 20 nt, Artificial Sequence
  MKO10067813_B_1700023F06Rik
  gRNA
gcuggauacccgcguugcgc

SEQ ID NO: 67814 - RNA, 20 nt, Artificial Sequence
  MKO10067814_B_1700023F06Rik
  gRNA
gauccccaucgacacugaga

SEQ ID NO: 67815 - RNA, 20 nt, Artificial Sequence
  MKO10067815_B_1700023F06Rik
  gRNA
cuguaccuucucagugucga

SEQ ID NO: 67816 - RNA, 20 nt, Artificial Sequence
  MKO10067816_B_1700024G13Rik
  gRNA
ccagcuguguuggccaaaga

SEQ ID NO: 67817 - RNA, 20 nt, Artificial Sequence
  MKO10067817_B_1700024G13Rik
  gRNA
gguggagcuugugguaaaug

SEQ ID NO: 67818 - RNA, 20 nt, Artificial Sequence
  MKO10067818_B_1700024G13Rik
  gRNA
acuagacccacugugugaag

SEQ ID NO: 67819 - RNA, 20 nt, Artificial Sequence
  MKO10067819_B_1700024P04Rik
  gRNA
ugaggguacagcgcuuucug

SEQ ID NO: 67820 - RNA, 20 nt, Artificial Sequence
  MKO10067820_B_1700024P04Rik
  gRNA
uguuagggacaacuuccuuc

SEQ ID NO: 67821 - RNA, 20 nt, Artificial Sequence
  MKO10067821_B_1700024P04Rik
  gRNA
guucgaagaugucauugaug

SEQ ID NO: 67822 - RNA, 20 nt, Artificial Sequence
  MKO10067822_B_1700024P16Rik
  gRNA
aaggcauagagguucacgaa

SEQ ID NO: 67823 - RNA, 20 nt, Artificial Sequence
  MKO10067823_B_1700024P16Rik
  gRNA
ggaccgagggucucaaugga

SEQ ID NO: 67824 - RNA, 20 nt, Artificial Sequence
  MKO10067824_B_1700024P16Rik
  gRNA
ucccucagcacacaaguuaa

SEQ ID NO: 67825 - RNA, 20 nt, Artificial Sequence
  MKO10067825_B_1700025F22Rik
  gRNA
uuuauccacaaacgauucug

SEQ ID NO: 67826 - RNA, 20 nt, Artificial Sequence
  MKO10067826_B_1700025F22Rik
  gRNA
auaugccacagaaucguuug

SEQ ID NO: 67827 - RNA, 20 nt, Artificial Sequence
  MKO10067827_B_1700025F22Rik
  gRNA
ugacuuaccguaugauuuga

SEQ ID NO: 67828 - RNA, 20 nt, Artificial Sequence
  MKO10067828_B_1700025G04Rik
  gRNA
acaagaauucuucagaaugc

SEQ ID NO: 67829 - RNA, 20 nt, Artificial Sequence
  MKO10067829_B_1700025G04Rik
  gRNA
ggauuacuguucugaagaag

SEQ ID NO: 67830 - RNA, 20 nt, Artificial Sequence
  MKO10067830_B_1700025G04Rik
  gRNA
gcauucugaagaauucuugu

SEQ ID NO: 67831 - RNA, 20 nt, Artificial Sequence
  MKO10067831_B_1700026D08Rik
  gRNA
uguaucuaacaagugaccac

SEQ ID NO: 67832 - RNA, 20 nt, Artificial Sequence
  MKO10067832_B_1700026D08Rik
  gRNA
ccucgauccccagcugcgcc

SEQ ID NO: 67833 - RNA, 20 nt, Artificial Sequence
  MKO10067833_B_1700026D08Rik
  gRNA
ucugcccauagacaaccacu

SEQ ID NO: 67834 - RNA, 20 nt, Artificial Sequence
  MKO10067834_B_1700026L06Rik
  gRNA
ugaacaugaucagaauccgc

SEQ ID NO: 67835 - RNA, 20 nt, Artificial Sequence
  MKO10067835_B_1700026L06Rik
  gRNA
agaaugcccacgacaaaauc

SEQ ID NO: 67836 - RNA, 20 nt, Artificial Sequence
  MKO10067836_B_1700026L06Rik
  gRNA
acugcaauaacuccacccac

SEQ ID NO: 67837 - RNA, 20 nt, Artificial Sequence
  MKO10067837_B_1700028K03Rik
  gRNA
gcguuuacuguguuguguac

SEQ ID NO: 67838 - RNA, 20 nt, Artificial Sequence
  MKO10067838_B_1700028K03Rik
  gRNA
ugcuaaggaguguaugacau

SEQ ID NO: 67839 - RNA, 20 nt, Artificial Sequence
  MKO10067839_B_1700028K03Rik
  gRNA
uucuauuugcuccacuccau

SEQ ID NO: 67840 - RNA, 20 nt, Artificial Sequence
  MKO10067840_B_1700028P14Rik
  gRNA
ugaauaccuuuccaaaaucc

SEQ ID NO: 67841 - RNA, 20 nt, Artificial Sequence
  MKO10067841_B_1700028P14Rik
  gRNA
aggaacaucccgaaagccug

SEQ ID NO: 67842 - RNA, 20 nt, Artificial Sequence
  MKO10067842_B_1700028P14Rik
  gRNA
gaagaagaaaacgggcuugc

SEQ ID NO: 67843 - RNA, 20 nt, Artificial Sequence
  MKO10067843_B_1700029F12Rik
  gRNA
ugacgacgccccaagacagc

SEQ ID NO: 67844 - RNA, 20 nt, Artificial Sequence
  MKO10067844_B_1700029F12Rik
  gRNA
augacaaggaaaugagcucc

SEQ ID NO: 67845 - RNA, 20 nt, Artificial Sequence
  MKO10067845_B_1700029F12Rik
  gRNA
cugagcuuacaucccaguca

SEQ ID NO: 67846 - RNA, 20 nt, Artificial Sequence
  MKO10067846_B_1700029H14Rik
  gRNA
gugacggggcggaacuccag

SEQ ID NO: 67847 - RNA, 20 nt, Artificial Sequence
  MKO10067847_B_1700029H14Rik
  gRNA
gcauucugaguccacgaagc

SEQ ID NO: 67848 - RNA, 20 nt, Artificial Sequence
  MKO10067848_B_1700029H14Rik
  gRNA
ccgucauccgugucacuucu

SEQ ID NO: 67849 - RNA, 20 nt, Artificial Sequence
  MKO10067849_B_1700029I15Rik
  gRNA
gcccgucccgcuugcgcugc

SEQ ID NO: 67850 - RNA, 20 nt, Artificial Sequence
  MKO10067850_B_1700029I15Rik
  gRNA
agcggggcugaaaauuccuc

SEQ ID NO: 67851 - RNA, 20 nt, Artificial Sequence
  MKO10067851_B_1700029I15Rik
  gRNA
uaggucucagcaaucuguuc

SEQ ID NO: 67852 - RNA, 20 nt, Artificial Sequence
  MKO10067852_B_1700029J07Rik
  gRNA
caagcugcaucuucacccga

SEQ ID NO: 67853 - RNA, 20 nt, Artificial Sequence
  MKO10067853_B_1700029J07Rik
  gRNA
agcuaugccaauguuaccau

SEQ ID NO: 67854 - RNA, 20 nt, Artificial Sequence
  MKO10067854_B_1700029J07Rik
  gRNA
acgugaauuugaaucaagug

SEQ ID NO: 67855 - RNA, 20 nt, Artificial Sequence
  MKO10067855_B_1700029P11Rik
  gRNA
augcacgccgucuucuucuu

SEQ ID NO: 67856 - RNA, 20 nt, Artificial Sequence
  MKO10067856_B_1700029P11Rik
  gRNA
ggaccgggcgaccacagccc

SEQ ID NO: 67857 - RNA, 20 nt, Artificial Sequence
  MKO10067857_B_1700029P11Rik
  gRNA
uugaagaacccacacuucca

SEQ ID NO: 67858 - RNA, 20 nt, Artificial Sequence
  MKO10067858_B_1700030F18Rik
  gRNA
cuuuacucacugugaccgga

SEQ ID NO: 67859 - RNA, 20 nt, Artificial Sequence
  MKO10067859_B_1700030F18Rik
  gRNA
uucuuaaagcuggggaucga

SEQ ID NO: 67860 - RNA, 20 nt, Artificial Sequence
  MKO10067860_B_1700030F18Rik
  gRNA
aucggugccuucucuauuau

SEQ ID NO: 67861 - RNA, 20 nt, Artificial Sequence
  MKO10067861_B_1700030J22Rik
  gRNA
cagcgaccucacacuggaag

SEQ ID NO: 67862 - RNA, 20 nt, Artificial Sequence
  MKO10067862_B_1700030J22Rik
  gRNA
cccagcggaagccccgagca

SEQ ID NO: 67863 - RNA, 20 nt, Artificial Sequence
  MKO10067863_B_1700030J22Rik
  gRNA
cugcuaacugucucgggcau

SEQ ID NO: 67864 - RNA, 20 nt, Artificial Sequence
  MKO10067864_B_1700030K09Rik
  gRNA
acccacaucaccuacucgac

SEQ ID NO: 67865 - RNA, 20 nt, Artificial Sequence
  MKO10067865_B_1700030K09Rik
  gRNA
gucagcgcagacgccauaga

SEQ ID NO: 67866 - RNA, 20 nt, Artificial Sequence
  MKO10067866_B_1700030K09Rik
  gRNA
gguccacauaagcaccucca

SEQ ID NO: 67867 - RNA, 20 nt, Artificial Sequence
  MKO10067867_B_1700031F05Rik
  gRNA
aggaccugugccagcuugac

SEQ ID NO: 67868 - RNA, 20 nt, Artificial Sequence
  MKO10067868_B_1700031F05Rik
  gRNA
auacaggacauauugaugac

SEQ ID NO: 67869 - RNA, 20 nt, Artificial Sequence
  MKO10067869_B_1700031F05Rik
  gRNA
caggcuggucaaggggauac

SEQ ID NO: 67870 - RNA, 20 nt, Artificial Sequence
  MKO10067870_B_1700034E13Rik
  gRNA
ccaguaaugguucugacuuc

SEQ ID NO: 67871 - RNA, 20 nt, Artificial Sequence
  MKO10067871_B_1700034E13Rik
  gRNA
uugguucccuguaacguuug

SEQ ID NO: 67872 - RNA, 20 nt, Artificial Sequence
  MKO10067872_B_1700034E13Rik
  gRNA
gucaagaucguagaacccuu

SEQ ID NO: 67873 - RNA, 20 nt, Artificial Sequence
  MKO10067873_B_1700034F02Rik
  gRNA
auugagugcuuccagauuaa

SEQ ID NO: 67874 - RNA, 20 nt, Artificial Sequence
  MKO10067874_B_1700034F02Rik
  gRNA
cggaaaaccaaagcuaucua

SEQ ID NO: 67875 - RNA, 20 nt, Artificial Sequence
  MKO10067875_B_1700034F02Rik
  gRNA
uggugauacaccaaugcugu

SEQ ID NO: 67876 - RNA, 20 nt, Artificial Sequence
  MKO10067876_B_1700034J05Rik
  gRNA
agauuuguguccgcagccau

SEQ ID NO: 67877 - RNA, 20 nt, Artificial Sequence
  MKO10067877_B_1700034J05Rik
  gRNA
ugacaaacaucacguucuuu

SEQ ID NO: 67878 - RNA, 20 nt, Artificial Sequence
  MKO10067878_B_1700034J05Rik
  gRNA
ugcagacucucuugcuaauc

SEQ ID NO: 67879 - RNA, 20 nt, Artificial Sequence
  MKO10067879_B_1700034O15Rik
  gRNA
ucugauagugagugcaagcu

SEQ ID NO: 67880 - RNA, 20 nt, Artificial Sequence
  MKO10067880_B_1700034O15Rik
  gRNA
gagucuucacccccuucacu

SEQ ID NO: 67881 - RNA, 20 nt, Artificial Sequence
  MKO10067881_B_1700034O15Rik
  gRNA
uuauguuguagaccagggug

SEQ ID NO: 67882 - RNA, 20 nt, Artificial Sequence
  MKO10067882_B_1700037C18Rik
  gRNA
agagcggguucucuugcaca

SEQ ID NO: 67883 - RNA, 20 nt, Artificial Sequence
  MKO10067883_B_1700037C18Rik
  gRNA
ccacuggcuaggccggcuca

SEQ ID NO: 67884 - RNA, 20 nt, Artificial Sequence
  MKO10067884_B_1700037C18Rik
  gRNA
ccaugagccggccuagccag

SEQ ID NO: 67885 - RNA, 20 nt, Artificial Sequence
  MKO10067885_B_1700037H04Rik
  gRNA
uaccuugcagaccggcacca

SEQ ID NO: 67886 - RNA, 20 nt, Artificial Sequence
  MKO10067886_B_1700037H04Rik
  gRNA
uccuugcucagucugcgcac

SEQ ID NO: 67887 - RNA, 20 nt, Artificial Sequence
  MKO10067887_B_1700037H04Rik
  gRNA
agcgucacacccaccucuga

SEQ ID NO: 67888 - RNA, 20 nt, Artificial Sequence
  MKO10067888_B_1700039E15Rik
  gRNA
ugcccagacccaugauagcc

SEQ ID NO: 67889 - RNA, 20 nt, Artificial Sequence
  MKO10067889_B_1700039E15Rik
  gRNA
ggcuaucagguugaucagau

SEQ ID NO: 67890 - RNA, 20 nt, Artificial Sequence
  MKO10067890_B_1700039E15Rik
  gRNA
gggcaccaugcuaacucucc

SEQ ID NO: 67891 - RNA, 20 nt, Artificial Sequence
  MKO10067891_B_1700040L02Rik
  gRNA
uaaguggcucggggaaguga

SEQ ID NO: 67892 - RNA, 20 nt, Artificial Sequence
  MKO10067892_B_1700040L02Rik
  gRNA
uggucagaggagaguauauc

SEQ ID NO: 67893 - RNA, 20 nt, Artificial Sequence
  MKO10067893_B_1700040L02Rik
  gRNA
aaucuucacucuucugcgag

SEQ ID NO: 67894 - RNA, 20 nt, Artificial Sequence
  MKO10067894_B_1700042B14Rik
  gRNA
ugcaauccuuucagacuuuc

SEQ ID NO: 67895 - RNA, 20 nt, Artificial Sequence
  MKO10067895_B_1700042B14Rik
  gRNA
uagaaaccagcagcaagugc

SEQ ID NO: 67896 - RNA, 20 nt, Artificial Sequence
  MKO10067896_B_1700042B14Rik
  gRNA
acauagccaucaugagcaaa

SEQ ID NO: 67897 - RNA, 20 nt, Artificial Sequence
  MKO10067897_B_1700042G07Rik
  gRNA
uagaggaccagaaagccccc

SEQ ID NO: 67898 - RNA, 20 nt, Artificial Sequence
  MKO10067898_B_1700042G07Rik
  gRNA
guauugauucugucaccucg

SEQ ID NO: 67899 - RNA, 20 nt, Artificial Sequence
  MKO10067899_B_1700042G07Rik
  gRNA
gcuugacuucucccuaccga

SEQ ID NO: 67900 - RNA, 20 nt, Artificial Sequence
  MKO10067900_B_1700047I17Rik2
  gRNA
uguugcagacaaaacuuacc

SEQ ID NO: 67901 - RNA, 20 nt, Artificial Sequence
  MKO10067901_B_1700047I17Rik2
  gRNA
gacacaccuccuucuucauc

SEQ ID NO: 67902 - RNA, 20 nt, Artificial Sequence
  MKO10067902_B_1700047I17Rik2
  gRNA
ucucuagugugugacuuucu

SEQ ID NO: 67903 - RNA, 20 nt, Artificial Sequence
  MKO10067903_B_1700049G17Rik
  gRNA
gaaacagacaggccgagccc

SEQ ID NO: 67904 - RNA, 20 nt, Artificial Sequence
  MKO10067904_B_1700049G17Rik
  gRNA
agagaagucauucgagugca

SEQ ID NO: 67905 - RNA, 20 nt, Artificial Sequence
  MKO10067905_B_1700049G17Rik
  gRNA
gagguaugccagaacaacaa

SEQ ID NO: 67906 - RNA, 20 nt, Artificial Sequence
  MKO10067906_B_1700052N19Rik
  gRNA
ccaugacuucgacguguuua

SEQ ID NO: 67907 - RNA, 20 nt, Artificial Sequence
  MKO10067907_B_1700052N19Rik
  gRNA
uccauauugugugaugcccc

SEQ ID NO: 67908 - RNA, 20 nt, Artificial Sequence
  MKO10067908_B_1700052N19Rik
  gRNA
aacaccgcagaucuuaacca

SEQ ID NO: 67909 - RNA, 20 nt, Artificial Sequence
  MKO10067909_B_1700054O13Rik
  gRNA
uuauguguaccguauacugc

SEQ ID NO: 67910 - RNA, 20 nt, Artificial Sequence
  MKO10067910_B_1700054O13Rik
  gRNA
gucggugagguaaucaagca

SEQ ID NO: 67911 - RNA, 20 nt, Artificial Sequence
  MKO10067911_B_1700054O13Rik
  gRNA
gagcaauauacccccugcau

SEQ ID NO: 67912 - RNA, 20 nt, Artificial Sequence
  MKO10067912_B_1700055N04Rik
  gRNA
gaucauucugugcgagaaug

SEQ ID NO: 67913 - RNA, 20 nt, Artificial Sequence
  MKO10067913_B_1700055N04Rik
  gRNA
agagcugcuaccccaguauc

SEQ ID NO: 67914 - RNA, 20 nt, Artificial Sequence
  MKO10067914_B_1700055N04Rik
  gRNA
ugagccuguguccaccaacu

SEQ ID NO: 67915 - RNA, 20 nt, Artificial Sequence
  MKO10067915_B_1700056E22Rik
  gRNA
cacuccggagagcuacucgg

SEQ ID NO: 67916 - RNA, 20 nt, Artificial Sequence
  MKO10067916_B_1700056E22Rik
  gRNA
cccgcaguccauccgccccc

SEQ ID NO: 67917 - RNA, 20 nt, Artificial Sequence
  MKO10067917_B_1700056E22Rik
  gRNA
cgggcuccaaaacaucgcac

SEQ ID NO: 67918 - RNA, 20 nt, Artificial Sequence
  MKO10067918_B_1700057G04Rik
  gRNA
aucucuugaugaagaauucg

SEQ ID NO: 67919 - RNA, 20 nt, Artificial Sequence
  MKO10067919_B_1700057G04Rik
  gRNA
ccaauguugcacacgcagau

SEQ ID NO: 67920 - RNA, 20 nt, Artificial Sequence
  MKO10067920_B_1700057G04Rik
  gRNA
ccauuagaccuuucaccaug

SEQ ID NO: 67921 - RNA, 20 nt, Artificial Sequence
  MKO10067921_B_1700061G19Rik
  gRNA
ggacauaccgaguauagauu

SEQ ID NO: 67922 - RNA, 20 nt, Artificial Sequence
  MKO10067922_B_1700061G19Rik
  gRNA
gggcuacuugaagcaucuca

SEQ ID NO: 67923 - RNA, 20 nt, Artificial Sequence
  MKO10067923_B_1700061G19Rik
  gRNA
ugccaugauagcuccaaugc

SEQ ID NO: 67924 - RNA, 20 nt, Artificial Sequence
  MKO10067924_B_1700065D16Rik
  gRNA
cuuagagauuaacaguuuau

SEQ ID NO: 67925 - RNA, 20 nt, Artificial Sequence
  MKO10067925_B_1700065D16Rik
  gRNA
gagacccggcgacucgaagc

SEQ ID NO: 67926 - RNA, 20 nt, Artificial Sequence
  MKO10067926_B_1700065D16Rik
  gRNA
cgacgacgcgcggcccuacc

SEQ ID NO: 67927 - RNA, 20 nt, Artificial Sequence
  MKO10067927_B_1700065I17Rik
  gRNA
augucgguaaucuuuaucuc

SEQ ID NO: 67928 - RNA, 20 nt, Artificial Sequence
  MKO10067928_B_1700065I17Rik
  gRNA
ccuaucagaucagucgccuc

SEQ ID NO: 67929 - RNA, 20 nt, Artificial Sequence
  MKO10067929_B_1700065I17Rik
  gRNA
aagagcagccucaacagcuc

SEQ ID NO: 67930 - RNA, 20 nt, Artificial Sequence
  MKO10067930_B_1700066B19Rik
  gRNA
gcacaaugcagaucgccagc

SEQ ID NO: 67931 - RNA, 20 nt, Artificial Sequence
  MKO10067931_B_1700066B19Rik
  gRNA
gcuggcgaucugcauugugc

SEQ ID NO: 67932 - RNA, 20 nt, Artificial Sequence
  MKO10067932_B_1700066B19Rik
  gRNA
augagguaaacgccguucuc

SEQ ID NO: 67933 - RNA, 20 nt, Artificial Sequence
  MKO10067933_B_1700066M21Rik
  gRNA
uggccaccauuacuaguaga

SEQ ID NO: 67934 - RNA, 20 nt, Artificial Sequence
  MKO10067934_B_1700066M21Rik
  gRNA
agcaguucguugcugcgcug

SEQ ID NO: 67935 - RNA, 20 nt, Artificial Sequence
  MKO10067935_B_1700066M21Rik
  gRNA
ucgagcccaugcuggggucg

SEQ ID NO: 67936 - RNA, 20 nt, Artificial Sequence
  MKO10067936_B_1700067K01Rik
  gRNA
gaaccucccgcagaaaaagc

SEQ ID NO: 67937 - RNA, 20 nt, Artificial Sequence
  MKO10067937_B_1700067K01Rik
  gRNA
uggugugcaguaucggaaga

SEQ ID NO: 67938 - RNA, 20 nt, Artificial Sequence
  MKO10067938_B_1700067K01Rik
  gRNA
ccagcagcuaacacugcgcu

SEQ ID NO: 67939 - RNA, 20 nt, Artificial Sequence
  MKO10067939_B_1700067P10Rik
  gRNA
cucauucuccaucuuuccca

SEQ ID NO: 67940 - RNA, 20 nt, Artificial Sequence
  MKO10067940_B_1700067P10Rik
  gRNA
gcucucccaccacucuccga

SEQ ID NO: 67941 - RNA, 20 nt, Artificial Sequence
  MKO10067941_B_1700067P10Rik
  gRNA
uccgguaccucugcgccagc

SEQ ID NO: 67942 - RNA, 20 nt, Artificial Sequence
  MKO10067942_B_1700071K01Rik
  gRNA
ugcauguuaagaagcccuua

SEQ ID NO: 67943 - RNA, 20 nt, Artificial Sequence
  MKO10067943_B_1700071K01Rik
  gRNA
agccaagccgaacuuuccga

SEQ ID NO: 67944 - RNA, 20 nt, Artificial Sequence
  MKO10067944_B_1700071K01Rik
  gRNA
ccccucaagcuucccuagug

SEQ ID NO: 67945 - RNA, 20 nt, Artificial Sequence
  MKO10067945_B_1700074P13Rik
  gRNA
agaguguccaaacagucacu

SEQ ID NO: 67946 - RNA, 20 nt, Artificial Sequence
  MKO10067946_B_1700074P13Rik
  gRNA
gggaaagcaaguguagccaa

SEQ ID NO: 67947 - RNA, 20 nt, Artificial Sequence
  MKO10067947_B_1700074P13Rik
  gRNA
gacugcagauagaccauaua

SEQ ID NO: 67948 - RNA, 20 nt, Artificial Sequence
  MKO10067948_B_1700080E11Rik
  gRNA
gugacaaagaugccgccagc

SEQ ID NO: 67949 - RNA, 20 nt, Artificial Sequence
  MKO10067949_B_1700080E11Rik
  gRNA
auuccuucauuggugucgcc

SEQ ID NO: 67950 - RNA, 20 nt, Artificial Sequence
  MKO10067950_B_1700080E11Rik
  gRNA
guugaacuguucguuccuug

SEQ ID NO: 67951 - RNA, 20 nt, Artificial Sequence
  MKO10067951_B_1700080O16Rik
  gRNA
cggcccccacagauacucuc

SEQ ID NO: 67952 - RNA, 20 nt, Artificial Sequence
  MKO10067952_B_1700080O16Rik
  gRNA
uggauccucccgacaacagc

SEQ ID NO: 67953 - RNA, 20 nt, Artificial Sequence
  MKO10067953_B_1700080O16Rik
  gRNA
uugacauuccggcuguuguc

SEQ ID NO: 67954 - RNA, 20 nt, Artificial Sequence
  MKO10067954_B_1700084C01Rik
  gRNA
gggucauguaaagagggcac

SEQ ID NO: 67955 - RNA, 20 nt, Artificial Sequence
  MKO10067955_B_1700084C01Rik
  gRNA
augcucacuauguccgccac

SEQ ID NO: 67956 - RNA, 20 nt, Artificial Sequence
  MKO10067956_B_1700084C01Rik
  gRNA
gucacauucuugccaccaac

SEQ ID NO: 67957 - RNA, 20 nt, Artificial Sequence
  MKO10067957_B_1700088E04Rik
  gRNA
ucgugaacaauucaagccuc

SEQ ID NO: 67958 - RNA, 20 nt, Artificial Sequence
  MKO10067958_B_1700088E04Rik
  gRNA
guggcucacguucaucaaac

SEQ ID NO: 67959 - RNA, 20 nt, Artificial Sequence
  MKO10067959_B_1700088E04Rik
  gRNA
cuuccagcaacgccacauca

SEQ ID NO: 67960 - RNA, 20 nt, Artificial Sequence
  MKO10067960_B_1700092M07Rik
  gRNA
aucccuugcuugcucauccg

SEQ ID NO: 67961 - RNA, 20 nt, Artificial Sequence
  MKO10067961_B_1700092M07Rik
  gRNA
ggugcuuguaggcaacgaag

SEQ ID NO: 67962 - RNA, 20 nt, Artificial Sequence
  MKO10067962_B_1700092M07Rik
  gRNA
guccucgcggucaggcaagc

SEQ ID NO: 67963 - RNA, 20 nt, Artificial Sequence
  MKO10067963_B_1700093K21Rik
  gRNA
ccacugaagacccucuguac

SEQ ID NO: 67964 - RNA, 20 nt, Artificial Sequence
  MKO10067964_B_1700093K21Rik
  gRNA
gaagaagaaugugaucgcug

SEQ ID NO: 67965 - RNA, 20 nt, Artificial Sequence
  MKO10067965_B_1700093K21Rik
  gRNA
auguuuacgcaaagugacac

SEQ ID NO: 67966 - RNA, 20 nt, Artificial Sequence
  MKO10067966_B_1700094D03Rik
  gRNA
ccagcaggaacucaaucaga

SEQ ID NO: 67967 - RNA, 20 nt, Artificial Sequence
  MKO10067967_B_1700094D03Rik
  gRNA
ccaucugauugaguuccugc

SEQ ID NO: 67968 - RNA, 20 nt, Artificial Sequence
  MKO10067968_B_1700094D03Rik
  gRNA
gcagaauuugcaaagagcug

SEQ ID NO: 67969 - RNA, 20 nt, Artificial Sequence
  MKO10067969_B_1700101E01Rik
  gRNA
ucgucucguacagcuucccc

SEQ ID NO: 67970 - RNA, 20 nt, Artificial Sequence
  MKO10067970_B_1700101E01Rik
  gRNA
ucuuugaccuguuacaacau

SEQ ID NO: 67971 - RNA, 20 nt, Artificial Sequence
  MKO10067971_B_1700101E01Rik
  gRNA
aauuauggacucuacauccg

SEQ ID NO: 67972 - RNA, 20 nt, Artificial Sequence
  MKO10067972_B_1700102P08Rik
  gRNA
aaugaauugaaccgugugug

SEQ ID NO: 67973 - RNA, 20 nt, Artificial Sequence
  MKO10067973_B_1700102P08Rik
  gRNA
gaacugcugagcaguacauu

SEQ ID NO: 67974 - RNA, 20 nt, Artificial Sequence
  MKO10067974_B_1700102P08Rik
  gRNA
gcucagcaguucuagccaag

SEQ ID NO: 67975 - RNA, 20 nt, Artificial Sequence
  MKO10067975_B_1700106J16Rik
  gRNA
acaacccgcugcgagccauc

SEQ ID NO: 67976 - RNA, 20 nt, Artificial Sequence
  MKO10067976_B_1700106J16Rik
  gRNA
cgcgggccgcucaguccgcc

SEQ ID NO: 67977 - RNA, 20 nt, Artificial Sequence
  MKO10067977_B_1700106J16Rik
  gRNA
cugcuguaggaucuccaagu

SEQ ID NO: 67978 - RNA, 20 nt, Artificial Sequence
  MKO10067978_B_1700109H08Rik
  gRNA
cucuaggauuaugacaauga

SEQ ID NO: 67979 - RNA, 20 nt, Artificial Sequence
  MKO10067979_B_1700109H08Rik
  gRNA
ggcuuggcaguguuucuccg

SEQ ID NO: 67980 - RNA, 20 nt, Artificial Sequence
  MKO10067980_B_1700109H08Rik
  gRNA
gcuauguaaauuuagaagag

SEQ ID NO: 67981 - RNA, 20 nt, Artificial Sequence
  MKO10067981_B_1700110M21Rik
  gRNA
ggccgggugugccgagccac

SEQ ID NO: 67982 - RNA, 20 nt, Artificial Sequence
  MKO10067982_B_1700110M21Rik
  gRNA
gugauugaaggucuauagac

SEQ ID NO: 67983 - RNA, 20 nt, Artificial Sequence
  MKO10067983_B_1700110M21Rik
  gRNA
ggggaugcagcgaccugucu

SEQ ID NO: 67984 - RNA, 20 nt, Artificial Sequence
  MKO10067984_B_1700112E06Rik
  gRNA
cuccaaguugaccagcucau

SEQ ID NO: 67985 - RNA, 20 nt, Artificial Sequence
  MKO10067985_B_1700112E06Rik
  gRNA
ugccuccucccguucuuguc

SEQ ID NO: 67986 - RNA, 20 nt, Artificial Sequence
  MKO10067986_B_1700112E06Rik
  gRNA
accugagcuucaaccucuug

SEQ ID NO: 67987 - RNA, 20 nt, Artificial Sequence
  MKO10067987_B_1700113H08Rik
  gRNA
gacgacuacccaaucagacc

SEQ ID NO: 67988 - RNA, 20 nt, Artificial Sequence
  MKO10067988_B_1700113H08Rik
  gRNA
ugcuuacucacacuuguauu

SEQ ID NO: 67989 - RNA, 20 nt, Artificial Sequence
  MKO10067989_B_1700113H08Rik
  gRNA
cuccagauuccuuacucaca

SEQ ID NO: 67990 - RNA, 20 nt, Artificial Sequence
  MKO10067990_B_1700122O11Rik
  gRNA
ucccguggccugucagccac

SEQ ID NO: 67991 - RNA, 20 nt, Artificial Sequence
  MKO10067991_B_1700122O11Rik
  gRNA
uauguccaagaucucaucau

SEQ ID NO: 67992 - RNA, 20 nt, Artificial Sequence
  MKO10067992_B_1700122O11Rik
  gRNA
gacagaccuccaaagucacu

SEQ ID NO: 67993 - RNA, 20 nt, Artificial Sequence
  MKO10067993_B_1700123I01Rik
  gRNA
gcaaaacuuaccaacucaag

SEQ ID NO: 67994 - RNA, 20 nt, Artificial Sequence
  MKO10067994_B_1700123I01Rik
  gRNA
agaugauauuccucuugagu

SEQ ID NO: 67995 - RNA, 20 nt, Artificial Sequence
  MKO10067995_B_1700123I01Rik
  gRNA
ggauucuauccgugcagucu

SEQ ID NO: 67996 - RNA, 20 nt, Artificial Sequence
  MKO10067996_B_1700123K08Rik
  gRNA
accaaacguaugcuaccacc

SEQ ID NO: 67997 - RNA, 20 nt, Artificial Sequence
  MKO10067997_B_1700123K08Rik
  gRNA
ucaucuauugccacaucuac

SEQ ID NO: 67998 - RNA, 20 nt, Artificial Sequence
  MKO10067998_B_1700123K08Rik
  gRNA
uuccacgaagucuggcugga

SEQ ID NO: 67999 - RNA, 20 nt, Artificial Sequence
  MKO10067999_B_1700123O20Rik
  gRNA
uugagugucagcuacgucuu

SEQ ID NO: 68000 - RNA, 20 nt, Artificial Sequence
  MKO10068000_B_1700123O20Rik
  gRNA
ucuacaggaccuggucgcua

SEQ ID NO: 68001 - RNA, 20 nt, Artificial Sequence
  MKO10068001_B_1700123O20Rik
  gRNA
ggucagugagccagauuucg

SEQ ID NO: 68002 - RNA, 20 nt, Artificial Sequence
  MKO10068002_B_1700125H20Rik
  gRNA
ggagcguucccuguuuagag

SEQ ID NO: 68003 - RNA, 20 nt, Artificial Sequence
  MKO10068003_B_1700125H20Rik
  gRNA
aucacugcuugccaaccaag

SEQ ID NO: 68004 - RNA, 20 nt, Artificial Sequence
  MKO10068004_B_1700125H20Rik
  gRNA
guacaccaagacgaaccaga

SEQ ID NO: 68005 - RNA, 20 nt, Artificial Sequence
  MKO10068005_B_1700129C05Rik
  gRNA
guaccagggaaucugcagcc

SEQ ID NO: 68006 - RNA, 20 nt, Artificial Sequence
  MKO10068006_B_1700129C05Rik
  gRNA
aggacagaaugaauugucau

SEQ ID NO: 68007 - RNA, 20 nt, Artificial Sequence
  MKO10068007_B_1700129C05Rik
  gRNA
ugauuuccagucucuguccc

SEQ ID NO: 68008 - RNA, 20 nt, Artificial Sequence
  MKO10068008_B_1810009A15Rik
  gRNA
gauccuccauagcuacgucc

SEQ ID NO: 68009 - RNA, 20 nt, Artificial Sequence
  MKO10068009_B_1810009A15Rik
  gRNA
ggacgauugaucuuuccucc

SEQ ID NO: 68010 - RNA, 20 nt, Artificial Sequence
  MKO10068010_B_1810009A15Rik
  gRNA
cgugccaacaucacgcuguc

SEQ ID NO: 68011 - RNA, 20 nt, Artificial Sequence
  MKO10068011_B_1810009J06Rik
  gRNA
cgucugcaauggagagaucc

SEQ ID NO: 68012 - RNA, 20 nt, Artificial Sequence
  MKO10068012_B_1810009J06Rik
  gRNA
uauuuccccagccagaaaca

SEQ ID NO: 68013 - RNA, 20 nt, Artificial Sequence
  MKO10068013_B_1810009J06Rik
  gRNA
agaagacuccagguucgccu

SEQ ID NO: 68014 - RNA, 20 nt, Artificial Sequence
  MKO10068014_B_1810010H24Rik
  gRNA
ccgcgugcauauacuagccc

SEQ ID NO: 68015 - RNA, 20 nt, Artificial Sequence
  MKO10068015_B_1810010H24Rik
  gRNA
ugugaaaccgggcuaccuua

SEQ ID NO: 68016 - RNA, 20 nt, Artificial Sequence
  MKO10068016_B_1810010H24Rik
  gRNA
ucgauaccggguuuaaauuc

SEQ ID NO: 68017 - RNA, 20 nt, Artificial Sequence
  MKO10068017_B_1810011H11Rik
  gRNA
cauuggaggagcucaagugu

SEQ ID NO: 68018 - RNA, 20 nt, Artificial Sequence
  MKO10068018_B_1810011H11Rik
  gRNA
cagcucacagcucaaucucc

SEQ ID NO: 68019 - RNA, 20 nt, Artificial Sequence
  MKO10068019_B_1810011H11Rik
  gRNA
ugcugaagaagaaaagccca

SEQ ID NO: 68020 - RNA, 20 nt, Artificial Sequence
  MKO10068020_B_1810011O10Rik
  gRNA
ggagaaaacucgagcccuca

SEQ ID NO: 68021 - RNA, 20 nt, Artificial Sequence
  MKO10068021_B_1810011O10Rik
  gRNA
cugugucgaagugguagccg

SEQ ID NO: 68022 - RNA, 20 nt, Artificial Sequence
  MKO10068022_B_1810011O10Rik
  gRNA
gcccacagcuuucuugcgag

SEQ ID NO: 68023 - RNA, 20 nt, Artificial Sequence
  MKO10068023_B_1810013L24Rik
  gRNA
ugacggcgguggcugcguuu

SEQ ID NO: 68024 - RNA, 20 nt, Artificial Sequence
  MKO10068024_B_1810013L24Rik
  gRNA
aaguguucaaaucgacauca

SEQ ID NO: 68025 - RNA, 20 nt, Artificial Sequence
  MKO10068025_B_1810013L24Rik
  gRNA
agacaacugcucguccugcu

SEQ ID NO: 68026 - RNA, 20 nt, Artificial Sequence
  MKO10068026_B_1810019J16Rik
  gRNA
cugaggccguauggagcccc

SEQ ID NO: 68027 - RNA, 20 nt, Artificial Sequence
  MKO10068027_B_1810019J16Rik
  gRNA
aagagucuguguccgugccc

SEQ ID NO: 68028 - RNA, 20 nt, Artificial Sequence
  MKO10068028_B_1810019J16Rik
  gRNA
cagccaagacucaucauucc

SEQ ID NO: 68029 - RNA, 20 nt, Artificial Sequence
  MKO10068029_B_1810022K09Rik
  gRNA
uaaaucugugcagaaagagc

SEQ ID NO: 68030 - RNA, 20 nt, Artificial Sequence
  MKO10068030_B_1810022K09Rik
  gRNA
auggccaagaacaaauuaaa

SEQ ID NO: 68031 - RNA, 20 nt, Artificial Sequence
  MKO10068031_B_1810022K09Rik
  gRNA
ucugcacagauuuaagagaa

SEQ ID NO: 68032 - RNA, 20 nt, Artificial Sequence
  MKO10068032_B_1810024B03Rik
  gRNA
ugacaauagaccccacaaug

SEQ ID NO: 68033 - RNA, 20 nt, Artificial Sequence
  MKO10068033_B_1810024B03Rik
  gRNA
acaugauacuaucccagagc

SEQ ID NO: 68034 - RNA, 20 nt, Artificial Sequence
  MKO10068034_B_1810024B03Rik
  gRNA
agcucuggagacaggcgaua

SEQ ID NO: 68035 - RNA, 20 nt, Artificial Sequence
  MKO10068035_B_1810026J23Rik
  gRNA
ucccgcuucaccgugcccac

SEQ ID NO: 68036 - RNA, 20 nt, Artificial Sequence
  MKO10068036_B_1810026J23Rik
  gRNA
gaucauacucaccgacgauc

SEQ ID NO: 68037 - RNA, 20 nt, Artificial Sequence
  MKO10068037_B_1810026J23Rik
  gRNA
cgccugauccaccugaucgu

SEQ ID NO: 68038 - RNA, 20 nt, Artificial Sequence
  MKO10068038_B_1810030O07Rik
  gRNA
gaucugaaaaucucgaagcc

SEQ ID NO: 68039 - RNA, 20 nt, Artificial Sequence
  MKO10068039_B_1810030O07Rik
  gRNA
caacuccugugaucacuuug

SEQ ID NO: 68040 - RNA, 20 nt, Artificial Sequence
  MKO10068040_B_1810030O07Rik
  gRNA
acagaaauggagacgugcac

SEQ ID NO: 68041 - RNA, 20 nt, Artificial Sequence
  MKO10068041_B_1810033B17Rik
  gRNA
acccagcugaguccccgccu

SEQ ID NO: 68042 - RNA, 20 nt, Artificial Sequence
  MKO10068042_B_1810033B17Rik
  gRNA
aaauccucguuugcugauuc

SEQ ID NO: 68043 - RNA, 20 nt, Artificial Sequence
  MKO10068043_B_1810033B17Rik
  gRNA
agccaaguucaagacauccc

SEQ ID NO: 68044 - RNA, 20 nt, Artificial Sequence
  MKO10068044_B_1810037I17Rik
  gRNA
cgucugguaccgacgguguc

SEQ ID NO: 68045 - RNA, 20 nt, Artificial Sequence
  MKO10068045_B_1810037I17Rik
  gRNA
cgcggagauggaggugagcc

SEQ ID NO: 68046 - RNA, 20 nt, Artificial Sequence
  MKO10068046_B_1810037I17Rik
  gRNA
acacgaagacgaacaaggcc

SEQ ID NO: 68047 - RNA, 20 nt, Artificial Sequence
  MKO10068047_B_1810041L15Rik
  gRNA
agccggaugaugaccaguug

SEQ ID NO: 68048 - RNA, 20 nt, Artificial Sequence
  MKO10068048_B_1810041L15Rik
  gRNA
gguuugccugcaugaccgcc

SEQ ID NO: 68049 - RNA, 20 nt, Artificial Sequence
  MKO10068049_B_1810041L15Rik
  gRNA
gagccuuacacggaucacaa

SEQ ID NO: 68050 - RNA, 20 nt, Artificial Sequence
  MKO10068050_B_1810043G02Rik
  gRNA
ugcagcugcgcaccgguucc

SEQ ID NO: 68051 - RNA, 20 nt, Artificial Sequence
  MKO10068051_B_1810043G02Rik
  gRNA
cuggccgagaacccgugcug

SEQ ID NO: 68052 - RNA, 20 nt, Artificial Sequence
  MKO10068052_B_1810043G02Rik
  gRNA
accugagugugauuaccucu

SEQ ID NO: 68053 - RNA, 20 nt, Artificial Sequence
  MKO10068053_B_1810043H04Rik
  gRNA
ggaccgcucaugucugugaa

SEQ ID NO: 68054 - RNA, 20 nt, Artificial Sequence
  MKO10068054_B_1810043H04Rik
  gRNA
uuccuaggagccucccauca

SEQ ID NO: 68055 - RNA, 20 nt, Artificial Sequence
  MKO10068055_B_1810043H04Rik
  gRNA
ccaggccaagaagaccauga

SEQ ID NO: 68056 - RNA, 20 nt, Artificial Sequence
  MKO10068056_B_1810046K07Rik
  gRNA
guccuacucgcugcaugcac

SEQ ID NO: 68057 - RNA, 20 nt, Artificial Sequence
  MKO10068057_B_1810046K07Rik
  gRNA
gcagagucgaggugcugaac

SEQ ID NO: 68058 - RNA, 20 nt, Artificial Sequence
  MKO10068058_B_1810046K07Rik
  gRNA
aagaagauggcaguauggcc

SEQ ID NO: 68059 - RNA, 20 nt, Artificial Sequence
  MKO10068059_B_1810055G02Rik
  gRNA
cagcaagauguggacagccc

SEQ ID NO: 68060 - RNA, 20 nt, Artificial Sequence
  MKO10068060_B_1810055G02Rik
  gRNA
cagguggacuaccugaucaa

SEQ ID NO: 68061 - RNA, 20 nt, Artificial Sequence
  MKO10068061_B_1810055G02Rik
  gRNA
ggggauaugacgucuacauc

SEQ ID NO: 68062 - RNA, 20 nt, Artificial Sequence
  MKO10068062_B_1810062G17Rik
  gRNA
gugaaaccauuuccgcucug

SEQ ID NO: 68063 - RNA, 20 nt, Artificial Sequence
  MKO10068063_B_1810062G17Rik
  gRNA
aucuuagucaccuugcaccu

SEQ ID NO: 68064 - RNA, 20 nt, Artificial Sequence
  MKO10068064_B_1810062G17Rik
  gRNA
accaucugccaugcguaugc

SEQ ID NO: 68065 - RNA, 20 nt, Artificial Sequence
  MKO10068065_B_1810065E05Rik
  gRNA
gacgaggggguuggaaguac

SEQ ID NO: 68066 - RNA, 20 nt, Artificial Sequence
  MKO10068066_B_1810065E05Rik
  gRNA
ucgcucccugugcacuucag

SEQ ID NO: 68067 - RNA, 20 nt, Artificial Sequence
  MKO10068067_B_1810065E05Rik
  gRNA
agagguauugcauguaccca

SEQ ID NO: 68068 - RNA, 20 nt, Artificial Sequence
  MKO10068068_B_42431
  gRNA
cuguuuggucucgacaucaa

SEQ ID NO: 68069 - RNA, 20 nt, Artificial Sequence
  MKO10068069_B_42431
  gRNA
gcgucagguaauuguucucc

SEQ ID NO: 68070 - RNA, 20 nt, Artificial Sequence
  MKO10068070_B_42431
  gRNA
acuugggaugaacuccugau

SEQ ID NO: 68071 - RNA, 20 nt, Artificial Sequence
  MKO10068071_B_42615
  gRNA
caacagucgaagccucuauc

SEQ ID NO: 68072 - RNA, 20 nt, Artificial Sequence
  MKO10068072_B_42615
  gRNA
guucgaguucacucugaugg

SEQ ID NO: 68073 - RNA, 20 nt, Artificial Sequence
  MKO10068073_B_42615
  gRNA
uuucuggguagagaucaguc

SEQ ID NO: 68074 - RNA, 20 nt, Artificial Sequence
  MKO10068074_B_2010001E11Rik
  gRNA
ucaauguuaauuacugcagu

SEQ ID NO: 68075 - RNA, 20 nt, Artificial Sequence
  MKO10068075_B_2010001E11Rik
  gRNA
ugcuuacccaaaaguaaaaa

SEQ ID NO: 68076 - RNA, 20 nt, Artificial Sequence
  MKO10068076_B_2010001E11Rik
  gRNA
agcagaugcuguugugcccc

SEQ ID NO: 68077 - RNA, 20 nt, Artificial Sequence
  MKO10068077_B_2010002M12Rik
  gRNA
aagccuuuaccucauguugc

SEQ ID NO: 68078 - RNA, 20 nt, Artificial Sequence
  MKO10068078_B_2010002M12Rik
  gRNA
uccucccagaacaauaucuu

SEQ ID NO: 68079 - RNA, 20 nt, Artificial Sequence
  MKO10068079_B_2010002M12Rik
  gRNA
uugugagccacacuuccgca

SEQ ID NO: 68080 - RNA, 20 nt, Artificial Sequence
  MKO10068080_B_2010003K11Rik
  gRNA
agccuccccagagaccuugu

SEQ ID NO: 68081 - RNA, 20 nt, Artificial Sequence
  MKO10068081_B_2010003K11Rik
  gRNA
ccccgauggcacggaagggc

SEQ ID NO: 68082 - RNA, 20 nt, Artificial Sequence
  MKO10068082_B_2010003K11Rik
  gRNA
gguacugucucagccaccgc

SEQ ID NO: 68083 - RNA, 20 nt, Artificial Sequence
  MKO10068083_B_2010005H15Rik
  gRNA
cucaucagaaugaugccugg

SEQ ID NO: 68084 - RNA, 20 nt, Artificial Sequence
  MKO10068084_B_2010005H15Rik
  gRNA
gaacacuucauauuucucau

SEQ ID NO: 68085 - RNA, 20 nt, Artificial Sequence
  MKO10068085_B_2010005H15Rik
  gRNA
uauaaaucucaagucgucgc

SEQ ID NO: 68086 - RNA, 20 nt, Artificial Sequence
  MKO10068086_B_2010012O05Rik
  gRNA
acuucaguaagugacucaac

SEQ ID NO: 68087 - RNA, 20 nt, Artificial Sequence
  MKO10068087_B_2010012O05Rik
  gRNA
ggaacagucgccugaccugc

SEQ ID NO: 68088 - RNA, 20 nt, Artificial Sequence
  MKO10068088_B_2010012O05Rik
  gRNA
ugugcagaguuuaaggaaga

SEQ ID NO: 68089 - RNA, 20 nt, Artificial Sequence
  MKO10068089_B_2010015L04Rik
  gRNA
accuccauuaccgucaucca

SEQ ID NO: 68090 - RNA, 20 nt, Artificial Sequence
  MKO10068090_B_2010015L04Rik
  gRNA
caggaugaccuacauguugu

SEQ ID NO: 68091 - RNA, 20 nt, Artificial Sequence
  MKO10068091_B_2010015L04Rik
  gRNA
caaacuccagauccuccaac

SEQ ID NO: 68092 - RNA, 20 nt, Artificial Sequence
  MKO10068092_B_2010106E10Rik
  gRNA
ccucaacauaauucugcaua

SEQ ID NO: 68093 - RNA, 20 nt, Artificial Sequence
  MKO10068093_B_2010106E10Rik
  gRNA
gcaaugugccaucaaaaacc

SEQ ID NO: 68094 - RNA, 20 nt, Artificial Sequence
  MKO10068094_B_2010106E10Rik
  gRNA
uccucaaccuaaucaaagag

SEQ ID NO: 68095 - RNA, 20 nt, Artificial Sequence
  MKO10068095_B_2010107E04Rik
  gRNA
cuggguauaguaggguuuca

SEQ ID NO: 68096 - RNA, 20 nt, Artificial Sequence
  MKO10068096_B_2010107E04Rik
  gRNA
aaaagaaguaaagcuuugaa

SEQ ID NO: 68097 - RNA, 20 nt, Artificial Sequence
  MKO10068097_B_2010107E04Rik
  gRNA
aaaccuugauucaaaaaguc

SEQ ID NO: 68098 - RNA, 20 nt, Artificial Sequence
  MKO10068098_B_2010107G12Rik
  gRNA
ccgagaaacccacuagcauc

SEQ ID NO: 68099 - RNA, 20 nt, Artificial Sequence
  MKO10068099_B_2010107G12Rik
  gRNA
gcgauuaucacgccugugcu

SEQ ID NO: 68100 - RNA, 20 nt, Artificial Sequence
  MKO10068100_B_2010107G12Rik
  gRNA
acguccuacagugagaacgu

SEQ ID NO: 68101 - RNA, 20 nt, Artificial Sequence
  MKO10068101_B_2010107G23Rik
  gRNA
auccugaacgaucuccccau

SEQ ID NO: 68102 - RNA, 20 nt, Artificial Sequence
  MKO10068102_B_2010107G23Rik
  gRNA
gcagcaggcaggugcccgac

SEQ ID NO: 68103 - RNA, 20 nt, Artificial Sequence
  MKO10068103_B_2010107G23Rik
  gRNA
ggcgcaccuccagggggccc

SEQ ID NO: 68104 - RNA, 20 nt, Artificial Sequence
  MKO10068104_B_2010109A12Rik
  gRNA
auguucucuaccacgucucu

SEQ ID NO: 68105 - RNA, 20 nt, Artificial Sequence
  MKO10068105_B_2010109A12Rik
  gRNA
ggauaaaagucucaagagua

SEQ ID NO: 68106 - RNA, 20 nt, Artificial Sequence
  MKO10068106_B_2010109A12Rik
  gRNA
aauauccaacauuaucuuca

SEQ ID NO: 68107 - RNA, 20 nt, Artificial Sequence
  MKO10068107_B_2010109I03Rik
  gRNA
gguuccuggcacuauugcag

SEQ ID NO: 68108 - RNA, 20 nt, Artificial Sequence
  MKO10068108_B_2010109I03Rik
  gRNA
agaugaggacucaccugcuu

SEQ ID NO: 68109 - RNA, 20 nt, Artificial Sequence
  MKO10068109_B_2010109I03Rik
  gRNA
uuguugccccugauucugcu

SEQ ID NO: 68110 - RNA, 20 nt, Artificial Sequence
  MKO10068110_B_2010111I01Rik
  gRNA
gccaugaaauugcucacucc

SEQ ID NO: 68111 - RNA, 20 nt, Artificial Sequence
  MKO10068111_B_2010111I01Rik
  gRNA
gagugcguccgcugccuccc

SEQ ID NO: 68112 - RNA, 20 nt, Artificial Sequence
  MKO10068112_B_2010111I01Rik
  gRNA
aagcccacaccacuucgaga

SEQ ID NO: 68113 - RNA, 20 nt, Artificial Sequence
  MKO10068113_B_2010300C02Rik
  gRNA
aggacccugcucggcccgug

SEQ ID NO: 68114 - RNA, 20 nt, Artificial Sequence
  MKO10068114_B_2010300C02Rik
  gRNA
gccucaguuuacuugaucgc

SEQ ID NO: 68115 - RNA, 20 nt, Artificial Sequence
  MKO10068115_B_2010300C02Rik
  gRNA
gcgaugccuccaucucgucu

SEQ ID NO: 68116 - RNA, 20 nt, Artificial Sequence
  MKO10068116_B_2010315B03Rik
  gRNA
gaucugccagugaggugaca

SEQ ID NO: 68117 - RNA, 20 nt, Artificial Sequence
  MKO10068117_B_2010315B03Rik
  gRNA
ccagaagagucucuacaaag

SEQ ID NO: 68118 - RNA, 20 nt, Artificial Sequence
  MKO10068118_B_2010315B03Rik
  gRNA
gaaauuguucuucaauauaa

SEQ ID NO: 68119 - RNA, 20 nt, Artificial Sequence
  MKO10068119_B_2200002D01Rik
  gRNA
uagcagcuccagcgacucag

SEQ ID NO: 68120 - RNA, 20 nt, Artificial Sequence
  MKO10068120_B_2200002D01Rik
  gRNA
ugcggccaagucaaacucca

SEQ ID NO: 68121 - RNA, 20 nt, Artificial Sequence
  MKO10068121_B_2200002D01Rik
  gRNA
uucaugcuucuugcagccag

SEQ ID NO: 68122 - RNA, 20 nt, Artificial Sequence
  MKO10068122_B_2200002J24Rik
  gRNA
acuaauuaaucuaauagagc

SEQ ID NO: 68123 - RNA, 20 nt, Artificial Sequence
  MKO10068123_B_2200002J24Rik
  gRNA
agacagagguaauccuucgc

SEQ ID NO: 68124 - RNA, 20 nt, Artificial Sequence
  MKO10068124_B_2200002J24Rik
  gRNA
acccgggaagccaacucugu

SEQ ID NO: 68125 - RNA, 20 nt, Artificial Sequence
  MKO10068125_B_2210010C04Rik
  gRNA
cacuagcaacauguucuguc

SEQ ID NO: 68126 - RNA, 20 nt, Artificial Sequence
  MKO10068126_B_2210010C04Rik
  gRNA
ucuugcacaaguucuuaccc

SEQ ID NO: 68127 - RNA, 20 nt, Artificial Sequence
  MKO10068127_B_2210010C04Rik
  gRNA
caucaauguuguguucuccc

SEQ ID NO: 68128 - RNA, 20 nt, Artificial Sequence
  MKO10068128_B_2210013O21Rik
  gRNA
ccuuuagcaucacaacuucc

SEQ ID NO: 68129 - RNA, 20 nt, Artificial Sequence
  MKO10068129_B_2210013O21Rik
  gRNA
uaauguaauacagcaaagac

SEQ ID NO: 68130 - RNA, 20 nt, Artificial Sequence
  MKO10068130_B_2210013O21Rik
  gRNA
cucuauuugacugugccacu

SEQ ID NO: 68131 - RNA, 20 nt, Artificial Sequence
  MKO10068131_B_2210016F16Rik
  gRNA
cacuccacguguccgccacg

SEQ ID NO: 68132 - RNA, 20 nt, Artificial Sequence
  MKO10068132_B_2210016F16Rik
  gRNA
uuuggugugucgagcugauc

SEQ ID NO: 68133 - RNA, 20 nt, Artificial Sequence
  MKO10068133_B_2210016F16Rik
  gRNA
gggacuaugcccgagagcac

SEQ ID NO: 68134 - RNA, 20 nt, Artificial Sequence
  MKO10068134_B_2210016L21Rik
  gRNA
cuucuuccaaacuucugcga

SEQ ID NO: 68135 - RNA, 20 nt, Artificial Sequence
  MKO10068135_B_2210016L21Rik
  gRNA
ccauugccaucgcagaaguu

SEQ ID NO: 68136 - RNA, 20 nt, Artificial Sequence
  MKO10068136_B_2210016L21Rik
  gRNA
cgaccccgcagccaagccgc

SEQ ID NO: 68137 - RNA, 20 nt, Artificial Sequence
  MKO10068137_B_2210018M11Rik
  gRNA
cugcucuccgaacuucagca

SEQ ID NO: 68138 - RNA, 20 nt, Artificial Sequence
  MKO10068138_B_2210018M11Rik
  gRNA
agcauucgcuguuacaguga

SEQ ID NO: 68139 - RNA, 20 nt, Artificial Sequence
  MKO10068139_B_2210018M11Rik
  gRNA
uggucuuucacccaaauaua

SEQ ID NO: 68140 - RNA, 20 nt, Artificial Sequence
  MKO10068140_B_2210404O07Rik
  gRNA
gaagggcggacagagcaacg

SEQ ID NO: 68141 - RNA, 20 nt, Artificial Sequence
  MKO10068141_B_2210404O07Rik
  gRNA
ugaacgagaacucacagcca

SEQ ID NO: 68142 - RNA, 20 nt, Artificial Sequence
  MKO10068142_B_2210404O07Rik
  gRNA
ugugcuggccauggacaccu

SEQ ID NO: 68143 - RNA, 20 nt, Artificial Sequence
  MKO10068143_B_2210404O09Rik
  gRNA
uucucucauaaaugcuccuc

SEQ ID NO: 68144 - RNA, 20 nt, Artificial Sequence
  MKO10068144_B_2210404O09Rik
  gRNA
uguggcuguggacuucucac

SEQ ID NO: 68145 - RNA, 20 nt, Artificial Sequence
  MKO10068145_B_2210404O09Rik
  gRNA
gacaaauccuuuacgcaaaa

SEQ ID NO: 68146 - RNA, 20 nt, Artificial Sequence
  MKO10068146_B_2210407C18Rik
  gRNA
gcagcuauaagagguuagac

SEQ ID NO: 68147 - RNA, 20 nt, Artificial Sequence
  MKO10068147_B_2210407C18Rik
  gRNA
auacaagcuacgugugaaaa

SEQ ID NO: 68148 - RNA, 20 nt, Artificial Sequence
  MKO10068148_B_2210407C18Rik
  gRNA
aaccuaguacuugagcaaaa

SEQ ID NO: 68149 - RNA, 20 nt, Artificial Sequence
  MKO10068149_B_2210408I21Rik
  gRNA
cacaguaccuggagaacucc

SEQ ID NO: 68150 - RNA, 20 nt, Artificial Sequence
  MKO10068150_B_2210408I21Rik
  gRNA
aauauuggagaaaucuaaga

SEQ ID NO: 68151 - RNA, 20 nt, Artificial Sequence
  MKO10068151_B_2210408I21Rik
  gRNA
caacaagugacugcuucaaa

SEQ ID NO: 68152 - RNA, 20 nt, Artificial Sequence
  MKO10068152_B_2300002M23Rik
  gRNA
gagcccggcucccaccugcg

SEQ ID NO: 68153 - RNA, 20 nt, Artificial Sequence
  MKO10068153_B_2300002M23Rik
  gRNA
ggguaggaagccgcuaguga

SEQ ID NO: 68154 - RNA, 20 nt, Artificial Sequence
  MKO10068154_B_2300002M23Rik
  gRNA
cgaccgccucuggaaaggua

SEQ ID NO: 68155 - RNA, 20 nt, Artificial Sequence
  MKO10068155_B_2300003K06Rik
  gRNA
guagcagguggauuggcaac

SEQ ID NO: 68156 - RNA, 20 nt, Artificial Sequence
  MKO10068156_B_2300003K06Rik
  gRNA
uggguuuccaaaugaaugua

SEQ ID NO: 68157 - RNA, 20 nt, Artificial Sequence
  MKO10068157_B_2300003K06Rik
  gRNA
guugcagaccuaacugcugc

SEQ ID NO: 68158 - RNA, 20 nt, Artificial Sequence
  MKO10068158_B_2300005B03Rik
  gRNA
auccuccaaaucccuugcac

SEQ ID NO: 68159 - RNA, 20 nt, Artificial Sequence
  MKO10068159_B_2300005B03Rik
  gRNA
uagcuccaugcucaagacca

SEQ ID NO: 68160 - RNA, 20 nt, Artificial Sequence
  MKO10068160_B_2300005B03Rik
  gRNA
agaacaugaggcuucccuuc

SEQ ID NO: 68161 - RNA, 20 nt, Artificial Sequence
  MKO10068161_B_2300009A05Rik
  gRNA
ccaaguccauauaauaaagu

SEQ ID NO: 68162 - RNA, 20 nt, Artificial Sequence
  MKO10068162_B_2300009A05Rik
  gRNA
ucggccugucgcacuucaau

SEQ ID NO: 68163 - RNA, 20 nt, Artificial Sequence
  MKO10068163_B_2300009A05Rik
  gRNA
ugaagugcgacaggccgaac

SEQ ID NO: 68164 - RNA, 20 nt, Artificial Sequence
  MKO10068164_B_2310002J15Rik
  gRNA
gggcuucaguaguuuguaag

SEQ ID NO: 68165 - RNA, 20 nt, Artificial Sequence
  MKO10068165_B_2310002J15Rik
  gRNA
ucagagcgcaggugagcccg

SEQ ID NO: 68166 - RNA, 20 nt, Artificial Sequence
  MKO10068166_B_2310002J15Rik
  gRNA
ucugggauacauguuccugc

SEQ ID NO: 68167 - RNA, 20 nt, Artificial Sequence
  MKO10068167_B_2310002L09Rik
  gRNA
aaggucauaccucgaaaugc

SEQ ID NO: 68168 - RNA, 20 nt, Artificial Sequence
  MKO10068168_B_2310002L09Rik
  gRNA
ucuggcuauggcauagagac

SEQ ID NO: 68169 - RNA, 20 nt, Artificial Sequence
  MKO10068169_B_2310002L09Rik
  gRNA
cucuggucaagcguugcucc

SEQ ID NO: 68170 - RNA, 20 nt, Artificial Sequence
  MKO10068170_B_2310003H01Rik
  gRNA
uguccagcgaguccaacgac

SEQ ID NO: 68171 - RNA, 20 nt, Artificial Sequence
  MKO10068171_B_2310003H01Rik
  gRNA
cgggaagugacguugccccu

SEQ ID NO: 68172 - RNA, 20 nt, Artificial Sequence
  MKO10068172_B_2310003H01Rik
  gRNA
aggcaauacucacgcagcuc

SEQ ID NO: 68173 - RNA, 20 nt, Artificial Sequence
  MKO10068173_B_2310005G13Rik
  gRNA
cauagcuguccaccacuauc

SEQ ID NO: 68174 - RNA, 20 nt, Artificial Sequence
  MKO10068174_B_2310005G13Rik
  gRNA
gcaucaaccuaugucaucau

SEQ ID NO: 68175 - RNA, 20 nt, Artificial Sequence
  MKO10068175_B_2310005G13Rik
  gRNA
uguacuccaccagagaccua

SEQ ID NO: 68176 - RNA, 20 nt, Artificial Sequence
  MKO10068176_B_2310007B03Rik
  gRNA
ccgcuucaacguugugcccg

SEQ ID NO: 68177 - RNA, 20 nt, Artificial Sequence
  MKO10068177_B_2310007B03Rik
  gRNA
accgcguaaaccuagaaagu

SEQ ID NO: 68178 - RNA, 20 nt, Artificial Sequence
  MKO10068178_B_2310007B03Rik
  gRNA
cugguaccagguccaccccg

SEQ ID NO: 68179 - RNA, 20 nt, Artificial Sequence
  MKO10068179_B_2310007L24Rik
  gRNA
aacuguuaccuuccuugacc

SEQ ID NO: 68180 - RNA, 20 nt, Artificial Sequence
  MKO10068180_B_2310007L24Rik
  gRNA
cuucucagccucagcauaac

SEQ ID NO: 68181 - RNA, 20 nt, Artificial Sequence
  MKO10068181_B_2310007L24Rik
  gRNA
cugccccuaccugaagcugg

SEQ ID NO: 68182 - RNA, 20 nt, Artificial Sequence
  MKO10068182_B_2310009B15Rik
  gRNA
ccuugugagaaccacauagc

SEQ ID NO: 68183 - RNA, 20 nt, Artificial Sequence
  MKO10068183_B_2310009B15Rik
  gRNA
uugaauugcuucuucuuaga

SEQ ID NO: 68184 - RNA, 20 nt, Artificial Sequence
  MKO10068184_B_2310009B15Rik
  gRNA
uuguugucaaacauaaaaau

SEQ ID NO: 68185 - RNA, 20 nt, Artificial Sequence
  MKO10068185_B_2310011J03Rik
  gRNA
ccucucauucauagccacgu

SEQ ID NO: 68186 - RNA, 20 nt, Artificial Sequence
  MKO10068186_B_2310011J03Rik
  gRNA
caccuacaagaugaacucca

SEQ ID NO: 68187 - RNA, 20 nt, Artificial Sequence
  MKO10068187_B_2310011J03Rik
  gRNA
cugcuccaccgugggaggcg

SEQ ID NO: 68188 - RNA, 20 nt, Artificial Sequence
  MKO10068188_B_2310014L17Rik
  gRNA
cagcuugaaaaugccgucga

SEQ ID NO: 68189 - RNA, 20 nt, Artificial Sequence
  MKO10068189_B_2310014L17Rik
  gRNA
aguggcgcgcgcgcaucgcg

SEQ ID NO: 68190 - RNA, 20 nt, Artificial Sequence
  MKO10068190_B_2310014L17Rik
  gRNA
cucuuucgcggcccgggaga

SEQ ID NO: 68191 - RNA, 20 nt, Artificial Sequence
  MKO10068191_B_2310022A10Rik
  gRNA
uaaccccagccacuuccgag

SEQ ID NO: 68192 - RNA, 20 nt, Artificial Sequence
  MKO10068192_B_2310022A10Rik
  gRNA
aucacagcguaauuaacagc

SEQ ID NO: 68193 - RNA, 20 nt, Artificial Sequence
  MKO10068193_B_2310022A10Rik
  gRNA
uaaagaaaucaugaacgagc

SEQ ID NO: 68194 - RNA, 20 nt, Artificial Sequence
  MKO10068194_B_2310022B05Rik
  gRNA
aggccccucccgagagcgcu

SEQ ID NO: 68195 - RNA, 20 nt, Artificial Sequence
  MKO10068195_B_2310022B05Rik
  gRNA
ucaacuuacccucgucuccc

SEQ ID NO: 68196 - RNA, 20 nt, Artificial Sequence
  MKO10068196_B_2310022B05Rik
  gRNA
aacacucggccccauucucc

SEQ ID NO: 68197 - RNA, 20 nt, Artificial Sequence
  MKO10068197_B_2310030G06Rik
  gRNA
ccugggagacacaaccgcca

SEQ ID NO: 68198 - RNA, 20 nt, Artificial Sequence
  MKO10068198_B_2310030G06Rik
  gRNA
ugcucaaugugggucuuggg

SEQ ID NO: 68199 - RNA, 20 nt, Artificial Sequence
  MKO10068199_B_2310030G06Rik
  gRNA
uccugaagcagcaacagcug

SEQ ID NO: 68200 - RNA, 20 nt, Artificial Sequence
  MKO10068200_B_2310033P09Rik
  gRNA
guccccugcaguggcuccgc

SEQ ID NO: 68201 - RNA, 20 nt, Artificial Sequence
  MKO10068201_B_2310033P09Rik
  gRNA
cguggaccggcuccugggcu

SEQ ID NO: 68202 - RNA, 20 nt, Artificial Sequence
  MKO10068202_B_2310033P09Rik
  gRNA
gcagugguuacaagaacgug

SEQ ID NO: 68203 - RNA, 20 nt, Artificial Sequence
  MKO10068203_B_2310034C09Rik
  gRNA
cuuaacagcugaugccgcag

SEQ ID NO: 68204 - RNA, 20 nt, Artificial Sequence
  MKO10068204_B_2310034C09Rik
  gRNA
agccauagacuccacaauug

SEQ ID NO: 68205 - RNA, 20 nt, Artificial Sequence
  MKO10068205_B_2310034C09Rik
  gRNA
gccuaccauccuaccauuaa

SEQ ID NO: 68206 - RNA, 20 nt, Artificial Sequence
  MKO10068206_B_2310035C23Rik
  gRNA
uuaacaaaaacucauugacu

SEQ ID NO: 68207 - RNA, 20 nt, Artificial Sequence
  MKO10068207_B_2310035C23Rik
  gRNA
caaucacccaccugaauuuc

SEQ ID NO: 68208 - RNA, 20 nt, Artificial Sequence
  MKO10068208_B_2310035C23Rik
  gRNA
uuugcaagauauucagauga

SEQ ID NO: 68209 - RNA, 20 nt, Artificial Sequence
  MKO10068209_B_2310036O22Rik
  gRNA
cgggagggagucauuucacc

SEQ ID NO: 68210 - RNA, 20 nt, Artificial Sequence
  MKO10068210_B_2310036O22Rik
  gRNA
gaacaaacuagcccucaaga

SEQ ID NO: 68211 - RNA, 20 nt, Artificial Sequence
  MKO10068211_B_2310036O22Rik
  gRNA
acccaggugggcaagcgcag

SEQ ID NO: 68212 - RNA, 20 nt, Artificial Sequence
  MKO10068212_B_2310039H08Rik
  gRNA
gccccgggaucgcuccucga

SEQ ID NO: 68213 - RNA, 20 nt, Artificial Sequence
  MKO10068213_B_2310039H08Rik
  gRNA
gcaccaucgcccuagacacg

SEQ ID NO: 68214 - RNA, 20 nt, Artificial Sequence
  MKO10068214_B_2310039H08Rik
  gRNA
cuccaguccgagcggugcac

SEQ ID NO: 68215 - RNA, 20 nt, Artificial Sequence
  MKO10068215_B_2310042D19Rik
  gRNA
acagucuugcucgccaacau

SEQ ID NO: 68216 - RNA, 20 nt, Artificial Sequence
  MKO10068216_B_2310042D19Rik
  gRNA
cagucaaaacgacaugugcc

SEQ ID NO: 68217 - RNA, 20 nt, Artificial Sequence
  MKO10068217_B_2310042D19Rik
  gRNA
gacugaacguaaaugaagug

SEQ ID NO: 68218 - RNA, 20 nt, Artificial Sequence
  MKO10068218_B_2310042E22Rik
  gRNA
ucgagugugcaugcacaucu

SEQ ID NO: 68219 - RNA, 20 nt, Artificial Sequence
  MKO10068219_B_2310042E22Rik
  gRNA
ugcuuuccugucauggcuuu

SEQ ID NO: 68220 - RNA, 20 nt, Artificial Sequence
  MKO10068220_B_2310042E22Rik
  gRNA
uauugagaacaaaagcgucu

SEQ ID NO: 68221 - RNA, 20 nt, Artificial Sequence
  MKO10068221_B_2310044G17Rik
  gRNA
cgggucucgagcuauccccg

SEQ ID NO: 68222 - RNA, 20 nt, Artificial Sequence
  MKO10068222_B_2310044G17Rik
  gRNA
uggucauggagcggcgaccc

SEQ ID NO: 68223 - RNA, 20 nt, Artificial Sequence
  MKO10068223_B_2310044G17Rik
  gRNA
acgcucuucaugacgaccau

SEQ ID NO: 68224 - RNA, 20 nt, Artificial Sequence
  MKO10068224_B_2310045N01Rik
  gRNA
gcgccguucacugccagagc

SEQ ID NO: 68225 - RNA, 20 nt, Artificial Sequence
  MKO10068225_B_2310045N01Rik
  gRNA
ucaaacaggccaucaguauc

SEQ ID NO: 68226 - RNA, 20 nt, Artificial Sequence
  MKO10068226_B_2310045N01Rik
  gRNA
ucaccugcaggcguacucca

SEQ ID NO: 68227 - RNA, 20 nt, Artificial Sequence
  MKO10068227_B_2310047M10Rik
  gRNA
cggccugccgcugaaagucg

SEQ ID NO: 68228 - RNA, 20 nt, Artificial Sequence
  MKO10068228_B_2310047M10Rik
  gRNA
caccaucccucccaucgacc

SEQ ID NO: 68229 - RNA, 20 nt, Artificial Sequence
  MKO10068229_B_2310047M10Rik
  gRNA
gggccccugacggcgucgcc

SEQ ID NO: 68230 - RNA, 20 nt, Artificial Sequence
  MKO10068230_B_2310050C09Rik
  gRNA
ggcacuucacauuaguuguc

SEQ ID NO: 68231 - RNA, 20 nt, Artificial Sequence
  MKO10068231_B_2310050C09Rik
  gRNA
uugacagaggucgucugaca

SEQ ID NO: 68232 - RNA, 20 nt, Artificial Sequence
  MKO10068232_B_2310050C09Rik
  gRNA
gacauauuauguccaguauc

SEQ ID NO: 68233 - RNA, 20 nt, Artificial Sequence
  MKO10068233_B_2310057J18Rik
  gRNA
guggaggcaggaucgugauu

SEQ ID NO: 68234 - RNA, 20 nt, Artificial Sequence
  MKO10068234_B_2310057J18Rik
  gRNA
uugaauuccagugacuuuga

SEQ ID NO: 68235 - RNA, 20 nt, Artificial Sequence
  MKO10068235_B_2310057J18Rik
  gRNA
cauuucuuaccugucuccaa

SEQ ID NO: 68236 - RNA, 20 nt, Artificial Sequence
  MKO10068236_B_2310057M21Rik
  gRNA
gcaggcagucuugccucgac

SEQ ID NO: 68237 - RNA, 20 nt, Artificial Sequence
  MKO10068237_B_2310057M21Rik
  gRNA
aacucagaacgccaaccgaa

SEQ ID NO: 68238 - RNA, 20 nt, Artificial Sequence
  MKO10068238_B_2310057M21Rik
  gRNA
cacacacugcuucuccccga

SEQ ID NO: 68239 - RNA, 20 nt, Artificial Sequence
  MKO10068239_B_2310057N15Rik
  gRNA
ucuuguuauagaucagucug

SEQ ID NO: 68240 - RNA, 20 nt, Artificial Sequence
  MKO10068240_B_2310057N15Rik
  gRNA
ccuguagaagccacauacac

SEQ ID NO: 68241 - RNA, 20 nt, Artificial Sequence
  MKO10068241_B_2310057N15Rik
  gRNA
auccaguggcuucagauccc

SEQ ID NO: 68242 - RNA, 20 nt, Artificial Sequence
  MKO10068242_B_2310061I04Rik
  gRNA
gaccgccuugccccuauccu

SEQ ID NO: 68243 - RNA, 20 nt, Artificial Sequence
  MKO10068243_B_2310061I04Rik
  gRNA
ccucaucugucgccaucacc

SEQ ID NO: 68244 - RNA, 20 nt, Artificial Sequence
  MKO10068244_B_2310061I04Rik
  gRNA
ugacuacacuauauauucaa

SEQ ID NO: 68245 - RNA, 20 nt, Artificial Sequence
  MKO10068245_B_2310061N02Rik
  gRNA
ggaacccagauggcgguuuc

SEQ ID NO: 68246 - RNA, 20 nt, Artificial Sequence
  MKO10068246_B_2310061N02Rik
  gRNA
aguucugaugauagccguga

SEQ ID NO: 68247 - RNA, 20 nt, Artificial Sequence
  MKO10068247_B_2310061N02Rik
  gRNA
guagcacaguugaccuccau

SEQ ID NO: 68248 - RNA, 20 nt, Artificial Sequence
  MKO10068248_B_2310067B10Rik
  gRNA
ccugcagggagagccccccu

SEQ ID NO: 68249 - RNA, 20 nt, Artificial Sequence
  MKO10068249_B_2310067B10Rik
  gRNA
ggccccgggccaguggaaac

SEQ ID NO: 68250 - RNA, 20 nt, Artificial Sequence
  MKO10068250_B_2310067B10Rik
  gRNA
ccacuaccuugaugccccuc

SEQ ID NO: 68251 - RNA, 20 nt, Artificial Sequence
  MKO10068251_B_2310079G19Rik
  gRNA
cccuugggcuauaugaccua

SEQ ID NO: 68252 - RNA, 20 nt, Artificial Sequence
  MKO10068252_B_2310079G19Rik
  gRNA
gccaaucaaccagcugcaac

SEQ ID NO: 68253 - RNA, 20 nt, Artificial Sequence
  MKO10068253_B_2310079G19Rik
  gRNA
ccagauaucccggaaguaau

SEQ ID NO: 68254 - RNA, 20 nt, Artificial Sequence
  MKO10068254_B_2410002F23Rik
  gRNA
caucuuuaacuaccgcugca

SEQ ID NO: 68255 - RNA, 20 nt, Artificial Sequence
  MKO10068255_B_2410002F23Rik
  gRNA
cuacacauacacggaguugu

SEQ ID NO: 68256 - RNA, 20 nt, Artificial Sequence
  MKO10068256_B_2410002F23Rik
  gRNA
gccccagcuccccagaauuc

SEQ ID NO: 68257 - RNA, 20 nt, Artificial Sequence
  MKO10068257_B_2410004B18Rik
  gRNA
uugaucgccauguccagcuc

SEQ ID NO: 68258 - RNA, 20 nt, Artificial Sequence
  MKO10068258_B_2410004B18Rik
  gRNA
aagauucgcagaguggagcc

SEQ ID NO: 68259 - RNA, 20 nt, Artificial Sequence
  MKO10068259_B_2410004B18Rik
  gRNA
aauucucuacuucuucuucu

SEQ ID NO: 68260 - RNA, 20 nt, Artificial Sequence
  MKO10068260_B_2410004P03Rik
  gRNA
ccagagggucauagucuuuc

SEQ ID NO: 68261 - RNA, 20 nt, Artificial Sequence
  MKO10068261_B_2410004P03Rik
  gRNA
cagcaggguggacacacccc

SEQ ID NO: 68262 - RNA, 20 nt, Artificial Sequence
  MKO10068262_B_2410004P03Rik
  gRNA
ccuuccccugcucuaccaac

SEQ ID NO: 68263 - RNA, 20 nt, Artificial Sequence
  MKO10068263_B_2410012M07Rik
  gRNA
gaacuggacaucaacaugcu

SEQ ID NO: 68264 - RNA, 20 nt, Artificial Sequence
  MKO10068264_B_2410012M07Rik
  gRNA
cuccaagacuccacccauuu

SEQ ID NO: 68265 - RNA, 20 nt, Artificial Sequence
  MKO10068265_B_2410012M07Rik
  gRNA
gggacuugguccugagacaa

SEQ ID NO: 68266 - RNA, 20 nt, Artificial Sequence
  MKO10068266_B_2410015M20Rik
  gRNA
uaaccaugguggcucgagug

SEQ ID NO: 68267 - RNA, 20 nt, Artificial Sequence
  MKO10068267_B_2410015M20Rik
  gRNA
caaggcccgagaauacucca

SEQ ID NO: 68268 - RNA, 20 nt, Artificial Sequence
  MKO10068268_B_2410015M20Rik
  gRNA
caauaugugugccagcagac

SEQ ID NO: 68269 - RNA, 20 nt, Artificial Sequence
  MKO10068269_B_2410016O06Rik
  gRNA
gcaggaccgcagcuacuacg

SEQ ID NO: 68270 - RNA, 20 nt, Artificial Sequence
  MKO10068270_B_2410016O06Rik
  gRNA
cgcuacgaggacgugcaauu

SEQ ID NO: 68271 - RNA, 20 nt, Artificial Sequence
  MKO10068271_B_2410016O06Rik
  gRNA
gcucgcacgcggaugagccg

SEQ ID NO: 68272 - RNA, 20 nt, Artificial Sequence
  MKO10068272_B_2410018M08Rik
  gRNA
gagggucucacccggccaga

SEQ ID NO: 68273 - RNA, 20 nt, Artificial Sequence
  MKO10068273_B_2410018M08Rik
  gRNA
gcucaccugguaagugaugu

SEQ ID NO: 68274 - RNA, 20 nt, Artificial Sequence
  MKO10068274_B_2410018M08Rik
  gRNA
ccagccgggccccucagaug

SEQ ID NO: 68275 - RNA, 20 nt, Artificial Sequence
  MKO10068275_B_2410076I21Rik
  gRNA
ggagccugacagcaccaccc

SEQ ID NO: 68276 - RNA, 20 nt, Artificial Sequence
  MKO10068276_B_2410076I21Rik
  gRNA
guugaagauuguaagacgca

SEQ ID NO: 68277 - RNA, 20 nt, Artificial Sequence
  MKO10068277_B_2410076I21Rik
  gRNA
auguuucguguccaguuuag

SEQ ID NO: 68278 - RNA, 20 nt, Artificial Sequence
  MKO10068278_B_2410089E03Rik
  gRNA
uacuuauacguagcugaaaa

SEQ ID NO: 68279 - RNA, 20 nt, Artificial Sequence
  MKO10068279_B_2410089E03Rik
  gRNA
aauccugaucuuuguuccac

SEQ ID NO: 68280 - RNA, 20 nt, Artificial Sequence
  MKO10068280_B_2410089E03Rik
  gRNA
gccgcuuuaauagcuucuuu

SEQ ID NO: 68281 - RNA, 20 nt, Artificial Sequence
  MKO10068281_B_2410124H12Rik
  gRNA
gaagaggaugucgauuggcu

SEQ ID NO: 68282 - RNA, 20 nt, Artificial Sequence
  MKO10068282_B_2410124H12Rik
  gRNA
guagugccuucacgccacgc

SEQ ID NO: 68283 - RNA, 20 nt, Artificial Sequence
  MKO10068283_B_2410124H12Rik
  gRNA
gcgcuacuugcuccgccacg

SEQ ID NO: 68284 - RNA, 20 nt, Artificial Sequence
  MKO10068284_B_2410127L17Rik
  gRNA
auguaugcaaucauucacaa

SEQ ID NO: 68285 - RNA, 20 nt, Artificial Sequence
  MKO10068285_B_2410127L17Rik
  gRNA
acagaacagaaagacaguuu

SEQ ID NO: 68286 - RNA, 20 nt, Artificial Sequence
  MKO10068286_B_2410127L17Rik
  gRNA
gccagcaucuacauuugaca

SEQ ID NO: 68287 - RNA, 20 nt, Artificial Sequence
  MKO10068287_B_2410131K14Rik
  gRNA
gcaggagacgcaguacucgu

SEQ ID NO: 68288 - RNA, 20 nt, Artificial Sequence
  MKO10068288_B_2410131K14Rik
  gRNA
ugggucggcugcuguugccu

SEQ ID NO: 68289 - RNA, 20 nt, Artificial Sequence
  MKO10068289_B_2410131K14Rik
  gRNA
uagccaagcacaguucgaag

SEQ ID NO: 68290 - RNA, 20 nt, Artificial Sequence
  MKO10068290_B_2410137M14Rik
  gRNA
cacuaccuuuacuccauuuc

SEQ ID NO: 68291 - RNA, 20 nt, Artificial Sequence
  MKO10068291_B_2410137M14Rik
  gRNA
gaacagaaugcagaacgauu

SEQ ID NO: 68292 - RNA, 20 nt, Artificial Sequence
  MKO10068292_B_2410137M14Rik
  gRNA
gcaccuccagugaccaaaac

SEQ ID NO: 68293 - RNA, 20 nt, Artificial Sequence
  MKO10068293_B_2410141K09Rik
  gRNA
ugaacuucacuaaagaagag

SEQ ID NO: 68294 - RNA, 20 nt, Artificial Sequence
  MKO10068294_B_2410141K09Rik
  gRNA
cagucuuaccuauagaagua

SEQ ID NO: 68295 - RNA, 20 nt, Artificial Sequence
  MKO10068295_B_2410141K09Rik
  gRNA
ugucuucgagaacuuugaca

SEQ ID NO: 68296 - RNA, 20 nt, Artificial Sequence
  MKO10068296_B_2510002D24Rik
  gRNA
ggccuggacauggcggucgc

SEQ ID NO: 68297 - RNA, 20 nt, Artificial Sequence
  MKO10068297_B_2510002D24Rik
  gRNA
aucccucugugagagcgagc

SEQ ID NO: 68298 - RNA, 20 nt, Artificial Sequence
  MKO10068298_B_2510002D24Rik
  gRNA
accugacuaacugccgcgag

SEQ ID NO: 68299 - RNA, 20 nt, Artificial Sequence
  MKO10068299_B_2510003E04Rik
  gRNA
agacuugagccagguaauac

SEQ ID NO: 68300 - RNA, 20 nt, Artificial Sequence
  MKO10068300_B_2510003E04Rik
  gRNA
ccgaugacuccagguagguc

SEQ ID NO: 68301 - RNA, 20 nt, Artificial Sequence
  MKO10068301_B_2510003E04Rik
  gRNA
aacuuacugucuucuguagc

SEQ ID NO: 68302 - RNA, 20 nt, Artificial Sequence
  MKO10068302_B_2510009E07Rik
  gRNA
cccgacuuccagccgugcga

SEQ ID NO: 68303 - RNA, 20 nt, Artificial Sequence
  MKO10068303_B_2510009E07Rik
  gRNA
gaaugguguuagucggcucu

SEQ ID NO: 68304 - RNA, 20 nt, Artificial Sequence
  MKO10068304_B_2510009E07Rik
  gRNA
cucgcucuuccagccgcgcu

SEQ ID NO: 68305 - RNA, 20 nt, Artificial Sequence
  MKO10068305_B_2510039O18Rik
  gRNA
uaaggugcagcgugugccgc

SEQ ID NO: 68306 - RNA, 20 nt, Artificial Sequence
  MKO10068306_B_2510039O18Rik
  gRNA
ucgagguucacucagacacu

SEQ ID NO: 68307 - RNA, 20 nt, Artificial Sequence
  MKO10068307_B_2510039O18Rik
  gRNA
gcgggagccugccgugacgc

SEQ ID NO: 68308 - RNA, 20 nt, Artificial Sequence
  MKO10068308_B_2510049J12Rik
  gRNA
guuggaaucacuaacacacg

SEQ ID NO: 68309 - RNA, 20 nt, Artificial Sequence
  MKO10068309_B_2510049J12Rik
  gRNA
uaccuaccuaugaggcagcc

SEQ ID NO: 68310 - RNA, 20 nt, Artificial Sequence
  MKO10068310_B_2510049J12Rik
  gRNA
ugacugaccaucccgaccca

SEQ ID NO: 68311 - RNA, 20 nt, Artificial Sequence
  MKO10068311_B_2610002J02Rik
  gRNA
acuucgggucaaacgccuuc

SEQ ID NO: 68312 - RNA, 20 nt, Artificial Sequence
  MKO10068312_B_2610002J02Rik
  gRNA
uaggcugacccagcuagaug

SEQ ID NO: 68313 - RNA, 20 nt, Artificial Sequence
  MKO10068313_B_2610002J02Rik
  gRNA
agugcaccgaagauguggug

SEQ ID NO: 68314 - RNA, 20 nt, Artificial Sequence
  MKO10068314_B_2610002M06Rik
  gRNA
aaucuauggaugcuacauug

SEQ ID NO: 68315 - RNA, 20 nt, Artificial Sequence
  MKO10068315_B_2610002M06Rik
  gRNA
aguucaaacugcaguaacaa

SEQ ID NO: 68316 - RNA, 20 nt, Artificial Sequence
  MKO10068316_B_2610002M06Rik
  gRNA
uugcugcaaaagaacuuaau

SEQ ID NO: 68317 - RNA, 20 nt, Artificial Sequence
  MKO10068317_B_2610008E11Rik
  gRNA
uugaacuucaaguuaucgca

SEQ ID NO: 68318 - RNA, 20 nt, Artificial Sequence
  MKO10068318_B_2610008E11Rik
  gRNA
accugaguugauccucaugu

SEQ ID NO: 68319 - RNA, 20 nt, Artificial Sequence
  MKO10068319_B_2610008E11Rik
  gRNA
uugcucagaaguugcucuac

SEQ ID NO: 68320 - RNA, 20 nt, Artificial Sequence
  MKO10068320_B_2610015P09Rik
  gRNA
ucaugggcgucuggcacagg

SEQ ID NO: 68321 - RNA, 20 nt, Artificial Sequence
  MKO10068321_B_2610015P09Rik
  gRNA
aucugcauuucugguagaac

SEQ ID NO: 68322 - RNA, 20 nt, Artificial Sequence
  MKO10068322_B_2610015P09Rik
  gRNA
caaacuugucauacuucaaa

SEQ ID NO: 68323 - RNA, 20 nt, Artificial Sequence
  MKO10068323_B_2610018G03Rik
  gRNA
auaauaauggaauaccuagg

SEQ ID NO: 68324 - RNA, 20 nt, Artificial Sequence
  MKO10068324_B_2610018G03Rik
  gRNA
gcugacuguugaauaacuuc

SEQ ID NO: 68325 - RNA, 20 nt, Artificial Sequence
  MKO10068325_B_2610018G03Rik
  gRNA
guuuacaggguucaaaacua

SEQ ID NO: 68326 - RNA, 20 nt, Artificial Sequence
  MKO10068326_B_2610020H08Rik
  gRNA
uggcccacuaacacagcauc

SEQ ID NO: 68327 - RNA, 20 nt, Artificial Sequence
  MKO10068327_B_2610020H08Rik
  gRNA
caagccugaucucaagauuc

SEQ ID NO: 68328 - RNA, 20 nt, Artificial Sequence
  MKO10068328_B_2610020H08Rik
  gRNA
uccuccugaugcuguguuag

SEQ ID NO: 68329 - RNA, 20 nt, Artificial Sequence
  MKO10068329_B_2610028H24Rik
  gRNA
cagcccuccagagugcuuug

SEQ ID NO: 68330 - RNA, 20 nt, Artificial Sequence
  MKO10068330_B_2610028H24Rik
  gRNA
cugcgguagcugcugaauga

SEQ ID NO: 68331 - RNA, 20 nt, Artificial Sequence
  MKO10068331_B_2610028H24Rik
  gRNA
cuacccagagucucuguaga

SEQ ID NO: 68332 - RNA, 20 nt, Artificial Sequence
  MKO10068332_B_2610034B18Rik
  gRNA
cuuacgccuguggauacagc

SEQ ID NO: 68333 - RNA, 20 nt, Artificial Sequence
  MKO10068333_B_2610034B18Rik
  gRNA
accuacuguaagaugacaug

SEQ ID NO: 68334 - RNA, 20 nt, Artificial Sequence
  MKO10068334_B_2610034B18Rik
  gRNA
auggaaagacgggagcuucc

SEQ ID NO: 68335 - RNA, 20 nt, Artificial Sequence
  MKO10068335_B_2610034M16Rik
  gRNA
uagagagucgaccagcuauc

SEQ ID NO: 68336 - RNA, 20 nt, Artificial Sequence
  MKO10068336_B_2610034M16Rik
  gRNA
gaacugaauccgaaaucccc

SEQ ID NO: 68337 - RNA, 20 nt, Artificial Sequence
  MKO10068337_B_2610034M16Rik
  gRNA
guuucaucuagaccagaauu

SEQ ID NO: 68338 - RNA, 20 nt, Artificial Sequence
  MKO10068338_B_2610044O15Rik8
  gRNA
uaccuauaucagugagauuc

SEQ ID NO: 68339 - RNA, 20 nt, Artificial Sequence
  MKO10068339_B_2610044O15Rik8
  gRNA
gacaauguucuucaauauga

SEQ ID NO: 68340 - RNA, 20 nt, Artificial Sequence
  MKO10068340_B_2610044O15Rik8
  gRNA
aaaguucuagaagacaugaa

SEQ ID NO: 68341 - RNA, 20 nt, Artificial Sequence
  MKO10068341_B_2610301B20Rik
  gRNA
ugugucagagcucccaugca

SEQ ID NO: 68342 - RNA, 20 nt, Artificial Sequence
  MKO10068342_B_2610301B20Rik
  gRNA
agcgccauuccaugugggau

SEQ ID NO: 68343 - RNA, 20 nt, Artificial Sequence
  MKO10068343_B_2610301B20Rik
  gRNA
ucuuauuaaugaaauauucg

SEQ ID NO: 68344 - RNA, 20 nt, Artificial Sequence
  MKO10068344_B_2610305D13Rik
  gRNA
uuugcuccucaccaagaauc

SEQ ID NO: 68345 - RNA, 20 nt, Artificial Sequence
  MKO10068345_B_2610305D13Rik
  gRNA
uuguucuucucccagauucu

SEQ ID NO: 68346 - RNA, 20 nt, Artificial Sequence
  MKO10068346_B_2610305D13Rik
  gRNA
acagugucuauuaaccuuca

SEQ ID NO: 68347 - RNA, 20 nt, Artificial Sequence
  MKO10068347_B_2610318N02Rik
  gRNA
cauagagaugcaucggcgcc

SEQ ID NO: 68348 - RNA, 20 nt, Artificial Sequence
  MKO10068348_B_2610318N02Rik
  gRNA
uuucuuguagauggagaaac

SEQ ID NO: 68349 - RNA, 20 nt, Artificial Sequence
  MKO10068349_B_2610318N02Rik
  gRNA
uggccuccuccuccucuucu

SEQ ID NO: 68350 - RNA, 20 nt, Artificial Sequence
  MKO10068350_B_2610507B11Rik
  gRNA
gaaaucugcuucuacugauc

SEQ ID NO: 68351 - RNA, 20 nt, Artificial Sequence
  MKO10068351_B_2610507B11Rik
  gRNA
aacuauguggcauugugcuu

SEQ ID NO: 68352 - RNA, 20 nt, Artificial Sequence
  MKO10068352_B_2610507B11Rik
  gRNA
cuuaagaaccaugauguuua

SEQ ID NO: 68353 - RNA, 20 nt, Artificial Sequence
  MKO10068353_B_2610524H06Rik
  gRNA
gaagcuuaaucgaaccagag

SEQ ID NO: 68354 - RNA, 20 nt, Artificial Sequence
  MKO10068354_B_2610524H06Rik
  gRNA
cugccuccgcagcaccucgu

SEQ ID NO: 68355 - RNA, 20 nt, Artificial Sequence
  MKO10068355_B_2610524H06Rik
  gRNA
guuucagugaugcugcgcuu

SEQ ID NO: 68356 - RNA, 20 nt, Artificial Sequence
  MKO10068356_B_2610528A11Rik
  gRNA
augagacuucuagcccuuuc

SEQ ID NO: 68357 - RNA, 20 nt, Artificial Sequence
  MKO10068357_B_2610528A11Rik
  gRNA
gcaugcagagcagaccggaa

SEQ ID NO: 68358 - RNA, 20 nt, Artificial Sequence
  MKO10068358_B_2610528A11Rik
  gRNA
accuuuccagguugucagcu

SEQ ID NO: 68359 - RNA, 20 nt, Artificial Sequence
  MKO10068359_B_2610528J11Rik
  gRNA
gggugggaaccgcccaccgg

SEQ ID NO: 68360 - RNA, 20 nt, Artificial Sequence
  MKO10068360_B_2610528J11Rik
  gRNA
gccgauaccaugccaguuac

SEQ ID NO: 68361 - RNA, 20 nt, Artificial Sequence
  MKO10068361_B_2610528J11Rik
  gRNA
ccucuccauucucaucgcgc

SEQ ID NO: 68362 - RNA, 20 nt, Artificial Sequence
  MKO10068362_B_2700029M09Rik
  gRNA
cagugaccuucgaaaagaag

SEQ ID NO: 68363 - RNA, 20 nt, Artificial Sequence
  MKO10068363_B_2700029M09Rik
  gRNA
ugaacuguaaucuucacugg

SEQ ID NO: 68364 - RNA, 20 nt, Artificial Sequence
  MKO10068364_B_2700029M09Rik
  gRNA
cuugauccugaaaagccagc

SEQ ID NO: 68365 - RNA, 20 nt, Artificial Sequence
  MKO10068365_B_2700049A03Rik
  gRNA
gaagagaacaacgcaccaaa

SEQ ID NO: 68366 - RNA, 20 nt, Artificial Sequence
  MKO10068366_B_2700049A03Rik
  gRNA
cuuuauuucucaguacacca

SEQ ID NO: 68367 - RNA, 20 nt, Artificial Sequence
  MKO10068367_B_2700049A03Rik
  gRNA
uuucuaaagaugcuguaguu

SEQ ID NO: 68368 - RNA, 20 nt, Artificial Sequence
  MKO10068368_B_2700050L05Rik
  gRNA
uguccagcucaucuaguaag

SEQ ID NO: 68369 - RNA, 20 nt, Artificial Sequence
  MKO10068369_B_2700050L05Rik
  gRNA
ucguuauucagacuggugau

SEQ ID NO: 68370 - RNA, 20 nt, Artificial Sequence
  MKO10068370_B_2700050L05Rik
  gRNA
ggcguaugacuucauugacu

SEQ ID NO: 68371 - RNA, 20 nt, Artificial Sequence
  MKO10068371_B_2700060E02Rik
  gRNA
ugccgauccugaaucuugaa

SEQ ID NO: 68372 - RNA, 20 nt, Artificial Sequence
  MKO10068372_B_2700060E02Rik
  gRNA
cacuacaagauugaagacag

SEQ ID NO: 68373 - RNA, 20 nt, Artificial Sequence
  MKO10068373_B_2700060E02Rik
  gRNA
ugcagagccacugaucaacu

SEQ ID NO: 68374 - RNA, 20 nt, Artificial Sequence
  MKO10068374_B_2700062C07Rik
  gRNA
agagucccuccuugaccauc

SEQ ID NO: 68375 - RNA, 20 nt, Artificial Sequence
  MKO10068375_B_2700062C07Rik
  gRNA
uaaagacucuacaagugugc

SEQ ID NO: 68376 - RNA, 20 nt, Artificial Sequence
  MKO10068376_B_2700062C07Rik
  gRNA
ccuuucagaacaccuacauc

SEQ ID NO: 68377 - RNA, 20 nt, Artificial Sequence
  MKO10068377_B_2700081O15Rik
  gRNA
ggcgcuauuaccacgaccac

SEQ ID NO: 68378 - RNA, 20 nt, Artificial Sequence
  MKO10068378_B_2700081O15Rik
  gRNA
ggacggcugccgacgcggcc

SEQ ID NO: 68379 - RNA, 20 nt, Artificial Sequence
  MKO10068379_B_2700081O15Rik
  gRNA
cacaccagccgauucccccg

SEQ ID NO: 68380 - RNA, 20 nt, Artificial Sequence
  MKO10068380_B_2700089E24Rik
  gRNA
cggggcgucggcgggaccca

SEQ ID NO: 68381 - RNA, 20 nt, Artificial Sequence
  MKO10068381_B_2700089E24Rik
  gRNA
ccagcucgaagaaggcgagc

SEQ ID NO: 68382 - RNA, 20 nt, Artificial Sequence
  MKO10068382_B_2700089E24Rik
  gRNA
ggcucuaaauguguaccugc

SEQ ID NO: 68383 - RNA, 20 nt, Artificial Sequence
  MKO10068383_B_2700094K13Rik
  gRNA
aagugaacccguccaaaccg

SEQ ID NO: 68384 - RNA, 20 nt, Artificial Sequence
  MKO10068384_B_2700094K13Rik
  gRNA
caaauuuccugagccucaag

SEQ ID NO: 68385 - RNA, 20 nt, Artificial Sequence
  MKO10068385_B_2700094K13Rik
  gRNA
ucaggaaauuugagcuuucg

SEQ ID NO: 68386 - RNA, 20 nt, Artificial Sequence
  MKO10068386_B_2700097O09Rik
  gRNA
guugacguuggcuccagacu

SEQ ID NO: 68387 - RNA, 20 nt, Artificial Sequence
  MKO10068387_B_2700097O09Rik
  gRNA
cauguacucccugaucuguc

SEQ ID NO: 68388 - RNA, 20 nt, Artificial Sequence
  MKO10068388_B_2700097O09Rik
  gRNA
gcugcacugcugagcuguaa

SEQ ID NO: 68389 - RNA, 20 nt, Artificial Sequence
  MKO10068389_B_2810004N23Rik
  gRNA
gaacacuuacgugaacuaca

SEQ ID NO: 68390 - RNA, 20 nt, Artificial Sequence
  MKO10068390_B_2810004N23Rik
  gRNA
acuagcuugcugccguucuu

SEQ ID NO: 68391 - RNA, 20 nt, Artificial Sequence
  MKO10068391_B_2810004N23Rik
  gRNA
cucguacaggagauccaggc

SEQ ID NO: 68392 - RNA, 20 nt, Artificial Sequence
  MKO10068392_B_2810006K23Rik
  gRNA
cugaugcugaugguauacca

SEQ ID NO: 68393 - RNA, 20 nt, Artificial Sequence
  MKO10068393_B_2810006K23Rik
  gRNA
cuucgagcucacucucauuc

SEQ ID NO: 68394 - RNA, 20 nt, Artificial Sequence
  MKO10068394_B_2810006K23Rik
  gRNA
uuugauccacagaucuuguu

SEQ ID NO: 68395 - RNA, 20 nt, Artificial Sequence
  MKO10068395_B_2810007J24Rik
  gRNA
gaauuuggaaucaggggaac

SEQ ID NO: 68396 - RNA, 20 nt, Artificial Sequence
  MKO10068396_B_2810007J24Rik
  gRNA
cugauuccaaauucucuccc

SEQ ID NO: 68397 - RNA, 20 nt, Artificial Sequence
  MKO10068397_B_2810007J24Rik
  gRNA
cauguggcuggauaucccug

SEQ ID NO: 68398 - RNA, 20 nt, Artificial Sequence
  MKO10068398_B_2810021J22Rik
  gRNA
gcaaggagcugggccaugga

SEQ ID NO: 68399 - RNA, 20 nt, Artificial Sequence
  MKO10068399_B_2810021J22Rik
  gRNA
cagcuccuugcuccaacuuc

SEQ ID NO: 68400 - RNA, 20 nt, Artificial Sequence
  MKO10068400_B_2810021J22Rik
  gRNA
uucacucacucaaggacagc

SEQ ID NO: 68401 - RNA, 20 nt, Artificial Sequence
  MKO10068401_B_2810403A07Rik
  gRNA
cugcugugucaacucgggga

SEQ ID NO: 68402 - RNA, 20 nt, Artificial Sequence
  MKO10068402_B_2810403A07Rik
  gRNA
ugcagaaaccugcugacacg

SEQ ID NO: 68403 - RNA, 20 nt, Artificial Sequence
  MKO10068403_B_2810403A07Rik
  gRNA
uccauuguaucuucauguuc

SEQ ID NO: 68404 - RNA, 20 nt, Artificial Sequence
  MKO10068404_B_2810408A11Rik
  gRNA
caggcugcaggacaccgaug

SEQ ID NO: 68405 - RNA, 20 nt, Artificial Sequence
  MKO10068405_B_2810408A11Rik
  gRNA
ccccuucagguuugccacaa

SEQ ID NO: 68406 - RNA, 20 nt, Artificial Sequence
  MKO10068406_B_2810408A11Rik
  gRNA
cgaaagauacacuacaguga

SEQ ID NO: 68407 - RNA, 20 nt, Artificial Sequence
  MKO10068407_B_2810408M09Rik
  gRNA
ugccccagucgucuucuuug

SEQ ID NO: 68408 - RNA, 20 nt, Artificial Sequence
  MKO10068408_B_2810408M09Rik
  gRNA
gcggcuccgcucgcgcgcag

SEQ ID NO: 68409 - RNA, 20 nt, Artificial Sequence
  MKO10068409_B_2810408M09Rik
  gRNA
ccggcggcggacagugcagg

SEQ ID NO: 68410 - RNA, 20 nt, Artificial Sequence
  MKO10068410_B_2810417H13Rik
  gRNA
ucucgacgaacuugaagaau

SEQ ID NO: 68411 - RNA, 20 nt, Artificial Sequence
  MKO10068411_B_2810417H13Rik
  gRNA
acagcugaaaauaaguaugc

SEQ ID NO: 68412 - RNA, 20 nt, Artificial Sequence
  MKO10068412_B_2810417H13Rik
  gRNA
uuccugcuucuucaggagcc

SEQ ID NO: 68413 - RNA, 20 nt, Artificial Sequence
  MKO10068413_B_2810428I15Rik
  gRNA
gcuucagaaugaacgcgcac

SEQ ID NO: 68414 - RNA, 20 nt, Artificial Sequence
  MKO10068414_B_2810428I15Rik
  gRNA
ggcgaucggcgagguucugc

SEQ ID NO: 68415 - RNA, 20 nt, Artificial Sequence
  MKO10068415_B_2810428I15Rik
  gRNA
gaugcggaaucugccgagug

SEQ ID NO: 68416 - RNA, 20 nt, Artificial Sequence
  MKO10068416_B_2810459M11Rik
  gRNA
agugcgggcaggucuuuccc

SEQ ID NO: 68417 - RNA, 20 nt, Artificial Sequence
  MKO10068417_B_2810459M11Rik
  gRNA
gacugugaagaccguggaaa

SEQ ID NO: 68418 - RNA, 20 nt, Artificial Sequence
  MKO10068418_B_2810459M11Rik
  gRNA
ucuuucuagcagaaggugcc

SEQ ID NO: 68419 - RNA, 20 nt, Artificial Sequence
  MKO10068419_B_2810474O19Rik
  gRNA
augccugaaucaagucaaag

SEQ ID NO: 68420 - RNA, 20 nt, Artificial Sequence
  MKO10068420_B_2810474O19Rik
  gRNA
uuaccucuuugacuugauuc

SEQ ID NO: 68421 - RNA, 20 nt, Artificial Sequence
  MKO10068421_B_2810474O19Rik
  gRNA
aagaaucaaauaucauguuc

SEQ ID NO: 68422 - RNA, 20 nt, Artificial Sequence
  MKO10068422_B_2900011O08Rik
  gRNA
ccaggacuucacggagacgc

SEQ ID NO: 68423 - RNA, 20 nt, Artificial Sequence
  MKO10068423_B_2900011O08Rik
  gRNA
ggaugacauucagcucugca

SEQ ID NO: 68424 - RNA, 20 nt, Artificial Sequence
  MKO10068424_B_2900011O08Rik
  gRNA
gcacucacuggcugaagucu

SEQ ID NO: 68425 - RNA, 20 nt, Artificial Sequence
  MKO10068425_B_2900026A02Rik
  gRNA
aaucagaugaagagccgccc

SEQ ID NO: 68426 - RNA, 20 nt, Artificial Sequence
  MKO10068426_B_2900026A02Rik
  gRNA
gucugagagccgauccccuc

SEQ ID NO: 68427 - RNA, 20 nt, Artificial Sequence
  MKO10068427_B_2900026A02Rik
  gRNA
agucuuaccugcccccguuc

SEQ ID NO: 68428 - RNA, 20 nt, Artificial Sequence
  MKO10068428_B_2900092C05Rik
  gRNA
gaaauuacaugaacaagucc

SEQ ID NO: 68429 - RNA, 20 nt, Artificial Sequence
  MKO10068429_B_2900092C05Rik
  gRNA
aaguauugcaaguaagccuc

SEQ ID NO: 68430 - RNA, 20 nt, Artificial Sequence
  MKO10068430_B_2900092C05Rik
  gRNA
ucagaauucgauacaaauaa

SEQ ID NO: 68431 - RNA, 20 nt, Artificial Sequence
  MKO10068431_B_42432
  gRNA
caccagcucagccgcgccug

SEQ ID NO: 68432 - RNA, 20 nt, Artificial Sequence
  MKO10068432_B_42432
  gRNA
agugcuccaggcagcuccga

SEQ ID NO: 68433 - RNA, 20 nt, Artificial Sequence
  MKO10068433_B_42432
  gRNA
cugcucgacugauuccaaaa

SEQ ID NO: 68434 - RNA, 20 nt, Artificial Sequence
  MKO10068434_B_42616
  gRNA
acaguacgaaaaguuccuga

SEQ ID NO: 68435 - RNA, 20 nt, Artificial Sequence
  MKO10068435_B_42616
  gRNA
cugacagucaucgacacacc

SEQ ID NO: 68436 - RNA, 20 nt, Artificial Sequence
  MKO10068436_B_42616
  gRNA
cgcuuugaucuccacugucu

SEQ ID NO: 68437 - RNA, 20 nt, Artificial Sequence
  MKO10068437_B_3010026O09Rik
  gRNA
gagagaagcagucauuuguu

SEQ ID NO: 68438 - RNA, 20 nt, Artificial Sequence
  MKO10068438_B_3010026O09Rik
  gRNA
cuugcagcagauuuagcuuu

SEQ ID NO: 68439 - RNA, 20 nt, Artificial Sequence
  MKO10068439_B_3010026O09Rik
  gRNA
aggugaagaagagucucaaa

SEQ ID NO: 68440 - RNA, 20 nt, Artificial Sequence
  MKO10068440_B_3110001I22Rik
  gRNA
acuucaucauaugaucuguu

SEQ ID NO: 68441 - RNA, 20 nt, Artificial Sequence
  MKO10068441_B_3110001I22Rik
  gRNA
gacguccuaaagcugcaagc

SEQ ID NO: 68442 - RNA, 20 nt, Artificial Sequence
  MKO10068442_B_3110001I22Rik
  gRNA
gaugaccgggauaugaagca

SEQ ID NO: 68443 - RNA, 20 nt, Artificial Sequence
  MKO10068443_B_3110002H16Rik
  gRNA
uauuccagauaacucucaac

SEQ ID NO: 68444 - RNA, 20 nt, Artificial Sequence
  MKO10068444_B_3110002H16Rik
  gRNA
uacuccaguugagaguuauc

SEQ ID NO: 68445 - RNA, 20 nt, Artificial Sequence
  MKO10068445_B_3110002H16Rik
  gRNA
cgcaaauuaccuaaaagaga

SEQ ID NO: 68446 - RNA, 20 nt, Artificial Sequence
  MKO10068446_B_3110007F17Rik
  gRNA
ugagauacccggauauccaa

SEQ ID NO: 68447 - RNA, 20 nt, Artificial Sequence
  MKO10068447_B_3110007F17Rik
  gRNA
uauuucuuacuguccuucaa

SEQ ID NO: 68448 - RNA, 20 nt, Artificial Sequence
  MKO10068448_B_3110007F17Rik
  gRNA
uguuauggcagguguaguaa

SEQ ID NO: 68449 - RNA, 20 nt, Artificial Sequence
  MKO10068449_B_3110009E18Rik
  gRNA
gaaugcaauuucaguuucac

SEQ ID NO: 68450 - RNA, 20 nt, Artificial Sequence
  MKO10068450_B_3110009E18Rik
  gRNA
gguggcaggcugguccucaa

SEQ ID NO: 68451 - RNA, 20 nt, Artificial Sequence
  MKO10068451_B_3110009E18Rik
  gRNA
ucaucaagcucacaaagcaa

SEQ ID NO: 68452 - RNA, 20 nt, Artificial Sequence
  MKO10068452_B_3110021N24Rik
  gRNA
auucaucuaauaccuugucc

SEQ ID NO: 68453 - RNA, 20 nt, Artificial Sequence
  MKO10068453_B_3110021N24Rik
  gRNA
cacuuuguauccaauaaagu

SEQ ID NO: 68454 - RNA, 20 nt, Artificial Sequence
  MKO10068454_B_3110021N24Rik
  gRNA
guccuggccagcggcacagc

SEQ ID NO: 68455 - RNA, 20 nt, Artificial Sequence
  MKO10068455_B_3110035E14Rik
  gRNA
ucgagcauaugggaagucgu

SEQ ID NO: 68456 - RNA, 20 nt, Artificial Sequence
  MKO10068456_B_3110035E14Rik
  gRNA
aucucggugaaagcuccagc

SEQ ID NO: 68457 - RNA, 20 nt, Artificial Sequence
  MKO10068457_B_3110035E14Rik
  gRNA
caagagcucucaccaccucu

SEQ ID NO: 68458 - RNA, 20 nt, Artificial Sequence
  MKO10068458_B_3110040N11Rik
  gRNA
ugcugcaauggccacaccaa

SEQ ID NO: 68459 - RNA, 20 nt, Artificial Sequence
  MKO10068459_B_3110040N11Rik
  gRNA
uccagacagaacgcugugac

SEQ ID NO: 68460 - RNA, 20 nt, Artificial Sequence
  MKO10068460_B_3110040N11Rik
  gRNA
uggcucagggugguaaaucu

SEQ ID NO: 68461 - RNA, 20 nt, Artificial Sequence
  MKO10068461_B_3110043O21Rik
  gRNA
gugcucaaugaugaugacau

SEQ ID NO: 68462 - RNA, 20 nt, Artificial Sequence
  MKO10068462_B_3110043O21Rik
  gRNA
agcucacaccugcagaccug

SEQ ID NO: 68463 - RNA, 20 nt, Artificial Sequence
  MKO10068463_B_3110043O21Rik
  gRNA
aaauguccagaaaauugucu

SEQ ID NO: 68464 - RNA, 20 nt, Artificial Sequence
  MKO10068464_B_3110047P20Rik
  gRNA
uccuguucacuacuggcaga

SEQ ID NO: 68465 - RNA, 20 nt, Artificial Sequence
  MKO10068465_B_3110047P20Rik
  gRNA
guaccaaucuuccaguaacu

SEQ ID NO: 68466 - RNA, 20 nt, Artificial Sequence
  MKO10068466_B_3110047P20Rik
  gRNA
uuuauacccacaacaaagca

SEQ ID NO: 68467 - RNA, 20 nt, Artificial Sequence
  MKO10068467_B_3110052M02Rik
  gRNA
ucuauacauugaugugaugu

SEQ ID NO: 68468 - RNA, 20 nt, Artificial Sequence
  MKO10068468_B_3110052M02Rik
  gRNA
cugaccugggacauguuuac

SEQ ID NO: 68469 - RNA, 20 nt, Artificial Sequence
  MKO10068469_B_3110052M02Rik
  gRNA
uacaauguuccucagaagua

SEQ ID NO: 68470 - RNA, 20 nt, Artificial Sequence
  MKO10068470_B_3110057O12Rik
  gRNA
ucagauuguaagauccuaga

SEQ ID NO: 68471 - RNA, 20 nt, Artificial Sequence
  MKO10068471_B_3110057O12Rik
  gRNA
ccagccagaugaaugcacac

SEQ ID NO: 68472 - RNA, 20 nt, Artificial Sequence
  MKO10068472_B_3110057O12Rik
  gRNA
auuccaguuuaucgugccua

SEQ ID NO: 68473 - RNA, 20 nt, Artificial Sequence
  MKO10068473_B_3110062M04Rik
  gRNA
ggcacuggggauccugauug

SEQ ID NO: 68474 - RNA, 20 nt, Artificial Sequence
  MKO10068474_B_3110062M04Rik
  gRNA
uaaaauccaagaccaaaacg

SEQ ID NO: 68475 - RNA, 20 nt, Artificial Sequence
  MKO10068475_B_3110062M04Rik
  gRNA
agcuucauucaugcaguaca

SEQ ID NO: 68476 - RNA, 20 nt, Artificial Sequence
  MKO10068476_B_3110079O15Rik
  gRNA
gagccuauugaauugcccuc

SEQ ID NO: 68477 - RNA, 20 nt, Artificial Sequence
  MKO10068477_B_3110079O15Rik
  gRNA
cuggccccugcggugcucac

SEQ ID NO: 68478 - RNA, 20 nt, Artificial Sequence
  MKO10068478_B_3110079O15Rik
  gRNA
cccuuaccugugagcaccgc

SEQ ID NO: 68479 - RNA, 20 nt, Artificial Sequence
  MKO10068479_B_3110082I17Rik
  gRNA
guacuggccgucuccuuguc

SEQ ID NO: 68480 - RNA, 20 nt, Artificial Sequence
  MKO10068480_B_3110082I17Rik
  gRNA
cuggcucuggaguaccucca

SEQ ID NO: 68481 - RNA, 20 nt, Artificial Sequence
  MKO10068481_B_3110082I17Rik
  gRNA
gccacgucugucuugucuuc

SEQ ID NO: 68482 - RNA, 20 nt, Artificial Sequence
  MKO10068482_B_3110082J24Rik
  gRNA
gagcaugggcgcuuucccgc

SEQ ID NO: 68483 - RNA, 20 nt, Artificial Sequence
  MKO10068483_B_3110082J24Rik
  gRNA
acggccagucccgcgcagcu

SEQ ID NO: 68484 - RNA, 20 nt, Artificial Sequence
  MKO10068484_B_3110082J24Rik
  gRNA
ggcugaugccccguggaagg

SEQ ID NO: 68485 - RNA, 20 nt, Artificial Sequence
  MKO10068485_B_3300002I08Rik
  gRNA
gacccgcagcacacaaguua

SEQ ID NO: 68486 - RNA, 20 nt, Artificial Sequence
  MKO10068486_B_3300002I08Rik
  gRNA
ugugcaugugaacuucacuc

SEQ ID NO: 68487 - RNA, 20 nt, Artificial Sequence
  MKO10068487_B_3300002I08Rik
  gRNA
uauagcagcgagauuccugu

SEQ ID NO: 68488 - RNA, 20 nt, Artificial Sequence
  MKO10068488_B_3425401B19Rik
  gRNA
ccccacuaucgcuuuacucc

SEQ ID NO: 68489 - RNA, 20 nt, Artificial Sequence
  MKO10068489_B_3425401B19Rik
  gRNA
ccagcuucuucgcccugcgc

SEQ ID NO: 68490 - RNA, 20 nt, Artificial Sequence
  MKO10068490_B_3425401B19Rik
  gRNA
ucccuccgaguuagccccgu

SEQ ID NO: 68491 - RNA, 20 nt, Artificial Sequence
  MKO10068491_B_3632451O06Rik
  gRNA
ucuccuguagaaucaacacc

SEQ ID NO: 68492 - RNA, 20 nt, Artificial Sequence
  MKO10068492_B_3632451O06Rik
  gRNA
cuagaacaacuugaaucuga

SEQ ID NO: 68493 - RNA, 20 nt, Artificial Sequence
  MKO10068493_B_3632451O06Rik
  gRNA
gcagucacagacguaacaca

SEQ ID NO: 68494 - RNA, 20 nt, Artificial Sequence
  MKO10068494_B_3830403N18Rik
  gRNA
aucuccaguacaaaauauuc

SEQ ID NO: 68495 - RNA, 20 nt, Artificial Sequence
  MKO10068495_B_3830403N18Rik
  gRNA
uccaaaguuguucuaauuuc

SEQ ID NO: 68496 - RNA, 20 nt, Artificial Sequence
  MKO10068496_B_3830403N18Rik
  gRNA
cuuguucuucauugaauuuc

SEQ ID NO: 68497 - RNA, 20 nt, Artificial Sequence
  MKO10068497_B_3830406C13Rik
  gRNA
ugagaauuaccuucaagagu

SEQ ID NO: 68498 - RNA, 20 nt, Artificial Sequence
  MKO10068498_B_3830406C13Rik
  gRNA
acaggacauagaugcugcag

SEQ ID NO: 68499 - RNA, 20 nt, Artificial Sequence
  MKO10068499_B_3830406C13Rik
  gRNA
cagaaaaugaaaaacaaauu

SEQ ID NO: 68500 - RNA, 20 nt, Artificial Sequence
  MKO10068500_B_3830417A13Rik
  gRNA
uccugcuuguuaaguuucga

SEQ ID NO: 68501 - RNA, 20 nt, Artificial Sequence
  MKO10068501_B_3830417A13Rik
  gRNA
cggggccccuuucuucaguu

SEQ ID NO: 68502 - RNA, 20 nt, Artificial Sequence
  MKO10068502_B_3830417A13Rik
  gRNA
cucgggcccaaacugaagaa

SEQ ID NO: 68503 - RNA, 20 nt, Artificial Sequence
  MKO10068503_B_42433
  gRNA
uauaucgcaucuuuaaacgc

SEQ ID NO: 68504 - RNA, 20 nt, Artificial Sequence
  MKO10068504_B_42433
  gRNA
cuggaggggcccccgagaag

SEQ ID NO: 68505 - RNA, 20 nt, Artificial Sequence
  MKO10068505_B_42433
  gRNA
ucaaauugcagccgccaucu

SEQ ID NO: 68506 - RNA, 20 nt, Artificial Sequence
  MKO10068506_B_42617
  gRNA
aagcgaacccuaccacucag

SEQ ID NO: 68507 - RNA, 20 nt, Artificial Sequence
  MKO10068507_B_42617
  gRNA
cgcccagcaguuuccgaucc

SEQ ID NO: 68508 - RNA, 20 nt, Artificial Sequence
  MKO10068508_B_42617
  gRNA
cccuccccaaucaaguccac

SEQ ID NO: 68509 - RNA, 20 nt, Artificial Sequence
  MKO10068509_B_4430402I18Rik
  gRNA
aaaaguucugcgacagcucc

SEQ ID NO: 68510 - RNA, 20 nt, Artificial Sequence
  MKO10068510_B_4430402I18Rik
  gRNA
ccucacaccuuggcaugcag

SEQ ID NO: 68511 - RNA, 20 nt, Artificial Sequence
  MKO10068511_B_4430402I18Rik
  gRNA
ccuuguagaaaacucuauuu

SEQ ID NO: 68512 - RNA, 20 nt, Artificial Sequence
  MKO10068512_B_4632428N05Rik
  gRNA
ccuuacaggcaucacggcug

SEQ ID NO: 68513 - RNA, 20 nt, Artificial Sequence
  MKO10068513_B_4632428N05Rik
  gRNA
cggcgacauggguguccccg

SEQ ID NO: 68514 - RNA, 20 nt, Artificial Sequence
  MKO10068514_B_4632428N05Rik
  gRNA
cucauuagacgccaugcaug

SEQ ID NO: 68515 - RNA, 20 nt, Artificial Sequence
  MKO10068515_B_4632434I11Rik
  gRNA
agauaauccuugaguccaaa

SEQ ID NO: 68516 - RNA, 20 nt, Artificial Sequence
  MKO10068516_B_4632434I11Rik
  gRNA
agguuuacuugucccaaaug

SEQ ID NO: 68517 - RNA, 20 nt, Artificial Sequence
  MKO10068517_B_4632434I11Rik
  gRNA
caguacuugcuguccagaau

SEQ ID NO: 68518 - RNA, 20 nt, Artificial Sequence
  MKO10068518_B_4732456N10Rik
  gRNA
uucgaacaugggcucuagau

SEQ ID NO: 68519 - RNA, 20 nt, Artificial Sequence
  MKO10068519_B_4732456N10Rik
  gRNA
auccaucagagcuuccaccu

SEQ ID NO: 68520 - RNA, 20 nt, Artificial Sequence
  MKO10068520_B_4732456N10Rik
  gRNA
acaggagcuggcucaacuuc

SEQ ID NO: 68521 - RNA, 20 nt, Artificial Sequence
  MKO10068521_B_4833403I15Rik
  gRNA
cuuacccagcuggggcauau

SEQ ID NO: 68522 - RNA, 20 nt, Artificial Sequence
  MKO10068522_B_4833403I15Rik
  gRNA
guuuaacuuagauacguguc

SEQ ID NO: 68523 - RNA, 20 nt, Artificial Sequence
  MKO10068523_B_4833403I15Rik
  gRNA
cggaaagacgacauugcaag

SEQ ID NO: 68524 - RNA, 20 nt, Artificial Sequence
  MKO10068524_B_4833420G17Rik
  gRNA
guguuuccacgccucuggac

SEQ ID NO: 68525 - RNA, 20 nt, Artificial Sequence
  MKO10068525_B_4833420G17Rik
  gRNA
gguauaaggguguuacauac

SEQ ID NO: 68526 - RNA, 20 nt, Artificial Sequence
  MKO10068526_B_4833420G17Rik
  gRNA
uuccuauccugagcuuguga

SEQ ID NO: 68527 - RNA, 20 nt, Artificial Sequence
  MKO10068527_B_4833423E24Rik
  gRNA
ccacuuggacuucuuaaaca

SEQ ID NO: 68528 - RNA, 20 nt, Artificial Sequence
  MKO10068528_B_4833423E24Rik
  gRNA
uaucuuaagccacuacucau

SEQ ID NO: 68529 - RNA, 20 nt, Artificial Sequence
  MKO10068529_B_4833423E24Rik
  gRNA
gaaaguucuccaaugaguag

SEQ ID NO: 68530 - RNA, 20 nt, Artificial Sequence
  MKO10068530_B_4833424O15Rik
  gRNA
uagcggaauaucgaaaucau

SEQ ID NO: 68531 - RNA, 20 nt, Artificial Sequence
  MKO10068531_B_4833424O15Rik
  gRNA
cugcuauagauauuccgacu

SEQ ID NO: 68532 - RNA, 20 nt, Artificial Sequence
  MKO10068532_B_4833424O15Rik
  gRNA
gcuuucuacucgaggaaugu

SEQ ID NO: 68533 - RNA, 20 nt, Artificial Sequence
  MKO10068533_B_4833427G06Rik
  gRNA
uuaucuuugcuaaagcccaa

SEQ ID NO: 68534 - RNA, 20 nt, Artificial Sequence
  MKO10068534_B_4833427G06Rik
  gRNA
ccagcccuuucccuuugauc

SEQ ID NO: 68535 - RNA, 20 nt, Artificial Sequence
  MKO10068535_B_4833427G06Rik
  gRNA
gauuugggcacuuuguccuu

SEQ ID NO: 68536 - RNA, 20 nt, Artificial Sequence
  MKO10068536_B_4833439L19Rik
  gRNA
acugaccuggacuucugcuu

SEQ ID NO: 68537 - RNA, 20 nt, Artificial Sequence
  MKO10068537_B_4833439L19Rik
  gRNA
gacgcgugaggggugcugcu

SEQ ID NO: 68538 - RNA, 20 nt, Artificial Sequence
  MKO10068538_B_4833439L19Rik
  gRNA
cugccuguuguucaaaacgc

SEQ ID NO: 68539 - RNA, 20 nt, Artificial Sequence
  MKO10068539_B_4921501E09Rik
  gRNA
ccaguaugcuagccgcuuga

SEQ ID NO: 68540 - RNA, 20 nt, Artificial Sequence
  MKO10068540_B_4921501E09Rik
  gRNA
ggaaagcuuacgaacuaucu

SEQ ID NO: 68541 - RNA, 20 nt, Artificial Sequence
  MKO10068541_B_4921501E09Rik
  gRNA
aaaagagcuuguccgaaucu

SEQ ID NO: 68542 - RNA, 20 nt, Artificial Sequence
  MKO10068542_B_4921504E06Rik
  gRNA
ucaguugaaccaaaucuuug

SEQ ID NO: 68543 - RNA, 20 nt, Artificial Sequence
  MKO10068543_B_4921504E06Rik
  gRNA
cauuccuuugauaauagcua

SEQ ID NO: 68544 - RNA, 20 nt, Artificial Sequence
  MKO10068544_B_4921504E06Rik
  gRNA
ugcagucugucugaguagca

SEQ ID NO: 68545 - RNA, 20 nt, Artificial Sequence
  MKO10068545_B_4921506M07Rik
  gRNA
acuggauguuccguaauacu

SEQ ID NO: 68546 - RNA, 20 nt, Artificial Sequence
  MKO10068546_B_4921506M07Rik
  gRNA
ucuccagccgagcauuuaug

SEQ ID NO: 68547 - RNA, 20 nt, Artificial Sequence
  MKO10068547_B_4921506M07Rik
  gRNA
aauguaccucagaccaucuc

SEQ ID NO: 68548 - RNA, 20 nt, Artificial Sequence
  MKO10068548_B_4921507P07Rik
  gRNA
aacaagaagagcgacgugua

SEQ ID NO: 68549 - RNA, 20 nt, Artificial Sequence
  MKO10068549_B_4921507P07Rik
  gRNA
uggggugccgauagagaaua

SEQ ID NO: 68550 - RNA, 20 nt, Artificial Sequence
  MKO10068550_B_4921507P07Rik
  gRNA
cauauaguaauacugcucaa

SEQ ID NO: 68551 - RNA, 20 nt, Artificial Sequence
  MKO10068551_B_4921509C19Rik
  gRNA
cucguugaagcaguuccucg

SEQ ID NO: 68552 - RNA, 20 nt, Artificial Sequence
  MKO10068552_B_4921509C19Rik
  gRNA
gcacagucugacgccugcca

SEQ ID NO: 68553 - RNA, 20 nt, Artificial Sequence
  MKO10068553_B_4921509C19Rik
  gRNA
gggugcacucuccuuucgau

SEQ ID NO: 68554 - RNA, 20 nt, Artificial Sequence
  MKO10068554_B_4921511H03Rik
  gRNA
cagacccauacacguuaccc

SEQ ID NO: 68555 - RNA, 20 nt, Artificial Sequence
  MKO10068555_B_4921511H03Rik
  gRNA
uaccaauuaccugcaccuuc

SEQ ID NO: 68556 - RNA, 20 nt, Artificial Sequence
  MKO10068556_B_4921511H03Rik
  gRNA
guaauugguacgaggaaccu

SEQ ID NO: 68557 - RNA, 20 nt, Artificial Sequence
  MKO10068557_B_4921511M17Rik
  gRNA
acacagaaaaccagaaccac

SEQ ID NO: 68558 - RNA, 20 nt, Artificial Sequence
  MKO10068558_B_4921511M17Rik
  gRNA
aacaagcaaacauuuaacug

SEQ ID NO: 68559 - RNA, 20 nt, Artificial Sequence
  MKO10068559_B_4921511M17Rik
  gRNA
ucaaaauggcccauacuacc

SEQ ID NO: 68560 - RNA, 20 nt, Artificial Sequence
  MKO10068560_B_4921517D22Rik
  gRNA
gcugacuccccaccgauguu

SEQ ID NO: 68561 - RNA, 20 nt, Artificial Sequence
  MKO10068561_B_4921517D22Rik
  gRNA
cucuugucuuccguuacccc

SEQ ID NO: 68562 - RNA, 20 nt, Artificial Sequence
  MKO10068562_B_4921517D22Rik
  gRNA
ucuucguagaacagccugcc

SEQ ID NO: 68563 - RNA, 20 nt, Artificial Sequence
  MKO10068563_B_4921524J17Rik
  gRNA
ucacaauuaccuguagacgg

SEQ ID NO: 68564 - RNA, 20 nt, Artificial Sequence
  MKO10068564_B_4921524J17Rik
  gRNA
ccauacagaaaacaagcacg

SEQ ID NO: 68565 - RNA, 20 nt, Artificial Sequence
  MKO10068565_B_4921524J17Rik
  gRNA
uucauccgccaaaaaacacg

SEQ ID NO: 68566 - RNA, 20 nt, Artificial Sequence
  MKO10068566_B_4921524L21Rik
  gRNA
aaggagaaccgggggcgaca

SEQ ID NO: 68567 - RNA, 20 nt, Artificial Sequence
  MKO10068567_B_4921524L21Rik
  gRNA
aagcuugaugugacccucac

SEQ ID NO: 68568 - RNA, 20 nt, Artificial Sequence
  MKO10068568_B_4921524L21Rik
  gRNA
aauccuacagcgcaucuucu

SEQ ID NO: 68569 - RNA, 20 nt, Artificial Sequence
  MKO10068569_B_4921530D09Rik
  gRNA
ucggcgacgcggacagaagu

SEQ ID NO: 68570 - RNA, 20 nt, Artificial Sequence
  MKO10068570_B_4921530D09Rik
  gRNA
cugcgcagcaaccuccgccg

SEQ ID NO: 68571 - RNA, 20 nt, Artificial Sequence
  MKO10068571_B_4921530D09Rik
  gRNA
cauggacguauccuuuccgc

SEQ ID NO: 68572 - RNA, 20 nt, Artificial Sequence
  MKO10068572_B_4921530L21Rik
  gRNA
uacaacgccuugagcacaga

SEQ ID NO: 68573 - RNA, 20 nt, Artificial Sequence
  MKO10068573_B_4921530L21Rik
  gRNA
gaccaaggcucugcaacacc

SEQ ID NO: 68574 - RNA, 20 nt, Artificial Sequence
  MKO10068574_B_4921530L21Rik
  gRNA
guagcugguucugcugccgu

SEQ ID NO: 68575 - RNA, 20 nt, Artificial Sequence
  MKO10068575_B_4921536K21Rik
  gRNA
gaacuuccggcgcgagagac

SEQ ID NO: 68576 - RNA, 20 nt, Artificial Sequence
  MKO10068576_B_4921536K21Rik
  gRNA
gcgcgauucccagagcaccc

SEQ ID NO: 68577 - RNA, 20 nt, Artificial Sequence
  MKO10068577_B_4921536K21Rik
  gRNA
agcgaaucaucuuucucagc

SEQ ID NO: 68578 - RNA, 20 nt, Artificial Sequence
  MKO10068578_B_4921539E11Rik
  gRNA
cagcagauucuaguacaagc

SEQ ID NO: 68579 - RNA, 20 nt, Artificial Sequence
  MKO10068579_B_4921539E11Rik
  gRNA
uuaagauaacgaagagauau

SEQ ID NO: 68580 - RNA, 20 nt, Artificial Sequence
  MKO10068580_B_4921539E11Rik
  gRNA
uuguacuagaaucugcugag

SEQ ID NO: 68581 - RNA, 20 nt, Artificial Sequence
  MKO10068581_B_4922501C03Rik
  gRNA
guugacagcuuagaagcuaa

SEQ ID NO: 68582 - RNA, 20 nt, Artificial Sequence
  MKO10068582_B_4922501C03Rik
  gRNA
uucucacauccaucuucagc

SEQ ID NO: 68583 - RNA, 20 nt, Artificial Sequence
  MKO10068583_B_4922501C03Rik
  gRNA
aauacagagccagcugaaga

SEQ ID NO: 68584 - RNA, 20 nt, Artificial Sequence
  MKO10068584_B_4922501L14Rik
  gRNA
uagcaaugcaguuaucacaa

SEQ ID NO: 68585 - RNA, 20 nt, Artificial Sequence
  MKO10068585_B_4922501L14Rik
  gRNA
gaaugaaugcaccaucgaaa

SEQ ID NO: 68586 - RNA, 20 nt, Artificial Sequence
  MKO10068586_B_4922501L14Rik
  gRNA
gugugguaacuguuaaugug

SEQ ID NO: 68587 - RNA, 20 nt, Artificial Sequence
  MKO10068587_B_4922502D21Rik
  gRNA
cauagacaguaccaguugug

SEQ ID NO: 68588 - RNA, 20 nt, Artificial Sequence
  MKO10068588_B_4922502D21Rik
  gRNA
cagcaacagcaccuccuagc

SEQ ID NO: 68589 - RNA, 20 nt, Artificial Sequence
  MKO10068589_B_4922502D21Rik
  gRNA
cgaagaaagugcugacccuu

SEQ ID NO: 68590 - RNA, 20 nt, Artificial Sequence
  MKO10068590_B_4922505E12Rik
  gRNA
uggcgccgagaucgagaccg

SEQ ID NO: 68591 - RNA, 20 nt, Artificial Sequence
  MKO10068591_B_4922505E12Rik
  gRNA
gggcaccucggucucgaucu

SEQ ID NO: 68592 - RNA, 20 nt, Artificial Sequence
  MKO10068592_B_4922505E12Rik
  gRNA
ccgagcuccccauaggaccg

SEQ ID NO: 68593 - RNA, 20 nt, Artificial Sequence
  MKO10068593_B_4930402F06Rik
  gRNA
uuaagacugucaaacucgcu

SEQ ID NO: 68594 - RNA, 20 nt, Artificial Sequence
  MKO10068594_B_4930402F06Rik
  gRNA
ugcagaugacguaucagugc

SEQ ID NO: 68595 - RNA, 20 nt, Artificial Sequence
  MKO10068595_B_4930402F06Rik
  gRNA
cacuuacaaugaguuagucu

SEQ ID NO: 68596 - RNA, 20 nt, Artificial Sequence
  MKO10068596_B_4930402H24Rik
  gRNA
acaugguucgagacuguagu

SEQ ID NO: 68597 - RNA, 20 nt, Artificial Sequence
  MKO10068597_B_4930402H24Rik
  gRNA
cagcugcagccgacuccgcc

SEQ ID NO: 68598 - RNA, 20 nt, Artificial Sequence
  MKO10068598_B_4930402H24Rik
  gRNA
gcuuugcaggaauugacagc

SEQ ID NO: 68599 - RNA, 20 nt, Artificial Sequence
  MKO10068599_B_4930402K13Rik
  gRNA
gcugaaguugcccaccuccg

SEQ ID NO: 68600 - RNA, 20 nt, Artificial Sequence
  MKO10068600_B_4930402K13Rik
  gRNA
uugccccauaugguucuacg

SEQ ID NO: 68601 - RNA, 20 nt, Artificial Sequence
  MKO10068601_B_4930402K13Rik
  gRNA
gcacuacugccaagucuaua

SEQ ID NO: 68602 - RNA, 20 nt, Artificial Sequence
  MKO10068602_B_4930404A10Rik
  gRNA
cgcagucuguuaaguguuac

SEQ ID NO: 68603 - RNA, 20 nt, Artificial Sequence
  MKO10068603_B_4930404A10Rik
  gRNA
gcggaaaauuacugagaaga

SEQ ID NO: 68604 - RNA, 20 nt, Artificial Sequence
  MKO10068604_B_4930404A10Rik
  gRNA
agugacugauaccuuugaga

SEQ ID NO: 68605 - RNA, 20 nt, Artificial Sequence
  MKO10068605_B_4930404N11Rik
  gRNA
ggacaggcaaauccguggca

SEQ ID NO: 68606 - RNA, 20 nt, Artificial Sequence
  MKO10068606_B_4930404N11Rik
  gRNA
accgcgcaguaucucaacuc

SEQ ID NO: 68607 - RNA, 20 nt, Artificial Sequence
  MKO10068607_B_4930404N11Rik
  gRNA
caggaacccaccgguagaga

SEQ ID NO: 68608 - RNA, 20 nt, Artificial Sequence
  MKO10068608_B_4930407I10Rik
  gRNA
aguauuggcaccaguucucc

SEQ ID NO: 68609 - RNA, 20 nt, Artificial Sequence
  MKO10068609_B_4930407I10Rik
  gRNA
ucgucucccgugaaacauag

SEQ ID NO: 68610 - RNA, 20 nt, Artificial Sequence
  MKO10068610_B_4930407I10Rik
  gRNA
gacuugcauaguaccgagcc

SEQ ID NO: 68611 - RNA, 20 nt, Artificial Sequence
  MKO10068611_B_4930412D23Rik
  gRNA
uguggcuggaguugucaacg

SEQ ID NO: 68612 - RNA, 20 nt, Artificial Sequence
  MKO10068612_B_4930412D23Rik
  gRNA
guuagcgcaacaucugcucc

SEQ ID NO: 68613 - RNA, 20 nt, Artificial Sequence
  MKO10068613_B_4930412D23Rik
  gRNA
caucaugguaggaguagugc

SEQ ID NO: 68614 - RNA, 20 nt, Artificial Sequence
  MKO10068614_B_4930415F15Rik
  gRNA
uucaucuccgaaucugcuga

SEQ ID NO: 68615 - RNA, 20 nt, Artificial Sequence
  MKO10068615_B_4930415F15Rik
  gRNA
uaagugugaguccaaguacu

SEQ ID NO: 68616 - RNA, 20 nt, Artificial Sequence
  MKO10068616_B_4930415F15Rik
  gRNA
cacagacuugauaucuccgu

SEQ ID NO: 68617 - RNA, 20 nt, Artificial Sequence
  MKO10068617_B_4930415L06Rik
  gRNA
uuacagacauaucgaagaua

SEQ ID NO: 68618 - RNA, 20 nt, Artificial Sequence
  MKO10068618_B_4930415L06Rik
  gRNA
gauaagcaguggaaaaacgu

SEQ ID NO: 68619 - RNA, 20 nt, Artificial Sequence
  MKO10068619_B_4930415L06Rik
  gRNA
aaauaugcguaccacagcua

SEQ ID NO: 68620 - RNA, 20 nt, Artificial Sequence
  MKO10068620_B_4930415O20Rik
  gRNA
caagaccucaccuggucauu

SEQ ID NO: 68621 - RNA, 20 nt, Artificial Sequence
  MKO10068621_B_4930415O20Rik
  gRNA
uucuucaacuuauaucuacu

SEQ ID NO: 68622 - RNA, 20 nt, Artificial Sequence
  MKO10068622_B_4930415O20Rik
  gRNA
cgcuccucaguaaagacuga

SEQ ID NO: 68623 - RNA, 20 nt, Artificial Sequence
  MKO10068623_B_4930422G04Rik
  gRNA
ggacgcuuguauccuccagc

SEQ ID NO: 68624 - RNA, 20 nt, Artificial Sequence
  MKO10068624_B_4930422G04Rik
  gRNA
ccucaaggcacuuaagaaac

SEQ ID NO: 68625 - RNA, 20 nt, Artificial Sequence
  MKO10068625_B_4930422G04Rik
  gRNA
guucugaagaucacucacuu

SEQ ID NO: 68626 - RNA, 20 nt, Artificial Sequence
  MKO10068626_B_4930426D05Rik
  gRNA
aacccagcauaccgauguug

SEQ ID NO: 68627 - RNA, 20 nt, Artificial Sequence
  MKO10068627_B_4930426D05Rik
  gRNA
cucgagcccacgagguguca

SEQ ID NO: 68628 - RNA, 20 nt, Artificial Sequence
  MKO10068628_B_4930426D05Rik
  gRNA
ugugcuguugcuuaacuucg

SEQ ID NO: 68629 - RNA, 20 nt, Artificial Sequence
  MKO10068629_B_4930427A07Rik
  gRNA
ccgacuaguggaauggcuga

SEQ ID NO: 68630 - RNA, 20 nt, Artificial Sequence
  MKO10068630_B_4930427A07Rik
  gRNA
cgcuugcugcaaacaauacc

SEQ ID NO: 68631 - RNA, 20 nt, Artificial Sequence
  MKO10068631_B_4930427A07Rik
  gRNA
ccuguauuaccuugcugagg

SEQ ID NO: 68632 - RNA, 20 nt, Artificial Sequence
  MKO10068632_B_4930428D18Rik
  gRNA
cuaauuugcuguaucuccau

SEQ ID NO: 68633 - RNA, 20 nt, Artificial Sequence
  MKO10068633_B_4930428D18Rik
  gRNA
aaugauccaacaauugcuac

SEQ ID NO: 68634 - RNA, 20 nt, Artificial Sequence
  MKO10068634_B_4930428D18Rik
  gRNA
ucaccaccauuauugcccuu

SEQ ID NO: 68635 - RNA, 20 nt, Artificial Sequence
  MKO10068635_B_4930430A15Rik
  gRNA
gcuuaaguacagugcaaaca

SEQ ID NO: 68636 - RNA, 20 nt, Artificial Sequence
  MKO10068636_B_4930430A15Rik
  gRNA
uccuugagagccaguaaaag

SEQ ID NO: 68637 - RNA, 20 nt, Artificial Sequence
  MKO10068637_B_4930430A15Rik
  gRNA
gaauacuuacuacuuccacc

SEQ ID NO: 68638 - RNA, 20 nt, Artificial Sequence
  MKO10068638_B_4930430D24Rik
  gRNA
gcuaucuaccauuugugcau

SEQ ID NO: 68639 - RNA, 20 nt, Artificial Sequence
  MKO10068639_B_4930430D24Rik
  gRNA
gcuguaugaagccucaccag

SEQ ID NO: 68640 - RNA, 20 nt, Artificial Sequence
  MKO10068640_B_4930430D24Rik
  gRNA
gcagaggaacuugcagauga

SEQ ID NO: 68641 - RNA, 20 nt, Artificial Sequence
  MKO10068641_B_4930430F08Rik
  gRNA
agaugcagacguguacaaug

SEQ ID NO: 68642 - RNA, 20 nt, Artificial Sequence
  MKO10068642_B_4930430F08Rik
  gRNA
ugcuauguuacuaacuacaa

SEQ ID NO: 68643 - RNA, 20 nt, Artificial Sequence
  MKO10068643_B_4930430F08Rik
  gRNA
ucaagccugucccagagugc

SEQ ID NO: 68644 - RNA, 20 nt, Artificial Sequence
  MKO10068644_B_4930432K09Rik
  gRNA
cuuuaccucuucaguggacg

SEQ ID NO: 68645 - RNA, 20 nt, Artificial Sequence
  MKO10068645_B_4930432K09Rik
  gRNA
aaaagcgacacacaugaugc

SEQ ID NO: 68646 - RNA, 20 nt, Artificial Sequence
  MKO10068646_B_4930432K09Rik
  gRNA
ucaaaaugaaguuacuucuu

SEQ ID NO: 68647 - RNA, 20 nt, Artificial Sequence
  MKO10068647_B_4930432K21Rik
  gRNA
uaccugaaagcuucguguag

SEQ ID NO: 68648 - RNA, 20 nt, Artificial Sequence
  MKO10068648_B_4930432K21Rik
  gRNA
uccccgccuagcucuacaga

SEQ ID NO: 68649 - RNA, 20 nt, Artificial Sequence
  MKO10068649_B_4930432K21Rik
  gRNA
ggagcugccucugaccucgc

SEQ ID NO: 68650 - RNA, 20 nt, Artificial Sequence
  MKO10068650_B_4930432M17Rik
  gRNA
cugcguagagccuucaagag

SEQ ID NO: 68651 - RNA, 20 nt, Artificial Sequence
  MKO10068651_B_4930432M17Rik
  gRNA
ucaccuuguccacccaacag

SEQ ID NO: 68652 - RNA, 20 nt, Artificial Sequence
  MKO10068652_B_4930432M17Rik
  gRNA
agcccccuagacuguaucaa

SEQ ID NO: 68653 - RNA, 20 nt, Artificial Sequence
  MKO10068653_B_4930433I11Rik
  gRNA
uaccacuucuucccagcauc

SEQ ID NO: 68654 - RNA, 20 nt, Artificial Sequence
  MKO10068654_B_4930433I11Rik
  gRNA
cagaagcagacgucugucuu

SEQ ID NO: 68655 - RNA, 20 nt, Artificial Sequence
  MKO10068655_B_4930433I11Rik
  gRNA
cugaucccuccagacaacug

SEQ ID NO: 68656 - RNA, 20 nt, Artificial Sequence
  MKO10068656_B_4930435E12Rik
  gRNA
guauccggccaagccaaugc

SEQ ID NO: 68657 - RNA, 20 nt, Artificial Sequence
  MKO10068657_B_4930435E12Rik
  gRNA
acuguauuucaugcuagacc

SEQ ID NO: 68658 - RNA, 20 nt, Artificial Sequence
  MKO10068658_B_4930435E12Rik
  gRNA
cugaaaaccuagucuaugaa

SEQ ID NO: 68659 - RNA, 20 nt, Artificial Sequence
  MKO10068659_B_4930444G20Rik
  gRNA
aggaacgggugaggccugug

SEQ ID NO: 68660 - RNA, 20 nt, Artificial Sequence
  MKO10068660_B_4930444G20Rik
  gRNA
uauugccuuugccacuaucc

SEQ ID NO: 68661 - RNA, 20 nt, Artificial Sequence
  MKO10068661_B_4930444G20Rik
  gRNA
aucauccuggauaguggcaa

SEQ ID NO: 68662 - RNA, 20 nt, Artificial Sequence
  MKO10068662_B_4930444P10Rik
  gRNA
acgcugagaucccucccauc

SEQ ID NO: 68663 - RNA, 20 nt, Artificial Sequence
  MKO10068663_B_4930444P10Rik
  gRNA
ucacaagcgccugcugcaca

SEQ ID NO: 68664 - RNA, 20 nt, Artificial Sequence
  MKO10068664_B_4930444P10Rik
  gRNA
gugcaguauggcagcauuuc

SEQ ID NO: 68665 - RNA, 20 nt, Artificial Sequence
  MKO10068665_B_4930447A16Rik
  gRNA
aagauugugcaagcuuaagg

SEQ ID NO: 68666 - RNA, 20 nt, Artificial Sequence
  MKO10068666_B_4930447A16Rik
  gRNA
uuauucagugaugaagaugu

SEQ ID NO: 68667 - RNA, 20 nt, Artificial Sequence
  MKO10068667_B_4930447A16Rik
  gRNA
cagaugugugccacuccacc

SEQ ID NO: 68668 - RNA, 20 nt, Artificial Sequence
  MKO10068668_B_4930447C04Rik
  gRNA
acuguacuugucuuucucau

SEQ ID NO: 68669 - RNA, 20 nt, Artificial Sequence
  MKO10068669_B_4930447C04Rik
  gRNA
acuauucuuaugaaauuucu

SEQ ID NO: 68670 - RNA, 20 nt, Artificial Sequence
  MKO10068670_B_4930447C04Rik
  gRNA
agaaauuaaaaauagagugu

SEQ ID NO: 68671 - RNA, 20 nt, Artificial Sequence
  MKO10068671_B_4930449I24Rik
  gRNA
ggucuguucucaaaaugaac

SEQ ID NO: 68672 - RNA, 20 nt, Artificial Sequence
  MKO10068672_B_4930449I24Rik
  gRNA
ccacucaccucuuaguuugc

SEQ ID NO: 68673 - RNA, 20 nt, Artificial Sequence
  MKO10068673_B_4930449I24Rik
  gRNA
gccacagguaugcauccuuc

SEQ ID NO: 68674 - RNA, 20 nt, Artificial Sequence
  MKO10068674_B_4930451C15Rik
  gRNA
uaaucccuacaucaagcguc

SEQ ID NO: 68675 - RNA, 20 nt, Artificial Sequence
  MKO10068675_B_4930451C15Rik
  gRNA
uucuugucuucugcgccaag

SEQ ID NO: 68676 - RNA, 20 nt, Artificial Sequence
  MKO10068676_B_4930451C15Rik
  gRNA
uucauucuucugaacuucgc

SEQ ID NO: 68677 - RNA, 20 nt, Artificial Sequence
  MKO10068677_B_4930451G09Rik
  gRNA
ccuguuggugucgaugaguc

SEQ ID NO: 68678 - RNA, 20 nt, Artificial Sequence
  MKO10068678_B_4930451G09Rik
  gRNA
cgaagcgcagagcccuccgc

SEQ ID NO: 68679 - RNA, 20 nt, Artificial Sequence
  MKO10068679_B_4930451G09Rik
  gRNA
ugaacgucaaaccuuggucu

SEQ ID NO: 68680 - RNA, 20 nt, Artificial Sequence
  MKO10068680_B_4930451I11Rik
  gRNA
caguuccccaccuguuucua

SEQ ID NO: 68681 - RNA, 20 nt, Artificial Sequence
  MKO10068681_B_4930451I11Rik
  gRNA
ccaccacuaauguccccacc

SEQ ID NO: 68682 - RNA, 20 nt, Artificial Sequence
  MKO10068682_B_4930451I11Rik
  gRNA
uaucucauuaggccccuuuc

SEQ ID NO: 68683 - RNA, 20 nt, Artificial Sequence
  MKO10068683_B_4930452B06Rik
  gRNA
uucuaguuggacugauccag

SEQ ID NO: 68684 - RNA, 20 nt, Artificial Sequence
  MKO10068684_B_4930452B06Rik
  gRNA
gcuucagauuuacauacccc

SEQ ID NO: 68685 - RNA, 20 nt, Artificial Sequence
  MKO10068685_B_4930452B06Rik
  gRNA
guauuuaucaacaguccaua

SEQ ID NO: 68686 - RNA, 20 nt, Artificial Sequence
  MKO10068686_B_4930453H23Rik
  gRNA
uauauucucagccaauacag

SEQ ID NO: 68687 - RNA, 20 nt, Artificial Sequence
  MKO10068687_B_4930453H23Rik
  gRNA
ugaaaauguagaugucaacu

SEQ ID NO: 68688 - RNA, 20 nt, Artificial Sequence
  MKO10068688_B_4930453H23Rik
  gRNA
auugaaaaagacccaugaag

SEQ ID NO: 68689 - RNA, 20 nt, Artificial Sequence
  MKO10068689_B_4930453N24Rik
  gRNA
ucuugaggugggcccaaaaa

SEQ ID NO: 68690 - RNA, 20 nt, Artificial Sequence
  MKO10068690_B_4930453N24Rik
  gRNA
cgucgugccagaagugcugu

SEQ ID NO: 68691 - RNA, 20 nt, Artificial Sequence
  MKO10068691_B_4930453N24Rik
  gRNA
cgacaccgucaccaaccgcc

SEQ ID NO: 68692 - RNA, 20 nt, Artificial Sequence
  MKO10068692_B_4930467E23Rik
  gRNA
ggccacccaacgagacaaug

SEQ ID NO: 68693 - RNA, 20 nt, Artificial Sequence
  MKO10068693_B_4930467E23Rik
  gRNA
gcuaaaaauucuaccauuuc

SEQ ID NO: 68694 - RNA, 20 nt, Artificial Sequence
  MKO10068694_B_4930467E23Rik
  gRNA
auuugaacagaaaccugaaa

SEQ ID NO: 68695 - RNA, 20 nt, Artificial Sequence
  MKO10068695_B_4930468A15Rik
  gRNA
aagaaccauacucgccauug

SEQ ID NO: 68696 - RNA, 20 nt, Artificial Sequence
  MKO10068696_B_4930468A15Rik
  gRNA
uuuaaauaguauagcgcacu

SEQ ID NO: 68697 - RNA, 20 nt, Artificial Sequence
  MKO10068697_B_4930468A15Rik
  gRNA
guguuacaaauacaccuacc

SEQ ID NO: 68698 - RNA, 20 nt, Artificial Sequence
  MKO10068698_B_4930469G21Rik
  gRNA
agugcacuaccugaaaguua

SEQ ID NO: 68699 - RNA, 20 nt, Artificial Sequence
  MKO10068699_B_4930469G21Rik
  gRNA
caacguggacaaaggucgga

SEQ ID NO: 68700 - RNA, 20 nt, Artificial Sequence
  MKO10068700_B_4930469G21Rik
  gRNA
gacuggcaggacuaucugaa

SEQ ID NO: 68701 - RNA, 20 nt, Artificial Sequence
  MKO10068701_B_4930474N05Rik
  gRNA
ugucuaugcucaacagaaug

SEQ ID NO: 68702 - RNA, 20 nt, Artificial Sequence
  MKO10068702_B_4930474N05Rik
  gRNA
aagcuuuguuaccccccuac

SEQ ID NO: 68703 - RNA, 20 nt, Artificial Sequence
  MKO10068703_B_4930474N05Rik
  gRNA
gguaacaaagcuucuguaug

SEQ ID NO: 68704 - RNA, 20 nt, Artificial Sequence
  MKO10068704_B_4930480E11Rik
  gRNA
uagauaucaugggggaucag

SEQ ID NO: 68705 - RNA, 20 nt, Artificial Sequence
  MKO10068705_B_4930480E11Rik
  gRNA
accuggguaaucgaggaagc

SEQ ID NO: 68706 - RNA, 20 nt, Artificial Sequence
  MKO10068706_B_4930480E11Rik
  gRNA
guguacaaugaaauccuuaa

SEQ ID NO: 68707 - RNA, 20 nt, Artificial Sequence
  MKO10068707_B_4930486L24Rik
  gRNA
uucgaaggcagaagaucaag

SEQ ID NO: 68708 - RNA, 20 nt, Artificial Sequence
  MKO10068708_B_4930486L24Rik
  gRNA
gaauucgugaaaaugaugac

SEQ ID NO: 68709 - RNA, 20 nt, Artificial Sequence
  MKO10068709_B_4930486L24Rik
  gRNA
acuuaccacugucauagaau

SEQ ID NO: 68710 - RNA, 20 nt, Artificial Sequence
  MKO10068710_B_4930502E18Rik
  gRNA
ucucuagacauugcuuguaa

SEQ ID NO: 68711 - RNA, 20 nt, Artificial Sequence
  MKO10068711_B_4930502E18Rik
  gRNA
gcaugcaauccaacuauuuc

SEQ ID NO: 68712 - RNA, 20 nt, Artificial Sequence
  MKO10068712_B_4930502E18Rik
  gRNA
acagauuucaaaccuuauaa

SEQ ID NO: 68713 - RNA, 20 nt, Artificial Sequence
  MKO10068713_B_4930503B20Rik
  gRNA
uuucgucacaauccuucacg

SEQ ID NO: 68714 - RNA, 20 nt, Artificial Sequence
  MKO10068714_B_4930503B20Rik
  gRNA
cguuugugucccaugaaucc

SEQ ID NO: 68715 - RNA, 20 nt, Artificial Sequence
  MKO10068715_B_4930503B20Rik
  gRNA
gucguaauccuuucgcuucu

SEQ ID NO: 68716 - RNA, 20 nt, Artificial Sequence
  MKO10068716_B_4930503E14Rik
  gRNA
ucagaaagauaaaugcugag

SEQ ID NO: 68717 - RNA, 20 nt, Artificial Sequence
  MKO10068717_B_4930503E14Rik
  gRNA
gauuagugauguugcaauuu

SEQ ID NO: 68718 - RNA, 20 nt, Artificial Sequence
  MKO10068718_B_4930503E14Rik
  gRNA
acaacaugagaagacaaugu

SEQ ID NO: 68719 - RNA, 20 nt, Artificial Sequence
  MKO10068719_B_4930503L19Rik
  gRNA
cgcauucacacauugugucc

SEQ ID NO: 68720 - RNA, 20 nt, Artificial Sequence
  MKO10068720_B_4930503L19Rik
  gRNA
cuuuagagcucuacucuauc

SEQ ID NO: 68721 - RNA, 20 nt, Artificial Sequence
  MKO10068721_B_4930503L19Rik
  gRNA
auuuaaccuucagacaguac

SEQ ID NO: 68722 - RNA, 20 nt, Artificial Sequence
  MKO10068722_B_4930504O13Rik
  gRNA
gacucuggccccguuucuga

SEQ ID NO: 68723 - RNA, 20 nt, Artificial Sequence
  MKO10068723_B_4930504O13Rik
  gRNA
gccuuuaugcccuucucuac

SEQ ID NO: 68724 - RNA, 20 nt, Artificial Sequence
  MKO10068724_B_4930504O13Rik
  gRNA
uguaagucagccaucagaaa

SEQ ID NO: 68725 - RNA, 20 nt, Artificial Sequence
  MKO10068725_B_4930505A04Rik
  gRNA
agaguguucaauaauaccuc

SEQ ID NO: 68726 - RNA, 20 nt, Artificial Sequence
  MKO10068726_B_4930505A04Rik
  gRNA
uuauuaucaauguagggaac

SEQ ID NO: 68727 - RNA, 20 nt, Artificial Sequence
  MKO10068727_B_4930505A04Rik
  gRNA
acucccaaugaacccaucaa

SEQ ID NO: 68728 - RNA, 20 nt, Artificial Sequence
  MKO10068728_B_4930506M07Rik
  gRNA
ucgagagagcgcugaagccu

SEQ ID NO: 68729 - RNA, 20 nt, Artificial Sequence
  MKO10068729_B_4930506M07Rik
  gRNA
caggcucaccuuugucgcca

SEQ ID NO: 68730 - RNA, 20 nt, Artificial Sequence
  MKO10068730_B_4930506M07Rik
  gRNA
agaugaagcuguuaaaaaac

SEQ ID NO: 68731 - RNA, 20 nt, Artificial Sequence
  MKO10068731_B_4930513O06Rik
  gRNA
cacagguguguucauaguua

SEQ ID NO: 68732 - RNA, 20 nt, Artificial Sequence
  MKO10068732_B_4930513O06Rik
  gRNA
gcaagaccucacagugauag

SEQ ID NO: 68733 - RNA, 20 nt, Artificial Sequence
  MKO10068733_B_4930513O06Rik
  gRNA
agaauaccuuguagagucca

SEQ ID NO: 68734 - RNA, 20 nt, Artificial Sequence
  MKO10068734_B_4930519F16Rik
  gRNA
auaguacccuggcaauuauc

SEQ ID NO: 68735 - RNA, 20 nt, Artificial Sequence
  MKO10068735_B_4930519F16Rik
  gRNA
auaugaccagccuuucgugc

SEQ ID NO: 68736 - RNA, 20 nt, Artificial Sequence
  MKO10068736_B_4930519F16Rik
  gRNA
ugccaguugagucgaaauga

SEQ ID NO: 68737 - RNA, 20 nt, Artificial Sequence
  MKO10068737_B_4930519G04Rik
  gRNA
ccuccuaccagauuccaaca

SEQ ID NO: 68738 - RNA, 20 nt, Artificial Sequence
  MKO10068738_B_4930519G04Rik
  gRNA
gugaccacagguggaauccu

SEQ ID NO: 68739 - RNA, 20 nt, Artificial Sequence
  MKO10068739_B_4930519G04Rik
  gRNA
auauccagaaguacauguca

SEQ ID NO: 68740 - RNA, 20 nt, Artificial Sequence
  MKO10068740_B_4930522H14Rik
  gRNA
ugcuggcuauuuacaaucac

SEQ ID NO: 68741 - RNA, 20 nt, Artificial Sequence
  MKO10068741_B_4930522H14Rik
  gRNA
agcuccagcagccauaaagu

SEQ ID NO: 68742 - RNA, 20 nt, Artificial Sequence
  MKO10068742_B_4930522H14Rik
  gRNA
gugauuguaaauagccagca

SEQ ID NO: 68743 - RNA, 20 nt, Artificial Sequence
  MKO10068743_B_4930523C07Rik
  gRNA
ccaccaccaggggcaacccc

SEQ ID NO: 68744 - RNA, 20 nt, Artificial Sequence
  MKO10068744_B_4930523C07Rik
  gRNA
ugugcuccugggguugcccc

SEQ ID NO: 68745 - RNA, 20 nt, Artificial Sequence
  MKO10068745_B_4930523C07Rik
  gRNA
cgccucuuucgugucugauc

SEQ ID NO: 68746 - RNA, 20 nt, Artificial Sequence
  MKO10068746_B_4930524B15Rik
  gRNA
uuacuucacuagauacacgc

SEQ ID NO: 68747 - RNA, 20 nt, Artificial Sequence
  MKO10068747_B_4930524B15Rik
  gRNA
uuaucuuuaaggccucugug

SEQ ID NO: 68748 - RNA, 20 nt, Artificial Sequence
  MKO10068748_B_4930524B15Rik
  gRNA
uuuccucuccuucauuagcu

SEQ ID NO: 68749 - RNA, 20 nt, Artificial Sequence
  MKO10068749_B_4930524N10Rik
  gRNA
cuuugcagccuauuaucuuc

SEQ ID NO: 68750 - RNA, 20 nt, Artificial Sequence
  MKO10068750_B_4930524N10Rik
  gRNA
uuccaaacccugaagauaau

SEQ ID NO: 68751 - RNA, 20 nt, Artificial Sequence
  MKO10068751_B_4930524N10Rik
  gRNA
ugcccagcaugcuuccaaaa

SEQ ID NO: 68752 - RNA, 20 nt, Artificial Sequence
  MKO10068752_B_4930525M21Rik
  gRNA
cugcaaguuccucugcacca

SEQ ID NO: 68753 - RNA, 20 nt, Artificial Sequence
  MKO10068753_B_4930525M21Rik
  gRNA
gcuguaugaagccucaccag

SEQ ID NO: 68754 - RNA, 20 nt, Artificial Sequence
  MKO10068754_B_4930525M21Rik
  gRNA
gcagcagcuccucauuccug

SEQ ID NO: 68755 - RNA, 20 nt, Artificial Sequence
  MKO10068755_B_4930526D03Rik
  gRNA
gaggcguguugagacaaucc

SEQ ID NO: 68756 - RNA, 20 nt, Artificial Sequence
  MKO10068756_B_4930526D03Rik
  gRNA
cgcgcgcggagcucugcuuc

SEQ ID NO: 68757 - RNA, 20 nt, Artificial Sequence
  MKO10068757_B_4930526D03Rik
  gRNA
ugccaucuaccuccucuucc

SEQ ID NO: 68758 - RNA, 20 nt, Artificial Sequence
  MKO10068758_B_4930529M08Rik
  gRNA
gugccaacauauuugagccu

SEQ ID NO: 68759 - RNA, 20 nt, Artificial Sequence
  MKO10068759_B_4930529M08Rik
  gRNA
cucaccggaugauuucuuug

SEQ ID NO: 68760 - RNA, 20 nt, Artificial Sequence
  MKO10068760_B_4930529M08Rik
  gRNA
ugcauaaacagcguguucag

SEQ ID NO: 68761 - RNA, 20 nt, Artificial Sequence
  MKO10068761_B_4930538K18Rik
  gRNA
caucguguggguagcaacuc

SEQ ID NO: 68762 - RNA, 20 nt, Artificial Sequence
  MKO10068762_B_4930538K18Rik
  gRNA
uuccuauugcaaugucuaac

SEQ ID NO: 68763 - RNA, 20 nt, Artificial Sequence
  MKO10068763_B_4930538K18Rik
  gRNA
gaagagccccaggaucaugu

SEQ ID NO: 68764 - RNA, 20 nt, Artificial Sequence
  MKO10068764_B_4930539E08Rik
  gRNA
gcccagaaacccggcccaag

SEQ ID NO: 68765 - RNA, 20 nt, Artificial Sequence
  MKO10068765_B_4930539E08Rik
  gRNA
accagauucugaccuuccuc

SEQ ID NO: 68766 - RNA, 20 nt, Artificial Sequence
  MKO10068766_B_4930539E08Rik
  gRNA
ggacucacggucaggcuucc

SEQ ID NO: 68767 - RNA, 20 nt, Artificial Sequence
  MKO10068767_B_4930544D05Rik
  gRNA
cgugcaaaccucguccacac

SEQ ID NO: 68768 - RNA, 20 nt, Artificial Sequence
  MKO10068768_B_4930544D05Rik
  gRNA
cagcaggguguccaaauugc

SEQ ID NO: 68769 - RNA, 20 nt, Artificial Sequence
  MKO10068769_B_4930544D05Rik
  gRNA
gaaggggauucccagcaauu

SEQ ID NO: 68770 - RNA, 20 nt, Artificial Sequence
  MKO10068770_B_4930544G11Rik
  gRNA
cguuugcagagcagcccuug

SEQ ID NO: 68771 - RNA, 20 nt, Artificial Sequence
  MKO10068771_B_4930544G11Rik
  gRNA
gcgccugugagaccugaaca

SEQ ID NO: 68772 - RNA, 20 nt, Artificial Sequence
  MKO10068772_B_4930544G11Rik
  gRNA
ccuaggcaauggcugccauc

SEQ ID NO: 68773 - RNA, 20 nt, Artificial Sequence
  MKO10068773_B_4930547C10Rik
  gRNA
gccugcaccgacugauuccc

SEQ ID NO: 68774 - RNA, 20 nt, Artificial Sequence
  MKO10068774_B_4930547C10Rik
  gRNA
guaguccgagugagucugac

SEQ ID NO: 68775 - RNA, 20 nt, Artificial Sequence
  MKO10068775_B_4930547C10Rik
  gRNA
agaagagcucuguacuauuc

SEQ ID NO: 68776 - RNA, 20 nt, Artificial Sequence
  MKO10068776_B_4930548H24Rik
  gRNA
gcuacuaacuuaguccuagc

SEQ ID NO: 68777 - RNA, 20 nt, Artificial Sequence
  MKO10068777_B_4930548H24Rik
  gRNA
accuuggggagauuauucga

SEQ ID NO: 68778 - RNA, 20 nt, Artificial Sequence
  MKO10068778_B_4930548H24Rik
  gRNA
cagguucgccaagcaaacug

SEQ ID NO: 68779 - RNA, 20 nt, Artificial Sequence
  MKO10068779_B_4930549C01Rik
  gRNA
gggaacuaaucuuucuucug

SEQ ID NO: 68780 - RNA, 20 nt, Artificial Sequence
  MKO10068780_B_4930549C01Rik
  gRNA
uaaugcuugcuucgcccucc

SEQ ID NO: 68781 - RNA, 20 nt, Artificial Sequence
  MKO10068781_B_4930549C01Rik
  gRNA
auguacuaccgucaccccca

SEQ ID NO: 68782 - RNA, 20 nt, Artificial Sequence
  MKO10068782_B_4930550C14Rik
  gRNA
gagguacauuaacccuaaag

SEQ ID NO: 68783 - RNA, 20 nt, Artificial Sequence
  MKO10068783_B_4930550C14Rik
  gRNA
uaucgccguguagagaacaa

SEQ ID NO: 68784 - RNA, 20 nt, Artificial Sequence
  MKO10068784_B_4930550C14Rik
  gRNA
ucaccccacccaaccugaau

SEQ ID NO: 68785 - RNA, 20 nt, Artificial Sequence
  MKO10068785_B_4930550L24Rik
  gRNA
aagcaccaggaggccggucu

SEQ ID NO: 68786 - RNA, 20 nt, Artificial Sequence
  MKO10068786_B_4930550L24Rik
  gRNA
guccuugaccucaccuauga

SEQ ID NO: 68787 - RNA, 20 nt, Artificial Sequence
  MKO10068787_B_4930550L24Rik
  gRNA
cuuccaugaagauuauacca

SEQ ID NO: 68788 - RNA, 20 nt, Artificial Sequence
  MKO10068788_B_4930555G01Rik
  gRNA
acaacaugagaagacaaugu

SEQ ID NO: 68789 - RNA, 20 nt, Artificial Sequence
  MKO10068789_B_4930555G01Rik
  gRNA
cugcuguuccuuugcacuug

SEQ ID NO: 68790 - RNA, 20 nt, Artificial Sequence
  MKO10068790_B_4930555G01Rik
  gRNA
cucaacucaacaaaaaagua

SEQ ID NO: 68791 - RNA, 20 nt, Artificial Sequence
  MKO10068791_B_4930557A04Rik
  gRNA
auagcguugcucccucuuca

SEQ ID NO: 68792 - RNA, 20 nt, Artificial Sequence
  MKO10068792_B_4930557A04Rik
  gRNA
auagaguccuguuaucuuau

SEQ ID NO: 68793 - RNA, 20 nt, Artificial Sequence
  MKO10068793_B_4930557A04Rik
  gRNA
agcauauccguaaacaaaac

SEQ ID NO: 68794 - RNA, 20 nt, Artificial Sequence
  MKO10068794_B_4930558K02Rik
  gRNA
cuuguacgaagucagaacaa

SEQ ID NO: 68795 - RNA, 20 nt, Artificial Sequence
  MKO10068795_B_4930558K02Rik
  gRNA
agcgcacaguugcuuguuuc

SEQ ID NO: 68796 - RNA, 20 nt, Artificial Sequence
  MKO10068796_B_4930558K02Rik
  gRNA
gagggugguuucugaugguc

SEQ ID NO: 68797 - RNA, 20 nt, Artificial Sequence
  MKO10068797_B_4930562C15Rik
  gRNA
uccgcucaccggacugaaca

SEQ ID NO: 68798 - RNA, 20 nt, Artificial Sequence
  MKO10068798_B_4930562C15Rik
  gRNA
ggacagcucgaaccuuguuc

SEQ ID NO: 68799 - RNA, 20 nt, Artificial Sequence
  MKO10068799_B_4930562C15Rik
  gRNA
caacgaccuucauguccuca

SEQ ID NO: 68800 - RNA, 20 nt, Artificial Sequence
  MKO10068800_B_4930563D23Rik
  gRNA
acaguuugugaagcgagcca

SEQ ID NO: 68801 - RNA, 20 nt, Artificial Sequence
  MKO10068801_B_4930563D23Rik
  gRNA
gucaguuugacagcgccaag

SEQ ID NO: 68802 - RNA, 20 nt, Artificial Sequence
  MKO10068802_B_4930563D23Rik
  gRNA
cuugacugcccccagcgugu

SEQ ID NO: 68803 - RNA, 20 nt, Artificial Sequence
  MKO10068803_B_4930563E22Rik
  gRNA
ggacguuuccgugcacugcg

SEQ ID NO: 68804 - RNA, 20 nt, Artificial Sequence
  MKO10068804_B_4930563E22Rik
  gRNA
augcuguuguauucccgcga

SEQ ID NO: 68805 - RNA, 20 nt, Artificial Sequence
  MKO10068805_B_4930563E22Rik
  gRNA
gucagggugguguauuacgu

SEQ ID NO: 68806 - RNA, 20 nt, Artificial Sequence
  MKO10068806_B_4930564B18Rik
  gRNA
cuucaggucguguguagagc

SEQ ID NO: 68807 - RNA, 20 nt, Artificial Sequence
  MKO10068807_B_4930564B18Rik
  gRNA
aaugcugggugggaccgaaa

SEQ ID NO: 68808 - RNA, 20 nt, Artificial Sequence
  MKO10068808_B_4930564B18Rik
  gRNA
aggucaagacucgagggucu

SEQ ID NO: 68809 - RNA, 20 nt, Artificial Sequence
  MKO10068809_B_4930564C03Rik
  gRNA
ggugcaaaucaaagaccacc

SEQ ID NO: 68810 - RNA, 20 nt, Artificial Sequence
  MKO10068810_B_4930564C03Rik
  gRNA
aagagucuccauuggcauac

SEQ ID NO: 68811 - RNA, 20 nt, Artificial Sequence
  MKO10068811_B_4930564C03Rik
  gRNA
uuagugcguagcugcagaag

SEQ ID NO: 68812 - RNA, 20 nt, Artificial Sequence
  MKO10068812_B_4930564D02Rik
  gRNA
agccauggcucccuaagcag

SEQ ID NO: 68813 - RNA, 20 nt, Artificial Sequence
  MKO10068813_B_4930564D02Rik
  gRNA
uccucaagcuugcaguucua

SEQ ID NO: 68814 - RNA, 20 nt, Artificial Sequence
  MKO10068814_B_4930564D02Rik
  gRNA
ugggaaacagcaaucagagc

SEQ ID NO: 68815 - RNA, 20 nt, Artificial Sequence
  MKO10068815_B_4930567H17Rik
  gRNA
ucucaggcaguaccucuccc

SEQ ID NO: 68816 - RNA, 20 nt, Artificial Sequence
  MKO10068816_B_4930567H17Rik
  gRNA
agaugaggaggaagaugagg

SEQ ID NO: 68817 - RNA, 20 nt, Artificial Sequence
  MKO10068817_B_4930567H17Rik
  gRNA
ggagauggaggaggaagaug

SEQ ID NO: 68818 - RNA, 20 nt, Artificial Sequence
  MKO10068818_B_4930568D16Rik
  gRNA
ccaguuguugcuauaacauc

SEQ ID NO: 68819 - RNA, 20 nt, Artificial Sequence
  MKO10068819_B_4930568D16Rik
  gRNA
aagaaccucaucucuccacc

SEQ ID NO: 68820 - RNA, 20 nt, Artificial Sequence
  MKO10068820_B_4930568D16Rik
  gRNA
uacagaagauguaugccugc

SEQ ID NO: 68821 - RNA, 20 nt, Artificial Sequence
  MKO10068821_B_4930571K23Rik
  gRNA
uaacuaagcgucucaccacc

SEQ ID NO: 68822 - RNA, 20 nt, Artificial Sequence
  MKO10068822_B_4930571K23Rik
  gRNA
gcagugggauugguuuaucc

SEQ ID NO: 68823 - RNA, 20 nt, Artificial Sequence
  MKO10068823_B_4930571K23Rik
  gRNA
aaagacuguccguaguaccu

SEQ ID NO: 68824 - RNA, 20 nt, Artificial Sequence
  MKO10068824_B_4930578C19Rik
  gRNA
cguugacagccagcguguag

SEQ ID NO: 68825 - RNA, 20 nt, Artificial Sequence
  MKO10068825_B_4930578C19Rik
  gRNA
auccgagaugccagugcgcu

SEQ ID NO: 68826 - RNA, 20 nt, Artificial Sequence
  MKO10068826_B_4930578C19Rik
  gRNA
aaggaugcgcucaaugcugc

SEQ ID NO: 68827 - RNA, 20 nt, Artificial Sequence
  MKO10068827_B_4930578I06Rik
  gRNA
cguacuguagaagcuccugc

SEQ ID NO: 68828 - RNA, 20 nt, Artificial Sequence
  MKO10068828_B_4930578I06Rik
  gRNA
gcuucuacaguacgagaucc

SEQ ID NO: 68829 - RNA, 20 nt, Artificial Sequence
  MKO10068829_B_4930578I06Rik
  gRNA
cugucugugccauccgucag

SEQ ID NO: 68830 - RNA, 20 nt, Artificial Sequence
  MKO10068830_B_4930579F01Rik
  gRNA
cagaaccuccgccagagagu

SEQ ID NO: 68831 - RNA, 20 nt, Artificial Sequence
  MKO10068831_B_4930579F01Rik
  gRNA
uccucucggaagggcuaaac

SEQ ID NO: 68832 - RNA, 20 nt, Artificial Sequence
  MKO10068832_B_4930579F01Rik
  gRNA
gacuuccaaagacaaucccu

SEQ ID NO: 68833 - RNA, 20 nt, Artificial Sequence
  MKO10068833_B_4930579G24Rik
  gRNA
augcacgcuuccuuaagacg

SEQ ID NO: 68834 - RNA, 20 nt, Artificial Sequence
  MKO10068834_B_4930579G24Rik
  gRNA
guuggaccgggacuccugcu

SEQ ID NO: 68835 - RNA, 20 nt, Artificial Sequence
  MKO10068835_B_4930579G24Rik
  gRNA
acaucggcaagucaguuguc

SEQ ID NO: 68836 - RNA, 20 nt, Artificial Sequence
  MKO10068836_B_4930590J08Rik
  gRNA
ccaucuccuuugcguugaga

SEQ ID NO: 68837 - RNA, 20 nt, Artificial Sequence
  MKO10068837_B_4930590J08Rik
  gRNA
cuccaugaacauuucugcua

SEQ ID NO: 68838 - RNA, 20 nt, Artificial Sequence
  MKO10068838_B_4930590J08Rik
  gRNA
ugcuuuccuuucccgugcag

SEQ ID NO: 68839 - RNA, 20 nt, Artificial Sequence
  MKO10068839_B_4930591A17Rik
  gRNA
caggauauccccuaacugca

SEQ ID NO: 68840 - RNA, 20 nt, Artificial Sequence
  MKO10068840_B_4930591A17Rik
  gRNA
ccaugggaaaugaagccgug

SEQ ID NO: 68841 - RNA, 20 nt, Artificial Sequence
  MKO10068841_B_4930591A17Rik
  gRNA
gaaugagcucccgcaucccc

SEQ ID NO: 68842 - RNA, 20 nt, Artificial Sequence
  MKO10068842_B_4930595M18Rik
  gRNA
uugucacucguacuagaaac

SEQ ID NO: 68843 - RNA, 20 nt, Artificial Sequence
  MKO10068843_B_4930595M18Rik
  gRNA
ucauauacugucaauauuuc

SEQ ID NO: 68844 - RNA, 20 nt, Artificial Sequence
  MKO10068844_B_4930595M18Rik
  gRNA
cugacaucuauucgaguugu

SEQ ID NO: 68845 - RNA, 20 nt, Artificial Sequence
  MKO10068845_B_4930596D02Rik
  gRNA
uacgccuccagacaccacca

SEQ ID NO: 68846 - RNA, 20 nt, Artificial Sequence
  MKO10068846_B_4930596D02Rik
  gRNA
ugcagacacguugaaaaagc

SEQ ID NO: 68847 - RNA, 20 nt, Artificial Sequence
  MKO10068847_B_4930596D02Rik
  gRNA
cuacucgaggcucaggccac

SEQ ID NO: 68848 - RNA, 20 nt, Artificial Sequence
  MKO10068848_B_4931406B18Rik
  gRNA
cauuaggagacuucgcugug

SEQ ID NO: 68849 - RNA, 20 nt, Artificial Sequence
  MKO10068849_B_4931406B18Rik
  gRNA
gagaucacccaugggggcac

SEQ ID NO: 68850 - RNA, 20 nt, Artificial Sequence
  MKO10068850_B_4931406B18Rik
  gRNA
uagcuugaccacuuuacugc

SEQ ID NO: 68851 - RNA, 20 nt, Artificial Sequence
  MKO10068851_B_4931406C07Rik
  gRNA
cuacgcaccucuuacaggaa

SEQ ID NO: 68852 - RNA, 20 nt, Artificial Sequence
  MKO10068852_B_4931406C07Rik
  gRNA
aauggcuccuuuguuaaauc

SEQ ID NO: 68853 - RNA, 20 nt, Artificial Sequence
  MKO10068853_B_4931406C07Rik
  gRNA
agcaggcacgcuccaucugc

SEQ ID NO: 68854 - RNA, 20 nt, Artificial Sequence
  MKO10068854_B_4931406P16Rik
  gRNA
ggccauugaagcaaguuugc

SEQ ID NO: 68855 - RNA, 20 nt, Artificial Sequence
  MKO10068855_B_4931406P16Rik
  gRNA
caugggccacacaccugaac

SEQ ID NO: 68856 - RNA, 20 nt, Artificial Sequence
  MKO10068856_B_4931406P16Rik
  gRNA
aaaaaucgacagugcuuugc

SEQ ID NO: 68857 - RNA, 20 nt, Artificial Sequence
  MKO10068857_B_4931408C20Rik
  gRNA
aaagcuuauguccacuacua

SEQ ID NO: 68858 - RNA, 20 nt, Artificial Sequence
  MKO10068858_B_4931408C20Rik
  gRNA
gccgucuuguguuaauaccc

SEQ ID NO: 68859 - RNA, 20 nt, Artificial Sequence
  MKO10068859_B_4931408C20Rik
  gRNA
gaugaaggacgugauugguu

SEQ ID NO: 68860 - RNA, 20 nt, Artificial Sequence
  MKO10068860_B_4931409K22Rik
  gRNA
ccugauuucucgcaugaaag

SEQ ID NO: 68861 - RNA, 20 nt, Artificial Sequence
  MKO10068861_B_4931409K22Rik
  gRNA
cugcuccagcugaaaauauu

SEQ ID NO: 68862 - RNA, 20 nt, Artificial Sequence
  MKO10068862_B_4931409K22Rik
  gRNA
caucugcugacgugccuuca

SEQ ID NO: 68863 - RNA, 20 nt, Artificial Sequence
  MKO10068863_B_4931414P19Rik
  gRNA
gugacagcauuaagucgucu

SEQ ID NO: 68864 - RNA, 20 nt, Artificial Sequence
  MKO10068864_B_4931414P19Rik
  gRNA
ugaugugguuaugcacauug

SEQ ID NO: 68865 - RNA, 20 nt, Artificial Sequence
  MKO10068865_B_4931414P19Rik
  gRNA
cccauugaaucucuugucau

SEQ ID NO: 68866 - RNA, 20 nt, Artificial Sequence
  MKO10068866_B_4931417E11Rik
  gRNA
cuaauagcgcagagacuugc

SEQ ID NO: 68867 - RNA, 20 nt, Artificial Sequence
  MKO10068867_B_4931417E11Rik
  gRNA
ugcgcuauuagaaugcagca

SEQ ID NO: 68868 - RNA, 20 nt, Artificial Sequence
  MKO10068868_B_4931417E11Rik
  gRNA
accccccggaacuuuaugac

SEQ ID NO: 68869 - RNA, 20 nt, Artificial Sequence
  MKO10068869_B_4931423N10Rik
  gRNA
agauggcacaauucuuagua

SEQ ID NO: 68870 - RNA, 20 nt, Artificial Sequence
  MKO10068870_B_4931423N10Rik
  gRNA
cucuuaaggcuguccaaagc

SEQ ID NO: 68871 - RNA, 20 nt, Artificial Sequence
  MKO10068871_B_4931423N10Rik
  gRNA
cgacaccuuguugaagaaua

SEQ ID NO: 68872 - RNA, 20 nt, Artificial Sequence
  MKO10068872_B_4931428F04Rik
  gRNA
ggaugcgcaaaaugccaucc

SEQ ID NO: 68873 - RNA, 20 nt, Artificial Sequence
  MKO10068873_B_4931428F04Rik
  gRNA
gcaugcccuccaaccaguac

SEQ ID NO: 68874 - RNA, 20 nt, Artificial Sequence
  MKO10068874_B_4931428F04Rik
  gRNA
cuucugcauguauuugcgca

SEQ ID NO: 68875 - RNA, 20 nt, Artificial Sequence
  MKO10068875_B_4931429I11Rik
  gRNA
gacuacgcaccuguucgagg

SEQ ID NO: 68876 - RNA, 20 nt, Artificial Sequence
  MKO10068876_B_4931429I11Rik
  gRNA
uacuacgggccaucuucacc

SEQ ID NO: 68877 - RNA, 20 nt, Artificial Sequence
  MKO10068877_B_4931429I11Rik
  gRNA
cugaacgcuaauaaaagacg

SEQ ID NO: 68878 - RNA, 20 nt, Artificial Sequence
  MKO10068878_B_4931429L15Rik
  gRNA
uagcuuuaccugaccacugg

SEQ ID NO: 68879 - RNA, 20 nt, Artificial Sequence
  MKO10068879_B_4931429L15Rik
  gRNA
ugacugcucuugucuagacc

SEQ ID NO: 68880 - RNA, 20 nt, Artificial Sequence
  MKO10068880_B_4931429L15Rik
  gRNA
cuugaggacagcgccuccag

SEQ ID NO: 68881 - RNA, 20 nt, Artificial Sequence
  MKO10068881_B_4931431F19Rik
  gRNA
uuccggaaugugaacgccau

SEQ ID NO: 68882 - RNA, 20 nt, Artificial Sequence
  MKO10068882_B_4931431F19Rik
  gRNA
ucacuguaacgcugaccgau

SEQ ID NO: 68883 - RNA, 20 nt, Artificial Sequence
  MKO10068883_B_4931431F19Rik
  gRNA
agaacuuccugcgauugcgc

SEQ ID NO: 68884 - RNA, 20 nt, Artificial Sequence
  MKO10068884_B_4931440F15Rik
  gRNA
uggggacuccucaauacaag

SEQ ID NO: 68885 - RNA, 20 nt, Artificial Sequence
  MKO10068885_B_4931440F15Rik
  gRNA
agaagguggagugcaccccc

SEQ ID NO: 68886 - RNA, 20 nt, Artificial Sequence
  MKO10068886_B_4931440F15Rik
  gRNA
ggcgauggaacuccgccacc

SEQ ID NO: 68887 - RNA, 20 nt, Artificial Sequence
  MKO10068887_B_4931440L10Rik
  gRNA
aagcaaaugcagcuaguuua

SEQ ID NO: 68888 - RNA, 20 nt, Artificial Sequence
  MKO10068888_B_4931440L10Rik
  gRNA
gugaacgcuaaucaggucgg

SEQ ID NO: 68889 - RNA, 20 nt, Artificial Sequence
  MKO10068889_B_4931440L10Rik
  gRNA
gcuccucgaguucucuaaua

SEQ ID NO: 68890 - RNA, 20 nt, Artificial Sequence
  MKO10068890_B_4932411E22Rik
  gRNA
ggagucuaucagcuuaguga

SEQ ID NO: 68891 - RNA, 20 nt, Artificial Sequence
  MKO10068891_B_4932411E22Rik
  gRNA
uggaugcucuacaguaugcc

SEQ ID NO: 68892 - RNA, 20 nt, Artificial Sequence
  MKO10068892_B_4932411E22Rik
  gRNA
aggucgcagcugccaaacaa

SEQ ID NO: 68893 - RNA, 20 nt, Artificial Sequence
  MKO10068893_B_4932411N23Rik
  gRNA
caaagcagugucgugcuaaa

SEQ ID NO: 68894 - RNA, 20 nt, Artificial Sequence
  MKO10068894_B_4932411N23Rik
  gRNA
gcaacaguggcucaacgagu

SEQ ID NO: 68895 - RNA, 20 nt, Artificial Sequence
  MKO10068895_B_4932411N23Rik
  gRNA
auaacaauaggggccgccau

SEQ ID NO: 68896 - RNA, 20 nt, Artificial Sequence
  MKO10068896_B_4932414N04Rik
  gRNA
ugaacugcgccuuagagcac

SEQ ID NO: 68897 - RNA, 20 nt, Artificial Sequence
  MKO10068897_B_4932414N04Rik
  gRNA
guuauccgaaucacucucug

SEQ ID NO: 68898 - RNA, 20 nt, Artificial Sequence
  MKO10068898_B_4932414N04Rik
  gRNA
auuucuucauaccaaccauc

SEQ ID NO: 68899 - RNA, 20 nt, Artificial Sequence
  MKO10068899_B_4932416K20Rik
  gRNA
agugauaaucccgauccagc

SEQ ID NO: 68900 - RNA, 20 nt, Artificial Sequence
  MKO10068900_B_4932416K20Rik
  gRNA
ggauggcguagagaccagug

SEQ ID NO: 68901 - RNA, 20 nt, Artificial Sequence
  MKO10068901_B_4932416K20Rik
  gRNA
ugaagguggauucgcugcac

SEQ ID NO: 68902 - RNA, 20 nt, Artificial Sequence
  MKO10068902_B_4932418E24Rik
  gRNA
agaccugcgccaacaaaucc

SEQ ID NO: 68903 - RNA, 20 nt, Artificial Sequence
  MKO10068903_B_4932418E24Rik
  gRNA
uucuucguacagcugagcau

SEQ ID NO: 68904 - RNA, 20 nt, Artificial Sequence
  MKO10068904_B_4932418E24Rik
  gRNA
auccuucgcagaacugccaa

SEQ ID NO: 68905 - RNA, 20 nt, Artificial Sequence
  MKO10068905_B_4932429P05Rik
  gRNA
caaaucucuugacaaccguu

SEQ ID NO: 68906 - RNA, 20 nt, Artificial Sequence
  MKO10068906_B_4932429P05Rik
  gRNA
cugauucugacugaacaauc

SEQ ID NO: 68907 - RNA, 20 nt, Artificial Sequence
  MKO10068907_B_4932429P05Rik
  gRNA
aucucaacgagauuccagau

SEQ ID NO: 68908 - RNA, 20 nt, Artificial Sequence
  MKO10068908_B_4932438A13Rik
  gRNA
cuuaacagauuguauaaaca

SEQ ID NO: 68909 - RNA, 20 nt, Artificial Sequence
  MKO10068909_B_4932438A13Rik
  gRNA
ucuucccucaggauucagga

SEQ ID NO: 68910 - RNA, 20 nt, Artificial Sequence
  MKO10068910_B_4932438A13Rik
  gRNA
uuaccauguuguuucugcuu

SEQ ID NO: 68911 - RNA, 20 nt, Artificial Sequence
  MKO10068911_B_4932438H23Rik
  gRNA
ccacgugcugaaguucacuc

SEQ ID NO: 68912 - RNA, 20 nt, Artificial Sequence
  MKO10068912_B_4932438H23Rik
  gRNA
uguuugccagccuuuguaca

SEQ ID NO: 68913 - RNA, 20 nt, Artificial Sequence
  MKO10068913_B_4932438H23Rik
  gRNA
gacuugaagcuuucccuaug

SEQ ID NO: 68914 - RNA, 20 nt, Artificial Sequence
  MKO10068914_B_4932443I19Rik
  gRNA
gguggguguccacuaguggu

SEQ ID NO: 68915 - RNA, 20 nt, Artificial Sequence
  MKO10068915_B_4932443I19Rik
  gRNA
ccagaaugcccaaccacuag

SEQ ID NO: 68916 - RNA, 20 nt, Artificial Sequence
  MKO10068916_B_4932443I19Rik
  gRNA
agagacucuccaucauugac

SEQ ID NO: 68917 - RNA, 20 nt, Artificial Sequence
  MKO10068917_B_4933402D24Rik
  gRNA
cuucaggauaacaugauccc

SEQ ID NO: 68918 - RNA, 20 nt, Artificial Sequence
  MKO10068918_B_4933402D24Rik
  gRNA
ccacaacuucccgaagagca

SEQ ID NO: 68919 - RNA, 20 nt, Artificial Sequence
  MKO10068919_B_4933402D24Rik
  gRNA
cuuugcuggcuaaugcagua

SEQ ID NO: 68920 - RNA, 20 nt, Artificial Sequence
  MKO10068920_B_4933402E13Rik
  gRNA
agcaacacaaugucucgcua

SEQ ID NO: 68921 - RNA, 20 nt, Artificial Sequence
  MKO10068921_B_4933402E13Rik
  gRNA
agaggaagauaacgucgaga

SEQ ID NO: 68922 - RNA, 20 nt, Artificial Sequence
  MKO10068922_B_4933402E13Rik
  gRNA
caaauacaagcccaaaugcg

SEQ ID NO: 68923 - RNA, 20 nt, Artificial Sequence
  MKO10068923_B_4933402J07Rik
  gRNA
gcaugaucacugccaacuuc

SEQ ID NO: 68924 - RNA, 20 nt, Artificial Sequence
  MKO10068924_B_4933402J07Rik
  gRNA
ugugcucuccgauguucuuc

SEQ ID NO: 68925 - RNA, 20 nt, Artificial Sequence
  MKO10068925_B_4933402J07Rik
  gRNA
ccgcaaagugaccuuccaca

SEQ ID NO: 68926 - RNA, 20 nt, Artificial Sequence
  MKO10068926_B_4933402N03Rik
  gRNA
ucagauccacgcauugcccu

SEQ ID NO: 68927 - RNA, 20 nt, Artificial Sequence
  MKO10068927_B_4933402N03Rik
  gRNA
cagagguccucuuuguggug

SEQ ID NO: 68928 - RNA, 20 nt, Artificial Sequence
  MKO10068928_B_4933402N03Rik
  gRNA
acuugaauuucuuguuccau

SEQ ID NO: 68929 - RNA, 20 nt, Artificial Sequence
  MKO10068929_B_4933402N22Rik
  gRNA
cuauccacuuauugagcucc

SEQ ID NO: 68930 - RNA, 20 nt, Artificial Sequence
  MKO10068930_B_4933402N22Rik
  gRNA
acugagaucaacgaagaacc

SEQ ID NO: 68931 - RNA, 20 nt, Artificial Sequence
  MKO10068931_B_4933402N22Rik
  gRNA
uuguugggucucaugguugc

SEQ ID NO: 68932 - RNA, 20 nt, Artificial Sequence
  MKO10068932_B_4933402P03Rik
  gRNA
ccaaaagaucaucuugucua

SEQ ID NO: 68933 - RNA, 20 nt, Artificial Sequence
  MKO10068933_B_4933402P03Rik
  gRNA
ugauguugaccagaaugaug

SEQ ID NO: 68934 - RNA, 20 nt, Artificial Sequence
  MKO10068934_B_4933402P03Rik
  gRNA
ccauagacaagaugaucuuu

SEQ ID NO: 68935 - RNA, 20 nt, Artificial Sequence
  MKO10068935_B_4933403O08Rik
  gRNA
cuuauugagcucucaaagau

SEQ ID NO: 68936 - RNA, 20 nt, Artificial Sequence
  MKO10068936_B_4933403O08Rik
  gRNA
uccugggcgacuguauucug

SEQ ID NO: 68937 - RNA, 20 nt, Artificial Sequence
  MKO10068937_B_4933403O08Rik
  gRNA
uuucaacgcuuagaaguuac

SEQ ID NO: 68938 - RNA, 20 nt, Artificial Sequence
  MKO10068938_B_4933405L10Rik
  gRNA
cacgauggaugacguaggcu

SEQ ID NO: 68939 - RNA, 20 nt, Artificial Sequence
  MKO10068939_B_4933405L10Rik
  gRNA
ggcagcaguaggguuagccc

SEQ ID NO: 68940 - RNA, 20 nt, Artificial Sequence
  MKO10068940_B_4933405L10Rik
  gRNA
aggcgaagacaagugucccg

SEQ ID NO: 68941 - RNA, 20 nt, Artificial Sequence
  MKO10068941_B_4933405O20Rik
  gRNA
cuccucuucauuagaugucg

SEQ ID NO: 68942 - RNA, 20 nt, Artificial Sequence
  MKO10068942_B_4933405O20Rik
  gRNA
cacacgguggcuaugauucc

SEQ ID NO: 68943 - RNA, 20 nt, Artificial Sequence
  MKO10068943_B_4933405O20Rik
  gRNA
augcucucauggccauccgu

SEQ ID NO: 68944 - RNA, 20 nt, Artificial Sequence
  MKO10068944_B_4933406J08Rik
  gRNA
cauuaucuucuauguacucg

SEQ ID NO: 68945 - RNA, 20 nt, Artificial Sequence
  MKO10068945_B_4933406J08Rik
  gRNA
gacaguucuuguuuguguuc

SEQ ID NO: 68946 - RNA, 20 nt, Artificial Sequence
  MKO10068946_B_4933406J08Rik
  gRNA
caauuuacagcaugacagaa

SEQ ID NO: 68947 - RNA, 20 nt, Artificial Sequence
  MKO10068947_B_4933406M09Rik
  gRNA
cucacucuuuggcugguaag

SEQ ID NO: 68948 - RNA, 20 nt, Artificial Sequence
  MKO10068948_B_4933406M09Rik
  gRNA
gcagcaacauaacacauugc

SEQ ID NO: 68949 - RNA, 20 nt, Artificial Sequence
  MKO10068949_B_4933406M09Rik
  gRNA
aaugauucagcagauagcuc

SEQ ID NO: 68950 - RNA, 20 nt, Artificial Sequence
  MKO10068950_B_4933408B17Rik
  gRNA
uaagggacgcauucacacca

SEQ ID NO: 68951 - RNA, 20 nt, Artificial Sequence
  MKO10068951_B_4933408B17Rik
  gRNA
uucaccacauccuuguaucc

SEQ ID NO: 68952 - RNA, 20 nt, Artificial Sequence
  MKO10068952_B_4933408B17Rik
  gRNA
ccaggggagcuuccugaacu

SEQ ID NO: 68953 - RNA, 20 nt, Artificial Sequence
  MKO10068953_B_4933409G03Rik
  gRNA
uccaggacagugguaacucu

SEQ ID NO: 68954 - RNA, 20 nt, Artificial Sequence
  MKO10068954_B_4933409G03Rik
  gRNA
gucaucggaagaagaacaga

SEQ ID NO: 68955 - RNA, 20 nt, Artificial Sequence
  MKO10068955_B_4933409G03Rik
  gRNA
uuauguccagaaccaggcuu

SEQ ID NO: 68956 - RNA, 20 nt, Artificial Sequence
  MKO10068956_B_4933411G11Rik
  gRNA
aacugcgcuuccaguucauu

SEQ ID NO: 68957 - RNA, 20 nt, Artificial Sequence
  MKO10068957_B_4933411G11Rik
  gRNA
cacccgcagcaucuuguccc

SEQ ID NO: 68958 - RNA, 20 nt, Artificial Sequence
  MKO10068958_B_4933411G11Rik
  gRNA
acaccucuucacacucuucc

SEQ ID NO: 68959 - RNA, 20 nt, Artificial Sequence
  MKO10068959_B_4933411K16Rik
  gRNA
ucacuucagccgccuauccg

SEQ ID NO: 68960 - RNA, 20 nt, Artificial Sequence
  MKO10068960_B_4933411K16Rik
  gRNA
auagacugugugcgauuggu

SEQ ID NO: 68961 - RNA, 20 nt, Artificial Sequence
  MKO10068961_B_4933411K16Rik
  gRNA
gucagggaaguccccgucca

SEQ ID NO: 68962 - RNA, 20 nt, Artificial Sequence
  MKO10068962_B_4933411K20Rik
  gRNA
guuggcccaacucaagcgac

SEQ ID NO: 68963 - RNA, 20 nt, Artificial Sequence
  MKO10068963_B_4933411K20Rik
  gRNA
caagaguagaucucacucgu

SEQ ID NO: 68964 - RNA, 20 nt, Artificial Sequence
  MKO10068964_B_4933411K20Rik
  gRNA
agcagccugcaauaauaccu

SEQ ID NO: 68965 - RNA, 20 nt, Artificial Sequence
  MKO10068965_B_4933412E24Rik
  gRNA
uauaaacgcccggagccucc

SEQ ID NO: 68966 - RNA, 20 nt, Artificial Sequence
  MKO10068966_B_4933412E24Rik
  gRNA
caaggcucaagcccguguug

SEQ ID NO: 68967 - RNA, 20 nt, Artificial Sequence
  MKO10068967_B_4933412E24Rik
  gRNA
cccggguaguagagaccagc

SEQ ID NO: 68968 - RNA, 20 nt, Artificial Sequence
  MKO10068968_B_4933413G19Rik
  gRNA
uuccaccaguagauauguac

SEQ ID NO: 68969 - RNA, 20 nt, Artificial Sequence
  MKO10068969_B_4933413G19Rik
  gRNA
ccccacucuaccuucaggaa

SEQ ID NO: 68970 - RNA, 20 nt, Artificial Sequence
  MKO10068970_B_4933413G19Rik
  gRNA
ugagccaaguaucucguacc

SEQ ID NO: 68971 - RNA, 20 nt, Artificial Sequence
  MKO10068971_B_4933415F23Rik
  gRNA
acauggaaagcgacgauacc

SEQ ID NO: 68972 - RNA, 20 nt, Artificial Sequence
  MKO10068972_B_4933415F23Rik
  gRNA
caacccggauaaagaugacc

SEQ ID NO: 68973 - RNA, 20 nt, Artificial Sequence
  MKO10068973_B_4933415F23Rik
  gRNA
ucucuacgacugcaaggaag

SEQ ID NO: 68974 - RNA, 20 nt, Artificial Sequence
  MKO10068974_B_4933416C03Rik
  gRNA
uucacgccgugccgucguuc

SEQ ID NO: 68975 - RNA, 20 nt, Artificial Sequence
  MKO10068975_B_4933416C03Rik
  gRNA
caacggaacgugugaagugc

SEQ ID NO: 68976 - RNA, 20 nt, Artificial Sequence
  MKO10068976_B_4933416C03Rik
  gRNA
aacugguucucgaguucgug

SEQ ID NO: 68977 - RNA, 20 nt, Artificial Sequence
  MKO10068977_B_4933416I08Rik
  gRNA
uucagcacugaugcuauaau

SEQ ID NO: 68978 - RNA, 20 nt, Artificial Sequence
  MKO10068978_B_4933416I08Rik
  gRNA
gguuuguguuuccucagaag

SEQ ID NO: 68979 - RNA, 20 nt, Artificial Sequence
  MKO10068979_B_4933416I08Rik
  gRNA
aacagauaaaucuuugaccu

SEQ ID NO: 68980 - RNA, 20 nt, Artificial Sequence
  MKO10068980_B_4933417A18Rik
  gRNA
aaaagccuaccuggcaacga

SEQ ID NO: 68981 - RNA, 20 nt, Artificial Sequence
  MKO10068981_B_4933417A18Rik
  gRNA
ccacuacaaaggagaaccac

SEQ ID NO: 68982 - RNA, 20 nt, Artificial Sequence
  MKO10068982_B_4933417A18Rik
  gRNA
agcuaguuauggagcuccug

SEQ ID NO: 68983 - RNA, 20 nt, Artificial Sequence
  MKO10068983_B_4933421I07Rik
  gRNA
cucaaugugccuuucggaga

SEQ ID NO: 68984 - RNA, 20 nt, Artificial Sequence
  MKO10068984_B_4933421I07Rik
  gRNA
accgaacauaugcuaccacc

SEQ ID NO: 68985 - RNA, 20 nt, Artificial Sequence
  MKO10068985_B_4933421I07Rik
  gRNA
ggccagagccucugcaaguc

SEQ ID NO: 68986 - RNA, 20 nt, Artificial Sequence
  MKO10068986_B_4933422H20Rik
  gRNA
gccccuuccagguggaaguu

SEQ ID NO: 68987 - RNA, 20 nt, Artificial Sequence
  MKO10068987_B_4933422H20Rik
  gRNA
uccacagccugcucgccaac

SEQ ID NO: 68988 - RNA, 20 nt, Artificial Sequence
  MKO10068988_B_4933422H20Rik
  gRNA
agagaaaacucacucguccc

SEQ ID NO: 68989 - RNA, 20 nt, Artificial Sequence
  MKO10068989_B_4933425L06Rik
  gRNA
aucugucauggacguuacug

SEQ ID NO: 68990 - RNA, 20 nt, Artificial Sequence
  MKO10068990_B_4933425L06Rik
  gRNA
gauguggcacuccuuaauuc

SEQ ID NO: 68991 - RNA, 20 nt, Artificial Sequence
  MKO10068991_B_4933425L06Rik
  gRNA
gguuuacaaguacccagcuc

SEQ ID NO: 68992 - RNA, 20 nt, Artificial Sequence
  MKO10068992_B_4933426M11Rik
  gRNA
cgacagaacaaucuguacuc

SEQ ID NO: 68993 - RNA, 20 nt, Artificial Sequence
  MKO10068993_B_4933426M11Rik
  gRNA
cgaguggacgccagccaugg

SEQ ID NO: 68994 - RNA, 20 nt, Artificial Sequence
  MKO10068994_B_4933426M11Rik
  gRNA
cuggacaccauccaccauaa

SEQ ID NO: 68995 - RNA, 20 nt, Artificial Sequence
  MKO10068995_B_4933427D06Rik
  gRNA
accuugaucgggcaucucag

SEQ ID NO: 68996 - RNA, 20 nt, Artificial Sequence
  MKO10068996_B_4933427D06Rik
  gRNA
agcaugacguccugcagcuc

SEQ ID NO: 68997 - RNA, 20 nt, Artificial Sequence
  MKO10068997_B_4933427D06Rik
  gRNA
gcccaguacccauaaacuau

SEQ ID NO: 68998 - RNA, 20 nt, Artificial Sequence
  MKO10068998_B_4933427D14Rik
  gRNA
guaccggacugccaaguugc

SEQ ID NO: 68999 - RNA, 20 nt, Artificial Sequence
  MKO10068999_B_4933427D14Rik
  gRNA
gcugaagaacguagagcaug

SEQ ID NO: 69000 - RNA, 20 nt, Artificial Sequence
  MKO10069000_B_4933427D14Rik
  gRNA
aagagcaucgaauccgaguc

SEQ ID NO: 69001 - RNA, 20 nt, Artificial Sequence
  MKO10069001_B_4933427G17Rik
  gRNA
auaaccguauuucuucagcc

SEQ ID NO: 69002 - RNA, 20 nt, Artificial Sequence
  MKO10069002_B_4933427G17Rik
  gRNA
cagauuuaccgaaguuuaac

SEQ ID NO: 69003 - RNA, 20 nt, Artificial Sequence
  MKO10069003_B_4933427G17Rik
  gRNA
cgcccuugucauguuacuuc

SEQ ID NO: 69004 - RNA, 20 nt, Artificial Sequence
  MKO10069004_B_4933428G20Rik
  gRNA
cccgccgcuucuuccguuug

SEQ ID NO: 69005 - RNA, 20 nt, Artificial Sequence
  MKO10069005_B_4933428G20Rik
  gRNA
gucucggguugcgguagcug

SEQ ID NO: 69006 - RNA, 20 nt, Artificial Sequence
  MKO10069006_B_4933428G20Rik
  gRNA
cuguggacugcauccgaaac

SEQ ID NO: 69007 - RNA, 20 nt, Artificial Sequence
  MKO10069007_B_4933430I17Rik
  gRNA
gaagccguuuguaccuuguc

SEQ ID NO: 69008 - RNA, 20 nt, Artificial Sequence
  MKO10069008_B_4933430I17Rik
  gRNA
ucuuugucacguaaagccuu

SEQ ID NO: 69009 - RNA, 20 nt, Artificial Sequence
  MKO10069009_B_4933430I17Rik
  gRNA
ugacuuacuuugagaggccu

SEQ ID NO: 69010 - RNA, 20 nt, Artificial Sequence
  MKO10069010_B_4933433C11Rik
  gRNA
cgacuucaaccgagagacaa

SEQ ID NO: 69011 - RNA, 20 nt, Artificial Sequence
  MKO10069011_B_4933433C11Rik
  gRNA
ggccucucgcagagacauau

SEQ ID NO: 69012 - RNA, 20 nt, Artificial Sequence
  MKO10069012_B_4933433C11Rik
  gRNA
gaagucggucuucugcauga

SEQ ID NO: 69013 - RNA, 20 nt, Artificial Sequence
  MKO10069013_B_4933434E20Rik
  gRNA
gaaugcacaggacuuaaaag

SEQ ID NO: 69014 - RNA, 20 nt, Artificial Sequence
  MKO10069014_B_4933434E20Rik
  gRNA
cgauggcgucuaguaguaac

SEQ ID NO: 69015 - RNA, 20 nt, Artificial Sequence
  MKO10069015_B_4933434E20Rik
  gRNA
uucuggagugaaugucgugc

SEQ ID NO: 69016 - RNA, 20 nt, Artificial Sequence
  MKO10069016_B_4933434I20Rik
  gRNA
cagaaugacucccgaagaag

SEQ ID NO: 69017 - RNA, 20 nt, Artificial Sequence
  MKO10069017_B_4933434I20Rik
  gRNA
gaaucuccaccauuaacaga

SEQ ID NO: 69018 - RNA, 20 nt, Artificial Sequence
  MKO10069018_B_4933434I20Rik
  gRNA
ccagcuauagccacuagcaa

SEQ ID NO: 69019 - RNA, 20 nt, Artificial Sequence
  MKO10069019_B_4933436I01Rik
  gRNA
cauuugcauaaguagugaac

SEQ ID NO: 69020 - RNA, 20 nt, Artificial Sequence
  MKO10069020_B_4933436I01Rik
  gRNA
uuguucguguaguugcagaa

SEQ ID NO: 69021 - RNA, 20 nt, Artificial Sequence
  MKO10069021_B_4933436I01Rik
  gRNA
ugaacgaaacaaaaugcugc

SEQ ID NO: 69022 - RNA, 20 nt, Artificial Sequence
  MKO10069022_B_42434
  gRNA
agauccaagacauaaaccac

SEQ ID NO: 69023 - RNA, 20 nt, Artificial Sequence
  MKO10069023_B_42434
  gRNA
aucuugaacaguauauuucc

SEQ ID NO: 69024 - RNA, 20 nt, Artificial Sequence
  MKO10069024_B_42434
  gRNA
accuguccagcaucuguuga

SEQ ID NO: 69025 - RNA, 20 nt, Artificial Sequence
  MKO10069025_B_42618
  gRNA
auggccaggugaguccggcc

SEQ ID NO: 69026 - RNA, 20 nt, Artificial Sequence
  MKO10069026_B_42618
  gRNA
gaaacacaccgucgacauug

SEQ ID NO: 69027 - RNA, 20 nt, Artificial Sequence
  MKO10069027_B_42618
  gRNA
ccccuucuccucaaugucga

SEQ ID NO: 69028 - RNA, 20 nt, Artificial Sequence
  MKO10069028_B_5031410I06Rik
  gRNA
ugagcuccugauuguucucu

SEQ ID NO: 69029 - RNA, 20 nt, Artificial Sequence
  MKO10069029_B_5031410I06Rik
  gRNA
uuuccaguaaccugcacacc

SEQ ID NO: 69030 - RNA, 20 nt, Artificial Sequence
  MKO10069030_B_5031410I06Rik
  gRNA
gaaucuuauaaagaagaagu

SEQ ID NO: 69031 - RNA, 20 nt, Artificial Sequence
  MKO10069031_B_5031414D18Rik
  gRNA
uucagguugugcugcacucc

SEQ ID NO: 69032 - RNA, 20 nt, Artificial Sequence
  MKO10069032_B_5031414D18Rik
  gRNA
gcugcccgcugauguagaaa

SEQ ID NO: 69033 - RNA, 20 nt, Artificial Sequence
  MKO10069033_B_5031414D18Rik
  gRNA
cuuguucaagucauguuugc

SEQ ID NO: 69034 - RNA, 20 nt, Artificial Sequence
  MKO10069034_B_5031439G07Rik
  gRNA
ugggagauccugacaucgac

SEQ ID NO: 69035 - RNA, 20 nt, Artificial Sequence
  MKO10069035_B_5031439G07Rik
  gRNA
cucuccucccagucgauguc

SEQ ID NO: 69036 - RNA, 20 nt, Artificial Sequence
  MKO10069036_B_5031439G07Rik
  gRNA
ggcacgcgugcacacagcac

SEQ ID NO: 69037 - RNA, 20 nt, Artificial Sequence
  MKO10069037_B_5033411D12Rik
  gRNA
uugacgauucucacuccucu

SEQ ID NO: 69038 - RNA, 20 nt, Artificial Sequence
  MKO10069038_B_5033411D12Rik
  gRNA
aggagugagaaucgucaaag

SEQ ID NO: 69039 - RNA, 20 nt, Artificial Sequence
  MKO10069039_B_5033411D12Rik
  gRNA
ugagaauucuggaucuaaca

SEQ ID NO: 69040 - RNA, 20 nt, Artificial Sequence
  MKO10069040_B_5330417C22Rik
  gRNA
ggcggugcauucaucugugu

SEQ ID NO: 69041 - RNA, 20 nt, Artificial Sequence
  MKO10069041_B_5330417C22Rik
  gRNA
ggcgauguuucuaacaagca

SEQ ID NO: 69042 - RNA, 20 nt, Artificial Sequence
  MKO10069042_B_5330417C22Rik
  gRNA
uggaugaagacuacggagaa

SEQ ID NO: 69043 - RNA, 20 nt, Artificial Sequence
  MKO10069043_B_5430401F13Rik
  gRNA
aaauaucucacguuguuggu

SEQ ID NO: 69044 - RNA, 20 nt, Artificial Sequence
  MKO10069044_B_5430401F13Rik
  gRNA
uucacagaugcccuugaaau

SEQ ID NO: 69045 - RNA, 20 nt, Artificial Sequence
  MKO10069045_B_5430401F13Rik
  gRNA
uaauguucaagaaguuuacc

SEQ ID NO: 69046 - RNA, 20 nt, Artificial Sequence
  MKO10069046_B_5430402E10Rik
  gRNA
gagaaaaacaagaagauggg

SEQ ID NO: 69047 - RNA, 20 nt, Artificial Sequence
  MKO10069047_B_5430402E10Rik
  gRNA
uuacuucgaaguuguaauga

SEQ ID NO: 69048 - RNA, 20 nt, Artificial Sequence
  MKO10069048_B_5430402E10Rik
  gRNA
cauuaacguugugaaagaaa

SEQ ID NO: 69049 - RNA, 20 nt, Artificial Sequence
  MKO10069049_B_5430419D17Rik
  gRNA
ugggguccuaccugauacag

SEQ ID NO: 69050 - RNA, 20 nt, Artificial Sequence
  MKO10069050_B_5430419D17Rik
  gRNA
cuaccuugaggccuugcugc

SEQ ID NO: 69051 - RNA, 20 nt, Artificial Sequence
  MKO10069051_B_5430419D17Rik
  gRNA
aauccagccaccauauuauc

SEQ ID NO: 69052 - RNA, 20 nt, Artificial Sequence
  MKO10069052_B_5430421N21Rik
  gRNA
ugcugagcucaaccaugcgc

SEQ ID NO: 69053 - RNA, 20 nt, Artificial Sequence
  MKO10069053_B_5430421N21Rik
  gRNA
ugacagaugugucugagaug

SEQ ID NO: 69054 - RNA, 20 nt, Artificial Sequence
  MKO10069054_B_5430421N21Rik
  gRNA
uugggucagagccucugcgu

SEQ ID NO: 69055 - RNA, 20 nt, Artificial Sequence
  MKO10069055_B_5430427O19Rik
  gRNA
uauuagccaccuguugcagu

SEQ ID NO: 69056 - RNA, 20 nt, Artificial Sequence
  MKO10069056_B_5430427O19Rik
  gRNA
aucucaguggacuuaccuac

SEQ ID NO: 69057 - RNA, 20 nt, Artificial Sequence
  MKO10069057_B_5430427O19Rik
  gRNA
ugcagugcucaaugaguacc

SEQ ID NO: 69058 - RNA, 20 nt, Artificial Sequence
  MKO10069058_B_5430435G22Rik
  gRNA
ugcgaagaaugacaucaaug

SEQ ID NO: 69059 - RNA, 20 nt, Artificial Sequence
  MKO10069059_B_5430435G22Rik
  gRNA
gucauccaauaugaugauuu

SEQ ID NO: 69060 - RNA, 20 nt, Artificial Sequence
  MKO10069060_B_5430435G22Rik
  gRNA
gacuccaucaagcucucucc

SEQ ID NO: 69061 - RNA, 20 nt, Artificial Sequence
  MKO10069061_B_5530400C23Rik
  gRNA
cugcccucugagcugagcuc

SEQ ID NO: 69062 - RNA, 20 nt, Artificial Sequence
  MKO10069062_B_5530400C23Rik
  gRNA
uaguccugagcucagcucag

SEQ ID NO: 69063 - RNA, 20 nt, Artificial Sequence
  MKO10069063_B_5530400C23Rik
  gRNA
ugugcuuacuggguauuggu

SEQ ID NO: 69064 - RNA, 20 nt, Artificial Sequence
  MKO10069064_B_5730409E04Rik
  gRNA
cggaguccgcagucccccgg

SEQ ID NO: 69065 - RNA, 20 nt, Artificial Sequence
  MKO10069065_B_5730409E04Rik
  gRNA
cuggcaccgcucaacuucuc

SEQ ID NO: 69066 - RNA, 20 nt, Artificial Sequence
  MKO10069066_B_5730409E04Rik
  gRNA
ggacugcggacuccggccuc

SEQ ID NO: 69067 - RNA, 20 nt, Artificial Sequence
  MKO10069067_B_5730455P16Rik
  gRNA
uaacaaccaacucgguaacc

SEQ ID NO: 69068 - RNA, 20 nt, Artificial Sequence
  MKO10069068_B_5730455P16Rik
  gRNA
ugguagauuaguauccacca

SEQ ID NO: 69069 - RNA, 20 nt, Artificial Sequence
  MKO10069069_B_5730455P16Rik
  gRNA
ugcagauugacacagaaucg

SEQ ID NO: 69070 - RNA, 20 nt, Artificial Sequence
  MKO10069070_B_5730507C01Rik
  gRNA
uaucauaaaagaacucauaa

SEQ ID NO: 69071 - RNA, 20 nt, Artificial Sequence
  MKO10069071_B_5730507C01Rik
  gRNA
cagucauaccuauaacagcg

SEQ ID NO: 69072 - RNA, 20 nt, Artificial Sequence
  MKO10069072_B_5730507C01Rik
  gRNA
gaugugcaugugaacuucac

SEQ ID NO: 69073 - RNA, 20 nt, Artificial Sequence
  MKO10069073_B_5730508B09Rik
  gRNA
gcuguacauaaauaaugaca

SEQ ID NO: 69074 - RNA, 20 nt, Artificial Sequence
  MKO10069074_B_5730508B09Rik
  gRNA
accugcucgcccucguccug

SEQ ID NO: 69075 - RNA, 20 nt, Artificial Sequence
  MKO10069075_B_5730508B09Rik
  gRNA
cggagcacggggcgagcccg

SEQ ID NO: 69076 - RNA, 20 nt, Artificial Sequence
  MKO10069076_B_5730559C18Rik
  gRNA
cugcugcuugcguacugcau

SEQ ID NO: 69077 - RNA, 20 nt, Artificial Sequence
  MKO10069077_B_5730559C18Rik
  gRNA
aggcccccaagguccggcgc

SEQ ID NO: 69078 - RNA, 20 nt, Artificial Sequence
  MKO10069078_B_5730559C18Rik
  gRNA
cugcaggaugaugccgcugu

SEQ ID NO: 69079 - RNA, 20 nt, Artificial Sequence
  MKO10069079_B_5830403L16Rik
  gRNA
cggagccuucuugaugaucu

SEQ ID NO: 69080 - RNA, 20 nt, Artificial Sequence
  MKO10069080_B_5830403L16Rik
  gRNA
acagauacaugcucaacgcu

SEQ ID NO: 69081 - RNA, 20 nt, Artificial Sequence
  MKO10069081_B_5830403L16Rik
  gRNA
guaggccgagaucaucaaga

SEQ ID NO: 69082 - RNA, 20 nt, Artificial Sequence
  MKO10069082_B_5830411N06Rik
  gRNA
caccauuccgcaagcguacu

SEQ ID NO: 69083 - RNA, 20 nt, Artificial Sequence
  MKO10069083_B_5830411N06Rik
  gRNA
gcagaaguaccuuacaugcc

SEQ ID NO: 69084 - RNA, 20 nt, Artificial Sequence
  MKO10069084_B_5830411N06Rik
  gRNA
gugaaggccaaguacgcuug

SEQ ID NO: 69085 - RNA, 20 nt, Artificial Sequence
  MKO10069085_B_5830415F09Rik
  gRNA
uaaguacuuccacuccgcag

SEQ ID NO: 69086 - RNA, 20 nt, Artificial Sequence
  MKO10069086_B_5830415F09Rik
  gRNA
agcgucagcccuauggcauu

SEQ ID NO: 69087 - RNA, 20 nt, Artificial Sequence
  MKO10069087_B_5830415F09Rik
  gRNA
aggcaaaagugcagccgccc

SEQ ID NO: 69088 - RNA, 20 nt, Artificial Sequence
  MKO10069088_B_5830418K08Rik
  gRNA
aaaacagaggcgaagucagc

SEQ ID NO: 69089 - RNA, 20 nt, Artificial Sequence
  MKO10069089_B_5830418K08Rik
  gRNA
gccugucccaucccccuuug

SEQ ID NO: 69090 - RNA, 20 nt, Artificial Sequence
  MKO10069090_B_5830418K08Rik
  gRNA
cucauuuggcugaggagcua

SEQ ID NO: 69091 - RNA, 20 nt, Artificial Sequence
  MKO10069091_B_5830473C10Rik
  gRNA
agcagacaugcucaagauag

SEQ ID NO: 69092 - RNA, 20 nt, Artificial Sequence
  MKO10069092_B_5830473C10Rik
  gRNA
gaucaccuggaggagaacuu

SEQ ID NO: 69093 - RNA, 20 nt, Artificial Sequence
  MKO10069093_B_5830473C10Rik
  gRNA
ugacuccuaaguucuccucc

SEQ ID NO: 69094 - RNA, 20 nt, Artificial Sequence
  MKO10069094_B_42435
  gRNA
guaauuacagcuuaguucag

SEQ ID NO: 69095 - RNA, 20 nt, Artificial Sequence
  MKO10069095_B_42435
  gRNA
uaucauccuuguguauguac

SEQ ID NO: 69096 - RNA, 20 nt, Artificial Sequence
  MKO10069096_B_42435
  gRNA
uaaacaagcacuuguagaug

SEQ ID NO: 69097 - RNA, 20 nt, Artificial Sequence
  MKO10069097_B_42619
  gRNA
guccaauaccuacgaccucc

SEQ ID NO: 69098 - RNA, 20 nt, Artificial Sequence
  MKO10069098_B_42619
  gRNA
cgcuggcuccccuucaaacu

SEQ ID NO: 69099 - RNA, 20 nt, Artificial Sequence
  MKO10069099_B_42619
  gRNA
agauugucgaacuguccccc

SEQ ID NO: 69100 - RNA, 20 nt, Artificial Sequence
  MKO10069100_B_6030419C18Rik
  gRNA
cguggugaaggaugaacauu

SEQ ID NO: 69101 - RNA, 20 nt, Artificial Sequence
  MKO10069101_B_6030419C18Rik
  gRNA
uaucagccgucaugaagucc

SEQ ID NO: 69102 - RNA, 20 nt, Artificial Sequence
  MKO10069102_B_6030419C18Rik
  gRNA
gggccauccaccgagucuga

SEQ ID NO: 69103 - RNA, 20 nt, Artificial Sequence
  MKO10069103_B_6030458C11Rik
  gRNA
gaugcuucgaaccuauggcc

SEQ ID NO: 69104 - RNA, 20 nt, Artificial Sequence
  MKO10069104_B_6030458C11Rik
  gRNA
auuaugccugcaguuuacgc

SEQ ID NO: 69105 - RNA, 20 nt, Artificial Sequence
  MKO10069105_B_6030458C11Rik
  gRNA
uaaucuggcuccaccccacg

SEQ ID NO: 69106 - RNA, 20 nt, Artificial Sequence
  MKO10069106_B_6030468B19Rik
  gRNA
ggacgccucaggggcaucgc

SEQ ID NO: 69107 - RNA, 20 nt, Artificial Sequence
  MKO10069107_B_6030468B19Rik
  gRNA
uuauaagcacccuccggcuu

SEQ ID NO: 69108 - RNA, 20 nt, Artificial Sequence
  MKO10069108_B_6030468B19Rik
  gRNA
cugccagccagaauacaggu

SEQ ID NO: 69109 - RNA, 20 nt, Artificial Sequence
  MKO10069109_B_6030498E09Rik
  gRNA
gcagaugagauagugaaaga

SEQ ID NO: 69110 - RNA, 20 nt, Artificial Sequence
  MKO10069110_B_6030498E09Rik
  gRNA
agccauuagauguauagaag

SEQ ID NO: 69111 - RNA, 20 nt, Artificial Sequence
  MKO10069111_B_6030498E09Rik
  gRNA
cagcccucacucuucgccuc

SEQ ID NO: 69112 - RNA, 20 nt, Artificial Sequence
  MKO10069112_B_6330403A02Rik
  gRNA
cgugcagguucgcgagaaga

SEQ ID NO: 69113 - RNA, 20 nt, Artificial Sequence
  MKO10069113_B_6330403A02Rik
  gRNA
ccuuacaggguacaaggauc

SEQ ID NO: 69114 - RNA, 20 nt, Artificial Sequence
  MKO10069114_B_6330403A02Rik
  gRNA
cuguaggcucacagcuguug

SEQ ID NO: 69115 - RNA, 20 nt, Artificial Sequence
  MKO10069115_B_6330403K07Rik
  gRNA
auaccagaacucgcguuugc

SEQ ID NO: 69116 - RNA, 20 nt, Artificial Sequence
  MKO10069116_B_6330403K07Rik
  gRNA
cgacucugcgcccaccccgu

SEQ ID NO: 69117 - RNA, 20 nt, Artificial Sequence
  MKO10069117_B_6330403K07Rik
  gRNA
accccagggcuugcgcgaaa

SEQ ID NO: 69118 - RNA, 20 nt, Artificial Sequence
  MKO10069118_B_6330408A02Rik
  gRNA
accgagcgcagccgugcaga

SEQ ID NO: 69119 - RNA, 20 nt, Artificial Sequence
  MKO10069119_B_6330408A02Rik
  gRNA
cccuuugcgagaucgacucg

SEQ ID NO: 69120 - RNA, 20 nt, Artificial Sequence
  MKO10069120_B_6330408A02Rik
  gRNA
agaagacuaccagucgcugc

SEQ ID NO: 69121 - RNA, 20 nt, Artificial Sequence
  MKO10069121_B_6330409D20Rik
  gRNA
ggacuaugugaagguaggcu

SEQ ID NO: 69122 - RNA, 20 nt, Artificial Sequence
  MKO10069122_B_6330409D20Rik
  gRNA
ggaagcagaacuucaccuuc

SEQ ID NO: 69123 - RNA, 20 nt, Artificial Sequence
  MKO10069123_B_6330409D20Rik
  gRNA
aaccucuggccuggaccaga

SEQ ID NO: 69124 - RNA, 20 nt, Artificial Sequence
  MKO10069124_B_6330416G13Rik
  gRNA
ugcaccuaucuccuuugacc

SEQ ID NO: 69125 - RNA, 20 nt, Artificial Sequence
  MKO10069125_B_6330416G13Rik
  gRNA
ucugcgacaccgugugcugc

SEQ ID NO: 69126 - RNA, 20 nt, Artificial Sequence
  MKO10069126_B_6330416G13Rik
  gRNA
gguacaucaucuacaacucc

SEQ ID NO: 69127 - RNA, 20 nt, Artificial Sequence
  MKO10069127_B_6430531B16Rik
  gRNA
agaauagacucgauaacucc

SEQ ID NO: 69128 - RNA, 20 nt, Artificial Sequence
  MKO10069128_B_6430531B16Rik
  gRNA
guuggggguaagaucccgcc

SEQ ID NO: 69129 - RNA, 20 nt, Artificial Sequence
  MKO10069129_B_6430531B16Rik
  gRNA
ugagccuacaugaacagucc

SEQ ID NO: 69130 - RNA, 20 nt, Artificial Sequence
  MKO10069130_B_6430548M08Rik
  gRNA
agcagcaccgucaacgcucc

SEQ ID NO: 69131 - RNA, 20 nt, Artificial Sequence
  MKO10069131_B_6430548M08Rik
  gRNA
ggcggaaucagcacucugau

SEQ ID NO: 69132 - RNA, 20 nt, Artificial Sequence
  MKO10069132_B_6430548M08Rik
  gRNA
gugcuucacuuacuaccauc

SEQ ID NO: 69133 - RNA, 20 nt, Artificial Sequence
  MKO10069133_B_6430550D23Rik
  gRNA
aucuccauuaccgugucacu

SEQ ID NO: 69134 - RNA, 20 nt, Artificial Sequence
  MKO10069134_B_6430550D23Rik
  gRNA
aacugguucugcuucaaauu

SEQ ID NO: 69135 - RNA, 20 nt, Artificial Sequence
  MKO10069135_B_6430550D23Rik
  gRNA
ccuguaccugacacaugaau

SEQ ID NO: 69136 - RNA, 20 nt, Artificial Sequence
  MKO10069136_B_6430571L13Rik
  gRNA
cagcucgucuuguuccuccg

SEQ ID NO: 69137 - RNA, 20 nt, Artificial Sequence
  MKO10069137_B_6430571L13Rik
  gRNA
gcgagacgcagccuccaugc

SEQ ID NO: 69138 - RNA, 20 nt, Artificial Sequence
  MKO10069138_B_6430571L13Rik
  gRNA
gaucaucacagugauuggcc

SEQ ID NO: 69139 - RNA, 20 nt, Artificial Sequence
  MKO10069139_B_6430573F11Rik
  gRNA
acgaacaccucaucuaaguu

SEQ ID NO: 69140 - RNA, 20 nt, Artificial Sequence
  MKO10069140_B_6430573F11Rik
  gRNA
agaugauagcaucgaagccc

SEQ ID NO: 69141 - RNA, 20 nt, Artificial Sequence
  MKO10069141_B_6430573F11Rik
  gRNA
uagagauugcccggaauaga

SEQ ID NO: 69142 - RNA, 20 nt, Artificial Sequence
  MKO10069142_B_6720489N17Rik
  gRNA
gaaugcagaguaggggaaca

SEQ ID NO: 69143 - RNA, 20 nt, Artificial Sequence
  MKO10069143_B_6720489N17Rik
  gRNA
cuagaaugcagugacuuaug

SEQ ID NO: 69144 - RNA, 20 nt, Artificial Sequence
  MKO10069144_B_6720489N17Rik
  gRNA
caaauguaccuaaagcacug

SEQ ID NO: 69145 - RNA, 20 nt, Artificial Sequence
  MKO10069145_B_6820408C15Rik
  gRNA
ccuccccuccgacaagucaa

SEQ ID NO: 69146 - RNA, 20 nt, Artificial Sequence
  MKO10069146_B_6820408C15Rik
  gRNA
aggccaagguccggcugaug

SEQ ID NO: 69147 - RNA, 20 nt, Artificial Sequence
  MKO10069147_B_6820408C15Rik
  gRNA
agaagggaccaaacgcacca

SEQ ID NO: 69148 - RNA, 20 nt, Artificial Sequence
  MKO10069148_B_42436
  gRNA
auagagccgugcaaaugcac

SEQ ID NO: 69149 - RNA, 20 nt, Artificial Sequence
  MKO10069149_B_42436
  gRNA
aaguaccauugaugaagauc

SEQ ID NO: 69150 - RNA, 20 nt, Artificial Sequence
  MKO10069150_B_42436
  gRNA
auaauccauaagauugcuga

SEQ ID NO: 69151 - RNA, 20 nt, Artificial Sequence
  MKO10069151_B_42620
  gRNA
augcaguggauaauaguaau

SEQ ID NO: 69152 - RNA, 20 nt, Artificial Sequence
  MKO10069152_B_42620
  gRNA
cuggagaauacaaaucugug

SEQ ID NO: 69153 - RNA, 20 nt, Artificial Sequence
  MKO10069153_B_42620
  gRNA
uagaaucaaaaagacuguac

SEQ ID NO: 69154 - RNA, 20 nt, Artificial Sequence
  MKO10069154_B_7420426K07Rik
  gRNA
uugcugagaguugugcuccg

SEQ ID NO: 69155 - RNA, 20 nt, Artificial Sequence
  MKO10069155_B_7420426K07Rik
  gRNA
agcagcacuagcgcugaccu

SEQ ID NO: 69156 - RNA, 20 nt, Artificial Sequence
  MKO10069156_B_7420426K07Rik
  gRNA
gaugaacgcuccagaugacc

SEQ ID NO: 69157 - RNA, 20 nt, Artificial Sequence
  MKO10069157_B_7420461P10Rik
  gRNA
cucgugguccauacccaugc

SEQ ID NO: 69158 - RNA, 20 nt, Artificial Sequence
  MKO10069158_B_7420461P10Rik
  gRNA
cuuaugucugcagcaucagc

SEQ ID NO: 69159 - RNA, 20 nt, Artificial Sequence
  MKO10069159_B_7420461P10Rik
  gRNA
guguaucuaaaacccuccau

SEQ ID NO: 69160 - RNA, 20 nt, Artificial Sequence
  MKO10069160_B_7530416G11Rik
  gRNA
cugucgccaaguccccuucu

SEQ ID NO: 69161 - RNA, 20 nt, Artificial Sequence
  MKO10069161_B_7530416G11Rik
  gRNA
agggcggaggaugcucacaa

SEQ ID NO: 69162 - RNA, 20 nt, Artificial Sequence
  MKO10069162_B_7530416G11Rik
  gRNA
agauuuacugagucuccaag

SEQ ID NO: 69163 - RNA, 20 nt, Artificial Sequence
  MKO10069163_B_42437
  gRNA
caugaucuuccugcgcucac

SEQ ID NO: 69164 - RNA, 20 nt, Artificial Sequence
  MKO10069164_B_42437
  gRNA
gcucauugaccgcacagcag

SEQ ID NO: 69165 - RNA, 20 nt, Artificial Sequence
  MKO10069165_B_42437
  gRNA
gaguaguccuccauccacga

SEQ ID NO: 69166 - RNA, 20 nt, Artificial Sequence
  MKO10069166_B_42621
  gRNA
cgccauggcggccaccgacu

SEQ ID NO: 69167 - RNA, 20 nt, Artificial Sequence
  MKO10069167_B_42621
  gRNA
ucaucucaagcugaccaucg

SEQ ID NO: 69168 - RNA, 20 nt, Artificial Sequence
  MKO10069168_B_42621
  gRNA
cuuuggcgaucagaucaaua

SEQ ID NO: 69169 - RNA, 20 nt, Artificial Sequence
  MKO10069169_B_8030411F24Rik
  gRNA
aaggacagucaugucgugga

SEQ ID NO: 69170 - RNA, 20 nt, Artificial Sequence
  MKO10069170_B_8030411F24Rik
  gRNA
cauaauugcccauugcuaca

SEQ ID NO: 69171 - RNA, 20 nt, Artificial Sequence
  MKO10069171_B_8030411F24Rik
  gRNA
ucucuugagccuuguagcaa

SEQ ID NO: 69172 - RNA, 20 nt, Artificial Sequence
  MKO10069172_B_8030423J24Rik
  gRNA
aggggccuugcagugugcuu

SEQ ID NO: 69173 - RNA, 20 nt, Artificial Sequence
  MKO10069173_B_8030423J24Rik
  gRNA
ggcuuacagcagcgagggac

SEQ ID NO: 69174 - RNA, 20 nt, Artificial Sequence
  MKO10069174_B_8030423J24Rik
  gRNA
aaaauacaaugacuuuccga

SEQ ID NO: 69175 - RNA, 20 nt, Artificial Sequence
  MKO10069175_B_8030462N17Rik
  gRNA
cuccacuucgcuaucugaag

SEQ ID NO: 69176 - RNA, 20 nt, Artificial Sequence
  MKO10069176_B_8030462N17Rik
  gRNA
ggcgaagcccacgucugcug

SEQ ID NO: 69177 - RNA, 20 nt, Artificial Sequence
  MKO10069177_B_8030462N17Rik
  gRNA
accugccucuagaagcucgc

SEQ ID NO: 69178 - RNA, 20 nt, Artificial Sequence
  MKO10069178_B_8430408G22Rik
  gRNA
gcgccucuucucucgagucc

SEQ ID NO: 69179 - RNA, 20 nt, Artificial Sequence
  MKO10069179_B_8430408G22Rik
  gRNA
ucugacauuucccgaaucgu

SEQ ID NO: 69180 - RNA, 20 nt, Artificial Sequence
  MKO10069180_B_8430408G22Rik
  gRNA
ugccccauuugccaacgauu

SEQ ID NO: 69181 - RNA, 20 nt, Artificial Sequence
  MKO10069181_B_8430419L09Rik
  gRNA
ugcugccguucauccccgaa

SEQ ID NO: 69182 - RNA, 20 nt, Artificial Sequence
  MKO10069182_B_8430419L09Rik
  gRNA
uaccuuggcagccccgguug

SEQ ID NO: 69183 - RNA, 20 nt, Artificial Sequence
  MKO10069183_B_8430419L09Rik
  gRNA
uauucacgucagccaacucc

SEQ ID NO: 69184 - RNA, 20 nt, Artificial Sequence
  MKO10069184_B_8430427H17Rik
  gRNA
ugcgcuugcgggcccgcucc

SEQ ID NO: 69185 - RNA, 20 nt, Artificial Sequence
  MKO10069185_B_8430427H17Rik
  gRNA
ucauagcucccggagcugua

SEQ ID NO: 69186 - RNA, 20 nt, Artificial Sequence
  MKO10069186_B_8430427H17Rik
  gRNA
cucagggaauugccggcugc

SEQ ID NO: 69187 - RNA, 20 nt, Artificial Sequence
  MKO10069187_B_42438
  gRNA
ucacggaccagccccccugc

SEQ ID NO: 69188 - RNA, 20 nt, Artificial Sequence
  MKO10069188_B_42438
  gRNA
accaacccugccuaauccgc

SEQ ID NO: 69189 - RNA, 20 nt, Artificial Sequence
  MKO10069189_B_42438
  gRNA
cgacgaggaacagcgauccc

SEQ ID NO: 69190 - RNA, 20 nt, Artificial Sequence
  MKO10069190_B_42622
  gRNA
aggugggcugcaccgacuuc

SEQ ID NO: 69191 - RNA, 20 nt, Artificial Sequence
  MKO10069191_B_42622
  gRNA
ugucgggaaugcgcuucuuc

SEQ ID NO: 69192 - RNA, 20 nt, Artificial Sequence
  MKO10069192_B_42622
  gRNA
ugggacauacgaguggccgg

SEQ ID NO: 69193 - RNA, 20 nt, Artificial Sequence
  MKO10069193_B_9030025P20Rik
  gRNA
ccuccuaucagggcgaaguc

SEQ ID NO: 69194 - RNA, 20 nt, Artificial Sequence
  MKO10069194_B_9030025P20Rik
  gRNA
gccgagggcucgcuccagac

SEQ ID NO: 69195 - RNA, 20 nt, Artificial Sequence
  MKO10069195_B_9030025P20Rik
  gRNA
cagccugcugccgucucccu

SEQ ID NO: 69196 - RNA, 20 nt, Artificial Sequence
  MKO10069196_B_9030617O03Rik
  gRNA
cccauucacaucggugaccc

SEQ ID NO: 69197 - RNA, 20 nt, Artificial Sequence
  MKO10069197_B_9030617O03Rik
  gRNA
ucaccgccucacuuugucca

SEQ ID NO: 69198 - RNA, 20 nt, Artificial Sequence
  MKO10069198_B_9030617O03Rik
  gRNA
cgggguccucugccccuccu

SEQ ID NO: 69199 - RNA, 20 nt, Artificial Sequence
  MKO10069199_B_9030624G23Rik
  gRNA
caccuccucgauggccgccg

SEQ ID NO: 69200 - RNA, 20 nt, Artificial Sequence
  MKO10069200_B_9030624G23Rik
  gRNA
gaugugcaugugaacuucac

SEQ ID NO: 69201 - RNA, 20 nt, Artificial Sequence
  MKO10069201_B_9030624G23Rik
  gRNA
cagucauaccuauaacagug

SEQ ID NO: 69202 - RNA, 20 nt, Artificial Sequence
  MKO10069202_B_9030624J02Rik
  gRNA
aaggauuuccacacguuugu

SEQ ID NO: 69203 - RNA, 20 nt, Artificial Sequence
  MKO10069203_B_9030624J02Rik
  gRNA
gcugcucagaggaucgauca

SEQ ID NO: 69204 - RNA, 20 nt, Artificial Sequence
  MKO10069204_B_9030624J02Rik
  gRNA
aggcggagcuggcgucuugc

SEQ ID NO: 69205 - RNA, 20 nt, Artificial Sequence
  MKO10069205_B_9130008F23Rik
  gRNA
aauccacgacccgcaccaac

SEQ ID NO: 69206 - RNA, 20 nt, Artificial Sequence
  MKO10069206_B_9130008F23Rik
  gRNA
gggccguggcaaugcgccug

SEQ ID NO: 69207 - RNA, 20 nt, Artificial Sequence
  MKO10069207_B_9130008F23Rik
  gRNA
gcucugagugcucuccgcgc

SEQ ID NO: 69208 - RNA, 20 nt, Artificial Sequence
  MKO10069208_B_9130011E15Rik
  gRNA
ccugcaaggcguugacaacu

SEQ ID NO: 69209 - RNA, 20 nt, Artificial Sequence
  MKO10069209_B_9130011E15Rik
  gRNA
accuugugugcacuuauucg

SEQ ID NO: 69210 - RNA, 20 nt, Artificial Sequence
  MKO10069210_B_9130011E15Rik
  gRNA
ggaggaacucuuccucauga

SEQ ID NO: 69211 - RNA, 20 nt, Artificial Sequence
  MKO10069211_B_9130019O22Rik
  gRNA
guccgcgaaguucacagccc

SEQ ID NO: 69212 - RNA, 20 nt, Artificial Sequence
  MKO10069212_B_9130019O22Rik
  gRNA
ugcaggacagaaguucacuc

SEQ ID NO: 69213 - RNA, 20 nt, Artificial Sequence
  MKO10069213_B_9130019O22Rik
  gRNA
acccugugcccaggauccag

SEQ ID NO: 69214 - RNA, 20 nt, Artificial Sequence
  MKO10069214_B_9130023H24Rik
  gRNA
uggaccagcaguacuuaugu

SEQ ID NO: 69215 - RNA, 20 nt, Artificial Sequence
  MKO10069215_B_9130023H24Rik
  gRNA
uaggucugcacugcgaccaa

SEQ ID NO: 69216 - RNA, 20 nt, Artificial Sequence
  MKO10069216_B_9130023H24Rik
  gRNA
gcuacaugagcgcccccucc

SEQ ID NO: 69217 - RNA, 20 nt, Artificial Sequence
  MKO10069217_B_9130204L05Rik
  gRNA
ucauccaauaguauacuuaa

SEQ ID NO: 69218 - RNA, 20 nt, Artificial Sequence
  MKO10069218_B_9130204L05Rik
  gRNA
gacagucauacugggugaga

SEQ ID NO: 69219 - RNA, 20 nt, Artificial Sequence
  MKO10069219_B_9130204L05Rik
  gRNA
acaaaauaaugaugcucuac

SEQ ID NO: 69220 - RNA, 20 nt, Artificial Sequence
  MKO10069220_B_9130401M01Rik
  gRNA
cucguauuccugucgucugu

SEQ ID NO: 69221 - RNA, 20 nt, Artificial Sequence
  MKO10069221_B_9130401M01Rik
  gRNA
ggaccuggccuacagacgac

SEQ ID NO: 69222 - RNA, 20 nt, Artificial Sequence
  MKO10069222_B_9130401M01Rik
  gRNA
uaaucgccagaaagcccugc

SEQ ID NO: 69223 - RNA, 20 nt, Artificial Sequence
  MKO10069223_B_9130409I23Rik
  gRNA
gguucuucugcaccgcuuac

SEQ ID NO: 69224 - RNA, 20 nt, Artificial Sequence
  MKO10069224_B_9130409I23Rik
  gRNA
ccucuucuucauccgugaau

SEQ ID NO: 69225 - RNA, 20 nt, Artificial Sequence
  MKO10069225_B_9130409I23Rik
  gRNA
aucauacaguacuuugaucc

SEQ ID NO: 69226 - RNA, 20 nt, Artificial Sequence
  MKO10069226_B_9230104L09Rik
  gRNA
aaacuuucuucgugaagcug

SEQ ID NO: 69227 - RNA, 20 nt, Artificial Sequence
  MKO10069227_B_9230104L09Rik
  gRNA
guugaaaaugacuuguucug

SEQ ID NO: 69228 - RNA, 20 nt, Artificial Sequence
  MKO10069228_B_9230104L09Rik
  gRNA
gccugggcugcugaugcuga

SEQ ID NO: 69229 - RNA, 20 nt, Artificial Sequence
  MKO10069229_B_9230110C19Rik
  gRNA
auaugaagucuuuagcccag

SEQ ID NO: 69230 - RNA, 20 nt, Artificial Sequence
  MKO10069230_B_9230110C19Rik
  gRNA
ucugagaguaacugcaaauu

SEQ ID NO: 69231 - RNA, 20 nt, Artificial Sequence
  MKO10069231_B_9230110C19Rik
  gRNA
gacauugaaaguugugugca

SEQ ID NO: 69232 - RNA, 20 nt, Artificial Sequence
  MKO10069232_B_9230110F15Rik
  gRNA
auggcugaaaacauguaucu

SEQ ID NO: 69233 - RNA, 20 nt, Artificial Sequence
  MKO10069233_B_9230110F15Rik
  gRNA
ugccuuaucacaguccaauu

SEQ ID NO: 69234 - RNA, 20 nt, Artificial Sequence
  MKO10069234_B_9230110F15Rik
  gRNA
ccuuaccugugugugagaau

SEQ ID NO: 69235 - RNA, 20 nt, Artificial Sequence
  MKO10069235_B_9230112D13Rik
  gRNA
ucacccauaguccccucguc

SEQ ID NO: 69236 - RNA, 20 nt, Artificial Sequence
  MKO10069236_B_9230112D13Rik
  gRNA
cgucuauaaaaugcagcuga

SEQ ID NO: 69237 - RNA, 20 nt, Artificial Sequence
  MKO10069237_B_9230112D13Rik
  gRNA
ugugaguucaucucuugacu

SEQ ID NO: 69238 - RNA, 20 nt, Artificial Sequence
  MKO10069238_B_9330159F19Rik
  gRNA
acuuacaucagaaccgcauu

SEQ ID NO: 69239 - RNA, 20 nt, Artificial Sequence
  MKO10069239_B_9330159F19Rik
  gRNA
ggaauccuuuggccacagac

SEQ ID NO: 69240 - RNA, 20 nt, Artificial Sequence
  MKO10069240_B_9330159F19Rik
  gRNA
ucccccaaaucaccucaacu

SEQ ID NO: 69241 - RNA, 20 nt, Artificial Sequence
  MKO10069241_B_9330182L06Rik
  gRNA
uuccaacguugcaacauuca

SEQ ID NO: 69242 - RNA, 20 nt, Artificial Sequence
  MKO10069242_B_9330182L06Rik
  gRNA
ucuuacuuguuacagccauc

SEQ ID NO: 69243 - RNA, 20 nt, Artificial Sequence
  MKO10069243_B_9330182L06Rik
  gRNA
gagcaauccacugcagaauu

SEQ ID NO: 69244 - RNA, 20 nt, Artificial Sequence
  MKO10069244_B_9330182O14Rik
  gRNA
uuacuucaugguaagcacac

SEQ ID NO: 69245 - RNA, 20 nt, Artificial Sequence
  MKO10069245_B_9330182O14Rik
  gRNA
auuugggagguccaaacaac

SEQ ID NO: 69246 - RNA, 20 nt, Artificial Sequence
  MKO10069246_B_9330182O14Rik
  gRNA
aggaauaauguauaauggag

SEQ ID NO: 69247 - RNA, 20 nt, Artificial Sequence
  MKO10069247_B_9430007A20Rik
  gRNA
ucuugcgaccgugugucucc

SEQ ID NO: 69248 - RNA, 20 nt, Artificial Sequence
  MKO10069248_B_9430007A20Rik
  gRNA
cccucccgggucgugaucug

SEQ ID NO: 69249 - RNA, 20 nt, Artificial Sequence
  MKO10069249_B_9430007A20Rik
  gRNA
ucucuccacagaucacgacc

SEQ ID NO: 69250 - RNA, 20 nt, Artificial Sequence
  MKO10069250_B_9430015G10Rik
  gRNA
gacuucaaugcuaccugccu

SEQ ID NO: 69251 - RNA, 20 nt, Artificial Sequence
  MKO10069251_B_9430015G10Rik
  gRNA
accacauccaugcaacacuc

SEQ ID NO: 69252 - RNA, 20 nt, Artificial Sequence
  MKO10069252_B_9430015G10Rik
  gRNA
uuaccaaaauguggcugucc

SEQ ID NO: 69253 - RNA, 20 nt, Artificial Sequence
  MKO10069253_B_9430016H08Rik
  gRNA
gacauugucuacacaucaac

SEQ ID NO: 69254 - RNA, 20 nt, Artificial Sequence
  MKO10069254_B_9430016H08Rik
  gRNA
cugcagcaagugcauucuua

SEQ ID NO: 69255 - RNA, 20 nt, Artificial Sequence
  MKO10069255_B_9430016H08Rik
  gRNA
caauguguuccaggugaagc

SEQ ID NO: 69256 - RNA, 20 nt, Artificial Sequence
  MKO10069256_B_9430020K01Rik
  gRNA
cuacagcccauacgcacagu

SEQ ID NO: 69257 - RNA, 20 nt, Artificial Sequence
  MKO10069257_B_9430020K01Rik
  gRNA
uuccuaugauccaagccgag

SEQ ID NO: 69258 - RNA, 20 nt, Artificial Sequence
  MKO10069258_B_9430020K01Rik
  gRNA
gccaucacacccucuccacu

SEQ ID NO: 69259 - RNA, 20 nt, Artificial Sequence
  MKO10069259_B_9430023L20Rik
  gRNA
acguguuugacacgggccug

SEQ ID NO: 69260 - RNA, 20 nt, Artificial Sequence
  MKO10069260_B_9430023L20Rik
  gRNA
cucugaggagacgcgcacau

SEQ ID NO: 69261 - RNA, 20 nt, Artificial Sequence
  MKO10069261_B_9430023L20Rik
  gRNA
cgagaagaucauuaacaucg

SEQ ID NO: 69262 - RNA, 20 nt, Artificial Sequence
  MKO10069262_B_9430038I01Rik
  gRNA
ccgcugcacucauauccacc

SEQ ID NO: 69263 - RNA, 20 nt, Artificial Sequence
  MKO10069263_B_9430038I01Rik
  gRNA
guucggcccagccuugccug

SEQ ID NO: 69264 - RNA, 20 nt, Artificial Sequence
  MKO10069264_B_9430038I01Rik
  gRNA
aucacaaccagacuguagcc

SEQ ID NO: 69265 - RNA, 20 nt, Artificial Sequence
  MKO10069265_B_9430069I07Rik
  gRNA
gccccauccuagagauacgc

SEQ ID NO: 69266 - RNA, 20 nt, Artificial Sequence
  MKO10069266_B_9430069I07Rik
  gRNA
aucccugcguaucucuagga

SEQ ID NO: 69267 - RNA, 20 nt, Artificial Sequence
  MKO10069267_B_9430069I07Rik
  gRNA
ugcguggagaggaaguacuu

SEQ ID NO: 69268 - RNA, 20 nt, Artificial Sequence
  MKO10069268_B_9530002B09Rik
  gRNA
gauucuagcuguagaucuug

SEQ ID NO: 69269 - RNA, 20 nt, Artificial Sequence
  MKO10069269_B_9530002B09Rik
  gRNA
gcuaggagaaacaauaagua

SEQ ID NO: 69270 - RNA, 20 nt, Artificial Sequence
  MKO10069270_B_9530002B09Rik
  gRNA
gaauacuuacacauuuggga

SEQ ID NO: 69271 - RNA, 20 nt, Artificial Sequence
  MKO10069271_B_9530003J23Rik
  gRNA
cgacaaaaguuccuugaucc

SEQ ID NO: 69272 - RNA, 20 nt, Artificial Sequence
  MKO10069272_B_9530003J23Rik
  gRNA
agccccgaauguacucuuug

SEQ ID NO: 69273 - RNA, 20 nt, Artificial Sequence
  MKO10069273_B_9530003J23Rik
  gRNA
gauccucuuugcacaaacua

SEQ ID NO: 69274 - RNA, 20 nt, Artificial Sequence
  MKO10069274_B_9530053A07Rik
  gRNA
ugggcaucucuguccgcgaa

SEQ ID NO: 69275 - RNA, 20 nt, Artificial Sequence
  MKO10069275_B_9530053A07Rik
  gRNA
uuuauagaaaaugaacgccg

SEQ ID NO: 69276 - RNA, 20 nt, Artificial Sequence
  MKO10069276_B_9530053A07Rik
  gRNA
ugguucgugaccuccauucg

SEQ ID NO: 69277 - RNA, 20 nt, Artificial Sequence
  MKO10069277_B_9530068E07Rik
  gRNA
gagaucgcgccagagccccg

SEQ ID NO: 69278 - RNA, 20 nt, Artificial Sequence
  MKO10069278_B_9530068E07Rik
  gRNA
gcauggccucguucacguuc

SEQ ID NO: 69279 - RNA, 20 nt, Artificial Sequence
  MKO10069279_B_9530068E07Rik
  gRNA
ucuggcgcgaucucuggugc

SEQ ID NO: 69280 - RNA, 20 nt, Artificial Sequence
  MKO10069280_B_9530077C05Rik
  gRNA
uguugucuaaaacucgaauc

SEQ ID NO: 69281 - RNA, 20 nt, Artificial Sequence
  MKO10069281_B_9530077C05Rik
  gRNA
gcauccaugacgguaguaaa

SEQ ID NO: 69282 - RNA, 20 nt, Artificial Sequence
  MKO10069282_B_9530077C05Rik
  gRNA
ugcuauaaagcccaucaacc

SEQ ID NO: 69283 - RNA, 20 nt, Artificial Sequence
  MKO10069283_B_9630033F20Rik
  gRNA
acgacuccaggcuccgagaa

SEQ ID NO: 69284 - RNA, 20 nt, Artificial Sequence
  MKO10069284_B_9630033F20Rik
  gRNA
aguuacccuuucucggagcc

SEQ ID NO: 69285 - RNA, 20 nt, Artificial Sequence
  MKO10069285_B_9630033F20Rik
  gRNA
ugccccauguucaccccgcc

SEQ ID NO: 69286 - RNA, 20 nt, Artificial Sequence
  MKO10069286_B_9830001H06Rik
  gRNA
ccugcaguaccgacugcgua

SEQ ID NO: 69287 - RNA, 20 nt, Artificial Sequence
  MKO10069287_B_9830001H06Rik
  gRNA
guugauggggaacucauccg

SEQ ID NO: 69288 - RNA, 20 nt, Artificial Sequence
  MKO10069288_B_9830001H06Rik
  gRNA
cagcuccuugugaagccgca

SEQ ID NO: 69289 - RNA, 20 nt, Artificial Sequence
  MKO10069289_B_9830107B12Rik
  gRNA
gccaggagcagcagcagcac

SEQ ID NO: 69290 - RNA, 20 nt, Artificial Sequence
  MKO10069290_B_9830107B12Rik
  gRNA
auccaguguuacuauucccg

SEQ ID NO: 69291 - RNA, 20 nt, Artificial Sequence
  MKO10069291_B_9830107B12Rik
  gRNA
ugaauaccagugucuugcug

SEQ ID NO: 69292 - RNA, 20 nt, Artificial Sequence
  MKO10069292_B_9830147E19Rik
  gRNA
augugcauauacacuucacu

SEQ ID NO: 69293 - RNA, 20 nt, Artificial Sequence
  MKO10069293_B_9830147E19Rik
  gRNA
ucucaaaaugauagaagaua

SEQ ID NO: 69294 - RNA, 20 nt, Artificial Sequence
  MKO10069294_B_9830147E19Rik
  gRNA
uuucaugcauucgaagauag

SEQ ID NO: 69295 - RNA, 20 nt, Artificial Sequence
  MKO10069295_B_9930012K11Rik
  gRNA
agauagcgcaagcccugacc

SEQ ID NO: 69296 - RNA, 20 nt, Artificial Sequence
  MKO10069296_B_9930012K11Rik
  gRNA
caacacucacgaauguucac

SEQ ID NO: 69297 - RNA, 20 nt, Artificial Sequence
  MKO10069297_B_9930012K11Rik
  gRNA
ugucccacagguugguaaua

SEQ ID NO: 69298 - RNA, 20 nt, Artificial Sequence
  MKO10069298_B_9930013L23Rik
  gRNA
aaguacaucggaguagacaa

SEQ ID NO: 69299 - RNA, 20 nt, Artificial Sequence
  MKO10069299_B_9930013L23Rik
  gRNA
gcucuccaccgucaucaauc

SEQ ID NO: 69300 - RNA, 20 nt, Artificial Sequence
  MKO10069300_B_9930013L23Rik
  gRNA
ccuuccgggcugugucaucc

SEQ ID NO: 69301 - RNA, 20 nt, Artificial Sequence
  MKO10069301_B_9930021J03Rik
  gRNA
uuaacugccacaaaguugua

SEQ ID NO: 69302 - RNA, 20 nt, Artificial Sequence
  MKO10069302_B_9930021J03Rik
  gRNA
gcacuaaucuugaugaacuc

SEQ ID NO: 69303 - RNA, 20 nt, Artificial Sequence
  MKO10069303_B_9930021J03Rik
  gRNA
cgagaaugaacucaaagauc

SEQ ID NO: 69304 - RNA, 20 nt, Artificial Sequence
  MKO10069304_B_9930104L06Rik
  gRNA
cacgcugcaccaucgccccc

SEQ ID NO: 69305 - RNA, 20 nt, Artificial Sequence
  MKO10069305_B_9930104L06Rik
  gRNA
ugaugguguuacggaccuug

SEQ ID NO: 69306 - RNA, 20 nt, Artificial Sequence
  MKO10069306_B_9930104L06Rik
  gRNA
cgcacagagucugcgcuuug

SEQ ID NO: 69307 - RNA, 20 nt, Artificial Sequence
  MKO10069307_B_9930111J21Rik1
  gRNA
ugaaaagcucuucuuuacug

SEQ ID NO: 69308 - RNA, 20 nt, Artificial Sequence
  MKO10069308_B_9930111J21Rik1
  gRNA
ucugaagaaaaucgaguuug

SEQ ID NO: 69309 - RNA, 20 nt, Artificial Sequence
  MKO10069309_B_9930111J21Rik1
  gRNA
caugaacaugugguguuugu

SEQ ID NO: 69310 - RNA, 20 nt, Artificial Sequence
  MKO10069310_B_9930111J21Rik2
  gRNA
gcaacaucuccauguccuuu

SEQ ID NO: 69311 - RNA, 20 nt, Artificial Sequence
  MKO10069311_B_9930111J21Rik2
  gRNA
uucuucauuauugucucuuc

SEQ ID NO: 69312 - RNA, 20 nt, Artificial Sequence
  MKO10069312_B_9930111J21Rik2
  gRNA
gguaugguagcccaugcucu

SEQ ID NO: 69313 - RNA, 20 nt, Artificial Sequence
  MKO10069313_B_A130010J15Rik
  gRNA
ugguccaccgaccggacaga

SEQ ID NO: 69314 - RNA, 20 nt, Artificial Sequence
  MKO10069314_B_A130010J15Rik
  gRNA
aggaacucagaacccgauuu

SEQ ID NO: 69315 - RNA, 20 nt, Artificial Sequence
  MKO10069315_B_A130010J15Rik
  gRNA
cacuguauuugggauacucc

SEQ ID NO: 69316 - RNA, 20 nt, Artificial Sequence
  MKO10069316_B_A1bg
  gRNA
cucaugcugauccagucgac

SEQ ID NO: 69317 - RNA, 20 nt, Artificial Sequence
  MKO10069317_B_A1bg
  gRNA
gcaagcccguagaguuaaug

SEQ ID NO: 69318 - RNA, 20 nt, Artificial Sequence
  MKO10069318_B_A1bg
  gRNA
ccgagcauuagaguauuucc

SEQ ID NO: 69319 - RNA, 20 nt, Artificial Sequence
  MKO10069319_B_A1cf
  gRNA
ccgugaaaauccuguacgua

SEQ ID NO: 69320 - RNA, 20 nt, Artificial Sequence
  MKO10069320_B_A1cf
  gRNA
aaguaugguggcccuccacc

SEQ ID NO: 69321 - RNA, 20 nt, Artificial Sequence
  MKO10069321_B_A1cf
  gRNA
aaaaucucgcagccccuuuc

SEQ ID NO: 69322 - RNA, 20 nt, Artificial Sequence
  MKO10069322_B_A230046K03Rik
  gRNA
aaacagugaugacuuuguuc

SEQ ID NO: 69323 - RNA, 20 nt, Artificial Sequence
  MKO10069323_B_A230046K03Rik
  gRNA
cagucuuuaugaguuccaaa

SEQ ID NO: 69324 - RNA, 20 nt, Artificial Sequence
  MKO10069324_B_A230046K03Rik
  gRNA
cuaugagcagucuucccuuu

SEQ ID NO: 69325 - RNA, 20 nt, Artificial Sequence
  MKO10069325_B_A230050P20Rik
  gRNA
ucuuuggaacauucgaagau

SEQ ID NO: 69326 - RNA, 20 nt, Artificial Sequence
  MKO10069326_B_A230050P20Rik
  gRNA
gggagguuaccugagcgucc

SEQ ID NO: 69327 - RNA, 20 nt, Artificial Sequence
  MKO10069327_B_A230050P20Rik
  gRNA
accaacgcaccuggauaucu

SEQ ID NO: 69328 - RNA, 20 nt, Artificial Sequence
  MKO10069328_B_A230065H16Rik
  gRNA
gcuccuuccccaaguccacc

SEQ ID NO: 69329 - RNA, 20 nt, Artificial Sequence
  MKO10069329_B_A230065H16Rik
  gRNA
gggcccucaguggggcucuc

SEQ ID NO: 69330 - RNA, 20 nt, Artificial Sequence
  MKO10069330_B_A230065H16Rik
  gRNA
agcaccagagagccccacug

SEQ ID NO: 69331 - RNA, 20 nt, Artificial Sequence
  MKO10069331_B_A2m
  gRNA
gauuccucuacuguacauuc

SEQ ID NO: 69332 - RNA, 20 nt, Artificial Sequence
  MKO10069332_B_A2m
  gRNA
ccacgcuggcaccccugaga

SEQ ID NO: 69333 - RNA, 20 nt, Artificial Sequence
  MKO10069333_B_A2m
  gRNA
gaucaagacuaaagagagcc

SEQ ID NO: 69334 - RNA, 20 nt, Artificial Sequence
  MKO10069334_B_A330021E22Rik
  gRNA
uaucaucaaaguccuugaag

SEQ ID NO: 69335 - RNA, 20 nt, Artificial Sequence
  MKO10069335_B_A330021E22Rik
  gRNA
cugauacacugcuaucagaa

SEQ ID NO: 69336 - RNA, 20 nt, Artificial Sequence
  MKO10069336_B_A330021E22Rik
  gRNA
auuaaagccucuaagagauu

SEQ ID NO: 69337 - RNA, 20 nt, Artificial Sequence
  MKO10069337_B_A330050F15Rik
  gRNA
aaggcagacccggugacagc

SEQ ID NO: 69338 - RNA, 20 nt, Artificial Sequence
  MKO10069338_B_A330050F15Rik
  gRNA
augccauccugcaagccaug

SEQ ID NO: 69339 - RNA, 20 nt, Artificial Sequence
  MKO10069339_B_A330050F15Rik
  gRNA
uuugcuuuaggugagaaguc

SEQ ID NO: 69340 - RNA, 20 nt, Artificial Sequence
  MKO10069340_B_A330070K13Rik
  gRNA
guggaguuguuagaccucug

SEQ ID NO: 69341 - RNA, 20 nt, Artificial Sequence
  MKO10069341_B_A330070K13Rik
  gRNA
aaauggggcucuguuugugc

SEQ ID NO: 69342 - RNA, 20 nt, Artificial Sequence
  MKO10069342_B_A330070K13Rik
  gRNA
gucucuugggaucugagguu

SEQ ID NO: 69343 - RNA, 20 nt, Artificial Sequence
  MKO10069343_B_A3galt2
  gRNA
agcaaacacagucagcccga

SEQ ID NO: 69344 - RNA, 20 nt, Artificial Sequence
  MKO10069344_B_A3galt2
  gRNA
ucuuaggccuguaccauuac

SEQ ID NO: 69345 - RNA, 20 nt, Artificial Sequence
  MKO10069345_B_A3galt2
  gRNA
ccgccacaggagucucuucu

SEQ ID NO: 69346 - RNA, 20 nt, Artificial Sequence
  MKO10069346_B_A430005L14Rik
  gRNA
ucuagcuuacagguggagug

SEQ ID NO: 69347 - RNA, 20 nt, Artificial Sequence
  MKO10069347_B_A430005L14Rik
  gRNA
ggcgcucacucaugaggagc

SEQ ID NO: 69348 - RNA, 20 nt, Artificial Sequence
  MKO10069348_B_A430005L14Rik
  gRNA
ucugaauucucuucugcuca

SEQ ID NO: 69349 - RNA, 20 nt, Artificial Sequence
  MKO10069349_B_A430033K04Rik
  gRNA
cgauggugagaagacgccag

SEQ ID NO: 69350 - RNA, 20 nt, Artificial Sequence
  MKO10069350_B_A430033K04Rik
  gRNA
accugaguugaucuccaagu

SEQ ID NO: 69351 - RNA, 20 nt, Artificial Sequence
  MKO10069351_B_A430033K04Rik
  gRNA
gccacagagcagugccuacc

SEQ ID NO: 69352 - RNA, 20 nt, Artificial Sequence
  MKO10069352_B_A430078G23Rik
  gRNA
uguccaccguggaggcauca

SEQ ID NO: 69353 - RNA, 20 nt, Artificial Sequence
  MKO10069353_B_A430078G23Rik
  gRNA
uuccauacagcugaucucac

SEQ ID NO: 69354 - RNA, 20 nt, Artificial Sequence
  MKO10069354_B_A430078G23Rik
  gRNA
guccugugagaucagcugua

SEQ ID NO: 69355 - RNA, 20 nt, Artificial Sequence
  MKO10069355_B_A430089I19Rik
  gRNA
accugaagaccugacucaug

SEQ ID NO: 69356 - RNA, 20 nt, Artificial Sequence
  MKO10069356_B_A430089I19Rik
  gRNA
uaggugcuugaugacacccu

SEQ ID NO: 69357 - RNA, 20 nt, Artificial Sequence
  MKO10069357_B_A430089I19Rik
  gRNA
aguuggcuguuugcuguaaa

SEQ ID NO: 69358 - RNA, 20 nt, Artificial Sequence
  MKO10069358_B_A430105I19Rik
  gRNA
uccaggugaaaggggcgccc

SEQ ID NO: 69359 - RNA, 20 nt, Artificial Sequence
  MKO10069359_B_A430105I19Rik
  gRNA
agaaacccacgacccaagcg

SEQ ID NO: 69360 - RNA, 20 nt, Artificial Sequence
  MKO10069360_B_A430105I19Rik
  gRNA
gccagggcgccccuuucacc

SEQ ID NO: 69361 - RNA, 20 nt, Artificial Sequence
  MKO10069361_B_A430107P09Rik
  gRNA
ucagcugcagccagaagcac

SEQ ID NO: 69362 - RNA, 20 nt, Artificial Sequence
  MKO10069362_B_A430107P09Rik
  gRNA
guaacccuacuaugauccaa

SEQ ID NO: 69363 - RNA, 20 nt, Artificial Sequence
  MKO10069363_B_A430107P09Rik
  gRNA
ucaaaugcuccauucaaaca

SEQ ID NO: 69364 - RNA, 20 nt, Artificial Sequence
  MKO10069364_B_A4galt
  gRNA
cgagcgcaagcaugaguucu

SEQ ID NO: 69365 - RNA, 20 nt, Artificial Sequence
  MKO10069365_B_A4galt
  gRNA
aggcaccguugaggacauag

SEQ ID NO: 69366 - RNA, 20 nt, Artificial Sequence
  MKO10069366_B_A4galt
  gRNA
caaucccgcuauguccucaa

SEQ ID NO: 69367 - RNA, 20 nt, Artificial Sequence
  MKO10069367_B_A4gnt
  gRNA
ugaugcuucguccacuccuc

SEQ ID NO: 69368 - RNA, 20 nt, Artificial Sequence
  MKO10069368_B_A4gnt
  gRNA
gggcugcgucggagcugacg

SEQ ID NO: 69369 - RNA, 20 nt, Artificial Sequence
  MKO10069369_B_A4gnt
  gRNA
cagcuccgacgcagcccgcc

SEQ ID NO: 69370 - RNA, 20 nt, Artificial Sequence
  MKO10069370_B_A530016L24Rik
  gRNA
acccacccuaggaugguaac

SEQ ID NO: 69371 - RNA, 20 nt, Artificial Sequence
  MKO10069371_B_A530016L24Rik
  gRNA
cugcugugacacguuuggcc

SEQ ID NO: 69372 - RNA, 20 nt, Artificial Sequence
  MKO10069372_B_A530016L24Rik
  gRNA
ucagaacucacccuugaugg

SEQ ID NO: 69373 - RNA, 20 nt, Artificial Sequence
  MKO10069373_B_A530032D15Rik
  gRNA
auguacagaagaaguuuagc

SEQ ID NO: 69374 - RNA, 20 nt, Artificial Sequence
  MKO10069374_B_A530032D15Rik
  gRNA
aacuaaugaugaacaagcag

SEQ ID NO: 69375 - RNA, 20 nt, Artificial Sequence
  MKO10069375_B_A530032D15Rik
  gRNA
ucaccuccuccauugcauug

SEQ ID NO: 69376 - RNA, 20 nt, Artificial Sequence
  MKO10069376_B_A530054K11Rik
  gRNA
gcuacauacuugacuguuau

SEQ ID NO: 69377 - RNA, 20 nt, Artificial Sequence
  MKO10069377_B_A530054K11Rik
  gRNA
uccagacaugugaucagaug

SEQ ID NO: 69378 - RNA, 20 nt, Artificial Sequence
  MKO10069378_B_A530054K11Rik
  gRNA
aucauuacuacuaauacaca

SEQ ID NO: 69379 - RNA, 20 nt, Artificial Sequence
  MKO10069379_B_A530064D06Rik
  gRNA
ccuagagucaucaucauaaa

SEQ ID NO: 69380 - RNA, 20 nt, Artificial Sequence
  MKO10069380_B_A530064D06Rik
  gRNA
cccagugcugcugcugcucc

SEQ ID NO: 69381 - RNA, 20 nt, Artificial Sequence
  MKO10069381_B_A530064D06Rik
  gRNA
gccaggagcagcagcagcac

SEQ ID NO: 69382 - RNA, 20 nt, Artificial Sequence
  MKO10069382_B_A530099J19Rik
  gRNA
caauguccguuugagcucac

SEQ ID NO: 69383 - RNA, 20 nt, Artificial Sequence
  MKO10069383_B_A530099J19Rik
  gRNA
aauuucuccacgaucaacca

SEQ ID NO: 69384 - RNA, 20 nt, Artificial Sequence
  MKO10069384_B_A530099J19Rik
  gRNA
gaauggaguauacccuaaca

SEQ ID NO: 69385 - RNA, 20 nt, Artificial Sequence
  MKO10069385_B_A630001G21Rik
  gRNA
cucgccccagaaaugcaaac

SEQ ID NO: 69386 - RNA, 20 nt, Artificial Sequence
  MKO10069386_B_A630001G21Rik
  gRNA
cgauguccuucaagaguggu

SEQ ID NO: 69387 - RNA, 20 nt, Artificial Sequence
  MKO10069387_B_A630001G21Rik
  gRNA
gugcacccaaguuaugagca

SEQ ID NO: 69388 - RNA, 20 nt, Artificial Sequence
  MKO10069388_B_A630007B06Rik
  gRNA
gcauaugaacacaauaaagc

SEQ ID NO: 69389 - RNA, 20 nt, Artificial Sequence
  MKO10069389_B_A630007B06Rik
  gRNA
gaaguaugugagaggcgaga

SEQ ID NO: 69390 - RNA, 20 nt, Artificial Sequence
  MKO10069390_B_A630007B06Rik
  gRNA
cucaagucauuaaaguaaag

SEQ ID NO: 69391 - RNA, 20 nt, Artificial Sequence
  MKO10069391_B_A630023A22Rik
  gRNA
agcagaaaaagugccgaaca

SEQ ID NO: 69392 - RNA, 20 nt, Artificial Sequence
  MKO10069392_B_A630023A22Rik
  gRNA
ugaugucauaaagggcccca

SEQ ID NO: 69393 - RNA, 20 nt, Artificial Sequence
  MKO10069393_B_A630023A22Rik
  gRNA
acugccugaucugaagacaa

SEQ ID NO: 69394 - RNA, 20 nt, Artificial Sequence
  MKO10069394_B_A630033H20Rik
  gRNA
gaaucuucagacuaucucuc

SEQ ID NO: 69395 - RNA, 20 nt, Artificial Sequence
  MKO10069395_B_A630033H20Rik
  gRNA
ccuuacaaugcaaacaugac

SEQ ID NO: 69396 - RNA, 20 nt, Artificial Sequence
  MKO10069396_B_A630033H20Rik
  gRNA
agcugcaguuaccaugccaa

SEQ ID NO: 69397 - RNA, 20 nt, Artificial Sequence
  MKO10069397_B_A630073D07Rik
  gRNA
ccagcaagacugcaaugagu

SEQ ID NO: 69398 - RNA, 20 nt, Artificial Sequence
  MKO10069398_B_A630073D07Rik
  gRNA
acaucuucaacagucacuac

SEQ ID NO: 69399 - RNA, 20 nt, Artificial Sequence
  MKO10069399_B_A630073D07Rik
  gRNA
gccacaccugcaggugcagc

SEQ ID NO: 69400 - RNA, 20 nt, Artificial Sequence
  MKO10069400_B_A630076J17Rik
  gRNA
cauauuguccucaucuggaa

SEQ ID NO: 69401 - RNA, 20 nt, Artificial Sequence
  MKO10069401_B_A630076J17Rik
  gRNA
gcaaaggaaaugacagcugc

SEQ ID NO: 69402 - RNA, 20 nt, Artificial Sequence
  MKO10069402_B_A630076J17Rik
  gRNA
acgcuuccaucuucaacuau

SEQ ID NO: 69403 - RNA, 20 nt, Artificial Sequence
  MKO10069403_B_A630095E13Rik
  gRNA
guaccucuuguugcuacucu

SEQ ID NO: 69404 - RNA, 20 nt, Artificial Sequence
  MKO10069404_B_A630095E13Rik
  gRNA
ccugugaagcuacaaauaau

SEQ ID NO: 69405 - RNA, 20 nt, Artificial Sequence
  MKO10069405_B_A630095E13Rik
  gRNA
aaggcuuguuacacaaauuu

SEQ ID NO: 69406 - RNA, 20 nt, Artificial Sequence
  MKO10069406_B_A630095N17Rik
  gRNA
ucugguuaggagaauuucgu

SEQ ID NO: 69407 - RNA, 20 nt, Artificial Sequence
  MKO10069407_B_A630095N17Rik
  gRNA
cucaggagucuaccugcagg

SEQ ID NO: 69408 - RNA, 20 nt, Artificial Sequence
  MKO10069408_B_A630095N17Rik
  gRNA
ugucaucauuugugaaguuc

SEQ ID NO: 69409 - RNA, 20 nt, Artificial Sequence
  MKO10069409_B_A730008H23Rik
  gRNA
guuaaccuacgagacgcccc

SEQ ID NO: 69410 - RNA, 20 nt, Artificial Sequence
  MKO10069410_B_A730008H23Rik
  gRNA
uuucuuaaggguugagaguu

SEQ ID NO: 69411 - RNA, 20 nt, Artificial Sequence
  MKO10069411_B_A730008H23Rik
  gRNA
uuucagaacgcagagaagag

SEQ ID NO: 69412 - RNA, 20 nt, Artificial Sequence
  MKO10069412_B_A730017C20Rik
  gRNA
cauugcuacucagcgaauca

SEQ ID NO: 69413 - RNA, 20 nt, Artificial Sequence
  MKO10069413_B_A730017C20Rik
  gRNA
uucagcagagugucgaagcc

SEQ ID NO: 69414 - RNA, 20 nt, Artificial Sequence
  MKO10069414_B_A730017C20Rik
  gRNA
augaagaacaacccguugua

SEQ ID NO: 69415 - RNA, 20 nt, Artificial Sequence
  MKO10069415_B_A830010M20Rik
  gRNA
gaucagcagaaaauucaagu

SEQ ID NO: 69416 - RNA, 20 nt, Artificial Sequence
  MKO10069416_B_A830010M20Rik
  gRNA
accugagagcuggugagcac

SEQ ID NO: 69417 - RNA, 20 nt, Artificial Sequence
  MKO10069417_B_A830010M20Rik
  gRNA
acucaugaacaagacucuca

SEQ ID NO: 69418 - RNA, 20 nt, Artificial Sequence
  MKO10069418_B_A830018L16Rik
  gRNA
ucgucaacaaacccgaaucc

SEQ ID NO: 69419 - RNA, 20 nt, Artificial Sequence
  MKO10069419_B_A830018L16Rik
  gRNA
aggugucucaguuauuaacu

SEQ ID NO: 69420 - RNA, 20 nt, Artificial Sequence
  MKO10069420_B_A830018L16Rik
  gRNA
aaaaucccuucucguuccuu

SEQ ID NO: 69421 - RNA, 20 nt, Artificial Sequence
  MKO10069421_B_A830080D01Rik
  gRNA
uaagcucucagagagcgagc

SEQ ID NO: 69422 - RNA, 20 nt, Artificial Sequence
  MKO10069422_B_A830080D01Rik
  gRNA
cguucauuuagaguaauauc

SEQ ID NO: 69423 - RNA, 20 nt, Artificial Sequence
  MKO10069423_B_A830080D01Rik
  gRNA
uccugagcaaauucuucagu

SEQ ID NO: 69424 - RNA, 20 nt, Artificial Sequence
  MKO10069424_B_A930009A15Rik
  gRNA
auauauagucggaaggccag

SEQ ID NO: 69425 - RNA, 20 nt, Artificial Sequence
  MKO10069425_B_A930009A15Rik
  gRNA
ccugugauguccuccaccac

SEQ ID NO: 69426 - RNA, 20 nt, Artificial Sequence
  MKO10069426_B_A930009A15Rik
  gRNA
gaauaacagcugcucacaca

SEQ ID NO: 69427 - RNA, 20 nt, Artificial Sequence
  MKO10069427_B_A930018P22Rik
  gRNA
cugaagaugagcaggcaacc

SEQ ID NO: 69428 - RNA, 20 nt, Artificial Sequence
  MKO10069428_B_A930018P22Rik
  gRNA
acuuuccgucgcucuacgac

SEQ ID NO: 69429 - RNA, 20 nt, Artificial Sequence
  MKO10069429_B_A930018P22Rik
  gRNA
ggcgucccgcccgccuucag

SEQ ID NO: 69430 - RNA, 20 nt, Artificial Sequence
  MKO10069430_B_AA414768
  gRNA
cauuugaaugguaccguguc

SEQ ID NO: 69431 - RNA, 20 nt, Artificial Sequence
  MKO10069431_B_AA414768
  gRNA
cugcugacgaagcgaacugu

SEQ ID NO: 69432 - RNA, 20 nt, Artificial Sequence
  MKO10069432_B_AA414768
  gRNA
uaacacauuucacggaauca

SEQ ID NO: 69433 - RNA, 20 nt, Artificial Sequence
  MKO10069433_B_AA415398
  gRNA
ccuggucagaauaggaaaug

SEQ ID NO: 69434 - RNA, 20 nt, Artificial Sequence
  MKO10069434_B_AA415398
  gRNA
auacagacccaccacccauu

SEQ ID NO: 69435 - RNA, 20 nt, Artificial Sequence
  MKO10069435_B_AA415398
  gRNA
ccucauuuccuauucugacc

SEQ ID NO: 69436 - RNA, 20 nt, Artificial Sequence
  MKO10069436_B_AA467197
  gRNA
uugaggagcugcaaaaaguc

SEQ ID NO: 69437 - RNA, 20 nt, Artificial Sequence
  MKO10069437_B_AA467197
  gRNA
ggauccuacucaaccccaaa

SEQ ID NO: 69438 - RNA, 20 nt, Artificial Sequence
  MKO10069438_B_AA467197
  gRNA
ccuuauucuucaucaauauc

SEQ ID NO: 69439 - RNA, 20 nt, Artificial Sequence
  MKO10069439_B_AA792892
  gRNA
ccucuuuaaauuaaaacauc

SEQ ID NO: 69440 - RNA, 20 nt, Artificial Sequence
  MKO10069440_B_AA792892
  gRNA
agguuaggcuucuuuaucaa

SEQ ID NO: 69441 - RNA, 20 nt, Artificial Sequence
  MKO10069441_B_AA792892
  gRNA
cuucccagcacuauucaaag

SEQ ID NO: 69442 - RNA, 20 nt, Artificial Sequence
  MKO10069442_B_AA986860
  gRNA
ugucgccacagcugccgaug

SEQ ID NO: 69443 - RNA, 20 nt, Artificial Sequence
  MKO10069443_B_AA986860
  gRNA
ggcuggcucugacucgucug

SEQ ID NO: 69444 - RNA, 20 nt, Artificial Sequence
  MKO10069444_B_AA986860
  gRNA
ugcuucaggcgaugcccaag

SEQ ID NO: 69445 - RNA, 20 nt, Artificial Sequence
  MKO10069445_B_AA987161
  gRNA
ugacacaccugggagcauag

SEQ ID NO: 69446 - RNA, 20 nt, Artificial Sequence
  MKO10069446_B_AA987161
  gRNA
uacuucgucuaagccauauc

SEQ ID NO: 69447 - RNA, 20 nt, Artificial Sequence
  MKO10069447_B_AA987161
  gRNA
aaugccuugauccugcucag

SEQ ID NO: 69448 - RNA, 20 nt, Artificial Sequence
  MKO10069448_B_AB124611
  gRNA
gcagagagcgugaauccugc

SEQ ID NO: 69449 - RNA, 20 nt, Artificial Sequence
  MKO10069449_B_AB124611
  gRNA
acucaccagaugcaaacagc

SEQ ID NO: 69450 - RNA, 20 nt, Artificial Sequence
  MKO10069450_B_AB124611
  gRNA
ccaaaaacuuacagaagcag

SEQ ID NO: 69451 - RNA, 20 nt, Artificial Sequence
  MKO10069451_B_AF067061
  gRNA
gccuuucucacuucuucuuc

SEQ ID NO: 69452 - RNA, 20 nt, Artificial Sequence
  MKO10069452_B_AF067061
  gRNA
cacacucucaaauacacaaa

SEQ ID NO: 69453 - RNA, 20 nt, Artificial Sequence
  MKO10069453_B_AF067061
  gRNA
aacccuccccaagcuugcuc

SEQ ID NO: 69454 - RNA, 20 nt, Artificial Sequence
  MKO10069454_B_AF067063
  gRNA
gguggcuuucucacuucuuc

SEQ ID NO: 69455 - RNA, 20 nt, Artificial Sequence
  MKO10069455_B_AF067063
  gRNA
cuggaacuugagaccuguga

SEQ ID NO: 69456 - RNA, 20 nt, Artificial Sequence
  MKO10069456_B_AF067063
  gRNA
caacaauccagucauccuca

SEQ ID NO: 69457 - RNA, 20 nt, Artificial Sequence
  MKO10069457_B_AF251705
  gRNA
uucggagcagccucuacuuc

SEQ ID NO: 69458 - RNA, 20 nt, Artificial Sequence
  MKO10069458_B_AF251705
  gRNA
gaaucccccacauccucagu

SEQ ID NO: 69459 - RNA, 20 nt, Artificial Sequence
  MKO10069459_B_AF251705
  gRNA
uuccuguuccugagcaugcu

SEQ ID NO: 69460 - RNA, 20 nt, Artificial Sequence
  MKO10069460_B_AF366264
  gRNA
cuccugagaagucuucuucu

SEQ ID NO: 69461 - RNA, 20 nt, Artificial Sequence
  MKO10069461_B_AF366264
  gRNA
aucuccaacccaggcaguuu

SEQ ID NO: 69462 - RNA, 20 nt, Artificial Sequence
  MKO10069462_B_AF366264
  gRNA
cgaaaauaccacgaugaaag

SEQ ID NO: 69463 - RNA, 20 nt, Artificial Sequence
  MKO10069463_B_AF529169
  gRNA
ucagccgcaugucuguauac

SEQ ID NO: 69464 - RNA, 20 nt, Artificial Sequence
  MKO10069464_B_AF529169
  gRNA
agcagcgaucuugcaaaccu

SEQ ID NO: 69465 - RNA, 20 nt, Artificial Sequence
  MKO10069465_B_AF529169
  gRNA
caggacuucaucgugcagau

SEQ ID NO: 69466 - RNA, 20 nt, Artificial Sequence
  MKO10069466_B_AI118078
  gRNA
gaucaccaccaauauuacac

SEQ ID NO: 69467 - RNA, 20 nt, Artificial Sequence
  MKO10069467_B_AI118078
  gRNA
gaagagagcagccguauggc

SEQ ID NO: 69468 - RNA, 20 nt, Artificial Sequence
  MKO10069468_B_AI118078
  gRNA
ugucauucacuggaucaguc

SEQ ID NO: 69469 - RNA, 20 nt, Artificial Sequence
  MKO10069469_B_AI182371
  gRNA
guguauacuccacaacagcc

SEQ ID NO: 69470 - RNA, 20 nt, Artificial Sequence
  MKO10069470_B_AI182371
  gRNA
ugugaaugaugacuuagagc

SEQ ID NO: 69471 - RNA, 20 nt, Artificial Sequence
  MKO10069471_B_AI182371
  gRNA
aaucucgaagucaggaaaag

SEQ ID NO: 69472 - RNA, 20 nt, Artificial Sequence
  MKO10069472_B_AI314180
  gRNA
uccauggcaguaagaagcgu

SEQ ID NO: 69473 - RNA, 20 nt, Artificial Sequence
  MKO10069473_B_AI314180
  gRNA
cucacccguaaggcaucaga

SEQ ID NO: 69474 - RNA, 20 nt, Artificial Sequence
  MKO10069474_B_AI314180
  gRNA
gauguccuucugaugccuua

SEQ ID NO: 69475 - RNA, 20 nt, Artificial Sequence
  MKO10069475_B_AI317395
  gRNA
ugaagaauuccgaucaccgc

SEQ ID NO: 69476 - RNA, 20 nt, Artificial Sequence
  MKO10069476_B_AI317395
  gRNA
uccucacagucuagaacuag

SEQ ID NO: 69477 - RNA, 20 nt, Artificial Sequence
  MKO10069477_B_AI317395
  gRNA
uccguugguguuguggauac

SEQ ID NO: 69478 - RNA, 20 nt, Artificial Sequence
  MKO10069478_B_AI413582
  gRNA
ugacccugcagaagaacucc

SEQ ID NO: 69479 - RNA, 20 nt, Artificial Sequence
  MKO10069479_B_AI413582
  gRNA
gcaggagcugcucucugaug

SEQ ID NO: 69480 - RNA, 20 nt, Artificial Sequence
  MKO10069480_B_AI413582
  gRNA
uguaugugcagaagaaaaag

SEQ ID NO: 69481 - RNA, 20 nt, Artificial Sequence
  MKO10069481_B_AI429214
  gRNA
ugggcgggcauauucaaagc

SEQ ID NO: 69482 - RNA, 20 nt, Artificial Sequence
  MKO10069482_B_AI429214
  gRNA
ugaauaugcccgcccaaagc

SEQ ID NO: 69483 - RNA, 20 nt, Artificial Sequence
  MKO10069483_B_AI429214
  gRNA
aguucuucugcggauuccuu

SEQ ID NO: 69484 - RNA, 20 nt, Artificial Sequence
  MKO10069484_B_AI462493
  gRNA
ugcuuuacgagccaccucca

SEQ ID NO: 69485 - RNA, 20 nt, Artificial Sequence
  MKO10069485_B_AI462493
  gRNA
cacguucuccuucguggcug

SEQ ID NO: 69486 - RNA, 20 nt, Artificial Sequence
  MKO10069486_B_AI462493
  gRNA
acuggugauggcuacccuga

SEQ ID NO: 69487 - RNA, 20 nt, Artificial Sequence
  MKO10069487_B_AI464131
  gRNA
gcucagcuaccgcgugugcg

SEQ ID NO: 69488 - RNA, 20 nt, Artificial Sequence
  MKO10069488_B_AI464131
  gRNA
cucgguauggggcuacgacc

SEQ ID NO: 69489 - RNA, 20 nt, Artificial Sequence
  MKO10069489_B_AI464131
  gRNA
gaccuccuuuaaguucgacg

SEQ ID NO: 69490 - RNA, 20 nt, Artificial Sequence
  MKO10069490_B_AI467606
  gRNA
caucauaacuacugcuguac

SEQ ID NO: 69491 - RNA, 20 nt, Artificial Sequence
  MKO10069491_B_AI467606
  gRNA
uggggucugguugcgggcgg

SEQ ID NO: 69492 - RNA, 20 nt, Artificial Sequence
  MKO10069492_B_AI467606
  gRNA
guguggguaguaauccccug

SEQ ID NO: 69493 - RNA, 20 nt, Artificial Sequence
  MKO10069493_B_AI593442
  gRNA
uuugcuucccacaacgccag

SEQ ID NO: 69494 - RNA, 20 nt, Artificial Sequence
  MKO10069494_B_AI593442
  gRNA
cucgccagguguguccaagc

SEQ ID NO: 69495 - RNA, 20 nt, Artificial Sequence
  MKO10069495_B_AI593442
  gRNA
ggagcuugaacaccugcccg

SEQ ID NO: 69496 - RNA, 20 nt, Artificial Sequence
  MKO10069496_B_AI597468
  gRNA
cuuagugaugaacccccaga

SEQ ID NO: 69497 - RNA, 20 nt, Artificial Sequence
  MKO10069497_B_AI597468
  gRNA
ccaccauuggugguguggcu

SEQ ID NO: 69498 - RNA, 20 nt, Artificial Sequence
  MKO10069498_B_AI597468
  gRNA
auguugucucgugugacugg

SEQ ID NO: 69499 - RNA, 20 nt, Artificial Sequence
  MKO10069499_B_AI597479
  gRNA
aucccucugaggcaacggua

SEQ ID NO: 69500 - RNA, 20 nt, Artificial Sequence
  MKO10069500_B_AI597479
  gRNA
aaucaccaaauuccucgucg

SEQ ID NO: 69501 - RNA, 20 nt, Artificial Sequence
  MKO10069501_B_AI597479
  gRNA
gacaaccauggcgggggaug

SEQ ID NO: 69502 - RNA, 20 nt, Artificial Sequence
  MKO10069502_B_AI607873
  gRNA
uugucuccagacuccucuua

SEQ ID NO: 69503 - RNA, 20 nt, Artificial Sequence
  MKO10069503_B_AI607873
  gRNA
uggagaguacuuaguaauua

SEQ ID NO: 69504 - RNA, 20 nt, Artificial Sequence
  MKO10069504_B_AI607873
  gRNA
ugugaacguuaacccaacaa

SEQ ID NO: 69505 - RNA, 20 nt, Artificial Sequence
  MKO10069505_B_AI661453
  gRNA
ucucacggugaauguauuga

SEQ ID NO: 69506 - RNA, 20 nt, Artificial Sequence
  MKO10069506_B_AI661453
  gRNA
ccauaguggguguugccgug

SEQ ID NO: 69507 - RNA, 20 nt, Artificial Sequence
  MKO10069507_B_AI661453
  gRNA
guucaacacugugagcgaau

SEQ ID NO: 69508 - RNA, 20 nt, Artificial Sequence
  MKO10069508_B_AI747448
  gRNA
augucuuacaggaaaacugu

SEQ ID NO: 69509 - RNA, 20 nt, Artificial Sequence
  MKO10069509_B_AI747448
  gRNA
caaguugaauauggagauuc

SEQ ID NO: 69510 - RNA, 20 nt, Artificial Sequence
  MKO10069510_B_AI747448
  gRNA
aaaacaguucccaguacaga

SEQ ID NO: 69511 - RNA, 20 nt, Artificial Sequence
  MKO10069511_B_AI836003
  gRNA
uaugaccacugcgccccgcc

SEQ ID NO: 69512 - RNA, 20 nt, Artificial Sequence
  MKO10069512_B_AI836003
  gRNA
aagccgcuguccucgauccc

SEQ ID NO: 69513 - RNA, 20 nt, Artificial Sequence
  MKO10069513_B_AI836003
  gRNA
gaaccagagacaccuucgcc

SEQ ID NO: 69514 - RNA, 20 nt, Artificial Sequence
  MKO10069514_B_AI837181
  gRNA
cgcccacccucuuuggcccg

SEQ ID NO: 69515 - RNA, 20 nt, Artificial Sequence
  MKO10069515_B_AI837181
  gRNA
guuggcgcggaacggaguga

SEQ ID NO: 69516 - RNA, 20 nt, Artificial Sequence
  MKO10069516_B_AI837181
  gRNA
uggugugaugggucgcccac

SEQ ID NO: 69517 - RNA, 20 nt, Artificial Sequence
  MKO10069517_B_AI846148
  gRNA
gguuguccucggaauccaag

SEQ ID NO: 69518 - RNA, 20 nt, Artificial Sequence
  MKO10069518_B_AI846148
  gRNA
aaaaucuuggacccugaccc

SEQ ID NO: 69519 - RNA, 20 nt, Artificial Sequence
  MKO10069519_B_AI846148
  gRNA
uccggguuggagaugggguc

SEQ ID NO: 69520 - RNA, 20 nt, Artificial Sequence
  MKO10069520_B_AI848285
  gRNA
auuacgacgugaugggccag

SEQ ID NO: 69521 - RNA, 20 nt, Artificial Sequence
  MKO10069521_B_AI848285
  gRNA
acgccucaauaaugcgccuc

SEQ ID NO: 69522 - RNA, 20 nt, Artificial Sequence
  MKO10069522_B_AI848285
  gRNA
accccagaggcgcauuauug

SEQ ID NO: 69523 - RNA, 20 nt, Artificial Sequence
  MKO10069523_B_AI987944
  gRNA
cuucuucagugaaguuuaca

SEQ ID NO: 69524 - RNA, 20 nt, Artificial Sequence
  MKO10069524_B_AI987944
  gRNA
uuucaacauucuagaagaca

SEQ ID NO: 69525 - RNA, 20 nt, Artificial Sequence
  MKO10069525_B_AI987944
  gRNA
uaaacuucacugaagaagag

SEQ ID NO: 69526 - RNA, 20 nt, Artificial Sequence
  MKO10069526_B_AK010878
  gRNA
gcagaagaugaaaauaacuc

SEQ ID NO: 69527 - RNA, 20 nt, Artificial Sequence
  MKO10069527_B_AK010878
  gRNA
cgcgucucccgacgccucac

SEQ ID NO: 69528 - RNA, 20 nt, Artificial Sequence
  MKO10069528_B_AK010878
  gRNA
gauccggacgacgcuuugga

SEQ ID NO: 69529 - RNA, 20 nt, Artificial Sequence
  MKO10069529_B_AK129341
  gRNA
aaauguguuccagcuuaaac

SEQ ID NO: 69530 - RNA, 20 nt, Artificial Sequence
  MKO10069530_B_AK129341
  gRNA
uuuguugcuguaguagcauc

SEQ ID NO: 69531 - RNA, 20 nt, Artificial Sequence
  MKO10069531_B_AK129341
  gRNA
uccaguuccuccauuagaag

SEQ ID NO: 69532 - RNA, 20 nt, Artificial Sequence
  MKO10069532_B_AU015228
  gRNA
aaagccgucguccgacucac

SEQ ID NO: 69533 - RNA, 20 nt, Artificial Sequence
  MKO10069533_B_AU015228
  gRNA
ucuucagaacuguacgcccc

SEQ ID NO: 69534 - RNA, 20 nt, Artificial Sequence
  MKO10069534_B_AU015228
  gRNA
gcagcagaaaguuccuaucg

SEQ ID NO: 69535 - RNA, 20 nt, Artificial Sequence
  MKO10069535_B_AU018091
  gRNA
cagacuguucguuugccgcc

SEQ ID NO: 69536 - RNA, 20 nt, Artificial Sequence
  MKO10069536_B_AU018091
  gRNA
ucccgcaggaauccucgccc

SEQ ID NO: 69537 - RNA, 20 nt, Artificial Sequence
  MKO10069537_B_AU018091
  gRNA
aauacagucgaacccaauga

SEQ ID NO: 69538 - RNA, 20 nt, Artificial Sequence
  MKO10069538_B_AU018829
  gRNA
ccacaggaggccaaaacuuc

SEQ ID NO: 69539 - RNA, 20 nt, Artificial Sequence
  MKO10069539_B_AU018829
  gRNA
uauccauguuuacugcaaac

SEQ ID NO: 69540 - RNA, 20 nt, Artificial Sequence
  MKO10069540_B_AU018829
  gRNA
ccuaauuucacagacagacu

SEQ ID NO: 69541 - RNA, 20 nt, Artificial Sequence
  MKO10069541_B_AU019823
  gRNA
cugaagaguuugaaacagac

SEQ ID NO: 69542 - RNA, 20 nt, Artificial Sequence
  MKO10069542_B_AU019823
  gRNA
cauacuucaccuugagcugc

SEQ ID NO: 69543 - RNA, 20 nt, Artificial Sequence
  MKO10069543_B_AU019823
  gRNA
acuuacagauggggucacag

SEQ ID NO: 69544 - RNA, 20 nt, Artificial Sequence
  MKO10069544_B_AU021092
  gRNA
gugugccuggugcaacuacu

SEQ ID NO: 69545 - RNA, 20 nt, Artificial Sequence
  MKO10069545_B_AU021092
  gRNA
ggugggguaagcguauccaa

SEQ ID NO: 69546 - RNA, 20 nt, Artificial Sequence
  MKO10069546_B_AU021092
  gRNA
gugguucaguuccaucauau

SEQ ID NO: 69547 - RNA, 20 nt, Artificial Sequence
  MKO10069547_B_AU022252
  gRNA
caugucauguugcagcuugu

SEQ ID NO: 69548 - RNA, 20 nt, Artificial Sequence
  MKO10069548_B_AU022252
  gRNA
acugcuggccgcuuucccgc

SEQ ID NO: 69549 - RNA, 20 nt, Artificial Sequence
  MKO10069549_B_AU022252
  gRNA
ucaccauauuacaagccgca

SEQ ID NO: 69550 - RNA, 20 nt, Artificial Sequence
  MKO10069550_B_AU022751
  gRNA
ccggagccucgaagccgaaa

SEQ ID NO: 69551 - RNA, 20 nt, Artificial Sequence
  MKO10069551_B_AU022751
  gRNA
cguuccggaguuguaccuuu

SEQ ID NO: 69552 - RNA, 20 nt, Artificial Sequence
  MKO10069552_B_AU022751
  gRNA
cucgcuugcggccggcugcu

SEQ ID NO: 69553 - RNA, 20 nt, Artificial Sequence
  MKO10069553_B_AU040320
  gRNA
gaaggaaccggcaacuguaa

SEQ ID NO: 69554 - RNA, 20 nt, Artificial Sequence
  MKO10069554_B_AU040320
  gRNA
ucaagccaagucccgcuucc

SEQ ID NO: 69555 - RNA, 20 nt, Artificial Sequence
  MKO10069555_B_AU040320
  gRNA
aaaacccaggaagcgggacu

SEQ ID NO: 69556 - RNA, 20 nt, Artificial Sequence
  MKO10069556_B_AU041133
  gRNA
cgagguccgaauccgcgcca

SEQ ID NO: 69557 - RNA, 20 nt, Artificial Sequence
  MKO10069557_B_AU041133
  gRNA
gagaguguuccucacuauuc

SEQ ID NO: 69558 - RNA, 20 nt, Artificial Sequence
  MKO10069558_B_AU041133
  gRNA
ucucagcgcucuagaagaua

SEQ ID NO: 69559 - RNA, 20 nt, Artificial Sequence
  MKO10069559_B_AV320801
  gRNA
auguccacuaucaauuccau

SEQ ID NO: 69560 - RNA, 20 nt, Artificial Sequence
  MKO10069560_B_AV320801
  gRNA
aaugccaccucccauagcaa

SEQ ID NO: 69561 - RNA, 20 nt, Artificial Sequence
  MKO10069561_B_AV320801
  gRNA
cagaguacuaucugcugauu

SEQ ID NO: 69562 - RNA, 20 nt, Artificial Sequence
  MKO10069562_B_AW146154
  gRNA
gaaaauauucuucaauauua

SEQ ID NO: 69563 - RNA, 20 nt, Artificial Sequence
  MKO10069563_B_AW146154
  gRNA
uacagaaaccucacugcuau

SEQ ID NO: 69564 - RNA, 20 nt, Artificial Sequence
  MKO10069564_B_AW146154
  gRNA
gaugugcauguaaacuucac

SEQ ID NO: 69565 - RNA, 20 nt, Artificial Sequence
  MKO10069565_B_AW209491
  gRNA
cugaagcgcugcauaacauc

SEQ ID NO: 69566 - RNA, 20 nt, Artificial Sequence
  MKO10069566_B_AW209491
  gRNA
cugcaccgguugcugucgac

SEQ ID NO: 69567 - RNA, 20 nt, Artificial Sequence
  MKO10069567_B_AW209491
  gRNA
ugagcgugccuugagacuag

SEQ ID NO: 69568 - RNA, 20 nt, Artificial Sequence
  MKO10069568_B_AW549877
  gRNA
ugcccuguccaguuaaauga

SEQ ID NO: 69569 - RNA, 20 nt, Artificial Sequence
  MKO10069569_B_AW549877
  gRNA
acagcuaaauugcugaguac

SEQ ID NO: 69570 - RNA, 20 nt, Artificial Sequence
  MKO10069570_B_AW549877
  gRNA
uucaaauccauccaaucuuu

SEQ ID NO: 69571 - RNA, 20 nt, Artificial Sequence
  MKO10069571_B_AW551984
  gRNA
guguagggcaauuccuccaa

SEQ ID NO: 69572 - RNA, 20 nt, Artificial Sequence
  MKO10069572_B_AW551984
  gRNA
ucaccggagagaugguaucu

SEQ ID NO: 69573 - RNA, 20 nt, Artificial Sequence
  MKO10069573_B_AW551984
  gRNA
uugaaucccauugaguacac

SEQ ID NO: 69574 - RNA, 20 nt, Artificial Sequence
  MKO10069574_B_AW554918
  gRNA
ugccaacuuaauuaaagaac

SEQ ID NO: 69575 - RNA, 20 nt, Artificial Sequence
  MKO10069575_B_AW554918
  gRNA
ggagcggcugaaaacugagc

SEQ ID NO: 69576 - RNA, 20 nt, Artificial Sequence
  MKO10069576_B_AW554918
  gRNA
gacugaugcuuccgucucca

SEQ ID NO: 69577 - RNA, 20 nt, Artificial Sequence
  MKO10069577_B_AY074887
  gRNA
gcgggcucagucugcccacg

SEQ ID NO: 69578 - RNA, 20 nt, Artificial Sequence
  MKO10069578_B_AY074887
  gRNA
cgcggaaguucucccagugc

SEQ ID NO: 69579 - RNA, 20 nt, Artificial Sequence
  MKO10069579_B_AY074887
  gRNA
acagaccgcagccaaagccg

SEQ ID NO: 69580 - RNA, 20 nt, Artificial Sequence
  MKO10069580_B_AY358078
  gRNA
aagauaugaaacuuuauauc

SEQ ID NO: 69581 - RNA, 20 nt, Artificial Sequence
  MKO10069581_B_AY358078
  gRNA
cucaucuugugauuuaauga

SEQ ID NO: 69582 - RNA, 20 nt, Artificial Sequence
  MKO10069582_B_AY358078
  gRNA
acaagaugagaagacaaugu

SEQ ID NO: 69583 - RNA, 20 nt, Artificial Sequence
  MKO10069583_B_AY761184
  gRNA
ccucucugcccuugcccugc

SEQ ID NO: 69584 - RNA, 20 nt, Artificial Sequence
  MKO10069584_B_AY761184
  gRNA
agagccuucugugccuccaa

SEQ ID NO: 69585 - RNA, 20 nt, Artificial Sequence
  MKO10069585_B_AY761184
  gRNA
acagccugguccucuuccuc

SEQ ID NO: 69586 - RNA, 20 nt, Artificial Sequence
  MKO10069586_B_AY761185
  gRNA
ugugggcacuuugagcacac

SEQ ID NO: 69587 - RNA, 20 nt, Artificial Sequence
  MKO10069587_B_AY761185
  gRNA
agaaucagccuggacauaga

SEQ ID NO: 69588 - RNA, 20 nt, Artificial Sequence
  MKO10069588_B_AY761185
  gRNA
acuaaaacugaugaucagcc

SEQ ID NO: 69589 - RNA, 20 nt, Artificial Sequence
  MKO10069589_B_Aaas
  gRNA
aggcgcggccacagagagcc

SEQ ID NO: 69590 - RNA, 20 nt, Artificial Sequence
  MKO10069590_B_Aaas
  gRNA
aauuugcccaaguaacuaac

SEQ ID NO: 69591 - RNA, 20 nt, Artificial Sequence
  MKO10069591_B_Aaas
  gRNA
uccuuggucagguguaggac

SEQ ID NO: 69592 - RNA, 20 nt, Artificial Sequence
  MKO10069592_B_Aacs
  gRNA
cccaaaaguccauauacgac

SEQ ID NO: 69593 - RNA, 20 nt, Artificial Sequence
  MKO10069593_B_Aacs
  gRNA
cauuuggaguucuaccucgc

SEQ ID NO: 69594 - RNA, 20 nt, Artificial Sequence
  MKO10069594_B_Aacs
  gRNA
acuccaaauggccccaauac

SEQ ID NO: 69595 - RNA, 20 nt, Artificial Sequence
  MKO10069595_B_Aadacl2
  gRNA
aaauagaucacagcucgucu

SEQ ID NO: 69596 - RNA, 20 nt, Artificial Sequence
  MKO10069596_B_Aadacl2
  gRNA
uaucuccaugauaaucaauc

SEQ ID NO: 69597 - RNA, 20 nt, Artificial Sequence
  MKO10069597_B_Aadacl2
  gRNA
uguuugcaguccaucuauuc

SEQ ID NO: 69598 - RNA, 20 nt, Artificial Sequence
  MKO10069598_B_Aadacl3
  gRNA
uagaggcaucauggugguuc

SEQ ID NO: 69599 - RNA, 20 nt, Artificial Sequence
  MKO10069599_B_Aadacl3
  gRNA
gacucuguugucguuucagu

SEQ ID NO: 69600 - RNA, 20 nt, Artificial Sequence
  MKO10069600_B_Aadacl3
  gRNA
cuuacucaagcucccuauga

SEQ ID NO: 69601 - RNA, 20 nt, Artificial Sequence
  MKO10069601_B_Aadac
  gRNA
ccuaggagagucgguguguc

SEQ ID NO: 69602 - RNA, 20 nt, Artificial Sequence
  MKO10069602_B_Aadac
  gRNA
gagcuggcucaaaaguaucc

SEQ ID NO: 69603 - RNA, 20 nt, Artificial Sequence
  MKO10069603_B_Aadac
  gRNA
ccuaugacacucuaucgaga

SEQ ID NO: 69604 - RNA, 20 nt, Artificial Sequence
  MKO10069604_B_Aadau
  gRNA
auggaucucugcaucacauc

SEQ ID NO: 69605 - RNA, 20 nt, Artificial Sequence
  MKO10069605_B_Aadau
  gRNA
uuugaaaugcucaucaaucc

SEQ ID NO: 69606 - RNA, 20 nt, Artificial Sequence
  MKO10069606_B_Aadau
  gRNA
cuccaauacucuccaagcua

SEQ ID NO: 69607 - RNA, 20 nt, Artificial Sequence
  MKO10069607_B_Aaed1
  gRNA
aucaucauaccaucauauug

SEQ ID NO: 69608 - RNA, 20 nt, Artificial Sequence
  MKO10069608_B_Aaed1
  gRNA
ucugaaggcuucccgagagc

SEQ ID NO: 69609 - RNA, 20 nt, Artificial Sequence
  MKO10069609_B_Aaed1
  gRNA
uagccuuucugcaaacugac

SEQ ID NO: 69610 - RNA, 20 nt, Artificial Sequence
  MKO10069610_B_Aagab
  gRNA
uuuaggaauaaaccgacaac

SEQ ID NO: 69611 - RNA, 20 nt, Artificial Sequence
  MKO10069611_B_Aagab
  gRNA
accacucuucaucacgacau

SEQ ID NO: 69612 - RNA, 20 nt, Artificial Sequence
  MKO10069612_B_Aagab
  gRNA
cgcuuuacaccuguagauuc

SEQ ID NO: 69613 - RNA, 20 nt, Artificial Sequence
  MKO10069613_B_Aak1
  gRNA
guugacaaacauacguuuca

SEQ ID NO: 69614 - RNA, 20 nt, Artificial Sequence
  MKO10069614_B_Aak1
  gRNA
uguucacagagagaccuauc

SEQ ID NO: 69615 - RNA, 20 nt, Artificial Sequence
  MKO10069615_B_Aak1
  gRNA
augaaccagcgucuccagac

SEQ ID NO: 69616 - RNA, 20 nt, Artificial Sequence
  MKO10069616_B_Aamdc
  gRNA
caaggcauuauacuccuuca

SEQ ID NO: 69617 - RNA, 20 nt, Artificial Sequence
  MKO10069617_B_Aamdc
  gRNA
gggguacagacucuugugau

SEQ ID NO: 69618 - RNA, 20 nt, Artificial Sequence
  MKO10069618_B_Aamdc
  gRNA
ucccaagcccgacugccucc

SEQ ID NO: 69619 - RNA, 20 nt, Artificial Sequence
  MKO10069619_B_Aamp
  gRNA
aucaccgagccuccacacga

SEQ ID NO: 69620 - RNA, 20 nt, Artificial Sequence
  MKO10069620_B_Aamp
  gRNA
aagacgacaaggccuucgug

SEQ ID NO: 69621 - RNA, 20 nt, Artificial Sequence
  MKO10069621_B_Aamp
  gRNA
cagucacgauuccacccuag

SEQ ID NO: 69622 - RNA, 20 nt, Artificial Sequence
  MKO10069622_B_Aanau
  gRNA
ccagugcguuugagauugag

SEQ ID NO: 69623 - RNA, 20 nt, Artificial Sequence
  MKO10069623_B_Aanau
  gRNA
cccucuacuuggaugagauc

SEQ ID NO: 69624 - RNA, 20 nt, Artificial Sequence
  MKO10069624_B_Aanau
  gRNA
ccuucaucauuggcucgcug

SEQ ID NO: 69625 - RNA, 20 nt, Artificial Sequence
  MKO10069625_B_Aar2
  gRNA
accugacuaagaaguuccgc

SEQ ID NO: 69626 - RNA, 20 nt, Artificial Sequence
  MKO10069626_B_Aar2
  gRNA
uagcccggcugcccgagaug

SEQ ID NO: 69627 - RNA, 20 nt, Artificial Sequence
  MKO10069627_B_Aar2
  gRNA
aguacucaccuguaagguac

SEQ ID NO: 69628 - RNA, 20 nt, Artificial Sequence
  MKO10069628_B_Aard
  gRNA
ccacuaugcgcuuccacacu

SEQ ID NO: 69629 - RNA, 20 nt, Artificial Sequence
  MKO10069629_B_Aard
  gRNA
gcgugccgccgcccgcugaa

SEQ ID NO: 69630 - RNA, 20 nt, Artificial Sequence
  MKO10069630_B_Aard
  gRNA
cacuucgaugccgaugcgcc

SEQ ID NO: 69631 - RNA, 20 nt, Artificial Sequence
  MKO10069631_B_Aars2
  gRNA
uggucuucaugcaacacuac

SEQ ID NO: 69632 - RNA, 20 nt, Artificial Sequence
  MKO10069632_B_Aars2
  gRNA
gaucacgccccacauccucc

SEQ ID NO: 69633 - RNA, 20 nt, Artificial Sequence
  MKO10069633_B_Aars2
  gRNA
uccgaaggagagcacacggc

SEQ ID NO: 69634 - RNA, 20 nt, Artificial Sequence
  MKO10069634_B_Aarsd1
  gRNA
uaauaccugucccccgcccu

SEQ ID NO: 69635 - RNA, 20 nt, Artificial Sequence
  MKO10069635_B_Aarsd1
  gRNA
uugucuucagcccgaagaga

SEQ ID NO: 69636 - RNA, 20 nt, Artificial Sequence
  MKO10069636_B_Aarsd1
  gRNA
uccggguggacugggagcgg

SEQ ID NO: 69637 - RNA, 20 nt, Artificial Sequence
  MKO10069637_B_Aars
  gRNA
uucugaauggcuucgaagua

SEQ ID NO: 69638 - RNA, 20 nt, Artificial Sequence
  MKO10069638_B_Aars
  gRNA
cugucauucagggagucgga

SEQ ID NO: 69639 - RNA, 20 nt, Artificial Sequence
  MKO10069639_B_Aars
  gRNA
cguugugcuugcccccagcu

SEQ ID NO: 69640 - RNA, 20 nt, Artificial Sequence
  MKO10069640_B_Aasdhppt
  gRNA
aaaucccaauccaacuccaa

SEQ ID NO: 69641 - RNA, 20 nt, Artificial Sequence
  MKO10069641_B_Aasdhppt
  gRNA
uucaugauaugaaagaauuc

SEQ ID NO: 69642 - RNA, 20 nt, Artificial Sequence
  MKO10069642_B_Aasdhppt
  gRNA
uaacagccacugcaacaaaa

SEQ ID NO: 69643 - RNA, 20 nt, Artificial Sequence
  MKO10069643_B_Aasdh
  gRNA
cgcugaccauccucaaaagc

SEQ ID NO: 69644 - RNA, 20 nt, Artificial Sequence
  MKO10069644_B_Aasdh
  gRNA
cagaaguuggcacgauaagc

SEQ ID NO: 69645 - RNA, 20 nt, Artificial Sequence
  MKO10069645_B_Aasdh
  gRNA
acaggaccuaccggaagugc

SEQ ID NO: 69646 - RNA, 20 nt, Artificial Sequence
  MKO10069646_B_Aass
  gRNA
cccuuaacguuugucuucac

SEQ ID NO: 69647 - RNA, 20 nt, Artificial Sequence
  MKO10069647_B_Aass
  gRNA
ugcguccccaggaguauguc

SEQ ID NO: 69648 - RNA, 20 nt, Artificial Sequence
  MKO10069648_B_Aass
  gRNA
cccugugaagacaaacguua

SEQ ID NO: 69649 - RNA, 20 nt, Artificial Sequence
  MKO10069649_B_Aauf
  gRNA
gauguugacgaagacuuaga

SEQ ID NO: 69650 - RNA, 20 nt, Artificial Sequence
  MKO10069650_B_Aauf
  gRNA
aucugguugaggcaacugau

SEQ ID NO: 69651 - RNA, 20 nt, Artificial Sequence
  MKO10069651_B_Aauf
  gRNA
agcauugugggaccagcucu

SEQ ID NO: 69652 - RNA, 20 nt, Artificial Sequence
  MKO10069652_B_Aauk
  gRNA
ugccgcccuucuuacaacac

SEQ ID NO: 69653 - RNA, 20 nt, Artificial Sequence
  MKO10069653_B_Aauk
  gRNA
gagguacacucgggcgucag

SEQ ID NO: 69654 - RNA, 20 nt, Artificial Sequence
  MKO10069654_B_Aauk
  gRNA
agauuggccacggcugguuu

SEQ ID NO: 69655 - RNA, 20 nt, Artificial Sequence
  MKO10069655_B_Abau
  gRNA
gguuggcucaccuuagaucu

SEQ ID NO: 69656 - RNA, 20 nt, Artificial Sequence
  MKO10069656_B_Abau
  gRNA
agcggcuuggcugauauauc

SEQ ID NO: 69657 - RNA, 20 nt, Artificial Sequence
  MKO10069657_B_Abau
  gRNA
gaaacagcugaacacaaucc

SEQ ID NO: 69658 - RNA, 20 nt, Artificial Sequence
  MKO10069658_B_Abca12
  gRNA
caauugcuuacacgcauccu

SEQ ID NO: 69659 - RNA, 20 nt, Artificial Sequence
  MKO10069659_B_Abca12
  gRNA
guuccuuccaaaucauagcu

SEQ ID NO: 69660 - RNA, 20 nt, Artificial Sequence
  MKO10069660_B_Abca12
  gRNA
gauaaauugcugucccucuu

SEQ ID NO: 69661 - RNA, 20 nt, Artificial Sequence
  MKO10069661_B_Abca13
  gRNA
acggccagaagaacucagcc

SEQ ID NO: 69662 - RNA, 20 nt, Artificial Sequence
  MKO10069662_B_Abca13
  gRNA
guacugucagaaucaugaac

SEQ ID NO: 69663 - RNA, 20 nt, Artificial Sequence
  MKO10069663_B_Abca13
  gRNA
uuuaaacgagauucaggauc

SEQ ID NO: 69664 - RNA, 20 nt, Artificial Sequence
  MKO10069664_B_Abca14
  gRNA
guaaaauauaguuugcgcuu

SEQ ID NO: 69665 - RNA, 20 nt, Artificial Sequence
  MKO10069665_B_Abca14
  gRNA
cggaacuucuuggaaaacga

SEQ ID NO: 69666 - RNA, 20 nt, Artificial Sequence
  MKO10069666_B_Abca14
  gRNA
cauaguugggaccauuaugc

SEQ ID NO: 69667 - RNA, 20 nt, Artificial Sequence
  MKO10069667_B_Abca15
  gRNA
cuuucauucuuugcgucuug

SEQ ID NO: 69668 - RNA, 20 nt, Artificial Sequence
  MKO10069668_B_Abca15
  gRNA
ggcacauaagccaacuccca

SEQ ID NO: 69669 - RNA, 20 nt, Artificial Sequence
  MKO10069669_B_Abca15
  gRNA
uuaugugccuuccaacauca

SEQ ID NO: 69670 - RNA, 20 nt, Artificial Sequence
  MKO10069670_B_Abca16
  gRNA
acaggaguaccagcucauaa

SEQ ID NO: 69671 - RNA, 20 nt, Artificial Sequence
  MKO10069671_B_Abca16
  gRNA
aaaucgacacugugauacag

SEQ ID NO: 69672 - RNA, 20 nt, Artificial Sequence
  MKO10069672_B_Abca16
  gRNA
gcgauccauuguguuugaaa

SEQ ID NO: 69673 - RNA, 20 nt, Artificial Sequence
  MKO10069673_B_Abca17
  gRNA
ccgcauaaucgcuuugucua

SEQ ID NO: 69674 - RNA, 20 nt, Artificial Sequence
  MKO10069674_B_Abca17
  gRNA
gaagucaucuaccaacuacc

SEQ ID NO: 69675 - RNA, 20 nt, Artificial Sequence
  MKO10069675_B_Abca17
  gRNA
uuucuuaccacaaguggcaa

SEQ ID NO: 69676 - RNA, 20 nt, Artificial Sequence
  MKO10069676_B_Abca1
  gRNA
agccugcugcaggcgaaugu

SEQ ID NO: 69677 - RNA, 20 nt, Artificial Sequence
  MKO10069677_B_Abca1
  gRNA
gaccaacauucgccugcagc

SEQ ID NO: 69678 - RNA, 20 nt, Artificial Sequence
  MKO10069678_B_Abca1
  gRNA
aauaaagccaugccgucugc

SEQ ID NO: 69679 - RNA, 20 nt, Artificial Sequence
  MKO10069679_B_Abca2
  gRNA
gagggcuugggccgugcugu

SEQ ID NO: 69680 - RNA, 20 nt, Artificial Sequence
  MKO10069680_B_Abca2
  gRNA
ucaccucggaaggguccaca

SEQ ID NO: 69681 - RNA, 20 nt, Artificial Sequence
  MKO10069681_B_Abca2
  gRNA
acguggaguuggcauauugc

SEQ ID NO: 69682 - RNA, 20 nt, Artificial Sequence
  MKO10069682_B_Abca3
  gRNA
ccaucacggagacggugaaa

SEQ ID NO: 69683 - RNA, 20 nt, Artificial Sequence
  MKO10069683_B_Abca3
  gRNA
ucacucucaccgccagcggc

SEQ ID NO: 69684 - RNA, 20 nt, Artificial Sequence
  MKO10069684_B_Abca3
  gRNA
caaccacuccuccagcgugc

SEQ ID NO: 69685 - RNA, 20 nt, Artificial Sequence
  MKO10069685_B_Abca4
  gRNA
gguguccaugaacugcgaca

SEQ ID NO: 69686 - RNA, 20 nt, Artificial Sequence
  MKO10069686_B_Abca4
  gRNA
uuuccagauucgcuuuguag

SEQ ID NO: 69687 - RNA, 20 nt, Artificial Sequence
  MKO10069687_B_Abca4
  gRNA
gaugggcaaccgagucagac

SEQ ID NO: 69688 - RNA, 20 nt, Artificial Sequence
  MKO10069688_B_Abca5
  gRNA
gagauugacaccuucccgcg

SEQ ID NO: 69689 - RNA, 20 nt, Artificial Sequence
  MKO10069689_B_Abca5
  gRNA
ucuaaguccagcaacuucgu

SEQ ID NO: 69690 - RNA, 20 nt, Artificial Sequence
  MKO10069690_B_Abca5
  gRNA
gauagaugcugccauuauac

SEQ ID NO: 69691 - RNA, 20 nt, Artificial Sequence
  MKO10069691_B_Abca6
  gRNA
gaggagcugauguccaucga

SEQ ID NO: 69692 - RNA, 20 nt, Artificial Sequence
  MKO10069692_B_Abca6
  gRNA
uggagcauaccaauuauuau

SEQ ID NO: 69693 - RNA, 20 nt, Artificial Sequence
  MKO10069693_B_Abca6
  gRNA
aguucuucugcacaauauac

SEQ ID NO: 69694 - RNA, 20 nt, Artificial Sequence
  MKO10069694_B_Abca7
  gRNA
ucacauucgugaugcuccag

SEQ ID NO: 69695 - RNA, 20 nt, Artificial Sequence
  MKO10069695_B_Abca7
  gRNA
ccuccccucagcacgaccac

SEQ ID NO: 69696 - RNA, 20 nt, Artificial Sequence
  MKO10069696_B_Abca7
  gRNA
uccccagauccaacuacuag

SEQ ID NO: 69697 - RNA, 20 nt, Artificial Sequence
  MKO10069697_B_Abca8a
  gRNA
aaugcguuucagugauguag

SEQ ID NO: 69698 - RNA, 20 nt, Artificial Sequence
  MKO10069698_B_Abca8a
  gRNA
aacaccagcugagauauaau

SEQ ID NO: 69699 - RNA, 20 nt, Artificial Sequence
  MKO10069699_B_Abca8a
  gRNA
gugguccugaugcuccuuua

SEQ ID NO: 69700 - RNA, 20 nt, Artificial Sequence
  MKO10069700_B_Abca8b
  gRNA
accagaaugcuggaucucga

SEQ ID NO: 69701 - RNA, 20 nt, Artificial Sequence
  MKO10069701_B_Abca8b
  gRNA
gucgauucuuucagacaauc

SEQ ID NO: 69702 - RNA, 20 nt, Artificial Sequence
  MKO10069702_B_Abca8b
  gRNA
acugucugauagccauauuc

SEQ ID NO: 69703 - RNA, 20 nt, Artificial Sequence
  MKO10069703_B_Abca9
  gRNA
cucaaugauaccagcauuaa

SEQ ID NO: 69704 - RNA, 20 nt, Artificial Sequence
  MKO10069704_B_Abca9
  gRNA
ugacgcuccugaaaugucug

SEQ ID NO: 69705 - RNA, 20 nt, Artificial Sequence
  MKO10069705_B_Abca9
  gRNA
auuuaagucuagcucauuca

SEQ ID NO: 69706 - RNA, 20 nt, Artificial Sequence
  MKO10069706_B_Abcb10
  gRNA
gcuauggcgauagcuugacu

SEQ ID NO: 69707 - RNA, 20 nt, Artificial Sequence
  MKO10069707_B_Abcb10
  gRNA
auaagaaccauccgagcuuu

SEQ ID NO: 69708 - RNA, 20 nt, Artificial Sequence
  MKO10069708_B_Abcb10
  gRNA
aucgcccauaaaucacagcg

SEQ ID NO: 69709 - RNA, 20 nt, Artificial Sequence
  MKO10069709_B_Abcb11
  gRNA
agugugugcgcauugcucca

SEQ ID NO: 69710 - RNA, 20 nt, Artificial Sequence
  MKO10069710_B_Abcb11
  gRNA
uacuaacuugaaaguauccu

SEQ ID NO: 69711 - RNA, 20 nt, Artificial Sequence
  MKO10069711_B_Abcb11
  gRNA
agguuacaagauaagaagaa

SEQ ID NO: 69712 - RNA, 20 nt, Artificial Sequence
  MKO10069712_B_Abcb1a
  gRNA
auuguaagcacacugacugc

SEQ ID NO: 69713 - RNA, 20 nt, Artificial Sequence
  MKO10069713_B_Abcb1a
  gRNA
aagagccauguuugccaaac

SEQ ID NO: 69714 - RNA, 20 nt, Artificial Sequence
  MKO10069714_B_Abcb1a
  gRNA
agguacgccuacuauuacac

SEQ ID NO: 69715 - RNA, 20 nt, Artificial Sequence
  MKO10069715_B_Abcb1b
  gRNA
gcugaugaucagaguacugu

SEQ ID NO: 69716 - RNA, 20 nt, Artificial Sequence
  MKO10069716_B_Abcb1b
  gRNA
auuacuuccccucuugaugc

SEQ ID NO: 69717 - RNA, 20 nt, Artificial Sequence
  MKO10069717_B_Abcb1b
  gRNA
agauacgccuacuauuacac

SEQ ID NO: 69718 - RNA, 20 nt, Artificial Sequence
  MKO10069718_B_Abcb4
  gRNA
uauccugccagucagaguau

SEQ ID NO: 69719 - RNA, 20 nt, Artificial Sequence
  MKO10069719_B_Abcb4
  gRNA
cacaacuuaccagugucaac

SEQ ID NO: 69720 - RNA, 20 nt, Artificial Sequence
  MKO10069720_B_Abcb4
  gRNA
ucauugucaaugcuaaaucc

SEQ ID NO: 69721 - RNA, 20 nt, Artificial Sequence
  MKO10069721_B_Abcb5
  gRNA
gcaagaacaagugccuaaag

SEQ ID NO: 69722 - RNA, 20 nt, Artificial Sequence
  MKO10069722_B_Abcb5
  gRNA
agguugacucuauauuauau

SEQ ID NO: 69723 - RNA, 20 nt, Artificial Sequence
  MKO10069723_B_Abcb5
  gRNA
acagcuugauuucccacuuu

SEQ ID NO: 69724 - RNA, 20 nt, Artificial Sequence
  MKO10069724_B_Abcb6
  gRNA
ggucucuccagguggaucgu

SEQ ID NO: 69725 - RNA, 20 nt, Artificial Sequence
  MKO10069725_B_Abcb6
  gRNA
gaacguguagaguauaagac

SEQ ID NO: 69726 - RNA, 20 nt, Artificial Sequence
  MKO10069726_B_Abcb6
  gRNA
ucacauaacgcaggacccac

SEQ ID NO: 69727 - RNA, 20 nt, Artificial Sequence
  MKO10069727_B_Abcb7
  gRNA
agacagccucaaccagaugu

SEQ ID NO: 69728 - RNA, 20 nt, Artificial Sequence
  MKO10069728_B_Abcb7
  gRNA
acaguuacuagaugcuacaa

SEQ ID NO: 69729 - RNA, 20 nt, Artificial Sequence
  MKO10069729_B_Abcb7
  gRNA
uguagcaucuaguaacuguc

SEQ ID NO: 69730 - RNA, 20 nt, Artificial Sequence
  MKO10069730_B_Abcb8
  gRNA
uuccaauuaaagcgcagcuc

SEQ ID NO: 69731 - RNA, 20 nt, Artificial Sequence
  MKO10069731_B_Abcb8
  gRNA
cagcagcacuagguauccaa

SEQ ID NO: 69732 - RNA, 20 nt, Artificial Sequence
  MKO10069732_B_Abcb8
  gRNA
uggccaugcgcucaccaaug

SEQ ID NO: 69733 - RNA, 20 nt, Artificial Sequence
  MKO10069733_B_Abcb9
  gRNA
ccagacugaacauucgccuc

SEQ ID NO: 69734 - RNA, 20 nt, Artificial Sequence
  MKO10069734_B_Abcb9
  gRNA
acaccugcugaagcuuccgc

SEQ ID NO: 69735 - RNA, 20 nt, Artificial Sequence
  MKO10069735_B_Abcb9
  gRNA
cggccuacauguccuacguc

SEQ ID NO: 69736 - RNA, 20 nt, Artificial Sequence
  MKO10069736_B_Abcc10
  gRNA
cacguagguguuuacagcgc

SEQ ID NO: 69737 - RNA, 20 nt, Artificial Sequence
  MKO10069737_B_Abcc10
  gRNA
ggugacugaugaaggucuuc

SEQ ID NO: 69738 - RNA, 20 nt, Artificial Sequence
  MKO10069738_B_Abcc10
  gRNA
ggcucugggggaccgaguga

SEQ ID NO: 69739 - RNA, 20 nt, Artificial Sequence
  MKO10069739_B_Abcc12
  gRNA
uuguaacuucgaaucaucac

SEQ ID NO: 69740 - RNA, 20 nt, Artificial Sequence
  MKO10069740_B_Abcc12
  gRNA
ucucauauucaucccgaucc

SEQ ID NO: 69741 - RNA, 20 nt, Artificial Sequence
  MKO10069741_B_Abcc12
  gRNA
aggcugccaugacgaugcac

SEQ ID NO: 69742 - RNA, 20 nt, Artificial Sequence
  MKO10069742_B_Abcc1
  gRNA
ugaccaguaacacuggggcu

SEQ ID NO: 69743 - RNA, 20 nt, Artificial Sequence
  MKO10069743_B_Abcc1
  gRNA
gugucaucuggauguagccc

SEQ ID NO: 69744 - RNA, 20 nt, Artificial Sequence
  MKO10069744_B_Abcc1
  gRNA
gaccguguucugaaagcacu

SEQ ID NO: 69745 - RNA, 20 nt, Artificial Sequence
  MKO10069745_B_Abcc2
  gRNA
aaccauaggagacgaagaac

SEQ ID NO: 69746 - RNA, 20 nt, Artificial Sequence
  MKO10069746_B_Abcc2
  gRNA
guuacuguaccugcuuggca

SEQ ID NO: 69747 - RNA, 20 nt, Artificial Sequence
  MKO10069747_B_Abcc2
  gRNA
ugagucgcuugauucugaaa

SEQ ID NO: 69748 - RNA, 20 nt, Artificial Sequence
  MKO10069748_B_Abcc3
  gRNA
cuuugcuaauccaguacgag

SEQ ID NO: 69749 - RNA, 20 nt, Artificial Sequence
  MKO10069749_B_Abcc3
  gRNA
aggcggcuucuccuugaagc

SEQ ID NO: 69750 - RNA, 20 nt, Artificial Sequence
  MKO10069750_B_Abcc3
  gRNA
gaagccgccuuuguucuccc

SEQ ID NO: 69751 - RNA, 20 nt, Artificial Sequence
  MKO10069751_B_Abcc4
  gRNA
ggcacuccgguuaaguaacu

SEQ ID NO: 69752 - RNA, 20 nt, Artificial Sequence
  MKO10069752_B_Abcc4
  gRNA
agaagaacacgcgcgagcag

SEQ ID NO: 69753 - RNA, 20 nt, Artificial Sequence
  MKO10069753_B_Abcc4
  gRNA
gaagaucgcucaaagcaccu

SEQ ID NO: 69754 - RNA, 20 nt, Artificial Sequence
  MKO10069754_B_Abcc5
  gRNA
cacucaccgaucuuguucuc

SEQ ID NO: 69755 - RNA, 20 nt, Artificial Sequence
  MKO10069755_B_Abcc5
  gRNA
cccccuucuugugaaccacu

SEQ ID NO: 69756 - RNA, 20 nt, Artificial Sequence
  MKO10069756_B_Abcc5
  gRNA
aaugcuccucguccagaauu

SEQ ID NO: 69757 - RNA, 20 nt, Artificial Sequence
  MKO10069757_B_Abcc6
  gRNA
uucuaauucacccuacugug

SEQ ID NO: 69758 - RNA, 20 nt, Artificial Sequence
  MKO10069758_B_Abcc6
  gRNA
aggaagggaguccggucauc

SEQ ID NO: 69759 - RNA, 20 nt, Artificial Sequence
  MKO10069759_B_Abcc6
  gRNA
ugccaccuuucugauccaca

SEQ ID NO: 69760 - RNA, 20 nt, Artificial Sequence
  MKO10069760_B_Abcc8
  gRNA
aaguucuacgaccacgccau

SEQ ID NO: 69761 - RNA, 20 nt, Artificial Sequence
  MKO10069761_B_Abcc8
  gRNA
ccucagcgaucucacacacc

SEQ ID NO: 69762 - RNA, 20 nt, Artificial Sequence
  MKO10069762_B_Abcc8
  gRNA
guugugauaguagaccacag

SEQ ID NO: 69763 - RNA, 20 nt, Artificial Sequence
  MKO10069763_B_Abcc9
  gRNA
aauguuaugauaauagacga

SEQ ID NO: 69764 - RNA, 20 nt, Artificial Sequence
  MKO10069764_B_Abcc9
  gRNA
cuccugugaugcagaagcgc

SEQ ID NO: 69765 - RNA, 20 nt, Artificial Sequence
  MKO10069765_B_Abcc9
  gRNA
gaccugcgcuucugcaucac

SEQ ID NO: 69766 - RNA, 20 nt, Artificial Sequence
  MKO10069766_B_Abcd1
  gRNA
ucucucuacaggccaaguug

SEQ ID NO: 69767 - RNA, 20 nt, Artificial Sequence
  MKO10069767_B_Abcd1
  gRNA
cuugaccuacccugauguug

SEQ ID NO: 69768 - RNA, 20 nt, Artificial Sequence
  MKO10069768_B_Abcd1
  gRNA
gaggggccccugaagaucca

SEQ ID NO: 69769 - RNA, 20 nt, Artificial Sequence
  MKO10069769_B_Abcd2
  gRNA
cagcuguggacuaauuaugg

SEQ ID NO: 69770 - RNA, 20 nt, Artificial Sequence
  MKO10069770_B_Abcd2
  gRNA
caugauguaccauaaacguu

SEQ ID NO: 69771 - RNA, 20 nt, Artificial Sequence
  MKO10069771_B_Abcd2
  gRNA
gucuucgaugaagugaagag

SEQ ID NO: 69772 - RNA, 20 nt, Artificial Sequence
  MKO10069772_B_Abcd3
  gRNA
accgccauuacagaauaaug

SEQ ID NO: 69773 - RNA, 20 nt, Artificial Sequence
  MKO10069773_B_Abcd3
  gRNA
cucacagauccuaaaaauua

SEQ ID NO: 69774 - RNA, 20 nt, Artificial Sequence
  MKO10069774_B_Abcd3
  gRNA
uuccuuugcaguaagaaaag

SEQ ID NO: 69775 - RNA, 20 nt, Artificial Sequence
  MKO10069775_B_Abcd4
  gRNA
ucuguauccucacgaaccuc

SEQ ID NO: 69776 - RNA, 20 nt, Artificial Sequence
  MKO10069776_B_Abcd4
  gRNA
auuuaaggcacugaccuugc

SEQ ID NO: 69777 - RNA, 20 nt, Artificial Sequence
  MKO10069777_B_Abcd4
  gRNA
gcucuugugcgugacccucc

SEQ ID NO: 69778 - RNA, 20 nt, Artificial Sequence
  MKO10069778_B_Abce1
  gRNA
caaacugaccuuugcagccu

SEQ ID NO: 69779 - RNA, 20 nt, Artificial Sequence
  MKO10069779_B_Abce1
  gRNA
auuucugaaacucucuguau

SEQ ID NO: 69780 - RNA, 20 nt, Artificial Sequence
  MKO10069780_B_Abce1
  gRNA
aauauaccugugaagcuuga

SEQ ID NO: 69781 - RNA, 20 nt, Artificial Sequence
  MKO10069781_B_Abcf1
  gRNA
gugccugcccccauaccccg

SEQ ID NO: 69782 - RNA, 20 nt, Artificial Sequence
  MKO10069782_B_Abcf1
  gRNA
ccagacaaaguagugaagaa

SEQ ID NO: 69783 - RNA, 20 nt, Artificial Sequence
  MKO10069783_B_Abcf1
  gRNA
ggaaaaauugcagaaggaga

SEQ ID NO: 69784 - RNA, 20 nt, Artificial Sequence
  MKO10069784_B_Abcf2
  gRNA
ucacaguuucaagcgcaucc

SEQ ID NO: 69785 - RNA, 20 nt, Artificial Sequence
  MKO10069785_B_Abcf2
  gRNA
gaggcaucucacgagucaga

SEQ ID NO: 69786 - RNA, 20 nt, Artificial Sequence
  MKO10069786_B_Abcf2
  gRNA
gcugcugcucgagcugucac

SEQ ID NO: 69787 - RNA, 20 nt, Artificial Sequence
  MKO10069787_B_Abcf3
  gRNA
cauccaguugucgaagauaa

SEQ ID NO: 69788 - RNA, 20 nt, Artificial Sequence
  MKO10069788_B_Abcf3
  gRNA
gacugugacaccaaacuucc

SEQ ID NO: 69789 - RNA, 20 nt, Artificial Sequence
  MKO10069789_B_Abcf3
  gRNA
ccaaacucacagaggguugc

SEQ ID NO: 69790 - RNA, 20 nt, Artificial Sequence
  MKO10069790_B_Abcg1
  gRNA
agaccuuccggaagcagcgc

SEQ ID NO: 69791 - RNA, 20 nt, Artificial Sequence
  MKO10069791_B_Abcg1
  gRNA
guccgcgcaucugaagcugc

SEQ ID NO: 69792 - RNA, 20 nt, Artificial Sequence
  MKO10069792_B_Abcg1
  gRNA
guggccaucauggguccuuc

SEQ ID NO: 69793 - RNA, 20 nt, Artificial Sequence
  MKO10069793_B_Abcg2
  gRNA
ccuuaaggaugacguuguga

SEQ ID NO: 69794 - RNA, 20 nt, Artificial Sequence
  MKO10069794_B_Abcg2
  gRNA
cccagaauagcauuaaggcc

SEQ ID NO: 69795 - RNA, 20 nt, Artificial Sequence
  MKO10069795_B_Abcg2
  gRNA
acaucuccagauaaucccuu

SEQ ID NO: 69796 - RNA, 20 nt, Artificial Sequence
  MKO10069796_B_Abcg3
  gRNA
agccuagauccaaagaacuc

SEQ ID NO: 69797 - RNA, 20 nt, Artificial Sequence
  MKO10069797_B_Abcg3
  gRNA
cccauaauggcauugaggcc

SEQ ID NO: 69798 - RNA, 20 nt, Artificial Sequence
  MKO10069798_B_Abcg3
  gRNA
gaacucuaaauugucucuca

SEQ ID NO: 69799 - RNA, 20 nt, Artificial Sequence
  MKO10069799_B_Abcg4
  gRNA
uucugucgccgagagcugau

SEQ ID NO: 69800 - RNA, 20 nt, Artificial Sequence
  MKO10069800_B_Abcg4
  gRNA
ggcagauccugguuaacggg

SEQ ID NO: 69801 - RNA, 20 nt, Artificial Sequence
  MKO10069801_B_Abcg4
  gRNA
aucaugggccccucuggggc

SEQ ID NO: 69802 - RNA, 20 nt, Artificial Sequence
  MKO10069802_B_Abcg5
  gRNA
cacgcccaccugcaggacgu

SEQ ID NO: 69803 - RNA, 20 nt, Artificial Sequence
  MKO10069803_B_Abcg5
  gRNA
cgcggacuucuacaacaaga

SEQ ID NO: 69804 - RNA, 20 nt, Artificial Sequence
  MKO10069804_B_Abcg5
  gRNA
uuccuuuaaagcaaccgugu

SEQ ID NO: 69805 - RNA, 20 nt, Artificial Sequence
  MKO10069805_B_Abcg8
  gRNA
gagcgccgacgagugagcau

SEQ ID NO: 69806 - RNA, 20 nt, Artificial Sequence
  MKO10069806_B_Abcg8
  gRNA
acagguggacaucgccucuc

SEQ ID NO: 69807 - RNA, 20 nt, Artificial Sequence
  MKO10069807_B_Abcg8
  gRNA
cagacuguugucacuuuccg

SEQ ID NO: 69808 - RNA, 20 nt, Artificial Sequence
  MKO10069808_B_Abhd10
  gRNA
auacuugaugacguagcuga

SEQ ID NO: 69809 - RNA, 20 nt, Artificial Sequence
  MKO10069809_B_Abhd10
  gRNA
uucagcuacgucaucaagua

SEQ ID NO: 69810 - RNA, 20 nt, Artificial Sequence
  MKO10069810_B_Abhd10
  gRNA
cuauuucauccuucaugccg

SEQ ID NO: 69811 - RNA, 20 nt, Artificial Sequence
  MKO10069811_B_Abhd11
  gRNA
cuggugcccugcguccucgu

SEQ ID NO: 69812 - RNA, 20 nt, Artificial Sequence
  MKO10069812_B_Abhd11
  gRNA
accaaucguuccacaacauc

SEQ ID NO: 69813 - RNA, 20 nt, Artificial Sequence
  MKO10069813_B_Abhd11
  gRNA
cccaucgcaggugcugacgg

SEQ ID NO: 69814 - RNA, 20 nt, Artificial Sequence
  MKO10069814_B_Abhd12b
  gRNA
ccagcaucgacacuuccccu

SEQ ID NO: 69815 - RNA, 20 nt, Artificial Sequence
  MKO10069815_B_Abhd12b
  gRNA
ucucuuuaaauccacgagaa

SEQ ID NO: 69816 - RNA, 20 nt, Artificial Sequence
  MKO10069816_B_Abhd12b
  gRNA
cuucacgaguaaaucuuuaa

SEQ ID NO: 69817 - RNA, 20 nt, Artificial Sequence
  MKO10069817_B_Abhd12
  gRNA
caauuacuaccuccagccag

SEQ ID NO: 69818 - RNA, 20 nt, Artificial Sequence
  MKO10069818_B_Abhd12
  gRNA
augaugugacuauuggaguc

SEQ ID NO: 69819 - RNA, 20 nt, Artificial Sequence
  MKO10069819_B_Abhd12
  gRNA
cucauagacgaaagagccug

SEQ ID NO: 69820 - RNA, 20 nt, Artificial Sequence
  MKO10069820_B_Abhd13
  gRNA
uuaauauucguaucaauugc

SEQ ID NO: 69821 - RNA, 20 nt, Artificial Sequence
  MKO10069821_B_Abhd13
  gRNA
accagcauuagcagugcguu

SEQ ID NO: 69822 - RNA, 20 nt, Artificial Sequence
  MKO10069822_B_Abhd13
  gRNA
ucuacgagcucucuccaucc

SEQ ID NO: 69823 - RNA, 20 nt, Artificial Sequence
  MKO10069823_B_Abhd14a
  gRNA
ugggcacgaauccacguagc

SEQ ID NO: 69824 - RNA, 20 nt, Artificial Sequence
  MKO10069824_B_Abhd14a
  gRNA
uuguuccugugcauaauucc

SEQ ID NO: 69825 - RNA, 20 nt, Artificial Sequence
  MKO10069825_B_Abhd14a
  gRNA
accccaacucuuauccugua

SEQ ID NO: 69826 - RNA, 20 nt, Artificial Sequence
  MKO10069826_B_Abhd14b
  gRNA
caagccugaugaguggcaua

SEQ ID NO: 69827 - RNA, 20 nt, Artificial Sequence
  MKO10069827_B_Abhd14b
  gRNA
ccuugauggugcccucaugc

SEQ ID NO: 69828 - RNA, 20 nt, Artificial Sequence
  MKO10069828_B_Abhd14b
  gRNA
ccagcaugagggcaccauca

SEQ ID NO: 69829 - RNA, 20 nt, Artificial Sequence
  MKO10069829_B_Abhd15
  gRNA
gggaucucaacgacccacuc

SEQ ID NO: 69830 - RNA, 20 nt, Artificial Sequence
  MKO10069830_B_Abhd15
  gRNA
ccgcggaucaguucagcgac

SEQ ID NO: 69831 - RNA, 20 nt, Artificial Sequence
  MKO10069831_B_Abhd15
  gRNA
aacccucgcucaccgcgaac

SEQ ID NO: 69832 - RNA, 20 nt, Artificial Sequence
  MKO10069832_B_Abhd16a
  gRNA
ccgacaguucaucaccaucu

SEQ ID NO: 69833 - RNA, 20 nt, Artificial Sequence
  MKO10069833_B_Abhd16a
  gRNA
ucgccuucuucuacuuauac

SEQ ID NO: 69834 - RNA, 20 nt, Artificial Sequence
  MKO10069834_B_Abhd16a
  gRNA
acauugcugcugcuacuugc

SEQ ID NO: 69835 - RNA, 20 nt, Artificial Sequence
  MKO10069835_B_Abhd16b
  gRNA
gucaaucucauugccgucgc

SEQ ID NO: 69836 - RNA, 20 nt, Artificial Sequence
  MKO10069836_B_Abhd16b
  gRNA
ggcugguaguacgcacugua

SEQ ID NO: 69837 - RNA, 20 nt, Artificial Sequence
  MKO10069837_B_Abhd16b
  gRNA
acaguuacaacuuccgcagc

SEQ ID NO: 69838 - RNA, 20 nt, Artificial Sequence
  MKO10069838_B_Abhd17a
  gRNA
acgcuacgagugugcugcag

SEQ ID NO: 69839 - RNA, 20 nt, Artificial Sequence
  MKO10069839_B_Abhd17a
  gRNA
gcccgccaugaacggccugu

SEQ ID NO: 69840 - RNA, 20 nt, Artificial Sequence
  MKO10069840_B_Abhd17a
  gRNA
ggugucgaagaucacgucac

SEQ ID NO: 69841 - RNA, 20 nt, Artificial Sequence
  MKO10069841_B_Abhd17b
  gRNA
accugucagagcgagcagac

SEQ ID NO: 69842 - RNA, 20 nt, Artificial Sequence
  MKO10069842_B_Abhd17b
  gRNA
gccagucugcucgcucugac

SEQ ID NO: 69843 - RNA, 20 nt, Artificial Sequence
  MKO10069843_B_Abhd17b
  gRNA
gaaagcaacucgcauuccug

SEQ ID NO: 69844 - RNA, 20 nt, Artificial Sequence
  MKO10069844_B_Abhd17c
  gRNA
ggcugcacacucguaccgcg

SEQ ID NO: 69845 - RNA, 20 nt, Artificial Sequence
  MKO10069845_B_Abhd17c
  gRNA
gcucauacaucgccaagcca

SEQ ID NO: 69846 - RNA, 20 nt, Artificial Sequence
  MKO10069846_B_Abhd17c
  gRNA
ugccaaugcucuguccauag

SEQ ID NO: 69847 - RNA, 20 nt, Artificial Sequence
  MKO10069847_B_Abhd1
  gRNA
augauuauagaggccucguc

SEQ ID NO: 69848 - RNA, 20 nt, Artificial Sequence
  MKO10069848_B_Abhd1
  gRNA
uggcuacugccgcugaugcc

SEQ ID NO: 69849 - RNA, 20 nt, Artificial Sequence
  MKO10069849_B_Abhd1
  gRNA
cuacucccaagcuccacugc

SEQ ID NO: 69850 - RNA, 20 nt, Artificial Sequence
  MKO10069850_B_Abhd2
  gRNA
ugcacacgauguuaccaccc

SEQ ID NO: 69851 - RNA, 20 nt, Artificial Sequence
  MKO10069851_B_Abhd2
  gRNA
cuucgaccucuucgagcccc

SEQ ID NO: 69852 - RNA, 20 nt, Artificial Sequence
  MKO10069852_B_Abhd2
  gRNA
aguuguagaaccugcggcac

SEQ ID NO: 69853 - RNA, 20 nt, Artificial Sequence
  MKO10069853_B_Abhd3
  gRNA
caauaacagugcguacuaug

SEQ ID NO: 69854 - RNA, 20 nt, Artificial Sequence
  MKO10069854_B_Abhd3
  gRNA
acuuacuuccuguauugcac

SEQ ID NO: 69855 - RNA, 20 nt, Artificial Sequence
  MKO10069855_B_Abhd3
  gRNA
ccuacuaucuugcucuugcc

SEQ ID NO: 69856 - RNA, 20 nt, Artificial Sequence
  MKO10069856_B_Abhd4
  gRNA
agauccgugcaccuccaacc

SEQ ID NO: 69857 - RNA, 20 nt, Artificial Sequence
  MKO10069857_B_Abhd4
  gRNA
gcaaacuugcgcuugaaguc

SEQ ID NO: 69858 - RNA, 20 nt, Artificial Sequence
  MKO10069858_B_Abhd4
  gRNA
ggucguaggggaaagcccca

SEQ ID NO: 69859 - RNA, 20 nt, Artificial Sequence
  MKO10069859_B_Abhd5
  gRNA
uccgcaucacugucaaaccu

SEQ ID NO: 69860 - RNA, 20 nt, Artificial Sequence
  MKO10069860_B_Abhd5
  gRNA
cgugucaucuucaaacauag

SEQ ID NO: 69861 - RNA, 20 nt, Artificial Sequence
  MKO10069861_B_Abhd5
  gRNA
caaaagguccugcaauccug

SEQ ID NO: 69862 - RNA, 20 nt, Artificial Sequence
  MKO10069862_B_Abhd6
  gRNA
cugcuccuauguccgcuuca

SEQ ID NO: 69863 - RNA, 20 nt, Artificial Sequence
  MKO10069863_B_Abhd6
  gRNA
cagcaggacacacgagagac

SEQ ID NO: 69864 - RNA, 20 nt, Artificial Sequence
  MKO10069864_B_Abhd6
  gRNA
gcaaguuaaaaggauacauc

SEQ ID NO: 69865 - RNA, 20 nt, Artificial Sequence
  MKO10069865_B_Abhd8
  gRNA
ugguagaccucgucgccuuc

SEQ ID NO: 69866 - RNA, 20 nt, Artificial Sequence
  MKO10069866_B_Abhd8
  gRNA
agggccggcuuugcccgcca

SEQ ID NO: 69867 - RNA, 20 nt, Artificial Sequence
  MKO10069867_B_Abhd8
  gRNA
gugcccguagauccugcugc

SEQ ID NO: 69868 - RNA, 20 nt, Artificial Sequence
  MKO10069868_B_Abi1
  gRNA
accaccaagcccucccgugu

SEQ ID NO: 69869 - RNA, 20 nt, Artificial Sequence
  MKO10069869_B_Abi1
  gRNA
cccgacacgggagggcuugg

SEQ ID NO: 69870 - RNA, 20 nt, Artificial Sequence
  MKO10069870_B_Abi1
  gRNA
aggagaucccgucuggcaag

SEQ ID NO: 69871 - RNA, 20 nt, Artificial Sequence
  MKO10069871_B_Abi2
  gRNA
uauaacgaacuggccgcuca

SEQ ID NO: 69872 - RNA, 20 nt, Artificial Sequence
  MKO10069872_B_Abi2
  gRNA
uggcuggcgcaauaaucuua

SEQ ID NO: 69873 - RNA, 20 nt, Artificial Sequence
  MKO10069873_B_Abi2
  gRNA
uccuccguaacugugaugcc

SEQ ID NO: 69874 - RNA, 20 nt, Artificial Sequence
  MKO10069874_B_Abi3bp
  gRNA
uccagcuuuacguuugcauu

SEQ ID NO: 69875 - RNA, 20 nt, Artificial Sequence
  MKO10069875_B_Abi3bp
  gRNA
uaccugaacaugacuucuuc

SEQ ID NO: 69876 - RNA, 20 nt, Artificial Sequence
  MKO10069876_B_Abi3bp
  gRNA
aaugcacagaaauugccaaa

SEQ ID NO: 69877 - RNA, 20 nt, Artificial Sequence
  MKO10069877_B_Abi3
  gRNA
ccuuuaugcucuugcgagac

SEQ ID NO: 69878 - RNA, 20 nt, Artificial Sequence
  MKO10069878_B_Abi3
  gRNA
cacucccuaggagaccaccc

SEQ ID NO: 69879 - RNA, 20 nt, Artificial Sequence
  MKO10069879_B_Abi3
  gRNA
ugacauuggccacggaguca

SEQ ID NO: 69880 - RNA, 20 nt, Artificial Sequence
  MKO10069880_B_Abl1
  gRNA
cgcaacaagcccacuaucua

SEQ ID NO: 69881 - RNA, 20 nt, Artificial Sequence
  MKO10069881_B_Abl1
  gRNA
ucaucaccgccgcuuccuuc

SEQ ID NO: 69882 - RNA, 20 nt, Artificial Sequence
  MKO10069882_B_Abl1
  gRNA
gucucagcgaagcagcucga

SEQ ID NO: 69883 - RNA, 20 nt, Artificial Sequence
  MKO10069883_B_Abl2
  gRNA
cuucacuccacucgccauuc

SEQ ID NO: 69884 - RNA, 20 nt, Artificial Sequence
  MKO10069884_B_Abl2
  gRNA
aggcacugaaugaagcgauc

SEQ ID NO: 69885 - RNA, 20 nt, Artificial Sequence
  MKO10069885_B_Abl2
  gRNA
aacacacucaguaucacuaa

SEQ ID NO: 69886 - RNA, 20 nt, Artificial Sequence
  MKO10069886_B_Ablim1
  gRNA
ucuuuccagguucuaccgug

SEQ ID NO: 69887 - RNA, 20 nt, Artificial Sequence
  MKO10069887_B_Ablim1
  gRNA
uaugagccuuucuacacauc

SEQ ID NO: 69888 - RNA, 20 nt, Artificial Sequence
  MKO10069888_B_Ablim1
  gRNA
uccagcaucccugguucacc

SEQ ID NO: 69889 - RNA, 20 nt, Artificial Sequence
  MKO10069889_B_Ablim2
  gRNA
agcgagugccauagagccgc

SEQ ID NO: 69890 - RNA, 20 nt, Artificial Sequence
  MKO10069890_B_Ablim2
  gRNA
ccccacagugucgcagcccc

SEQ ID NO: 69891 - RNA, 20 nt, Artificial Sequence
  MKO10069891_B_Ablim2
  gRNA
ccacuucgccuucaaugaag

SEQ ID NO: 69892 - RNA, 20 nt, Artificial Sequence
  MKO10069892_B_Ablim3
  gRNA
agcagaguccguacaguccc

SEQ ID NO: 69893 - RNA, 20 nt, Artificial Sequence
  MKO10069893_B_Ablim3
  gRNA
accuuaucuccaauagggaa

SEQ ID NO: 69894 - RNA, 20 nt, Artificial Sequence
  MKO10069894_B_Ablim3
  gRNA
cacccgcugugauagcugcc

SEQ ID NO: 69895 - RNA, 20 nt, Artificial Sequence
  MKO10069895_B_Abo
  gRNA
aaaugcaacuuccuucaccu

SEQ ID NO: 69896 - RNA, 20 nt, Artificial Sequence
  MKO10069896_B_Abo
  gRNA
acucaccuagucacagcucc

SEQ ID NO: 69897 - RNA, 20 nt, Artificial Sequence
  MKO10069897_B_Abo
  gRNA
ggaaugccuaucugcagcca

SEQ ID NO: 69898 - RNA, 20 nt, Artificial Sequence
  MKO10069898_B_Abracl
  gRNA
gaugaauuuccuccaccagg

SEQ ID NO: 69899 - RNA, 20 nt, Artificial Sequence
  MKO10069899_B_Abracl
  gRNA
cacaucugucauccuggaag

SEQ ID NO: 69900 - RNA, 20 nt, Artificial Sequence
  MKO10069900_B_Abracl
  gRNA
ggaacaugaaguuaaccucc

SEQ ID NO: 69901 - RNA, 20 nt, Artificial Sequence
  MKO10069901_B_Abra
  gRNA
gugcaccaguccguguuucc

SEQ ID NO: 69902 - RNA, 20 nt, Artificial Sequence
  MKO10069902_B_Abra
  gRNA
auagucaaauucgucacuga

SEQ ID NO: 69903 - RNA, 20 nt, Artificial Sequence
  MKO10069903_B_Abra
  gRNA
cauagcccucgucucccuug

SEQ ID NO: 69904 - RNA, 20 nt, Artificial Sequence
  MKO10069904_B_Abr
  gRNA
agagaucuacauuaaccagc

SEQ ID NO: 69905 - RNA, 20 nt, Artificial Sequence
  MKO10069905_B_Abr
  gRNA
augcuuuguacacgccaagc

SEQ ID NO: 69906 - RNA, 20 nt, Artificial Sequence
  MKO10069906_B_Abr
  gRNA
ucagcccaugaaaccccuga

SEQ ID NO: 69907 - RNA, 20 nt, Artificial Sequence
  MKO10069907_B_Abt1
  gRNA
caagcguguagccaagcgag

SEQ ID NO: 69908 - RNA, 20 nt, Artificial Sequence
  MKO10069908_B_Abt1
  gRNA
cuacucggccaaauagcucc

SEQ ID NO: 69909 - RNA, 20 nt, Artificial Sequence
  MKO10069909_B_Abt1
  gRNA
cagucuacauaacacgccca

SEQ ID NO: 69910 - RNA, 20 nt, Artificial Sequence
  MKO10069910_B_Abtb1
  gRNA
cgggcccaucgcuguauccu

SEQ ID NO: 69911 - RNA, 20 nt, Artificial Sequence
  MKO10069911_B_Abtb1
  gRNA
cuuuguaggagcccgcugug

SEQ ID NO: 69912 - RNA, 20 nt, Artificial Sequence
  MKO10069912_B_Abtb1
  gRNA
ggaguuggugcgcuaccugu

SEQ ID NO: 69913 - RNA, 20 nt, Artificial Sequence
  MKO10069913_B_Abtb2
  gRNA
cugcucgcucaucguggccc

SEQ ID NO: 69914 - RNA, 20 nt, Artificial Sequence
  MKO10069914_B_Abtb2
  gRNA
ggcuuccgcaugcucaacug

SEQ ID NO: 69915 - RNA, 20 nt, Artificial Sequence
  MKO10069915_B_Abtb2
  gRNA
ccgaaguuccagcugagcau

SEQ ID NO: 69916 - RNA, 20 nt, Artificial Sequence
  MKO10069916_B_Acaa1a
  gRNA
gaggcuaaagccugagcagc

SEQ ID NO: 69917 - RNA, 20 nt, Artificial Sequence
  MKO10069917_B_Acaa1a
  gRNA
ucaccacuuaccagcaaugu

SEQ ID NO: 69918 - RNA, 20 nt, Artificial Sequence
  MKO10069918_B_Acaa1a
  gRNA
agagacuguaccuuugucua

SEQ ID NO: 69919 - RNA, 20 nt, Artificial Sequence
  MKO10069919_B_Acaa1b
  gRNA
gaagcuaaagccugagcagc

SEQ ID NO: 69920 - RNA, 20 nt, Artificial Sequence
  MKO10069920_B_Acaa1b
  gRNA
agagacuguaccuuugucua

SEQ ID NO: 69921 - RNA, 20 nt, Artificial Sequence
  MKO10069921_B_Acaa1b
  gRNA
ucaccacuuaccagcaaugu

SEQ ID NO: 69922 - RNA, 20 nt, Artificial Sequence
  MKO10069922_B_Acaa2
  gRNA
gcugcgaagcgaacacccuu

SEQ ID NO: 69923 - RNA, 20 nt, Artificial Sequence
  MKO10069923_B_Acaa2
  gRNA
ugugucagaaaugugcgcuu

SEQ ID NO: 69924 - RNA, 20 nt, Artificial Sequence
  MKO10069924_B_Acaa2
  gRNA
cuugagaucuaauccaaauu

SEQ ID NO: 69925 - RNA, 20 nt, Artificial Sequence
  MKO10069925_B_Acaca
  gRNA
aaacgaguaacaaauucugc

SEQ ID NO: 69926 - RNA, 20 nt, Artificial Sequence
  MKO10069926_B_Acaca
  gRNA
caacaacaauuacgcaaaug

SEQ ID NO: 69927 - RNA, 20 nt, Artificial Sequence
  MKO10069927_B_Acaca
  gRNA
auuugcguaauuguuguugu

SEQ ID NO: 69928 - RNA, 20 nt, Artificial Sequence
  MKO10069928_B_Acacb
  gRNA
caccuguacagggauucucu

SEQ ID NO: 69929 - RNA, 20 nt, Artificial Sequence
  MKO10069929_B_Acacb
  gRNA
gaucaguacgucccuguccc

SEQ ID NO: 69930 - RNA, 20 nt, Artificial Sequence
  MKO10069930_B_Acacb
  gRNA
uccaaaccgagugacaaacu

SEQ ID NO: 69931 - RNA, 20 nt, Artificial Sequence
  MKO10069931_B_Acad10
  gRNA
ccuugauggugugaaugccc

SEQ ID NO: 69932 - RNA, 20 nt, Artificial Sequence
  MKO10069932_B_Acad10
  gRNA
gcgacagugggcccuggaua

SEQ ID NO: 69933 - RNA, 20 nt, Artificial Sequence
  MKO10069933_B_Acad10
  gRNA
uucccaacacccggccugug

SEQ ID NO: 69934 - RNA, 20 nt, Artificial Sequence
  MKO10069934_B_Acad11
  gRNA
cuggagucggguacugcaaa

SEQ ID NO: 69935 - RNA, 20 nt, Artificial Sequence
  MKO10069935_B_Acad11
  gRNA
gugucauaccuuaugugcuu

SEQ ID NO: 69936 - RNA, 20 nt, Artificial Sequence
  MKO10069936_B_Acad11
  gRNA
aagcaucucugcaguauagc

SEQ ID NO: 69937 - RNA, 20 nt, Artificial Sequence
  MKO10069937_B_Acad12
  gRNA
cuugugaccauuuaugacau

SEQ ID NO: 69938 - RNA, 20 nt, Artificial Sequence
  MKO10069938_B_Acad12
  gRNA
agcugcuuccccuucucaug

SEQ ID NO: 69939 - RNA, 20 nt, Artificial Sequence
  MKO10069939_B_Acad12
  gRNA
gauaacuccuaugucauaaa

SEQ ID NO: 69940 - RNA, 20 nt, Artificial Sequence
  MKO10069940_B_Acad8
  gRNA
uugcccaccgcucuguacca

SEQ ID NO: 69941 - RNA, 20 nt, Artificial Sequence
  MKO10069941_B_Acad8
  gRNA
caaacgcaccugguucagug

SEQ ID NO: 69942 - RNA, 20 nt, Artificial Sequence
  MKO10069942_B_Acad8
  gRNA
ggucuaugugcgaacagaug

SEQ ID NO: 69943 - RNA, 20 nt, Artificial Sequence
  MKO10069943_B_Acad9
  gRNA
ugccagggucaccgugauag

SEQ ID NO: 69944 - RNA, 20 nt, Artificial Sequence
  MKO10069944_B_Acad9
  gRNA
guguuccccagacgacaguu

SEQ ID NO: 69945 - RNA, 20 nt, Artificial Sequence
  MKO10069945_B_Acad9
  gRNA
ccuguaugccaaaaaguccc

SEQ ID NO: 69946 - RNA, 20 nt, Artificial Sequence
  MKO10069946_B_Acadl
  gRNA
ccaaucacucccagaucuuu

SEQ ID NO: 69947 - RNA, 20 nt, Artificial Sequence
  MKO10069947_B_Acadl
  gRNA
ugcucucaacagcaguuacu

SEQ ID NO: 69948 - RNA, 20 nt, Artificial Sequence
  MKO10069948_B_Acadl
  gRNA
ggcacuuacucuguguggug

SEQ ID NO: 69949 - RNA, 20 nt, Artificial Sequence
  MKO10069949_B_Acadm
  gRNA
ucgaacacaacacucgaaag

SEQ ID NO: 69950 - RNA, 20 nt, Artificial Sequence
  MKO10069950_B_Acadm
  gRNA
cgcuguagguggccuuggcc

SEQ ID NO: 69951 - RNA, 20 nt, Artificial Sequence
  MKO10069951_B_Acadm
  gRNA
aacaagcaucgaacguuccc

SEQ ID NO: 69952 - RNA, 20 nt, Artificial Sequence
  MKO10069952_B_Acadsb
  gRNA
ucugcagacacuuacugaug

SEQ ID NO: 69953 - RNA, 20 nt, Artificial Sequence
  MKO10069953_B_Acadsb
  gRNA
ugugaggauuugaggacacg

SEQ ID NO: 69954 - RNA, 20 nt, Artificial Sequence
  MKO10069954_B_Acadsb
  gRNA
acuagcuaagguggaugcuu

SEQ ID NO: 69955 - RNA, 20 nt, Artificial Sequence
  MKO10069955_B_Acads
  gRNA
ugugcuggcaaauaccaccg

SEQ ID NO: 69956 - RNA, 20 nt, Artificial Sequence
  MKO10069956_B_Acads
  gRNA
gucccgucagucucucuacu

SEQ ID NO: 69957 - RNA, 20 nt, Artificial Sequence
  MKO10069957_B_Acads
  gRNA
aggcacggcugaucuccucc

SEQ ID NO: 69958 - RNA, 20 nt, Artificial Sequence
  MKO10069958_B_Acadvl
  gRNA
acaccugaucaaugguaagc

SEQ ID NO: 69959 - RNA, 20 nt, Artificial Sequence
  MKO10069959_B_Acadvl
  gRNA
gcgaucuacuacugugcuuc

SEQ ID NO: 69960 - RNA, 20 nt, Artificial Sequence
  MKO10069960_B_Acadvl
  gRNA
uucucugguggaagcaucag

SEQ ID NO: 69961 - RNA, 20 nt, Artificial Sequence
  MKO10069961_B_Acan
  gRNA
agugagaaccuacggaaucc

SEQ ID NO: 69962 - RNA, 20 nt, Artificial Sequence
  MKO10069962_B_Acan
  gRNA
gaucuccaagguagcaucgc

SEQ ID NO: 69963 - RNA, 20 nt, Artificial Sequence
  MKO10069963_B_Acan
  gRNA
ucauaucgggaugagggauc

SEQ ID NO: 69964 - RNA, 20 nt, Artificial Sequence
  MKO10069964_B_Acap1
  gRNA
guaucacauaccgccaucau

SEQ ID NO: 69965 - RNA, 20 nt, Artificial Sequence
  MKO10069965_B_Acap1
  gRNA
cgugagucugaaccacaaac

SEQ ID NO: 69966 - RNA, 20 nt, Artificial Sequence
  MKO10069966_B_Acap1
  gRNA
cagcauggcuguccaguuug

SEQ ID NO: 69967 - RNA, 20 nt, Artificial Sequence
  MKO10069967_B_Acap2
  gRNA
uccuagggcugcuuuggaag

SEQ ID NO: 69968 - RNA, 20 nt, Artificial Sequence
  MKO10069968_B_Acap2
  gRNA
ccuuaauugaucucuggguu

SEQ ID NO: 69969 - RNA, 20 nt, Artificial Sequence
  MKO10069969_B_Acap2
  gRNA
cugaagacugucagaaaacu

SEQ ID NO: 69970 - RNA, 20 nt, Artificial Sequence
  MKO10069970_B_Acap3
  gRNA
accgcucacaaagagccugu

SEQ ID NO: 69971 - RNA, 20 nt, Artificial Sequence
  MKO10069971_B_Acap3
  gRNA
aacagaugugguugagaucg

SEQ ID NO: 69972 - RNA, 20 nt, Artificial Sequence
  MKO10069972_B_Acap3
  gRNA
aucccagauccuguuugacc

SEQ ID NO: 69973 - RNA, 20 nt, Artificial Sequence
  MKO10069973_B_Acau1
  gRNA
ugcagcaguaccaaguuuag

SEQ ID NO: 69974 - RNA, 20 nt, Artificial Sequence
  MKO10069974_B_Acau1
  gRNA
gugaaggacaggccccuacc

SEQ ID NO: 69975 - RNA, 20 nt, Artificial Sequence
  MKO10069975_B_Acau1
  gRNA
aagucuuauguguggacauc

SEQ ID NO: 69976 - RNA, 20 nt, Artificial Sequence
  MKO10069976_B_Acau2
  gRNA
gacauguccaaauaugaccu

SEQ ID NO: 69977 - RNA, 20 nt, Artificial Sequence
  MKO10069977_B_Acau2
  gRNA
uccuacucgacaagccagug

SEQ ID NO: 69978 - RNA, 20 nt, Artificial Sequence
  MKO10069978_B_Acau2
  gRNA
caugccuccagcuaccacaa

SEQ ID NO: 69979 - RNA, 20 nt, Artificial Sequence
  MKO10069979_B_Acau3
  gRNA
gacauguccaaauaugaccu

SEQ ID NO: 69980 - RNA, 20 nt, Artificial Sequence
  MKO10069980_B_Acau3
  gRNA
uccuacucgacaagccagug

SEQ ID NO: 69981 - RNA, 20 nt, Artificial Sequence
  MKO10069981_B_Acau3
  gRNA
caugccuccagcuaccacaa

SEQ ID NO: 69982 - RNA, 20 nt, Artificial Sequence
  MKO10069982_B_Acbd3
  gRNA
ugcuguuguucguaguuccc

SEQ ID NO: 69983 - RNA, 20 nt, Artificial Sequence
  MKO10069983_B_Acbd3
  gRNA
ggaagagaggcggcggauag

SEQ ID NO: 69984 - RNA, 20 nt, Artificial Sequence
  MKO10069984_B_Acbd3
  gRNA
gcaacauaugccgagaggag

SEQ ID NO: 69985 - RNA, 20 nt, Artificial Sequence
  MKO10069985_B_Acbd4
  gRNA
uugcagagucgcuucaaagu

SEQ ID NO: 69986 - RNA, 20 nt, Artificial Sequence
  MKO10069986_B_Acbd4
  gRNA
acccaugcugcuucgagcuc

SEQ ID NO: 69987 - RNA, 20 nt, Artificial Sequence
  MKO10069987_B_Acbd4
  gRNA
cuccuagggaugccuggaac

SEQ ID NO: 69988 - RNA, 20 nt, Artificial Sequence
  MKO10069988_B_Acbd5
  gRNA
auccagaguuugccgaaaaa

SEQ ID NO: 69989 - RNA, 20 nt, Artificial Sequence
  MKO10069989_B_Acbd5
  gRNA
guucuauagcuucuacaaac

SEQ ID NO: 69990 - RNA, 20 nt, Artificial Sequence
  MKO10069990_B_Acbd5
  gRNA
aagaguucugacuugaccuc

SEQ ID NO: 69991 - RNA, 20 nt, Artificial Sequence
  MKO10069991_B_Acbd6
  gRNA
aagcccuagccaagcaaugc

SEQ ID NO: 69992 - RNA, 20 nt, Artificial Sequence
  MKO10069992_B_Acbd6
  gRNA
ccuucaaaaucaaagaaauu

SEQ ID NO: 69993 - RNA, 20 nt, Artificial Sequence
  MKO10069993_B_Acbd6
  gRNA
gaagucaggacaggaacuca

SEQ ID NO: 69994 - RNA, 20 nt, Artificial Sequence
  MKO10069994_B_Acbd7
  gRNA
cagcuuccucacgucuugug

SEQ ID NO: 69995 - RNA, 20 nt, Artificial Sequence
  MKO10069995_B_Acbd7
  gRNA
ucucaucauuauguccuugc

SEQ ID NO: 69996 - RNA, 20 nt, Artificial Sequence
  MKO10069996_B_Acbd7
  gRNA
cucucucgcuuuagaaauau

SEQ ID NO: 69997 - RNA, 20 nt, Artificial Sequence
  MKO10069997_B_Accsl
  gRNA
ugccagccccacgcuuagau

SEQ ID NO: 69998 - RNA, 20 nt, Artificial Sequence
  MKO10069998_B_Accsl
  gRNA
cccagcugcaguacuccgac

SEQ ID NO: 69999 - RNA, 20 nt, Artificial Sequence
  MKO10069999_B_Accsl
  gRNA
agcuagccagcucuucccga

SEQ ID NO: 70000 - RNA, 20 nt, Artificial Sequence
  MKO10070000_B_Accs
  gRNA
ucugcagggcaucauuaacu

SEQ ID NO: 70001 - RNA, 20 nt, Artificial Sequence
  MKO10070001_B_Accs
  gRNA
gucuuucuauuguaagagcc

SEQ ID NO: 70002 - RNA, 20 nt, Artificial Sequence
  MKO10070002_B_Accs
  gRNA
aacaaauguccucuccaguc

SEQ ID NO: 70003 - RNA, 20 nt, Artificial Sequence
  MKO10070003_B_Acd
  gRNA
gcccgcaggccugcaguagc

SEQ ID NO: 70004 - RNA, 20 nt, Artificial Sequence
  MKO10070004_B_Acd
  gRNA
gccugcggaguucuaccucc

SEQ ID NO: 70005 - RNA, 20 nt, Artificial Sequence
  MKO10070005_B_Acd
  gRNA
cugcgggcuccgcguucagg

SEQ ID NO: 70006 - RNA, 20 nt, Artificial Sequence
  MKO10070006_B_Ace2
  gRNA
aaaacagauuauaacgacua

SEQ ID NO: 70007 - RNA, 20 nt, Artificial Sequence
  MKO10070007_B_Ace2
  gRNA
gaaugcuuauuacuugagcc

SEQ ID NO: 70008 - RNA, 20 nt, Artificial Sequence
  MKO10070008_B_Ace2
  gRNA
ugugguccugaaaaacgaga

SEQ ID NO: 70009 - RNA, 20 nt, Artificial Sequence
  MKO10070009_B_Ace3
  gRNA
gcccacggaggaucuccuag

SEQ ID NO: 70010 - RNA, 20 nt, Artificial Sequence
  MKO10070010_B_Ace3
  gRNA
gacagcauauaaccgagcug

SEQ ID NO: 70011 - RNA, 20 nt, Artificial Sequence
  MKO10070011_B_Ace3
  gRNA
agcccacuuaccauuauauu

SEQ ID NO: 70012 - RNA, 20 nt, Artificial Sequence
  MKO10070012_B_Acer1
  gRNA
ggauuagggaugaugaucuu

SEQ ID NO: 70013 - RNA, 20 nt, Artificial Sequence
  MKO10070013_B_Acer1
  gRNA
ucuacuaccugcacagcauu

SEQ ID NO: 70014 - RNA, 20 nt, Artificial Sequence
  MKO10070014_B_Acer1
  gRNA
caagaaggugcugauaauag

SEQ ID NO: 70015 - RNA, 20 nt, Artificial Sequence
  MKO10070015_B_Acer2
  gRNA
cugucauuccgaaagaucuu

SEQ ID NO: 70016 - RNA, 20 nt, Artificial Sequence
  MKO10070016_B_Acer2
  gRNA
caaugugcguguguuuaagc

SEQ ID NO: 70017 - RNA, 20 nt, Artificial Sequence
  MKO10070017_B_Acer2
  gRNA
gguauuuaccaaagaucuuu

SEQ ID NO: 70018 - RNA, 20 nt, Artificial Sequence
  MKO10070018_B_Acer3
  gRNA
cuguuaaacuguauagaaau

SEQ ID NO: 70019 - RNA, 20 nt, Artificial Sequence
  MKO10070019_B_Acer3
  gRNA
auacaguuuaacaguaacua

SEQ ID NO: 70020 - RNA, 20 nt, Artificial Sequence
  MKO10070020_B_Acer3
  gRNA
gacucugaaauaugaaaugc

SEQ ID NO: 70021 - RNA, 20 nt, Artificial Sequence
  MKO10070021_B_Ace
  gRNA
acuuguaugccccuggaacc

SEQ ID NO: 70022 - RNA, 20 nt, Artificial Sequence
  MKO10070022_B_Ace
  gRNA
uccagaucuaacaaacauga

SEQ ID NO: 70023 - RNA, 20 nt, Artificial Sequence
  MKO10070023_B_Ace
  gRNA
uccaaucacacccugaaaua

SEQ ID NO: 70024 - RNA, 20 nt, Artificial Sequence
  MKO10070024_B_Ache
  gRNA
uguaguucagcgagggaucc

SEQ ID NO: 70025 - RNA, 20 nt, Artificial Sequence
  MKO10070025_B_Ache
  gRNA
cccaaauugcucagcgccac

SEQ ID NO: 70026 - RNA, 20 nt, Artificial Sequence
  MKO10070026_B_Ache
  gRNA
auccgccugaaggccccugg

SEQ ID NO: 70027 - RNA, 20 nt, Artificial Sequence
  MKO10070027_B_Acin1
  gRNA
cgaugcccaagucauucaag

SEQ ID NO: 70028 - RNA, 20 nt, Artificial Sequence
  MKO10070028_B_Acin1
  gRNA
cgaugacucccgaaucucug

SEQ ID NO: 70029 - RNA, 20 nt, Artificial Sequence
  MKO10070029_B_Acin1
  gRNA
uugcugacuuggucugcaac

SEQ ID NO: 70030 - RNA, 20 nt, Artificial Sequence
  MKO10070030_B_Ackr2
  gRNA
uggcacugcuaugcggauuu

SEQ ID NO: 70031 - RNA, 20 nt, Artificial Sequence
  MKO10070031_B_Ackr2
  gRNA
gcgcuuccagcugaaccuuc

SEQ ID NO: 70032 - RNA, 20 nt, Artificial Sequence
  MKO10070032_B_Ackr2
  gRNA
ucugcagucaccgcuuccgc

SEQ ID NO: 70033 - RNA, 20 nt, Artificial Sequence
  MKO10070033_B_Ackr3
  gRNA
ucgucaucaccauccccguc

SEQ ID NO: 70034 - RNA, 20 nt, Artificial Sequence
  MKO10070034_B_Ackr3
  gRNA
gcagugcgugucguagccug

SEQ ID NO: 70035 - RNA, 20 nt, Artificial Sequence
  MKO10070035_B_Ackr3
  gRNA
cugacauggcucuagcgagc

SEQ ID NO: 70036 - RNA, 20 nt, Artificial Sequence
  MKO10070036_B_Ackr4
  gRNA
ugugcuaugccaguaccgcc

SEQ ID NO: 70037 - RNA, 20 nt, Artificial Sequence
  MKO10070037_B_Ackr4
  gRNA
caucuugaugagcgcccugg

SEQ ID NO: 70038 - RNA, 20 nt, Artificial Sequence
  MKO10070038_B_Ackr4
  gRNA
uuaugcagaucacuucguac

SEQ ID NO: 70039 - RNA, 20 nt, Artificial Sequence
  MKO10070039_B_Acly
  gRNA
ucacccgggcguacuugaac

SEQ ID NO: 70040 - RNA, 20 nt, Artificial Sequence
  MKO10070040_B_Acly
  gRNA
acgugugcaucuaugcuacc

SEQ ID NO: 70041 - RNA, 20 nt, Artificial Sequence
  MKO10070041_B_Acly
  gRNA
ccuuaggucggcaaggccaa

SEQ ID NO: 70042 - RNA, 20 nt, Artificial Sequence
  MKO10070042_B_Acmsd
  gRNA
gagugauccaacagaacugc

SEQ ID NO: 70043 - RNA, 20 nt, Artificial Sequence
  MKO10070043_B_Acmsd
  gRNA
uuccugucauguuuagcuac

SEQ ID NO: 70044 - RNA, 20 nt, Artificial Sequence
  MKO10070044_B_Acmsd
  gRNA
ucauugcagagguuuggcua

SEQ ID NO: 70045 - RNA, 20 nt, Artificial Sequence
  MKO10070045_B_Acn9
  gRNA
agugauacuaaacugccuau

SEQ ID NO: 70046 - RNA, 20 nt, Artificial Sequence
  MKO10070046_B_Acn9
  gRNA
agauucgccuauauaaagcc

SEQ ID NO: 70047 - RNA, 20 nt, Artificial Sequence
  MKO10070047_B_Acn9
  gRNA
ggcgaaucuugcugcuacau

SEQ ID NO: 70048 - RNA, 20 nt, Artificial Sequence
  MKO10070048_B_Acnau1
  gRNA
ccugccugagaaacugcaag

SEQ ID NO: 70049 - RNA, 20 nt, Artificial Sequence
  MKO10070049_B_Acnau1
  gRNA
ccuuggggggugacuaugua

SEQ ID NO: 70050 - RNA, 20 nt, Artificial Sequence
  MKO10070050_B_Acnau1
  gRNA
cacaccuucaaaugcccuug

SEQ ID NO: 70051 - RNA, 20 nt, Artificial Sequence
  MKO10070051_B_Acnau2
  gRNA
uuucucaggcaggucuucau

SEQ ID NO: 70052 - RNA, 20 nt, Artificial Sequence
  MKO10070052_B_Acnau2
  gRNA
acauagucaccccccaaagc

SEQ ID NO: 70053 - RNA, 20 nt, Artificial Sequence
  MKO10070053_B_Acnau2
  gRNA
cuuuggggggugacuaugua

SEQ ID NO: 70054 - RNA, 20 nt, Artificial Sequence
  MKO10070054_B_Aco1
  gRNA
aaacucaucacaguuccgaa

SEQ ID NO: 70055 - RNA, 20 nt, Artificial Sequence
  MKO10070055_B_Aco1
  gRNA
acaucgagaauauccugaau

SEQ ID NO: 70056 - RNA, 20 nt, Artificial Sequence
  MKO10070056_B_Aco1
  gRNA
ccuuaggggugugccugcug

SEQ ID NO: 70057 - RNA, 20 nt, Artificial Sequence
  MKO10070057_B_Aco2
  gRNA
uggaucugggaucauucacc

SEQ ID NO: 70058 - RNA, 20 nt, Artificial Sequence
  MKO10070058_B_Aco2
  gRNA
gugccgaucagaagaacucc

SEQ ID NO: 70059 - RNA, 20 nt, Artificial Sequence
  MKO10070059_B_Aco2
  gRNA
acugauucgcacacccccaa

SEQ ID NO: 70060 - RNA, 20 nt, Artificial Sequence
  MKO10070060_B_Acot10
  gRNA
uaccccaguaaccuuaaaaa

SEQ ID NO: 70061 - RNA, 20 nt, Artificial Sequence
  MKO10070061_B_Acot10
  gRNA
uaguagguauuuccacaguc

SEQ ID NO: 70062 - RNA, 20 nt, Artificial Sequence
  MKO10070062_B_Acot10
  gRNA
acauaucaaucuuguccacc

SEQ ID NO: 70063 - RNA, 20 nt, Artificial Sequence
  MKO10070063_B_Acot11
  gRNA
ucuccucagugucggccaag

SEQ ID NO: 70064 - RNA, 20 nt, Artificial Sequence
  MKO10070064_B_Acot11
  gRNA
gaaguagaugucauccauag

SEQ ID NO: 70065 - RNA, 20 nt, Artificial Sequence
  MKO10070065_B_Acot11
  gRNA
auaucaaggccaaggugaac

SEQ ID NO: 70066 - RNA, 20 nt, Artificial Sequence
  MKO10070066_B_Acot12
  gRNA
uucuguuugaggacacagcg

SEQ ID NO: 70067 - RNA, 20 nt, Artificial Sequence
  MKO10070067_B_Acot12
  gRNA
ccaucagagcaaaagugacu

SEQ ID NO: 70068 - RNA, 20 nt, Artificial Sequence
  MKO10070068_B_Acot12
  gRNA
cuccuucauaauguuguuga

SEQ ID NO: 70069 - RNA, 20 nt, Artificial Sequence
  MKO10070069_B_Acot13
  gRNA
uacuuaggugacgcuugucu

SEQ ID NO: 70070 - RNA, 20 nt, Artificial Sequence
  MKO10070070_B_Acot13
  gRNA
agagcagcauacuaauaaac

SEQ ID NO: 70071 - RNA, 20 nt, Artificial Sequence
  MKO10070071_B_Acot13
  gRNA
uacaugucaccugcuaagau

SEQ ID NO: 70072 - RNA, 20 nt, Artificial Sequence
  MKO10070072_B_Acot1
  gRNA
cgaugaccuccccaagaaca

SEQ ID NO: 70073 - RNA, 20 nt, Artificial Sequence
  MKO10070073_B_Acot1
  gRNA
gcugcugccaugcauccaac

SEQ ID NO: 70074 - RNA, 20 nt, Artificial Sequence
  MKO10070074_B_Acot1
  gRNA
gcagaaccuggacccuuucc

SEQ ID NO: 70075 - RNA, 20 nt, Artificial Sequence
  MKO10070075_B_Acot2
  gRNA
gcugcugccaugcguccacc

SEQ ID NO: 70076 - RNA, 20 nt, Artificial Sequence
  MKO10070076_B_Acot2
  gRNA
ugggaagggcuuugccguga

SEQ ID NO: 70077 - RNA, 20 nt, Artificial Sequence
  MKO10070077_B_Acot2
  gRNA
gagcauagaaaccaugcaca

SEQ ID NO: 70078 - RNA, 20 nt, Artificial Sequence
  MKO10070078_B_Acot3
  gRNA
uuaccacccagaacccgaac

SEQ ID NO: 70079 - RNA, 20 nt, Artificial Sequence
  MKO10070079_B_Acot3
  gRNA
gucacaaaggcaaccacccg

SEQ ID NO: 70080 - RNA, 20 nt, Artificial Sequence
  MKO10070080_B_Acot3
  gRNA
ggacauggacauuauccacc

SEQ ID NO: 70081 - RNA, 20 nt, Artificial Sequence
  MKO10070081_B_Acot4
  gRNA
ccauaaacaucgaugaugcc

SEQ ID NO: 70082 - RNA, 20 nt, Artificial Sequence
  MKO10070082_B_Acot4
  gRNA
aauggcagcgacacugagcg

SEQ ID NO: 70083 - RNA, 20 nt, Artificial Sequence
  MKO10070083_B_Acot4
  gRNA
cgccagccgccgcccgccau

SEQ ID NO: 70084 - RNA, 20 nt, Artificial Sequence
  MKO10070084_B_Acot5
  gRNA
gauggugccaacaguaagcc

SEQ ID NO: 70085 - RNA, 20 nt, Artificial Sequence
  MKO10070085_B_Acot5
  gRNA
cgccagcagccgcccgccgu

SEQ ID NO: 70086 - RNA, 20 nt, Artificial Sequence
  MKO10070086_B_Acot5
  gRNA
uaaauaugaugaccucccua

SEQ ID NO: 70087 - RNA, 20 nt, Artificial Sequence
  MKO10070087_B_Acot6
  gRNA
cgaugugcagauacccuucg

SEQ ID NO: 70088 - RNA, 20 nt, Artificial Sequence
  MKO10070088_B_Acot6
  gRNA
ggugcuggacggacacgagc

SEQ ID NO: 70089 - RNA, 20 nt, Artificial Sequence
  MKO10070089_B_Acot6
  gRNA
uuugaugcuacgccauccuc

SEQ ID NO: 70090 - RNA, 20 nt, Artificial Sequence
  MKO10070090_B_Acot7
  gRNA
ggucaucuuaccacaauggg

SEQ ID NO: 70091 - RNA, 20 nt, Artificial Sequence
  MKO10070091_B_Acot7
  gRNA
ccggggccaucaucagcacg

SEQ ID NO: 70092 - RNA, 20 nt, Artificial Sequence
  MKO10070092_B_Acot7
  gRNA
ccuugaggugccucccauug

SEQ ID NO: 70093 - RNA, 20 nt, Artificial Sequence
  MKO10070093_B_Acot8
  gRNA
cuucucagugcgcgccguga

SEQ ID NO: 70094 - RNA, 20 nt, Artificial Sequence
  MKO10070094_B_Acot8
  gRNA
ccuucacaagaaguaucgag

SEQ ID NO: 70095 - RNA, 20 nt, Artificial Sequence
  MKO10070095_B_Acot8
  gRNA
gccccaccaguccaaguaua

SEQ ID NO: 70096 - RNA, 20 nt, Artificial Sequence
  MKO10070096_B_Acot9
  gRNA
ugacuguucaaaauacagua

SEQ ID NO: 70097 - RNA, 20 nt, Artificial Sequence
  MKO10070097_B_Acot9
  gRNA
gaacccuuacacauccauca

SEQ ID NO: 70098 - RNA, 20 nt, Artificial Sequence
  MKO10070098_B_Acot9
  gRNA
cuugccuugauggaugugua

SEQ ID NO: 70099 - RNA, 20 nt, Artificial Sequence
  MKO10070099_B_Acox1
  gRNA
cucacggauagggacaacaa

SEQ ID NO: 70100 - RNA, 20 nt, Artificial Sequence
  MKO10070100_B_Acox1
  gRNA
cuucgaagcucugugcaccg

SEQ ID NO: 70101 - RNA, 20 nt, Artificial Sequence
  MKO10070101_B_Acox1
  gRNA
ugagccuuuggaccuucacu

SEQ ID NO: 70102 - RNA, 20 nt, Artificial Sequence
  MKO10070102_B_Acox2
  gRNA
aucccaagggacauaccugc

SEQ ID NO: 70103 - RNA, 20 nt, Artificial Sequence
  MKO10070103_B_Acox2
  gRNA
gugguccucuaggcuccgga

SEQ ID NO: 70104 - RNA, 20 nt, Artificial Sequence
  MKO10070104_B_Acox2
  gRNA
uuaaguuguuauauccagca

SEQ ID NO: 70105 - RNA, 20 nt, Artificial Sequence
  MKO10070105_B_Acox3
  gRNA
gcaggucggccccguacgag

SEQ ID NO: 70106 - RNA, 20 nt, Artificial Sequence
  MKO10070106_B_Acox3
  gRNA
ccuugagaagaucuauagcc

SEQ ID NO: 70107 - RNA, 20 nt, Artificial Sequence
  MKO10070107_B_Acox3
  gRNA
gcucucaccgaacugaguca

SEQ ID NO: 70108 - RNA, 20 nt, Artificial Sequence
  MKO10070108_B_Acoxl
  gRNA
aacgcccacaagauguacau

SEQ ID NO: 70109 - RNA, 20 nt, Artificial Sequence
  MKO10070109_B_Acoxl
  gRNA
caucagccaaauccuuaucc

SEQ ID NO: 70110 - RNA, 20 nt, Artificial Sequence
  MKO10070110_B_Acoxl
  gRNA
cuugaguggccaaaaccacu

SEQ ID NO: 70111 - RNA, 20 nt, Artificial Sequence
  MKO10070111_B_Acp1
  gRNA
ccauugcagaagcaguauuc

SEQ ID NO: 70112 - RNA, 20 nt, Artificial Sequence
  MKO10070112_B_Acp1
  gRNA
auucgauuauauacuaugua

SEQ ID NO: 70113 - RNA, 20 nt, Artificial Sequence
  MKO10070113_B_Acp1
  gRNA
acauaguauauaaucgaaug

SEQ ID NO: 70114 - RNA, 20 nt, Artificial Sequence
  MKO10070114_B_Acp2
  gRNA
guugaagugcugaacuucau

SEQ ID NO: 70115 - RNA, 20 nt, Artificial Sequence
  MKO10070115_B_Acp2
  gRNA
uucugaacaccucuuaccac

SEQ ID NO: 70116 - RNA, 20 nt, Artificial Sequence
  MKO10070116_B_Acp2
  gRNA
auaggcugccaugaaauguu

SEQ ID NO: 70117 - RNA, 20 nt, Artificial Sequence
  MKO10070117_B_Acp5
  gRNA
guaggcagugaccccguaug

SEQ ID NO: 70118 - RNA, 20 nt, Artificial Sequence
  MKO10070118_B_Acp5
  gRNA
gcccaaaaugccucgagacc

SEQ ID NO: 70119 - RNA, 20 nt, Artificial Sequence
  MKO10070119_B_Acp5
  gRNA
ugcugggccuacaaaucaua

SEQ ID NO: 70120 - RNA, 20 nt, Artificial Sequence
  MKO10070120_B_Acp6
  gRNA
ggaaucuacucggugcuugc

SEQ ID NO: 70121 - RNA, 20 nt, Artificial Sequence
  MKO10070121_B_Acp6
  gRNA
cuuuaggguggcgugcuugc

SEQ ID NO: 70122 - RNA, 20 nt, Artificial Sequence
  MKO10070122_B_Acp6
  gRNA
uuccagauuccgaaacaugu

SEQ ID NO: 70123 - RNA, 20 nt, Artificial Sequence
  MKO10070123_B_Acpl2
  gRNA
ccccacgaagcagcuccgcg

SEQ ID NO: 70124 - RNA, 20 nt, Artificial Sequence
  MKO10070124_B_Acpl2
  gRNA
aaucuuggccaucuccccgu

SEQ ID NO: 70125 - RNA, 20 nt, Artificial Sequence
  MKO10070125_B_Acpl2
  gRNA
augcugugcuccgcuacgcu

SEQ ID NO: 70126 - RNA, 20 nt, Artificial Sequence
  MKO10070126_B_Acpp
  gRNA
gggcagaggaacggcucgca

SEQ ID NO: 70127 - RNA, 20 nt, Artificial Sequence
  MKO10070127_B_Acpp
  gRNA
acuugccugaucaugcuuau

SEQ ID NO: 70128 - RNA, 20 nt, Artificial Sequence
  MKO10070128_B_Acpp
  gRNA
uuccagaugcugauccccuc

SEQ ID NO: 70129 - RNA, 20 nt, Artificial Sequence
  MKO10070129_B_Acpt
  gRNA
ggagagugcacaagccaacc

SEQ ID NO: 70130 - RNA, 20 nt, Artificial Sequence
  MKO10070130_B_Acpt
  gRNA
agcugacuaccaggaggccc

SEQ ID NO: 70131 - RNA, 20 nt, Artificial Sequence
  MKO10070131_B_Acpt
  gRNA
cccuccucaccuuagucagu

SEQ ID NO: 70132 - RNA, 20 nt, Artificial Sequence
  MKO10070132_B_Acrbp
  gRNA
gccaugaugaaucuagcugc

SEQ ID NO: 70133 - RNA, 20 nt, Artificial Sequence
  MKO10070133_B_Acrbp
  gRNA
cccauugugucccaugccac

SEQ ID NO: 70134 - RNA, 20 nt, Artificial Sequence
  MKO10070134_B_Acrbp
  gRNA
cuccaccuccuugagagugu

SEQ ID NO: 70135 - RNA, 20 nt, Artificial Sequence
  MKO10070135_B_Acrv1
  gRNA
cacacccuugaaccaugaac

SEQ ID NO: 70136 - RNA, 20 nt, Artificial Sequence
  MKO10070136_B_Acrv1
  gRNA
aaugaaggaguuaaucuuac

SEQ ID NO: 70137 - RNA, 20 nt, Artificial Sequence
  MKO10070137_B_Acrv1
  gRNA
ucuucuuuaacaugcacugc

SEQ ID NO: 70138 - RNA, 20 nt, Artificial Sequence
  MKO10070138_B_Acr
  gRNA
cugccugaaucguaacccac

SEQ ID NO: 70139 - RNA, 20 nt, Artificial Sequence
  MKO10070139_B_Acr
  gRNA
ccccacaccugcuacgugac

SEQ ID NO: 70140 - RNA, 20 nt, Artificial Sequence
  MKO10070140_B_Acr
  gRNA
ggagcacaagaaaucgaaua

SEQ ID NO: 70141 - RNA, 20 nt, Artificial Sequence
  MKO10070141_B_Acsbg1
  gRNA
cccaccagcuccuuaauuga

SEQ ID NO: 70142 - RNA, 20 nt, Artificial Sequence
  MKO10070142_B_Acsbg1
  gRNA
agccaaggaucgccacgcug

SEQ ID NO: 70143 - RNA, 20 nt, Artificial Sequence
  MKO10070143_B_Acsbg1
  gRNA
gagagcucgagaccgugacu

SEQ ID NO: 70144 - RNA, 20 nt, Artificial Sequence
  MKO10070144_B_Acsbg2
  gRNA
cgacacacuggaagcgcugc

SEQ ID NO: 70145 - RNA, 20 nt, Artificial Sequence
  MKO10070145_B_Acsbg2
  gRNA
uucgacacauuucauaguac

SEQ ID NO: 70146 - RNA, 20 nt, Artificial Sequence
  MKO10070146_B_Acsbg2
  gRNA
ugagcgauucagugcuuauc

SEQ ID NO: 70147 - RNA, 20 nt, Artificial Sequence
  MKO10070147_B_Acsf2
  gRNA
uacccaccucucacucuuca

SEQ ID NO: 70148 - RNA, 20 nt, Artificial Sequence
  MKO10070148_B_Acsf2
  gRNA
uggguccccacaugcccagc

SEQ ID NO: 70149 - RNA, 20 nt, Artificial Sequence
  MKO10070149_B_Acsf2
  gRNA
ggggacccaacuccuaugcc

SEQ ID NO: 70150 - RNA, 20 nt, Artificial Sequence
  MKO10070150_B_Acsf3
  gRNA
cuggcacgcgagccuccguc

SEQ ID NO: 70151 - RNA, 20 nt, Artificial Sequence
  MKO10070151_B_Acsf3
  gRNA
caucucagaaaacccgcaga

SEQ ID NO: 70152 - RNA, 20 nt, Artificial Sequence
  MKO10070152_B_Acsf3
  gRNA
gccaugaauacgguaaucug

SEQ ID NO: 70153 - RNA, 20 nt, Artificial Sequence
  MKO10070153_B_Acsl1
  gRNA
ugaucuucgaauaccaucag

SEQ ID NO: 70154 - RNA, 20 nt, Artificial Sequence
  MKO10070154_B_Acsl1
  gRNA
ggcuuccgagaaccuaaaca

SEQ ID NO: 70155 - RNA, 20 nt, Artificial Sequence
  MKO10070155_B_Acsl1
  gRNA
ccuugcuccgagcaguucau

SEQ ID NO: 70156 - RNA, 20 nt, Artificial Sequence
  MKO10070156_B_Acsl3
  gRNA
gcaguaaucauguacacaag

SEQ ID NO: 70157 - RNA, 20 nt, Artificial Sequence
  MKO10070157_B_Acsl3
  gRNA
ggcgagaaggauuccaagac

SEQ ID NO: 70158 - RNA, 20 nt, Artificial Sequence
  MKO10070158_B_Acsl3
  gRNA
agcgaucauccacucagccc

SEQ ID NO: 70159 - RNA, 20 nt, Artificial Sequence
  MKO10070159_B_Acsl4
  gRNA
uuauccagaguaucugcucc

SEQ ID NO: 70160 - RNA, 20 nt, Artificial Sequence
  MKO10070160_B_Acsl4
  gRNA
gaccaugcuguagccaaauu

SEQ ID NO: 70161 - RNA, 20 nt, Artificial Sequence
  MKO10070161_B_Acsl4
  gRNA
gauuacuaguguugagcuuc

SEQ ID NO: 70162 - RNA, 20 nt, Artificial Sequence
  MKO10070162_B_Acsl5
  gRNA
uaaaggauauaagucaucac

SEQ ID NO: 70163 - RNA, 20 nt, Artificial Sequence
  MKO10070163_B_Acsl5
  gRNA
cuguacccagcgugucauac

SEQ ID NO: 70164 - RNA, 20 nt, Artificial Sequence
  MKO10070164_B_Acsl5
  gRNA
uuuguaggagauccauuugu

SEQ ID NO: 70165 - RNA, 20 nt, Artificial Sequence
  MKO10070165_B_Acsl6
  gRNA
ccugcggcugcccgagcuau

SEQ ID NO: 70166 - RNA, 20 nt, Artificial Sequence
  MKO10070166_B_Acsl6
  gRNA
aacccccaaucacagaucgc

SEQ ID NO: 70167 - RNA, 20 nt, Artificial Sequence
  MKO10070167_B_Acsl6
  gRNA
ucuccagcacgacuguaaag

SEQ ID NO: 70168 - RNA, 20 nt, Artificial Sequence
  MKO10070168_B_Acsm1
  gRNA
uggcucgagauauuuguauu

SEQ ID NO: 70169 - RNA, 20 nt, Artificial Sequence
  MKO10070169_B_Acsm1
  gRNA
acaaaucugcucaaagacgu

SEQ ID NO: 70170 - RNA, 20 nt, Artificial Sequence
  MKO10070170_B_Acsm1
  gRNA
cuagggaucaucuucaugcc

SEQ ID NO: 70171 - RNA, 20 nt, Artificial Sequence
  MKO10070171_B_Acsm2
  gRNA
uacuucguccccagccacaa

SEQ ID NO: 70172 - RNA, 20 nt, Artificial Sequence
  MKO10070172_B_Acsm2
  gRNA
gcagccaucuacuucacuag

SEQ ID NO: 70173 - RNA, 20 nt, Artificial Sequence
  MKO10070173_B_Acsm2
  gRNA
cucugacuaugcaucaucua

SEQ ID NO: 70174 - RNA, 20 nt, Artificial Sequence
  MKO10070174_B_Acsm3
  gRNA
cacaaaacacgacgagauga

SEQ ID NO: 70175 - RNA, 20 nt, Artificial Sequence
  MKO10070175_B_Acsm3
  gRNA
cauuauuaccgaugauacuu

SEQ ID NO: 70176 - RNA, 20 nt, Artificial Sequence
  MKO10070176_B_Acsm3
  gRNA
uaggauugucugucaaugga

SEQ ID NO: 70177 - RNA, 20 nt, Artificial Sequence
  MKO10070177_B_Acsm4
  gRNA
ugaggaaguggcccccgcag

SEQ ID NO: 70178 - RNA, 20 nt, Artificial Sequence
  MKO10070178_B_Acsm4
  gRNA
uggaugcuugcagccgguag

SEQ ID NO: 70179 - RNA, 20 nt, Artificial Sequence
  MKO10070179_B_Acsm4
  gRNA
uucugccccguaucccugaa

SEQ ID NO: 70180 - RNA, 20 nt, Artificial Sequence
  MKO10070180_B_Acsm5
  gRNA
acgcugaucagccaccaauc

SEQ ID NO: 70181 - RNA, 20 nt, Artificial Sequence
  MKO10070181_B_Acsm5
  gRNA
cacaaaacccaauccauagc

SEQ ID NO: 70182 - RNA, 20 nt, Artificial Sequence
  MKO10070182_B_Acsm5
  gRNA
ugacugagucugacauauuc

SEQ ID NO: 70183 - RNA, 20 nt, Artificial Sequence
  MKO10070183_B_Acss1
  gRNA
aagagacauggagugcaccg

SEQ ID NO: 70184 - RNA, 20 nt, Artificial Sequence
  MKO10070184_B_Acss1
  gRNA
ggcuccuaccuugugcguca

SEQ ID NO: 70185 - RNA, 20 nt, Artificial Sequence
  MKO10070185_B_Acss1
  gRNA
ggcucacaggacggacacca

SEQ ID NO: 70186 - RNA, 20 nt, Artificial Sequence
  MKO10070186_B_Acss2
  gRNA
aaacaucugcuacaacgugc

SEQ ID NO: 70187 - RNA, 20 nt, Artificial Sequence
  MKO10070187_B_Acss2
  gRNA
uacuggaaaaccgcaugccc

SEQ ID NO: 70188 - RNA, 20 nt, Artificial Sequence
  MKO10070188_B_Acss2
  gRNA
accacaaguuccaagaucau

SEQ ID NO: 70189 - RNA, 20 nt, Artificial Sequence
  MKO10070189_B_Acss3
  gRNA
cauuuacagccguccaaaca

SEQ ID NO: 70190 - RNA, 20 nt, Artificial Sequence
  MKO10070190_B_Acss3
  gRNA
cagaggugccccaagcgucc

SEQ ID NO: 70191 - RNA, 20 nt, Artificial Sequence
  MKO10070191_B_Acss3
  gRNA
gaggagccgcugugacccga

SEQ ID NO: 70192 - RNA, 20 nt, Artificial Sequence
  MKO10070192_B_Acua1
  gRNA
gcccccugacaugacguugu

SEQ ID NO: 70193 - RNA, 20 nt, Artificial Sequence
  MKO10070193_B_Acua1
  gRNA
ccccugcacaggcaucgugu

SEQ ID NO: 70194 - RNA, 20 nt, Artificial Sequence
  MKO10070194_B_Acua1
  gRNA
cagugaggucgcgaccggcc

SEQ ID NO: 70195 - RNA, 20 nt, Artificial Sequence
  MKO10070195_B_Acua2
  gRNA
cacugaacccuaaggccaac

SEQ ID NO: 70196 - RNA, 20 nt, Artificial Sequence
  MKO10070196_B_Acua2
  gRNA
gcauccgacacugcugacag

SEQ ID NO: 70197 - RNA, 20 nt, Artificial Sequence
  MKO10070197_B_Acua2
  gRNA
ucacaacgugccuaucuaug

SEQ ID NO: 70198 - RNA, 20 nt, Artificial Sequence
  MKO10070198_B_Acubl2
  gRNA
caaaccgaauacuugcguuc

SEQ ID NO: 70199 - RNA, 20 nt, Artificial Sequence
  MKO10070199_B_Acubl2
  gRNA
ucccccagaacgcaaguauu

SEQ ID NO: 70200 - RNA, 20 nt, Artificial Sequence
  MKO10070200_B_Acubl2
  gRNA
uuggucguccacgacaccag

SEQ ID NO: 70201 - RNA, 20 nt, Artificial Sequence
  MKO10070201_B_Acub
  gRNA
agugugggugaccccgucuc

SEQ ID NO: 70202 - RNA, 20 nt, Artificial Sequence
  MKO10070202_B_Acub
  gRNA
uuagcuuaccuugaucuuca

SEQ ID NO: 70203 - RNA, 20 nt, Artificial Sequence
  MKO10070203_B_Acub
  gRNA
aguccgccuagaagcacuug

SEQ ID NO: 70204 - RNA, 20 nt, Artificial Sequence
  MKO10070204_B_Acuc1
  gRNA
ggucccgaccagcuagaucc

SEQ ID NO: 70205 - RNA, 20 nt, Artificial Sequence
  MKO10070205_B_Acuc1
  gRNA
ucagcggggcuucagugagc

SEQ ID NO: 70206 - RNA, 20 nt, Artificial Sequence
  MKO10070206_B_Acuc1
  gRNA
accccaugccaucaugcgcc

SEQ ID NO: 70207 - RNA, 20 nt, Artificial Sequence
  MKO10070207_B_Acug1
  gRNA
ggacaccuacccaggaagga

SEQ ID NO: 70208 - RNA, 20 nt, Artificial Sequence
  MKO10070208_B_Acug1
  gRNA
ucccuaggcauggaguccug

SEQ ID NO: 70209 - RNA, 20 nt, Artificial Sequence
  MKO10070209_B_Acug1
  gRNA
caauaccccagccauguacg

SEQ ID NO: 70210 - RNA, 20 nt, Artificial Sequence
  MKO10070210_B_Acug2
  gRNA
ugccaucaugcgucuugacc

SEQ ID NO: 70211 - RNA, 20 nt, Artificial Sequence
  MKO10070211_B_Acug2
  gRNA
cucgucacagggugugaugg

SEQ ID NO: 70212 - RNA, 20 nt, Artificial Sequence
  MKO10070212_B_Acug2
  gRNA
uuaggggggccucugugagc

SEQ ID NO: 70213 - RNA, 20 nt, Artificial Sequence
  MKO10070213_B_Acul10
  gRNA
gccaauacgguggugcuagc

SEQ ID NO: 70214 - RNA, 20 nt, Artificial Sequence
  MKO10070214_B_Acul10
  gRNA
aauacaucucgcaccagcaa

SEQ ID NO: 70215 - RNA, 20 nt, Artificial Sequence
  MKO10070215_B_Acul10
  gRNA
ugaacuccuuucagugccgc

SEQ ID NO: 70216 - RNA, 20 nt, Artificial Sequence
  MKO10070216_B_Acul11
  gRNA
guggcgaucuggacacuacc

SEQ ID NO: 70217 - RNA, 20 nt, Artificial Sequence
  MKO10070217_B_Acul11
  gRNA
ggagucccggcaugccauga

SEQ ID NO: 70218 - RNA, 20 nt, Artificial Sequence
  MKO10070218_B_Acul11
  gRNA
ugugguacccgaacaccaag

SEQ ID NO: 70219 - RNA, 20 nt, Artificial Sequence
  MKO10070219_B_Acul6a
  gRNA
cagcaccacaccgauagccg

SEQ ID NO: 70220 - RNA, 20 nt, Artificial Sequence
  MKO10070220_B_Acul6a
  gRNA
caguuucucucucuucgccc

SEQ ID NO: 70221 - RNA, 20 nt, Artificial Sequence
  MKO10070221_B_Acul6a
  gRNA
acagugagggcuggcuaugc

SEQ ID NO: 70222 - RNA, 20 nt, Artificial Sequence
  MKO10070222_B_Acul6b
  gRNA
ggagccuccgacaugaguac

SEQ ID NO: 70223 - RNA, 20 nt, Artificial Sequence
  MKO10070223_B_Acul6b
  gRNA
ggcucuuucucaguccgagc

SEQ ID NO: 70224 - RNA, 20 nt, Artificial Sequence
  MKO10070224_B_Acul6b
  gRNA
ccuccccagcguacccagcu

SEQ ID NO: 70225 - RNA, 20 nt, Artificial Sequence
  MKO10070225_B_Acul7a
  gRNA
auccauuauacccugccuga

SEQ ID NO: 70226 - RNA, 20 nt, Artificial Sequence
  MKO10070226_B_Acul7a
  gRNA
auugaccuggggggugucgu

SEQ ID NO: 70227 - RNA, 20 nt, Artificial Sequence
  MKO10070227_B_Acul7a
  gRNA
ugguaggcgaugugcauugc

SEQ ID NO: 70228 - RNA, 20 nt, Artificial Sequence
  MKO10070228_B_Acul7b
  gRNA
uacuguaagugcggcuaugc

SEQ ID NO: 70229 - RNA, 20 nt, Artificial Sequence
  MKO10070229_B_Acul7b
  gRNA
aacuucaaggagacauacgu

SEQ ID NO: 70230 - RNA, 20 nt, Artificial Sequence
  MKO10070230_B_Acul7b
  gRNA
gcuaacgugcugcugugcgg

SEQ ID NO: 70231 - RNA, 20 nt, Artificial Sequence
  MKO10070231_B_Acul9
  gRNA
auuccaggauugucgcccau

SEQ ID NO: 70232 - RNA, 20 nt, Artificial Sequence
  MKO10070232_B_Acul9
  gRNA
uaccaaggaccagucggagc

SEQ ID NO: 70233 - RNA, 20 nt, Artificial Sequence
  MKO10070233_B_Acul9
  gRNA
cugcccugaagcgacccucc

SEQ ID NO: 70234 - RNA, 20 nt, Artificial Sequence
  MKO10070234_B_Acun1
  gRNA
ucuguguccccgcuuugcgc

SEQ ID NO: 70235 - RNA, 20 nt, Artificial Sequence
  MKO10070235_B_Acun1
  gRNA
caccuuccacggagaugucc

SEQ ID NO: 70236 - RNA, 20 nt, Artificial Sequence
  MKO10070236_B_Acun1
  gRNA
cauucuccgcuuugccaucc

SEQ ID NO: 70237 - RNA, 20 nt, Artificial Sequence
  MKO10070237_B_Acun2
  gRNA
aaaggcugcccaaaccugac

SEQ ID NO: 70238 - RNA, 20 nt, Artificial Sequence
  MKO10070238_B_Acun2
  gRNA
uguugacauucgcaaucuug

SEQ ID NO: 70239 - RNA, 20 nt, Artificial Sequence
  MKO10070239_B_Acun2
  gRNA
cauccuccgcuucgccauuc

SEQ ID NO: 70240 - RNA, 20 nt, Artificial Sequence
  MKO10070240_B_Acun3
  gRNA
cuaguguccaucggugcuga

SEQ ID NO: 70241 - RNA, 20 nt, Artificial Sequence
  MKO10070241_B_Acun3
  gRNA
gcagaucgagaacauugaag

SEQ ID NO: 70242 - RNA, 20 nt, Artificial Sequence
  MKO10070242_B_Acun3
  gRNA
ucccuggcagaaauuguuga

SEQ ID NO: 70243 - RNA, 20 nt, Artificial Sequence
  MKO10070243_B_Acun4
  gRNA
agcaccugauauggaaguuc

SEQ ID NO: 70244 - RNA, 20 nt, Artificial Sequence
  MKO10070244_B_Acun4
  gRNA
aacucucaucuucggaaggc

SEQ ID NO: 70245 - RNA, 20 nt, Artificial Sequence
  MKO10070245_B_Acun4
  gRNA
acguccagaacuuccauauc

SEQ ID NO: 70246 - RNA, 20 nt, Artificial Sequence
  MKO10070246_B_Acur10
  gRNA
ccuagugugauaaaaagagc

SEQ ID NO: 70247 - RNA, 20 nt, Artificial Sequence
  MKO10070247_B_Acur10
  gRNA
ugguccuggauuguggauau

SEQ ID NO: 70248 - RNA, 20 nt, Artificial Sequence
  MKO10070248_B_Acur10
  gRNA
uuucccuauauccacaaucc

SEQ ID NO: 70249 - RNA, 20 nt, Artificial Sequence
  MKO10070249_B_Acur1a
  gRNA
cuuuaaacccucggaaaaac

SEQ ID NO: 70250 - RNA, 20 nt, Artificial Sequence
  MKO10070250_B_Acur1a
  gRNA
acccaaacauguucguguca

SEQ ID NO: 70251 - RNA, 20 nt, Artificial Sequence
  MKO10070251_B_Acur1a
  gRNA
ggauccggugugauuaaagc

SEQ ID NO: 70252 - RNA, 20 nt, Artificial Sequence
  MKO10070252_B_Acur1b
  gRNA
gcugaccauccgauacccca

SEQ ID NO: 70253 - RNA, 20 nt, Artificial Sequence
  MKO10070253_B_Acur1b
  gRNA
ggggccuccguuagaagaac

SEQ ID NO: 70254 - RNA, 20 nt, Artificial Sequence
  MKO10070254_B_Acur1b
  gRNA
gcaggguucaggggugauca

SEQ ID NO: 70255 - RNA, 20 nt, Artificial Sequence
  MKO10070255_B_Acur2
  gRNA
acuuaccuugauaagauacc

SEQ ID NO: 70256 - RNA, 20 nt, Artificial Sequence
  MKO10070256_B_Acur2
  gRNA
guucugacuuuguaugcuca

SEQ ID NO: 70257 - RNA, 20 nt, Artificial Sequence
  MKO10070257_B_Acur2
  gRNA
uccuuccaguuugugaagug

SEQ ID NO: 70258 - RNA, 20 nt, Artificial Sequence
  MKO10070258_B_Acur3b
  gRNA
caacuuuaccuugguagcgu

SEQ ID NO: 70259 - RNA, 20 nt, Artificial Sequence
  MKO10070259_B_Acur3b
  gRNA
guugccugcguagccaagcu

SEQ ID NO: 70260 - RNA, 20 nt, Artificial Sequence
  MKO10070260_B_Acur3b
  gRNA
caugacgggauaaugaacug

SEQ ID NO: 70261 - RNA, 20 nt, Artificial Sequence
  MKO10070261_B_Acur3
  gRNA
ugaagaucauuacuuucuuu

SEQ ID NO: 70262 - RNA, 20 nt, Artificial Sequence
  MKO10070262_B_Acur3
  gRNA
caugaugggaugauaaacug

SEQ ID NO: 70263 - RNA, 20 nt, Artificial Sequence
  MKO10070263_B_Acur3
  gRNA
cauuaaagagucugcaaaag

SEQ ID NO: 70264 - RNA, 20 nt, Artificial Sequence
  MKO10070264_B_Acur5
  gRNA
ggagcauagcuacauugccg

SEQ ID NO: 70265 - RNA, 20 nt, Artificial Sequence
  MKO10070265_B_Acur5
  gRNA
cuacucccgucaaaugaugu

SEQ ID NO: 70266 - RNA, 20 nt, Artificial Sequence
  MKO10070266_B_Acur5
  gRNA
ggagcuccgacaucauuuga

SEQ ID NO: 70267 - RNA, 20 nt, Artificial Sequence
  MKO10070267_B_Acur6
  gRNA
ccggugcucucagcgcacac

SEQ ID NO: 70268 - RNA, 20 nt, Artificial Sequence
  MKO10070268_B_Acur6
  gRNA
aggauauaaaagaguccuga

SEQ ID NO: 70269 - RNA, 20 nt, Artificial Sequence
  MKO10070269_B_Acur6
  gRNA
gaugaaauaaaagacccuuc

SEQ ID NO: 70270 - RNA, 20 nt, Artificial Sequence
  MKO10070270_B_Acur8
  gRNA
ggucagcugaacauccaccc

SEQ ID NO: 70271 - RNA, 20 nt, Artificial Sequence
  MKO10070271_B_Acur8
  gRNA
cgaaccuguucuggugacac

SEQ ID NO: 70272 - RNA, 20 nt, Artificial Sequence
  MKO10070272_B_Acur8
  gRNA
aaaagaugucaaacgguaca

SEQ ID NO: 70273 - RNA, 20 nt, Artificial Sequence
  MKO10070273_B_Acurt1
  gRNA
agccgaauaacaucugucug

SEQ ID NO: 70274 - RNA, 20 nt, Artificial Sequence
  MKO10070274_B_Acurt1
  gRNA
uuccgauuagaucuugcaga

SEQ ID NO: 70275 - RNA, 20 nt, Artificial Sequence
  MKO10070275_B_Acurt1
  gRNA
acagaguugaugacaugacg

SEQ ID NO: 70276 - RNA, 20 nt, Artificial Sequence
  MKO10070276_B_Acurt2
  gRNA
ccaugggugcccaacugguc

SEQ ID NO: 70277 - RNA, 20 nt, Artificial Sequence
  MKO10070277_B_Acurt2
  gRNA
guagaaggcagguaccucga

SEQ ID NO: 70278 - RNA, 20 nt, Artificial Sequence
  MKO10070278_B_Acurt2
  gRNA
ucuccuugaugucauccgcc

SEQ ID NO: 70279 - RNA, 20 nt, Artificial Sequence
  MKO10070279_B_Acurt3
  gRNA
ccugccugcuguccgccgua

SEQ ID NO: 70280 - RNA, 20 nt, Artificial Sequence
  MKO10070280_B_Acurt3
  gRNA
ccgguccaagggccauacgg

SEQ ID NO: 70281 - RNA, 20 nt, Artificial Sequence
  MKO10070281_B_Acurt3
  gRNA
uuggaccggcccagaauauu

SEQ ID NO: 70282 - RNA, 20 nt, Artificial Sequence
  MKO10070282_B_Acvr1b
  gRNA
cacgccauacuuccccgaac

SEQ ID NO: 70283 - RNA, 20 nt, Artificial Sequence
  MKO10070283_B_Acvr1b
  gRNA
cauggugcuccacgccaucc

SEQ ID NO: 70284 - RNA, 20 nt, Artificial Sequence
  MKO10070284_B_Acvr1b
  gRNA
ccgcuacacagugaccauug

SEQ ID NO: 70285 - RNA, 20 nt, Artificial Sequence
  MKO10070285_B_Acvr1c
  gRNA
cuggcgcuuuccauagcgag

SEQ ID NO: 70286 - RNA, 20 nt, Artificial Sequence
  MKO10070286_B_Acvr1c
  gRNA
gccuccgucaugcuaaccaa

SEQ ID NO: 70287 - RNA, 20 nt, Artificial Sequence
  MKO10070287_B_Acvr1c
  gRNA
caaaucgugugugucccucc

SEQ ID NO: 70288 - RNA, 20 nt, Artificial Sequence
  MKO10070288_B_Acvr1
  gRNA
gguaccauacuccacgucuc

SEQ ID NO: 70289 - RNA, 20 nt, Artificial Sequence
  MKO10070289_B_Acvr1
  gRNA
ggcucgccagauaacccugu

SEQ ID NO: 70290 - RNA, 20 nt, Artificial Sequence
  MKO10070290_B_Acvr1
  gRNA
ccucccgagacgagaaguca

SEQ ID NO: 70291 - RNA, 20 nt, Artificial Sequence
  MKO10070291_B_Acvr2a
  gRNA
augauaucaacugcuaugac

SEQ ID NO: 70292 - RNA, 20 nt, Artificial Sequence
  MKO10070292_B_Acvr2a
  gRNA
uucaacccuaguaaugggga

SEQ ID NO: 70293 - RNA, 20 nt, Artificial Sequence
  MKO10070293_B_Acvr2a
  gRNA
uaccuuacaggugcuauacu

SEQ ID NO: 70294 - RNA, 20 nt, Artificial Sequence
  MKO10070294_B_Acvr2b
  gRNA
aucaaggcucggggccgcuu

SEQ ID NO: 70295 - RNA, 20 nt, Artificial Sequence
  MKO10070295_B_Acvr2b
  gRNA
ccuucuggauguaucgucau

SEQ ID NO: 70296 - RNA, 20 nt, Artificial Sequence
  MKO10070296_B_Acvr2b
  gRNA
guggcucaccuugucgugga

SEQ ID NO: 70297 - RNA, 20 nt, Artificial Sequence
  MKO10070297_B_Acvrl1
  gRNA
cgcgccacaccucaccauau

SEQ ID NO: 70298 - RNA, 20 nt, Artificial Sequence
  MKO10070298_B_Acvrl1
  gRNA
ccuggacagcgacuguacua

SEQ ID NO: 70299 - RNA, 20 nt, Artificial Sequence
  MKO10070299_B_Acvrl1
  gRNA
ccagcaucagagacacguug

SEQ ID NO: 70300 - RNA, 20 nt, Artificial Sequence
  MKO10070300_B_Acy1
  gRNA
gccacuccuaccaggcacaa

SEQ ID NO: 70301 - RNA, 20 nt, Artificial Sequence
  MKO10070301_B_Acy1
  gRNA
ucugagcugucagaaaauag

SEQ ID NO: 70302 - RNA, 20 nt, Artificial Sequence
  MKO10070302_B_Acy1
  gRNA
agcacagugaucacaaagcc

SEQ ID NO: 70303 - RNA, 20 nt, Artificial Sequence
  MKO10070303_B_Acy3
  gRNA
cucauacagaaagaggcggc

SEQ ID NO: 70304 - RNA, 20 nt, Artificial Sequence
  MKO10070304_B_Acy3
  gRNA
cugaaggucuccgucccagc

SEQ ID NO: 70305 - RNA, 20 nt, Artificial Sequence
  MKO10070305_B_Acy3
  gRNA
acaacaccaaccugcaguug

SEQ ID NO: 70306 - RNA, 20 nt, Artificial Sequence
  MKO10070306_B_Acyp1
  gRNA
cacauaccugaguguacuug

SEQ ID NO: 70307 - RNA, 20 nt, Artificial Sequence
  MKO10070307_B_Acyp1
  gRNA
caccgugcaagggcaacugc

SEQ ID NO: 70308 - RNA, 20 nt, Artificial Sequence
  MKO10070308_B_Acyp1
  gRNA
ugagaaagucaucgcaaacu

SEQ ID NO: 70309 - RNA, 20 nt, Artificial Sequence
  MKO10070309_B_Acyp2
  gRNA
acagugacaggucaaguuca

SEQ ID NO: 70310 - RNA, 20 nt, Artificial Sequence
  MKO10070310_B_Acyp2
  gRNA
uacagguguuugcuucagaa

SEQ ID NO: 70311 - RNA, 20 nt, Artificial Sequence
  MKO10070311_B_Acyp2
  gRNA
gaaggagaagcuaagaaacg

SEQ ID NO: 70312 - RNA, 20 nt, Artificial Sequence
  MKO10070312_B_Adad1
  gRNA
gaugguauucaguacaagac

SEQ ID NO: 70313 - RNA, 20 nt, Artificial Sequence
  MKO10070313_B_Adad1
  gRNA
gcguguucagcuugaccuua

SEQ ID NO: 70314 - RNA, 20 nt, Artificial Sequence
  MKO10070314_B_Adad1
  gRNA
cacgcugcauuugugcaaac

SEQ ID NO: 70315 - RNA, 20 nt, Artificial Sequence
  MKO10070315_B_Adad2
  gRNA
ggcuggaguucucaggccgu

SEQ ID NO: 70316 - RNA, 20 nt, Artificial Sequence
  MKO10070316_B_Adad2
  gRNA
auggguuggucuguccugcg

SEQ ID NO: 70317 - RNA, 20 nt, Artificial Sequence
  MKO10070317_B_Adad2
  gRNA
cuaccuaccuaugcugagag

SEQ ID NO: 70318 - RNA, 20 nt, Artificial Sequence
  MKO10070318_B_Adal
  gRNA
gagcuccaugcccacuugaa

SEQ ID NO: 70319 - RNA, 20 nt, Artificial Sequence
  MKO10070319_B_Adal
  gRNA
uaguaagcugauguauaacu

SEQ ID NO: 70320 - RNA, 20 nt, Artificial Sequence
  MKO10070320_B_Adal
  gRNA
aaugacuaggaagacuuacg

SEQ ID NO: 70321 - RNA, 20 nt, Artificial Sequence
  MKO10070321_B_Adam10
  gRNA
gauaccucucauauuuacac

SEQ ID NO: 70322 - RNA, 20 nt, Artificial Sequence
  MKO10070322_B_Adam10
  gRNA
ugaucugcacagccccccug

SEQ ID NO: 70323 - RNA, 20 nt, Artificial Sequence
  MKO10070323_B_Adam10
  gRNA
augaggaaguaccaaaugac

SEQ ID NO: 70324 - RNA, 20 nt, Artificial Sequence
  MKO10070324_B_Adam11
  gRNA
guggcgcuccacauacugcg

SEQ ID NO: 70325 - RNA, 20 nt, Artificial Sequence
  MKO10070325_B_Adam11
  gRNA
agcgaaccaugaggcggcug

SEQ ID NO: 70326 - RNA, 20 nt, Artificial Sequence
  MKO10070326_B_Adam11
  gRNA
ccaggugaguuucgucaucc

SEQ ID NO: 70327 - RNA, 20 nt, Artificial Sequence
  MKO10070327_B_Adam12
  gRNA
cucucucacucgaaaucaca

SEQ ID NO: 70328 - RNA, 20 nt, Artificial Sequence
  MKO10070328_B_Adam12
  gRNA
cacaggggacucauugccaa

SEQ ID NO: 70329 - RNA, 20 nt, Artificial Sequence
  MKO10070329_B_Adam12
  gRNA
aguugcacagucagcacguc

SEQ ID NO: 70330 - RNA, 20 nt, Artificial Sequence
  MKO10070330_B_Adam15
  gRNA
aacucaccuauauuuggcag

SEQ ID NO: 70331 - RNA, 20 nt, Artificial Sequence
  MKO10070331_B_Adam15
  gRNA
uccuggagcuucuacaaaau

SEQ ID NO: 70332 - RNA, 20 nt, Artificial Sequence
  MKO10070332_B_Adam15
  gRNA
cuggugugguaccagccuga

SEQ ID NO: 70333 - RNA, 20 nt, Artificial Sequence
  MKO10070333_B_Adam17
  gRNA
uacuaaagauaaacgaaugc

SEQ ID NO: 70334 - RNA, 20 nt, Artificial Sequence
  MKO10070334_B_Adam17
  gRNA
ucucugucuaugagcccuuu

SEQ ID NO: 70335 - RNA, 20 nt, Artificial Sequence
  MKO10070335_B_Adam17
  gRNA
auauucagcagcacuccaua

SEQ ID NO: 70336 - RNA, 20 nt, Artificial Sequence
  MKO10070336_B_Adam18
  gRNA
caggcucauugccauuaccg

SEQ ID NO: 70337 - RNA, 20 nt, Artificial Sequence
  MKO10070337_B_Adam18
  gRNA
gcacuucaucaacauauccu

SEQ ID NO: 70338 - RNA, 20 nt, Artificial Sequence
  MKO10070338_B_Adam18
  gRNA
auguguaaaccaaaaaguuc

SEQ ID NO: 70339 - RNA, 20 nt, Artificial Sequence
  MKO10070339_B_Adam19
  gRNA
cuuucugaaguccgccacug

SEQ ID NO: 70340 - RNA, 20 nt, Artificial Sequence
  MKO10070340_B_Adam19
  gRNA
augaacucauaauaccucag

SEQ ID NO: 70341 - RNA, 20 nt, Artificial Sequence
  MKO10070341_B_Adam19
  gRNA
gcgagagcugauccuagacc

SEQ ID NO: 70342 - RNA, 20 nt, Artificial Sequence
  MKO10070342_B_Adam1a
  gRNA
aagcacugucacugcgaugc

SEQ ID NO: 70343 - RNA, 20 nt, Artificial Sequence
  MKO10070343_B_Adam1a
  gRNA
aguauaucugcacuggucgu

SEQ ID NO: 70344 - RNA, 20 nt, Artificial Sequence
  MKO10070344_B_Adam1a
  gRNA
gagacucaagugucgaucag

SEQ ID NO: 70345 - RNA, 20 nt, Artificial Sequence
  MKO10070345_B_Adam1b
  gRNA
ucagagaccgcuuccgaagc

SEQ ID NO: 70346 - RNA, 20 nt, Artificial Sequence
  MKO10070346_B_Adam1b
  gRNA
cugagaccgaggacuggugc

SEQ ID NO: 70347 - RNA, 20 nt, Artificial Sequence
  MKO10070347_B_Adam1b
  gRNA
accgaacaacuugcugcucc

SEQ ID NO: 70348 - RNA, 20 nt, Artificial Sequence
  MKO10070348_B_Adam20
  gRNA
gaauuggaguaaucaguacc

SEQ ID NO: 70349 - RNA, 20 nt, Artificial Sequence
  MKO10070349_B_Adam20
  gRNA
uaacaaaucacacguguuag

SEQ ID NO: 70350 - RNA, 20 nt, Artificial Sequence
  MKO10070350_B_Adam20
  gRNA
gagaucaauguuguaacucc

SEQ ID NO: 70351 - RNA, 20 nt, Artificial Sequence
  MKO10070351_B_Adam21
  gRNA
agauuccauguacaagccgc

SEQ ID NO: 70352 - RNA, 20 nt, Artificial Sequence
  MKO10070352_B_Adam21
  gRNA
agacuacuguaccaacccuu

SEQ ID NO: 70353 - RNA, 20 nt, Artificial Sequence
  MKO10070353_B_Adam21
  gRNA
cgcucaacaaaacuugucaa

SEQ ID NO: 70354 - RNA, 20 nt, Artificial Sequence
  MKO10070354_B_Adam22
  gRNA
agcuuccggguggacgccuu

SEQ ID NO: 70355 - RNA, 20 nt, Artificial Sequence
  MKO10070355_B_Adam22
  gRNA
gauguugcagcugacgcaug

SEQ ID NO: 70356 - RNA, 20 nt, Artificial Sequence
  MKO10070356_B_Adam22
  gRNA
cugcccgaccgcagcgcgcc

SEQ ID NO: 70357 - RNA, 20 nt, Artificial Sequence
  MKO10070357_B_Adam23
  gRNA
uuugcuaucuucugacuacg

SEQ ID NO: 70358 - RNA, 20 nt, Artificial Sequence
  MKO10070358_B_Adam23
  gRNA
agcuuccagaucgaagcuuu

SEQ ID NO: 70359 - RNA, 20 nt, Artificial Sequence
  MKO10070359_B_Adam23
  gRNA
cgggaagcagauguacucua

SEQ ID NO: 70360 - RNA, 20 nt, Artificial Sequence
  MKO10070360_B_Adam24
  gRNA
aaaaaccuaacgucauaauu

SEQ ID NO: 70361 - RNA, 20 nt, Artificial Sequence
  MKO10070361_B_Adam24
  gRNA
aauaaccaaauuaugacguu

SEQ ID NO: 70362 - RNA, 20 nt, Artificial Sequence
  MKO10070362_B_Adam24
  gRNA
ucuucauaaacuucguuucc

SEQ ID NO: 70363 - RNA, 20 nt, Artificial Sequence
  MKO10070363_B_Adam25
  gRNA
gccaucuuugagggugcagc

SEQ ID NO: 70364 - RNA, 20 nt, Artificial Sequence
  MKO10070364_B_Adam25
  gRNA
uaccuugguuuagccuauau

SEQ ID NO: 70365 - RNA, 20 nt, Artificial Sequence
  MKO10070365_B_Adam25
  gRNA
acuguaguuauucuuacuac

SEQ ID NO: 70366 - RNA, 20 nt, Artificial Sequence
  MKO10070366_B_Adam26a
  gRNA
auccauuuggaaugagauaa

SEQ ID NO: 70367 - RNA, 20 nt, Artificial Sequence
  MKO10070367_B_Adam26a
  gRNA
cacagaguacaucagcaauu

SEQ ID NO: 70368 - RNA, 20 nt, Artificial Sequence
  MKO10070368_B_Adam26a
  gRNA
uucauuccauacuucaagag

SEQ ID NO: 70369 - RNA, 20 nt, Artificial Sequence
  MKO10070369_B_Adam26b
  gRNA
ccaugguaauagcagucauu

SEQ ID NO: 70370 - RNA, 20 nt, Artificial Sequence
  MKO10070370_B_Adam26b
  gRNA
accaaguuaugccauaugca

SEQ ID NO: 70371 - RNA, 20 nt, Artificial Sequence
  MKO10070371_B_Adam26b
  gRNA
uaaaaagcccaacuagaauu

SEQ ID NO: 70372 - RNA, 20 nt, Artificial Sequence
  MKO10070372_B_Adam28
  gRNA
ggcauacuaaccuuuggcuc

SEQ ID NO: 70373 - RNA, 20 nt, Artificial Sequence
  MKO10070373_B_Adam28
  gRNA
aaacauuugaaacugagcua

SEQ ID NO: 70374 - RNA, 20 nt, Artificial Sequence
  MKO10070374_B_Adam28
  gRNA
auaaaccacuucauauuucu

SEQ ID NO: 70375 - RNA, 20 nt, Artificial Sequence
  MKO10070375_B_Adam29
  gRNA
agucacccuccacauaaccu

SEQ ID NO: 70376 - RNA, 20 nt, Artificial Sequence
  MKO10070376_B_Adam29
  gRNA
ucacaucgccuauaucaguu

SEQ ID NO: 70377 - RNA, 20 nt, Artificial Sequence
  MKO10070377_B_Adam29
  gRNA
augaccgcaaugagcacugu

SEQ ID NO: 70378 - RNA, 20 nt, Artificial Sequence
  MKO10070378_B_Adam2
  gRNA
uuagcacauguacuggacuc

SEQ ID NO: 70379 - RNA, 20 nt, Artificial Sequence
  MKO10070379_B_Adam2
  gRNA
ugaagguuauccaaauucua

SEQ ID NO: 70380 - RNA, 20 nt, Artificial Sequence
  MKO10070380_B_Adam2
  gRNA
uucguagccauugcuuguga

SEQ ID NO: 70381 - RNA, 20 nt, Artificial Sequence
  MKO10070381_B_Adam30
  gRNA
ccugacaagugcaauagccg

SEQ ID NO: 70382 - RNA, 20 nt, Artificial Sequence
  MKO10070382_B_Adam30
  gRNA
uaccuccuguggucguaauc

SEQ ID NO: 70383 - RNA, 20 nt, Artificial Sequence
  MKO10070383_B_Adam30
  gRNA
uugcccguggcaauaugucu

SEQ ID NO: 70384 - RNA, 20 nt, Artificial Sequence
  MKO10070384_B_Adam32
  gRNA
guguacugcuucuuguuuau

SEQ ID NO: 70385 - RNA, 20 nt, Artificial Sequence
  MKO10070385_B_Adam32
  gRNA
caggcucagugcuauuauca

SEQ ID NO: 70386 - RNA, 20 nt, Artificial Sequence
  MKO10070386_B_Adam32
  gRNA
gccacccucagcacaugcuc

SEQ ID NO: 70387 - RNA, 20 nt, Artificial Sequence
  MKO10070387_B_Adam33
  gRNA
aacauccgagcgcuccgcag

SEQ ID NO: 70388 - RNA, 20 nt, Artificial Sequence
  MKO10070388_B_Adam33
  gRNA
aaagccaccagcaccgaguc

SEQ ID NO: 70389 - RNA, 20 nt, Artificial Sequence
  MKO10070389_B_Adam33
  gRNA
ggggagugacuagcucucca

SEQ ID NO: 70390 - RNA, 20 nt, Artificial Sequence
  MKO10070390_B_Adam34
  gRNA
uauuuaggguuagcuaaugu

SEQ ID NO: 70391 - RNA, 20 nt, Artificial Sequence
  MKO10070391_B_Adam34
  gRNA
aaccuugcugauguacucug

SEQ ID NO: 70392 - RNA, 20 nt, Artificial Sequence
  MKO10070392_B_Adam34
  gRNA
aaauguugacguugugcucu

SEQ ID NO: 70393 - RNA, 20 nt, Artificial Sequence
  MKO10070393_B_Adam39
  gRNA
caggcacaguuugccgaaaa

SEQ ID NO: 70394 - RNA, 20 nt, Artificial Sequence
  MKO10070394_B_Adam39
  gRNA
cccacuacaugcagcaugaa

SEQ ID NO: 70395 - RNA, 20 nt, Artificial Sequence
  MKO10070395_B_Adam39
  gRNA
uccaaucacaaaauucaacu

SEQ ID NO: 70396 - RNA, 20 nt, Artificial Sequence
  MKO10070396_B_Adam3
  gRNA
cugagugucacuguugauac

SEQ ID NO: 70397 - RNA, 20 nt, Artificial Sequence
  MKO10070397_B_Adam3
  gRNA
cgcaaauauguuccaaaaag

SEQ ID NO: 70398 - RNA, 20 nt, Artificial Sequence
  MKO10070398_B_Adam3
  gRNA
gugacacucagcacuugcuc

SEQ ID NO: 70399 - RNA, 20 nt, Artificial Sequence
  MKO10070399_B_Adam4
  gRNA
guaguggauggugcaaccug

SEQ ID NO: 70400 - RNA, 20 nt, Artificial Sequence
  MKO10070400_B_Adam4
  gRNA
uauucgcaugauucuuaucu

SEQ ID NO: 70401 - RNA, 20 nt, Artificial Sequence
  MKO10070401_B_Adam4
  gRNA
uaucauggcuuacaucuaaa

SEQ ID NO: 70402 - RNA, 20 nt, Artificial Sequence
  MKO10070402_B_Adam5
  gRNA
cggcuuaccagagcugacaa

SEQ ID NO: 70403 - RNA, 20 nt, Artificial Sequence
  MKO10070403_B_Adam5
  gRNA
uccugaaaagaucucaucac

SEQ ID NO: 70404 - RNA, 20 nt, Artificial Sequence
  MKO10070404_B_Adam5
  gRNA
uuucaggaacaguugucugc

SEQ ID NO: 70405 - RNA, 20 nt, Artificial Sequence
  MKO10070405_B_Adam6a
  gRNA
cagaacuuaccccuugaaca

SEQ ID NO: 70406 - RNA, 20 nt, Artificial Sequence
  MKO10070406_B_Adam6a
  gRNA
ccccagagauaaccgauuga

SEQ ID NO: 70407 - RNA, 20 nt, Artificial Sequence
  MKO10070407_B_Adam6a
  gRNA
ggcuccaaccaaaauggcaa

SEQ ID NO: 70408 - RNA, 20 nt, Artificial Sequence
  MKO10070408_B_Adam6b
  gRNA
cgacuugaguuugcaguucc

SEQ ID NO: 70409 - RNA, 20 nt, Artificial Sequence
  MKO10070409_B_Adam6b
  gRNA
uccuuagcccuaauuuguau

SEQ ID NO: 70410 - RNA, 20 nt, Artificial Sequence
  MKO10070410_B_Adam6b
  gRNA
gacaaacuuucaucuacugu

SEQ ID NO: 70411 - RNA, 20 nt, Artificial Sequence
  MKO10070411_B_Adam7
  gRNA
uuucacuguaauuugaacug

SEQ ID NO: 70412 - RNA, 20 nt, Artificial Sequence
  MKO10070412_B_Adam7
  gRNA
uuguaagauaccaagaucug

SEQ ID NO: 70413 - RNA, 20 nt, Artificial Sequence
  MKO10070413_B_Adam7
  gRNA
cacuuuaccuugcuuucaga

SEQ ID NO: 70414 - RNA, 20 nt, Artificial Sequence
  MKO10070414_B_Adam8
  gRNA
ucuccugaagcaguagcccc

SEQ ID NO: 70415 - RNA, 20 nt, Artificial Sequence
  MKO10070415_B_Adam8
  gRNA
gccaguauuagcaccugugc

SEQ ID NO: 70416 - RNA, 20 nt, Artificial Sequence
  MKO10070416_B_Adam8
  gRNA
gagaccuacucagcugccaa

SEQ ID NO: 70417 - RNA, 20 nt, Artificial Sequence
  MKO10070417_B_Adam9
  gRNA
uguaguuuacaccuacgaca

SEQ ID NO: 70418 - RNA, 20 nt, Artificial Sequence
  MKO10070418_B_Adam9
  gRNA
uuagaucucuuacgucaucc

SEQ ID NO: 70419 - RNA, 20 nt, Artificial Sequence
  MKO10070419_B_Adam9
  gRNA
cuuucucuaguuaaucucca

SEQ ID NO: 70420 - RNA, 20 nt, Artificial Sequence
  MKO10070420_B_Adamdec1
  gRNA
uaagauguuucaguguaguc

SEQ ID NO: 70421 - RNA, 20 nt, Artificial Sequence
  MKO10070421_B_Adamdec1
  gRNA
augaucugauauugaacuuc

SEQ ID NO: 70422 - RNA, 20 nt, Artificial Sequence
  MKO10070422_B_Adamdec1
  gRNA
gaaacaucuuacucacccag

SEQ ID NO: 70423 - RNA, 20 nt, Artificial Sequence
  MKO10070423_B_Adamts10
  gRNA
agucagcagagagcgcuaug

SEQ ID NO: 70424 - RNA, 20 nt, Artificial Sequence
  MKO10070424_B_Adamts10
  gRNA
aacgcuuguauacuacaugg

SEQ ID NO: 70425 - RNA, 20 nt, Artificial Sequence
  MKO10070425_B_Adamts10
  gRNA
uaucugauugaaccccugca

SEQ ID NO: 70426 - RNA, 20 nt, Artificial Sequence
  MKO10070426_B_Adamts12
  gRNA
ugucuccuguauacgacaug

SEQ ID NO: 70427 - RNA, 20 nt, Artificial Sequence
  MKO10070427_B_Adamts12
  gRNA
cuucuccacgacauagccgu

SEQ ID NO: 70428 - RNA, 20 nt, Artificial Sequence
  MKO10070428_B_Adamts12
  gRNA
ucuucgugucggccaccacg

SEQ ID NO: 70429 - RNA, 20 nt, Artificial Sequence
  MKO10070429_B_Adamts13
  gRNA
acuguugagaaacccauccc

SEQ ID NO: 70430 - RNA, 20 nt, Artificial Sequence
  MKO10070430_B_Adamts13
  gRNA
cugugggccccgauguuucc

SEQ ID NO: 70431 - RNA, 20 nt, Artificial Sequence
  MKO10070431_B_Adamts13
  gRNA
caucggggcccacagcuacc

SEQ ID NO: 70432 - RNA, 20 nt, Artificial Sequence
  MKO10070432_B_Adamts14
  gRNA
aaaugcugccucggaccgcc

SEQ ID NO: 70433 - RNA, 20 nt, Artificial Sequence
  MKO10070433_B_Adamts14
  gRNA
ggacccaugugguauaccgc

SEQ ID NO: 70434 - RNA, 20 nt, Artificial Sequence
  MKO10070434_B_Adamts14
  gRNA
acuucacgacuauguuguga

SEQ ID NO: 70435 - RNA, 20 nt, Artificial Sequence
  MKO10070435_B_Adamts15
  gRNA
caugccccaugacaacguga

SEQ ID NO: 70436 - RNA, 20 nt, Artificial Sequence
  MKO10070436_B_Adamts15
  gRNA
ggggcgugcagcuggcccgg

SEQ ID NO: 70437 - RNA, 20 nt, Artificial Sequence
  MKO10070437_B_Adamts15
  gRNA
cccggccuuacccagcucau

SEQ ID NO: 70438 - RNA, 20 nt, Artificial Sequence
  MKO10070438_B_Adamts16
  gRNA
ucuugccagaucucgcuucc

SEQ ID NO: 70439 - RNA, 20 nt, Artificial Sequence
  MKO10070439_B_Adamts16
  gRNA
cucuucuccgacgccuccgc

SEQ ID NO: 70440 - RNA, 20 nt, Artificial Sequence
  MKO10070440_B_Adamts16
  gRNA
acgcugcagcugcgaguccc

SEQ ID NO: 70441 - RNA, 20 nt, Artificial Sequence
  MKO10070441_B_Adamts17
  gRNA
cggcgaccgcgagcaucucc

SEQ ID NO: 70442 - RNA, 20 nt, Artificial Sequence
  MKO10070442_B_Adamts17
  gRNA
acuacuuugcagcgcugccu

SEQ ID NO: 70443 - RNA, 20 nt, Artificial Sequence
  MKO10070443_B_Adamts17
  gRNA
ugucggcaucggccaccacc

SEQ ID NO: 70444 - RNA, 20 nt, Artificial Sequence
  MKO10070444_B_Adamts18
  gRNA
gugacugcucaagaucgccg

SEQ ID NO: 70445 - RNA, 20 nt, Artificial Sequence
  MKO10070445_B_Adamts18
  gRNA
gggcggcccagacggucagc

SEQ ID NO: 70446 - RNA, 20 nt, Artificial Sequence
  MKO10070446_B_Adamts18
  gRNA
cacaacuauagcucgccugc

SEQ ID NO: 70447 - RNA, 20 nt, Artificial Sequence
  MKO10070447_B_Adamts19
  gRNA
cacugucccgguguaaaagc

SEQ ID NO: 70448 - RNA, 20 nt, Artificial Sequence
  MKO10070448_B_Adamts19
  gRNA
gucacccgcaccguuuauac

SEQ ID NO: 70449 - RNA, 20 nt, Artificial Sequence
  MKO10070449_B_Adamts19
  gRNA
gggcuuuauacagcucaaug

SEQ ID NO: 70450 - RNA, 20 nt, Artificial Sequence
  MKO10070450_B_Adamts1
  gRNA
ucccacacgugugacacucu

SEQ ID NO: 70451 - RNA, 20 nt, Artificial Sequence
  MKO10070451_B_Adamts1
  gRNA
cgccagugucaguuuacauu

SEQ ID NO: 70452 - RNA, 20 nt, Artificial Sequence
  MKO10070452_B_Adamts1
  gRNA
guuggcaucguacaagguac

SEQ ID NO: 70453 - RNA, 20 nt, Artificial Sequence
  MKO10070453_B_Adamts20
  gRNA
gcugcccguaggcgcugauu

SEQ ID NO: 70454 - RNA, 20 nt, Artificial Sequence
  MKO10070454_B_Adamts20
  gRNA
aguucguuuccacccacgac

SEQ ID NO: 70455 - RNA, 20 nt, Artificial Sequence
  MKO10070455_B_Adamts20
  gRNA
ugauaaaaaacgcuuauucc

SEQ ID NO: 70456 - RNA, 20 nt, Artificial Sequence
  MKO10070456_B_Adamts2
  gRNA
ugaacaaggccgagugcaug

SEQ ID NO: 70457 - RNA, 20 nt, Artificial Sequence
  MKO10070457_B_Adamts2
  gRNA
gcgggcucguacccccgccc

SEQ ID NO: 70458 - RNA, 20 nt, Artificial Sequence
  MKO10070458_B_Adamts2
  gRNA
aaucuaccaugaugagucgu

SEQ ID NO: 70459 - RNA, 20 nt, Artificial Sequence
  MKO10070459_B_Adamts3
  gRNA
uaucugaagacgucuaccac

SEQ ID NO: 70460 - RNA, 20 nt, Artificial Sequence
  MKO10070460_B_Adamts3
  gRNA
cugcuaucaaccaaagugac

SEQ ID NO: 70461 - RNA, 20 nt, Artificial Sequence
  MKO10070461_B_Adamts3
  gRNA
gacgucuucagauacaucuc

SEQ ID NO: 70462 - RNA, 20 nt, Artificial Sequence
  MKO10070462_B_Adamts4
  gRNA
gcuuaccauaaccauugucc

SEQ ID NO: 70463 - RNA, 20 nt, Artificial Sequence
  MKO10070463_B_Adamts4
  gRNA
ggguggccgcugucugcacg

SEQ ID NO: 70464 - RNA, 20 nt, Artificial Sequence
  MKO10070464_B_Adamts4
  gRNA
ggguuccucucgccauguca

SEQ ID NO: 70465 - RNA, 20 nt, Artificial Sequence
  MKO10070465_B_Adamts5
  gRNA
gaugguggcugacgugcauu

SEQ ID NO: 70466 - RNA, 20 nt, Artificial Sequence
  MKO10070466_B_Adamts5
  gRNA
guggcaucguaggucugucc

SEQ ID NO: 70467 - RNA, 20 nt, Artificial Sequence
  MKO10070467_B_Adamts5
  gRNA
aacacugcaggaacgguaua

SEQ ID NO: 70468 - RNA, 20 nt, Artificial Sequence
  MKO10070468_B_Adamts6
  gRNA
auucacaacguuuccuagac

SEQ ID NO: 70469 - RNA, 20 nt, Artificial Sequence
  MKO10070469_B_Adamts6
  gRNA
gaugucuuauucagccacca

SEQ ID NO: 70470 - RNA, 20 nt, Artificial Sequence
  MKO10070470_B_Adamts6
  gRNA
ucaacauaguacaacuaaag

SEQ ID NO: 70471 - RNA, 20 nt, Artificial Sequence
  MKO10070471_B_Adamts7
  gRNA
cccaugguacucgaccaucu

SEQ ID NO: 70472 - RNA, 20 nt, Artificial Sequence
  MKO10070472_B_Adamts7
  gRNA
agcacauagcucuccacuug

SEQ ID NO: 70473 - RNA, 20 nt, Artificial Sequence
  MKO10070473_B_Adamts7
  gRNA
ccucgucuuccaguaugaua

SEQ ID NO: 70474 - RNA, 20 nt, Artificial Sequence
  MKO10070474_B_Adamts8
  gRNA
cagugucauagugcuccggg

SEQ ID NO: 70475 - RNA, 20 nt, Artificial Sequence
  MKO10070475_B_Adamts8
  gRNA
acgugaacaagacgcugccc

SEQ ID NO: 70476 - RNA, 20 nt, Artificial Sequence
  MKO10070476_B_Adamts8
  gRNA
agggcagcgucuuguucacg

SEQ ID NO: 70477 - RNA, 20 nt, Artificial Sequence
  MKO10070477_B_Adamts9
  gRNA
gcagaagcgagacuuccgag

SEQ ID NO: 70478 - RNA, 20 nt, Artificial Sequence
  MKO10070478_B_Adamts9
  gRNA
gacuuacccggcaaaggccu

SEQ ID NO: 70479 - RNA, 20 nt, Artificial Sequence
  MKO10070479_B_Adamts9
  gRNA
uuccgucaaucacucugucu

SEQ ID NO: 70480 - RNA, 20 nt, Artificial Sequence
  MKO10070480_B_Adamtsl1
  gRNA
uuccaggacugcacgcucag

SEQ ID NO: 70481 - RNA, 20 nt, Artificial Sequence
  MKO10070481_B_Adamtsl1
  gRNA
gcugagauuuauacugcccu

SEQ ID NO: 70482 - RNA, 20 nt, Artificial Sequence
  MKO10070482_B_Adamtsl1
  gRNA
uucuggaacacucgcuccaa

SEQ ID NO: 70483 - RNA, 20 nt, Artificial Sequence
  MKO10070483_B_Adamtsl2
  gRNA
acgcccggccgucauacaca

SEQ ID NO: 70484 - RNA, 20 nt, Artificial Sequence
  MKO10070484_B_Adamtsl2
  gRNA
acagcauguucccgcaguug

SEQ ID NO: 70485 - RNA, 20 nt, Artificial Sequence
  MKO10070485_B_Adamtsl2
  gRNA
gguccacuccccccaccagu

SEQ ID NO: 70486 - RNA, 20 nt, Artificial Sequence
  MKO10070486_B_Adamtsl3
  gRNA
cacauaccgcuaugaugacc

SEQ ID NO: 70487 - RNA, 20 nt, Artificial Sequence
  MKO10070487_B_Adamtsl3
  gRNA
cagacaucuccgcaaagaau

SEQ ID NO: 70488 - RNA, 20 nt, Artificial Sequence
  MKO10070488_B_Adamtsl3
  gRNA
uccuccuuuaggaacugcga

SEQ ID NO: 70489 - RNA, 20 nt, Artificial Sequence
  MKO10070489_B_Adamtsl4
  gRNA
cucccauaaccgaacauccc

SEQ ID NO: 70490 - RNA, 20 nt, Artificial Sequence
  MKO10070490_B_Adamtsl4
  gRNA
caggaagcccaucgacccca

SEQ ID NO: 70491 - RNA, 20 nt, Artificial Sequence
  MKO10070491_B_Adamtsl4
  gRNA
agagggccaccccuuccccg

SEQ ID NO: 70492 - RNA, 20 nt, Artificial Sequence
  MKO10070492_B_Adamtsl5
  gRNA
cuaccggcagcuggcacacc

SEQ ID NO: 70493 - RNA, 20 nt, Artificial Sequence
  MKO10070493_B_Adamtsl5
  gRNA
gaccucaacugccuagcuga

SEQ ID NO: 70494 - RNA, 20 nt, Artificial Sequence
  MKO10070494_B_Adamtsl5
  gRNA
ggggcgacagccaugaauac

SEQ ID NO: 70495 - RNA, 20 nt, Artificial Sequence
  MKO10070495_B_Adap1
  gRNA
guaguagaagggcgguacuu

SEQ ID NO: 70496 - RNA, 20 nt, Artificial Sequence
  MKO10070496_B_Adap1
  gRNA
gaggcaagaauucguucaug

SEQ ID NO: 70497 - RNA, 20 nt, Artificial Sequence
  MKO10070497_B_Adap1
  gRNA
cccgcccacgcuuccagaga

SEQ ID NO: 70498 - RNA, 20 nt, Artificial Sequence
  MKO10070498_B_Adap2
  gRNA
cuucugggacgacaguaugg

SEQ ID NO: 70499 - RNA, 20 nt, Artificial Sequence
  MKO10070499_B_Adap2
  gRNA
ucgagcuaaguaugaaagac

SEQ ID NO: 70500 - RNA, 20 nt, Artificial Sequence
  MKO10070500_B_Adap2
  gRNA
uuacaguucaugacucacca

SEQ ID NO: 70501 - RNA, 20 nt, Artificial Sequence
  MKO10070501_B_Adarb1
  gRNA
uucgggagauuaucucugcg

SEQ ID NO: 70502 - RNA, 20 nt, Artificial Sequence
  MKO10070502_B_Adarb1
  gRNA
agucauugagugcgaggcca

SEQ ID NO: 70503 - RNA, 20 nt, Artificial Sequence
  MKO10070503_B_Adarb1
  gRNA
uuuccuccccucaugcacga

SEQ ID NO: 70504 - RNA, 20 nt, Artificial Sequence
  MKO10070504_B_Adarb2
  gRNA
guaugcccgccacaaaacac

SEQ ID NO: 70505 - RNA, 20 nt, Artificial Sequence
  MKO10070505_B_Adarb2
  gRNA
gugcucaccgcugauacacu

SEQ ID NO: 70506 - RNA, 20 nt, Artificial Sequence
  MKO10070506_B_Adarb2
  gRNA
cgacugucaugcugagaucg

SEQ ID NO: 70507 - RNA, 20 nt, Artificial Sequence
  MKO10070507_B_Adar
  gRNA
caccuggucauccgcugaac

SEQ ID NO: 70508 - RNA, 20 nt, Artificial Sequence
  MKO10070508_B_Adar
  gRNA
uucccgaagcagaaucgcca

SEQ ID NO: 70509 - RNA, 20 nt, Artificial Sequence
  MKO10070509_B_Adar
  gRNA
gcgggaauuucccccagcug

SEQ ID NO: 70510 - RNA, 20 nt, Artificial Sequence
  MKO10070510_B_Adau1
  gRNA
caguccaagaugcgagagag

SEQ ID NO: 70511 - RNA, 20 nt, Artificial Sequence
  MKO10070511_B_Adau1
  gRNA
cggcugccaaauggagcuga

SEQ ID NO: 70512 - RNA, 20 nt, Artificial Sequence
  MKO10070512_B_Adau1
  gRNA
caaagaugcuauccucuuuc

SEQ ID NO: 70513 - RNA, 20 nt, Artificial Sequence
  MKO10070513_B_Adau2
  gRNA
ugacagccauagacgaccag

SEQ ID NO: 70514 - RNA, 20 nt, Artificial Sequence
  MKO10070514_B_Adau2
  gRNA
cuucauuguuauagaccaua

SEQ ID NO: 70515 - RNA, 20 nt, Artificial Sequence
  MKO10070515_B_Adau2
  gRNA
ucuauaacaaugaaguugug

SEQ ID NO: 70516 - RNA, 20 nt, Artificial Sequence
  MKO10070516_B_Adau3
  gRNA
acugguccucgagaauaccg

SEQ ID NO: 70517 - RNA, 20 nt, Artificial Sequence
  MKO10070517_B_Adau3
  gRNA
auccagcuugcgcacgcuac

SEQ ID NO: 70518 - RNA, 20 nt, Artificial Sequence
  MKO10070518_B_Adau3
  gRNA
cgcauccagcgagucuucua

SEQ ID NO: 70519 - RNA, 20 nt, Artificial Sequence
  MKO10070519_B_Ada
  gRNA
gaggagcugcgcaacauuau

SEQ ID NO: 70520 - RNA, 20 nt, Artificial Sequence
  MKO10070520_B_Ada
  gRNA
acaagauccacaacgucauc

SEQ ID NO: 70521 - RNA, 20 nt, Artificial Sequence
  MKO10070521_B_Ada
  gRNA
ccaagguggacccaaugccc

SEQ ID NO: 70522 - RNA, 20 nt, Artificial Sequence
  MKO10070522_B_Adck1
  gRNA
gcaggucauccgagaagacc

SEQ ID NO: 70523 - RNA, 20 nt, Artificial Sequence
  MKO10070523_B_Adck1
  gRNA
gcagguaguccagcgccccc

SEQ ID NO: 70524 - RNA, 20 nt, Artificial Sequence
  MKO10070524_B_Adck1
  gRNA
gaagaaccugccucucgagu

SEQ ID NO: 70525 - RNA, 20 nt, Artificial Sequence
  MKO10070525_B_Adck2
  gRNA
uagcuugccugagaucgugg

SEQ ID NO: 70526 - RNA, 20 nt, Artificial Sequence
  MKO10070526_B_Adck2
  gRNA
guuguuggaugcuggcauug

SEQ ID NO: 70527 - RNA, 20 nt, Artificial Sequence
  MKO10070527_B_Adck2
  gRNA
gauucugagcuucauagcgc

SEQ ID NO: 70528 - RNA, 20 nt, Artificial Sequence
  MKO10070528_B_Adck3
  gRNA
ccagcgaagauccuuccacc

SEQ ID NO: 70529 - RNA, 20 nt, Artificial Sequence
  MKO10070529_B_Adck3
  gRNA
auugggcgguuggccaacuu

SEQ ID NO: 70530 - RNA, 20 nt, Artificial Sequence
  MKO10070530_B_Adck3
  gRNA
cauaggaaaaaaagccgugc

SEQ ID NO: 70531 - RNA, 20 nt, Artificial Sequence
  MKO10070531_B_Adck4
  gRNA
ugccucccgcaucagucgcu

SEQ ID NO: 70532 - RNA, 20 nt, Artificial Sequence
  MKO10070532_B_Adck4
  gRNA
acgggaggcccggcucagga

SEQ ID NO: 70533 - RNA, 20 nt, Artificial Sequence
  MKO10070533_B_Adck4
  gRNA
ucagugaagaugacauucgc

SEQ ID NO: 70534 - RNA, 20 nt, Artificial Sequence
  MKO10070534_B_Adck5
  gRNA
ugugcaccaccaguaguccg

SEQ ID NO: 70535 - RNA, 20 nt, Artificial Sequence
  MKO10070535_B_Adck5
  gRNA
cgugcccugccauauucuuc

SEQ ID NO: 70536 - RNA, 20 nt, Artificial Sequence
  MKO10070536_B_Adck5
  gRNA
ggucucauuaccuugcuggu

SEQ ID NO: 70537 - RNA, 20 nt, Artificial Sequence
  MKO10070537_B_Adcy10
  gRNA
ugaaacacggaacuacuucc

SEQ ID NO: 70538 - RNA, 20 nt, Artificial Sequence
  MKO10070538_B_Adcy10
  gRNA
accuuaacugcucucugauc

SEQ ID NO: 70539 - RNA, 20 nt, Artificial Sequence
  MKO10070539_B_Adcy10
  gRNA
ucuuaaaggugaugccuugc

SEQ ID NO: 70540 - RNA, 20 nt, Artificial Sequence
  MKO10070540_B_Adcy1
  gRNA
aacccacgaugucugcaaac

SEQ ID NO: 70541 - RNA, 20 nt, Artificial Sequence
  MKO10070541_B_Adcy1
  gRNA
caaguucgaugaguuagcca

SEQ ID NO: 70542 - RNA, 20 nt, Artificial Sequence
  MKO10070542_B_Adcy1
  gRNA
aucuugugaaaaauccucuc

SEQ ID NO: 70543 - RNA, 20 nt, Artificial Sequence
  MKO10070543_B_Adcy2
  gRNA
cacuaucguaugagaugaag

SEQ ID NO: 70544 - RNA, 20 nt, Artificial Sequence
  MKO10070544_B_Adcy2
  gRNA
gcuucuccgaguguucucgc

SEQ ID NO: 70545 - RNA, 20 nt, Artificial Sequence
  MKO10070545_B_Adcy2
  gRNA
agaucaccagcgagaacacu

SEQ ID NO: 70546 - RNA, 20 nt, Artificial Sequence
  MKO10070546_B_Adcy3
  gRNA
ggcagaccgcaagcaccgca

SEQ ID NO: 70547 - RNA, 20 nt, Artificial Sequence
  MKO10070547_B_Adcy3
  gRNA
caucucgucagccacgugcu

SEQ ID NO: 70548 - RNA, 20 nt, Artificial Sequence
  MKO10070548_B_Adcy3
  gRNA
cauaccugacauucucgugc

SEQ ID NO: 70549 - RNA, 20 nt, Artificial Sequence
  MKO10070549_B_Adcy4
  gRNA
gcauuacuggcucugggcua

SEQ ID NO: 70550 - RNA, 20 nt, Artificial Sequence
  MKO10070550_B_Adcy4
  gRNA
ugcaggcuggacagcgcuca

SEQ ID NO: 70551 - RNA, 20 nt, Artificial Sequence
  MKO10070551_B_Adcy4
  gRNA
cucaucccucucgcaccugc

SEQ ID NO: 70552 - RNA, 20 nt, Artificial Sequence
  MKO10070552_B_Adcy5
  gRNA
agcccucgaugucagcaaac

SEQ ID NO: 70553 - RNA, 20 nt, Artificial Sequence
  MKO10070553_B_Adcy5
  gRNA
ggauuguuacuacugcgucu

SEQ ID NO: 70554 - RNA, 20 nt, Artificial Sequence
  MKO10070554_B_Adcy5
  gRNA
ccagcgggagaaccagcaac

SEQ ID NO: 70555 - RNA, 20 nt, Artificial Sequence
  MKO10070555_B_Adcy6
  gRNA
agcccucaauguccgcaaac

SEQ ID NO: 70556 - RNA, 20 nt, Artificial Sequence
  MKO10070556_B_Adcy6
  gRNA
gcgugaucugcccgggccuc

SEQ ID NO: 70557 - RNA, 20 nt, Artificial Sequence
  MKO10070557_B_Adcy6
  gRNA
uugacaagcuggcugcggug

SEQ ID NO: 70558 - RNA, 20 nt, Artificial Sequence
  MKO10070558_B_Adcy7
  gRNA
gcugguguaugucgagugcc

SEQ ID NO: 70559 - RNA, 20 nt, Artificial Sequence
  MKO10070559_B_Adcy7
  gRNA
uacuaggcuccgugcugaug

SEQ ID NO: 70560 - RNA, 20 nt, Artificial Sequence
  MKO10070560_B_Adcy7
  gRNA
caucauugagcgccucaaag

SEQ ID NO: 70561 - RNA, 20 nt, Artificial Sequence
  MKO10070561_B_Adcy8
  gRNA
cgcucauugcuguguugaaa

SEQ ID NO: 70562 - RNA, 20 nt, Artificial Sequence
  MKO10070562_B_Adcy8
  gRNA
cucuacgaccuugucugcuc

SEQ ID NO: 70563 - RNA, 20 nt, Artificial Sequence
  MKO10070563_B_Adcy8
  gRNA
cacaguaguagcaguccccc

SEQ ID NO: 70564 - RNA, 20 nt, Artificial Sequence
  MKO10070564_B_Adcy9
  gRNA
cgagccuaagaccagcacca

SEQ ID NO: 70565 - RNA, 20 nt, Artificial Sequence
  MKO10070565_B_Adcy9
  gRNA
cggauguucuugaaccugag

SEQ ID NO: 70566 - RNA, 20 nt, Artificial Sequence
  MKO10070566_B_Adcy9
  gRNA
guucaggcugaacugauuga

SEQ ID NO: 70567 - RNA, 20 nt, Artificial Sequence
  MKO10070567_B_Adcyap1r1
  gRNA
ccagagggccaacgaccuga

SEQ ID NO: 70568 - RNA, 20 nt, Artificial Sequence
  MKO10070568_B_Adcyap1r1
  gRNA
gggcccuuaccauaggcagc

SEQ ID NO: 70569 - RNA, 20 nt, Artificial Sequence
  MKO10070569_B_Adcyap1r1
  gRNA
gucuggaugacagaaaccau

SEQ ID NO: 70570 - RNA, 20 nt, Artificial Sequence
  MKO10070570_B_Adcyap1
  gRNA
aaacucuuaccccgcgcccc

SEQ ID NO: 70571 - RNA, 20 nt, Artificial Sequence
  MKO10070571_B_Adcyap1
  gRNA
gccccuuaccaaacgccacu

SEQ ID NO: 70572 - RNA, 20 nt, Artificial Sequence
  MKO10070572_B_Adcyap1
  gRNA
cgaagccuaucgaaaagucu

SEQ ID NO: 70573 - RNA, 20 nt, Artificial Sequence
  MKO10070573_B_Adc
  gRNA
ucagcgacgccccaaaccuc

SEQ ID NO: 70574 - RNA, 20 nt, Artificial Sequence
  MKO10070574_B_Adc
  gRNA
ccgaccugggugcuguagug

SEQ ID NO: 70575 - RNA, 20 nt, Artificial Sequence
  MKO10070575_B_Adc
  gRNA
guucucgagcagaugucugc

SEQ ID NO: 70576 - RNA, 20 nt, Artificial Sequence
  MKO10070576_B_Add1
  gRNA
gaaguuacugcgguguaaac

SEQ ID NO: 70577 - RNA, 20 nt, Artificial Sequence
  MKO10070577_B_Add1
  gRNA
cacuuccucaucguaccuuu

SEQ ID NO: 70578 - RNA, 20 nt, Artificial Sequence
  MKO10070578_B_Add1
  gRNA
caaucugcugcaaugccagc

SEQ ID NO: 70579 - RNA, 20 nt, Artificial Sequence
  MKO10070579_B_Add2
  gRNA
ccaugaaguccgcgaucugu

SEQ ID NO: 70580 - RNA, 20 nt, Artificial Sequence
  MKO10070580_B_Add2
  gRNA
gcacacgccugccaccgcag

SEQ ID NO: 70581 - RNA, 20 nt, Artificial Sequence
  MKO10070581_B_Add2
  gRNA
aaacccccuuggggcugauc

SEQ ID NO: 70582 - RNA, 20 nt, Artificial Sequence
  MKO10070582_B_Add3
  gRNA
caugucuccugaucuacgac

SEQ ID NO: 70583 - RNA, 20 nt, Artificial Sequence
  MKO10070583_B_Add3
  gRNA
uugaaguccugucguagauc

SEQ ID NO: 70584 - RNA, 20 nt, Artificial Sequence
  MKO10070584_B_Add3
  gRNA
cuuccagguacgaauaagua

SEQ ID NO: 70585 - RNA, 20 nt, Artificial Sequence
  MKO10070585_B_Adgb
  gRNA
aguuccccaucuggccagag

SEQ ID NO: 70586 - RNA, 20 nt, Artificial Sequence
  MKO10070586_B_Adgb
  gRNA
agucauugaaaguauucucc

SEQ ID NO: 70587 - RNA, 20 nt, Artificial Sequence
  MKO10070587_B_Adgb
  gRNA
cugcuaaauauaaaaucuug

SEQ ID NO: 70588 - RNA, 20 nt, Artificial Sequence
  MKO10070588_B_Adh1
  gRNA
uggugaagcuccaucgauuu

SEQ ID NO: 70589 - RNA, 20 nt, Artificial Sequence
  MKO10070589_B_Adh1
  gRNA
uaaccacgugaucgucugag

SEQ ID NO: 70590 - RNA, 20 nt, Artificial Sequence
  MKO10070590_B_Adh1
  gRNA
cugccgcucagacgaucacg

SEQ ID NO: 70591 - RNA, 20 nt, Artificial Sequence
  MKO10070591_B_Adh4
  gRNA
guccccuccuaaagcuugug

SEQ ID NO: 70592 - RNA, 20 nt, Artificial Sequence
  MKO10070592_B_Adh4
  gRNA
ucgguggcauugaugucagu

SEQ ID NO: 70593 - RNA, 20 nt, Artificial Sequence
  MKO10070593_B_Adh4
  gRNA
gugaauaccugguuugaagu

SEQ ID NO: 70594 - RNA, 20 nt, Artificial Sequence
  MKO10070594_B_Adh5
  gRNA
accgaugccuauacccugag

SEQ ID NO: 70595 - RNA, 20 nt, Artificial Sequence
  MKO10070595_B_Adh5
  gRNA
ccucggggucagcuccgcuc

SEQ ID NO: 70596 - RNA, 20 nt, Artificial Sequence
  MKO10070596_B_Adh5
  gRNA
auccgaacuucaugagccuu

SEQ ID NO: 70597 - RNA, 20 nt, Artificial Sequence
  MKO10070597_B_Adh6a
  gRNA
ucuaugcagaugaucucguc

SEQ ID NO: 70598 - RNA, 20 nt, Artificial Sequence
  MKO10070598_B_Adh6a
  gRNA
ugaugcucgacgggaccucc

SEQ ID NO: 70599 - RNA, 20 nt, Artificial Sequence
  MKO10070599_B_Adh6a
  gRNA
ucugaugaucacgugcugaa

SEQ ID NO: 70600 - RNA, 20 nt, Artificial Sequence
  MKO10070600_B_Adh7
  gRNA
aaucgagguggccccaccaa

SEQ ID NO: 70601 - RNA, 20 nt, Artificial Sequence
  MKO10070601_B_Adh7
  gRNA
aucugugcgacagauuccug

SEQ ID NO: 70602 - RNA, 20 nt, Artificial Sequence
  MKO10070602_B_Adh7
  gRNA
ggggucacuacagugagacc

SEQ ID NO: 70603 - RNA, 20 nt, Artificial Sequence
  MKO10070603_B_Adhfe1
  gRNA
gcagggguuacgaaggaagu

SEQ ID NO: 70604 - RNA, 20 nt, Artificial Sequence
  MKO10070604_B_Adhfe1
  gRNA
gcugucucaaauauuagaua

SEQ ID NO: 70605 - RNA, 20 nt, Artificial Sequence
  MKO10070605_B_Adhfe1
  gRNA
cauucucauacuuacuccca

SEQ ID NO: 70606 - RNA, 20 nt, Artificial Sequence
  MKO10070606_B_Adi1
  gRNA
agauacacuucccaauuacg

SEQ ID NO: 70607 - RNA, 20 nt, Artificial Sequence
  MKO10070607_B_Adi1
  gRNA
gcucaccuucuccucguaau

SEQ ID NO: 70608 - RNA, 20 nt, Artificial Sequence
  MKO10070608_B_Adi1
  gRNA
caucuaucaccgcuucacac

SEQ ID NO: 70609 - RNA, 20 nt, Artificial Sequence
  MKO10070609_B_Adig
  gRNA
auucagauuugugcuucaac

SEQ ID NO: 70610 - RNA, 20 nt, Artificial Sequence
  MKO10070610_B_Adig
  gRNA
agugugaggucgcucaccag

SEQ ID NO: 70611 - RNA, 20 nt, Artificial Sequence
  MKO10070611_B_Adig
  gRNA
ugaggagacauuuccuggug

SEQ ID NO: 70612 - RNA, 20 nt, Artificial Sequence
  MKO10070612_B_Adipoq
  gRNA
ccacccaagggaacuugugc

SEQ ID NO: 70613 - RNA, 20 nt, Artificial Sequence
  MKO10070613_B_Adipoq
  gRNA
guaucgcucagcguucagug

SEQ ID NO: 70614 - RNA, 20 nt, Artificial Sequence
  MKO10070614_B_Adipoq
  gRNA
gucaacgacucuacauuuac

SEQ ID NO: 70615 - RNA, 20 nt, Artificial Sequence
  MKO10070615_B_Adipor1
  gRNA
gcucuugaagcaagcccgaa

SEQ ID NO: 70616 - RNA, 20 nt, Artificial Sequence
  MKO10070616_B_Adipor1
  gRNA
ugaggcagagcaccgcgccc

SEQ ID NO: 70617 - RNA, 20 nt, Artificial Sequence
  MKO10070617_B_Adipor1
  gRNA
gguuugccacucccaagcac

SEQ ID NO: 70618 - RNA, 20 nt, Artificial Sequence
  MKO10070618_B_Adipor2
  gRNA
ucauuauccuuaagccaauc

SEQ ID NO: 70619 - RNA, 20 nt, Artificial Sequence
  MKO10070619_B_Adipor2
  gRNA
gggcauguccccgcuccuac

SEQ ID NO: 70620 - RNA, 20 nt, Artificial Sequence
  MKO10070620_B_Adipor2
  gRNA
ccauucguuccauagcauga

SEQ ID NO: 70621 - RNA, 20 nt, Artificial Sequence
  MKO10070621_B_Adk
  gRNA
gcuugucuucagccaagauc

SEQ ID NO: 70622 - RNA, 20 nt, Artificial Sequence
  MKO10070622_B_Adk
  gRNA
uucaaaguugaauaucaugc

SEQ ID NO: 70623 - RNA, 20 nt, Artificial Sequence
  MKO10070623_B_Adk
  gRNA
gaaaccaaaugaccagaucu

SEQ ID NO: 70624 - RNA, 20 nt, Artificial Sequence
  MKO10070624_B_Adm2
  gRNA
cagacaacgugccggggagc

SEQ ID NO: 70625 - RNA, 20 nt, Artificial Sequence
  MKO10070625_B_Adm2
  gRNA
ucgucaugccccccagccac

SEQ ID NO: 70626 - RNA, 20 nt, Artificial Sequence
  MKO10070626_B_Adm2
  gRNA
ggugguggcucacgacaccc

SEQ ID NO: 70627 - RNA, 20 nt, Artificial Sequence
  MKO10070627_B_Adm
  gRNA
cgagugaacccaauaacauc

SEQ ID NO: 70628 - RNA, 20 nt, Artificial Sequence
  MKO10070628_B_Adm
  gRNA
acuccacaguccgggaccgg

SEQ ID NO: 70629 - RNA, 20 nt, Artificial Sequence
  MKO10070629_B_Adm
  gRNA
caguuguguucugcucgucc

SEQ ID NO: 70630 - RNA, 20 nt, Artificial Sequence
  MKO10070630_B_Adnp2
  gRNA
ugcagaaucuugacaacauc

SEQ ID NO: 70631 - RNA, 20 nt, Artificial Sequence
  MKO10070631_B_Adnp2
  gRNA
auguugucaagauucugcac

SEQ ID NO: 70632 - RNA, 20 nt, Artificial Sequence
  MKO10070632_B_Adnp2
  gRNA
gaucuuaaaagcuuugaucc

SEQ ID NO: 70633 - RNA, 20 nt, Artificial Sequence
  MKO10070633_B_Adnp
  gRNA
caacuuccugucaacaaucu

SEQ ID NO: 70634 - RNA, 20 nt, Artificial Sequence
  MKO10070634_B_Adnp
  gRNA
aaacugccaagauuguugac

SEQ ID NO: 70635 - RNA, 20 nt, Artificial Sequence
  MKO10070635_B_Adnp
  gRNA
uuuauuugaaaaacacuaca

SEQ ID NO: 70636 - RNA, 20 nt, Artificial Sequence
  MKO10070636_B_Adora1
  gRNA
cuucugcuucaucguauccc

SEQ ID NO: 70637 - RNA, 20 nt, Artificial Sequence
  MKO10070637_B_Adora1
  gRNA
ugauguggcuguuggcgccc

SEQ ID NO: 70638 - RNA, 20 nt, Artificial Sequence
  MKO10070638_B_Adora1
  gRNA
agguagcaucgcgaagugcc

SEQ ID NO: 70639 - RNA, 20 nt, Artificial Sequence
  MKO10070639_B_Adora2a
  gRNA
cgugguacccaugaauuaca

SEQ ID NO: 70640 - RNA, 20 nt, Artificial Sequence
  MKO10070640_B_Adora2a
  gRNA
agcacacaagcacguuaccc

SEQ ID NO: 70641 - RNA, 20 nt, Artificial Sequence
  MKO10070641_B_Adora2a
  gRNA
ugucgauggcaauagccaag

SEQ ID NO: 70642 - RNA, 20 nt, Artificial Sequence
  MKO10070642_B_Adora2b
  gRNA
cauuggauugacuccguucc

SEQ ID NO: 70643 - RNA, 20 nt, Artificial Sequence
  MKO10070643_B_Adora2b
  gRNA
ucaccugagcgggacgcgaa

SEQ ID NO: 70644 - RNA, 20 nt, Artificial Sequence
  MKO10070644_B_Adora2b
  gRNA
aucccuggcgacggcagacg

SEQ ID NO: 70645 - RNA, 20 nt, Artificial Sequence
  MKO10070645_B_Adora3
  gRNA
cuuaccggaaaagagagcca

SEQ ID NO: 70646 - RNA, 20 nt, Artificial Sequence
  MKO10070646_B_Adora3
  gRNA
cuuggugugguccuuguagu

SEQ ID NO: 70647 - RNA, 20 nt, Artificial Sequence
  MKO10070647_B_Adora3
  gRNA
cuuuggaagcccuacagcuc

SEQ ID NO: 70648 - RNA, 20 nt, Artificial Sequence
  MKO10070648_B_Ado
  gRNA
ccuugcgcggcgcgauguug

SEQ ID NO: 70649 - RNA, 20 nt, Artificial Sequence
  MKO10070649_B_Ado
  gRNA
gcccgucgagcugccgcgga

SEQ ID NO: 70650 - RNA, 20 nt, Artificial Sequence
  MKO10070650_B_Ado
  gRNA
acgcagcacgcccggucgca

SEQ ID NO: 70651 - RNA, 20 nt, Artificial Sequence
  MKO10070651_B_Adpgk
  gRNA
uucucucacgaccucuccaa

SEQ ID NO: 70652 - RNA, 20 nt, Artificial Sequence
  MKO10070652_B_Adpgk
  gRNA
gucuuacagcauuauguagg

SEQ ID NO: 70653 - RNA, 20 nt, Artificial Sequence
  MKO10070653_B_Adpgk
  gRNA
augcugcuuuaauuggacag

SEQ ID NO: 70654 - RNA, 20 nt, Artificial Sequence
  MKO10070654_B_Adprhl1
  gRNA
guuugccucuuacgcacuac

SEQ ID NO: 70655 - RNA, 20 nt, Artificial Sequence
  MKO10070655_B_Adprhl1
  gRNA
augagcgucuccagccguuc

SEQ ID NO: 70656 - RNA, 20 nt, Artificial Sequence
  MKO10070656_B_Adprhl1
  gRNA
cuuucccuguagugcguaag

SEQ ID NO: 70657 - RNA, 20 nt, Artificial Sequence
  MKO10070657_B_Adprhl2
  gRNA
ccuuggcguccaagaccgau

SEQ ID NO: 70658 - RNA, 20 nt, Artificial Sequence
  MKO10070658_B_Adprhl2
  gRNA
ggccuucgacgagguggaca

SEQ ID NO: 70659 - RNA, 20 nt, Artificial Sequence
  MKO10070659_B_Adprhl2
  gRNA
cuauaacggugccaucuugc

SEQ ID NO: 70660 - RNA, 20 nt, Artificial Sequence
  MKO10070660_B_Adprh
  gRNA
gccacccucgugacuguuga

SEQ ID NO: 70661 - RNA, 20 nt, Artificial Sequence
  MKO10070661_B_Adprh
  gRNA
cccuacuagccaaacauuac

SEQ ID NO: 70662 - RNA, 20 nt, Artificial Sequence
  MKO10070662_B_Adprh
  gRNA
ggagacgauacaccagcagu

SEQ ID NO: 70663 - RNA, 20 nt, Artificial Sequence
  MKO10070663_B_Adprm
  gRNA
cauccacguaguuccaagcc

SEQ ID NO: 70664 - RNA, 20 nt, Artificial Sequence
  MKO10070664_B_Adprm
  gRNA
uacauucucugacacgaacc

SEQ ID NO: 70665 - RNA, 20 nt, Artificial Sequence
  MKO10070665_B_Adprm
  gRNA
cuccguuaaacuggacauac

SEQ ID NO: 70666 - RNA, 20 nt, Artificial Sequence
  MKO10070666_B_Adra1a
  gRNA
cacaccaauguaucggucga

SEQ ID NO: 70667 - RNA, 20 nt, Artificial Sequence
  MKO10070667_B_Adra1a
  gRNA
uauguacugucgagucuacg

SEQ ID NO: 70668 - RNA, 20 nt, Artificial Sequence
  MKO10070668_B_Adra1a
  gRNA
guacaggcggauugguccuu

SEQ ID NO: 70669 - RNA, 20 nt, Artificial Sequence
  MKO10070669_B_Adra1b
  gRNA
cguccgcaggugccgguugc

SEQ ID NO: 70670 - RNA, 20 nt, Artificial Sequence
  MKO10070670_B_Adra1b
  gRNA
guggcugcguuccacgaccc

SEQ ID NO: 70671 - RNA, 20 nt, Artificial Sequence
  MKO10070671_B_Adra1b
  gRNA
aguaucgcaccccaauguag

SEQ ID NO: 70672 - RNA, 20 nt, Artificial Sequence
  MKO10070672_B_Adra1d
  gRNA
uggacaccuucgcacgcagc

SEQ ID NO: 70673 - RNA, 20 nt, Artificial Sequence
  MKO10070673_B_Adra1d
  gRNA
acucaccacuagccccccga

SEQ ID NO: 70674 - RNA, 20 nt, Artificial Sequence
  MKO10070674_B_Adra1d
  gRNA
uaguggcugcgccgcgacag

SEQ ID NO: 70675 - RNA, 20 nt, Artificial Sequence
  MKO10070675_B_Adra2a
  gRNA
cccgcgccagcgcgacgcuu

SEQ ID NO: 70676 - RNA, 20 nt, Artificial Sequence
  MKO10070676_B_Adra2a
  gRNA
ggcgccgaucgcaggcccaa

SEQ ID NO: 70677 - RNA, 20 nt, Artificial Sequence
  MKO10070677_B_Adra2a
  gRNA
gccccgcgauggggaugcgc

SEQ ID NO: 70678 - RNA, 20 nt, Artificial Sequence
  MKO10070678_B_Adra2b
  gRNA
uggcaauuacauagauucgc

SEQ ID NO: 70679 - RNA, 20 nt, Artificial Sequence
  MKO10070679_B_Adra2b
  gRNA
agaagagcacgucuagcgcc

SEQ ID NO: 70680 - RNA, 20 nt, Artificial Sequence
  MKO10070680_B_Adra2b
  gRNA
ccggcaaaggauccuucgaa

SEQ ID NO: 70681 - RNA, 20 nt, Artificial Sequence
  MKO10070681_B_Adra2c
  gRNA
gaccgacugggugccaccgc

SEQ ID NO: 70682 - RNA, 20 nt, Artificial Sequence
  MKO10070682_B_Adra2c
  gRNA
ucgaguucuuccugucgcgu

SEQ ID NO: 70683 - RNA, 20 nt, Artificial Sequence
  MKO10070683_B_Adra2c
  gRNA
uucgcccgcgucgcucccgu

SEQ ID NO: 70684 - RNA, 20 nt, Artificial Sequence
  MKO10070684_B_Adrb1
  gRNA
guaccugcggguguuccgcg

SEQ ID NO: 70685 - RNA, 20 nt, Artificial Sequence
  MKO10070685_B_Adrb1
  gRNA
ucucuacaccuuggacuccg

SEQ ID NO: 70686 - RNA, 20 nt, Artificial Sequence
  MKO10070686_B_Adrb1
  gRNA
ucugcucgcgcagagccacg

SEQ ID NO: 70687 - RNA, 20 nt, Artificial Sequence
  MKO10070687_B_Adrb2
  gRNA
ccaggacgauaaccgacaug

SEQ ID NO: 70688 - RNA, 20 nt, Artificial Sequence
  MKO10070688_B_Adrb2
  gRNA
acgggacgaagcguggguug

SEQ ID NO: 70689 - RNA, 20 nt, Artificial Sequence
  MKO10070689_B_Adrb2
  gRNA
ucuggcgcucggcuuccguu

SEQ ID NO: 70690 - RNA, 20 nt, Artificial Sequence
  MKO10070690_B_Adrb3
  gRNA
caaagguuugauggcuauga

SEQ ID NO: 70691 - RNA, 20 nt, Artificial Sequence
  MKO10070691_B_Adrb3
  gRNA
gcgaaacugguugcgaacug

SEQ ID NO: 70692 - RNA, 20 nt, Artificial Sequence
  MKO10070692_B_Adrb3
  gRNA
caacgugcugcgcgcacucg

SEQ ID NO: 70693 - RNA, 20 nt, Artificial Sequence
  MKO10070693_B_Adrbk1
  gRNA
cuccguagcauucuuugaaa

SEQ ID NO: 70694 - RNA, 20 nt, Artificial Sequence
  MKO10070694_B_Adrbk1
  gRNA
cucuucguagaacuccacca

SEQ ID NO: 70695 - RNA, 20 nt, Artificial Sequence
  MKO10070695_B_Adrbk1
  gRNA
gcaccugcuucuucaccagg

SEQ ID NO: 70696 - RNA, 20 nt, Artificial Sequence
  MKO10070696_B_Adrbk2
  gRNA
guauccggagugugaugcag

SEQ ID NO: 70697 - RNA, 20 nt, Artificial Sequence
  MKO10070697_B_Adrbk2
  gRNA
cugauugaaaaucuugucaa

SEQ ID NO: 70698 - RNA, 20 nt, Artificial Sequence
  MKO10070698_B_Adrbk2
  gRNA
ucuucauaaaauuucaccug

SEQ ID NO: 70699 - RNA, 20 nt, Artificial Sequence
  MKO10070699_B_Adrm1
  gRNA
cauccagaagaagagccgcu

SEQ ID NO: 70700 - RNA, 20 nt, Artificial Sequence
  MKO10070700_B_Adrm1
  gRNA
cugaugacugugaguucaag

SEQ ID NO: 70701 - RNA, 20 nt, Artificial Sequence
  MKO10070701_B_Adrm1
  gRNA
cgcccagugcugaaagcuca

SEQ ID NO: 70702 - RNA, 20 nt, Artificial Sequence
  MKO10070702_B_Adsl
  gRNA
uccagaacuugaagcguguc

SEQ ID NO: 70703 - RNA, 20 nt, Artificial Sequence
  MKO10070703_B_Adsl
  gRNA
cguauugucuccgacauagc

SEQ ID NO: 70704 - RNA, 20 nt, Artificial Sequence
  MKO10070704_B_Adsl
  gRNA
agcuugcuagagugaucucg

SEQ ID NO: 70705 - RNA, 20 nt, Artificial Sequence
  MKO10070705_B_Adssl1
  gRNA
accaguguucgacuuccacc

SEQ ID NO: 70706 - RNA, 20 nt, Artificial Sequence
  MKO10070706_B_Adssl1
  gRNA
gaagcuuaccaaggugagcc

SEQ ID NO: 70707 - RNA, 20 nt, Artificial Sequence
  MKO10070707_B_Adssl1
  gRNA
cuguguugcaggcaauggcg

SEQ ID NO: 70708 - RNA, 20 nt, Artificial Sequence
  MKO10070708_B_Adss
  gRNA
auaucggacagagcucauau

SEQ ID NO: 70709 - RNA, 20 nt, Artificial Sequence
  MKO10070709_B_Adss
  gRNA
uccgcuucuucaaacaaucc

SEQ ID NO: 70710 - RNA, 20 nt, Artificial Sequence
  MKO10070710_B_Adss
  gRNA
uccuggauuguuugaagaag

SEQ ID NO: 70711 - RNA, 20 nt, Artificial Sequence
  MKO10070711_B_Adtrp
  gRNA
aacuauccaucgaagaagcu

SEQ ID NO: 70712 - RNA, 20 nt, Artificial Sequence
  MKO10070712_B_Adtrp
  gRNA
auuaaggagugucaaguacu

SEQ ID NO: 70713 - RNA, 20 nt, Artificial Sequence
  MKO10070713_B_Adtrp
  gRNA
uggguacuuacuguggauau

SEQ ID NO: 70714 - RNA, 20 nt, Artificial Sequence
  MKO10070714_B_Aebp1
  gRNA
uccgucgccagaagcagccc

SEQ ID NO: 70715 - RNA, 20 nt, Artificial Sequence
  MKO10070715_B_Aebp1
  gRNA
cucaccuggccggggcugcu

SEQ ID NO: 70716 - RNA, 20 nt, Artificial Sequence
  MKO10070716_B_Aebp1
  gRNA
cuacaaugaccagauagaga

SEQ ID NO: 70717 - RNA, 20 nt, Artificial Sequence
  MKO10070717_B_Aebp2
  gRNA
aacagguguucguuugcuug

SEQ ID NO: 70718 - RNA, 20 nt, Artificial Sequence
  MKO10070718_B_Aebp2
  gRNA
ugugcaucgaagaaaucgug

SEQ ID NO: 70719 - RNA, 20 nt, Artificial Sequence
  MKO10070719_B_Aebp2
  gRNA
guucugcugacugaagugug

SEQ ID NO: 70720 - RNA, 20 nt, Artificial Sequence
  MKO10070720_B_Aen
  gRNA
uccgaggguggacguacuuc

SEQ ID NO: 70721 - RNA, 20 nt, Artificial Sequence
  MKO10070721_B_Aen
  gRNA
cuguucacaggucggucacc

SEQ ID NO: 70722 - RNA, 20 nt, Artificial Sequence
  MKO10070722_B_Aen
  gRNA
aguacauggacgaccaguac

SEQ ID NO: 70723 - RNA, 20 nt, Artificial Sequence
  MKO10070723_B_Aes
  gRNA
cucaucuuugaugcggucac

SEQ ID NO: 70724 - RNA, 20 nt, Artificial Sequence
  MKO10070724_B_Aes
  gRNA
gauacugcgcuugcagcagc

SEQ ID NO: 70725 - RNA, 20 nt, Artificial Sequence
  MKO10070725_B_Aes
  gRNA
gcuugucgcacuccagcuuc

SEQ ID NO: 70726 - RNA, 20 nt, Artificial Sequence
  MKO10070726_B_Afap1l1
  gRNA
ggucugcaguguucacauac

SEQ ID NO: 70727 - RNA, 20 nt, Artificial Sequence
  MKO10070727_B_Afap1l1
  gRNA
acuugccgggccccagggga

SEQ ID NO: 70728 - RNA, 20 nt, Artificial Sequence
  MKO10070728_B_Afap1l1
  gRNA
cugaggaguccggugagcuc

SEQ ID NO: 70729 - RNA, 20 nt, Artificial Sequence
  MKO10070729_B_Afap1l2
  gRNA
cuccuacgaguccuacgaug

SEQ ID NO: 70730 - RNA, 20 nt, Artificial Sequence
  MKO10070730_B_Afap1l2
  gRNA
agaccucccuccgcccaaga

SEQ ID NO: 70731 - RNA, 20 nt, Artificial Sequence
  MKO10070731_B_Afap1l2
  gRNA
gcccacaguucccgaggagc

SEQ ID NO: 70732 - RNA, 20 nt, Artificial Sequence
  MKO10070732_B_Afap1
  gRNA
gaagccgugccgcugagccc

SEQ ID NO: 70733 - RNA, 20 nt, Artificial Sequence
  MKO10070733_B_Afap1
  gRNA
cuuccucauaguaacccucu

SEQ ID NO: 70734 - RNA, 20 nt, Artificial Sequence
  MKO10070734_B_Afap1
  gRNA
gaucuccggcagaggcaucu

SEQ ID NO: 70735 - RNA, 20 nt, Artificial Sequence
  MKO10070735_B_Aff1
  gRNA
ucagaaucucuucaacgcaa

SEQ ID NO: 70736 - RNA, 20 nt, Artificial Sequence
  MKO10070736_B_Aff1
  gRNA
ucuaggaaaugacccacucg

SEQ ID NO: 70737 - RNA, 20 nt, Artificial Sequence
  MKO10070737_B_Aff1
  gRNA
gaaggaggcauuucccgaga

SEQ ID NO: 70738 - RNA, 20 nt, Artificial Sequence
  MKO10070738_B_Aff2
  gRNA
uuacuuuguaagguaaaucc

SEQ ID NO: 70739 - RNA, 20 nt, Artificial Sequence
  MKO10070739_B_Aff2
  gRNA
gaaucucagcaucugacucc

SEQ ID NO: 70740 - RNA, 20 nt, Artificial Sequence
  MKO10070740_B_Aff2
  gRNA
uacauauucagcuaccuugu

SEQ ID NO: 70741 - RNA, 20 nt, Artificial Sequence
  MKO10070741_B_Aff3
  gRNA
gcucuucagcgaacccuaca

SEQ ID NO: 70742 - RNA, 20 nt, Artificial Sequence
  MKO10070742_B_Aff3
  gRNA
uucgcugaagagcgaguaac

SEQ ID NO: 70743 - RNA, 20 nt, Artificial Sequence
  MKO10070743_B_Aff3
  gRNA
agaaaccaacugccuacgug

SEQ ID NO: 70744 - RNA, 20 nt, Artificial Sequence
  MKO10070744_B_Aff4
  gRNA
gagucgcaacagucuaacuu

SEQ ID NO: 70745 - RNA, 20 nt, Artificial Sequence
  MKO10070745_B_Aff4
  gRNA
agggcuugaggaucgagauu

SEQ ID NO: 70746 - RNA, 20 nt, Artificial Sequence
  MKO10070746_B_Aff4
  gRNA
uucaggagaugacgcauuca

SEQ ID NO: 70747 - RNA, 20 nt, Artificial Sequence
  MKO10070747_B_Afg3l1
  gRNA
uccuguuucagggucaucug

SEQ ID NO: 70748 - RNA, 20 nt, Artificial Sequence
  MKO10070748_B_Afg3l1
  gRNA
cuguauucaaaaccucccag

SEQ ID NO: 70749 - RNA, 20 nt, Artificial Sequence
  MKO10070749_B_Afg3l1
  gRNA
aacagaaaaagugcaagccc

SEQ ID NO: 70750 - RNA, 20 nt, Artificial Sequence
  MKO10070750_B_Afg3l2
  gRNA
ggugggggagggaagcgccg

SEQ ID NO: 70751 - RNA, 20 nt, Artificial Sequence
  MKO10070751_B_Afg3l2
  gRNA
aaaaaaggccagugagccua

SEQ ID NO: 70752 - RNA, 20 nt, Artificial Sequence
  MKO10070752_B_Afg3l2
  gRNA
cuuuacagaaccacagcccu

SEQ ID NO: 70753 - RNA, 20 nt, Artificial Sequence
  MKO10070753_B_Afmid
  gRNA
aguauccuccaugcaagaac

SEQ ID NO: 70754 - RNA, 20 nt, Artificial Sequence
  MKO10070754_B_Afmid
  gRNA
gguaaacccacugacugcac

SEQ ID NO: 70755 - RNA, 20 nt, Artificial Sequence
  MKO10070755_B_Afmid
  gRNA
cguguggaugacccaucugc

SEQ ID NO: 70756 - RNA, 20 nt, Artificial Sequence
  MKO10070756_B_Afm
  gRNA
aagaacgggggcgaagacaa

SEQ ID NO: 70757 - RNA, 20 nt, Artificial Sequence
  MKO10070757_B_Afm
  gRNA
cuuugaugagguggaaacgc

SEQ ID NO: 70758 - RNA, 20 nt, Artificial Sequence
  MKO10070758_B_Afm
  gRNA
ccaugucacauaacaugucc

SEQ ID NO: 70759 - RNA, 20 nt, Artificial Sequence
  MKO10070759_B_Afp
  gRNA
agauuccucccagugcguga

SEQ ID NO: 70760 - RNA, 20 nt, Artificial Sequence
  MKO10070760_B_Afp
  gRNA
caaaaugacuagcgaugugu

SEQ ID NO: 70761 - RNA, 20 nt, Artificial Sequence
  MKO10070761_B_Afp
  gRNA
cuugucguacugagcagcca

SEQ ID NO: 70762 - RNA, 20 nt, Artificial Sequence
  MKO10070762_B_Aftph
  gRNA
auagugcccauguaugcagc

SEQ ID NO: 70763 - RNA, 20 nt, Artificial Sequence
  MKO10070763_B_Aftph
  gRNA
uacuuacccacggucagcua

SEQ ID NO: 70764 - RNA, 20 nt, Artificial Sequence
  MKO10070764_B_Aftph
  gRNA
accgcaaaccaugugcauca

SEQ ID NO: 70765 - RNA, 20 nt, Artificial Sequence
  MKO10070765_B_Agap1
  gRNA
aucggcugaguguccauucc

SEQ ID NO: 70766 - RNA, 20 nt, Artificial Sequence
  MKO10070766_B_Agap1
  gRNA
agggggccccccggaggcac

SEQ ID NO: 70767 - RNA, 20 nt, Artificial Sequence
  MKO10070767_B_Agap1
  gRNA
cgaugacgugcucccgaauc

SEQ ID NO: 70768 - RNA, 20 nt, Artificial Sequence
  MKO10070768_B_Agap2
  gRNA
cuugggucccaaccagagcc

SEQ ID NO: 70769 - RNA, 20 nt, Artificial Sequence
  MKO10070769_B_Agap2
  gRNA
ggcaggugagcaguacaaga

SEQ ID NO: 70770 - RNA, 20 nt, Artificial Sequence
  MKO10070770_B_Agap2
  gRNA
ccucccggaucagcaccaga

SEQ ID NO: 70771 - RNA, 20 nt, Artificial Sequence
  MKO10070771_B_Agap3
  gRNA
cagcuuucgaaaugccagcg

SEQ ID NO: 70772 - RNA, 20 nt, Artificial Sequence
  MKO10070772_B_Agap3
  gRNA
aggcugauuucccacuagac

SEQ ID NO: 70773 - RNA, 20 nt, Artificial Sequence
  MKO10070773_B_Agap3
  gRNA
cuucaucccggaucagcagc

SEQ ID NO: 70774 - RNA, 20 nt, Artificial Sequence
  MKO10070774_B_Aga
  gRNA
agaagaauuaaaaacgcgau

SEQ ID NO: 70775 - RNA, 20 nt, Artificial Sequence
  MKO10070775_B_Aga
  gRNA
gcgugguggacauugcuauc

SEQ ID NO: 70776 - RNA, 20 nt, Artificial Sequence
  MKO10070776_B_Aga
  gRNA
caccaaguuugcugaaagua

SEQ ID NO: 70777 - RNA, 20 nt, Artificial Sequence
  MKO10070777_B_Agbl1
  gRNA
cuggcuaaaguuggccuaag

SEQ ID NO: 70778 - RNA, 20 nt, Artificial Sequence
  MKO10070778_B_Agbl1
  gRNA
uccuuccaggcacagaccgg

SEQ ID NO: 70779 - RNA, 20 nt, Artificial Sequence
  MKO10070779_B_Agbl1
  gRNA
caggguggaugcuuuaucag

SEQ ID NO: 70780 - RNA, 20 nt, Artificial Sequence
  MKO10070780_B_Agbl2
  gRNA
ccuaccuguuuaucuucaac

SEQ ID NO: 70781 - RNA, 20 nt, Artificial Sequence
  MKO10070781_B_Agbl2
  gRNA
cacauagacgcuguaaacag

SEQ ID NO: 70782 - RNA, 20 nt, Artificial Sequence
  MKO10070782_B_Agbl2
  gRNA
cgcugaugagugccugaguu

SEQ ID NO: 70783 - RNA, 20 nt, Artificial Sequence
  MKO10070783_B_Agbl3
  gRNA
gagacaccauauaaaucucg

SEQ ID NO: 70784 - RNA, 20 nt, Artificial Sequence
  MKO10070784_B_Agbl3
  gRNA
gagccaguguaugucccgac

SEQ ID NO: 70785 - RNA, 20 nt, Artificial Sequence
  MKO10070785_B_Agbl3
  gRNA
gccuguuuacccaaacucca

SEQ ID NO: 70786 - RNA, 20 nt, Artificial Sequence
  MKO10070786_B_Agbl4
  gRNA
ggcuguccagaguauccauu

SEQ ID NO: 70787 - RNA, 20 nt, Artificial Sequence
  MKO10070787_B_Agbl4
  gRNA
gaccugccucuggcgcuguc

SEQ ID NO: 70788 - RNA, 20 nt, Artificial Sequence
  MKO10070788_B_Agbl4
  gRNA
aaucuaccagcagaccaaaa

SEQ ID NO: 70789 - RNA, 20 nt, Artificial Sequence
  MKO10070789_B_Agbl5
  gRNA
cuuuguucaccguuucguag

SEQ ID NO: 70790 - RNA, 20 nt, Artificial Sequence
  MKO10070790_B_Agbl5
  gRNA
cccgaucaucucgaagccca

SEQ ID NO: 70791 - RNA, 20 nt, Artificial Sequence
  MKO10070791_B_Agbl5
  gRNA
ccccgaccauuccguuucac

SEQ ID NO: 70792 - RNA, 20 nt, Artificial Sequence
  MKO10070792_B_Ager
  gRNA
gccacuugugcuaagcugua

SEQ ID NO: 70793 - RNA, 20 nt, Artificial Sequence
  MKO10070793_B_Ager
  gRNA
cccuuacagcuuagcacaag

SEQ ID NO: 70794 - RNA, 20 nt, Artificial Sequence
  MKO10070794_B_Ager
  gRNA
uacuaccuuauuagggacac

SEQ ID NO: 70795 - RNA, 20 nt, Artificial Sequence
  MKO10070795_B_Agfg1
  gRNA
ccuugagagcgaccuacaac

SEQ ID NO: 70796 - RNA, 20 nt, Artificial Sequence
  MKO10070796_B_Agfg1
  gRNA
gcacacuuuaacagucaugc

SEQ ID NO: 70797 - RNA, 20 nt, Artificial Sequence
  MKO10070797_B_Agfg1
  gRNA
caugacaacauuuacacaac

SEQ ID NO: 70798 - RNA, 20 nt, Artificial Sequence
  MKO10070798_B_Agfg2
  gRNA
ucaccucauuuccacgagau

SEQ ID NO: 70799 - RNA, 20 nt, Artificial Sequence
  MKO10070799_B_Agfg2
  gRNA
agcugcugcgugccugcgac

SEQ ID NO: 70800 - RNA, 20 nt, Artificial Sequence
  MKO10070800_B_Agfg2
  gRNA
caucguugauaccagauucc

SEQ ID NO: 70801 - RNA, 20 nt, Artificial Sequence
  MKO10070801_B_Aggf1
  gRNA
ggucuacgcgagagugaaac

SEQ ID NO: 70802 - RNA, 20 nt, Artificial Sequence
  MKO10070802_B_Aggf1
  gRNA
gcaguaguaauaaauccccg

SEQ ID NO: 70803 - RNA, 20 nt, Artificial Sequence
  MKO10070803_B_Aggf1
  gRNA
gacgagucacacauagacag

SEQ ID NO: 70804 - RNA, 20 nt, Artificial Sequence
  MKO10070804_B_Agk
  gRNA
caucaacuccaagagcuucu

SEQ ID NO: 70805 - RNA, 20 nt, Artificial Sequence
  MKO10070805_B_Agk
  gRNA
gaaauacccuuugcaagcug

SEQ ID NO: 70806 - RNA, 20 nt, Artificial Sequence
  MKO10070806_B_Agk
  gRNA
agcagccugucaagaagcuc

SEQ ID NO: 70807 - RNA, 20 nt, Artificial Sequence
  MKO10070807_B_Agl
  gRNA
uauucuuuguauuaccgaug

SEQ ID NO: 70808 - RNA, 20 nt, Artificial Sequence
  MKO10070808_B_Agl
  gRNA
ugauaaccacguguuacccu

SEQ ID NO: 70809 - RNA, 20 nt, Artificial Sequence
  MKO10070809_B_Agl
  gRNA
ucaacuccaaugcguaaaau

SEQ ID NO: 70810 - RNA, 20 nt, Artificial Sequence
  MKO10070810_B_Agmau
  gRNA
ggggugagccccgcgauuuc

SEQ ID NO: 70811 - RNA, 20 nt, Artificial Sequence
  MKO10070811_B_Agmau
  gRNA
cgucaaucucuacaaccucc

SEQ ID NO: 70812 - RNA, 20 nt, Artificial Sequence
  MKO10070812_B_Agmau
  gRNA
auaucccauacugcaagccg

SEQ ID NO: 70813 - RNA, 20 nt, Artificial Sequence
  MKO10070813_B_Agmo
  gRNA
gaaagugaaauaccacgucc

SEQ ID NO: 70814 - RNA, 20 nt, Artificial Sequence
  MKO10070814_B_Agmo
  gRNA
ccucuguguggauccaaaau

SEQ ID NO: 70815 - RNA, 20 nt, Artificial Sequence
  MKO10070815_B_Agmo
  gRNA
ugcuugaacuagucaucagc

SEQ ID NO: 70816 - RNA, 20 nt, Artificial Sequence
  MKO10070816_B_Ago1
  gRNA
cauuucaaaccgcagaucuu

SEQ ID NO: 70817 - RNA, 20 nt, Artificial Sequence
  MKO10070817_B_Ago1
  gRNA
cccugccagguacaccccug

SEQ ID NO: 70818 - RNA, 20 nt, Artificial Sequence
  MKO10070818_B_Ago1
  gRNA
uacuaccacccgcugggggg

SEQ ID NO: 70819 - RNA, 20 nt, Artificial Sequence
  MKO10070819_B_Ago2
  gRNA
uguugcagguacaccccugu

SEQ ID NO: 70820 - RNA, 20 nt, Artificial Sequence
  MKO10070820_B_Ago2
  gRNA
agauaccuguucacucuccg

SEQ ID NO: 70821 - RNA, 20 nt, Artificial Sequence
  MKO10070821_B_Ago2
  gRNA
cucaccuugucccugccgau

SEQ ID NO: 70822 - RNA, 20 nt, Artificial Sequence
  MKO10070822_B_Ago3
  gRNA
cucccugacaggacccauug

SEQ ID NO: 70823 - RNA, 20 nt, Artificial Sequence
  MKO10070823_B_Ago3
  gRNA
ucuucugggcacgaugaaua

SEQ ID NO: 70824 - RNA, 20 nt, Artificial Sequence
  MKO10070824_B_Ago3
  gRNA
cuuaccccagugguugccac

SEQ ID NO: 70825 - RNA, 20 nt, Artificial Sequence
  MKO10070825_B_Ago4
  gRNA
cagucgaauugguuucccaa

SEQ ID NO: 70826 - RNA, 20 nt, Artificial Sequence
  MKO10070826_B_Ago4
  gRNA
cucuucagguacacuccagu

SEQ ID NO: 70827 - RNA, 20 nt, Artificial Sequence
  MKO10070827_B_Ago4
  gRNA
uuauuaccacccucugggag

SEQ ID NO: 70828 - RNA, 20 nt, Artificial Sequence
  MKO10070828_B_Agpau1
  gRNA
uccaugcugcccuucaaacg

SEQ ID NO: 70829 - RNA, 20 nt, Artificial Sequence
  MKO10070829_B_Agpau1
  gRNA
gauccgaguggaggugcgcg

SEQ ID NO: 70830 - RNA, 20 nt, Artificial Sequence
  MKO10070830_B_Agpau1
  gRNA
ucccauacagguauuugacg

SEQ ID NO: 70831 - RNA, 20 nt, Artificial Sequence
  MKO10070831_B_Agpau2
  gRNA
aagcgugagcuaauguucac

SEQ ID NO: 70832 - RNA, 20 nt, Artificial Sequence
  MKO10070832_B_Agpau2
  gRNA
uugucguugcguguacccuc

SEQ ID NO: 70833 - RNA, 20 nt, Artificial Sequence
  MKO10070833_B_Agpau2
  gRNA
cgguccuucaaguacgugua

SEQ ID NO: 70834 - RNA, 20 nt, Artificial Sequence
  MKO10070834_B_Agpau3
  gRNA
gucuccuaccugucccccgg

SEQ ID NO: 70835 - RNA, 20 nt, Artificial Sequence
  MKO10070835_B_Agpau3
  gRNA
guuugcagaauacgaucucu

SEQ ID NO: 70836 - RNA, 20 nt, Artificial Sequence
  MKO10070836_B_Agpau3
  gRNA
agaccgggacaccgucauag

SEQ ID NO: 70837 - RNA, 20 nt, Artificial Sequence
  MKO10070837_B_Agpau4
  gRNA
ggccuucgggucgguguaga

SEQ ID NO: 70838 - RNA, 20 nt, Artificial Sequence
  MKO10070838_B_Agpau4
  gRNA
gugaagugcuugcgagaugu

SEQ ID NO: 70839 - RNA, 20 nt, Artificial Sequence
  MKO10070839_B_Agpau4
  gRNA
cuacguaccagauacuucuc

SEQ ID NO: 70840 - RNA, 20 nt, Artificial Sequence
  MKO10070840_B_Agpau5
  gRNA
guauggguucuacuuugcuc

SEQ ID NO: 70841 - RNA, 20 nt, Artificial Sequence
  MKO10070841_B_Agpau5
  gRNA
cugagcagcaaaugccugac

SEQ ID NO: 70842 - RNA, 20 nt, Artificial Sequence
  MKO10070842_B_Agpau5
  gRNA
cugcagagcuaugugaacgc

SEQ ID NO: 70843 - RNA, 20 nt, Artificial Sequence
  MKO10070843_B_Agpau6
  gRNA
ccaucauuacguaccacaac

SEQ ID NO: 70844 - RNA, 20 nt, Artificial Sequence
  MKO10070844_B_Agpau6
  gRNA
caggauugcgcuggcauuca

SEQ ID NO: 70845 - RNA, 20 nt, Artificial Sequence
  MKO10070845_B_Agpau6
  gRNA
ccuaagcuuaccguuggugu

SEQ ID NO: 70846 - RNA, 20 nt, Artificial Sequence
  MKO10070846_B_Agpau9
  gRNA
agcugaucccaaugaaagcc

SEQ ID NO: 70847 - RNA, 20 nt, Artificial Sequence
  MKO10070847_B_Agpau9
  gRNA
gauguacugaaaguugacau

SEQ ID NO: 70848 - RNA, 20 nt, Artificial Sequence
  MKO10070848_B_Agpau9
  gRNA
gcugauuauaggaacuacac

SEQ ID NO: 70849 - RNA, 20 nt, Artificial Sequence
  MKO10070849_B_Agps
  gRNA
agcucggauuuccuacucac

SEQ ID NO: 70850 - RNA, 20 nt, Artificial Sequence
  MKO10070850_B_Agps
  gRNA
ggauuccugauauaguugua

SEQ ID NO: 70851 - RNA, 20 nt, Artificial Sequence
  MKO10070851_B_Agps
  gRNA
uggauccagucucucaaagu

SEQ ID NO: 70852 - RNA, 20 nt, Artificial Sequence
  MKO10070852_B_Agr2
  gRNA
ggggacuuacgaccagguug

SEQ ID NO: 70853 - RNA, 20 nt, Artificial Sequence
  MKO10070853_B_Agr2
  gRNA
gcaguuuguucuccucaacc

SEQ ID NO: 70854 - RNA, 20 nt, Artificial Sequence
  MKO10070854_B_Agr2
  gRNA
guccccagaauuguguuugu

SEQ ID NO: 70855 - RNA, 20 nt, Artificial Sequence
  MKO10070855_B_Agr3
  gRNA
gacaguacugacaguccucc

SEQ ID NO: 70856 - RNA, 20 nt, Artificial Sequence
  MKO10070856_B_Agr3
  gRNA
cucuuucacagcacuaaaaa

SEQ ID NO: 70857 - RNA, 20 nt, Artificial Sequence
  MKO10070857_B_Agr3
  gRNA
guuuaguaacaaaccacuga

SEQ ID NO: 70858 - RNA, 20 nt, Artificial Sequence
  MKO10070858_B_Agrn
  gRNA
uccaucggcugaagguacac

SEQ ID NO: 70859 - RNA, 20 nt, Artificial Sequence
  MKO10070859_B_Agrn
  gRNA
cccccucaucugcgacaacc

SEQ ID NO: 70860 - RNA, 20 nt, Artificial Sequence
  MKO10070860_B_Agrn
  gRNA
gguuguaggacacagacacg

SEQ ID NO: 70861 - RNA, 20 nt, Artificial Sequence
  MKO10070861_B_Agrp
  gRNA
ucccacacuggggguccaga

SEQ ID NO: 70862 - RNA, 20 nt, Artificial Sequence
  MKO10070862_B_Agrp
  gRNA
gcccaucuggacccccagug

SEQ ID NO: 70863 - RNA, 20 nt, Artificial Sequence
  MKO10070863_B_Agrp
  gRNA
gcagcagaacuucuucugcu

SEQ ID NO: 70864 - RNA, 20 nt, Artificial Sequence
  MKO10070864_B_Agupbp1
  gRNA
uuagccuuaccaauaguucu

SEQ ID NO: 70865 - RNA, 20 nt, Artificial Sequence
  MKO10070865_B_Agupbp1
  gRNA
ccagcucaaugagaaugcuu

SEQ ID NO: 70866 - RNA, 20 nt, Artificial Sequence
  MKO10070866_B_Agupbp1
  gRNA
ccuaagcauucucauugagc

SEQ ID NO: 70867 - RNA, 20 nt, Artificial Sequence
  MKO10070867_B_Agur1a
  gRNA
cuugagugcgacuuggccuu

SEQ ID NO: 70868 - RNA, 20 nt, Artificial Sequence
  MKO10070868_B_Agur1a
  gRNA
aaaagcgcaaacagugauau

SEQ ID NO: 70869 - RNA, 20 nt, Artificial Sequence
  MKO10070869_B_Agur1a
  gRNA
uagcgguauagacagcccac

SEQ ID NO: 70870 - RNA, 20 nt, Artificial Sequence
  MKO10070870_B_Agur1b
  gRNA
auaacaugagcucgucugcc

SEQ ID NO: 70871 - RNA, 20 nt, Artificial Sequence
  MKO10070871_B_Agur1b
  gRNA
auaccgcuauggaauaccag

SEQ ID NO: 70872 - RNA, 20 nt, Artificial Sequence
  MKO10070872_B_Agur1b
  gRNA
cguccgcaauuucacaguca

SEQ ID NO: 70873 - RNA, 20 nt, Artificial Sequence
  MKO10070873_B_Agur2
  gRNA
guaccuaucgacacucaugc

SEQ ID NO: 70874 - RNA, 20 nt, Artificial Sequence
  MKO10070874_B_Agur2
  gRNA
guugcguugagauuaucaaa

SEQ ID NO: 70875 - RNA, 20 nt, Artificial Sequence
  MKO10070875_B_Agur2
  gRNA
aguuauagcagucauugacc

SEQ ID NO: 70876 - RNA, 20 nt, Artificial Sequence
  MKO10070876_B_Agurap
  gRNA
uggcaucuauagagucccgc

SEQ ID NO: 70877 - RNA, 20 nt, Artificial Sequence
  MKO10070877_B_Agurap
  gRNA
agauuucuucggacccucuc

SEQ ID NO: 70878 - RNA, 20 nt, Artificial Sequence
  MKO10070878_B_Agurap
  gRNA
agugaaguugccccaagcau

SEQ ID NO: 70879 - RNA, 20 nt, Artificial Sequence
  MKO10070879_B_Agu
  gRNA
uccaagucaggaggucguuc

SEQ ID NO: 70880 - RNA, 20 nt, Artificial Sequence
  MKO10070880_B_Agu
  gRNA
ccgaggauccuacaaucugc

SEQ ID NO: 70881 - RNA, 20 nt, Artificial Sequence
  MKO10070881_B_Agu
  gRNA
ccuguucgccaucuacgagc

SEQ ID NO: 70882 - RNA, 20 nt, Artificial Sequence
  MKO10070882_B_Agxt2
  gRNA
aaaaacagauagaccgccug

SEQ ID NO: 70883 - RNA, 20 nt, Artificial Sequence
  MKO10070883_B_Agxt2
  gRNA
ccuggccuacagccgugugc

SEQ ID NO: 70884 - RNA, 20 nt, Artificial Sequence
  MKO10070884_B_Agxt2
  gRNA
aaucuuaccugguauuucuc

SEQ ID NO: 70885 - RNA, 20 nt, Artificial Sequence
  MKO10070885_B_Agxt
  gRNA
gggccuggcccaacacaaac

SEQ ID NO: 70886 - RNA, 20 nt, Artificial Sequence
  MKO10070886_B_Agxt
  gRNA
cagguaccagugccuacucc

SEQ ID NO: 70887 - RNA, 20 nt, Artificial Sequence
  MKO10070887_B_Agxt
  gRNA
ccuaucuacauggaccaaca

SEQ ID NO: 70888 - RNA, 20 nt, Artificial Sequence
  MKO10070888_B_Ahcuf1
  gRNA
aucgagccuauaauuaacca

SEQ ID NO: 70889 - RNA, 20 nt, Artificial Sequence
  MKO10070889_B_Ahcuf1
  gRNA
cuacucugaguuacaucaac

SEQ ID NO: 70890 - RNA, 20 nt, Artificial Sequence
  MKO10070890_B_Ahcuf1
  gRNA
cagauaaccgcucuccuguu

SEQ ID NO: 70891 - RNA, 20 nt, Artificial Sequence
  MKO10070891_B_Ahcyl1
  gRNA
uggaacgagacaaagaucuc

SEQ ID NO: 70892 - RNA, 20 nt, Artificial Sequence
  MKO10070892_B_Ahcyl1
  gRNA
aauugagacccuuugugccc

SEQ ID NO: 70893 - RNA, 20 nt, Artificial Sequence
  MKO10070893_B_Ahcyl1
  gRNA
accaaauucccuacuaagac

SEQ ID NO: 70894 - RNA, 20 nt, Artificial Sequence
  MKO10070894_B_Ahcyl2
  gRNA
cuacuccacccucaaugaag

SEQ ID NO: 70895 - RNA, 20 nt, Artificial Sequence
  MKO10070895_B_Ahcyl2
  gRNA
cucugggggcacagugccga

SEQ ID NO: 70896 - RNA, 20 nt, Artificial Sequence
  MKO10070896_B_Ahcyl2
  gRNA
gucagagcuaucuguauaug

SEQ ID NO: 70897 - RNA, 20 nt, Artificial Sequence
  MKO10070897_B_Ahcy
  gRNA
ugggccucaccucagcaccc

SEQ ID NO: 70898 - RNA, 20 nt, Artificial Sequence
  MKO10070898_B_Ahcy
  gRNA
cccugcaguguuugccugga

SEQ ID NO: 70899 - RNA, 20 nt, Artificial Sequence
  MKO10070899_B_Ahcy
  gRNA
cucaccuggaaugccagccu

SEQ ID NO: 70900 - RNA, 20 nt, Artificial Sequence
  MKO10070900_B_Ahdc1
  gRNA
ccgcccacaguguucgaugc

SEQ ID NO: 70901 - RNA, 20 nt, Artificial Sequence
  MKO10070901_B_Ahdc1
  gRNA
cucgaacuacacgccgcaga

SEQ ID NO: 70902 - RNA, 20 nt, Artificial Sequence
  MKO10070902_B_Ahdc1
  gRNA
cuggggcucuagacgucgac

SEQ ID NO: 70903 - RNA, 20 nt, Artificial Sequence
  MKO10070903_B_Ahi1
  gRNA
guaucgagacuccccuccga

SEQ ID NO: 70904 - RNA, 20 nt, Artificial Sequence
  MKO10070904_B_Ahi1
  gRNA
uucacagcagucgcucagua

SEQ ID NO: 70905 - RNA, 20 nt, Artificial Sequence
  MKO10070905_B_Ahi1
  gRNA
acucacugccccacaggcug

SEQ ID NO: 70906 - RNA, 20 nt, Artificial Sequence
  MKO10070906_B_Ahnak
  gRNA
ggcuugaaguugcaccguaa

SEQ ID NO: 70907 - RNA, 20 nt, Artificial Sequence
  MKO10070907_B_Ahnak
  gRNA
aacuccccugcggcccgcac

SEQ ID NO: 70908 - RNA, 20 nt, Artificial Sequence
  MKO10070908_B_Ahnak
  gRNA
ggaaccacugcccugccagu

SEQ ID NO: 70909 - RNA, 20 nt, Artificial Sequence
  MKO10070909_B_Ahrr
  gRNA
ggacuaucugggcuuucauc

SEQ ID NO: 70910 - RNA, 20 nt, Artificial Sequence
  MKO10070910_B_Ahrr
  gRNA
gucucucaauggcuucgcuc

SEQ ID NO: 70911 - RNA, 20 nt, Artificial Sequence
  MKO10070911_B_Ahrr
  gRNA
ccucuguaugaguguucuuc

SEQ ID NO: 70912 - RNA, 20 nt, Artificial Sequence
  MKO10070912_B_Ahr
  gRNA
gaacacagaguuagaccgcc

SEQ ID NO: 70913 - RNA, 20 nt, Artificial Sequence
  MKO10070913_B_Ahr
  gRNA
auuccgcccggucuucugua

SEQ ID NO: 70914 - RNA, 20 nt, Artificial Sequence
  MKO10070914_B_Ahr
  gRNA
ggcgcugaauggcuuugugc

SEQ ID NO: 70915 - RNA, 20 nt, Artificial Sequence
  MKO10070915_B_Ahsa1
  gRNA
cccaucaagcuuguucacuu

SEQ ID NO: 70916 - RNA, 20 nt, Artificial Sequence
  MKO10070916_B_Ahsa1
  gRNA
accuguccaguucaguuuga

SEQ ID NO: 70917 - RNA, 20 nt, Artificial Sequence
  MKO10070917_B_Ahsa1
  gRNA
acuaaagacugagacuugca

SEQ ID NO: 70918 - RNA, 20 nt, Artificial Sequence
  MKO10070918_B_Ahsa2
  gRNA
gcuucauguaacagccgcaa

SEQ ID NO: 70919 - RNA, 20 nt, Artificial Sequence
  MKO10070919_B_Ahsa2
  gRNA
aaacgaaaucaaugacacug

SEQ ID NO: 70920 - RNA, 20 nt, Artificial Sequence
  MKO10070920_B_Ahsa2
  gRNA
aacaaaagcuguagcaaccc

SEQ ID NO: 70921 - RNA, 20 nt, Artificial Sequence
  MKO10070921_B_Ahsg
  gRNA
ugcuuuggaccccaccccgc

SEQ ID NO: 70922 - RNA, 20 nt, Artificial Sequence
  MKO10070922_B_Ahsg
  gRNA
acccagugucauuccacccc

SEQ ID NO: 70923 - RNA, 20 nt, Artificial Sequence
  MKO10070923_B_Ahsg
  gRNA
uccagccaaaugcaaccugc

SEQ ID NO: 70924 - RNA, 20 nt, Artificial Sequence
  MKO10070924_B_Aicda
  gRNA
ugaaggucaugaucccgauc

SEQ ID NO: 70925 - RNA, 20 nt, Artificial Sequence
  MKO10070925_B_Aicda
  gRNA
cuucggccaccuucgcaaca

SEQ ID NO: 70926 - RNA, 20 nt, Artificial Sequence
  MKO10070926_B_Aicda
  gRNA
acaacuucggcgcauccuuu

SEQ ID NO: 70927 - RNA, 20 nt, Artificial Sequence
  MKO10070927_B_Aida
  gRNA
ugaauuuacagaagaacaaa

SEQ ID NO: 70928 - RNA, 20 nt, Artificial Sequence
  MKO10070928_B_Aida
  gRNA
cagaauuauuguguugagcu

SEQ ID NO: 70929 - RNA, 20 nt, Artificial Sequence
  MKO10070929_B_Aida
  gRNA
aggcaaaauugcgacauguu

SEQ ID NO: 70930 - RNA, 20 nt, Artificial Sequence
  MKO10070930_B_Aif1l
  gRNA
ggggguccccaagacccacc

SEQ ID NO: 70931 - RNA, 20 nt, Artificial Sequence
  MKO10070931_B_Aif1l
  gRNA
gaugaagaagaugaucucgg

SEQ ID NO: 70932 - RNA, 20 nt, Artificial Sequence
  MKO10070932_B_Aif1l
  gRNA
ucaaagcccggcaggagaag

SEQ ID NO: 70933 - RNA, 20 nt, Artificial Sequence
  MKO10070933_B_Aif1
  gRNA
guccaaacuugaagccuuca

SEQ ID NO: 70934 - RNA, 20 nt, Artificial Sequence
  MKO10070934_B_Aif1
  gRNA
uucucguccagugaaguaca

SEQ ID NO: 70935 - RNA, 20 nt, Artificial Sequence
  MKO10070935_B_Aif1
  gRNA
cccucaggaggaaaagcuuu

SEQ ID NO: 70936 - RNA, 20 nt, Artificial Sequence
  MKO10070936_B_Aifm1
  gRNA
uuguugauaagcccacaaua

SEQ ID NO: 70937 - RNA, 20 nt, Artificial Sequence
  MKO10070937_B_Aifm1
  gRNA
auggcuagcucugguucauc

SEQ ID NO: 70938 - RNA, 20 nt, Artificial Sequence
  MKO10070938_B_Aifm1
  gRNA
ggaguccuuaccggaggcaa

SEQ ID NO: 70939 - RNA, 20 nt, Artificial Sequence
  MKO10070939_B_Aifm2
  gRNA
uucguacucugcgaccuuca

SEQ ID NO: 70940 - RNA, 20 nt, Artificial Sequence
  MKO10070940_B_Aifm2
  gRNA
ccacgaugaauugugagcgc

SEQ ID NO: 70941 - RNA, 20 nt, Artificial Sequence
  MKO10070941_B_Aifm2
  gRNA
acaccucguuaaacuugcca

SEQ ID NO: 70942 - RNA, 20 nt, Artificial Sequence
  MKO10070942_B_Aifm3
  gRNA
gccugcuucaacauuaguac

SEQ ID NO: 70943 - RNA, 20 nt, Artificial Sequence
  MKO10070943_B_Aifm3
  gRNA
ggagcugucagccagcggaa

SEQ ID NO: 70944 - RNA, 20 nt, Artificial Sequence
  MKO10070944_B_Aifm3
  gRNA
gaccauucgggcaagcaagc

SEQ ID NO: 70945 - RNA, 20 nt, Artificial Sequence
  MKO10070945_B_Aig1
  gRNA
uguuuaguacuucuccaagc

SEQ ID NO: 70946 - RNA, 20 nt, Artificial Sequence
  MKO10070946_B_Aig1
  gRNA
ucucaucucgaucaauauaa

SEQ ID NO: 70947 - RNA, 20 nt, Artificial Sequence
  MKO10070947_B_Aig1
  gRNA
cauguggguguacccuuucc

SEQ ID NO: 70948 - RNA, 20 nt, Artificial Sequence
  MKO10070948_B_Aim1l
  gRNA
aagucuccagucagcgucac

SEQ ID NO: 70949 - RNA, 20 nt, Artificial Sequence
  MKO10070949_B_Aim1l
  gRNA
gagcccagcaccgaagaccc

SEQ ID NO: 70950 - RNA, 20 nt, Artificial Sequence
  MKO10070950_B_Aim1l
  gRNA
gcguggagucuccaaggcuu

SEQ ID NO: 70951 - RNA, 20 nt, Artificial Sequence
  MKO10070951_B_Aim1
  gRNA
auaguagugaaaguuguccg

SEQ ID NO: 70952 - RNA, 20 nt, Artificial Sequence
  MKO10070952_B_Aim1
  gRNA
cagugagcccgacgucucug

SEQ ID NO: 70953 - RNA, 20 nt, Artificial Sequence
  MKO10070953_B_Aim1
  gRNA
ucugauaaaccuguagugau

SEQ ID NO: 70954 - RNA, 20 nt, Artificial Sequence
  MKO10070954_B_Aim2
  gRNA
gauuagacucacguucuuug

SEQ ID NO: 70955 - RNA, 20 nt, Artificial Sequence
  MKO10070955_B_Aim2
  gRNA
uucagcaccgugacaacaag

SEQ ID NO: 70956 - RNA, 20 nt, Artificial Sequence
  MKO10070956_B_Aim2
  gRNA
cccaagcaaaacaaagugcg

SEQ ID NO: 70957 - RNA, 20 nt, Artificial Sequence
  MKO10070957_B_Aimp1
  gRNA
uuagguuucucugccgauuc

SEQ ID NO: 70958 - RNA, 20 nt, Artificial Sequence
  MKO10070958_B_Aimp1
  gRNA
gaggcggugguugcuacuga

SEQ ID NO: 70959 - RNA, 20 nt, Artificial Sequence
  MKO10070959_B_Aimp1
  gRNA
gcuaaagcaagagcugauuc

SEQ ID NO: 70960 - RNA, 20 nt, Artificial Sequence
  MKO10070960_B_Aimp2
  gRNA
uagggcuuuaccugguacau

SEQ ID NO: 70961 - RNA, 20 nt, Artificial Sequence
  MKO10070961_B_Aimp2
  gRNA
gccauguuucagcuucgaga

SEQ ID NO: 70962 - RNA, 20 nt, Artificial Sequence
  MKO10070962_B_Aimp2
  gRNA
ucccaccaugccgauguacc

SEQ ID NO: 70963 - RNA, 20 nt, Artificial Sequence
  MKO10070963_B_Aipl1
  gRNA
gacauucuacgacaccaccc

SEQ ID NO: 70964 - RNA, 20 nt, Artificial Sequence
  MKO10070964_B_Aipl1
  gRNA
ucaggccgccaccaaguacc

SEQ ID NO: 70965 - RNA, 20 nt, Artificial Sequence
  MKO10070965_B_Aipl1
  gRNA
cuauguugucccgcagucug

SEQ ID NO: 70966 - RNA, 20 nt, Artificial Sequence
  MKO10070966_B_Aip
  gRNA
ccgguuguaccgugagggcc

SEQ ID NO: 70967 - RNA, 20 nt, Artificial Sequence
  MKO10070967_B_Aip
  gRNA
ccuugcccucggcgauguug

SEQ ID NO: 70968 - RNA, 20 nt, Artificial Sequence
  MKO10070968_B_Aip
  gRNA
cacugugcagcguccgaaag

SEQ ID NO: 70969 - RNA, 20 nt, Artificial Sequence
  MKO10070969_B_Aire
  gRNA
ucuuagggggcuuagucuuc

SEQ ID NO: 70970 - RNA, 20 nt, Artificial Sequence
  MKO10070970_B_Aire
  gRNA
ggaagggauccuuauccagc

SEQ ID NO: 70971 - RNA, 20 nt, Artificial Sequence
  MKO10070971_B_Aire
  gRNA
ugggcuggagacgcucuuug

SEQ ID NO: 70972 - RNA, 20 nt, Artificial Sequence
  MKO10070972_B_Ajap1
  gRNA
ucaccgguuuccguugaaug

SEQ ID NO: 70973 - RNA, 20 nt, Artificial Sequence
  MKO10070973_B_Ajap1
  gRNA
gaugagaugccuauccgcag

SEQ ID NO: 70974 - RNA, 20 nt, Artificial Sequence
  MKO10070974_B_Ajap1
  gRNA
gcgcagcgaugaccaugaug

SEQ ID NO: 70975 - RNA, 20 nt, Artificial Sequence
  MKO10070975_B_Ajuba
  gRNA
aaggcuuucuacagcgucaa

SEQ ID NO: 70976 - RNA, 20 nt, Artificial Sequence
  MKO10070976_B_Ajuba
  gRNA
accuuuguugcacuugauac

SEQ ID NO: 70977 - RNA, 20 nt, Artificial Sequence
  MKO10070977_B_Ajuba
  gRNA
accuguaucaagugcaacaa

SEQ ID NO: 70978 - RNA, 20 nt, Artificial Sequence
  MKO10070978_B_Ak1
  gRNA
uccaauggcuuccugaucga

SEQ ID NO: 70979 - RNA, 20 nt, Artificial Sequence
  MKO10070979_B_Ak1
  gRNA
cuacccgagggaggugaaac

SEQ ID NO: 70980 - RNA, 20 nt, Artificial Sequence
  MKO10070980_B_Ak1
  gRNA
agcugacuucugcccgaagc

SEQ ID NO: 70981 - RNA, 20 nt, Artificial Sequence
  MKO10070981_B_Ak2
  gRNA
uccaagacucgcugcugauc

SEQ ID NO: 70982 - RNA, 20 nt, Artificial Sequence
  MKO10070982_B_Ak2
  gRNA
ucagccugccucacaguccg

SEQ ID NO: 70983 - RNA, 20 nt, Artificial Sequence
  MKO10070983_B_Ak2
  gRNA
cuucccucggacugugaggc

SEQ ID NO: 70984 - RNA, 20 nt, Artificial Sequence
  MKO10070984_B_Ak3
  gRNA
agaaccucugauucagcgcg

SEQ ID NO: 70985 - RNA, 20 nt, Artificial Sequence
  MKO10070985_B_Ak3
  gRNA
ucccagaugacgucaugacu

SEQ ID NO: 70986 - RNA, 20 nt, Artificial Sequence
  MKO10070986_B_Ak3
  gRNA
agccgagucaugacgucauc

SEQ ID NO: 70987 - RNA, 20 nt, Artificial Sequence
  MKO10070987_B_Ak4
  gRNA
caccaucuaacagccagugc

SEQ ID NO: 70988 - RNA, 20 nt, Artificial Sequence
  MKO10070988_B_Ak4
  gRNA
cacuuguacaguucgaugac

SEQ ID NO: 70989 - RNA, 20 nt, Artificial Sequence
  MKO10070989_B_Ak4
  gRNA
uaggggauugaugacaucac

SEQ ID NO: 70990 - RNA, 20 nt, Artificial Sequence
  MKO10070990_B_Ak5
  gRNA
cacauuaccauuucggagga

SEQ ID NO: 70991 - RNA, 20 nt, Artificial Sequence
  MKO10070991_B_Ak5
  gRNA
aucgccaagauaaucaccaa

SEQ ID NO: 70992 - RNA, 20 nt, Artificial Sequence
  MKO10070992_B_Ak5
  gRNA
auucucccacugagauguac

SEQ ID NO: 70993 - RNA, 20 nt, Artificial Sequence
  MKO10070993_B_Ak6
  gRNA
gugggagaucuagcucgaga

SEQ ID NO: 70994 - RNA, 20 nt, Artificial Sequence
  MKO10070994_B_Ak6
  gRNA
uaaugaaccagaacagcucg

SEQ ID NO: 70995 - RNA, 20 nt, Artificial Sequence
  MKO10070995_B_Ak6
  gRNA
cacuauaugaaaccagcguu

SEQ ID NO: 70996 - RNA, 20 nt, Artificial Sequence
  MKO10070996_B_Ak7
  gRNA
uuccuagcuaacugugucgc

SEQ ID NO: 70997 - RNA, 20 nt, Artificial Sequence
  MKO10070997_B_Ak7
  gRNA
acuccaugagaugcgagagc

SEQ ID NO: 70998 - RNA, 20 nt, Artificial Sequence
  MKO10070998_B_Ak7
  gRNA
guucuacuuacaggguccag

SEQ ID NO: 70999 - RNA, 20 nt, Artificial Sequence
  MKO10070999_B_Ak8
  gRNA
aagacugacaagaaucgaau

SEQ ID NO: 71000 - RNA, 20 nt, Artificial Sequence
  MKO10071000_B_Ak8
  gRNA
gaguuacuaccagguuuaca

SEQ ID NO: 71001 - RNA, 20 nt, Artificial Sequence
  MKO10071001_B_Ak8
  gRNA
gauucuugucagucuugucc

SEQ ID NO: 71002 - RNA, 20 nt, Artificial Sequence
  MKO10071002_B_Akap10
  gRNA
ugcuguccugcuacuugaaa

SEQ ID NO: 71003 - RNA, 20 nt, Artificial Sequence
  MKO10071003_B_Akap10
  gRNA
uuagaugucaaguccacuaa

SEQ ID NO: 71004 - RNA, 20 nt, Artificial Sequence
  MKO10071004_B_Akap10
  gRNA
gccaugagaaacgacaucau

SEQ ID NO: 71005 - RNA, 20 nt, Artificial Sequence
  MKO10071005_B_Akap11
  gRNA
ugagcacccccaguuaacug

SEQ ID NO: 71006 - RNA, 20 nt, Artificial Sequence
  MKO10071006_B_Akap11
  gRNA
uauggcaaaccucaguuaac

SEQ ID NO: 71007 - RNA, 20 nt, Artificial Sequence
  MKO10071007_B_Akap11
  gRNA
cuccuaaguaaauaugcugc

SEQ ID NO: 71008 - RNA, 20 nt, Artificial Sequence
  MKO10071008_B_Akap12
  gRNA
agcuggagaucccgcugacg

SEQ ID NO: 71009 - RNA, 20 nt, Artificial Sequence
  MKO10071009_B_Akap12
  gRNA
uuguucagcuacaccauuga

SEQ ID NO: 71010 - RNA, 20 nt, Artificial Sequence
  MKO10071010_B_Akap12
  gRNA
agaagauguccacguccaag

SEQ ID NO: 71011 - RNA, 20 nt, Artificial Sequence
  MKO10071011_B_Akap13
  gRNA
cucacugaacagucgccaua

SEQ ID NO: 71012 - RNA, 20 nt, Artificial Sequence
  MKO10071012_B_Akap13
  gRNA
uguagauguccaguucucga

SEQ ID NO: 71013 - RNA, 20 nt, Artificial Sequence
  MKO10071013_B_Akap13
  gRNA
gauaaccucgcuccagugcc

SEQ ID NO: 71014 - RNA, 20 nt, Artificial Sequence
  MKO10071014_B_Akap14
  gRNA
ggacuccaacaaaauaugcu

SEQ ID NO: 71015 - RNA, 20 nt, Artificial Sequence
  MKO10071015_B_Akap14
  gRNA
cggggaauucacaccagaaa

SEQ ID NO: 71016 - RNA, 20 nt, Artificial Sequence
  MKO10071016_B_Akap14
  gRNA
accccaucaagaacaucaag

SEQ ID NO: 71017 - RNA, 20 nt, Artificial Sequence
  MKO10071017_B_Akap17b
  gRNA
ggaggcggguugaagcucuu

SEQ ID NO: 71018 - RNA, 20 nt, Artificial Sequence
  MKO10071018_B_Akap17b
  gRNA
uguguguuugacaaggcuug

SEQ ID NO: 71019 - RNA, 20 nt, Artificial Sequence
  MKO10071019_B_Akap17b
  gRNA
aaggcuaaaauuacaggagc

SEQ ID NO: 71020 - RNA, 20 nt, Artificial Sequence
  MKO10071020_B_Akap1
  gRNA
acucugggggcuaucgggcu

SEQ ID NO: 71021 - RNA, 20 nt, Artificial Sequence
  MKO10071021_B_Akap1
  gRNA
cuuccuugccgaugacgucu

SEQ ID NO: 71022 - RNA, 20 nt, Artificial Sequence
  MKO10071022_B_Akap1
  gRNA
cuuccaugcacugcgcaguc

SEQ ID NO: 71023 - RNA, 20 nt, Artificial Sequence
  MKO10071023_B_Akap2
  gRNA
ggcuaagucaggcuguaagc

SEQ ID NO: 71024 - RNA, 20 nt, Artificial Sequence
  MKO10071024_B_Akap2
  gRNA
cucuaaguuacugucuugca

SEQ ID NO: 71025 - RNA, 20 nt, Artificial Sequence
  MKO10071025_B_Akap2
  gRNA
cuuccaugagggucugcauc

SEQ ID NO: 71026 - RNA, 20 nt, Artificial Sequence
  MKO10071026_B_Akap3
  gRNA
uuugcggcacgcuccaagcc

SEQ ID NO: 71027 - RNA, 20 nt, Artificial Sequence
  MKO10071027_B_Akap3
  gRNA
gaaaggccgcagcgucgggg

SEQ ID NO: 71028 - RNA, 20 nt, Artificial Sequence
  MKO10071028_B_Akap3
  gRNA
aaaguuggugucuauucacc

SEQ ID NO: 71029 - RNA, 20 nt, Artificial Sequence
  MKO10071029_B_Akap4
  gRNA
aaaagagauuaucguaauca

SEQ ID NO: 71030 - RNA, 20 nt, Artificial Sequence
  MKO10071030_B_Akap4
  gRNA
cuaccuugcacacgccucug

SEQ ID NO: 71031 - RNA, 20 nt, Artificial Sequence
  MKO10071031_B_Akap4
  gRNA
auuuaacucgccuucugacc

SEQ ID NO: 71032 - RNA, 20 nt, Artificial Sequence
  MKO10071032_B_Akap5
  gRNA
ccgcuguagcuucuccggcc

SEQ ID NO: 71033 - RNA, 20 nt, Artificial Sequence
  MKO10071033_B_Akap5
  gRNA
acuuucccggaugccauuac

SEQ ID NO: 71034 - RNA, 20 nt, Artificial Sequence
  MKO10071034_B_Akap5
  gRNA
uaccugaaucucagaaacgc

SEQ ID NO: 71035 - RNA, 20 nt, Artificial Sequence
  MKO10071035_B_Akap6
  gRNA
cuccgggagcgcauccuaca

SEQ ID NO: 71036 - RNA, 20 nt, Artificial Sequence
  MKO10071036_B_Akap6
  gRNA
cagccggaggcugucggucu

SEQ ID NO: 71037 - RNA, 20 nt, Artificial Sequence
  MKO10071037_B_Akap6
  gRNA
ucaguggcuaaacgaagcca

SEQ ID NO: 71038 - RNA, 20 nt, Artificial Sequence
  MKO10071038_B_Akap7
  gRNA
gcaaaauucgauacuacagc

SEQ ID NO: 71039 - RNA, 20 nt, Artificial Sequence
  MKO10071039_B_Akap7
  gRNA
aaaggagccgucgcccacca

SEQ ID NO: 71040 - RNA, 20 nt, Artificial Sequence
  MKO10071040_B_Akap7
  gRNA
cauuccgaucaccaacaaaa

SEQ ID NO: 71041 - RNA, 20 nt, Artificial Sequence
  MKO10071041_B_Akap8l
  gRNA
auucacccggaagucggcug

SEQ ID NO: 71042 - RNA, 20 nt, Artificial Sequence
  MKO10071042_B_Akap8l
  gRNA
gccacacucaccauaaucac

SEQ ID NO: 71043 - RNA, 20 nt, Artificial Sequence
  MKO10071043_B_Akap8l
  gRNA
acaguacguagacugcaaag

SEQ ID NO: 71044 - RNA, 20 nt, Artificial Sequence
  MKO10071044_B_Akap8
  gRNA
ggcaaaagacgccacaugca

SEQ ID NO: 71045 - RNA, 20 nt, Artificial Sequence
  MKO10071045_B_Akap8
  gRNA
gaaggucuuaccuugccagc

SEQ ID NO: 71046 - RNA, 20 nt, Artificial Sequence
  MKO10071046_B_Akap8
  gRNA
ugcuggaccugccaacaccc

SEQ ID NO: 71047 - RNA, 20 nt, Artificial Sequence
  MKO10071047_B_Akap9
  gRNA
gccgggaauccugauugcuc

SEQ ID NO: 71048 - RNA, 20 nt, Artificial Sequence
  MKO10071048_B_Akap9
  gRNA
ugauauugaagaguugacuc

SEQ ID NO: 71049 - RNA, 20 nt, Artificial Sequence
  MKO10071049_B_Akap9
  gRNA
cgagcuacauucaucugcag

SEQ ID NO: 71050 - RNA, 20 nt, Artificial Sequence
  MKO10071050_B_Akip1
  gRNA
uucugugauaacgguagaca

SEQ ID NO: 71051 - RNA, 20 nt, Artificial Sequence
  MKO10071051_B_Akip1
  gRNA
auacuacuugucuaugccag

SEQ ID NO: 71052 - RNA, 20 nt, Artificial Sequence
  MKO10071052_B_Akip1
  gRNA
gacuauacuucaagucagug

SEQ ID NO: 71053 - RNA, 20 nt, Artificial Sequence
  MKO10071053_B_Akirin1
  gRNA
cuuacugcaccagguucucc

SEQ ID NO: 71054 - RNA, 20 nt, Artificial Sequence
  MKO10071054_B_Akirin1
  gRNA
ucacgcaugaucagaucaug

SEQ ID NO: 71055 - RNA, 20 nt, Artificial Sequence
  MKO10071055_B_Akirin1
  gRNA
ggauuugcucauacuccucu

SEQ ID NO: 71056 - RNA, 20 nt, Artificial Sequence
  MKO10071056_B_Akirin2
  gRNA
auacugaauacaaaacuugc

SEQ ID NO: 71057 - RNA, 20 nt, Artificial Sequence
  MKO10071057_B_Akirin2
  gRNA
uuacgcaugaucagauaaug

SEQ ID NO: 71058 - RNA, 20 nt, Artificial Sequence
  MKO10071058_B_Akirin2
  gRNA
gugaacguuuguugaaagaa

SEQ ID NO: 71059 - RNA, 20 nt, Artificial Sequence
  MKO10071059_B_Aknad1
  gRNA
accugccaagaaccucucac

SEQ ID NO: 71060 - RNA, 20 nt, Artificial Sequence
  MKO10071060_B_Aknad1
  gRNA
gccuccuguggcccuccccu

SEQ ID NO: 71061 - RNA, 20 nt, Artificial Sequence
  MKO10071061_B_Aknad1
  gRNA
gccacaggaggccaccucca

SEQ ID NO: 71062 - RNA, 20 nt, Artificial Sequence
  MKO10071062_B_Akna
  gRNA
uugguccucaggccgagagc

SEQ ID NO: 71063 - RNA, 20 nt, Artificial Sequence
  MKO10071063_B_Akna
  gRNA
guucucagccuccgcauacu

SEQ ID NO: 71064 - RNA, 20 nt, Artificial Sequence
  MKO10071064_B_Akna
  gRNA
agggacucaggucuguucgu

SEQ ID NO: 71065 - RNA, 20 nt, Artificial Sequence
  MKO10071065_B_Akp3
  gRNA
cuguccccagacauacagug

SEQ ID NO: 71066 - RNA, 20 nt, Artificial Sequence
  MKO10071066_B_Akp3
  gRNA
cuggaacaagaaggcagccg

SEQ ID NO: 71067 - RNA, 20 nt, Artificial Sequence
  MKO10071067_B_Akp3
  gRNA
accuuggacagagccauaua

SEQ ID NO: 71068 - RNA, 20 nt, Artificial Sequence
  MKO10071068_B_Akr1a1
  gRNA
ccaagccccgugcgugacag

SEQ ID NO: 71069 - RNA, 20 nt, Artificial Sequence
  MKO10071069_B_Akr1a1
  gRNA
cccuuucccaagaaugccga

SEQ ID NO: 71070 - RNA, 20 nt, Artificial Sequence
  MKO10071070_B_Akr1a1
  gRNA
cucacaggcagucccucgag

SEQ ID NO: 71071 - RNA, 20 nt, Artificial Sequence
  MKO10071071_B_Akr1b10
  gRNA
aguggauuagauacaggucc

SEQ ID NO: 71072 - RNA, 20 nt, Artificial Sequence
  MKO10071072_B_Akr1b10
  gRNA
aauacugccuuuaucaucug

SEQ ID NO: 71073 - RNA, 20 nt, Artificial Sequence
  MKO10071073_B_Akr1b10
  gRNA
agucaagcuucagauccgag

SEQ ID NO: 71074 - RNA, 20 nt, Artificial Sequence
  MKO10071074_B_Akr1b3
  gRNA
uuuccaguccccuccuggcc

SEQ ID NO: 71075 - RNA, 20 nt, Artificial Sequence
  MKO10071075_B_Akr1b3
  gRNA
ggaucucuucauugucagca

SEQ ID NO: 71076 - RNA, 20 nt, Artificial Sequence
  MKO10071076_B_Akr1b3
  gRNA
cacguuccaugacaagagca

SEQ ID NO: 71077 - RNA, 20 nt, Artificial Sequence
  MKO10071077_B_Akr1b7
  gRNA
ccugaguaaauccacauucu

SEQ ID NO: 71078 - RNA, 20 nt, Artificial Sequence
  MKO10071078_B_Akr1b7
  gRNA
uuauuacccaaagacaauaa

SEQ ID NO: 71079 - RNA, 20 nt, Artificial Sequence
  MKO10071079_B_Akr1b7
  gRNA
aguccagcuucagauccgag

SEQ ID NO: 71080 - RNA, 20 nt, Artificial Sequence
  MKO10071080_B_Akr1b8
  gRNA
uuccaagaauguugucuuac

SEQ ID NO: 71081 - RNA, 20 nt, Artificial Sequence
  MKO10071081_B_Akr1b8
  gRNA
aguccagcuucagauccgug

SEQ ID NO: 71082 - RNA, 20 nt, Artificial Sequence
  MKO10071082_B_Akr1b8
  gRNA
uagcaguuucuucucaaagc

SEQ ID NO: 71083 - RNA, 20 nt, Artificial Sequence
  MKO10071083_B_Akr1c12
  gRNA
gaaauuucuauuggacacug

SEQ ID NO: 71084 - RNA, 20 nt, Artificial Sequence
  MKO10071084_B_Akr1c12
  gRNA
gagagaauccucaacaagcc

SEQ ID NO: 71085 - RNA, 20 nt, Artificial Sequence
  MKO10071085_B_Akr1c12
  gRNA
acuucaguccuggcuuguug

SEQ ID NO: 71086 - RNA, 20 nt, Artificial Sequence
  MKO10071086_B_Akr1c13
  gRNA
gaaaucucuguuggacacug

SEQ ID NO: 71087 - RNA, 20 nt, Artificial Sequence
  MKO10071087_B_Akr1c13
  gRNA
cagcugccugugguuaaagu

SEQ ID NO: 71088 - RNA, 20 nt, Artificial Sequence
  MKO10071088_B_Akr1c13
  gRNA
gauuucccuugcucauuuac

SEQ ID NO: 71089 - RNA, 20 nt, Artificial Sequence
  MKO10071089_B_Akr1c14
  gRNA
cacuuuccaucgaccagaau

SEQ ID NO: 71090 - RNA, 20 nt, Artificial Sequence
  MKO10071090_B_Akr1c14
  gRNA
gccuugauaaguucauccuu

SEQ ID NO: 71091 - RNA, 20 nt, Artificial Sequence
  MKO10071091_B_Akr1c14
  gRNA
acaaauaagcggagucaaaa

SEQ ID NO: 71092 - RNA, 20 nt, Artificial Sequence
  MKO10071092_B_Akr1c18
  gRNA
ggccuaucucuucuucauuc

SEQ ID NO: 71093 - RNA, 20 nt, Artificial Sequence
  MKO10071093_B_Akr1c18
  gRNA
agauauauucuauacuucga

SEQ ID NO: 71094 - RNA, 20 nt, Artificial Sequence
  MKO10071094_B_Akr1c18
  gRNA
aaguuuccaugcucaucuuu

SEQ ID NO: 71095 - RNA, 20 nt, Artificial Sequence
  MKO10071095_B_Akr1c19
  gRNA
auucgaagcaagauugcagc

SEQ ID NO: 71096 - RNA, 20 nt, Artificial Sequence
  MKO10071096_B_Akr1c19
  gRNA
guucucaccugguugcaaac

SEQ ID NO: 71097 - RNA, 20 nt, Artificial Sequence
  MKO10071097_B_Akr1c19
  gRNA
ggcuauccauuuagcucuag

SEQ ID NO: 71098 - RNA, 20 nt, Artificial Sequence
  MKO10071098_B_Akr1c20
  gRNA
agaagauccugaguaagccg

SEQ ID NO: 71099 - RNA, 20 nt, Artificial Sequence
  MKO10071099_B_Akr1c20
  gRNA
acacagcagcacaaucaaua

SEQ ID NO: 71100 - RNA, 20 nt, Artificial Sequence
  MKO10071100_B_Akr1c20
  gRNA
gcuucuguagccuuacuccu

SEQ ID NO: 71101 - RNA, 20 nt, Artificial Sequence
  MKO10071101_B_Akr1c21
  gRNA
gagcuccuuagcuuuacucu

SEQ ID NO: 71102 - RNA, 20 nt, Artificial Sequence
  MKO10071102_B_Akr1c21
  gRNA
gcaggacuaaccaaguccau

SEQ ID NO: 71103 - RNA, 20 nt, Artificial Sequence
  MKO10071103_B_Akr1c21
  gRNA
agaugauucugaauaagccu

SEQ ID NO: 71104 - RNA, 20 nt, Artificial Sequence
  MKO10071104_B_Akr1c6
  gRNA
gcuucuguagccuuacucuu

SEQ ID NO: 71105 - RNA, 20 nt, Artificial Sequence
  MKO10071105_B_Akr1c6
  gRNA
aaaauuaauauaugaugcug

SEQ ID NO: 71106 - RNA, 20 nt, Artificial Sequence
  MKO10071106_B_Akr1c6
  gRNA
auacccaccugguugcacac

SEQ ID NO: 71107 - RNA, 20 nt, Artificial Sequence
  MKO10071107_B_Akr1cl
  gRNA
cacaugucauagaccagagc

SEQ ID NO: 71108 - RNA, 20 nt, Artificial Sequence
  MKO10071108_B_Akr1cl
  gRNA
ucacucaccugguugcacac

SEQ ID NO: 71109 - RNA, 20 nt, Artificial Sequence
  MKO10071109_B_Akr1cl
  gRNA
ucaggguuagccaaguccau

SEQ ID NO: 71110 - RNA, 20 nt, Artificial Sequence
  MKO10071110_B_Akr1d1
  gRNA
guacaaaccagucacuaacc

SEQ ID NO: 71111 - RNA, 20 nt, Artificial Sequence
  MKO10071111_B_Akr1d1
  gRNA
caaucuaccugguuagugac

SEQ ID NO: 71112 - RNA, 20 nt, Artificial Sequence
  MKO10071112_B_Akr1d1
  gRNA
ggucuauguaaucuaguuug

SEQ ID NO: 71113 - RNA, 20 nt, Artificial Sequence
  MKO10071113_B_Akr1e1
  gRNA
aguaagcacaaucgaagugc

SEQ ID NO: 71114 - RNA, 20 nt, Artificial Sequence
  MKO10071114_B_Akr1e1
  gRNA
caacucaccugguuaguuau

SEQ ID NO: 71115 - RNA, 20 nt, Artificial Sequence
  MKO10071115_B_Akr1e1
  gRNA
gagugguaccuugaaaccca

SEQ ID NO: 71116 - RNA, 20 nt, Artificial Sequence
  MKO10071116_B_Akr7a5
  gRNA
guucuacgccuacaacccuu

SEQ ID NO: 71117 - RNA, 20 nt, Artificial Sequence
  MKO10071117_B_Akr7a5
  gRNA
ccaagugaaaaucgccacca

SEQ ID NO: 71118 - RNA, 20 nt, Artificial Sequence
  MKO10071118_B_Akr7a5
  gRNA
auuuauacuugccagucagc

SEQ ID NO: 71119 - RNA, 20 nt, Artificial Sequence
  MKO10071119_B_Akt1s1
  gRNA
cggcugggcgguagcgauaa

SEQ ID NO: 71120 - RNA, 20 nt, Artificial Sequence
  MKO10071120_B_Akt1s1
  gRNA
agaagcccgaucgucagaug

SEQ ID NO: 71121 - RNA, 20 nt, Artificial Sequence
  MKO10071121_B_Akt1s1
  gRNA
cggcgggcgucuccucgcuc

SEQ ID NO: 71122 - RNA, 20 nt, Artificial Sequence
  MKO10071122_B_Akt1
  gRNA
ccguuccuuguagccaauaa

SEQ ID NO: 71123 - RNA, 20 nt, Artificial Sequence
  MKO10071123_B_Akt1
  gRNA
ggcucacccagugacaacuc

SEQ ID NO: 71124 - RNA, 20 nt, Artificial Sequence
  MKO10071124_B_Akt1
  gRNA
cauggcauaguagcggccug

SEQ ID NO: 71125 - RNA, 20 nt, Artificial Sequence
  MKO10071125_B_Akt2
  gRNA
aaccagaaugaccuugccga

SEQ ID NO: 71126 - RNA, 20 nt, Artificial Sequence
  MKO10071126_B_Akt2
  gRNA
ccuacagggaagaguggaug

SEQ ID NO: 71127 - RNA, 20 nt, Artificial Sequence
  MKO10071127_B_Akt2
  gRNA
ucucaucuggagagucuaca

SEQ ID NO: 71128 - RNA, 20 nt, Artificial Sequence
  MKO10071128_B_Akt3
  gRNA
auuucauguagauacaccag

SEQ ID NO: 71129 - RNA, 20 nt, Artificial Sequence
  MKO10071129_B_Akt3
  gRNA
uccccucaacaacuucucag

SEQ ID NO: 71130 - RNA, 20 nt, Artificial Sequence
  MKO10071130_B_Akt3
  gRNA
uuugacuauuugaaacuacu

SEQ ID NO: 71131 - RNA, 20 nt, Artificial Sequence
  MKO10071131_B_Aktip
  gRNA
cugcaagaagcgaauauucc

SEQ ID NO: 71132 - RNA, 20 nt, Artificial Sequence
  MKO10071132_B_Aktip
  gRNA
ccaucuuaccgcucugcauu

SEQ ID NO: 71133 - RNA, 20 nt, Artificial Sequence
  MKO10071133_B_Aktip
  gRNA
gauggcuguacguagacucc

SEQ ID NO: 71134 - RNA, 20 nt, Artificial Sequence
  MKO10071134_B_Alad
  gRNA
uugaggcuguccgucugcug

SEQ ID NO: 71135 - RNA, 20 nt, Artificial Sequence
  MKO10071135_B_Alad
  gRNA
caaagaucaggacacagcgc

SEQ ID NO: 71136 - RNA, 20 nt, Artificial Sequence
  MKO10071136_B_Alad
  gRNA
cugcgcuguguccugaucuu

SEQ ID NO: 71137 - RNA, 20 nt, Artificial Sequence
  MKO10071137_B_Alas1
  gRNA
gacggcacacagcuuccguc

SEQ ID NO: 71138 - RNA, 20 nt, Artificial Sequence
  MKO10071138_B_Alas1
  gRNA
gagagcacaaaucuucccga

SEQ ID NO: 71139 - RNA, 20 nt, Artificial Sequence
  MKO10071139_B_Alas1
  gRNA
ugugccaucugggacucguc

SEQ ID NO: 71140 - RNA, 20 nt, Artificial Sequence
  MKO10071140_B_Alas2
  gRNA
cugauucagaacaauaugac

SEQ ID NO: 71141 - RNA, 20 nt, Artificial Sequence
  MKO10071141_B_Alas2
  gRNA
uaccaguuccuauuuaguau

SEQ ID NO: 71142 - RNA, 20 nt, Artificial Sequence
  MKO10071142_B_Alas2
  gRNA
acugccccuucagucugcuc

SEQ ID NO: 71143 - RNA, 20 nt, Artificial Sequence
  MKO10071143_B_Alb
  gRNA
aggaguuuaccuucgggguc

SEQ ID NO: 71144 - RNA, 20 nt, Artificial Sequence
  MKO10071144_B_Alb
  gRNA
ggguacucacugucccauaa

SEQ ID NO: 71145 - RNA, 20 nt, Artificial Sequence
  MKO10071145_B_Alb
  gRNA
ugagcaugccaaauuagugc

SEQ ID NO: 71146 - RNA, 20 nt, Artificial Sequence
  MKO10071146_B_Alcam
  gRNA
uaccaugugauguugccauc

SEQ ID NO: 71147 - RNA, 20 nt, Artificial Sequence
  MKO10071147_B_Alcam
  gRNA
uacacugucaacucagcaua

SEQ ID NO: 71148 - RNA, 20 nt, Artificial Sequence
  MKO10071148_B_Alcam
  gRNA
cagcugaucuguuucaagaa

SEQ ID NO: 71149 - RNA, 20 nt, Artificial Sequence
  MKO10071149_B_Aldh16a1
  gRNA
acuuuaccuacccauagcca

SEQ ID NO: 71150 - RNA, 20 nt, Artificial Sequence
  MKO10071150_B_Aldh16a1
  gRNA
gcgguuguggguguccagcc

SEQ ID NO: 71151 - RNA, 20 nt, Artificial Sequence
  MKO10071151_B_Aldh16a1
  gRNA
ggcugcaaagauagcauuca

SEQ ID NO: 71152 - RNA, 20 nt, Artificial Sequence
  MKO10071152_B_Aldh18a1
  gRNA
gcuugccgugggcacgacug

SEQ ID NO: 71153 - RNA, 20 nt, Artificial Sequence
  MKO10071153_B_Aldh18a1
  gRNA
ugguagaagacguugccuga

SEQ ID NO: 71154 - RNA, 20 nt, Artificial Sequence
  MKO10071154_B_Aldh18a1
  gRNA
cugagacacaugcaccgcuc

SEQ ID NO: 71155 - RNA, 20 nt, Artificial Sequence
  MKO10071155_B_Aldh1a1
  gRNA
aguucuuaacccugcaacug

SEQ ID NO: 71156 - RNA, 20 nt, Artificial Sequence
  MKO10071156_B_Aldh1a1
  gRNA
uauacaagacgugaaccuau

SEQ ID NO: 71157 - RNA, 20 nt, Artificial Sequence
  MKO10071157_B_Aldh1a1
  gRNA
ugcgccauggagagccaauc

SEQ ID NO: 71158 - RNA, 20 nt, Artificial Sequence
  MKO10071158_B_Aldh1a2
  gRNA
aaucgauguaaaaagcuugc

SEQ ID NO: 71159 - RNA, 20 nt, Artificial Sequence
  MKO10071159_B_Aldh1a2
  gRNA
guuggacaagcuugcagacu

SEQ ID NO: 71160 - RNA, 20 nt, Artificial Sequence
  MKO10071160_B_Aldh1a2
  gRNA
aguguguggacagaucaucc

SEQ ID NO: 71161 - RNA, 20 nt, Artificial Sequence
  MKO10071161_B_Aldh1a3
  gRNA
acaacguugugugcuucacc

SEQ ID NO: 71162 - RNA, 20 nt, Artificial Sequence
  MKO10071162_B_Aldh1a3
  gRNA
agauauuuaucaacaacgac

SEQ ID NO: 71163 - RNA, 20 nt, Artificial Sequence
  MKO10071163_B_Aldh1a3
  gRNA
aggucuuaauacagccuucc

SEQ ID NO: 71164 - RNA, 20 nt, Artificial Sequence
  MKO10071164_B_Aldh1a7
  gRNA
cgugaaccuauuggggugug

SEQ ID NO: 71165 - RNA, 20 nt, Artificial Sequence
  MKO10071165_B_Aldh1a7
  gRNA
gaaaacuuacagggaugauu

SEQ ID NO: 71166 - RNA, 20 nt, Artificial Sequence
  MKO10071166_B_Aldh1a7
  gRNA
ugcgccauggggagccaauc

SEQ ID NO: 71167 - RNA, 20 nt, Artificial Sequence
  MKO10071167_B_Aldh1b1
  gRNA
ggcuguguucacccgagacc

SEQ ID NO: 71168 - RNA, 20 nt, Artificial Sequence
  MKO10071168_B_Aldh1b1
  gRNA
agcuuguuguagcaaaucuc

SEQ ID NO: 71169 - RNA, 20 nt, Artificial Sequence
  MKO10071169_B_Aldh1b1
  gRNA
gcuggccccggcacucgcca

SEQ ID NO: 71170 - RNA, 20 nt, Artificial Sequence
  MKO10071170_B_Aldh1l1
  gRNA
ccauucacaacuggauccgu

SEQ ID NO: 71171 - RNA, 20 nt, Artificial Sequence
  MKO10071171_B_Aldh1l1
  gRNA
acgguuguacagcgugcuca

SEQ ID NO: 71172 - RNA, 20 nt, Artificial Sequence
  MKO10071172_B_Aldh1l1
  gRNA
ggcugugcgacugauugcag

SEQ ID NO: 71173 - RNA, 20 nt, Artificial Sequence
  MKO10071173_B_Aldh1l2
  gRNA
uuacccuugagucuccaucg

SEQ ID NO: 71174 - RNA, 20 nt, Artificial Sequence
  MKO10071174_B_Aldh1l2
  gRNA
cgucacacgaucucugaaga

SEQ ID NO: 71175 - RNA, 20 nt, Artificial Sequence
  MKO10071175_B_Aldh1l2
  gRNA
cuuauuggccagagccuguu

SEQ ID NO: 71176 - RNA, 20 nt, Artificial Sequence
  MKO10071176_B_Aldh2
  gRNA
ccggcuguuguaccgauugg

SEQ ID NO: 71177 - RNA, 20 nt, Artificial Sequence
  MKO10071177_B_Aldh2
  gRNA
accagguacgagaugacaua

SEQ ID NO: 71178 - RNA, 20 nt, Artificial Sequence
  MKO10071178_B_Aldh2
  gRNA
gggaaaaccauucccaucga

SEQ ID NO: 71179 - RNA, 20 nt, Artificial Sequence
  MKO10071179_B_Aldh3a1
  gRNA
gagcccuuguuacguagaca

SEQ ID NO: 71180 - RNA, 20 nt, Artificial Sequence
  MKO10071180_B_Aldh3a1
  gRNA
cucggaagugagugaucaca

SEQ ID NO: 71181 - RNA, 20 nt, Artificial Sequence
  MKO10071181_B_Aldh3a1
  gRNA
caugugaucacucacuuccg

SEQ ID NO: 71182 - RNA, 20 nt, Artificial Sequence
  MKO10071182_B_Aldh3a2
  gRNA
gcuucgcacaggauauaguc

SEQ ID NO: 71183 - RNA, 20 nt, Artificial Sequence
  MKO10071183_B_Aldh3a2
  gRNA
auaaucaguacgacucccag

SEQ ID NO: 71184 - RNA, 20 nt, Artificial Sequence
  MKO10071184_B_Aldh3a2
  gRNA
ucuucuguacgauuugauuc

SEQ ID NO: 71185 - RNA, 20 nt, Artificial Sequence
  MKO10071185_B_Aldh3b1
  gRNA
cuuucuguagucagccuucg

SEQ ID NO: 71186 - RNA, 20 nt, Artificial Sequence
  MKO10071186_B_Aldh3b1
  gRNA
ccugccccgcuaucuggacc

SEQ ID NO: 71187 - RNA, 20 nt, Artificial Sequence
  MKO10071187_B_Aldh3b1
  gRNA
gcugaccgcagggaauugug

SEQ ID NO: 71188 - RNA, 20 nt, Artificial Sequence
  MKO10071188_B_Aldh3b2
  gRNA
gaucauccugugcgagaaug

SEQ ID NO: 71189 - RNA, 20 nt, Artificial Sequence
  MKO10071189_B_Aldh3b2
  gRNA
agcugagcucagccuucauc

SEQ ID NO: 71190 - RNA, 20 nt, Artificial Sequence
  MKO10071190_B_Aldh3b2
  gRNA
agagcugcugccccaguauc

SEQ ID NO: 71191 - RNA, 20 nt, Artificial Sequence
  MKO10071191_B_Aldh4a1
  gRNA
aucgauggcucuguugagca

SEQ ID NO: 71192 - RNA, 20 nt, Artificial Sequence
  MKO10071192_B_Aldh4a1
  gRNA
gcccaucuuagcauucucuc

SEQ ID NO: 71193 - RNA, 20 nt, Artificial Sequence
  MKO10071193_B_Aldh4a1
  gRNA
cgagcgggaugcacugcaga

SEQ ID NO: 71194 - RNA, 20 nt, Artificial Sequence
  MKO10071194_B_Aldh5a1
  gRNA
gaggaagcucgccguauuua

SEQ ID NO: 71195 - RNA, 20 nt, Artificial Sequence
  MKO10071195_B_Aldh5a1
  gRNA
agacacacccuauuccgccc

SEQ ID NO: 71196 - RNA, 20 nt, Artificial Sequence
  MKO10071196_B_Aldh5a1
  gRNA
accucugccaaagauaagcg

SEQ ID NO: 71197 - RNA, 20 nt, Artificial Sequence
  MKO10071197_B_Aldh6a1
  gRNA
aaccccauagguuucuucua

SEQ ID NO: 71198 - RNA, 20 nt, Artificial Sequence
  MKO10071198_B_Aldh6a1
  gRNA
acuguaaagcucuucauuga

SEQ ID NO: 71199 - RNA, 20 nt, Artificial Sequence
  MKO10071199_B_Aldh6a1
  gRNA
ucaaugaagagcuuuacagu

SEQ ID NO: 71200 - RNA, 20 nt, Artificial Sequence
  MKO10071200_B_Aldh7a1
  gRNA
uagauuccugccccaaaacg

SEQ ID NO: 71201 - RNA, 20 nt, Artificial Sequence
  MKO10071201_B_Aldh7a1
  gRNA
gccaauagcaagaguccgac

SEQ ID NO: 71202 - RNA, 20 nt, Artificial Sequence
  MKO10071202_B_Aldh7a1
  gRNA
agggcguguauaauggaagc

SEQ ID NO: 71203 - RNA, 20 nt, Artificial Sequence
  MKO10071203_B_Aldh8a1
  gRNA
aacguucucucguccugaac

SEQ ID NO: 71204 - RNA, 20 nt, Artificial Sequence
  MKO10071204_B_Aldh8a1
  gRNA
uacccuugaucucguucacu

SEQ ID NO: 71205 - RNA, 20 nt, Artificial Sequence
  MKO10071205_B_Aldh8a1
  gRNA
cacgguauucccagcagcga

SEQ ID NO: 71206 - RNA, 20 nt, Artificial Sequence
  MKO10071206_B_Aldh9a1
  gRNA
cucucuucggguguagccga

SEQ ID NO: 71207 - RNA, 20 nt, Artificial Sequence
  MKO10071207_B_Aldh9a1
  gRNA
auugccacuuucgcguguuc

SEQ ID NO: 71208 - RNA, 20 nt, Artificial Sequence
  MKO10071208_B_Aldh9a1
  gRNA
cauccguaccuucacgccag

SEQ ID NO: 71209 - RNA, 20 nt, Artificial Sequence
  MKO10071209_B_Aldoart1
  gRNA
ggugacccauggcaacgcac

SEQ ID NO: 71210 - RNA, 20 nt, Artificial Sequence
  MKO10071210_B_Aldoart1
  gRNA
aucuugccugugcguugcca

SEQ ID NO: 71211 - RNA, 20 nt, Artificial Sequence
  MKO10071211_B_Aldoart1
  gRNA
uccuugacaagcgagacugu

SEQ ID NO: 71212 - RNA, 20 nt, Artificial Sequence
  MKO10071212_B_Aldoart2
  gRNA
ugguaguaguagcgccgucc

SEQ ID NO: 71213 - RNA, 20 nt, Artificial Sequence
  MKO10071213_B_Aldoart2
  gRNA
uuugcugauauguagacucg

SEQ ID NO: 71214 - RNA, 20 nt, Artificial Sequence
  MKO10071214_B_Aldoart2
  gRNA
uaaccacgccuacugagcag

SEQ ID NO: 71215 - RNA, 20 nt, Artificial Sequence
  MKO10071215_B_Aldoa
  gRNA
ccuugcccggagccacaaug

SEQ ID NO: 71216 - RNA, 20 nt, Artificial Sequence
  MKO10071216_B_Aldoa
  gRNA
ucccaccugcuggcagaugc

SEQ ID NO: 71217 - RNA, 20 nt, Artificial Sequence
  MKO10071217_B_Aldoa
  gRNA
uuaugccagcaucugccagc

SEQ ID NO: 71218 - RNA, 20 nt, Artificial Sequence
  MKO10071218_B_Aldob
  gRNA
uccugacggagaccaugacc

SEQ ID NO: 71219 - RNA, 20 nt, Artificial Sequence
  MKO10071219_B_Aldob
  gRNA
uauccacaguuggaccaagg

SEQ ID NO: 71220 - RNA, 20 nt, Artificial Sequence
  MKO10071220_B_Aldob
  gRNA
cccgcuugcaggaacaaaca

SEQ ID NO: 71221 - RNA, 20 nt, Artificial Sequence
  MKO10071221_B_Aldoc
  gRNA
cuacgagaaugcccuuaucc

SEQ ID NO: 71222 - RNA, 20 nt, Artificial Sequence
  MKO10071222_B_Aldoc
  gRNA
uccccgucggucccagcuag

SEQ ID NO: 71223 - RNA, 20 nt, Artificial Sequence
  MKO10071223_B_Aldoc
  gRNA
gaaucgccggcuguaccgcc

SEQ ID NO: 71224 - RNA, 20 nt, Artificial Sequence
  MKO10071224_B_Alg10b
  gRNA
uacgcuuccaaacuaagcua

SEQ ID NO: 71225 - RNA, 20 nt, Artificial Sequence
  MKO10071225_B_Alg10b
  gRNA
ucgcaguaccgcugcgccug

SEQ ID NO: 71226 - RNA, 20 nt, Artificial Sequence
  MKO10071226_B_Alg10b
  gRNA
cucccgcagagcgcggcuga

SEQ ID NO: 71227 - RNA, 20 nt, Artificial Sequence
  MKO10071227_B_Alg11
  gRNA
ccacauaguaugcagaccga

SEQ ID NO: 71228 - RNA, 20 nt, Artificial Sequence
  MKO10071228_B_Alg11
  gRNA
ccgccaccugcauuacagua

SEQ ID NO: 71229 - RNA, 20 nt, Artificial Sequence
  MKO10071229_B_Alg11
  gRNA
acuccgcauaucaucagucc

SEQ ID NO: 71230 - RNA, 20 nt, Artificial Sequence
  MKO10071230_B_Alg12
  gRNA
uacgaccaccacgaguuucc

SEQ ID NO: 71231 - RNA, 20 nt, Artificial Sequence
  MKO10071231_B_Alg12
  gRNA
gcagaacaugacagccaccg

SEQ ID NO: 71232 - RNA, 20 nt, Artificial Sequence
  MKO10071232_B_Alg12
  gRNA
ccugaagccaaugaugacga

SEQ ID NO: 71233 - RNA, 20 nt, Artificial Sequence
  MKO10071233_B_Alg13
  gRNA
gaucuugucauuagccacgc

SEQ ID NO: 71234 - RNA, 20 nt, Artificial Sequence
  MKO10071234_B_Alg13
  gRNA
uccauugacuguaacagccc

SEQ ID NO: 71235 - RNA, 20 nt, Artificial Sequence
  MKO10071235_B_Alg13
  gRNA
gaacaaucaucaauuugaau

SEQ ID NO: 71236 - RNA, 20 nt, Artificial Sequence
  MKO10071236_B_Alg14
  gRNA
ucuugcuauuccagcgacua

SEQ ID NO: 71237 - RNA, 20 nt, Artificial Sequence
  MKO10071237_B_Alg14
  gRNA
cagauagggacgcauguucc

SEQ ID NO: 71238 - RNA, 20 nt, Artificial Sequence
  MKO10071238_B_Alg14
  gRNA
gucucucagacucuugaucg

SEQ ID NO: 71239 - RNA, 20 nt, Artificial Sequence
  MKO10071239_B_Alg1
  gRNA
ccgccaccccauugugcugc

SEQ ID NO: 71240 - RNA, 20 nt, Artificial Sequence
  MKO10071240_B_Alg1
  gRNA
cugcauuugugggagcaaau

SEQ ID NO: 71241 - RNA, 20 nt, Artificial Sequence
  MKO10071241_B_Alg1
  gRNA
ugugugugaccaaugcuaug

SEQ ID NO: 71242 - RNA, 20 nt, Artificial Sequence
  MKO10071242_B_Alg2
  gRNA
caccacgucgaacuccucgc

SEQ ID NO: 71243 - RNA, 20 nt, Artificial Sequence
  MKO10071243_B_Alg2
  gRNA
uaggacccucuuacgccguc

SEQ ID NO: 71244 - RNA, 20 nt, Artificial Sequence
  MKO10071244_B_Alg2
  gRNA
aacuggccagacggcguaag

SEQ ID NO: 71245 - RNA, 20 nt, Artificial Sequence
  MKO10071245_B_Alg3
  gRNA
ccucacucacacaagagguc

SEQ ID NO: 71246 - RNA, 20 nt, Artificial Sequence
  MKO10071246_B_Alg3
  gRNA
gaagagccgcaguacaaaga

SEQ ID NO: 71247 - RNA, 20 nt, Artificial Sequence
  MKO10071247_B_Alg3
  gRNA
ucaucuucaccgagacagcc

SEQ ID NO: 71248 - RNA, 20 nt, Artificial Sequence
  MKO10071248_B_Alg5
  gRNA
acaacagauagcuguuucgu

SEQ ID NO: 71249 - RNA, 20 nt, Artificial Sequence
  MKO10071249_B_Alg5
  gRNA
agcaguuauaaacgccacaa

SEQ ID NO: 71250 - RNA, 20 nt, Artificial Sequence
  MKO10071250_B_Alg5
  gRNA
auacauuuaccuuugacguc

SEQ ID NO: 71251 - RNA, 20 nt, Artificial Sequence
  MKO10071251_B_Alg6
  gRNA
ucucauagccucgugaugug

SEQ ID NO: 71252 - RNA, 20 nt, Artificial Sequence
  MKO10071252_B_Alg6
  gRNA
gugauaacaauuuacuguac

SEQ ID NO: 71253 - RNA, 20 nt, Artificial Sequence
  MKO10071253_B_Alg6
  gRNA
gcuggaaaaccaccuauguu

SEQ ID NO: 71254 - RNA, 20 nt, Artificial Sequence
  MKO10071254_B_Alg8
  gRNA
guccauugcacgucuauuuc

SEQ ID NO: 71255 - RNA, 20 nt, Artificial Sequence
  MKO10071255_B_Alg8
  gRNA
gagugauugcaagccaauuu

SEQ ID NO: 71256 - RNA, 20 nt, Artificial Sequence
  MKO10071256_B_Alg8
  gRNA
uccuugaacuguaauaguuc

SEQ ID NO: 71257 - RNA, 20 nt, Artificial Sequence
  MKO10071257_B_Alg9
  gRNA
cgggggaauauucccauguc

SEQ ID NO: 71258 - RNA, 20 nt, Artificial Sequence
  MKO10071258_B_Alg9
  gRNA
aguccgagauguugcucaga

SEQ ID NO: 71259 - RNA, 20 nt, Artificial Sequence
  MKO10071259_B_Alg9
  gRNA
gugaugaaacauucaacuac

SEQ ID NO: 71260 - RNA, 20 nt, Artificial Sequence
  MKO10071260_B_Alkbh1
  gRNA
aggauagccuucgaguccau

SEQ ID NO: 71261 - RNA, 20 nt, Artificial Sequence
  MKO10071261_B_Alkbh1
  gRNA
ccuuacugucccaguuauaa

SEQ ID NO: 71262 - RNA, 20 nt, Artificial Sequence
  MKO10071262_B_Alkbh1
  gRNA
guuuacuagagagacugcgu

SEQ ID NO: 71263 - RNA, 20 nt, Artificial Sequence
  MKO10071263_B_Alkbh2
  gRNA
uguucgagaucgagucugcg

SEQ ID NO: 71264 - RNA, 20 nt, Artificial Sequence
  MKO10071264_B_Alkbh2
  gRNA
caucucugugcucgccgaug

SEQ ID NO: 71265 - RNA, 20 nt, Artificial Sequence
  MKO10071265_B_Alkbh2
  gRNA
gaccagaaaacguguacgug

SEQ ID NO: 71266 - RNA, 20 nt, Artificial Sequence
  MKO10071266_B_Alkbh3
  gRNA
gccccgcggucugggaaaga

SEQ ID NO: 71267 - RNA, 20 nt, Artificial Sequence
  MKO10071267_B_Alkbh3
  gRNA
acuuaccuagacacaccagu

SEQ ID NO: 71268 - RNA, 20 nt, Artificial Sequence
  MKO10071268_B_Alkbh3
  gRNA
agcuuuguaaggaugucccc

SEQ ID NO: 71269 - RNA, 20 nt, Artificial Sequence
  MKO10071269_B_Alkbh4
  gRNA
cccuggaagcucucacaguc

SEQ ID NO: 71270 - RNA, 20 nt, Artificial Sequence
  MKO10071270_B_Alkbh4
  gRNA
guguguccacuggugccucg

SEQ ID NO: 71271 - RNA, 20 nt, Artificial Sequence
  MKO10071271_B_Alkbh4
  gRNA
cuccgccaucgacccccacu

SEQ ID NO: 71272 - RNA, 20 nt, Artificial Sequence
  MKO10071272_B_Alkbh5
  gRNA
uaugcuucagaucgccuguc

SEQ ID NO: 71273 - RNA, 20 nt, Artificial Sequence
  MKO10071273_B_Alkbh5
  gRNA
cucaggacauuaaggaacgc

SEQ ID NO: 71274 - RNA, 20 nt, Artificial Sequence
  MKO10071274_B_Alkbh5
  gRNA
gcaaucuuccgaggacucau

SEQ ID NO: 71275 - RNA, 20 nt, Artificial Sequence
  MKO10071275_B_Alkbh6
  gRNA
uccacguagcguugaagcca

SEQ ID NO: 71276 - RNA, 20 nt, Artificial Sequence
  MKO10071276_B_Alkbh6
  gRNA
gccagacgaugaugucccua

SEQ ID NO: 71277 - RNA, 20 nt, Artificial Sequence
  MKO10071277_B_Alkbh6
  gRNA
gaagcuuccucccagacagc

SEQ ID NO: 71278 - RNA, 20 nt, Artificial Sequence
  MKO10071278_B_Alkbh7
  gRNA
cauccugcagcggguucggg

SEQ ID NO: 71279 - RNA, 20 nt, Artificial Sequence
  MKO10071279_B_Alkbh7
  gRNA
cagccgcccgaacccgcugc

SEQ ID NO: 71280 - RNA, 20 nt, Artificial Sequence
  MKO10071280_B_Alkbh7
  gRNA
ugcaccagcuucauaacacu

SEQ ID NO: 71281 - RNA, 20 nt, Artificial Sequence
  MKO10071281_B_Alkbh8
  gRNA
accgacuuuaggucuuccug

SEQ ID NO: 71282 - RNA, 20 nt, Artificial Sequence
  MKO10071282_B_Alkbh8
  gRNA
accauaaaucaauaugaacc

SEQ ID NO: 71283 - RNA, 20 nt, Artificial Sequence
  MKO10071283_B_Alkbh8
  gRNA
ucacuaugagagcaacacug

SEQ ID NO: 71284 - RNA, 20 nt, Artificial Sequence
  MKO10071284_B_Alk
  gRNA
cuccuaccccacaacgaagc

SEQ ID NO: 71285 - RNA, 20 nt, Artificial Sequence
  MKO10071285_B_Alk
  gRNA
aauccaccgccgacaagcuc

SEQ ID NO: 71286 - RNA, 20 nt, Artificial Sequence
  MKO10071286_B_Alk
  gRNA
cucggagggcacauggcgcc

SEQ ID NO: 71287 - RNA, 20 nt, Artificial Sequence
  MKO10071287_B_Allc
  gRNA
gcagcgaaccugagugaaga

SEQ ID NO: 71288 - RNA, 20 nt, Artificial Sequence
  MKO10071288_B_Allc
  gRNA
gggaacugcagcgacgccug

SEQ ID NO: 71289 - RNA, 20 nt, Artificial Sequence
  MKO10071289_B_Allc
  gRNA
guaacggcuucaaacuccuc

SEQ ID NO: 71290 - RNA, 20 nt, Artificial Sequence
  MKO10071290_B_Alms1
  gRNA
aaucaggcucaaccucuucu

SEQ ID NO: 71291 - RNA, 20 nt, Artificial Sequence
  MKO10071291_B_Alms1
  gRNA
augaugacugcugccauaca

SEQ ID NO: 71292 - RNA, 20 nt, Artificial Sequence
  MKO10071292_B_Alms1
  gRNA
aacuagaauuugcaccuuug

SEQ ID NO: 71293 - RNA, 20 nt, Artificial Sequence
  MKO10071293_B_Alox12b
  gRNA
gaaggaggcugucuugacga

SEQ ID NO: 71294 - RNA, 20 nt, Artificial Sequence
  MKO10071294_B_Alox12b
  gRNA
guuaccauccuccuccccga

SEQ ID NO: 71295 - RNA, 20 nt, Artificial Sequence
  MKO10071295_B_Alox12b
  gRNA
cgacacacucccuauccuuu

SEQ ID NO: 71296 - RNA, 20 nt, Artificial Sequence
  MKO10071296_B_Alox12e
  gRNA
gagugucaucaguuaccuuc

SEQ ID NO: 71297 - RNA, 20 nt, Artificial Sequence
  MKO10071297_B_Alox12e
  gRNA
ggauuaauccugccuauagc

SEQ ID NO: 71298 - RNA, 20 nt, Artificial Sequence
  MKO10071298_B_Alox12e
  gRNA
gcucucgauacuuccuaaac

SEQ ID NO: 71299 - RNA, 20 nt, Artificial Sequence
  MKO10071299_B_Alox12
  gRNA
gaccggccaaggcacucuuc

SEQ ID NO: 71300 - RNA, 20 nt, Artificial Sequence
  MKO10071300_B_Alox12
  gRNA
ccguguuucccugcuaccgc

SEQ ID NO: 71301 - RNA, 20 nt, Artificial Sequence
  MKO10071301_B_Alox12
  gRNA
cuuccagaaguaucgagaaa

SEQ ID NO: 71302 - RNA, 20 nt, Artificial Sequence
  MKO10071302_B_Alox15
  gRNA
ucggcuucuaggcugcaccg

SEQ ID NO: 71303 - RNA, 20 nt, Artificial Sequence
  MKO10071303_B_Alox15
  gRNA
gguguacuuaccagccaucu

SEQ ID NO: 71304 - RNA, 20 nt, Artificial Sequence
  MKO10071304_B_Alox15
  gRNA
gccuugagagucuucaacca

SEQ ID NO: 71305 - RNA, 20 nt, Artificial Sequence
  MKO10071305_B_Alox5ap
  gRNA
uuagucccugccgccuucgc

SEQ ID NO: 71306 - RNA, 20 nt, Artificial Sequence
  MKO10071306_B_Alox5ap
  gRNA
augguugaguaucccggcga

SEQ ID NO: 71307 - RNA, 20 nt, Artificial Sequence
  MKO10071307_B_Alox5ap
  gRNA
cgcuugccgaagauguagcc

SEQ ID NO: 71308 - RNA, 20 nt, Artificial Sequence
  MKO10071308_B_Alox5
  gRNA
ggaacucgauguaguccccg

SEQ ID NO: 71309 - RNA, 20 nt, Artificial Sequence
  MKO10071309_B_Alox5
  gRNA
uaucucggggcagauccuug

SEQ ID NO: 71310 - RNA, 20 nt, Artificial Sequence
  MKO10071310_B_Alox5
  gRNA
cuuuacgucugugcugcuug

SEQ ID NO: 71311 - RNA, 20 nt, Artificial Sequence
  MKO10071311_B_Alox8
  gRNA
ccaagucuuucacagucucg

SEQ ID NO: 71312 - RNA, 20 nt, Artificial Sequence
  MKO10071312_B_Alox8
  gRNA
uuccgcaagacuccagcagc

SEQ ID NO: 71313 - RNA, 20 nt, Artificial Sequence
  MKO10071313_B_Alox8
  gRNA
cacccgcagcaaaggugucc

SEQ ID NO: 71314 - RNA, 20 nt, Artificial Sequence
  MKO10071314_B_Aloxe3
  gRNA
gcucucaccgauaacauucu

SEQ ID NO: 71315 - RNA, 20 nt, Artificial Sequence
  MKO10071315_B_Aloxe3
  gRNA
agcuggaagaucuucgcccc

SEQ ID NO: 71316 - RNA, 20 nt, Artificial Sequence
  MKO10071316_B_Aloxe3
  gRNA
cugcugacauccaccauccg

SEQ ID NO: 71317 - RNA, 20 nt, Artificial Sequence
  MKO10071317_B_Alpi
  gRNA
cugcaucugaguaccaauua

SEQ ID NO: 71318 - RNA, 20 nt, Artificial Sequence
  MKO10071318_B_Alpi
  gRNA
ggccuuccaacugccccuuu

SEQ ID NO: 71319 - RNA, 20 nt, Artificial Sequence
  MKO10071319_B_Alpi
  gRNA
caccaaccuaccugcuuucu

SEQ ID NO: 71320 - RNA, 20 nt, Artificial Sequence
  MKO10071320_B_Alpk1
  gRNA
aucaggguccuuaacucgcu

SEQ ID NO: 71321 - RNA, 20 nt, Artificial Sequence
  MKO10071321_B_Alpk1
  gRNA
cuucacuccccagcgaguua

SEQ ID NO: 71322 - RNA, 20 nt, Artificial Sequence
  MKO10071322_B_Alpk1
  gRNA
uugcuccguuguugcuuauc

SEQ ID NO: 71323 - RNA, 20 nt, Artificial Sequence
  MKO10071323_B_Alpk2
  gRNA
cgcaguuucuugccgagacc

SEQ ID NO: 71324 - RNA, 20 nt, Artificial Sequence
  MKO10071324_B_Alpk2
  gRNA
agauuccaagucgauagccc

SEQ ID NO: 71325 - RNA, 20 nt, Artificial Sequence
  MKO10071325_B_Alpk2
  gRNA
augaagacucuaccgucugc

SEQ ID NO: 71326 - RNA, 20 nt, Artificial Sequence
  MKO10071326_B_Alpk3
  gRNA
uguccgaagacagugacguc

SEQ ID NO: 71327 - RNA, 20 nt, Artificial Sequence
  MKO10071327_B_Alpk3
  gRNA
aaauacgagaucacucauca

SEQ ID NO: 71328 - RNA, 20 nt, Artificial Sequence
  MKO10071328_B_Alpk3
  gRNA
cacggcacgggacuugagug

SEQ ID NO: 71329 - RNA, 20 nt, Artificial Sequence
  MKO10071329_B_Alpl
  gRNA
gcuacaccacaacacgggcg

SEQ ID NO: 71330 - RNA, 20 nt, Artificial Sequence
  MKO10071330_B_Alpl
  gRNA
cgagugugcguaggcugcac

SEQ ID NO: 71331 - RNA, 20 nt, Artificial Sequence
  MKO10071331_B_Alpl
  gRNA
cacgcgaugcaacaccacuc

SEQ ID NO: 71332 - RNA, 20 nt, Artificial Sequence
  MKO10071332_B_Alppl2
  gRNA
aaugccugccucagcgcuac

SEQ ID NO: 71333 - RNA, 20 nt, Artificial Sequence
  MKO10071333_B_Alppl2
  gRNA
ucaaccagugcaacacgaca

SEQ ID NO: 71334 - RNA, 20 nt, Artificial Sequence
  MKO10071334_B_Alppl2
  gRNA
uaagaaccucguuauccuca

SEQ ID NO: 71335 - RNA, 20 nt, Artificial Sequence
  MKO10071335_B_Als2cl
  gRNA
gcugccucagcgccuugcgc

SEQ ID NO: 71336 - RNA, 20 nt, Artificial Sequence
  MKO10071336_B_Als2cl
  gRNA
ugugggcaccacgaugugcc

SEQ ID NO: 71337 - RNA, 20 nt, Artificial Sequence
  MKO10071337_B_Als2cl
  gRNA
cugucacauaccacaaccgc

SEQ ID NO: 71338 - RNA, 20 nt, Artificial Sequence
  MKO10071338_B_Als2cr11
  gRNA
ucucgccaaaccuaaguaca

SEQ ID NO: 71339 - RNA, 20 nt, Artificial Sequence
  MKO10071339_B_Als2cr11
  gRNA
ugaacagauuaaaacgcugu

SEQ ID NO: 71340 - RNA, 20 nt, Artificial Sequence
  MKO10071340_B_Als2cr11
  gRNA
auacauaccacgucuccaaa

SEQ ID NO: 71341 - RNA, 20 nt, Artificial Sequence
  MKO10071341_B_Als2cr12
  gRNA
agaacagauaucagucaccu

SEQ ID NO: 71342 - RNA, 20 nt, Artificial Sequence
  MKO10071342_B_Als2cr12
  gRNA
acucagcaauuugcuccuga

SEQ ID NO: 71343 - RNA, 20 nt, Artificial Sequence
  MKO10071343_B_Als2cr12
  gRNA
ugcucucuguguuuccugac

SEQ ID NO: 71344 - RNA, 20 nt, Artificial Sequence
  MKO10071344_B_Als2
  gRNA
cgacugagcugccgucucgc

SEQ ID NO: 71345 - RNA, 20 nt, Artificial Sequence
  MKO10071345_B_Als2
  gRNA
cgcagccuuccuuaagagcc

SEQ ID NO: 71346 - RNA, 20 nt, Artificial Sequence
  MKO10071346_B_Als2
  gRNA
aaagaggccuaguccauguc

SEQ ID NO: 71347 - RNA, 20 nt, Artificial Sequence
  MKO10071347_B_Alx1
  gRNA
uaagacugauaugucguacg

SEQ ID NO: 71348 - RNA, 20 nt, Artificial Sequence
  MKO10071348_B_Alx1
  gRNA
augcaggaggacgcgucacg

SEQ ID NO: 71349 - RNA, 20 nt, Artificial Sequence
  MKO10071349_B_Alx1
  gRNA
cucaggaugucucccgugaa

SEQ ID NO: 71350 - RNA, 20 nt, Artificial Sequence
  MKO10071350_B_Alx3
  gRNA
ugcucccgagcauacacguc

SEQ ID NO: 71351 - RNA, 20 nt, Artificial Sequence
  MKO10071351_B_Alx3
  gRNA
ggggacuuguagucaccauc

SEQ ID NO: 71352 - RNA, 20 nt, Artificial Sequence
  MKO10071352_B_Alx3
  gRNA
acgcucacgcuuccgccacu

SEQ ID NO: 71353 - RNA, 20 nt, Artificial Sequence
  MKO10071353_B_Alx4
  gRNA
uggcgaaagagggagcgcuu

SEQ ID NO: 71354 - RNA, 20 nt, Artificial Sequence
  MKO10071354_B_Alx4
  gRNA
uaugaggaccgaccucaccg

SEQ ID NO: 71355 - RNA, 20 nt, Artificial Sequence
  MKO10071355_B_Alx4
  gRNA
gaggggcaacucauaggccg

SEQ ID NO: 71356 - RNA, 20 nt, Artificial Sequence
  MKO10071356_B_Alyref2
  gRNA
cccuuuggauggccgcccua

SEQ ID NO: 71357 - RNA, 20 nt, Artificial Sequence
  MKO10071357_B_Alyref2
  gRNA
ugaaucgaggcggcgggccu

SEQ ID NO: 71358 - RNA, 20 nt, Artificial Sequence
  MKO10071358_B_Alyref2
  gRNA
aacguugaaaaaagccgcug

SEQ ID NO: 71359 - RNA, 20 nt, Artificial Sequence
  MKO10071359_B_Alyref
  gRNA
gaagagguagaggcaccggc

SEQ ID NO: 71360 - RNA, 20 nt, Artificial Sequence
  MKO10071360_B_Alyref
  gRNA
caaucugugaugugacaagc

SEQ ID NO: 71361 - RNA, 20 nt, Artificial Sequence
  MKO10071361_B_Alyref
  gRNA
augacaagaaaccguggcuc

SEQ ID NO: 71362 - RNA, 20 nt, Artificial Sequence
  MKO10071362_B_Amacr
  gRNA
cuccccgucugccgucuugu

SEQ ID NO: 71363 - RNA, 20 nt, Artificial Sequence
  MKO10071363_B_Amacr
  gRNA
cuuuggagaaaauucccgau

SEQ ID NO: 71364 - RNA, 20 nt, Artificial Sequence
  MKO10071364_B_Amacr
  gRNA
caucugucccgucaaagauc

SEQ ID NO: 71365 - RNA, 20 nt, Artificial Sequence
  MKO10071365_B_Ambn
  gRNA
cauggcuaguuugagccuug

SEQ ID NO: 71366 - RNA, 20 nt, Artificial Sequence
  MKO10071366_B_Ambn
  gRNA
gaaaagcacuuaauaguuua

SEQ ID NO: 71367 - RNA, 20 nt, Artificial Sequence
  MKO10071367_B_Ambn
  gRNA
cucugucaguauucuagacu

SEQ ID NO: 71368 - RNA, 20 nt, Artificial Sequence
  MKO10071368_B_Ambp
  gRNA
uuccaucgauguccgucuuc

SEQ ID NO: 71369 - RNA, 20 nt, Artificial Sequence
  MKO10071369_B_Ambp
  gRNA
cagugauggugagcccgugg

SEQ ID NO: 71370 - RNA, 20 nt, Artificial Sequence
  MKO10071370_B_Ambp
  gRNA
cauauucgucauaguuggug

SEQ ID NO: 71371 - RNA, 20 nt, Artificial Sequence
  MKO10071371_B_Ambra1
  gRNA
agaaugcuguacgaauccuc

SEQ ID NO: 71372 - RNA, 20 nt, Artificial Sequence
  MKO10071372_B_Ambra1
  gRNA
aaggucgagcguggacuauc

SEQ ID NO: 71373 - RNA, 20 nt, Artificial Sequence
  MKO10071373_B_Ambra1
  gRNA
ccagugagauggagcguguc

SEQ ID NO: 71374 - RNA, 20 nt, Artificial Sequence
  MKO10071374_B_Amd1
  gRNA
aaucccuagcaagcuucaac

SEQ ID NO: 71375 - RNA, 20 nt, Artificial Sequence
  MKO10071375_B_Amd1
  gRNA
cacccucuuacugaaagcac

SEQ ID NO: 71376 - RNA, 20 nt, Artificial Sequence
  MKO10071376_B_Amd1
  gRNA
uucaugaagccuucucacca

SEQ ID NO: 71377 - RNA, 20 nt, Artificial Sequence
  MKO10071377_B_Amd2
  gRNA
guacccacaccggaauuucc

SEQ ID NO: 71378 - RNA, 20 nt, Artificial Sequence
  MKO10071378_B_Amd2
  gRNA
caccaucuuucauguagaac

SEQ ID NO: 71379 - RNA, 20 nt, Artificial Sequence
  MKO10071379_B_Amd2
  gRNA
agaauuuccaguguuugauc

SEQ ID NO: 71380 - RNA, 20 nt, Artificial Sequence
  MKO10071380_B_Amdhd1
  gRNA
cauaccucggcagccuucau

SEQ ID NO: 71381 - RNA, 20 nt, Artificial Sequence
  MKO10071381_B_Amdhd1
  gRNA
aguccacgaguuugcaauga

SEQ ID NO: 71382 - RNA, 20 nt, Artificial Sequence
  MKO10071382_B_Amdhd1
  gRNA
uuaccuucauugcaaacucg

SEQ ID NO: 71383 - RNA, 20 nt, Artificial Sequence
  MKO10071383_B_Amdhd2
  gRNA
aucugcacaucgauaaagcc

SEQ ID NO: 71384 - RNA, 20 nt, Artificial Sequence
  MKO10071384_B_Amdhd2
  gRNA
ucacaaugcagacguugucc

SEQ ID NO: 71385 - RNA, 20 nt, Artificial Sequence
  MKO10071385_B_Amdhd2
  gRNA
uuuaucgaugugcagaucaa

SEQ ID NO: 71386 - RNA, 20 nt, Artificial Sequence
  MKO10071386_B_Amelx
  gRNA
uggccaggaacuggcaucau

SEQ ID NO: 71387 - RNA, 20 nt, Artificial Sequence
  MKO10071387_B_Amelx
  gRNA
uuauaucaacuuaagcuaug

SEQ ID NO: 71388 - RNA, 20 nt, Artificial Sequence
  MKO10071388_B_Amelx
  gRNA
gcauagcaaaagcugcuccc

SEQ ID NO: 71389 - RNA, 20 nt, Artificial Sequence
  MKO10071389_B_Amer1
  gRNA
gaccaagcgaaguuccugcu

SEQ ID NO: 71390 - RNA, 20 nt, Artificial Sequence
  MKO10071390_B_Amer1
  gRNA
gccuaucuccaacgcuccau

SEQ ID NO: 71391 - RNA, 20 nt, Artificial Sequence
  MKO10071391_B_Amer1
  gRNA
gaaggguucaggccgcaccc

SEQ ID NO: 71392 - RNA, 20 nt, Artificial Sequence
  MKO10071392_B_Amer2
  gRNA
ugccaccuucggagucgaca

SEQ ID NO: 71393 - RNA, 20 nt, Artificial Sequence
  MKO10071393_B_Amer2
  gRNA
ccggagggacaagcgcggca

SEQ ID NO: 71394 - RNA, 20 nt, Artificial Sequence
  MKO10071394_B_Amer2
  gRNA
cucgcauugugagugcgccg

SEQ ID NO: 71395 - RNA, 20 nt, Artificial Sequence
  MKO10071395_B_Amer3
  gRNA
ggucauagaauaguucguag

SEQ ID NO: 71396 - RNA, 20 nt, Artificial Sequence
  MKO10071396_B_Amer3
  gRNA
ggucacacagccuacgagca

SEQ ID NO: 71397 - RNA, 20 nt, Artificial Sequence
  MKO10071397_B_Amer3
  gRNA
ccggccguauccuugggaac

SEQ ID NO: 71398 - RNA, 20 nt, Artificial Sequence
  MKO10071398_B_Amfr
  gRNA
cacacauggcaugcacaccu

SEQ ID NO: 71399 - RNA, 20 nt, Artificial Sequence
  MKO10071399_B_Amfr
  gRNA
agagcugaaccaucagaugc

SEQ ID NO: 71400 - RNA, 20 nt, Artificial Sequence
  MKO10071400_B_Amfr
  gRNA
cuuauccaguguauuguguu

SEQ ID NO: 71401 - RNA, 20 nt, Artificial Sequence
  MKO10071401_B_Amhr2
  gRNA
guagaggcagcggauacccu

SEQ ID NO: 71402 - RNA, 20 nt, Artificial Sequence
  MKO10071402_B_Amhr2
  gRNA
caccugggagaaacgcagcu

SEQ ID NO: 71403 - RNA, 20 nt, Artificial Sequence
  MKO10071403_B_Amhr2
  gRNA
ggacuucaguauccccaaac

SEQ ID NO: 71404 - RNA, 20 nt, Artificial Sequence
  MKO10071404_B_Amh
  gRNA
gagucauccgcgugaaacag

SEQ ID NO: 71405 - RNA, 20 nt, Artificial Sequence
  MKO10071405_B_Amh
  gRNA
ccgcuauuuggugcuaaccg

SEQ ID NO: 71406 - RNA, 20 nt, Artificial Sequence
  MKO10071406_B_Amh
  gRNA
cugauucccgcuguuucacg

SEQ ID NO: 71407 - RNA, 20 nt, Artificial Sequence
  MKO10071407_B_Amica1
  gRNA
uaugacuccaacaugcguag

SEQ ID NO: 71408 - RNA, 20 nt, Artificial Sequence
  MKO10071408_B_Amica1
  gRNA
cgcaaccguguagaccugac

SEQ ID NO: 71409 - RNA, 20 nt, Artificial Sequence
  MKO10071409_B_Amica1
  gRNA
ccagaucucagaguccgagu

SEQ ID NO: 71410 - RNA, 20 nt, Artificial Sequence
  MKO10071410_B_Amigo1
  gRNA
agccagggccggccgaucug

SEQ ID NO: 71411 - RNA, 20 nt, Artificial Sequence
  MKO10071411_B_Amigo1
  gRNA
cugccggugcccgaagcuac

SEQ ID NO: 71412 - RNA, 20 nt, Artificial Sequence
  MKO10071412_B_Amigo1
  gRNA
aagaccgagcugaccgacuc

SEQ ID NO: 71413 - RNA, 20 nt, Artificial Sequence
  MKO10071413_B_Amigo2
  gRNA
aggcgaccauaaugucguua

SEQ ID NO: 71414 - RNA, 20 nt, Artificial Sequence
  MKO10071414_B_Amigo2
  gRNA
auucuuguaucgcaaugaac

SEQ ID NO: 71415 - RNA, 20 nt, Artificial Sequence
  MKO10071415_B_Amigo2
  gRNA
cagugagaccguuauagccg

SEQ ID NO: 71416 - RNA, 20 nt, Artificial Sequence
  MKO10071416_B_Amigo3
  gRNA
ugaagagcagcugcacgcgc

SEQ ID NO: 71417 - RNA, 20 nt, Artificial Sequence
  MKO10071417_B_Amigo3
  gRNA
cgcacucaaacgccugcacc

SEQ ID NO: 71418 - RNA, 20 nt, Artificial Sequence
  MKO10071418_B_Amigo3
  gRNA
gcgcuaaccaccccgggugc

SEQ ID NO: 71419 - RNA, 20 nt, Artificial Sequence
  MKO10071419_B_Ammecr1l
  gRNA
ucagggaauacacauuaacc

SEQ ID NO: 71420 - RNA, 20 nt, Artificial Sequence
  MKO10071420_B_Ammecr1l
  gRNA
uuucuguagguaggggucca

SEQ ID NO: 71421 - RNA, 20 nt, Artificial Sequence
  MKO10071421_B_Ammecr1l
  gRNA
ugaauucaauccgaauucca

SEQ ID NO: 71422 - RNA, 20 nt, Artificial Sequence
  MKO10071422_B_Ammecr1
  gRNA
ugaagauguuugcgacuauu

SEQ ID NO: 71423 - RNA, 20 nt, Artificial Sequence
  MKO10071423_B_Ammecr1
  gRNA
acagcccacuguuuguaaca

SEQ ID NO: 71424 - RNA, 20 nt, Artificial Sequence
  MKO10071424_B_Ammecr1
  gRNA
ccaguaccuggucagcuuua

SEQ ID NO: 71425 - RNA, 20 nt, Artificial Sequence
  MKO10071425_B_Amn1
  gRNA
caaaauuaccucuaauuguu

SEQ ID NO: 71426 - RNA, 20 nt, Artificial Sequence
  MKO10071426_B_Amn1
  gRNA
agaaauagcauaacuucaga

SEQ ID NO: 71427 - RNA, 20 nt, Artificial Sequence
  MKO10071427_B_Amn1
  gRNA
uuuguuuagguaucugacaa

SEQ ID NO: 71428 - RNA, 20 nt, Artificial Sequence
  MKO10071428_B_Amn
  gRNA
gagccuuaccauauccgaga

SEQ ID NO: 71429 - RNA, 20 nt, Artificial Sequence
  MKO10071429_B_Amn
  gRNA
ccagaaccggaccccgugcg

SEQ ID NO: 71430 - RNA, 20 nt, Artificial Sequence
  MKO10071430_B_Amn
  gRNA
gcugcagauggugucggucc

SEQ ID NO: 71431 - RNA, 20 nt, Artificial Sequence
  MKO10071431_B_Amotl1
  gRNA
gcaaugagaaccaagcucga

SEQ ID NO: 71432 - RNA, 20 nt, Artificial Sequence
  MKO10071432_B_Amotl1
  gRNA
ggacuugaccaggcucucgu

SEQ ID NO: 71433 - RNA, 20 nt, Artificial Sequence
  MKO10071433_B_Amotl1
  gRNA
cuuaugcgccuguccacugu

SEQ ID NO: 71434 - RNA, 20 nt, Artificial Sequence
  MKO10071434_B_Amotl2
  gRNA
cuucuccagggccucacgcu

SEQ ID NO: 71435 - RNA, 20 nt, Artificial Sequence
  MKO10071435_B_Amotl2
  gRNA
cccucaguacagucuccauc

SEQ ID NO: 71436 - RNA, 20 nt, Artificial Sequence
  MKO10071436_B_Amotl2
  gRNA
gaaggcuggccgcauagaaa

SEQ ID NO: 71437 - RNA, 20 nt, Artificial Sequence
  MKO10071437_B_Amot
  gRNA
cauaagccucugagacccgu

SEQ ID NO: 71438 - RNA, 20 nt, Artificial Sequence
  MKO10071438_B_Amot
  gRNA
acacauugaaauccgagacc

SEQ ID NO: 71439 - RNA, 20 nt, Artificial Sequence
  MKO10071439_B_Amot
  gRNA
auugagcaaugcccaggcga

SEQ ID NO: 71440 - RNA, 20 nt, Artificial Sequence
  MKO10071440_B_Ampd1
  gRNA
aauuaacagucuuccguccu

SEQ ID NO: 71441 - RNA, 20 nt, Artificial Sequence
  MKO10071441_B_Ampd1
  gRNA
agacccccuccaaguacuug

SEQ ID NO: 71442 - RNA, 20 nt, Artificial Sequence
  MKO10071442_B_Ampd1
  gRNA
gguaaccguugaagacuuug

SEQ ID NO: 71443 - RNA, 20 nt, Artificial Sequence
  MKO10071443_B_Ampd2
  gRNA
uuggcucgaagaagaauauc

SEQ ID NO: 71444 - RNA, 20 nt, Artificial Sequence
  MKO10071444_B_Ampd2
  gRNA
ccguucuucuagcugcucga

SEQ ID NO: 71445 - RNA, 20 nt, Artificial Sequence
  MKO10071445_B_Ampd2
  gRNA
uuucagcgggucaucaucuc

SEQ ID NO: 71446 - RNA, 20 nt, Artificial Sequence
  MKO10071446_B_Ampd3
  gRNA
auuccagaaaguucagucgc

SEQ ID NO: 71447 - RNA, 20 nt, Artificial Sequence
  MKO10071447_B_Ampd3
  gRNA
cacuuucccccugaugagcc

SEQ ID NO: 71448 - RNA, 20 nt, Artificial Sequence
  MKO10071448_B_Ampd3
  gRNA
cugauacucaggcauagcau

SEQ ID NO: 71449 - RNA, 20 nt, Artificial Sequence
  MKO10071449_B_Amph
  gRNA
ggauauuuagcagcaaucaa

SEQ ID NO: 71450 - RNA, 20 nt, Artificial Sequence
  MKO10071450_B_Amph
  gRNA
ugauugcugcuaaauauccc

SEQ ID NO: 71451 - RNA, 20 nt, Artificial Sequence
  MKO10071451_B_Amph
  gRNA
agacuuccaucaaaagcuag

SEQ ID NO: 71452 - RNA, 20 nt, Artificial Sequence
  MKO10071452_B_Amtn
  gRNA
guugcaggaacucccgaagc

SEQ ID NO: 71453 - RNA, 20 nt, Artificial Sequence
  MKO10071453_B_Amtn
  gRNA
ccugcaacaaaaccgacucc

SEQ ID NO: 71454 - RNA, 20 nt, Artificial Sequence
  MKO10071454_B_Amtn
  gRNA
ucagauguuacccauuauug

SEQ ID NO: 71455 - RNA, 20 nt, Artificial Sequence
  MKO10071455_B_Amt
  gRNA
ggaaaaaugguggcguuugc

SEQ ID NO: 71456 - RNA, 20 nt, Artificial Sequence
  MKO10071456_B_Amt
  gRNA
ccaccuccaggccuacaucc

SEQ ID NO: 71457 - RNA, 20 nt, Artificial Sequence
  MKO10071457_B_Amt
  gRNA
ucucaccuugcagagcuaac

SEQ ID NO: 71458 - RNA, 20 nt, Artificial Sequence
  MKO10071458_B_Amy1
  gRNA
ucucuacuaggugauugauc

SEQ ID NO: 71459 - RNA, 20 nt, Artificial Sequence
  MKO10071459_B_Amy1
  gRNA
uccacagcccuucaagacca

SEQ ID NO: 71460 - RNA, 20 nt, Artificial Sequence
  MKO10071460_B_Amy1
  gRNA
gaaagauuauguucgaacca

SEQ ID NO: 71461 - RNA, 20 nt, Artificial Sequence
  MKO10071461_B_Amy2a2
  gRNA
uuaaagucccaagcagagua

SEQ ID NO: 71462 - RNA, 20 nt, Artificial Sequence
  MKO10071462_B_Amy2a2
  gRNA
gucagaaauugucgucugac

SEQ ID NO: 71463 - RNA, 20 nt, Artificial Sequence
  MKO10071463_B_Amy2a2
  gRNA
ucuaccucuuggaaaaugaa

SEQ ID NO: 71464 - RNA, 20 nt, Artificial Sequence
  MKO10071464_B_Amy2a3
  gRNA
uuaaagucccaagcagagua

SEQ ID NO: 71465 - RNA, 20 nt, Artificial Sequence
  MKO10071465_B_Amy2a3
  gRNA
gucagaaauugucgucugac

SEQ ID NO: 71466 - RNA, 20 nt, Artificial Sequence
  MKO10071466_B_Amy2a3
  gRNA
ucuaccucuuggaaaaugaa

SEQ ID NO: 71467 - RNA, 20 nt, Artificial Sequence
  MKO10071467_B_Amy2a4
  gRNA
uuaaagucccaagcagagua

SEQ ID NO: 71468 - RNA, 20 nt, Artificial Sequence
  MKO10071468_B_Amy2a4
  gRNA
gucagaaauugucgucugac

SEQ ID NO: 71469 - RNA, 20 nt, Artificial Sequence
  MKO10071469_B_Amy2a4
  gRNA
ucuaccucuuggaaaaugaa

SEQ ID NO: 71470 - RNA, 20 nt, Artificial Sequence
  MKO10071470_B_Amy2a5
  gRNA
uuaaagucccaagcagagua

SEQ ID NO: 71471 - RNA, 20 nt, Artificial Sequence
  MKO10071471_B_Amy2a5
  gRNA
gucagaaauugucgucugac

SEQ ID NO: 71472 - RNA, 20 nt, Artificial Sequence
  MKO10071472_B_Amy2a5
  gRNA
ucuaccucuuggaaaaugaa

SEQ ID NO: 71473 - RNA, 20 nt, Artificial Sequence
  MKO10071473_B_Amy2b
  gRNA
ucucuccuagguuauugauc

SEQ ID NO: 71474 - RNA, 20 nt, Artificial Sequence
  MKO10071474_B_Amy2b
  gRNA
guucugcugcuuucccucau

SEQ ID NO: 71475 - RNA, 20 nt, Artificial Sequence
  MKO10071475_B_Amy2b
  gRNA
ugcaccccuccaaaucccuu

SEQ ID NO: 71476 - RNA, 20 nt, Artificial Sequence
  MKO10071476_B_Amz1
  gRNA
uguagcuucgcucgcuucuc

SEQ ID NO: 71477 - RNA, 20 nt, Artificial Sequence
  MKO10071477_B_Amz1
  gRNA
gagacgcugccucgugagcg

SEQ ID NO: 71478 - RNA, 20 nt, Artificial Sequence
  MKO10071478_B_Amz1
  gRNA
ccccggaagaaaucugccga

SEQ ID NO: 71479 - RNA, 20 nt, Artificial Sequence
  MKO10071479_B_Amz2
  gRNA
caaugaucgaucucuacccu

SEQ ID NO: 71480 - RNA, 20 nt, Artificial Sequence
  MKO10071480_B_Amz2
  gRNA
cucggcagaugcagguacua

SEQ ID NO: 71481 - RNA, 20 nt, Artificial Sequence
  MKO10071481_B_Amz2
  gRNA
acuugccuguguggauuugc

SEQ ID NO: 71482 - RNA, 20 nt, Artificial Sequence
  MKO10071482_B_Anapc10
  gRNA
acuuagugaacauccaauuc

SEQ ID NO: 71483 - RNA, 20 nt, Artificial Sequence
  MKO10071483_B_Anapc10
  gRNA
uucuuaucagcaacuugaau

SEQ ID NO: 71484 - RNA, 20 nt, Artificial Sequence
  MKO10071484_B_Anapc10
  gRNA
cugauccuaagcaguuggag

SEQ ID NO: 71485 - RNA, 20 nt, Artificial Sequence
  MKO10071485_B_Anapc11
  gRNA
aucugcaggauggcguuuaa

SEQ ID NO: 71486 - RNA, 20 nt, Artificial Sequence
  MKO10071486_B_Anapc11
  gRNA
acaugcacugcauccucaag

SEQ ID NO: 71487 - RNA, 20 nt, Artificial Sequence
  MKO10071487_B_Anapc11
  gRNA
gcugcgcauucagccacuug

SEQ ID NO: 71488 - RNA, 20 nt, Artificial Sequence
  MKO10071488_B_Anapc13
  gRNA
cccgccaagcaucaucaauc

SEQ ID NO: 71489 - RNA, 20 nt, Artificial Sequence
  MKO10071489_B_Anapc13
  gRNA
guucucguggaggcccugua

SEQ ID NO: 71490 - RNA, 20 nt, Artificial Sequence
  MKO10071490_B_Anapc13
  gRNA
ccguugucuugcucgggcuc

SEQ ID NO: 71491 - RNA, 20 nt, Artificial Sequence
  MKO10071491_B_Anapc15
  gRNA
cucgugugacugagacacug

SEQ ID NO: 71492 - RNA, 20 nt, Artificial Sequence
  MKO10071492_B_Anapc15
  gRNA
ccucuucagguggacaugga

SEQ ID NO: 71493 - RNA, 20 nt, Artificial Sequence
  MKO10071493_B_Anapc15
  gRNA
cacagugucucagucacacg

SEQ ID NO: 71494 - RNA, 20 nt, Artificial Sequence
  MKO10071494_B_Anapc16
  gRNA
aguggcauccacgcuuaaac

SEQ ID NO: 71495 - RNA, 20 nt, Artificial Sequence
  MKO10071495_B_Anapc16
  gRNA
uaaacccaucgagcagcugc

SEQ ID NO: 71496 - RNA, 20 nt, Artificial Sequence
  MKO10071496_B_Anapc16
  gRNA
accagcugaagacgaagacg

SEQ ID NO: 71497 - RNA, 20 nt, Artificial Sequence
  MKO10071497_B_Anapc1
  gRNA
cuacgaugaagagcucuaug

SEQ ID NO: 71498 - RNA, 20 nt, Artificial Sequence
  MKO10071498_B_Anapc1
  gRNA
augaacaugcauagcauaga

SEQ ID NO: 71499 - RNA, 20 nt, Artificial Sequence
  MKO10071499_B_Anapc1
  gRNA
aaacagcaagccauauuuag

SEQ ID NO: 71500 - RNA, 20 nt, Artificial Sequence
  MKO10071500_B_Anapc2
  gRNA
gcaaaagucgguaguaccug

SEQ ID NO: 71501 - RNA, 20 nt, Artificial Sequence
  MKO10071501_B_Anapc2
  gRNA
aggauggaagaccgcugccg

SEQ ID NO: 71502 - RNA, 20 nt, Artificial Sequence
  MKO10071502_B_Anapc2
  gRNA
ucaauggcuggccgggaguc

SEQ ID NO: 71503 - RNA, 20 nt, Artificial Sequence
  MKO10071503_B_Anapc4
  gRNA
gagaaggaguguaagcuuuc

SEQ ID NO: 71504 - RNA, 20 nt, Artificial Sequence
  MKO10071504_B_Anapc4
  gRNA
cagcuuaggcaagagaagau

SEQ ID NO: 71505 - RNA, 20 nt, Artificial Sequence
  MKO10071505_B_Anapc4
  gRNA
acagcaccucaaaaauauuu

SEQ ID NO: 71506 - RNA, 20 nt, Artificial Sequence
  MKO10071506_B_Anapc5
  gRNA
ugaaggcgaacugaaggaua

SEQ ID NO: 71507 - RNA, 20 nt, Artificial Sequence
  MKO10071507_B_Anapc5
  gRNA
agcuuugacaguguaauauc

SEQ ID NO: 71508 - RNA, 20 nt, Artificial Sequence
  MKO10071508_B_Anapc5
  gRNA
ugaagaaucguguccucagc

SEQ ID NO: 71509 - RNA, 20 nt, Artificial Sequence
  MKO10071509_B_Anapc7
  gRNA
agcauacgcuuuaauccaca

SEQ ID NO: 71510 - RNA, 20 nt, Artificial Sequence
  MKO10071510_B_Anapc7
  gRNA
gaucccaucgaguacagcaa

SEQ ID NO: 71511 - RNA, 20 nt, Artificial Sequence
  MKO10071511_B_Anapc7
  gRNA
gguccugcggcagugcccuu

SEQ ID NO: 71512 - RNA, 20 nt, Artificial Sequence
  MKO10071512_B_Ang2
  gRNA
ugcagguaccgagccucuaa

SEQ ID NO: 71513 - RNA, 20 nt, Artificial Sequence
  MKO10071513_B_Ang2
  gRNA
cagauacugcgaaaguauga

SEQ ID NO: 71514 - RNA, 20 nt, Artificial Sequence
  MKO10071514_B_Ang2
  gRNA
aauauaucugaacccuuuag

SEQ ID NO: 71515 - RNA, 20 nt, Artificial Sequence
  MKO10071515_B_Ang3
  gRNA
agccucuagcuucacacugc

SEQ ID NO: 71516 - RNA, 20 nt, Artificial Sequence
  MKO10071516_B_Ang3
  gRNA
gcuggccagcuuuccuccaa

SEQ ID NO: 71517 - RNA, 20 nt, Artificial Sequence
  MKO10071517_B_Ang3
  gRNA
ccccccccaccccccguugg

SEQ ID NO: 71518 - RNA, 20 nt, Artificial Sequence
  MKO10071518_B_Ang4
  gRNA
gguugugauuccuccaacuc

SEQ ID NO: 71519 - RNA, 20 nt, Artificial Sequence
  MKO10071519_B_Ang4
  gRNA
auacugugaaaguaugauga

SEQ ID NO: 71520 - RNA, 20 nt, Artificial Sequence
  MKO10071520_B_Ang4
  gRNA
ucgguacccgcauggaggcc

SEQ ID NO: 71521 - RNA, 20 nt, Artificial Sequence
  MKO10071521_B_Ang5
  gRNA
aucacaacuugcaagcacaa

SEQ ID NO: 71522 - RNA, 20 nt, Artificial Sequence
  MKO10071522_B_Ang5
  gRNA
uuucacaguaucuguaaucc

SEQ ID NO: 71523 - RNA, 20 nt, Artificial Sequence
  MKO10071523_B_Ang5
  gRNA
uuuguacuggcauggaggcu

SEQ ID NO: 71524 - RNA, 20 nt, Artificial Sequence
  MKO10071524_B_Ang6
  gRNA
aaucuuuaaagucucuguac

SEQ ID NO: 71525 - RNA, 20 nt, Artificial Sequence
  MKO10071525_B_Ang6
  gRNA
guuggcuucuuugcauuuca

SEQ ID NO: 71526 - RNA, 20 nt, Artificial Sequence
  MKO10071526_B_Ang6
  gRNA
guaguuauccuuagccagag

SEQ ID NO: 71527 - RNA, 20 nt, Artificial Sequence
  MKO10071527_B_Angel1
  gRNA
gagaugagcucuucgccaga

SEQ ID NO: 71528 - RNA, 20 nt, Artificial Sequence
  MKO10071528_B_Angel1
  gRNA
aauccucccauucucgccac

SEQ ID NO: 71529 - RNA, 20 nt, Artificial Sequence
  MKO10071529_B_Angel1
  gRNA
aguacccaucauccgcagag

SEQ ID NO: 71530 - RNA, 20 nt, Artificial Sequence
  MKO10071530_B_Angel2
  gRNA
agcuuaaugucaccgcgccg

SEQ ID NO: 71531 - RNA, 20 nt, Artificial Sequence
  MKO10071531_B_Angel2
  gRNA
ggcgcacgggaguaaugucc

SEQ ID NO: 71532 - RNA, 20 nt, Artificial Sequence
  MKO10071532_B_Angel2
  gRNA
cgcaguuucaguacuauaau

SEQ ID NO: 71533 - RNA, 20 nt, Artificial Sequence
  MKO10071533_B_Angpt1
  gRNA
ucucaagcaugguggccgug

SEQ ID NO: 71534 - RNA, 20 nt, Artificial Sequence
  MKO10071534_B_Angpt1
  gRNA
ugugcagauguauaucaagc

SEQ ID NO: 71535 - RNA, 20 nt, Artificial Sequence
  MKO10071535_B_Angpt1
  gRNA
cuagcaguuguauuucaagu

SEQ ID NO: 71536 - RNA, 20 nt, Artificial Sequence
  MKO10071536_B_Angpt2
  gRNA
agcuguugacggucuccauu

SEQ ID NO: 71537 - RNA, 20 nt, Artificial Sequence
  MKO10071537_B_Angpt2
  gRNA
cuagcuggagaauuacauuc

SEQ ID NO: 71538 - RNA, 20 nt, Artificial Sequence
  MKO10071538_B_Angpt2
  gRNA
gauuuccgcacagucucuga

SEQ ID NO: 71539 - RNA, 20 nt, Artificial Sequence
  MKO10071539_B_Angpt4
  gRNA
gaaccagacaacuaccaugc

SEQ ID NO: 71540 - RNA, 20 nt, Artificial Sequence
  MKO10071540_B_Angpt4
  gRNA
uagccagggucccggucuga

SEQ ID NO: 71541 - RNA, 20 nt, Artificial Sequence
  MKO10071541_B_Angpt4
  gRNA
gagcuuuggucugguucaug

SEQ ID NO: 71542 - RNA, 20 nt, Artificial Sequence
  MKO10071542_B_Angptl1
  gRNA
aaguguacuacucuuccuac

SEQ ID NO: 71543 - RNA, 20 nt, Artificial Sequence
  MKO10071543_B_Angptl1
  gRNA
ucaggaugcaggcacuauua

SEQ ID NO: 71544 - RNA, 20 nt, Artificial Sequence
  MKO10071544_B_Angptl1
  gRNA
cucuguaccauacuccguug

SEQ ID NO: 71545 - RNA, 20 nt, Artificial Sequence
  MKO10071545_B_Angptl2
  gRNA
ugaguaugccaguuuccgac

SEQ ID NO: 71546 - RNA, 20 nt, Artificial Sequence
  MKO10071546_B_Angptl2
  gRNA
agcuuauaguacucgcuuuc

SEQ ID NO: 71547 - RNA, 20 nt, Artificial Sequence
  MKO10071547_B_Angptl2
  gRNA
gguaccgugggggccauuac

SEQ ID NO: 71548 - RNA, 20 nt, Artificial Sequence
  MKO10071548_B_Angptl3
  gRNA
gucuacugugauacccaauc

SEQ ID NO: 71549 - RNA, 20 nt, Artificial Sequence
  MKO10071549_B_Angptl3
  gRNA
ucuguuucguucaguugaag

SEQ ID NO: 71550 - RNA, 20 nt, Artificial Sequence
  MKO10071550_B_Angptl3
  gRNA
uauacuguucuuccacacuc

SEQ ID NO: 71551 - RNA, 20 nt, Artificial Sequence
  MKO10071551_B_Angptl4
  gRNA
ccggucuuagauagaccucu

SEQ ID NO: 71552 - RNA, 20 nt, Artificial Sequence
  MKO10071552_B_Angptl4
  gRNA
ucuacuuucagggccgcccc

SEQ ID NO: 71553 - RNA, 20 nt, Artificial Sequence
  MKO10071553_B_Angptl4
  gRNA
ugggagucaagccaaugagc

SEQ ID NO: 71554 - RNA, 20 nt, Artificial Sequence
  MKO10071554_B_Angptl6
  gRNA
cuacacgacggcccagccgc

SEQ ID NO: 71555 - RNA, 20 nt, Artificial Sequence
  MKO10071555_B_Angptl6
  gRNA
acagucacaagcgcacaagc

SEQ ID NO: 71556 - RNA, 20 nt, Artificial Sequence
  MKO10071556_B_Angptl6
  gRNA
ucagagaguacgccccacca

SEQ ID NO: 71557 - RNA, 20 nt, Artificial Sequence
  MKO10071557_B_Angptl7
  gRNA
caacuauucccucaaacgug

SEQ ID NO: 71558 - RNA, 20 nt, Artificial Sequence
  MKO10071558_B_Angptl7
  gRNA
agaguauagcuacuuugcgu

SEQ ID NO: 71559 - RNA, 20 nt, Artificial Sequence
  MKO10071559_B_Angptl7
  gRNA
ugcugaagacgguguuguua

SEQ ID NO: 71560 - RNA, 20 nt, Artificial Sequence
  MKO10071560_B_Ang
  gRNA
gaagagauggcgauaagccc

SEQ ID NO: 71561 - RNA, 20 nt, Artificial Sequence
  MKO10071561_B_Ang
  gRNA
gcuuccauucgcuccacaga

SEQ ID NO: 71562 - RNA, 20 nt, Artificial Sequence
  MKO10071562_B_Ang
  gRNA
ugaaaaacgacucaucgaag

SEQ ID NO: 71563 - RNA, 20 nt, Artificial Sequence
  MKO10071563_B_Ank1
  gRNA
ggaugaggugguccgggagc

SEQ ID NO: 71564 - RNA, 20 nt, Artificial Sequence
  MKO10071564_B_Ank1
  gRNA
uccucucagaacggguugaa

SEQ ID NO: 71565 - RNA, 20 nt, Artificial Sequence
  MKO10071565_B_Ank1
  gRNA
cuccauaguugaccagcucc

SEQ ID NO: 71566 - RNA, 20 nt, Artificial Sequence
  MKO10071566_B_Ank2
  gRNA
gaacuaccuucgguacaguc

SEQ ID NO: 71567 - RNA, 20 nt, Artificial Sequence
  MKO10071567_B_Ank2
  gRNA
cucccuccagacuguaccga

SEQ ID NO: 71568 - RNA, 20 nt, Artificial Sequence
  MKO10071568_B_Ank2
  gRNA
cacugagaacuuagacaacg

SEQ ID NO: 71569 - RNA, 20 nt, Artificial Sequence
  MKO10071569_B_Ank3
  gRNA
ccuaaaaauugugcccccgc

SEQ ID NO: 71570 - RNA, 20 nt, Artificial Sequence
  MKO10071570_B_Ank3
  gRNA
ugacaaguaucucgggccac

SEQ ID NO: 71571 - RNA, 20 nt, Artificial Sequence
  MKO10071571_B_Ank3
  gRNA
caucaugcugucccuugcgu

SEQ ID NO: 71572 - RNA, 20 nt, Artificial Sequence
  MKO10071572_B_Ankar
  gRNA
caaugcuauaaaguacaacc

SEQ ID NO: 71573 - RNA, 20 nt, Artificial Sequence
  MKO10071573_B_Ankar
  gRNA
caaaaaccuuaaacucaucc

SEQ ID NO: 71574 - RNA, 20 nt, Artificial Sequence
  MKO10071574_B_Ankar
  gRNA
ucauagaucccauuaaaguc

SEQ ID NO: 71575 - RNA, 20 nt, Artificial Sequence
  MKO10071575_B_Ankdd1b
  gRNA
augcucaugcuaguuaaagc

SEQ ID NO: 71576 - RNA, 20 nt, Artificial Sequence
  MKO10071576_B_Ankdd1b
  gRNA
ugguuugacagucauucacc

SEQ ID NO: 71577 - RNA, 20 nt, Artificial Sequence
  MKO10071577_B_Ankdd1b
  gRNA
cuugucagcaacauccaccc

SEQ ID NO: 71578 - RNA, 20 nt, Artificial Sequence
  MKO10071578_B_Ankef1
  gRNA
caucaaagccgugcguccug

SEQ ID NO: 71579 - RNA, 20 nt, Artificial Sequence
  MKO10071579_B_Ankef1
  gRNA
ggaaauaguucguggcauau

SEQ ID NO: 71580 - RNA, 20 nt, Artificial Sequence
  MKO10071580_B_Ankef1
  gRNA
gcaaucugcaaaacccccca

SEQ ID NO: 71581 - RNA, 20 nt, Artificial Sequence
  MKO10071581_B_Ankfn1
  gRNA
ucaacgcagccguagugacc

SEQ ID NO: 71582 - RNA, 20 nt, Artificial Sequence
  MKO10071582_B_Ankfn1
  gRNA
augcugccaagcgacuguac

SEQ ID NO: 71583 - RNA, 20 nt, Artificial Sequence
  MKO10071583_B_Ankfn1
  gRNA
cagucacucguccuuugaug

SEQ ID NO: 71584 - RNA, 20 nt, Artificial Sequence
  MKO10071584_B_Ankfy1
  gRNA
gucauucaucagccgcuugc

SEQ ID NO: 71585 - RNA, 20 nt, Artificial Sequence
  MKO10071585_B_Ankfy1
  gRNA
ucgcuucuaucaaacagcag

SEQ ID NO: 71586 - RNA, 20 nt, Artificial Sequence
  MKO10071586_B_Ankfy1
  gRNA
ccugacugaauugaugaaac

SEQ ID NO: 71587 - RNA, 20 nt, Artificial Sequence
  MKO10071587_B_Ankhd1
  gRNA
uccagagacccaagcgagac

SEQ ID NO: 71588 - RNA, 20 nt, Artificial Sequence
  MKO10071588_B_Ankhd1
  gRNA
gcaaugcuuccagucucgcu

SEQ ID NO: 71589 - RNA, 20 nt, Artificial Sequence
  MKO10071589_B_Ankhd1
  gRNA
cauccgugucagugcagcag

SEQ ID NO: 71590 - RNA, 20 nt, Artificial Sequence
  MKO10071590_B_Ankib1
  gRNA
ugcugccuuagacaagcgag

SEQ ID NO: 71591 - RNA, 20 nt, Artificial Sequence
  MKO10071591_B_Ankib1
  gRNA
acagaggaucuuguaguccu

SEQ ID NO: 71592 - RNA, 20 nt, Artificial Sequence
  MKO10071592_B_Ankib1
  gRNA
gcaucugcaccccugaccgc

SEQ ID NO: 71593 - RNA, 20 nt, Artificial Sequence
  MKO10071593_B_Ankk1
  gRNA
uucucccagauuuccgauuu

SEQ ID NO: 71594 - RNA, 20 nt, Artificial Sequence
  MKO10071594_B_Ankk1
  gRNA
ccggagccuuguuauucucc

SEQ ID NO: 71595 - RNA, 20 nt, Artificial Sequence
  MKO10071595_B_Ankk1
  gRNA
caacacaucguguccaucua

SEQ ID NO: 71596 - RNA, 20 nt, Artificial Sequence
  MKO10071596_B_Ankle1
  gRNA
ggggagcggaucccaaugcu

SEQ ID NO: 71597 - RNA, 20 nt, Artificial Sequence
  MKO10071597_B_Ankle1
  gRNA
uggcgcugcggcggugcacc

SEQ ID NO: 71598 - RNA, 20 nt, Artificial Sequence
  MKO10071598_B_Ankle1
  gRNA
ggggaucccagguccgcgga

SEQ ID NO: 71599 - RNA, 20 nt, Artificial Sequence
  MKO10071599_B_Ankle2
  gRNA
uaaccgcgcugggcuuggga

SEQ ID NO: 71600 - RNA, 20 nt, Artificial Sequence
  MKO10071600_B_Ankle2
  gRNA
gaguuucagucgagccauca

SEQ ID NO: 71601 - RNA, 20 nt, Artificial Sequence
  MKO10071601_B_Ankle2
  gRNA
ggaguacuuaccacuuuguc

SEQ ID NO: 71602 - RNA, 20 nt, Artificial Sequence
  MKO10071602_B_Ankmy1
  gRNA
aaucugcuccuuggggccgc

SEQ ID NO: 71603 - RNA, 20 nt, Artificial Sequence
  MKO10071603_B_Ankmy1
  gRNA
aagcucccuaccucgccugu

SEQ ID NO: 71604 - RNA, 20 nt, Artificial Sequence
  MKO10071604_B_Ankmy1
  gRNA
ggucccgguaaaacugccca

SEQ ID NO: 71605 - RNA, 20 nt, Artificial Sequence
  MKO10071605_B_Ankmy2
  gRNA
aacgaaucuccacccuguca

SEQ ID NO: 71606 - RNA, 20 nt, Artificial Sequence
  MKO10071606_B_Ankmy2
  gRNA
uggcgucagcuccauggcgc

SEQ ID NO: 71607 - RNA, 20 nt, Artificial Sequence
  MKO10071607_B_Ankmy2
  gRNA
gaauguucaugucaacugcu

SEQ ID NO: 71608 - RNA, 20 nt, Artificial Sequence
  MKO10071608_B_Ankra2
  gRNA
uugacgucaaugaauaugac

SEQ ID NO: 71609 - RNA, 20 nt, Artificial Sequence
  MKO10071609_B_Ankra2
  gRNA
acaugccuuacuugaauucc

SEQ ID NO: 71610 - RNA, 20 nt, Artificial Sequence
  MKO10071610_B_Ankra2
  gRNA
caugugccgcagcccacauc

SEQ ID NO: 71611 - RNA, 20 nt, Artificial Sequence
  MKO10071611_B_Ankrd10
  gRNA
auucacaaggcggcccgcuc

SEQ ID NO: 71612 - RNA, 20 nt, Artificial Sequence
  MKO10071612_B_Ankrd10
  gRNA
uggggccaacauuaacaaac

SEQ ID NO: 71613 - RNA, 20 nt, Artificial Sequence
  MKO10071613_B_Ankrd10
  gRNA
ugugagccccgcucccuacc

SEQ ID NO: 71614 - RNA, 20 nt, Artificial Sequence
  MKO10071614_B_Ankrd11
  gRNA
gagcagaaggacucggacac

SEQ ID NO: 71615 - RNA, 20 nt, Artificial Sequence
  MKO10071615_B_Ankrd11
  gRNA
gccaagcaacuguuagccgc

SEQ ID NO: 71616 - RNA, 20 nt, Artificial Sequence
  MKO10071616_B_Ankrd11
  gRNA
guccgggcuguuguucggca

SEQ ID NO: 71617 - RNA, 20 nt, Artificial Sequence
  MKO10071617_B_Ankrd12
  gRNA
aucugcuuucguucagaaag

SEQ ID NO: 71618 - RNA, 20 nt, Artificial Sequence
  MKO10071618_B_Ankrd12
  gRNA
acuuucugaacgaaagcaga

SEQ ID NO: 71619 - RNA, 20 nt, Artificial Sequence
  MKO10071619_B_Ankrd12
  gRNA
aaaacuucaaaaauugaccg

SEQ ID NO: 71620 - RNA, 20 nt, Artificial Sequence
  MKO10071620_B_Ankrd13a
  gRNA
agacuaccacaacacgucca

SEQ ID NO: 71621 - RNA, 20 nt, Artificial Sequence
  MKO10071621_B_Ankrd13a
  gRNA
gcugcuacacaaaauccucg

SEQ ID NO: 71622 - RNA, 20 nt, Artificial Sequence
  MKO10071622_B_Ankrd13a
  gRNA
gauacuugccuguccauccc

SEQ ID NO: 71623 - RNA, 20 nt, Artificial Sequence
  MKO10071623_B_Ankrd13b
  gRNA
ccagucgcuucaccacccgc

SEQ ID NO: 71624 - RNA, 20 nt, Artificial Sequence
  MKO10071624_B_Ankrd13b
  gRNA
aaucgcagcuucgucuucag

SEQ ID NO: 71625 - RNA, 20 nt, Artificial Sequence
  MKO10071625_B_Ankrd13b
  gRNA
ugaagugggaguucacaagu

SEQ ID NO: 71626 - RNA, 20 nt, Artificial Sequence
  MKO10071626_B_Ankrd13c
  gRNA
aacaucacagcaagauguaa

SEQ ID NO: 71627 - RNA, 20 nt, Artificial Sequence
  MKO10071627_B_Ankrd13c
  gRNA
guuguuaaaagcccuaaaag

SEQ ID NO: 71628 - RNA, 20 nt, Artificial Sequence
  MKO10071628_B_Ankrd13c
  gRNA
cagcaaucuagggagagugu

SEQ ID NO: 71629 - RNA, 20 nt, Artificial Sequence
  MKO10071629_B_Ankrd13d
  gRNA
cacaucgcucgggcacaucu

SEQ ID NO: 71630 - RNA, 20 nt, Artificial Sequence
  MKO10071630_B_Ankrd13d
  gRNA
gcuccagggggguucgcccu

SEQ ID NO: 71631 - RNA, 20 nt, Artificial Sequence
  MKO10071631_B_Ankrd13d
  gRNA
acugcucaacaaacuccguc

SEQ ID NO: 71632 - RNA, 20 nt, Artificial Sequence
  MKO10071632_B_Ankrd16
  gRNA
ccacaguugucucgacaguc

SEQ ID NO: 71633 - RNA, 20 nt, Artificial Sequence
  MKO10071633_B_Ankrd16
  gRNA
gauuggcaccguguucuaca

SEQ ID NO: 71634 - RNA, 20 nt, Artificial Sequence
  MKO10071634_B_Ankrd16
  gRNA
gcagcuuggcuauacuaaca

SEQ ID NO: 71635 - RNA, 20 nt, Artificial Sequence
  MKO10071635_B_Ankrd17
  gRNA
uccagucgagccugcgucuc

SEQ ID NO: 71636 - RNA, 20 nt, Artificial Sequence
  MKO10071636_B_Ankrd17
  gRNA
ucggcaaguccgguuccgcu

SEQ ID NO: 71637 - RNA, 20 nt, Artificial Sequence
  MKO10071637_B_Ankrd17
  gRNA
aggaauaggcaaguuaucga

SEQ ID NO: 71638 - RNA, 20 nt, Artificial Sequence
  MKO10071638_B_Ankrd1
  gRNA
ucuccgacaguauaaacgga

SEQ ID NO: 71639 - RNA, 20 nt, Artificial Sequence
  MKO10071639_B_Ankrd1
  gRNA
gccgcaggggaauuccuucc

SEQ ID NO: 71640 - RNA, 20 nt, Artificial Sequence
  MKO10071640_B_Ankrd1
  gRNA
gaaaagcgagaaacugcgag

SEQ ID NO: 71641 - RNA, 20 nt, Artificial Sequence
  MKO10071641_B_Ankrd22
  gRNA
aaauauccaauuagcaagac

SEQ ID NO: 71642 - RNA, 20 nt, Artificial Sequence
  MKO10071642_B_Ankrd22
  gRNA
agcagaaugagacucuuguc

SEQ ID NO: 71643 - RNA, 20 nt, Artificial Sequence
  MKO10071643_B_Ankrd22
  gRNA
cuucacagcauagugcaagc

SEQ ID NO: 71644 - RNA, 20 nt, Artificial Sequence
  MKO10071644_B_Ankrd23
  gRNA
agagacacaaaguccccccc

SEQ ID NO: 71645 - RNA, 20 nt, Artificial Sequence
  MKO10071645_B_Ankrd23
  gRNA
uccaccgcacagccuugcac

SEQ ID NO: 71646 - RNA, 20 nt, Artificial Sequence
  MKO10071646_B_Ankrd23
  gRNA
uaacagcuccagacugacuc

SEQ ID NO: 71647 - RNA, 20 nt, Artificial Sequence
  MKO10071647_B_Ankrd24
  gRNA
cacucacgcagacuugcccu

SEQ ID NO: 71648 - RNA, 20 nt, Artificial Sequence
  MKO10071648_B_Ankrd24
  gRNA
uccauccgugcucaugacau

SEQ ID NO: 71649 - RNA, 20 nt, Artificial Sequence
  MKO10071649_B_Ankrd24
  gRNA
acaccccgccgcaccccuca

SEQ ID NO: 71650 - RNA, 20 nt, Artificial Sequence
  MKO10071650_B_Ankrd26
  gRNA
ccgugcugcucucgcuguca

SEQ ID NO: 71651 - RNA, 20 nt, Artificial Sequence
  MKO10071651_B_Ankrd26
  gRNA
uccuuuacagcaaguaacau

SEQ ID NO: 71652 - RNA, 20 nt, Artificial Sequence
  MKO10071652_B_Ankrd26
  gRNA
ccgugacagcgagagcagca

SEQ ID NO: 71653 - RNA, 20 nt, Artificial Sequence
  MKO10071653_B_Ankrd27
  gRNA
aagccugcccggcagugugc

SEQ ID NO: 71654 - RNA, 20 nt, Artificial Sequence
  MKO10071654_B_Ankrd27
  gRNA
uagguccuagugccuugcag

SEQ ID NO: 71655 - RNA, 20 nt, Artificial Sequence
  MKO10071655_B_Ankrd27
  gRNA
gcuucuccgagacucucacc

SEQ ID NO: 71656 - RNA, 20 nt, Artificial Sequence
  MKO10071656_B_Ankrd28
  gRNA
cuggugcaagcuauauuuaa

SEQ ID NO: 71657 - RNA, 20 nt, Artificial Sequence
  MKO10071657_B_Ankrd28
  gRNA
aauauagcuugcaccaguga

SEQ ID NO: 71658 - RNA, 20 nt, Artificial Sequence
  MKO10071658_B_Ankrd28
  gRNA
acguucacauugcucagaag

SEQ ID NO: 71659 - RNA, 20 nt, Artificial Sequence
  MKO10071659_B_Ankrd29
  gRNA
cgcuugccaaugcugcauuc

SEQ ID NO: 71660 - RNA, 20 nt, Artificial Sequence
  MKO10071660_B_Ankrd29
  gRNA
cucugcaguccacguccaca

SEQ ID NO: 71661 - RNA, 20 nt, Artificial Sequence
  MKO10071661_B_Ankrd29
  gRNA
ggaugggggcacugcccugu

SEQ ID NO: 71662 - RNA, 20 nt, Artificial Sequence
  MKO10071662_B_Ankrd2
  gRNA
gcgcgugcgcaagacauccc

SEQ ID NO: 71663 - RNA, 20 nt, Artificial Sequence
  MKO10071663_B_Ankrd2
  gRNA
uccgucggacagcacugcau

SEQ ID NO: 71664 - RNA, 20 nt, Artificial Sequence
  MKO10071664_B_Ankrd2
  gRNA
cccgaugcagugcuguccga

SEQ ID NO: 71665 - RNA, 20 nt, Artificial Sequence
  MKO10071665_B_Ankrd32
  gRNA
aucacauguguuaucccacu

SEQ ID NO: 71666 - RNA, 20 nt, Artificial Sequence
  MKO10071666_B_Ankrd32
  gRNA
auucccaaaucaguccugcu

SEQ ID NO: 71667 - RNA, 20 nt, Artificial Sequence
  MKO10071667_B_Ankrd32
  gRNA
gugggauuuccugaaaugaa

SEQ ID NO: 71668 - RNA, 20 nt, Artificial Sequence
  MKO10071668_B_Ankrd33b
  gRNA
augugugcgagcccuuauga

SEQ ID NO: 71669 - RNA, 20 nt, Artificial Sequence
  MKO10071669_B_Ankrd33b
  gRNA
ccugccaguugacgucaacg

SEQ ID NO: 71670 - RNA, 20 nt, Artificial Sequence
  MKO10071670_B_Ankrd33b
  gRNA
aggagucaccggagcccaua

SEQ ID NO: 71671 - RNA, 20 nt, Artificial Sequence
  MKO10071671_B_Ankrd33
  gRNA
ucagagcugugaguccccgc

SEQ ID NO: 71672 - RNA, 20 nt, Artificial Sequence
  MKO10071672_B_Ankrd33
  gRNA
uguucccgucuuugucuugc

SEQ ID NO: 71673 - RNA, 20 nt, Artificial Sequence
  MKO10071673_B_Ankrd33
  gRNA
ccaaccuuaccugggacucu

SEQ ID NO: 71674 - RNA, 20 nt, Artificial Sequence
  MKO10071674_B_Ankrd34a
  gRNA
cccgacauucguccccaacc

SEQ ID NO: 71675 - RNA, 20 nt, Artificial Sequence
  MKO10071675_B_Ankrd34a
  gRNA
guuguuauccccucgcgccc

SEQ ID NO: 71676 - RNA, 20 nt, Artificial Sequence
  MKO10071676_B_Ankrd34a
  gRNA
cccaacaucgcagaccguuu

SEQ ID NO: 71677 - RNA, 20 nt, Artificial Sequence
  MKO10071677_B_Ankrd34b
  gRNA
caugucgaucaacagagcgu

SEQ ID NO: 71678 - RNA, 20 nt, Artificial Sequence
  MKO10071678_B_Ankrd34b
  gRNA
aucaacgaaagcaacgaccg

SEQ ID NO: 71679 - RNA, 20 nt, Artificial Sequence
  MKO10071679_B_Ankrd34b
  gRNA
accccuccaaccguagaaga

SEQ ID NO: 71680 - RNA, 20 nt, Artificial Sequence
  MKO10071680_B_Ankrd34c
  gRNA
uugcugcuggcucuaauauc

SEQ ID NO: 71681 - RNA, 20 nt, Artificial Sequence
  MKO10071681_B_Ankrd34c
  gRNA
gucguuucaauuggggcaaa

SEQ ID NO: 71682 - RNA, 20 nt, Artificial Sequence
  MKO10071682_B_Ankrd34c
  gRNA
agguggccugcggcgaacug

SEQ ID NO: 71683 - RNA, 20 nt, Artificial Sequence
  MKO10071683_B_Ankrd35
  gRNA
cacacaccugcccaguguaa

SEQ ID NO: 71684 - RNA, 20 nt, Artificial Sequence
  MKO10071684_B_Ankrd35
  gRNA
cugucagccacaguguguga

SEQ ID NO: 71685 - RNA, 20 nt, Artificial Sequence
  MKO10071685_B_Ankrd35
  gRNA
agcaagaccuucacacacug

SEQ ID NO: 71686 - RNA, 20 nt, Artificial Sequence
  MKO10071686_B_Ankrd36
  gRNA
ucuagcaccgcaaguauaag

SEQ ID NO: 71687 - RNA, 20 nt, Artificial Sequence
  MKO10071687_B_Ankrd36
  gRNA
caucgaagcccgagaccgag

SEQ ID NO: 71688 - RNA, 20 nt, Artificial Sequence
  MKO10071688_B_Ankrd36
  gRNA
uucugacuggccgugagcac

SEQ ID NO: 71689 - RNA, 20 nt, Artificial Sequence
  MKO10071689_B_Ankrd37
  gRNA
ucacccaaucuggacaucac

SEQ ID NO: 71690 - RNA, 20 nt, Artificial Sequence
  MKO10071690_B_Ankrd37
  gRNA
aagaucaucaggugagcaac

SEQ ID NO: 71691 - RNA, 20 nt, Artificial Sequence
  MKO10071691_B_Ankrd37
  gRNA
gggagaaacuccacuccaca

SEQ ID NO: 71692 - RNA, 20 nt, Artificial Sequence
  MKO10071692_B_Ankrd39
  gRNA
gugggcacacggaaaucgca

SEQ ID NO: 71693 - RNA, 20 nt, Artificial Sequence
  MKO10071693_B_Ankrd39
  gRNA
gcucaccagugcgguguagc

SEQ ID NO: 71694 - RNA, 20 nt, Artificial Sequence
  MKO10071694_B_Ankrd39
  gRNA
gcccgggguacagcagacgc

SEQ ID NO: 71695 - RNA, 20 nt, Artificial Sequence
  MKO10071695_B_Ankrd40
  gRNA
acccaacacucuguuaagaa

SEQ ID NO: 71696 - RNA, 20 nt, Artificial Sequence
  MKO10071696_B_Ankrd40
  gRNA
ugccgguacaacuaacauca

SEQ ID NO: 71697 - RNA, 20 nt, Artificial Sequence
  MKO10071697_B_Ankrd40
  gRNA
caccucccgaauguccccca

SEQ ID NO: 71698 - RNA, 20 nt, Artificial Sequence
  MKO10071698_B_Ankrd42
  gRNA
gaaugugcugcccaauguaa

SEQ ID NO: 71699 - RNA, 20 nt, Artificial Sequence
  MKO10071699_B_Ankrd42
  gRNA
uucuaggcucuuauaaucaa

SEQ ID NO: 71700 - RNA, 20 nt, Artificial Sequence
  MKO10071700_B_Ankrd42
  gRNA
cucucucuugucagucacgc

SEQ ID NO: 71701 - RNA, 20 nt, Artificial Sequence
  MKO10071701_B_Ankrd44
  gRNA
agugucaaugucuccgacag

SEQ ID NO: 71702 - RNA, 20 nt, Artificial Sequence
  MKO10071702_B_Ankrd44
  gRNA
augagcaugcgaaucuccuc

SEQ ID NO: 71703 - RNA, 20 nt, Artificial Sequence
  MKO10071703_B_Ankrd44
  gRNA
ggucagccacauguuguccu

SEQ ID NO: 71704 - RNA, 20 nt, Artificial Sequence
  MKO10071704_B_Ankrd45
  gRNA
gcacgcugugcagcugcuuu

SEQ ID NO: 71705 - RNA, 20 nt, Artificial Sequence
  MKO10071705_B_Ankrd45
  gRNA
ggaacuggauguugacauag

SEQ ID NO: 71706 - RNA, 20 nt, Artificial Sequence
  MKO10071706_B_Ankrd45
  gRNA
uuucugggucaguaaugaug

SEQ ID NO: 71707 - RNA, 20 nt, Artificial Sequence
  MKO10071707_B_Ankrd46
  gRNA
caaagaugucauccgacugc

SEQ ID NO: 71708 - RNA, 20 nt, Artificial Sequence
  MKO10071708_B_Ankrd46
  gRNA
uguccagcuuccgaaccacg

SEQ ID NO: 71709 - RNA, 20 nt, Artificial Sequence
  MKO10071709_B_Ankrd46
  gRNA
guccacauucccucgggccg

SEQ ID NO: 71710 - RNA, 20 nt, Artificial Sequence
  MKO10071710_B_Ankrd49
  gRNA
accagaccuggaaaacucug

SEQ ID NO: 71711 - RNA, 20 nt, Artificial Sequence
  MKO10071711_B_Ankrd49
  gRNA
gacaucaacgcccaaacgaa

SEQ ID NO: 71712 - RNA, 20 nt, Artificial Sequence
  MKO10071712_B_Ankrd49
  gRNA
uacuagagucauuaagacgg

SEQ ID NO: 71713 - RNA, 20 nt, Artificial Sequence
  MKO10071713_B_Ankrd50
  gRNA
cguggacgaaggcugcaaug

SEQ ID NO: 71714 - RNA, 20 nt, Artificial Sequence
  MKO10071714_B_Ankrd50
  gRNA
ggagccgcucagcugccaga

SEQ ID NO: 71715 - RNA, 20 nt, Artificial Sequence
  MKO10071715_B_Ankrd50
  gRNA
agucucagcagcacgcccuc

SEQ ID NO: 71716 - RNA, 20 nt, Artificial Sequence
  MKO10071716_B_Ankrd52
  gRNA
uugcaugcugcugccuacgu

SEQ ID NO: 71717 - RNA, 20 nt, Artificial Sequence
  MKO10071717_B_Ankrd52
  gRNA
ccacauugagacugcucaac

SEQ ID NO: 71718 - RNA, 20 nt, Artificial Sequence
  MKO10071718_B_Ankrd52
  gRNA
ccgggccaccaagugugcag

SEQ ID NO: 71719 - RNA, 20 nt, Artificial Sequence
  MKO10071719_B_Ankrd53
  gRNA
aggccagacgccccugcacu

SEQ ID NO: 71720 - RNA, 20 nt, Artificial Sequence
  MKO10071720_B_Ankrd53
  gRNA
auccuaguaccuccgaguug

SEQ ID NO: 71721 - RNA, 20 nt, Artificial Sequence
  MKO10071721_B_Ankrd53
  gRNA
ccaucgacuauugcagacuu

SEQ ID NO: 71722 - RNA, 20 nt, Artificial Sequence
  MKO10071722_B_Ankrd54
  gRNA
gucaucaccacacugcuucg

SEQ ID NO: 71723 - RNA, 20 nt, Artificial Sequence
  MKO10071723_B_Ankrd54
  gRNA
cauaccuccucgaagcagug

SEQ ID NO: 71724 - RNA, 20 nt, Artificial Sequence
  MKO10071724_B_Ankrd54
  gRNA
uggggcugaccccaaccaac

SEQ ID NO: 71725 - RNA, 20 nt, Artificial Sequence
  MKO10071725_B_Ankrd55
  gRNA
augcacgcccuugaugcacg

SEQ ID NO: 71726 - RNA, 20 nt, Artificial Sequence
  MKO10071726_B_Ankrd55
  gRNA
gaucaaccaucaagacacag

SEQ ID NO: 71727 - RNA, 20 nt, Artificial Sequence
  MKO10071727_B_Ankrd55
  gRNA
gacucaccucugugucuuga

SEQ ID NO: 71728 - RNA, 20 nt, Artificial Sequence
  MKO10071728_B_Ankrd60
  gRNA
agacugcguccagcccuuac

SEQ ID NO: 71729 - RNA, 20 nt, Artificial Sequence
  MKO10071729_B_Ankrd60
  gRNA
gggcaggacgccccugcacg

SEQ ID NO: 71730 - RNA, 20 nt, Artificial Sequence
  MKO10071730_B_Ankrd60
  gRNA
ggaugacaucguagaacuuc

SEQ ID NO: 71731 - RNA, 20 nt, Artificial Sequence
  MKO10071731_B_Ankrd61
  gRNA
uguacugcaucgagcaaagu

SEQ ID NO: 71732 - RNA, 20 nt, Artificial Sequence
  MKO10071732_B_Ankrd61
  gRNA
ccguuacagacuacugagcc

SEQ ID NO: 71733 - RNA, 20 nt, Artificial Sequence
  MKO10071733_B_Ankrd61
  gRNA
ccucauacaguuuagagugc

SEQ ID NO: 71734 - RNA, 20 nt, Artificial Sequence
  MKO10071734_B_Ankrd63
  gRNA
ggugcgcucuuuccgccgcc

SEQ ID NO: 71735 - RNA, 20 nt, Artificial Sequence
  MKO10071735_B_Ankrd63
  gRNA
ccagcgcguccagcacgaaa

SEQ ID NO: 71736 - RNA, 20 nt, Artificial Sequence
  MKO10071736_B_Ankrd63
  gRNA
cuuagacgccgugcagcucc

SEQ ID NO: 71737 - RNA, 20 nt, Artificial Sequence
  MKO10071737_B_Ankrd66
  gRNA
agccagacccugcuugguaa

SEQ ID NO: 71738 - RNA, 20 nt, Artificial Sequence
  MKO10071738_B_Ankrd66
  gRNA
gucuggcuccauauuguauc

SEQ ID NO: 71739 - RNA, 20 nt, Artificial Sequence
  MKO10071739_B_Ankrd66
  gRNA
acgacagaacuccacuucac

SEQ ID NO: 71740 - RNA, 20 nt, Artificial Sequence
  MKO10071740_B_Ankrd6
  gRNA
ugacuggcugaauccgugcc

SEQ ID NO: 71741 - RNA, 20 nt, Artificial Sequence
  MKO10071741_B_Ankrd6
  gRNA
ccucccggauaagcgcugug

SEQ ID NO: 71742 - RNA, 20 nt, Artificial Sequence
  MKO10071742_B_Ankrd6
  gRNA
cagcgaggugcaaggggguc

SEQ ID NO: 71743 - RNA, 20 nt, Artificial Sequence
  MKO10071743_B_Ankrd7
  gRNA
gguagauguuuauaguaaua

SEQ ID NO: 71744 - RNA, 20 nt, Artificial Sequence
  MKO10071744_B_Ankrd7
  gRNA
gcuacgguucuucuucuuca

SEQ ID NO: 71745 - RNA, 20 nt, Artificial Sequence
  MKO10071745_B_Ankrd7
  gRNA
aaacagaaccccauugauua

SEQ ID NO: 71746 - RNA, 20 nt, Artificial Sequence
  MKO10071746_B_Ankrd9
  gRNA
ccugcggcgcauccugcgaa

SEQ ID NO: 71747 - RNA, 20 nt, Artificial Sequence
  MKO10071747_B_Ankrd9
  gRNA
ccuggacgcagcgccaacgg

SEQ ID NO: 71748 - RNA, 20 nt, Artificial Sequence
  MKO10071748_B_Ankrd9
  gRNA
cacccgcaagcgagcugcgc

SEQ ID NO: 71749 - RNA, 20 nt, Artificial Sequence
  MKO10071749_B_Anks1b
  gRNA
gguacuuacccugaggguga

SEQ ID NO: 71750 - RNA, 20 nt, Artificial Sequence
  MKO10071750_B_Anks1b
  gRNA
cccauaccuuuggaaggagc

SEQ ID NO: 71751 - RNA, 20 nt, Artificial Sequence
  MKO10071751_B_Anks1b
  gRNA
acccuccacagaagcccccu

SEQ ID NO: 71752 - RNA, 20 nt, Artificial Sequence
  MKO10071752_B_Anks1
  gRNA
uucaaacuuguuguugcgca

SEQ ID NO: 71753 - RNA, 20 nt, Artificial Sequence
  MKO10071753_B_Anks1
  gRNA
cuaucuacacaguucacguu

SEQ ID NO: 71754 - RNA, 20 nt, Artificial Sequence
  MKO10071754_B_Anks1
  gRNA
cuacaccacgcugcuuugaa

SEQ ID NO: 71755 - RNA, 20 nt, Artificial Sequence
  MKO10071755_B_Anks3
  gRNA
aagagccucuaccguagccc

SEQ ID NO: 71756 - RNA, 20 nt, Artificial Sequence
  MKO10071756_B_Anks3
  gRNA
cugauguaugccuccuacau

SEQ ID NO: 71757 - RNA, 20 nt, Artificial Sequence
  MKO10071757_B_Anks3
  gRNA
aaugcuuucguugccacagc

SEQ ID NO: 71758 - RNA, 20 nt, Artificial Sequence
  MKO10071758_B_Anks4b
  gRNA
accuauagcaaggaggacuc

SEQ ID NO: 71759 - RNA, 20 nt, Artificial Sequence
  MKO10071759_B_Anks4b
  gRNA
uggcaugacacccacucucc

SEQ ID NO: 71760 - RNA, 20 nt, Artificial Sequence
  MKO10071760_B_Anks4b
  gRNA
cacucgcugcuuggugauag

SEQ ID NO: 71761 - RNA, 20 nt, Artificial Sequence
  MKO10071761_B_Anks6
  gRNA
uccccgcugccucccguugc

SEQ ID NO: 71762 - RNA, 20 nt, Artificial Sequence
  MKO10071762_B_Anks6
  gRNA
gugaugcugcugaacgaucc

SEQ ID NO: 71763 - RNA, 20 nt, Artificial Sequence
  MKO10071763_B_Anks6
  gRNA
guugcucuucgagccaaaaa

SEQ ID NO: 71764 - RNA, 20 nt, Artificial Sequence
  MKO10071764_B_Ankzf1
  gRNA
uuugaacagcaaagcuccac

SEQ ID NO: 71765 - RNA, 20 nt, Artificial Sequence
  MKO10071765_B_Ankzf1
  gRNA
guucaaagucugaagcagac

SEQ ID NO: 71766 - RNA, 20 nt, Artificial Sequence
  MKO10071766_B_Ankzf1
  gRNA
acucucucacccuugaaaaa

SEQ ID NO: 71767 - RNA, 20 nt, Artificial Sequence
  MKO10071767_B_Ank
  gRNA
cggcaggcguggacucaugc

SEQ ID NO: 71768 - RNA, 20 nt, Artificial Sequence
  MKO10071768_B_Ank
  gRNA
uccugucggggaugaugucg

SEQ ID NO: 71769 - RNA, 20 nt, Artificial Sequence
  MKO10071769_B_Ank
  gRNA
guaguacccuaagucacugu

SEQ ID NO: 71770 - RNA, 20 nt, Artificial Sequence
  MKO10071770_B_Anln
  gRNA
uugcugcaacgauuugcucc

SEQ ID NO: 71771 - RNA, 20 nt, Artificial Sequence
  MKO10071771_B_Anln
  gRNA
agcugccaucagcgagucug

SEQ ID NO: 71772 - RNA, 20 nt, Artificial Sequence
  MKO10071772_B_Anln
  gRNA
acagaggcauugccgucccu

SEQ ID NO: 71773 - RNA, 20 nt, Artificial Sequence
  MKO10071773_B_Ano10
  gRNA
uccauaggugaaggcccgca

SEQ ID NO: 71774 - RNA, 20 nt, Artificial Sequence
  MKO10071774_B_Ano10
  gRNA
gugaggagacugcucacguc

SEQ ID NO: 71775 - RNA, 20 nt, Artificial Sequence
  MKO10071775_B_Ano10
  gRNA
ugucaugcagcgggaacacu

SEQ ID NO: 71776 - RNA, 20 nt, Artificial Sequence
  MKO10071776_B_Ano1
  gRNA
uaccacaucagugagacgcg

SEQ ID NO: 71777 - RNA, 20 nt, Artificial Sequence
  MKO10071777_B_Ano1
  gRNA
uugugaagauccaugcgccc

SEQ ID NO: 71778 - RNA, 20 nt, Artificial Sequence
  MKO10071778_B_Ano1
  gRNA
uccggugagccugcauccac

SEQ ID NO: 71779 - RNA, 20 nt, Artificial Sequence
  MKO10071779_B_Ano2
  gRNA
auguacuugcauaccacuac

SEQ ID NO: 71780 - RNA, 20 nt, Artificial Sequence
  MKO10071780_B_Ano2
  gRNA
caguacucacagaacggucu

SEQ ID NO: 71781 - RNA, 20 nt, Artificial Sequence
  MKO10071781_B_Ano2
  gRNA
uagauguacgagaucaaagc

SEQ ID NO: 71782 - RNA, 20 nt, Artificial Sequence
  MKO10071782_B_Ano3
  gRNA
gucaacugagagugaaucuc

SEQ ID NO: 71783 - RNA, 20 nt, Artificial Sequence
  MKO10071783_B_Ano3
  gRNA
aagcgucauuaaaaccaucu

SEQ ID NO: 71784 - RNA, 20 nt, Artificial Sequence
  MKO10071784_B_Ano3
  gRNA
uaccuuagacagcuuugucu

SEQ ID NO: 71785 - RNA, 20 nt, Artificial Sequence
  MKO10071785_B_Ano4
  gRNA
gauaugcaaauacugcccga

SEQ ID NO: 71786 - RNA, 20 nt, Artificial Sequence
  MKO10071786_B_Ano4
  gRNA
gaaaaguccacaucgcucuu

SEQ ID NO: 71787 - RNA, 20 nt, Artificial Sequence
  MKO10071787_B_Ano4
  gRNA
cgagaacgaaacaaauccaa

SEQ ID NO: 71788 - RNA, 20 nt, Artificial Sequence
  MKO10071788_B_Ano5
  gRNA
accggugacuguaagucuuc

SEQ ID NO: 71789 - RNA, 20 nt, Artificial Sequence
  MKO10071789_B_Ano5
  gRNA
agcgauucaauuuguuccug

SEQ ID NO: 71790 - RNA, 20 nt, Artificial Sequence
  MKO10071790_B_Ano5
  gRNA
uuaccauaagacgccuccuc

SEQ ID NO: 71791 - RNA, 20 nt, Artificial Sequence
  MKO10071791_B_Ano6
  gRNA
ugcucucaucuucauacacg

SEQ ID NO: 71792 - RNA, 20 nt, Artificial Sequence
  MKO10071792_B_Ano6
  gRNA
gaaucuaaccuuaucugcca

SEQ ID NO: 71793 - RNA, 20 nt, Artificial Sequence
  MKO10071793_B_Ano6
  gRNA
cugauucuccagugauccaa

SEQ ID NO: 71794 - RNA, 20 nt, Artificial Sequence
  MKO10071794_B_Ano7
  gRNA
agcucugccaaacccccaau

SEQ ID NO: 71795 - RNA, 20 nt, Artificial Sequence
  MKO10071795_B_Ano7
  gRNA
gaaccaagagaaccccacga

SEQ ID NO: 71796 - RNA, 20 nt, Artificial Sequence
  MKO10071796_B_Ano7
  gRNA
uggcuuaccaauuggggguu

SEQ ID NO: 71797 - RNA, 20 nt, Artificial Sequence
  MKO10071797_B_Ano8
  gRNA
gcgaacuugcacgaucagcu

SEQ ID NO: 71798 - RNA, 20 nt, Artificial Sequence
  MKO10071798_B_Ano8
  gRNA
gagcacgucgcaguccucag

SEQ ID NO: 71799 - RNA, 20 nt, Artificial Sequence
  MKO10071799_B_Ano8
  gRNA
ggcagagcaucauucgcuuc

SEQ ID NO: 71800 - RNA, 20 nt, Artificial Sequence
  MKO10071800_B_Ano9
  gRNA
gugaacaacaagcuaaaacc

SEQ ID NO: 71801 - RNA, 20 nt, Artificial Sequence
  MKO10071801_B_Ano9
  gRNA
cuagaaaaccucgagagcaa

SEQ ID NO: 71802 - RNA, 20 nt, Artificial Sequence
  MKO10071802_B_Ano9
  gRNA
ucacgacaaagcucacaauu

SEQ ID NO: 71803 - RNA, 20 nt, Artificial Sequence
  MKO10071803_B_Anp32a
  gRNA
uuccuaaguacaaucaacgu

SEQ ID NO: 71804 - RNA, 20 nt, Artificial Sequence
  MKO10071804_B_Anp32a
  gRNA
ugaugaauaugcccagcuag

SEQ ID NO: 71805 - RNA, 20 nt, Artificial Sequence
  MKO10071805_B_Anp32a
  gRNA
caauugacuuacaguuaucc

SEQ ID NO: 71806 - RNA, 20 nt, Artificial Sequence
  MKO10071806_B_Anp32b
  gRNA
auccaccucuccaucugagu

SEQ ID NO: 71807 - RNA, 20 nt, Artificial Sequence
  MKO10071807_B_Anp32b
  gRNA
gaagcuaccuaaguugaaaa

SEQ ID NO: 71808 - RNA, 20 nt, Artificial Sequence
  MKO10071808_B_Anp32b
  gRNA
cuuucagguuauugccacuu

SEQ ID NO: 71809 - RNA, 20 nt, Artificial Sequence
  MKO10071809_B_Anp32e
  gRNA
uccuccucuucauagccuuc

SEQ ID NO: 71810 - RNA, 20 nt, Artificial Sequence
  MKO10071810_B_Anp32e
  gRNA
guugaagaacagagccccgg

SEQ ID NO: 71811 - RNA, 20 nt, Artificial Sequence
  MKO10071811_B_Anp32e
  gRNA
gaugaugacuacguugauga

SEQ ID NO: 71812 - RNA, 20 nt, Artificial Sequence
  MKO10071812_B_Anpep
  gRNA
cacccgcuccuuguugcuaa

SEQ ID NO: 71813 - RNA, 20 nt, Artificial Sequence
  MKO10071813_B_Anpep
  gRNA
gguggcuacaacgcagaugc

SEQ ID NO: 71814 - RNA, 20 nt, Artificial Sequence
  MKO10071814_B_Anpep
  gRNA
cacugugauugcucacgagc

SEQ ID NO: 71815 - RNA, 20 nt, Artificial Sequence
  MKO10071815_B_Antxr1
  gRNA
cucauaguaaaucugcucac

SEQ ID NO: 71816 - RNA, 20 nt, Artificial Sequence
  MKO10071816_B_Antxr1
  gRNA
caggaagugugcugcaccac

SEQ ID NO: 71817 - RNA, 20 nt, Artificial Sequence
  MKO10071817_B_Antxr1
  gRNA
uucauugucuucucuacucg

SEQ ID NO: 71818 - RNA, 20 nt, Artificial Sequence
  MKO10071818_B_Antxr2
  gRNA
cuggcaguguagcaaauaac

SEQ ID NO: 71819 - RNA, 20 nt, Artificial Sequence
  MKO10071819_B_Antxr2
  gRNA
uguuucuccaacuggcuuaa

SEQ ID NO: 71820 - RNA, 20 nt, Artificial Sequence
  MKO10071820_B_Antxr2
  gRNA
uuacaagcuuuaguccuuca

SEQ ID NO: 71821 - RNA, 20 nt, Artificial Sequence
  MKO10071821_B_Antxrl
  gRNA
caucauuaccuacucaacag

SEQ ID NO: 71822 - RNA, 20 nt, Artificial Sequence
  MKO10071822_B_Antxrl
  gRNA
cuuaagaacauagugccuca

SEQ ID NO: 71823 - RNA, 20 nt, Artificial Sequence
  MKO10071823_B_Antxrl
  gRNA
ccacauuuauucauuugcag

SEQ ID NO: 71824 - RNA, 20 nt, Artificial Sequence
  MKO10071824_B_Anxa10
  gRNA
gugcauugcugcguuguguu

SEQ ID NO: 71825 - RNA, 20 nt, Artificial Sequence
  MKO10071825_B_Anxa10
  gRNA
cuuaugaugcucaugagcuc

SEQ ID NO: 71826 - RNA, 20 nt, Artificial Sequence
  MKO10071826_B_Anxa10
  gRNA
agcucaugagcaucauaaga

SEQ ID NO: 71827 - RNA, 20 nt, Artificial Sequence
  MKO10071827_B_Anxa11
  gRNA
ugaccccuugcgagaugccg

SEQ ID NO: 71828 - RNA, 20 nt, Artificial Sequence
  MKO10071828_B_Anxa11
  gRNA
ggcggauacauuccauaagg

SEQ ID NO: 71829 - RNA, 20 nt, Artificial Sequence
  MKO10071829_B_Anxa11
  gRNA
guugaacugccccgcauagu

SEQ ID NO: 71830 - RNA, 20 nt, Artificial Sequence
  MKO10071830_B_Anxa13
  gRNA
cugcaucaaagccgugguga

SEQ ID NO: 71831 - RNA, 20 nt, Artificial Sequence
  MKO10071831_B_Anxa13
  gRNA
aagcuguacaaagccugcaa

SEQ ID NO: 71832 - RNA, 20 nt, Artificial Sequence
  MKO10071832_B_Anxa13
  gRNA
ccucuccuccgauguccugc

SEQ ID NO: 71833 - RNA, 20 nt, Artificial Sequence
  MKO10071833_B_Anxa1
  gRNA
cccuuccuucaauguauccu

SEQ ID NO: 71834 - RNA, 20 nt, Artificial Sequence
  MKO10071834_B_Anxa1
  gRNA
gucuugagaaaagcccuuac

SEQ ID NO: 71835 - RNA, 20 nt, Artificial Sequence
  MKO10071835_B_Anxa1
  gRNA
uaggggcucacugcugaccc

SEQ ID NO: 71836 - RNA, 20 nt, Artificial Sequence
  MKO10071836_B_Anxa2
  gRNA
uuaguuccgaagcaucauac

SEQ ID NO: 71837 - RNA, 20 nt, Artificial Sequence
  MKO10071837_B_Anxa2
  gRNA
uugccuucgccuaucagaga

SEQ ID NO: 71838 - RNA, 20 nt, Artificial Sequence
  MKO10071838_B_Anxa2
  gRNA
uguugaucucuugcagcucc

SEQ ID NO: 71839 - RNA, 20 nt, Artificial Sequence
  MKO10071839_B_Anxa3
  gRNA
gcuccgucagaauguugaug

SEQ ID NO: 71840 - RNA, 20 nt, Artificial Sequence
  MKO10071840_B_Anxa3
  gRNA
auagcuucggcauccaccga

SEQ ID NO: 71841 - RNA, 20 nt, Artificial Sequence
  MKO10071841_B_Anxa3
  gRNA
guaccuguucauacgcugcu

SEQ ID NO: 71842 - RNA, 20 nt, Artificial Sequence
  MKO10071842_B_Anxa4
  gRNA
cagaaacaccgcccagcgcc

SEQ ID NO: 71843 - RNA, 20 nt, Artificial Sequence
  MKO10071843_B_Anxa4
  gRNA
guacauaccgaggccuuuca

SEQ ID NO: 71844 - RNA, 20 nt, Artificial Sequence
  MKO10071844_B_Anxa4
  gRNA
cacagugcuguaugacguac

SEQ ID NO: 71845 - RNA, 20 nt, Artificial Sequence
  MKO10071845_B_Anxa5
  gRNA
aagagcaugcuucagcucgu

SEQ ID NO: 71846 - RNA, 20 nt, Artificial Sequence
  MKO10071846_B_Anxa5
  gRNA
cgagcugaagcaugcucuua

SEQ ID NO: 71847 - RNA, 20 nt, Artificial Sequence
  MKO10071847_B_Anxa5
  gRNA
aacguuacccaagccuuuca

SEQ ID NO: 71848 - RNA, 20 nt, Artificial Sequence
  MKO10071848_B_Anxa6
  gRNA
gguggcuuaccuugccauac

SEQ ID NO: 71849 - RNA, 20 nt, Artificial Sequence
  MKO10071849_B_Anxa6
  gRNA
guggacagagccucgguaca

SEQ ID NO: 71850 - RNA, 20 nt, Artificial Sequence
  MKO10071850_B_Anxa6
  gRNA
ccucccgcagcaacaagcag

SEQ ID NO: 71851 - RNA, 20 nt, Artificial Sequence
  MKO10071851_B_Anxa7
  gRNA
ccgccaccauaagacugugc

SEQ ID NO: 71852 - RNA, 20 nt, Artificial Sequence
  MKO10071852_B_Anxa7
  gRNA
gugcccugagucaucgaagc

SEQ ID NO: 71853 - RNA, 20 nt, Artificial Sequence
  MKO10071853_B_Anxa7
  gRNA
acaagcucccuacccuagcc

SEQ ID NO: 71854 - RNA, 20 nt, Artificial Sequence
  MKO10071854_B_Anxa8
  gRNA
uuguagagggucucugcauc

SEQ ID NO: 71855 - RNA, 20 nt, Artificial Sequence
  MKO10071855_B_Anxa8
  gRNA
uccuacaggaaccaaugagc

SEQ ID NO: 71856 - RNA, 20 nt, Artificial Sequence
  MKO10071856_B_Anxa8
  gRNA
cucaaugaugacuccuucuu

SEQ ID NO: 71857 - RNA, 20 nt, Artificial Sequence
  MKO10071857_B_Anxa9
  gRNA
ccugcaguccgggcgcugcu

SEQ ID NO: 71858 - RNA, 20 nt, Artificial Sequence
  MKO10071858_B_Anxa9
  gRNA
ugcagcccaauuugaugccc

SEQ ID NO: 71859 - RNA, 20 nt, Artificial Sequence
  MKO10071859_B_Anxa9
  gRNA
ugcucuuacagaccgcagcc

SEQ ID NO: 71860 - RNA, 20 nt, Artificial Sequence
  MKO10071860_B_Aoah
  gRNA
cagacucgaugaagcuauga

SEQ ID NO: 71861 - RNA, 20 nt, Artificial Sequence
  MKO10071861_B_Aoah
  gRNA
ccaugguagaggaccuccug

SEQ ID NO: 71862 - RNA, 20 nt, Artificial Sequence
  MKO10071862_B_Aoah
  gRNA
gaagaccgccugcuauuucu

SEQ ID NO: 71863 - RNA, 20 nt, Artificial Sequence
  MKO10071863_B_Aoc1
  gRNA
caugguugagaccguugucc

SEQ ID NO: 71864 - RNA, 20 nt, Artificial Sequence
  MKO10071864_B_Aoc1
  gRNA
gcaggcgguagcuccgccug

SEQ ID NO: 71865 - RNA, 20 nt, Artificial Sequence
  MKO10071865_B_Aoc1
  gRNA
caauguucucguuguuccga

SEQ ID NO: 71866 - RNA, 20 nt, Artificial Sequence
  MKO10071866_B_Aoc2
  gRNA
ccccuucgaaggcaucauaa

SEQ ID NO: 71867 - RNA, 20 nt, Artificial Sequence
  MKO10071867_B_Aoc2
  gRNA
ucuauuaccagaacgacaug

SEQ ID NO: 71868 - RNA, 20 nt, Artificial Sequence
  MKO10071868_B_Aoc2
  gRNA
cucucaaaguacacgcugcc

SEQ ID NO: 71869 - RNA, 20 nt, Artificial Sequence
  MKO10071869_B_Aoc3
  gRNA
uuguccccacgauuguaccu

SEQ ID NO: 71870 - RNA, 20 nt, Artificial Sequence
  MKO10071870_B_Aoc3
  gRNA
guuccccgcagucaccgugu

SEQ ID NO: 71871 - RNA, 20 nt, Artificial Sequence
  MKO10071871_B_Aoc3
  gRNA
ggcaggaauuucgggggcac

SEQ ID NO: 71872 - RNA, 20 nt, Artificial Sequence
  MKO10071872_B_Aox1
  gRNA
acagcagucaccacgguaga

SEQ ID NO: 71873 - RNA, 20 nt, Artificial Sequence
  MKO10071873_B_Aox1
  gRNA
cugcaccuaccugaucgccu

SEQ ID NO: 71874 - RNA, 20 nt, Artificial Sequence
  MKO10071874_B_Aox1
  gRNA
ccugcacagugaugaucucg

SEQ ID NO: 71875 - RNA, 20 nt, Artificial Sequence
  MKO10071875_B_Aox2
  gRNA
acuaaggaugcguguggaac

SEQ ID NO: 71876 - RNA, 20 nt, Artificial Sequence
  MKO10071876_B_Aox2
  gRNA
uccuucccaguaugccucac

SEQ ID NO: 71877 - RNA, 20 nt, Artificial Sequence
  MKO10071877_B_Aox2
  gRNA
gaaggguccaguucuuucuc

SEQ ID NO: 71878 - RNA, 20 nt, Artificial Sequence
  MKO10071878_B_Aox3
  gRNA
acccuuccaguccgacucac

SEQ ID NO: 71879 - RNA, 20 nt, Artificial Sequence
  MKO10071879_B_Aox3
  gRNA
uaccuggacaggguguaucc

SEQ ID NO: 71880 - RNA, 20 nt, Artificial Sequence
  MKO10071880_B_Aox3
  gRNA
gcccuccacagaacagauaa

SEQ ID NO: 71881 - RNA, 20 nt, Artificial Sequence
  MKO10071881_B_Aox4
  gRNA
acuaaguacagcuguggaac

SEQ ID NO: 71882 - RNA, 20 nt, Artificial Sequence
  MKO10071882_B_Aox4
  gRNA
gccgacaccugaucagauca

SEQ ID NO: 71883 - RNA, 20 nt, Artificial Sequence
  MKO10071883_B_Aox4
  gRNA
uggagcagccauuaccacag

SEQ ID NO: 71884 - RNA, 20 nt, Artificial Sequence
  MKO10071884_B_Ap1ar
  gRNA
aggagagcacuugaccauag

SEQ ID NO: 71885 - RNA, 20 nt, Artificial Sequence
  MKO10071885_B_Ap1ar
  gRNA
cuuucaguuugagaaccucg

SEQ ID NO: 71886 - RNA, 20 nt, Artificial Sequence
  MKO10071886_B_Ap1ar
  gRNA
uuugugcagggggagagccc

SEQ ID NO: 71887 - RNA, 20 nt, Artificial Sequence
  MKO10071887_B_Ap1b1
  gRNA
ccaggugguagcgaaugcag

SEQ ID NO: 71888 - RNA, 20 nt, Artificial Sequence
  MKO10071888_B_Ap1b1
  gRNA
uggcauaguucaucaaguac

SEQ ID NO: 71889 - RNA, 20 nt, Artificial Sequence
  MKO10071889_B_Ap1b1
  gRNA
agugauugcaucaaugacug

SEQ ID NO: 71890 - RNA, 20 nt, Artificial Sequence
  MKO10071890_B_Ap1g1
  gRNA
uccguucacacaucucugug

SEQ ID NO: 71891 - RNA, 20 nt, Artificial Sequence
  MKO10071891_B_Ap1g1
  gRNA
gacuuacuucuugauacagu

SEQ ID NO: 71892 - RNA, 20 nt, Artificial Sequence
  MKO10071892_B_Ap1g1
  gRNA
caugcucgcacauuucagaa

SEQ ID NO: 71893 - RNA, 20 nt, Artificial Sequence
  MKO10071893_B_Ap1g2
  gRNA
gugccgggaccuagccccug

SEQ ID NO: 71894 - RNA, 20 nt, Artificial Sequence
  MKO10071894_B_Ap1g2
  gRNA
augacgcucacgaagcaguu

SEQ ID NO: 71895 - RNA, 20 nt, Artificial Sequence
  MKO10071895_B_Ap1g2
  gRNA
ccucucauccaauagaagca

SEQ ID NO: 71896 - RNA, 20 nt, Artificial Sequence
  MKO10071896_B_Ap1m1
  gRNA
gggcccccguuuccagcuug

SEQ ID NO: 71897 - RNA, 20 nt, Artificial Sequence
  MKO10071897_B_Ap1m1
  gRNA
uuaccuguaccaccuuguag

SEQ ID NO: 71898 - RNA, 20 nt, Artificial Sequence
  MKO10071898_B_Ap1m1
  gRNA
cuccaacuccuuaaaguacu

SEQ ID NO: 71899 - RNA, 20 nt, Artificial Sequence
  MKO10071899_B_Ap1m2
  gRNA
cugauuagccgaaacuacaa

SEQ ID NO: 71900 - RNA, 20 nt, Artificial Sequence
  MKO10071900_B_Ap1m2
  gRNA
ggcauuagcguucuucagcg

SEQ ID NO: 71901 - RNA, 20 nt, Artificial Sequence
  MKO10071901_B_Ap1m2
  gRNA
agucuucauucuggacguca

SEQ ID NO: 71902 - RNA, 20 nt, Artificial Sequence
  MKO10071902_B_Ap1s1
  gRNA
ccaccgauacguagagcucu

SEQ ID NO: 71903 - RNA, 20 nt, Artificial Sequence
  MKO10071903_B_Ap1s1
  gRNA
agagcucaugcaagucgucc

SEQ ID NO: 71904 - RNA, 20 nt, Artificial Sequence
  MKO10071904_B_Ap1s1
  gRNA
gcccaaaaugugcagcuucc

SEQ ID NO: 71905 - RNA, 20 nt, Artificial Sequence
  MKO10071905_B_Ap1s2
  gRNA
ggacaaugaacugauuaccc

SEQ ID NO: 71906 - RNA, 20 nt, Artificial Sequence
  MKO10071906_B_Ap1s2
  gRNA
uguccuuaaagcaauugagc

SEQ ID NO: 71907 - RNA, 20 nt, Artificial Sequence
  MKO10071907_B_Ap1s2
  gRNA
uaucacagcaagaguuucau

SEQ ID NO: 71908 - RNA, 20 nt, Artificial Sequence
  MKO10071908_B_Ap1s3
  gRNA
aucuucuuccucuccuuguc

SEQ ID NO: 71909 - RNA, 20 nt, Artificial Sequence
  MKO10071909_B_Ap1s3
  gRNA
agagauuguucaucguuaug

SEQ ID NO: 71910 - RNA, 20 nt, Artificial Sequence
  MKO10071910_B_Ap1s3
  gRNA
agacuguacacuuaaaacgu

SEQ ID NO: 71911 - RNA, 20 nt, Artificial Sequence
  MKO10071911_B_Ap2a1
  gRNA
ccguguucaucuccgacauc

SEQ ID NO: 71912 - RNA, 20 nt, Artificial Sequence
  MKO10071912_B_Ap2a1
  gRNA
uguacuuguuagagcuuagc

SEQ ID NO: 71913 - RNA, 20 nt, Artificial Sequence
  MKO10071913_B_Ap2a1
  gRNA
gcuaagcucuaacaaguaca

SEQ ID NO: 71914 - RNA, 20 nt, Artificial Sequence
  MKO10071914_B_Ap2a2
  gRNA
guaggugacaaggcucuuga

SEQ ID NO: 71915 - RNA, 20 nt, Artificial Sequence
  MKO10071915_B_Ap2a2
  gRNA
ugugcuuguuacgccuguac

SEQ ID NO: 71916 - RNA, 20 nt, Artificial Sequence
  MKO10071916_B_Ap2a2
  gRNA
ucugagcucaaacagauaca

SEQ ID NO: 71917 - RNA, 20 nt, Artificial Sequence
  MKO10071917_B_Ap2b1
  gRNA
agugauugcugcuaugaccg

SEQ ID NO: 71918 - RNA, 20 nt, Artificial Sequence
  MKO10071918_B_Ap2b1
  gRNA
uggcauaguucaucagauag

SEQ ID NO: 71919 - RNA, 20 nt, Artificial Sequence
  MKO10071919_B_Ap2b1
  gRNA
guacuucacaaccaauaaga

SEQ ID NO: 71920 - RNA, 20 nt, Artificial Sequence
  MKO10071920_B_Ap2m1
  gRNA
ccugacucuugauacccugc

SEQ ID NO: 71921 - RNA, 20 nt, Artificial Sequence
  MKO10071921_B_Ap2m1
  gRNA
uuacaucacacaucuuguag

SEQ ID NO: 71922 - RNA, 20 nt, Artificial Sequence
  MKO10071922_B_Ap2m1
  gRNA
acagucccagaucaccagcc

SEQ ID NO: 71923 - RNA, 20 nt, Artificial Sequence
  MKO10071923_B_Ap2s1
  gRNA
caacaaucuggccuaucucg

SEQ ID NO: 71924 - RNA, 20 nt, Artificial Sequence
  MKO10071924_B_Ap2s1
  gRNA
gcugcuucagcaccuucguc

SEQ ID NO: 71925 - RNA, 20 nt, Artificial Sequence
  MKO10071925_B_Ap2s1
  gRNA
ccuugcccagguuuacacgg

SEQ ID NO: 71926 - RNA, 20 nt, Artificial Sequence
  MKO10071926_B_Ap3b1
  gRNA
uaucgugccugucaugaugc

SEQ ID NO: 71927 - RNA, 20 nt, Artificial Sequence
  MKO10071927_B_Ap3b1
  gRNA
cuugcacggauuaguugauu

SEQ ID NO: 71928 - RNA, 20 nt, Artificial Sequence
  MKO10071928_B_Ap3b1
  gRNA
aacccugcagaugauugcga

SEQ ID NO: 71929 - RNA, 20 nt, Artificial Sequence
  MKO10071929_B_Ap3b2
  gRNA
cuugcugcuccucggcauau

SEQ ID NO: 71930 - RNA, 20 nt, Artificial Sequence
  MKO10071930_B_Ap3b2
  gRNA
ccaacacccagaugaucgcc

SEQ ID NO: 71931 - RNA, 20 nt, Artificial Sequence
  MKO10071931_B_Ap3b2
  gRNA
gguccgaggcauucuuuccc

SEQ ID NO: 71932 - RNA, 20 nt, Artificial Sequence
  MKO10071932_B_Ap3d1
  gRNA
gcuugaucucgucaaugcac

SEQ ID NO: 71933 - RNA, 20 nt, Artificial Sequence
  MKO10071933_B_Ap3d1
  gRNA
gcagcguguuggcuaccuug

SEQ ID NO: 71934 - RNA, 20 nt, Artificial Sequence
  MKO10071934_B_Ap3d1
  gRNA
agccccagccaguacgacac

SEQ ID NO: 71935 - RNA, 20 nt, Artificial Sequence
  MKO10071935_B_Ap3m1
  gRNA
uucacuccugcucgacgcca

SEQ ID NO: 71936 - RNA, 20 nt, Artificial Sequence
  MKO10071936_B_Ap3m1
  gRNA
caaaacuuaccaugaaagag

SEQ ID NO: 71937 - RNA, 20 nt, Artificial Sequence
  MKO10071937_B_Ap3m1
  gRNA
auguuagauucaguagccag

SEQ ID NO: 71938 - RNA, 20 nt, Artificial Sequence
  MKO10071938_B_Ap3m2
  gRNA
auguuugacuccguagccaa

SEQ ID NO: 71939 - RNA, 20 nt, Artificial Sequence
  MKO10071939_B_Ap3m2
  gRNA
caucccggucagcuuaacac

SEQ ID NO: 71940 - RNA, 20 nt, Artificial Sequence
  MKO10071940_B_Ap3m2
  gRNA
ccuguguccguuucaagcgc

SEQ ID NO: 71941 - RNA, 20 nt, Artificial Sequence
  MKO10071941_B_Ap3s1
  gRNA
acacgcaacagcaaaucauc

SEQ ID NO: 71942 - RNA, 20 nt, Artificial Sequence
  MKO10071942_B_Ap3s1
  gRNA
aaugccaaguucacuuucug

SEQ ID NO: 71943 - RNA, 20 nt, Artificial Sequence
  MKO10071943_B_Ap3s1
  gRNA
uuuaauauuccauguagaca

SEQ ID NO: 71944 - RNA, 20 nt, Artificial Sequence
  MKO10071944_B_Ap3s2
  gRNA
uguucgagagacuuuccauc

SEQ ID NO: 71945 - RNA, 20 nt, Artificial Sequence
  MKO10071945_B_Ap3s2
  gRNA
aaucgaagcucaaaaccgac

SEQ ID NO: 71946 - RNA, 20 nt, Artificial Sequence
  MKO10071946_B_Ap3s2
  gRNA
cuugaucuuccauauggaua

SEQ ID NO: 71947 - RNA, 20 nt, Artificial Sequence
  MKO10071947_B_Ap4b1
  gRNA
augucauccagcgaguuauu

SEQ ID NO: 71948 - RNA, 20 nt, Artificial Sequence
  MKO10071948_B_Ap4b1
  gRNA
gucuuugcagagcguauuga

SEQ ID NO: 71949 - RNA, 20 nt, Artificial Sequence
  MKO10071949_B_Ap4b1
  gRNA
guacagucuucugcgugacc

SEQ ID NO: 71950 - RNA, 20 nt, Artificial Sequence
  MKO10071950_B_Ap4e1
  gRNA
gcuucuccuugugaauacag

SEQ ID NO: 71951 - RNA, 20 nt, Artificial Sequence
  MKO10071951_B_Ap4e1
  gRNA
ggaccugcagagcacuaauc

SEQ ID NO: 71952 - RNA, 20 nt, Artificial Sequence
  MKO10071952_B_Ap4e1
  gRNA
cuuauauacugugagaugcu

SEQ ID NO: 71953 - RNA, 20 nt, Artificial Sequence
  MKO10071953_B_Ap4m1
  gRNA
aagcugacgggacugccugg

SEQ ID NO: 71954 - RNA, 20 nt, Artificial Sequence
  MKO10071954_B_Ap4m1
  gRNA
ugcugaccacagcuucaguu

SEQ ID NO: 71955 - RNA, 20 nt, Artificial Sequence
  MKO10071955_B_Ap4m1
  gRNA
gaaguuccucagcauuucug

SEQ ID NO: 71956 - RNA, 20 nt, Artificial Sequence
  MKO10071956_B_Ap4s1
  gRNA
auaugcagcucucuuuguug

SEQ ID NO: 71957 - RNA, 20 nt, Artificial Sequence
  MKO10071957_B_Ap4s1
  gRNA
gacccagauaauguuuaauu

SEQ ID NO: 71958 - RNA, 20 nt, Artificial Sequence
  MKO10071958_B_Ap4s1
  gRNA
gugcucauucauugaauaca

SEQ ID NO: 71959 - RNA, 20 nt, Artificial Sequence
  MKO10071959_B_Ap5b1
  gRNA
gcccaggcuucucgaccuag

SEQ ID NO: 71960 - RNA, 20 nt, Artificial Sequence
  MKO10071960_B_Ap5b1
  gRNA
auuagugacgaggccagugc

SEQ ID NO: 71961 - RNA, 20 nt, Artificial Sequence
  MKO10071961_B_Ap5b1
  gRNA
gcccuuuacagcacauccgc

SEQ ID NO: 71962 - RNA, 20 nt, Artificial Sequence
  MKO10071962_B_Ap5m1
  gRNA
accccacuaaugcuaauuaa

SEQ ID NO: 71963 - RNA, 20 nt, Artificial Sequence
  MKO10071963_B_Ap5m1
  gRNA
cuuaugccacuacacuucuc

SEQ ID NO: 71964 - RNA, 20 nt, Artificial Sequence
  MKO10071964_B_Ap5m1
  gRNA
uucuaguagcauugacacaa

SEQ ID NO: 71965 - RNA, 20 nt, Artificial Sequence
  MKO10071965_B_Ap5s1
  gRNA
gccccgaauuuggaagauac

SEQ ID NO: 71966 - RNA, 20 nt, Artificial Sequence
  MKO10071966_B_Ap5s1
  gRNA
cacgcucaggacauacggau

SEQ ID NO: 71967 - RNA, 20 nt, Artificial Sequence
  MKO10071967_B_Ap5s1
  gRNA
cccagccauagcacuguccg

SEQ ID NO: 71968 - RNA, 20 nt, Artificial Sequence
  MKO10071968_B_Ap5z1
  gRNA
cacucaccuacggggguacu

SEQ ID NO: 71969 - RNA, 20 nt, Artificial Sequence
  MKO10071969_B_Ap5z1
  gRNA
aggcuaagcugccggguguu

SEQ ID NO: 71970 - RNA, 20 nt, Artificial Sequence
  MKO10071970_B_Ap5z1
  gRNA
ucuucaagauccucgagaac

SEQ ID NO: 71971 - RNA, 20 nt, Artificial Sequence
  MKO10071971_B_Apaf1
  gRNA
gcagaaucugugcaugcgcu

SEQ ID NO: 71972 - RNA, 20 nt, Artificial Sequence
  MKO10071972_B_Apaf1
  gRNA
auggcgcuuaccuucuaaga

SEQ ID NO: 71973 - RNA, 20 nt, Artificial Sequence
  MKO10071973_B_Apaf1
  gRNA
cacucugcagaagcgcagca

SEQ ID NO: 71974 - RNA, 20 nt, Artificial Sequence
  MKO10071974_B_Apba1
  gRNA
ccguggggucgccgggauga

SEQ ID NO: 71975 - RNA, 20 nt, Artificial Sequence
  MKO10071975_B_Apba1
  gRNA
ucaagcauaccccuucaucc

SEQ ID NO: 71976 - RNA, 20 nt, Artificial Sequence
  MKO10071976_B_Apba1
  gRNA
ucaguucuuaccuucaacgu

SEQ ID NO: 71977 - RNA, 20 nt, Artificial Sequence
  MKO10071977_B_Apba2
  gRNA
cagcagcgcucugaucucaa

SEQ ID NO: 71978 - RNA, 20 nt, Artificial Sequence
  MKO10071978_B_Apba2
  gRNA
ugacaauaacaacaucccag

SEQ ID NO: 71979 - RNA, 20 nt, Artificial Sequence
  MKO10071979_B_Apba2
  gRNA
ugcuaagaucaagaaaaaag

SEQ ID NO: 71980 - RNA, 20 nt, Artificial Sequence
  MKO10071980_B_Apba3
  gRNA
gcucaccuugacgcggucca

SEQ ID NO: 71981 - RNA, 20 nt, Artificial Sequence
  MKO10071981_B_Apba3
  gRNA
agccaacacuuugacacgcu

SEQ ID NO: 71982 - RNA, 20 nt, Artificial Sequence
  MKO10071982_B_Apba3
  gRNA
caccaagcgugucaaagugu

SEQ ID NO: 71983 - RNA, 20 nt, Artificial Sequence
  MKO10071983_B_Apbb1ip
  gRNA
auauaucccgaacugcaaau

SEQ ID NO: 71984 - RNA, 20 nt, Artificial Sequence
  MKO10071984_B_Apbb1ip
  gRNA
uggaugagcggcaguuggcu

SEQ ID NO: 71985 - RNA, 20 nt, Artificial Sequence
  MKO10071985_B_Apbb1ip
  gRNA
ugauaaaauuaaguuagcac

SEQ ID NO: 71986 - RNA, 20 nt, Artificial Sequence
  MKO10071986_B_Apbb1
  gRNA
cuccuucagcucaccuggac

SEQ ID NO: 71987 - RNA, 20 nt, Artificial Sequence
  MKO10071987_B_Apbb1
  gRNA
cuugaacaaaccuugauccc

SEQ ID NO: 71988 - RNA, 20 nt, Artificial Sequence
  MKO10071988_B_Apbb1
  gRNA
cccaauggaguugggacuga

SEQ ID NO: 71989 - RNA, 20 nt, Artificial Sequence
  MKO10071989_B_Apbb2
  gRNA
guuagguugaugacggcugc

SEQ ID NO: 71990 - RNA, 20 nt, Artificial Sequence
  MKO10071990_B_Apbb2
  gRNA
gcuaugcauccuugaaacuc

SEQ ID NO: 71991 - RNA, 20 nt, Artificial Sequence
  MKO10071991_B_Apbb2
  gRNA
accuggaaguacuucugaca

SEQ ID NO: 71992 - RNA, 20 nt, Artificial Sequence
  MKO10071992_B_Apbb3
  gRNA
agaaagauccgugaugcugc

SEQ ID NO: 71993 - RNA, 20 nt, Artificial Sequence
  MKO10071993_B_Apbb3
  gRNA
uccgguucaaugaacugucc

SEQ ID NO: 71994 - RNA, 20 nt, Artificial Sequence
  MKO10071994_B_Apbb3
  gRNA
cucaguggcagcgcccaacc

SEQ ID NO: 71995 - RNA, 20 nt, Artificial Sequence
  MKO10071995_B_Apc2
  gRNA
agcgcuccuccaucagcgag

SEQ ID NO: 71996 - RNA, 20 nt, Artificial Sequence
  MKO10071996_B_Apc2
  gRNA
cccucuggaguccgggcggc

SEQ ID NO: 71997 - RNA, 20 nt, Artificial Sequence
  MKO10071997_B_Apc2
  gRNA
augguccagagccgugcacu

SEQ ID NO: 71998 - RNA, 20 nt, Artificial Sequence
  MKO10071998_B_Apcdd1
  gRNA
cugugauccgcgcaccguug

SEQ ID NO: 71999 - RNA, 20 nt, Artificial Sequence
  MKO10071999_B_Apcdd1
  gRNA
gaguaaccacgagugcacca

SEQ ID NO: 72000 - RNA, 20 nt, Artificial Sequence
  MKO10072000_B_Apcdd1
  gRNA
gcagaugcccccgaccaucg

SEQ ID NO: 72001 - RNA, 20 nt, Artificial Sequence
  MKO10072001_B_Apcs
  gRNA
cuucuuaccugucugacaaa

SEQ ID NO: 72002 - RNA, 20 nt, Artificial Sequence
  MKO10072002_B_Apcs
  gRNA
aggacucccaagugguacau

SEQ ID NO: 72003 - RNA, 20 nt, Artificial Sequence
  MKO10072003_B_Apcs
  gRNA
agccccacccaguauagucc

SEQ ID NO: 72004 - RNA, 20 nt, Artificial Sequence
  MKO10072004_B_Apc
  gRNA
gugcacgcuucuccaugucc

SEQ ID NO: 72005 - RNA, 20 nt, Artificial Sequence
  MKO10072005_B_Apc
  gRNA
ggacauggagaagcgugcac

SEQ ID NO: 72006 - RNA, 20 nt, Artificial Sequence
  MKO10072006_B_Apc
  gRNA
gaagaugagacuaugacuuc

SEQ ID NO: 72007 - RNA, 20 nt, Artificial Sequence
  MKO10072007_B_Apeh
  gRNA
gcaacaguguggaaacccgg

SEQ ID NO: 72008 - RNA, 20 nt, Artificial Sequence
  MKO10072008_B_Apeh
  gRNA
uggaggugcagucucgggag

SEQ ID NO: 72009 - RNA, 20 nt, Artificial Sequence
  MKO10072009_B_Apeh
  gRNA
gaguuucaaccugucugcac

SEQ ID NO: 72010 - RNA, 20 nt, Artificial Sequence
  MKO10072010_B_Apex1
  gRNA
auugaccuccguaaccccaa

SEQ ID NO: 72011 - RNA, 20 nt, Artificial Sequence
  MKO10072011_B_Apex1
  gRNA
auguggaugggcuucgagcc

SEQ ID NO: 72012 - RNA, 20 nt, Artificial Sequence
  MKO10072012_B_Apex1
  gRNA
gaguuuguucuccgagcacu

SEQ ID NO: 72013 - RNA, 20 nt, Artificial Sequence
  MKO10072013_B_Apex2
  gRNA
aucuugaaggucagccgcuc

SEQ ID NO: 72014 - RNA, 20 nt, Artificial Sequence
  MKO10072014_B_Apex2
  gRNA
uauaacccucaacaauagcc

SEQ ID NO: 72015 - RNA, 20 nt, Artificial Sequence
  MKO10072015_B_Apex2
  gRNA
agcuucagccgcagccguag

SEQ ID NO: 72016 - RNA, 20 nt, Artificial Sequence
  MKO10072016_B_Aph1a
  gRNA
cccuauuacuuccugacuuc

SEQ ID NO: 72017 - RNA, 20 nt, Artificial Sequence
  MKO10072017_B_Aph1a
  gRNA
guuucccaggaaggcagaug

SEQ ID NO: 72018 - RNA, 20 nt, Artificial Sequence
  MKO10072018_B_Aph1a
  gRNA
ggucuccagcuacagugauc

SEQ ID NO: 72019 - RNA, 20 nt, Artificial Sequence
  MKO10072019_B_Aph1b
  gRNA
uuugaaaagcauaaacccug

SEQ ID NO: 72020 - RNA, 20 nt, Artificial Sequence
  MKO10072020_B_Aph1b
  gRNA
uuccucuuuaguuucuggcu

SEQ ID NO: 72021 - RNA, 20 nt, Artificial Sequence
  MKO10072021_B_Aph1b
  gRNA
ccugaauuaaggaagaacug

SEQ ID NO: 72022 - RNA, 20 nt, Artificial Sequence
  MKO10072022_B_Aph1c
  gRNA
auacgccaacagucgcaucg

SEQ ID NO: 72023 - RNA, 20 nt, Artificial Sequence
  MKO10072023_B_Aph1c
  gRNA
uuccucuuuaguuucuggcu

SEQ ID NO: 72024 - RNA, 20 nt, Artificial Sequence
  MKO10072024_B_Aph1c
  gRNA
ccugaauuaaggaagaacug

SEQ ID NO: 72025 - RNA, 20 nt, Artificial Sequence
  MKO10072025_B_Api5
  gRNA
agaugccuaccaagugauac

SEQ ID NO: 72026 - RNA, 20 nt, Artificial Sequence
  MKO10072026_B_Api5
  gRNA
acacaucuucauccucacag

SEQ ID NO: 72027 - RNA, 20 nt, Artificial Sequence
  MKO10072027_B_Api5
  gRNA
ugacucugcagaauuuaacc

SEQ ID NO: 72028 - RNA, 20 nt, Artificial Sequence
  MKO10072028_B_Apip
  gRNA
auaccuguaauagccuccug

SEQ ID NO: 72029 - RNA, 20 nt, Artificial Sequence
  MKO10072029_B_Apip
  gRNA
gcugggucaccggcacugga

SEQ ID NO: 72030 - RNA, 20 nt, Artificial Sequence
  MKO10072030_B_Apip
  gRNA
auaaggaaauguaccucagg

SEQ ID NO: 72031 - RNA, 20 nt, Artificial Sequence
  MKO10072031_B_Apitd1
  gRNA
uaagagcuucacgucuucag

SEQ ID NO: 72032 - RNA, 20 nt, Artificial Sequence
  MKO10072032_B_Apitd1
  gRNA
auugcccagcuuaaccugaa

SEQ ID NO: 72033 - RNA, 20 nt, Artificial Sequence
  MKO10072033_B_Apitd1
  gRNA
cccaccuggcaaacauuuca

SEQ ID NO: 72034 - RNA, 20 nt, Artificial Sequence
  MKO10072034_B_Aplf
  gRNA
gugucccaccauagauccua

SEQ ID NO: 72035 - RNA, 20 nt, Artificial Sequence
  MKO10072035_B_Aplf
  gRNA
gauucucaccauaggaucua

SEQ ID NO: 72036 - RNA, 20 nt, Artificial Sequence
  MKO10072036_B_Aplf
  gRNA
acuaucaaccacuucaagaa

SEQ ID NO: 72037 - RNA, 20 nt, Artificial Sequence
  MKO10072037_B_Aplnr
  gRNA
cugaaugcgacuacgcagac

SEQ ID NO: 72038 - RNA, 20 nt, Artificial Sequence
  MKO10072038_B_Aplnr
  gRNA
uuuccgaaaggagcgcauug

SEQ ID NO: 72039 - RNA, 20 nt, Artificial Sequence
  MKO10072039_B_Aplnr
  gRNA
uucauugcccaaaccaucgc

SEQ ID NO: 72040 - RNA, 20 nt, Artificial Sequence
  MKO10072040_B_Apln
  gRNA
accuccacaaacugcaguca

SEQ ID NO: 72041 - RNA, 20 nt, Artificial Sequence
  MKO10072041_B_Apln
  gRNA
agaaggaagcaugcgcuacc

SEQ ID NO: 72042 - RNA, 20 nt, Artificial Sequence
  MKO10072042_B_Apln
  gRNA
ggcccuuaugggagagccgg

SEQ ID NO: 72043 - RNA, 20 nt, Artificial Sequence
  MKO10072043_B_Aplp1
  gRNA
cacacugguccauacgcucc

SEQ ID NO: 72044 - RNA, 20 nt, Artificial Sequence
  MKO10072044_B_Aplp1
  gRNA
accagugugagaguucaacc

SEQ ID NO: 72045 - RNA, 20 nt, Artificial Sequence
  MKO10072045_B_Aplp1
  gRNA
cucugaucgguuccgaggug

SEQ ID NO: 72046 - RNA, 20 nt, Artificial Sequence
  MKO10072046_B_Aplp2
  gRNA
ugugugagaagcaccagcgc

SEQ ID NO: 72047 - RNA, 20 nt, Artificial Sequence
  MKO10072047_B_Aplp2
  gRNA
guuauaccauucaagugucu

SEQ ID NO: 72048 - RNA, 20 nt, Artificial Sequence
  MKO10072048_B_Aplp2
  gRNA
aaaugggagccugacccaac

SEQ ID NO: 72049 - RNA, 20 nt, Artificial Sequence
  MKO10072049_B_Apmap
  gRNA
ugcauccaaauacgaaguug

SEQ ID NO: 72050 - RNA, 20 nt, Artificial Sequence
  MKO10072050_B_Apmap
  gRNA
agaccccugggcauccgggc

SEQ ID NO: 72051 - RNA, 20 nt, Artificial Sequence
  MKO10072051_B_Apmap
  gRNA
cgagaugaugaaccuaccug

SEQ ID NO: 72052 - RNA, 20 nt, Artificial Sequence
  MKO10072052_B_Apoa1bp
  gRNA
cccauccccuccguuauuuc

SEQ ID NO: 72053 - RNA, 20 nt, Artificial Sequence
  MKO10072053_B_Apoa1bp
  gRNA
aucaacucauggagcuggcc

SEQ ID NO: 72054 - RNA, 20 nt, Artificial Sequence
  MKO10072054_B_Apoa1bp
  gRNA
gcuagcaucgacauucccuc

SEQ ID NO: 72055 - RNA, 20 nt, Artificial Sequence
  MKO10072055_B_Apoa1
  gRNA
ggauuucgcuaauguguaug

SEQ ID NO: 72056 - RNA, 20 nt, Artificial Sequence
  MKO10072056_B_Apoa1
  gRNA
guggcucuggucuuccugac

SEQ ID NO: 72057 - RNA, 20 nt, Artificial Sequence
  MKO10072057_B_Apoa1
  gRNA
acccuucaggaugaaagcug

SEQ ID NO: 72058 - RNA, 20 nt, Artificial Sequence
  MKO10072058_B_Apoa2
  gRNA
ucugaaaguauugagugaac

SEQ ID NO: 72059 - RNA, 20 nt, Artificial Sequence
  MKO10072059_B_Apoa2
  gRNA
aggagcuuugguuaagagac

SEQ ID NO: 72060 - RNA, 20 nt, Artificial Sequence
  MKO10072060_B_Apoa2
  gRNA
cucaccuuccaggcuacaga

SEQ ID NO: 72061 - RNA, 20 nt, Artificial Sequence
  MKO10072061_B_Apoa4
  gRNA
uucggaccagguggccaaug

SEQ ID NO: 72062 - RNA, 20 nt, Artificial Sequence
  MKO10072062_B_Apoa4
  gRNA
aaaguaaucccacaccacau

SEQ ID NO: 72063 - RNA, 20 nt, Artificial Sequence
  MKO10072063_B_Apoa4
  gRNA
gggucagcaccgcagccuuc

SEQ ID NO: 72064 - RNA, 20 nt, Artificial Sequence
  MKO10072064_B_Apoa5
  gRNA
agaagacccaccugcgagga

SEQ ID NO: 72065 - RNA, 20 nt, Artificial Sequence
  MKO10072065_B_Apoa5
  gRNA
gcauggcugcagucaucacu

SEQ ID NO: 72066 - RNA, 20 nt, Artificial Sequence
  MKO10072066_B_Apoa5
  gRNA
acuacuucagccaaaacagu

SEQ ID NO: 72067 - RNA, 20 nt, Artificial Sequence
  MKO10072067_B_Apobec1
  gRNA
auugugaaaaacgugaguug

SEQ ID NO: 72068 - RNA, 20 nt, Artificial Sequence
  MKO10072068_B_Apobec1
  gRNA
ggccaauaagcuucguuuga

SEQ ID NO: 72069 - RNA, 20 nt, Artificial Sequence
  MKO10072069_B_Apobec1
  gRNA
ggggugguauccuuugguaa

SEQ ID NO: 72070 - RNA, 20 nt, Artificial Sequence
  MKO10072070_B_Apobec2
  gRNA
ccgcccuucgagauugucac

SEQ ID NO: 72071 - RNA, 20 nt, Artificial Sequence
  MKO10072071_B_Apobec2
  gRNA
uaccuggaggaugaacacgc

SEQ ID NO: 72072 - RNA, 20 nt, Artificial Sequence
  MKO10072072_B_Apobec2
  gRNA
acguggaauacaguuccggg

SEQ ID NO: 72073 - RNA, 20 nt, Artificial Sequence
  MKO10072073_B_Apobec3
  gRNA
ucggugaauagcauuugcga

SEQ ID NO: 72074 - RNA, 20 nt, Artificial Sequence
  MKO10072074_B_Apobec3
  gRNA
aaguuccacuuuaagaaccu

SEQ ID NO: 72075 - RNA, 20 nt, Artificial Sequence
  MKO10072075_B_Apobec3
  gRNA
uccggccuuuggcauagccu

SEQ ID NO: 72076 - RNA, 20 nt, Artificial Sequence
  MKO10072076_B_Apobec4
  gRNA
agaucuaccgccaauucaug

SEQ ID NO: 72077 - RNA, 20 nt, Artificial Sequence
  MKO10072077_B_Apobec4
  gRNA
guuugaggguacguugacca

SEQ ID NO: 72078 - RNA, 20 nt, Artificial Sequence
  MKO10072078_B_Apobec4
  gRNA
gccaagaauuugccguuuac

SEQ ID NO: 72079 - RNA, 20 nt, Artificial Sequence
  MKO10072079_B_Apobr
  gRNA
gcaauccucucuucagcuag

SEQ ID NO: 72080 - RNA, 20 nt, Artificial Sequence
  MKO10072080_B_Apobr
  gRNA
ucgucucccugggcuacauc

SEQ ID NO: 72081 - RNA, 20 nt, Artificial Sequence
  MKO10072081_B_Apobr
  gRNA
agguuuggcuuugcucaucc

SEQ ID NO: 72082 - RNA, 20 nt, Artificial Sequence
  MKO10072082_B_Apob
  gRNA
ccguaccuuacaguugaucu

SEQ ID NO: 72083 - RNA, 20 nt, Artificial Sequence
  MKO10072083_B_Apob
  gRNA
caaccaguguacccuuaaag

SEQ ID NO: 72084 - RNA, 20 nt, Artificial Sequence
  MKO10072084_B_Apob
  gRNA
ugaagccauacaccucuuua

SEQ ID NO: 72085 - RNA, 20 nt, Artificial Sequence
  MKO10072085_B_Apoc1
  gRNA
ccaaagggccugguucucag

SEQ ID NO: 72086 - RNA, 20 nt, Artificial Sequence
  MKO10072086_B_Apoc1
  gRNA
cgcucuuccuguccugauug

SEQ ID NO: 72087 - RNA, 20 nt, Artificial Sequence
  MKO10072087_B_Apoc1
  gRNA
uuucuuaccuuccaagguca

SEQ ID NO: 72088 - RNA, 20 nt, Artificial Sequence
  MKO10072088_B_Apoc2
  gRNA
ggacauguacagcaaaagcu

SEQ ID NO: 72089 - RNA, 20 nt, Artificial Sequence
  MKO10072089_B_Apoc2
  gRNA
ucccagacagcauggggucu

SEQ ID NO: 72090 - RNA, 20 nt, Artificial Sequence
  MKO10072090_B_Apoc2
  gRNA
auuccuggucauccugaugu

SEQ ID NO: 72091 - RNA, 20 nt, Artificial Sequence
  MKO10072091_B_Apoc3
  gRNA
ccaucuuacgggcagaugcc

SEQ ID NO: 72092 - RNA, 20 nt, Artificial Sequence
  MKO10072092_B_Apoc3
  gRNA
acguaggugccaugcagccc

SEQ ID NO: 72093 - RNA, 20 nt, Artificial Sequence
  MKO10072093_B_Apoc3
  gRNA
acuugcuccaguagccuuuc

SEQ ID NO: 72094 - RNA, 20 nt, Artificial Sequence
  MKO10072094_B_Apoc4
  gRNA
gagacugauggcaggucccg

SEQ ID NO: 72095 - RNA, 20 nt, Artificial Sequence
  MKO10072095_B_Apoc4
  gRNA
agccacuggugaccagaacc

SEQ ID NO: 72096 - RNA, 20 nt, Artificial Sequence
  MKO10072096_B_Apoc4
  gRNA
gaaagccugagccccacgcc

SEQ ID NO: 72097 - RNA, 20 nt, Artificial Sequence
  MKO10072097_B_Apod
  gRNA
guucuccaucagcgaguagu

SEQ ID NO: 72098 - RNA, 20 nt, Artificial Sequence
  MKO10072098_B_Apod
  gRNA
aacagaucaagcgaacugcc

SEQ ID NO: 72099 - RNA, 20 nt, Artificial Sequence
  MKO10072099_B_Apod
  gRNA
gauaccuacacgggaagaac

SEQ ID NO: 72100 - RNA, 20 nt, Artificial Sequence
  MKO10072100_B_Apoe
  gRNA
gcuucugggauuaccugcgc

SEQ ID NO: 72101 - RNA, 20 nt, Artificial Sequence
  MKO10072101_B_Apoe
  gRNA
cuguuggucacauugcugac

SEQ ID NO: 72102 - RNA, 20 nt, Artificial Sequence
  MKO10072102_B_Apoe
  gRNA
cagcaaugugaccaacagca

SEQ ID NO: 72103 - RNA, 20 nt, Artificial Sequence
  MKO10072103_B_Apof
  gRNA
acccagauuaccauacaguc

SEQ ID NO: 72104 - RNA, 20 nt, Artificial Sequence
  MKO10072104_B_Apof
  gRNA
aucgaacguuuggcccucuu

SEQ ID NO: 72105 - RNA, 20 nt, Artificial Sequence
  MKO10072105_B_Apof
  gRNA
cagcuucagcuuuaccgauu

SEQ ID NO: 72106 - RNA, 20 nt, Artificial Sequence
  MKO10072106_B_Apoh
  gRNA
gccagaguauguccuuucgc

SEQ ID NO: 72107 - RNA, 20 nt, Artificial Sequence
  MKO10072107_B_Apoh
  gRNA
cuccgugcacuuagaugagc

SEQ ID NO: 72108 - RNA, 20 nt, Artificial Sequence
  MKO10072108_B_Apoh
  gRNA
gacugugucauuuccgauca

SEQ ID NO: 72109 - RNA, 20 nt, Artificial Sequence
  MKO10072109_B_Apol10a
  gRNA
auuucuuaagaacagaucug

SEQ ID NO: 72110 - RNA, 20 nt, Artificial Sequence
  MKO10072110_B_Apol10a
  gRNA
ggauuggaaugagaucuuag

SEQ ID NO: 72111 - RNA, 20 nt, Artificial Sequence
  MKO10072111_B_Apol10a
  gRNA
cucacucuuagugcugcuuc

SEQ ID NO: 72112 - RNA, 20 nt, Artificial Sequence
  MKO10072112_B_Apol10b
  gRNA
aaauucuaauggcuagagcu

SEQ ID NO: 72113 - RNA, 20 nt, Artificial Sequence
  MKO10072113_B_Apol10b
  gRNA
ugcucaacagaccucaagca

SEQ ID NO: 72114 - RNA, 20 nt, Artificial Sequence
  MKO10072114_B_Apol10b
  gRNA
aggaagcagcagaauuguca

SEQ ID NO: 72115 - RNA, 20 nt, Artificial Sequence
  MKO10072115_B_Apol11a
  gRNA
aguucuuaagaacagaucug

SEQ ID NO: 72116 - RNA, 20 nt, Artificial Sequence
  MKO10072116_B_Apol11a
  gRNA
ggauuggaaugagaucuuag

SEQ ID NO: 72117 - RNA, 20 nt, Artificial Sequence
  MKO10072117_B_Apol11a
  gRNA
cauaauacagauccuuugau

SEQ ID NO: 72118 - RNA, 20 nt, Artificial Sequence
  MKO10072118_B_Apol11b
  gRNA
augaccuugugaccaagcaa

SEQ ID NO: 72119 - RNA, 20 nt, Artificial Sequence
  MKO10072119_B_Apol11b
  gRNA
ggauuggaaugagaucucag

SEQ ID NO: 72120 - RNA, 20 nt, Artificial Sequence
  MKO10072120_B_Apol11b
  gRNA
aaacacuccugcucuaaucc

SEQ ID NO: 72121 - RNA, 20 nt, Artificial Sequence
  MKO10072121_B_Apol6
  gRNA
cgacugagagagcaagacuc

SEQ ID NO: 72122 - RNA, 20 nt, Artificial Sequence
  MKO10072122_B_Apol6
  gRNA
caccuuguuuccuuucaaag

SEQ ID NO: 72123 - RNA, 20 nt, Artificial Sequence
  MKO10072123_B_Apol6
  gRNA
aggcugaugcugaguugcua

SEQ ID NO: 72124 - RNA, 20 nt, Artificial Sequence
  MKO10072124_B_Apol7a
  gRNA
cucagcaagagauuccugca

SEQ ID NO: 72125 - RNA, 20 nt, Artificial Sequence
  MKO10072125_B_Apol7a
  gRNA
uuaacuaccuccuggacaca

SEQ ID NO: 72126 - RNA, 20 nt, Artificial Sequence
  MKO10072126_B_Apol7a
  gRNA
cuucugucagcaggagccgc

SEQ ID NO: 72127 - RNA, 20 nt, Artificial Sequence
  MKO10072127_B_Apol7b
  gRNA
gcagcugccaugggcacucc

SEQ ID NO: 72128 - RNA, 20 nt, Artificial Sequence
  MKO10072128_B_Apol7b
  gRNA
agaaugcuucauugagacug

SEQ ID NO: 72129 - RNA, 20 nt, Artificial Sequence
  MKO10072129_B_Apol7b
  gRNA
uucugccacaaaguguuucc

SEQ ID NO: 72130 - RNA, 20 nt, Artificial Sequence
  MKO10072130_B_Apol7c
  gRNA
ugaacuccaaauugaccugc

SEQ ID NO: 72131 - RNA, 20 nt, Artificial Sequence
  MKO10072131_B_Apol7c
  gRNA
gcagcuaucaugagcacccc

SEQ ID NO: 72132 - RNA, 20 nt, Artificial Sequence
  MKO10072132_B_Apol7c
  gRNA
aaagcgcuucauucccacug

SEQ ID NO: 72133 - RNA, 20 nt, Artificial Sequence
  MKO10072133_B_Apol7e
  gRNA
gcagcugccaugggcacccc

SEQ ID NO: 72134 - RNA, 20 nt, Artificial Sequence
  MKO10072134_B_Apol7e
  gRNA
uucugccacaaaguguuucc

SEQ ID NO: 72135 - RNA, 20 nt, Artificial Sequence
  MKO10072135_B_Apol7e
  gRNA
agaaugcuucauugagacug

SEQ ID NO: 72136 - RNA, 20 nt, Artificial Sequence
  MKO10072136_B_Apol8
  gRNA
caacucagcuuccgccacaa

SEQ ID NO: 72137 - RNA, 20 nt, Artificial Sequence
  MKO10072137_B_Apol8
  gRNA
cccugcccgaugugugcugc

SEQ ID NO: 72138 - RNA, 20 nt, Artificial Sequence
  MKO10072138_B_Apol8
  gRNA
ggggcauccucgcagucuga

SEQ ID NO: 72139 - RNA, 20 nt, Artificial Sequence
  MKO10072139_B_Apol9a
  gRNA
agacuccaucuucagccacc

SEQ ID NO: 72140 - RNA, 20 nt, Artificial Sequence
  MKO10072140_B_Apol9a
  gRNA
caggugcgggccagucugaa

SEQ ID NO: 72141 - RNA, 20 nt, Artificial Sequence
  MKO10072141_B_Apol9a
  gRNA
uguggauaggauugccagca

SEQ ID NO: 72142 - RNA, 20 nt, Artificial Sequence
  MKO10072142_B_Apol9b
  gRNA
uagcagugaccuggacaacu

SEQ ID NO: 72143 - RNA, 20 nt, Artificial Sequence
  MKO10072143_B_Apol9b
  gRNA
gauugucaacaagaucccuc

SEQ ID NO: 72144 - RNA, 20 nt, Artificial Sequence
  MKO10072144_B_Apol9b
  gRNA
ugccgcccucuggagugacg

SEQ ID NO: 72145 - RNA, 20 nt, Artificial Sequence
  MKO10072145_B_Apold1
  gRNA
ccucauccccagacgugccg

SEQ ID NO: 72146 - RNA, 20 nt, Artificial Sequence
  MKO10072146_B_Apold1
  gRNA
caacgcugcguccagaucag

SEQ ID NO: 72147 - RNA, 20 nt, Artificial Sequence
  MKO10072147_B_Apold1
  gRNA
ggauugcugcuggaccgccg

SEQ ID NO: 72148 - RNA, 20 nt, Artificial Sequence
  MKO10072148_B_Apom
  gRNA
cuguucuccagcucgugccc

SEQ ID NO: 72149 - RNA, 20 nt, Artificial Sequence
  MKO10072149_B_Apom
  gRNA
cacuguagaggagaaagcgc

SEQ ID NO: 72150 - RNA, 20 nt, Artificial Sequence
  MKO10072150_B_Apom
  gRNA
ggcuuugaaguccaagcaag

SEQ ID NO: 72151 - RNA, 20 nt, Artificial Sequence
  MKO10072151_B_Apon
  gRNA
cgugcaccuaugaacccggg

SEQ ID NO: 72152 - RNA, 20 nt, Artificial Sequence
  MKO10072152_B_Apon
  gRNA
aggccgugucuauccaaaau

SEQ ID NO: 72153 - RNA, 20 nt, Artificial Sequence
  MKO10072153_B_Apon
  gRNA
cauaucguacaacacccacc

SEQ ID NO: 72154 - RNA, 20 nt, Artificial Sequence
  MKO10072154_B_Apool
  gRNA
gcaccagccaauauaauaca

SEQ ID NO: 72155 - RNA, 20 nt, Artificial Sequence
  MKO10072155_B_Apool
  gRNA
agcuguaaucacucccauuu

SEQ ID NO: 72156 - RNA, 20 nt, Artificial Sequence
  MKO10072156_B_Apool
  gRNA
aaguugacaaccauaccugc

SEQ ID NO: 72157 - RNA, 20 nt, Artificial Sequence
  MKO10072157_B_Apoo
  gRNA
aaguuacaugaagaucgaug

SEQ ID NO: 72158 - RNA, 20 nt, Artificial Sequence
  MKO10072158_B_Apoo
  gRNA
accugacagaaacuuguaua

SEQ ID NO: 72159 - RNA, 20 nt, Artificial Sequence
  MKO10072159_B_Apoo
  gRNA
uucacucuacucaguuccug

SEQ ID NO: 72160 - RNA, 20 nt, Artificial Sequence
  MKO10072160_B_Apopt1
  gRNA
gguuauagcgcaugugcuuc

SEQ ID NO: 72161 - RNA, 20 nt, Artificial Sequence
  MKO10072161_B_Apopt1
  gRNA
agaagcacaugcgcuauaac

SEQ ID NO: 72162 - RNA, 20 nt, Artificial Sequence
  MKO10072162_B_Apopt1
  gRNA
cccugaaaacgagucucccu

SEQ ID NO: 72163 - RNA, 20 nt, Artificial Sequence
  MKO10072163_B_Appbp2
  gRNA
uacaugaugagaugcuccac

SEQ ID NO: 72164 - RNA, 20 nt, Artificial Sequence
  MKO10072164_B_Appbp2
  gRNA
cauguagcguacacaacuga

SEQ ID NO: 72165 - RNA, 20 nt, Artificial Sequence
  MKO10072165_B_Appbp2
  gRNA
cggcagugaauucugugaau

SEQ ID NO: 72166 - RNA, 20 nt, Artificial Sequence
  MKO10072166_B_Appl1
  gRNA
acuucaucaucaccccccaa

SEQ ID NO: 72167 - RNA, 20 nt, Artificial Sequence
  MKO10072167_B_Appl1
  gRNA
acuuaccucaucuaugaccu

SEQ ID NO: 72168 - RNA, 20 nt, Artificial Sequence
  MKO10072168_B_Appl1
  gRNA
ucagaucucuuucuuuaaac

SEQ ID NO: 72169 - RNA, 20 nt, Artificial Sequence
  MKO10072169_B_Appl2
  gRNA
caagcaacuggcagacacua

SEQ ID NO: 72170 - RNA, 20 nt, Artificial Sequence
  MKO10072170_B_Appl2
  gRNA
ucuuaccucauccaucacuu

SEQ ID NO: 72171 - RNA, 20 nt, Artificial Sequence
  MKO10072171_B_Appl2
  gRNA
cccacagaaugaaaugugcc

SEQ ID NO: 72172 - RNA, 20 nt, Artificial Sequence
  MKO10072172_B_App
  gRNA
gauugguaccucuuuggcga

SEQ ID NO: 72173 - RNA, 20 nt, Artificial Sequence
  MKO10072173_B_App
  gRNA
aagugggagucagacccguc

SEQ ID NO: 72174 - RNA, 20 nt, Artificial Sequence
  MKO10072174_B_App
  gRNA
ccgcuugcaccaguucugga

SEQ ID NO: 72175 - RNA, 20 nt, Artificial Sequence
  MKO10072175_B_Aprt
  gRNA
agcugaccucgcugaagggc

SEQ ID NO: 72176 - RNA, 20 nt, Artificial Sequence
  MKO10072176_B_Aprt
  gRNA
ccggcagcuuccccuguuuc

SEQ ID NO: 72177 - RNA, 20 nt, Artificial Sequence
  MKO10072177_B_Aprt
  gRNA
cacacuccaccacuucagcc

SEQ ID NO: 72178 - RNA, 20 nt, Artificial Sequence
  MKO10072178_B_Aptx
  gRNA
gcgaaucaaacuuccccauu

SEQ ID NO: 72179 - RNA, 20 nt, Artificial Sequence
  MKO10072179_B_Aptx
  gRNA
guugaaagcagaguguaaca

SEQ ID NO: 72180 - RNA, 20 nt, Artificial Sequence
  MKO10072180_B_Aptx
  gRNA
uuuaggaaucacugggccac

SEQ ID NO: 72181 - RNA, 20 nt, Artificial Sequence
  MKO10072181_B_Aqp11
  gRNA
uagaagaguucgucaaagca

SEQ ID NO: 72182 - RNA, 20 nt, Artificial Sequence
  MKO10072182_B_Aqp11
  gRNA
auuugauuguuaugcagcca

SEQ ID NO: 72183 - RNA, 20 nt, Artificial Sequence
  MKO10072183_B_Aqp11
  gRNA
ccaaguaccauuacgacgaa

SEQ ID NO: 72184 - RNA, 20 nt, Artificial Sequence
  MKO10072184_B_Aqp12
  gRNA
gcuuaccugcgacaggaccc

SEQ ID NO: 72185 - RNA, 20 nt, Artificial Sequence
  MKO10072185_B_Aqp12
  gRNA
guaugcccacguguacugcc

SEQ ID NO: 72186 - RNA, 20 nt, Artificial Sequence
  MKO10072186_B_Aqp12
  gRNA
accuggggacagcuuccccc

SEQ ID NO: 72187 - RNA, 20 nt, Artificial Sequence
  MKO10072187_B_Aqp1
  gRNA
caccuaagucucggcgccuc

SEQ ID NO: 72188 - RNA, 20 nt, Artificial Sequence
  MKO10072188_B_Aqp1
  gRNA
gaccggaggcgccgagacuu

SEQ ID NO: 72189 - RNA, 20 nt, Artificial Sequence
  MKO10072189_B_Aqp1
  gRNA
aucaacccugcccggucauu

SEQ ID NO: 72190 - RNA, 20 nt, Artificial Sequence
  MKO10072190_B_Aqp2
  gRNA
ccacguagaaggcagcucga

SEQ ID NO: 72191 - RNA, 20 nt, Artificial Sequence
  MKO10072191_B_Aqp2
  gRNA
ugagcgccgcagugacaacc

SEQ ID NO: 72192 - RNA, 20 nt, Artificial Sequence
  MKO10072192_B_Aqp2
  gRNA
caugaauccagcccgcuccc

SEQ ID NO: 72193 - RNA, 20 nt, Artificial Sequence
  MKO10072193_B_Aqp3
  gRNA
agagacgaaaagcucauugu

SEQ ID NO: 72194 - RNA, 20 nt, Artificial Sequence
  MKO10072194_B_Aqp3
  gRNA
ugauccagggcucucgugcc

SEQ ID NO: 72195 - RNA, 20 nt, Artificial Sequence
  MKO10072195_B_Aqp3
  gRNA
gcucagguggugcucagccg

SEQ ID NO: 72196 - RNA, 20 nt, Artificial Sequence
  MKO10072196_B_Aqp4
  gRNA
agaucgagcuggauucaugc

SEQ ID NO: 72197 - RNA, 20 nt, Artificial Sequence
  MKO10072197_B_Aqp4
  gRNA
gcuaccauggugcagugcuu

SEQ ID NO: 72198 - RNA, 20 nt, Artificial Sequence
  MKO10072198_B_Aqp4
  gRNA
accaguaacaucaguucguu

SEQ ID NO: 72199 - RNA, 20 nt, Artificial Sequence
  MKO10072199_B_Aqp5
  gRNA
ugccuggcgccaaccaguac

SEQ ID NO: 72200 - RNA, 20 nt, Artificial Sequence
  MKO10072200_B_Aqp5
  gRNA
aggcaaugcccgggguaacc

SEQ ID NO: 72201 - RNA, 20 nt, Artificial Sequence
  MKO10072201_B_Aqp5
  gRNA
augaacccagcccgaucuuu

SEQ ID NO: 72202 - RNA, 20 nt, Artificial Sequence
  MKO10072202_B_Aqp6
  gRNA
ugccacagagguuccaauca

SEQ ID NO: 72203 - RNA, 20 nt, Artificial Sequence
  MKO10072203_B_Aqp6
  gRNA
gcguccccagcugccaugau

SEQ ID NO: 72204 - RNA, 20 nt, Artificial Sequence
  MKO10072204_B_Aqp6
  gRNA
cagggccgaaggagcgggcu

SEQ ID NO: 72205 - RNA, 20 nt, Artificial Sequence
  MKO10072205_B_Aqp7
  gRNA
ggugccauuaaccacuuugc

SEQ ID NO: 72206 - RNA, 20 nt, Artificial Sequence
  MKO10072206_B_Aqp7
  gRNA
gaaguucccuguauaugugc

SEQ ID NO: 72207 - RNA, 20 nt, Artificial Sequence
  MKO10072207_B_Aqp7
  gRNA
cagagaugccgccugcuaca

SEQ ID NO: 72208 - RNA, 20 nt, Artificial Sequence
  MKO10072208_B_Aqp8
  gRNA
cuuugccaucguccaggagc

SEQ ID NO: 72209 - RNA, 20 nt, Artificial Sequence
  MKO10072209_B_Aqp8
  gRNA
cuucaacccugcugugucgc

SEQ ID NO: 72210 - RNA, 20 nt, Artificial Sequence
  MKO10072210_B_Aqp8
  gRNA
ccaugcugcuaauucccuau

SEQ ID NO: 72211 - RNA, 20 nt, Artificial Sequence
  MKO10072211_B_Aqp9
  gRNA
ggcacggauacaaaugguuu

SEQ ID NO: 72212 - RNA, 20 nt, Artificial Sequence
  MKO10072212_B_Aqp9
  gRNA
gucuucuauagacggacuca

SEQ ID NO: 72213 - RNA, 20 nt, Artificial Sequence
  MKO10072213_B_Aqp9
  gRNA
cacauugcaaaagacaccgc

SEQ ID NO: 72214 - RNA, 20 nt, Artificial Sequence
  MKO10072214_B_Aqr
  gRNA
aaaaagagaucgucaaauca

SEQ ID NO: 72215 - RNA, 20 nt, Artificial Sequence
  MKO10072215_B_Aqr
  gRNA
aaauaaugcugcuggaauuu

SEQ ID NO: 72216 - RNA, 20 nt, Artificial Sequence
  MKO10072216_B_Aqr
  gRNA
uuuaauguccaucugcugua

SEQ ID NO: 72217 - RNA, 20 nt, Artificial Sequence
  MKO10072217_B_Araf
  gRNA
acagugccaacugcccgaga

SEQ ID NO: 72218 - RNA, 20 nt, Artificial Sequence
  MKO10072218_B_Araf
  gRNA
gaaggugcggggucucaacc

SEQ ID NO: 72219 - RNA, 20 nt, Artificial Sequence
  MKO10072219_B_Araf
  gRNA
acagccauugcgccucugga

SEQ ID NO: 72220 - RNA, 20 nt, Artificial Sequence
  MKO10072220_B_Arap1
  gRNA
ugcuaggcauacuaucucgc

SEQ ID NO: 72221 - RNA, 20 nt, Artificial Sequence
  MKO10072221_B_Arap1
  gRNA
ggagaacggcuguaccuguu

SEQ ID NO: 72222 - RNA, 20 nt, Artificial Sequence
  MKO10072222_B_Arap1
  gRNA
ucccucuguguacaccucaa

SEQ ID NO: 72223 - RNA, 20 nt, Artificial Sequence
  MKO10072223_B_Arap2
  gRNA
uauccuuuaagcuccacgag

SEQ ID NO: 72224 - RNA, 20 nt, Artificial Sequence
  MKO10072224_B_Arap2
  gRNA
aagagaaaugucucuccgua

SEQ ID NO: 72225 - RNA, 20 nt, Artificial Sequence
  MKO10072225_B_Arap2
  gRNA
uccuccaaaagauucaaaug

SEQ ID NO: 72226 - RNA, 20 nt, Artificial Sequence
  MKO10072226_B_Arap3
  gRNA
acagucgccugagaacuauc

SEQ ID NO: 72227 - RNA, 20 nt, Artificial Sequence
  MKO10072227_B_Arap3
  gRNA
acaccguaguacaggcaacc

SEQ ID NO: 72228 - RNA, 20 nt, Artificial Sequence
  MKO10072228_B_Arap3
  gRNA
guacuacgguguccagccug

SEQ ID NO: 72229 - RNA, 20 nt, Artificial Sequence
  MKO10072229_B_Arcn1
  gRNA
ugaauauugccgagccuuag

SEQ ID NO: 72230 - RNA, 20 nt, Artificial Sequence
  MKO10072230_B_Arcn1
  gRNA
aguauuccgagcagucagag

SEQ ID NO: 72231 - RNA, 20 nt, Artificial Sequence
  MKO10072231_B_Arcn1
  gRNA
gcuuaccuuuccauauuaau

SEQ ID NO: 72232 - RNA, 20 nt, Artificial Sequence
  MKO10072232_B_Arc
  gRNA
uuggcggccggcccaccccg

SEQ ID NO: 72233 - RNA, 20 nt, Artificial Sequence
  MKO10072233_B_Arc
  gRNA
cacgcuugacccagcgcucc

SEQ ID NO: 72234 - RNA, 20 nt, Artificial Sequence
  MKO10072234_B_Arc
  gRNA
ccaucgccaaccuggagcgc

SEQ ID NO: 72235 - RNA, 20 nt, Artificial Sequence
  MKO10072235_B_Areg
  gRNA
augcagauacaucgagaacc

SEQ ID NO: 72236 - RNA, 20 nt, Artificial Sequence
  MKO10072236_B_Areg
  gRNA
gccaucauccucgcagcuau

SEQ ID NO: 72237 - RNA, 20 nt, Artificial Sequence
  MKO10072237_B_Areg
  gRNA
gccuuuggaaacgauacuuc

SEQ ID NO: 72238 - RNA, 20 nt, Artificial Sequence
  MKO10072238_B_Arel1
  gRNA
uucccuuacaugcacucgga

SEQ ID NO: 72239 - RNA, 20 nt, Artificial Sequence
  MKO10072239_B_Arel1
  gRNA
agaagucagugacguccaac

SEQ ID NO: 72240 - RNA, 20 nt, Artificial Sequence
  MKO10072240_B_Arel1
  gRNA
gucaaauucgccauuauuga

SEQ ID NO: 72241 - RNA, 20 nt, Artificial Sequence
  MKO10072241_B_Arf1
  gRNA
gcugcuuaccuuggguguuc

SEQ ID NO: 72242 - RNA, 20 nt, Artificial Sequence
  MKO10072242_B_Arf1
  gRNA
aauucuauacaaacuuaagc

SEQ ID NO: 72243 - RNA, 20 nt, Artificial Sequence
  MKO10072243_B_Arf1
  gRNA
ccgaaaucacagacaagcug

SEQ ID NO: 72244 - RNA, 20 nt, Artificial Sequence
  MKO10072244_B_Arf2
  gRNA
agaugggcuuuacgaaggcc

SEQ ID NO: 72245 - RNA, 20 nt, Artificial Sequence
  MKO10072245_B_Arf2
  gRNA
uucguaaagcccaucuccac

SEQ ID NO: 72246 - RNA, 20 nt, Artificial Sequence
  MKO10072246_B_Arf2
  gRNA
ugucgucuuagguuucaaug

SEQ ID NO: 72247 - RNA, 20 nt, Artificial Sequence
  MKO10072247_B_Arf3
  gRNA
cucuccaggcuugauauuug

SEQ ID NO: 72248 - RNA, 20 nt, Artificial Sequence
  MKO10072248_B_Arf3
  gRNA
uggccugaauguaccaauug

SEQ ID NO: 72249 - RNA, 20 nt, Artificial Sequence
  MKO10072249_B_Arf3
  gRNA
gucaccaccaucccgaccau

SEQ ID NO: 72250 - RNA, 20 nt, Artificial Sequence
  MKO10072250_B_Arf4
  gRNA
gauccuguuuguuugcaaaa

SEQ ID NO: 72251 - RNA, 20 nt, Artificial Sequence
  MKO10072251_B_Arf4
  gRNA
gcauuacuuccagaauaccc

SEQ ID NO: 72252 - RNA, 20 nt, Artificial Sequence
  MKO10072252_B_Arf4
  gRNA
gucaccaccauuccuaccau

SEQ ID NO: 72253 - RNA, 20 nt, Artificial Sequence
  MKO10072253_B_Arf5
  gRNA
acagaggccgaaucuuaucc

SEQ ID NO: 72254 - RNA, 20 nt, Artificial Sequence
  MKO10072254_B_Arf5
  gRNA
cccccaacuucaguuuguac

SEQ ID NO: 72255 - RNA, 20 nt, Artificial Sequence
  MKO10072255_B_Arf5
  gRNA
ggaguucaucagcagacucc

SEQ ID NO: 72256 - RNA, 20 nt, Artificial Sequence
  MKO10072256_B_Arf6
  gRNA
cucuggcggcauuacuacac

SEQ ID NO: 72257 - RNA, 20 nt, Artificial Sequence
  MKO10072257_B_Arf6
  gRNA
uugucuugccggcugcgucc

SEQ ID NO: 72258 - RNA, 20 nt, Artificial Sequence
  MKO10072258_B_Arf6
  gRNA
aacugggccugacccggauu

SEQ ID NO: 72259 - RNA, 20 nt, Artificial Sequence
  MKO10072259_B_Arfgap1
  gRNA
ucuuaaggaaguccgggcac

SEQ ID NO: 72260 - RNA, 20 nt, Artificial Sequence
  MKO10072260_B_Arfgap1
  gRNA
cagugggucagcgugacuua

SEQ ID NO: 72261 - RNA, 20 nt, Artificial Sequence
  MKO10072261_B_Arfgap1
  gRNA
aucuuguuagguggcuacuu

SEQ ID NO: 72262 - RNA, 20 nt, Artificial Sequence
  MKO10072262_B_Arfgap2
  gRNA
ccuaccugauaaagcugaga

SEQ ID NO: 72263 - RNA, 20 nt, Artificial Sequence
  MKO10072263_B_Arfgap2
  gRNA
uguacacagguccacagagu

SEQ ID NO: 72264 - RNA, 20 nt, Artificial Sequence
  MKO10072264_B_Arfgap2
  gRNA
gaagucucuuaaaaauaguc

SEQ ID NO: 72265 - RNA, 20 nt, Artificial Sequence
  MKO10072265_B_Arfgap3
  gRNA
cccuguagagcugagccgca

SEQ ID NO: 72266 - RNA, 20 nt, Artificial Sequence
  MKO10072266_B_Arfgap3
  gRNA
guacuuggcguugguguccu

SEQ ID NO: 72267 - RNA, 20 nt, Artificial Sequence
  MKO10072267_B_Arfgap3
  gRNA
aaacaccccauagcuuaugc

SEQ ID NO: 72268 - RNA, 20 nt, Artificial Sequence
  MKO10072268_B_Arfgef1
  gRNA
ggacuggcaugccaacucaa

SEQ ID NO: 72269 - RNA, 20 nt, Artificial Sequence
  MKO10072269_B_Arfgef1
  gRNA
cuugcagcacaguuccuuca

SEQ ID NO: 72270 - RNA, 20 nt, Artificial Sequence
  MKO10072270_B_Arfgef1
  gRNA
aguucaguugcagauaauaa

SEQ ID NO: 72271 - RNA, 20 nt, Artificial Sequence
  MKO10072271_B_Arfgef2
  gRNA
guauuuccuuccauucgagc

SEQ ID NO: 72272 - RNA, 20 nt, Artificial Sequence
  MKO10072272_B_Arfgef2
  gRNA
uuucccuaggcuuggcgcug

SEQ ID NO: 72273 - RNA, 20 nt, Artificial Sequence
  MKO10072273_B_Arfgef2
  gRNA
gugcagaaacucaucgcaua

SEQ ID NO: 72274 - RNA, 20 nt, Artificial Sequence
  MKO10072274_B_Arfip1
  gRNA
cagucagaucaccugcuugc

SEQ ID NO: 72275 - RNA, 20 nt, Artificial Sequence
  MKO10072275_B_Arfip1
  gRNA
guuucucagauauaauuugc

SEQ ID NO: 72276 - RNA, 20 nt, Artificial Sequence
  MKO10072276_B_Arfip1
  gRNA
auuucaucugcuagaauaac

SEQ ID NO: 72277 - RNA, 20 nt, Artificial Sequence
  MKO10072277_B_Arfip2
  gRNA
caccucgucaccagggccag

SEQ ID NO: 72278 - RNA, 20 nt, Artificial Sequence
  MKO10072278_B_Arfip2
  gRNA
cagcuguuaucagagagauu

SEQ ID NO: 72279 - RNA, 20 nt, Artificial Sequence
  MKO10072279_B_Arfip2
  gRNA
gugcaugcugggucugcaac

SEQ ID NO: 72280 - RNA, 20 nt, Artificial Sequence
  MKO10072280_B_Arfrp1
  gRNA
cgguguucccauccuggugu

SEQ ID NO: 72281 - RNA, 20 nt, Artificial Sequence
  MKO10072281_B_Arfrp1
  gRNA
uaguacuaugcagagugcca

SEQ ID NO: 72282 - RNA, 20 nt, Artificial Sequence
  MKO10072282_B_Arfrp1
  gRNA
uugauuccacugaugaagaa

SEQ ID NO: 72283 - RNA, 20 nt, Artificial Sequence
  MKO10072283_B_Arg1
  gRNA
cuguucuucagccucgagga

SEQ ID NO: 72284 - RNA, 20 nt, Artificial Sequence
  MKO10072284_B_Arg1
  gRNA
uggguucuucacaauuugaa

SEQ ID NO: 72285 - RNA, 20 nt, Artificial Sequence
  MKO10072285_B_Arg1
  gRNA
cauccacccaaaugacacau

SEQ ID NO: 72286 - RNA, 20 nt, Artificial Sequence
  MKO10072286_B_Arg2
  gRNA
uuggcaaggcccacugaacg

SEQ ID NO: 72287 - RNA, 20 nt, Artificial Sequence
  MKO10072287_B_Arg2
  gRNA
ccaauguacacaauauuugg

SEQ ID NO: 72288 - RNA, 20 nt, Artificial Sequence
  MKO10072288_B_Arg2
  gRNA
ccagcugccauucgagaagc

SEQ ID NO: 72289 - RNA, 20 nt, Artificial Sequence
  MKO10072289_B_Arglu1
  gRNA
ugaagaagccaaacgcauca

SEQ ID NO: 72290 - RNA, 20 nt, Artificial Sequence
  MKO10072290_B_Arglu1
  gRNA
guccuucucacuaaaaaccc

SEQ ID NO: 72291 - RNA, 20 nt, Artificial Sequence
  MKO10072291_B_Arglu1
  gRNA
gccuggacuuccccuugccc

SEQ ID NO: 72292 - RNA, 20 nt, Artificial Sequence
  MKO10072292_B_Arhgap10
  gRNA
gacuucaaguucgaguuuau

SEQ ID NO: 72293 - RNA, 20 nt, Artificial Sequence
  MKO10072293_B_Arhgap10
  gRNA
gaaggacucacacuugcagg

SEQ ID NO: 72294 - RNA, 20 nt, Artificial Sequence
  MKO10072294_B_Arhgap10
  gRNA
ugaaacccugauuaaacccu

SEQ ID NO: 72295 - RNA, 20 nt, Artificial Sequence
  MKO10072295_B_Arhgap11a
  gRNA
auuguugcugucgugucuua

SEQ ID NO: 72296 - RNA, 20 nt, Artificial Sequence
  MKO10072296_B_Arhgap11a
  gRNA
ucacuugucugaagaagauu

SEQ ID NO: 72297 - RNA, 20 nt, Artificial Sequence
  MKO10072297_B_Arhgap11a
  gRNA
cauucagucguuccagaauu

SEQ ID NO: 72298 - RNA, 20 nt, Artificial Sequence
  MKO10072298_B_Arhgap12
  gRNA
cuacuauaaccgcacaaccc

SEQ ID NO: 72299 - RNA, 20 nt, Artificial Sequence
  MKO10072299_B_Arhgap12
  gRNA
guauaccagugacuauacua

SEQ ID NO: 72300 - RNA, 20 nt, Artificial Sequence
  MKO10072300_B_Arhgap12
  gRNA
caguauuacuacagcgcaga

SEQ ID NO: 72301 - RNA, 20 nt, Artificial Sequence
  MKO10072301_B_Arhgap15
  gRNA
ucacuuacuggauguucuag

SEQ ID NO: 72302 - RNA, 20 nt, Artificial Sequence
  MKO10072302_B_Arhgap15
  gRNA
aauucugcccaccaagcuac

SEQ ID NO: 72303 - RNA, 20 nt, Artificial Sequence
  MKO10072303_B_Arhgap15
  gRNA
ugcagauuucccggcacaga

SEQ ID NO: 72304 - RNA, 20 nt, Artificial Sequence
  MKO10072304_B_Arhgap17
  gRNA
auucaaccgcaugaagcagc

SEQ ID NO: 72305 - RNA, 20 nt, Artificial Sequence
  MKO10072305_B_Arhgap17
  gRNA
cugaagccuccugcauguuc

SEQ ID NO: 72306 - RNA, 20 nt, Artificial Sequence
  MKO10072306_B_Arhgap17
  gRNA
agcucuugcccagaacaugc

SEQ ID NO: 72307 - RNA, 20 nt, Artificial Sequence
  MKO10072307_B_Arhgap18
  gRNA
ugucucugacgucacgaaug

SEQ ID NO: 72308 - RNA, 20 nt, Artificial Sequence
  MKO10072308_B_Arhgap18
  gRNA
cuccuagaucagccaucuag

SEQ ID NO: 72309 - RNA, 20 nt, Artificial Sequence
  MKO10072309_B_Arhgap18
  gRNA
cuaucgacagccccacuaga

SEQ ID NO: 72310 - RNA, 20 nt, Artificial Sequence
  MKO10072310_B_Arhgap19
  gRNA
gugcugagcagacuugcgag

SEQ ID NO: 72311 - RNA, 20 nt, Artificial Sequence
  MKO10072311_B_Arhgap19
  gRNA
uaacgggacugauauugacu

SEQ ID NO: 72312 - RNA, 20 nt, Artificial Sequence
  MKO10072312_B_Arhgap19
  gRNA
ugcaaugacucuccccuucg

SEQ ID NO: 72313 - RNA, 20 nt, Artificial Sequence
  MKO10072313_B_Arhgap1
  gRNA
gcugcaagaugaccugacgc

SEQ ID NO: 72314 - RNA, 20 nt, Artificial Sequence
  MKO10072314_B_Arhgap1
  gRNA
augccagacuuccccaaguc

SEQ ID NO: 72315 - RNA, 20 nt, Artificial Sequence
  MKO10072315_B_Arhgap1
  gRNA
caccagauuguggaaguagc

SEQ ID NO: 72316 - RNA, 20 nt, Artificial Sequence
  MKO10072316_B_Arhgap20
  gRNA
agucgcacucugcugauuga

SEQ ID NO: 72317 - RNA, 20 nt, Artificial Sequence
  MKO10072317_B_Arhgap20
  gRNA
cuggcccaccgugaacuuug

SEQ ID NO: 72318 - RNA, 20 nt, Artificial Sequence
  MKO10072318_B_Arhgap20
  gRNA
ugcucagaaguccuuugucc

SEQ ID NO: 72319 - RNA, 20 nt, Artificial Sequence
  MKO10072319_B_Arhgap21
  gRNA
cugaagaugagccauucucc

SEQ ID NO: 72320 - RNA, 20 nt, Artificial Sequence
  MKO10072320_B_Arhgap21
  gRNA
cuggcuuaccucacaggcag

SEQ ID NO: 72321 - RNA, 20 nt, Artificial Sequence
  MKO10072321_B_Arhgap21
  gRNA
cucucaccuuauaugaaaac

SEQ ID NO: 72322 - RNA, 20 nt, Artificial Sequence
  MKO10072322_B_Arhgap22
  gRNA
gcacuguguccucuagccgc

SEQ ID NO: 72323 - RNA, 20 nt, Artificial Sequence
  MKO10072323_B_Arhgap22
  gRNA
cagcgaugguuugugcuacg

SEQ ID NO: 72324 - RNA, 20 nt, Artificial Sequence
  MKO10072324_B_Arhgap22
  gRNA
ggggaccaaacuuccgcuca

SEQ ID NO: 72325 - RNA, 20 nt, Artificial Sequence
  MKO10072325_B_Arhgap23
  gRNA
agagguugagugucguuuag

SEQ ID NO: 72326 - RNA, 20 nt, Artificial Sequence
  MKO10072326_B_Arhgap23
  gRNA
gcgaggaugggcuaguuccc

SEQ ID NO: 72327 - RNA, 20 nt, Artificial Sequence
  MKO10072327_B_Arhgap23
  gRNA
ccucagccgccauuacuccc

SEQ ID NO: 72328 - RNA, 20 nt, Artificial Sequence
  MKO10072328_B_Arhgap24
  gRNA
cgacgggcucuggaaguucu

SEQ ID NO: 72329 - RNA, 20 nt, Artificial Sequence
  MKO10072329_B_Arhgap24
  gRNA
aguccauccgccgagucaua

SEQ ID NO: 72330 - RNA, 20 nt, Artificial Sequence
  MKO10072330_B_Arhgap24
  gRNA
cugcgccacgcugcucagua

SEQ ID NO: 72331 - RNA, 20 nt, Artificial Sequence
  MKO10072331_B_Arhgap25
  gRNA
gggagcggcccuccuuugac

SEQ ID NO: 72332 - RNA, 20 nt, Artificial Sequence
  MKO10072332_B_Arhgap25
  gRNA
agagguccaucgugaaaaac

SEQ ID NO: 72333 - RNA, 20 nt, Artificial Sequence
  MKO10072333_B_Arhgap25
  gRNA
aaaggccaauuaaggugggc

SEQ ID NO: 72334 - RNA, 20 nt, Artificial Sequence
  MKO10072334_B_Arhgap26
  gRNA
acagaugaugagauguguau

SEQ ID NO: 72335 - RNA, 20 nt, Artificial Sequence
  MKO10072335_B_Arhgap26
  gRNA
acacaucucaucaucuguuu

SEQ ID NO: 72336 - RNA, 20 nt, Artificial Sequence
  MKO10072336_B_Arhgap26
  gRNA
gcucccuuaccuccuguagc

SEQ ID NO: 72337 - RNA, 20 nt, Artificial Sequence
  MKO10072337_B_Arhgap27
  gRNA
aauucgggguagucuguuuc

SEQ ID NO: 72338 - RNA, 20 nt, Artificial Sequence
  MKO10072338_B_Arhgap27
  gRNA
guguccacaguggguaaggu

SEQ ID NO: 72339 - RNA, 20 nt, Artificial Sequence
  MKO10072339_B_Arhgap27
  gRNA
ggguagcucccacugaacag

SEQ ID NO: 72340 - RNA, 20 nt, Artificial Sequence
  MKO10072340_B_Arhgap28
  gRNA
cuacugagagaagcaucguc

SEQ ID NO: 72341 - RNA, 20 nt, Artificial Sequence
  MKO10072341_B_Arhgap28
  gRNA
aaaagaauaaacaacccguc

SEQ ID NO: 72342 - RNA, 20 nt, Artificial Sequence
  MKO10072342_B_Arhgap28
  gRNA
ggauugucaacucugaucuc

SEQ ID NO: 72343 - RNA, 20 nt, Artificial Sequence
  MKO10072343_B_Arhgap29
  gRNA
accuauuucucgagaaagua

SEQ ID NO: 72344 - RNA, 20 nt, Artificial Sequence
  MKO10072344_B_Arhgap29
  gRNA
guggacuuaccccaugaaaa

SEQ ID NO: 72345 - RNA, 20 nt, Artificial Sequence
  MKO10072345_B_Arhgap29
  gRNA
aaaugccaauguuucaaugg

SEQ ID NO: 72346 - RNA, 20 nt, Artificial Sequence
  MKO10072346_B_Arhgap30
  gRNA
gaugggaucuaccgccucuc

SEQ ID NO: 72347 - RNA, 20 nt, Artificial Sequence
  MKO10072347_B_Arhgap30
  gRNA
aacucccuauccaaaacuac

SEQ ID NO: 72348 - RNA, 20 nt, Artificial Sequence
  MKO10072348_B_Arhgap30
  gRNA
ugucauagagccgauaagug

SEQ ID NO: 72349 - RNA, 20 nt, Artificial Sequence
  MKO10072349_B_Arhgap31
  gRNA
ugugggccaggugucgaauc

SEQ ID NO: 72350 - RNA, 20 nt, Artificial Sequence
  MKO10072350_B_Arhgap31
  gRNA
gaauuucucauagagcucgu

SEQ ID NO: 72351 - RNA, 20 nt, Artificial Sequence
  MKO10072351_B_Arhgap31
  gRNA
uguuguuccaggcaagaguu

SEQ ID NO: 72352 - RNA, 20 nt, Artificial Sequence
  MKO10072352_B_Arhgap32
  gRNA
ggggagcaccuccucaauuc

SEQ ID NO: 72353 - RNA, 20 nt, Artificial Sequence
  MKO10072353_B_Arhgap32
  gRNA
augacuuaccuauagugugg

SEQ ID NO: 72354 - RNA, 20 nt, Artificial Sequence
  MKO10072354_B_Arhgap32
  gRNA
aacuccccccaccacacuau

SEQ ID NO: 72355 - RNA, 20 nt, Artificial Sequence
  MKO10072355_B_Arhgap33
  gRNA
ccaggcuuccccuuuguacc

SEQ ID NO: 72356 - RNA, 20 nt, Artificial Sequence
  MKO10072356_B_Arhgap33
  gRNA
uccaggcucucagcuccucg

SEQ ID NO: 72357 - RNA, 20 nt, Artificial Sequence
  MKO10072357_B_Arhgap33
  gRNA
cacuaugagaauguugacuu

SEQ ID NO: 72358 - RNA, 20 nt, Artificial Sequence
  MKO10072358_B_Arhgap36
  gRNA
gacugcuuaccacgaacucg

SEQ ID NO: 72359 - RNA, 20 nt, Artificial Sequence
  MKO10072359_B_Arhgap36
  gRNA
ucccagcuuucaucgccuau

SEQ ID NO: 72360 - RNA, 20 nt, Artificial Sequence
  MKO10072360_B_Arhgap36
  gRNA
ugcagauagcgcagaugaac

SEQ ID NO: 72361 - RNA, 20 nt, Artificial Sequence
  MKO10072361_B_Arhgap39
  gRNA
aagccaucaugucgaugagc

SEQ ID NO: 72362 - RNA, 20 nt, Artificial Sequence
  MKO10072362_B_Arhgap39
  gRNA
auaggaccuccucacugcga

SEQ ID NO: 72363 - RNA, 20 nt, Artificial Sequence
  MKO10072363_B_Arhgap39
  gRNA
agggaguaggugcccccgcc

SEQ ID NO: 72364 - RNA, 20 nt, Artificial Sequence
  MKO10072364_B_Arhgap40
  gRNA
uugcuaggaucagcagaacc

SEQ ID NO: 72365 - RNA, 20 nt, Artificial Sequence
  MKO10072365_B_Arhgap40
  gRNA
ggcagaagccagcuccuaga

SEQ ID NO: 72366 - RNA, 20 nt, Artificial Sequence
  MKO10072366_B_Arhgap40
  gRNA
agaguccucagaguugaucu

SEQ ID NO: 72367 - RNA, 20 nt, Artificial Sequence
  MKO10072367_B_Arhgap42
  gRNA
cauagaaguucugauguucu

SEQ ID NO: 72368 - RNA, 20 nt, Artificial Sequence
  MKO10072368_B_Arhgap42
  gRNA
aaauuucgaaaagaacagau

SEQ ID NO: 72369 - RNA, 20 nt, Artificial Sequence
  MKO10072369_B_Arhgap42
  gRNA
ucuucuucucuugaacuucu

SEQ ID NO: 72370 - RNA, 20 nt, Artificial Sequence
  MKO10072370_B_Arhgap44
  gRNA
gguggagaagcgccuagagc

SEQ ID NO: 72371 - RNA, 20 nt, Artificial Sequence
  MKO10072371_B_Arhgap44
  gRNA
gauccacuuugagcugcaag

SEQ ID NO: 72372 - RNA, 20 nt, Artificial Sequence
  MKO10072372_B_Arhgap44
  gRNA
gacggaggacaagcuagcuc

SEQ ID NO: 72373 - RNA, 20 nt, Artificial Sequence
  MKO10072373_B_Arhgap4
  gRNA
acuccaguucuaccuccgcc

SEQ ID NO: 72374 - RNA, 20 nt, Artificial Sequence
  MKO10072374_B_Arhgap4
  gRNA
caucuucgcugaugugacuu

SEQ ID NO: 72375 - RNA, 20 nt, Artificial Sequence
  MKO10072375_B_Arhgap4
  gRNA
gggcccugucucaacggugg

SEQ ID NO: 72376 - RNA, 20 nt, Artificial Sequence
  MKO10072376_B_Arhgap5
  gRNA
cugaauacaucauaguuuac

SEQ ID NO: 72377 - RNA, 20 nt, Artificial Sequence
  MKO10072377_B_Arhgap5
  gRNA
uucacuccacccagagcuau

SEQ ID NO: 72378 - RNA, 20 nt, Artificial Sequence
  MKO10072378_B_Arhgap5
  gRNA
augugauaacacaucuaaac

SEQ ID NO: 72379 - RNA, 20 nt, Artificial Sequence
  MKO10072379_B_Arhgap6
  gRNA
ccuugcagaauucaucccac

SEQ ID NO: 72380 - RNA, 20 nt, Artificial Sequence
  MKO10072380_B_Arhgap6
  gRNA
gcgggcacgacugcaggaag

SEQ ID NO: 72381 - RNA, 20 nt, Artificial Sequence
  MKO10072381_B_Arhgap6
  gRNA
guugucauccagaucaguga

SEQ ID NO: 72382 - RNA, 20 nt, Artificial Sequence
  MKO10072382_B_Arhgap8
  gRNA
cuuccggucaaacuccuugu

SEQ ID NO: 72383 - RNA, 20 nt, Artificial Sequence
  MKO10072383_B_Arhgap8
  gRNA
guacaacguacagugccuuc

SEQ ID NO: 72384 - RNA, 20 nt, Artificial Sequence
  MKO10072384_B_Arhgap8
  gRNA
gcucaaccaccagcgccugc

SEQ ID NO: 72385 - RNA, 20 nt, Artificial Sequence
  MKO10072385_B_Arhgap9
  gRNA
gccucagccaaagcguccca

SEQ ID NO: 72386 - RNA, 20 nt, Artificial Sequence
  MKO10072386_B_Arhgap9
  gRNA
ccaguuaacaccacccaagc

SEQ ID NO: 72387 - RNA, 20 nt, Artificial Sequence
  MKO10072387_B_Arhgap9
  gRNA
gcgcccuccuugagcaaucu

SEQ ID NO: 72388 - RNA, 20 nt, Artificial Sequence
  MKO10072388_B_Arhgdia
  gRNA
uggggcagugcugcauacca

SEQ ID NO: 72389 - RNA, 20 nt, Artificial Sequence
  MKO10072389_B_Arhgdia
  gRNA
gaaacagucguuugucuuga

SEQ ID NO: 72390 - RNA, 20 nt, Artificial Sequence
  MKO10072390_B_Arhgdia
  gRNA
accggauaaaaaucucuuuc

SEQ ID NO: 72391 - RNA, 20 nt, Artificial Sequence
  MKO10072391_B_Arhgdib
  gRNA
gugaggaauucguacuccuc

SEQ ID NO: 72392 - RNA, 20 nt, Artificial Sequence
  MKO10072392_B_Arhgdib
  gRNA
uucccaacgugacuguuacc

SEQ ID NO: 72393 - RNA, 20 nt, Artificial Sequence
  MKO10072393_B_Arhgdib
  gRNA
ucuuaccucucaugccaguc

SEQ ID NO: 72394 - RNA, 20 nt, Artificial Sequence
  MKO10072394_B_Arhgdig
  gRNA
cagccuagucaccugcacgu

SEQ ID NO: 72395 - RNA, 20 nt, Artificial Sequence
  MKO10072395_B_Arhgdig
  gRNA
ucguccagcaccucaucuga

SEQ ID NO: 72396 - RNA, 20 nt, Artificial Sequence
  MKO10072396_B_Arhgdig
  gRNA
ggcuccagggccuaucauca

SEQ ID NO: 72397 - RNA, 20 nt, Artificial Sequence
  MKO10072397_B_Arhgef10l
  gRNA
cugugucccucucaggggcg

SEQ ID NO: 72398 - RNA, 20 nt, Artificial Sequence
  MKO10072398_B_Arhgef10l
  gRNA
cucacuuacucugucugggg

SEQ ID NO: 72399 - RNA, 20 nt, Artificial Sequence
  MKO10072399_B_Arhgef10l
  gRNA
acaguaccuauggcaggcug

SEQ ID NO: 72400 - RNA, 20 nt, Artificial Sequence
  MKO10072400_B_Arhgef10
  gRNA
guggggaccacaaguuucgc

SEQ ID NO: 72401 - RNA, 20 nt, Artificial Sequence
  MKO10072401_B_Arhgef10
  gRNA
gugcaauucccuaagcuccg

SEQ ID NO: 72402 - RNA, 20 nt, Artificial Sequence
  MKO10072402_B_Arhgef10
  gRNA
ggucccuuaccugcaggaac

SEQ ID NO: 72403 - RNA, 20 nt, Artificial Sequence
  MKO10072403_B_Arhgef11
  gRNA
cuggugcagucugugcgccc

SEQ ID NO: 72404 - RNA, 20 nt, Artificial Sequence
  MKO10072404_B_Arhgef11
  gRNA
ugauaagcuucacuaccucc

SEQ ID NO: 72405 - RNA, 20 nt, Artificial Sequence
  MKO10072405_B_Arhgef11
  gRNA
ggaggcgcagccaugagagc

SEQ ID NO: 72406 - RNA, 20 nt, Artificial Sequence
  MKO10072406_B_Arhgef12
  gRNA
uuccccucaaaaaaccuaua

SEQ ID NO: 72407 - RNA, 20 nt, Artificial Sequence
  MKO10072407_B_Arhgef12
  gRNA
gaagacaaagucuaguucag

SEQ ID NO: 72408 - RNA, 20 nt, Artificial Sequence
  MKO10072408_B_Arhgef12
  gRNA
acuuucuguuucuuaucugu

SEQ ID NO: 72409 - RNA, 20 nt, Artificial Sequence
  MKO10072409_B_Arhgef15
  gRNA
acuggagggugacugaugac

SEQ ID NO: 72410 - RNA, 20 nt, Artificial Sequence
  MKO10072410_B_Arhgef15
  gRNA
aguucgguaccuucccucca

SEQ ID NO: 72411 - RNA, 20 nt, Artificial Sequence
  MKO10072411_B_Arhgef15
  gRNA
gaaugcucccccuguagccu

SEQ ID NO: 72412 - RNA, 20 nt, Artificial Sequence
  MKO10072412_B_Arhgef16
  gRNA
ccaucguggucaagagcuau

SEQ ID NO: 72413 - RNA, 20 nt, Artificial Sequence
  MKO10072413_B_Arhgef16
  gRNA
agagguggugguguuccguc

SEQ ID NO: 72414 - RNA, 20 nt, Artificial Sequence
  MKO10072414_B_Arhgef16
  gRNA
gagggccacuaugacccaga

SEQ ID NO: 72415 - RNA, 20 nt, Artificial Sequence
  MKO10072415_B_Arhgef17
  gRNA
aaucccacgcuaugagcuuc

SEQ ID NO: 72416 - RNA, 20 nt, Artificial Sequence
  MKO10072416_B_Arhgef17
  gRNA
uucaccagaagcucauagcg

SEQ ID NO: 72417 - RNA, 20 nt, Artificial Sequence
  MKO10072417_B_Arhgef17
  gRNA
ugauaacuuccucaaugcaa

SEQ ID NO: 72418 - RNA, 20 nt, Artificial Sequence
  MKO10072418_B_Arhgef18
  gRNA
acugaccgacugcaucauug

SEQ ID NO: 72419 - RNA, 20 nt, Artificial Sequence
  MKO10072419_B_Arhgef18
  gRNA
gaaaacagacucagcauucg

SEQ ID NO: 72420 - RNA, 20 nt, Artificial Sequence
  MKO10072420_B_Arhgef18
  gRNA
aaauacgcuguguucuguag

SEQ ID NO: 72421 - RNA, 20 nt, Artificial Sequence
  MKO10072421_B_Arhgef19
  gRNA
gucgaucuaaacgaggucca

SEQ ID NO: 72422 - RNA, 20 nt, Artificial Sequence
  MKO10072422_B_Arhgef19
  gRNA
cacgcaagacaagccgacuc

SEQ ID NO: 72423 - RNA, 20 nt, Artificial Sequence
  MKO10072423_B_Arhgef19
  gRNA
acccuuagggcgcaagaugc

SEQ ID NO: 72424 - RNA, 20 nt, Artificial Sequence
  MKO10072424_B_Arhgef1
  gRNA
aucucaccgcagucuucucc

SEQ ID NO: 72425 - RNA, 20 nt, Artificial Sequence
  MKO10072425_B_Arhgef1
  gRNA
aggccagaccggggaggccc

SEQ ID NO: 72426 - RNA, 20 nt, Artificial Sequence
  MKO10072426_B_Arhgef1
  gRNA
cuggagaugggagaagucgc

SEQ ID NO: 72427 - RNA, 20 nt, Artificial Sequence
  MKO10072427_B_Arhgef25
  gRNA
cucuguccagaacuggacgc

SEQ ID NO: 72428 - RNA, 20 nt, Artificial Sequence
  MKO10072428_B_Arhgef25
  gRNA
gacagagagugauuguaucg

SEQ ID NO: 72429 - RNA, 20 nt, Artificial Sequence
  MKO10072429_B_Arhgef25
  gRNA
cuauucuauugccgucagug

SEQ ID NO: 72430 - RNA, 20 nt, Artificial Sequence
  MKO10072430_B_Arhgef26
  gRNA
auacaaugacuaagaccgag

SEQ ID NO: 72431 - RNA, 20 nt, Artificial Sequence
  MKO10072431_B_Arhgef26
  gRNA
gcugucucagacagugagcc

SEQ ID NO: 72432 - RNA, 20 nt, Artificial Sequence
  MKO10072432_B_Arhgef26
  gRNA
caaggaacauuugaugggga

SEQ ID NO: 72433 - RNA, 20 nt, Artificial Sequence
  MKO10072433_B_Arhgef28
  gRNA
cguguaucuacccgaagaug

SEQ ID NO: 72434 - RNA, 20 nt, Artificial Sequence
  MKO10072434_B_Arhgef28
  gRNA
caaacggggucagcagcguc

SEQ ID NO: 72435 - RNA, 20 nt, Artificial Sequence
  MKO10072435_B_Arhgef28
  gRNA
cacucaggcugaccgacuca

SEQ ID NO: 72436 - RNA, 20 nt, Artificial Sequence
  MKO10072436_B_Arhgef2
  gRNA
gguggugaagagguggccgu

SEQ ID NO: 72437 - RNA, 20 nt, Artificial Sequence
  MKO10072437_B_Arhgef2
  gRNA
uuuacccuuccgacagcuuc

SEQ ID NO: 72438 - RNA, 20 nt, Artificial Sequence
  MKO10072438_B_Arhgef2
  gRNA
cuguaccaaggucaagcaga

SEQ ID NO: 72439 - RNA, 20 nt, Artificial Sequence
  MKO10072439_B_Arhgef33
  gRNA
cuuuaccugguaaaucugug

SEQ ID NO: 72440 - RNA, 20 nt, Artificial Sequence
  MKO10072440_B_Arhgef33
  gRNA
ccaaagcguauucuccaugu

SEQ ID NO: 72441 - RNA, 20 nt, Artificial Sequence
  MKO10072441_B_Arhgef33
  gRNA
gaaaaucgaacagcugcagc

SEQ ID NO: 72442 - RNA, 20 nt, Artificial Sequence
  MKO10072442_B_Arhgef37
  gRNA
gccgucagguaacuuauucu

SEQ ID NO: 72443 - RNA, 20 nt, Artificial Sequence
  MKO10072443_B_Arhgef37
  gRNA
ugauauugccguucacaucc

SEQ ID NO: 72444 - RNA, 20 nt, Artificial Sequence
  MKO10072444_B_Arhgef37
  gRNA
gaggagcaagcgcaccugau

SEQ ID NO: 72445 - RNA, 20 nt, Artificial Sequence
  MKO10072445_B_Arhgef38
  gRNA
uguauucgguccugucagac

SEQ ID NO: 72446 - RNA, 20 nt, Artificial Sequence
  MKO10072446_B_Arhgef38
  gRNA
ggccacaacagacguggaac

SEQ ID NO: 72447 - RNA, 20 nt, Artificial Sequence
  MKO10072447_B_Arhgef38
  gRNA
cguccuagaguccuaugaaa

SEQ ID NO: 72448 - RNA, 20 nt, Artificial Sequence
  MKO10072448_B_Arhgef39
  gRNA
agucugagaucucucugcgu

SEQ ID NO: 72449 - RNA, 20 nt, Artificial Sequence
  MKO10072449_B_Arhgef39
  gRNA
cacuguuggagccgcugcag

SEQ ID NO: 72450 - RNA, 20 nt, Artificial Sequence
  MKO10072450_B_Arhgef39
  gRNA
ccagaacuccagacccuguu

SEQ ID NO: 72451 - RNA, 20 nt, Artificial Sequence
  MKO10072451_B_Arhgef3
  gRNA
cacuuaugucaagacugcac

SEQ ID NO: 72452 - RNA, 20 nt, Artificial Sequence
  MKO10072452_B_Arhgef3
  gRNA
guucccuuaccugcaagguc

SEQ ID NO: 72453 - RNA, 20 nt, Artificial Sequence
  MKO10072453_B_Arhgef3
  gRNA
gcgaucuuugaacuuucuca

SEQ ID NO: 72454 - RNA, 20 nt, Artificial Sequence
  MKO10072454_B_Arhgef40
  gRNA
aucaagucccaagcuacaac

SEQ ID NO: 72455 - RNA, 20 nt, Artificial Sequence
  MKO10072455_B_Arhgef40
  gRNA
uguaccucagcgcauccucc

SEQ ID NO: 72456 - RNA, 20 nt, Artificial Sequence
  MKO10072456_B_Arhgef40
  gRNA
aguuguagcuugggacuuga

SEQ ID NO: 72457 - RNA, 20 nt, Artificial Sequence
  MKO10072457_B_Arhgef4
  gRNA
gcggccacaccugagcgagu

SEQ ID NO: 72458 - RNA, 20 nt, Artificial Sequence
  MKO10072458_B_Arhgef4
  gRNA
guuuccguucguugaugagc

SEQ ID NO: 72459 - RNA, 20 nt, Artificial Sequence
  MKO10072459_B_Arhgef4
  gRNA
acuugcugagcuucgugagc

SEQ ID NO: 72460 - RNA, 20 nt, Artificial Sequence
  MKO10072460_B_Arhgef5
  gRNA
gcgcagucuaaacauagcug

SEQ ID NO: 72461 - RNA, 20 nt, Artificial Sequence
  MKO10072461_B_Arhgef5
  gRNA
agauuuacgaaauccagcug

SEQ ID NO: 72462 - RNA, 20 nt, Artificial Sequence
  MKO10072462_B_Arhgef5
  gRNA
aagccucccauccccuccuu

SEQ ID NO: 72463 - RNA, 20 nt, Artificial Sequence
  MKO10072463_B_Arhgef6
  gRNA
auugauguugucgaugcagu

SEQ ID NO: 72464 - RNA, 20 nt, Artificial Sequence
  MKO10072464_B_Arhgef6
  gRNA
gaagaguugcacauccuuuc

SEQ ID NO: 72465 - RNA, 20 nt, Artificial Sequence
  MKO10072465_B_Arhgef6
  gRNA
uaugucacacgaguugaaga

SEQ ID NO: 72466 - RNA, 20 nt, Artificial Sequence
  MKO10072466_B_Arhgef7
  gRNA
guuguaauagcucuuguuga

SEQ ID NO: 72467 - RNA, 20 nt, Artificial Sequence
  MKO10072467_B_Arhgef7
  gRNA
cugugcuguccaccuaccug

SEQ ID NO: 72468 - RNA, 20 nt, Artificial Sequence
  MKO10072468_B_Arhgef7
  gRNA
cuuacuucgugcauucuucu

SEQ ID NO: 72469 - RNA, 20 nt, Artificial Sequence
  MKO10072469_B_Arhgef9
  gRNA
aguaugggaucacgucacca

SEQ ID NO: 72470 - RNA, 20 nt, Artificial Sequence
  MKO10072470_B_Arhgef9
  gRNA
uacagaaccgggaccagaug

SEQ ID NO: 72471 - RNA, 20 nt, Artificial Sequence
  MKO10072471_B_Arhgef9
  gRNA
aucuggucccgguucuguag

SEQ ID NO: 72472 - RNA, 20 nt, Artificial Sequence
  MKO10072472_B_Arid1a
  gRNA
agugucgcgcagucucgcuc

SEQ ID NO: 72473 - RNA, 20 nt, Artificial Sequence
  MKO10072473_B_Arid1a
  gRNA
ugagcgagacugcgcgacac

SEQ ID NO: 72474 - RNA, 20 nt, Artificial Sequence
  MKO10072474_B_Arid1a
  gRNA
cugcugcugauacgaaggcu

SEQ ID NO: 72475 - RNA, 20 nt, Artificial Sequence
  MKO10072475_B_Arid1b
  gRNA
aucuccccugcgaguauucc

SEQ ID NO: 72476 - RNA, 20 nt, Artificial Sequence
  MKO10072476_B_Arid1b
  gRNA
acagcuugcuguccguacug

SEQ ID NO: 72477 - RNA, 20 nt, Artificial Sequence
  MKO10072477_B_Arid1b
  gRNA
acggucccccaggugcacag

SEQ ID NO: 72478 - RNA, 20 nt, Artificial Sequence
  MKO10072478_B_Arid2
  gRNA
uaccugacacgcuguguugc

SEQ ID NO: 72479 - RNA, 20 nt, Artificial Sequence
  MKO10072479_B_Arid2
  gRNA
gccguuuaagaagaucccug

SEQ ID NO: 72480 - RNA, 20 nt, Artificial Sequence
  MKO10072480_B_Arid2
  gRNA
uccgccuaaaguagugacuc

SEQ ID NO: 72481 - RNA, 20 nt, Artificial Sequence
  MKO10072481_B_Arid3a
  gRNA
cagaugccaccaccggacca

SEQ ID NO: 72482 - RNA, 20 nt, Artificial Sequence
  MKO10072482_B_Arid3a
  gRNA
gaggaccugcuucgccauga

SEQ ID NO: 72483 - RNA, 20 nt, Artificial Sequence
  MKO10072483_B_Arid3a
  gRNA
ucuuguugauaaccucuacc

SEQ ID NO: 72484 - RNA, 20 nt, Artificial Sequence
  MKO10072484_B_Arid3b
  gRNA
ccagcgcugccuucacccuc

SEQ ID NO: 72485 - RNA, 20 nt, Artificial Sequence
  MKO10072485_B_Arid3b
  gRNA
uccaucagcaucgucacucc

SEQ ID NO: 72486 - RNA, 20 nt, Artificial Sequence
  MKO10072486_B_Arid3b
  gRNA
uggagugacgaugcugaugg

SEQ ID NO: 72487 - RNA, 20 nt, Artificial Sequence
  MKO10072487_B_Arid3c
  gRNA
ucuguaugcguuguuucgcu

SEQ ID NO: 72488 - RNA, 20 nt, Artificial Sequence
  MKO10072488_B_Arid3c
  gRNA
ucacuguguacggagcguga

SEQ ID NO: 72489 - RNA, 20 nt, Artificial Sequence
  MKO10072489_B_Arid3c
  gRNA
ccagcuguaugaacucgaug

SEQ ID NO: 72490 - RNA, 20 nt, Artificial Sequence
  MKO10072490_B_Arid4a
  gRNA
cggaccucacuuugccugaa

SEQ ID NO: 72491 - RNA, 20 nt, Artificial Sequence
  MKO10072491_B_Arid4a
  gRNA
gcaaauugacagaugcuagu

SEQ ID NO: 72492 - RNA, 20 nt, Artificial Sequence
  MKO10072492_B_Arid4a
  gRNA
ugagccugccuaccugacag

SEQ ID NO: 72493 - RNA, 20 nt, Artificial Sequence
  MKO10072493_B_Arid4b
  gRNA
ucagugcccacugucaaaua

SEQ ID NO: 72494 - RNA, 20 nt, Artificial Sequence
  MKO10072494_B_Arid4b
  gRNA
aguucaggaugaccacauaa

SEQ ID NO: 72495 - RNA, 20 nt, Artificial Sequence
  MKO10072495_B_Arid4b
  gRNA
acagaaggcuccucuguauu

SEQ ID NO: 72496 - RNA, 20 nt, Artificial Sequence
  MKO10072496_B_Arid5a
  gRNA
ggcugguccucccauaugug

SEQ ID NO: 72497 - RNA, 20 nt, Artificial Sequence
  MKO10072497_B_Arid5a
  gRNA
cuccugcucugcucaucauc

SEQ ID NO: 72498 - RNA, 20 nt, Artificial Sequence
  MKO10072498_B_Arid5a
  gRNA
cuaacucaccuggagcuggg

SEQ ID NO: 72499 - RNA, 20 nt, Artificial Sequence
  MKO10072499_B_Arid5b
  gRNA
cagugggucggcucaccgug

SEQ ID NO: 72500 - RNA, 20 nt, Artificial Sequence
  MKO10072500_B_Arid5b
  gRNA
cuucgggagaaacggacaga

SEQ ID NO: 72501 - RNA, 20 nt, Artificial Sequence
  MKO10072501_B_Arid5b
  gRNA
aauuagaggaccuugucaaa

SEQ ID NO: 72502 - RNA, 20 nt, Artificial Sequence
  MKO10072502_B_Arih1
  gRNA
uacuccuuagccacuucaau

SEQ ID NO: 72503 - RNA, 20 nt, Artificial Sequence
  MKO10072503_B_Arih1
  gRNA
aaaacuuauguccacauuca

SEQ ID NO: 72504 - RNA, 20 nt, Artificial Sequence
  MKO10072504_B_Arih1
  gRNA
auauuuaacuacaaaaauaa

SEQ ID NO: 72505 - RNA, 20 nt, Artificial Sequence
  MKO10072505_B_Arih2
  gRNA
aaugcuguucccaacagcuu

SEQ ID NO: 72506 - RNA, 20 nt, Artificial Sequence
  MKO10072506_B_Arih2
  gRNA
guuggcaggccagagagagu

SEQ ID NO: 72507 - RNA, 20 nt, Artificial Sequence
  MKO10072507_B_Arih2
  gRNA
uuauauuaguuaauuuccac

SEQ ID NO: 72508 - RNA, 20 nt, Artificial Sequence
  MKO10072508_B_Arl10
  gRNA
ucccaggccaaauggcgccg

SEQ ID NO: 72509 - RNA, 20 nt, Artificial Sequence
  MKO10072509_B_Arl10
  gRNA
acuccuuccaguaaaagcgc

SEQ ID NO: 72510 - RNA, 20 nt, Artificial Sequence
  MKO10072510_B_Arl10
  gRNA
cagguccaccucgaaauucu

SEQ ID NO: 72511 - RNA, 20 nt, Artificial Sequence
  MKO10072511_B_Arl11
  gRNA
cauggccggcguccccuucu

SEQ ID NO: 72512 - RNA, 20 nt, Artificial Sequence
  MKO10072512_B_Arl11
  gRNA
ugcuguccagcacguacaca

SEQ ID NO: 72513 - RNA, 20 nt, Artificial Sequence
  MKO10072513_B_Arl11
  gRNA
cgggcuugcagcgcucucac

SEQ ID NO: 72514 - RNA, 20 nt, Artificial Sequence
  MKO10072514_B_Arl13a
  gRNA
gccacucaccacgcggcaca

SEQ ID NO: 72515 - RNA, 20 nt, Artificial Sequence
  MKO10072515_B_Arl13a
  gRNA
guaucuaucuaugaccuaac

SEQ ID NO: 72516 - RNA, 20 nt, Artificial Sequence
  MKO10072516_B_Arl13a
  gRNA
ccauaaaacgcauuccaaag

SEQ ID NO: 72517 - RNA, 20 nt, Artificial Sequence
  MKO10072517_B_Arl13b
  gRNA
ccgaagugcuaagacacccg

SEQ ID NO: 72518 - RNA, 20 nt, Artificial Sequence
  MKO10072518_B_Arl13b
  gRNA
gcuacugcauaucauugcaa

SEQ ID NO: 72519 - RNA, 20 nt, Artificial Sequence
  MKO10072519_B_Arl13b
  gRNA
gcuggccaacaagcaagaca

SEQ ID NO: 72520 - RNA, 20 nt, Artificial Sequence
  MKO10072520_B_Arl14epl
  gRNA
gaagaacaacuccacucaac

SEQ ID NO: 72521 - RNA, 20 nt, Artificial Sequence
  MKO10072521_B_Arl14epl
  gRNA
uuucacagcaacagauagaa

SEQ ID NO: 72522 - RNA, 20 nt, Artificial Sequence
  MKO10072522_B_Arl14epl
  gRNA
ugcuuggcauuucaaaaccc

SEQ ID NO: 72523 - RNA, 20 nt, Artificial Sequence
  MKO10072523_B_Arl14ep
  gRNA
uucuacgcuugccccacuug

SEQ ID NO: 72524 - RNA, 20 nt, Artificial Sequence
  MKO10072524_B_Arl14ep
  gRNA
uucucccucuuaccgccuuc

SEQ ID NO: 72525 - RNA, 20 nt, Artificial Sequence
  MKO10072525_B_Arl14ep
  gRNA
ccacaagcgcugcuucugac

SEQ ID NO: 72526 - RNA, 20 nt, Artificial Sequence
  MKO10072526_B_Arl14
  gRNA
uuguuggccaguaugacgac

SEQ ID NO: 72527 - RNA, 20 nt, Artificial Sequence
  MKO10072527_B_Arl14
  gRNA
cgucauacuggccaacaaac

SEQ ID NO: 72528 - RNA, 20 nt, Artificial Sequence
  MKO10072528_B_Arl14
  gRNA
ugcuacugugagaacgcuca

SEQ ID NO: 72529 - RNA, 20 nt, Artificial Sequence
  MKO10072529_B_Arl15
  gRNA
aguagcggcuccaguauuuc

SEQ ID NO: 72530 - RNA, 20 nt, Artificial Sequence
  MKO10072530_B_Arl15
  gRNA
gcaggauccagcgcuuucca

SEQ ID NO: 72531 - RNA, 20 nt, Artificial Sequence
  MKO10072531_B_Arl15
  gRNA
cucacauucucacugccucg

SEQ ID NO: 72532 - RNA, 20 nt, Artificial Sequence
  MKO10072532_B_Arl16
  gRNA
auuaacucaccaagagcgaa

SEQ ID NO: 72533 - RNA, 20 nt, Artificial Sequence
  MKO10072533_B_Arl16
  gRNA
ccgcaguagaaauaagugcc

SEQ ID NO: 72534 - RNA, 20 nt, Artificial Sequence
  MKO10072534_B_Arl16
  gRNA
gcuuggcaacaguauugcuc

SEQ ID NO: 72535 - RNA, 20 nt, Artificial Sequence
  MKO10072535_B_Arl1
  gRNA
auuugcaaacaccacuaaaa

SEQ ID NO: 72536 - RNA, 20 nt, Artificial Sequence
  MKO10072536_B_Arl1
  gRNA
gccauuccauugccucauca

SEQ ID NO: 72537 - RNA, 20 nt, Artificial Sequence
  MKO10072537_B_Arl1
  gRNA
aauuaaaauccucauuucuc

SEQ ID NO: 72538 - RNA, 20 nt, Artificial Sequence
  MKO10072538_B_Arl2bp
  gRNA
ggcuuucaaggagauguucc

SEQ ID NO: 72539 - RNA, 20 nt, Artificial Sequence
  MKO10072539_B_Arl2bp
  gRNA
ugaaguuucucugcaauaac

SEQ ID NO: 72540 - RNA, 20 nt, Artificial Sequence
  MKO10072540_B_Arl2bp
  gRNA
guuauugcagagaaacuuca

SEQ ID NO: 72541 - RNA, 20 nt, Artificial Sequence
  MKO10072541_B_Arl2
  gRNA
ucaaggagccagucgaugcc

SEQ ID NO: 72542 - RNA, 20 nt, Artificial Sequence
  MKO10072542_B_Arl2
  gRNA
accugcugccuggcaucgac

SEQ ID NO: 72543 - RNA, 20 nt, Artificial Sequence
  MKO10072543_B_Arl2
  gRNA
cuacucacccgcggugcucc

SEQ ID NO: 72544 - RNA, 20 nt, Artificial Sequence
  MKO10072544_B_Arl3
  gRNA
aggauucgcaccuccugguc

SEQ ID NO: 72545 - RNA, 20 nt, Artificial Sequence
  MKO10072545_B_Arl3
  gRNA
aucaaaagcgugcagucaca

SEQ ID NO: 72546 - RNA, 20 nt, Artificial Sequence
  MKO10072546_B_Arl3
  gRNA
aagcugaauguaugggacau

SEQ ID NO: 72547 - RNA, 20 nt, Artificial Sequence
  MKO10072547_B_Arl4a
  gRNA
uuauuagcaacuauaagcac

SEQ ID NO: 72548 - RNA, 20 nt, Artificial Sequence
  MKO10072548_B_Arl4a
  gRNA
uugcuaauaaacaagaccug

SEQ ID NO: 72549 - RNA, 20 nt, Artificial Sequence
  MKO10072549_B_Arl4a
  gRNA
ucauacacccgaugcacaga

SEQ ID NO: 72550 - RNA, 20 nt, Artificial Sequence
  MKO10072550_B_Arl4c
  gRNA
agaugaugccguccgugcag

SEQ ID NO: 72551 - RNA, 20 nt, Artificial Sequence
  MKO10072551_B_Arl4c
  gRNA
caucggcgagggccucaccg

SEQ ID NO: 72552 - RNA, 20 nt, Artificial Sequence
  MKO10072552_B_Arl4c
  gRNA
gaaccagggcacaccgcucc

SEQ ID NO: 72553 - RNA, 20 nt, Artificial Sequence
  MKO10072553_B_Arl4d
  gRNA
cggguguaggagcgccacag

SEQ ID NO: 72554 - RNA, 20 nt, Artificial Sequence
  MKO10072554_B_Arl4d
  gRNA
ugagaagauccgcgugcccc

SEQ ID NO: 72555 - RNA, 20 nt, Artificial Sequence
  MKO10072555_B_Arl4d
  gRNA
cugcacucagugcccccggu

SEQ ID NO: 72556 - RNA, 20 nt, Artificial Sequence
  MKO10072556_B_Arl5a
  gRNA
cuacaagaugcuagcccacg

SEQ ID NO: 72557 - RNA, 20 nt, Artificial Sequence
  MKO10072557_B_Arl5a
  gRNA
uuaauacuuacaacugguaa

SEQ ID NO: 72558 - RNA, 20 nt, Artificial Sequence
  MKO10072558_B_Arl5a
  gRNA
uuacaggaccuaagaaaagc

SEQ ID NO: 72559 - RNA, 20 nt, Artificial Sequence
  MKO10072559_B_Arl5b
  gRNA
guucauacuucuccaaccau

SEQ ID NO: 72560 - RNA, 20 nt, Artificial Sequence
  MKO10072560_B_Arl5b
  gRNA
gaccaccgauaucccacaua

SEQ ID NO: 72561 - RNA, 20 nt, Artificial Sequence
  MKO10072561_B_Arl5b
  gRNA
cuaguucaucauucuuguug

SEQ ID NO: 72562 - RNA, 20 nt, Artificial Sequence
  MKO10072562_B_Arl5c
  gRNA
agagcacaaagucauuaucg

SEQ ID NO: 72563 - RNA, 20 nt, Artificial Sequence
  MKO10072563_B_Arl5c
  gRNA
cacuuacuacucuaaugcug

SEQ ID NO: 72564 - RNA, 20 nt, Artificial Sequence
  MKO10072564_B_Arl5c
  gRNA
augccacggguggucuuuga

SEQ ID NO: 72565 - RNA, 20 nt, Artificial Sequence
  MKO10072565_B_Arl6ip1
  gRNA
ugggaacaagguagucagcc

SEQ ID NO: 72566 - RNA, 20 nt, Artificial Sequence
  MKO10072566_B_Arl6ip1
  gRNA
aaaaacucgacgcagagcug

SEQ ID NO: 72567 - RNA, 20 nt, Artificial Sequence
  MKO10072567_B_Arl6ip1
  gRNA
uccaccugccaucaugggug

SEQ ID NO: 72568 - RNA, 20 nt, Artificial Sequence
  MKO10072568_B_Arl6ip4
  gRNA
ggccgggcagagccucggcc

SEQ ID NO: 72569 - RNA, 20 nt, Artificial Sequence
  MKO10072569_B_Arl6ip4
  gRNA
cuggccuuccagaugcgaac

SEQ ID NO: 72570 - RNA, 20 nt, Artificial Sequence
  MKO10072570_B_Arl6ip4
  gRNA
ggcugagcccucagggaagu

SEQ ID NO: 72571 - RNA, 20 nt, Artificial Sequence
  MKO10072571_B_Arl6ip5
  gRNA
gaccaugacacccccgaaca

SEQ ID NO: 72572 - RNA, 20 nt, Artificial Sequence
  MKO10072572_B_Arl6ip5
  gRNA
cggccugaagaaaacuccga

SEQ ID NO: 72573 - RNA, 20 nt, Artificial Sequence
  MKO10072573_B_Arl6ip5
  gRNA
cugacuacaucagcaaagcg

SEQ ID NO: 72574 - RNA, 20 nt, Artificial Sequence
  MKO10072574_B_Arl6ip6
  gRNA
aacacuuacuugaaccuagc

SEQ ID NO: 72575 - RNA, 20 nt, Artificial Sequence
  MKO10072575_B_Arl6ip6
  gRNA
uauugucgcugcucucacug

SEQ ID NO: 72576 - RNA, 20 nt, Artificial Sequence
  MKO10072576_B_Arl6ip6
  gRNA
aaugaagaugauauacauac

SEQ ID NO: 72577 - RNA, 20 nt, Artificial Sequence
  MKO10072577_B_Arl6
  gRNA
uuucucuaugcuaaauccua

SEQ ID NO: 72578 - RNA, 20 nt, Artificial Sequence
  MKO10072578_B_Arl6
  gRNA
uagagaaauucaaguccucc

SEQ ID NO: 72579 - RNA, 20 nt, Artificial Sequence
  MKO10072579_B_Arl6
  gRNA
caacugagacacuuucacag

SEQ ID NO: 72580 - RNA, 20 nt, Artificial Sequence
  MKO10072580_B_Arl8a
  gRNA
cagguuguggagcucauucu

SEQ ID NO: 72581 - RNA, 20 nt, Artificial Sequence
  MKO10072581_B_Arl8a
  gRNA
aguagcguucccacaugcuu

SEQ ID NO: 72582 - RNA, 20 nt, Artificial Sequence
  MKO10072582_B_Arl8a
  gRNA
aacaugcgaaaaaucaccaa

SEQ ID NO: 72583 - RNA, 20 nt, Artificial Sequence
  MKO10072583_B_Arl8b
  gRNA
cauaucuucacugaauugac

SEQ ID NO: 72584 - RNA, 20 nt, Artificial Sequence
  MKO10072584_B_Arl8b
  gRNA
gagagaucuuccaaaugccu

SEQ ID NO: 72585 - RNA, 20 nt, Artificial Sequence
  MKO10072585_B_Arl8b
  gRNA
ugaagauaugauacccacag

SEQ ID NO: 72586 - RNA, 20 nt, Artificial Sequence
  MKO10072586_B_Arl9
  gRNA
uagaauugaugaagugugac

SEQ ID NO: 72587 - RNA, 20 nt, Artificial Sequence
  MKO10072587_B_Arl9
  gRNA
cuccauccagaccuaguacu

SEQ ID NO: 72588 - RNA, 20 nt, Artificial Sequence
  MKO10072588_B_Arl9
  gRNA
ugugaacugcauuuaaaccu

SEQ ID NO: 72589 - RNA, 20 nt, Artificial Sequence
  MKO10072589_B_Armc10
  gRNA
guuugucagcagccucaguc

SEQ ID NO: 72590 - RNA, 20 nt, Artificial Sequence
  MKO10072590_B_Armc10
  gRNA
ugcugacccccugaacucug

SEQ ID NO: 72591 - RNA, 20 nt, Artificial Sequence
  MKO10072591_B_Armc10
  gRNA
ugaaaaucaaacuaagauaa

SEQ ID NO: 72592 - RNA, 20 nt, Artificial Sequence
  MKO10072592_B_Armc12
  gRNA
guaggccucuucuuguacua

SEQ ID NO: 72593 - RNA, 20 nt, Artificial Sequence
  MKO10072593_B_Armc12
  gRNA
gacuuggaauugcacguagc

SEQ ID NO: 72594 - RNA, 20 nt, Artificial Sequence
  MKO10072594_B_Armc12
  gRNA
uuaugacauucucaacuguc

SEQ ID NO: 72595 - RNA, 20 nt, Artificial Sequence
  MKO10072595_B_Armc1
  gRNA
cuguucaaagaugcguggug

SEQ ID NO: 72596 - RNA, 20 nt, Artificial Sequence
  MKO10072596_B_Armc1
  gRNA
acuaucaccaucagccaaau

SEQ ID NO: 72597 - RNA, 20 nt, Artificial Sequence
  MKO10072597_B_Armc1
  gRNA
gucagcaauagcaucaacca

SEQ ID NO: 72598 - RNA, 20 nt, Artificial Sequence
  MKO10072598_B_Armc2
  gRNA
ggcccgagcacgcuucuaca

SEQ ID NO: 72599 - RNA, 20 nt, Artificial Sequence
  MKO10072599_B_Armc2
  gRNA
uuacaccccgugaagaccaa

SEQ ID NO: 72600 - RNA, 20 nt, Artificial Sequence
  MKO10072600_B_Armc2
  gRNA
uguagaacuccccacgcuaa

SEQ ID NO: 72601 - RNA, 20 nt, Artificial Sequence
  MKO10072601_B_Armc3
  gRNA
uuggcuaagaugucuuccuc

SEQ ID NO: 72602 - RNA, 20 nt, Artificial Sequence
  MKO10072602_B_Armc3
  gRNA
agaaaugcuaugaugaucuu

SEQ ID NO: 72603 - RNA, 20 nt, Artificial Sequence
  MKO10072603_B_Armc3
  gRNA
gugauguuaagaagcucuug

SEQ ID NO: 72604 - RNA, 20 nt, Artificial Sequence
  MKO10072604_B_Armc4
  gRNA
cuguaccuuauauuaaagug

SEQ ID NO: 72605 - RNA, 20 nt, Artificial Sequence
  MKO10072605_B_Armc4
  gRNA
cacagaguuuccaugucaug

SEQ ID NO: 72606 - RNA, 20 nt, Artificial Sequence
  MKO10072606_B_Armc4
  gRNA
aagcuccucacuuuaauaua

SEQ ID NO: 72607 - RNA, 20 nt, Artificial Sequence
  MKO10072607_B_Armc5
  gRNA
gccaagauacgaagugcgcg

SEQ ID NO: 72608 - RNA, 20 nt, Artificial Sequence
  MKO10072608_B_Armc5
  gRNA
gggucagugcacaggcgacg

SEQ ID NO: 72609 - RNA, 20 nt, Artificial Sequence
  MKO10072609_B_Armc5
  gRNA
ucccccucaccggcagauga

SEQ ID NO: 72610 - RNA, 20 nt, Artificial Sequence
  MKO10072610_B_Armc6
  gRNA
guguaauagccgcugugagc

SEQ ID NO: 72611 - RNA, 20 nt, Artificial Sequence
  MKO10072611_B_Armc6
  gRNA
cugcagcacccuaucccgcc

SEQ ID NO: 72612 - RNA, 20 nt, Artificial Sequence
  MKO10072612_B_Armc6
  gRNA
gacaauaccgaaaguaucac

SEQ ID NO: 72613 - RNA, 20 nt, Artificial Sequence
  MKO10072613_B_Armc7
  gRNA
gggggccucccgcucaucau

SEQ ID NO: 72614 - RNA, 20 nt, Artificial Sequence
  MKO10072614_B_Armc7
  gRNA
ucggcgagcagaaguccucu

SEQ ID NO: 72615 - RNA, 20 nt, Artificial Sequence
  MKO10072615_B_Armc7
  gRNA
cccaagauagacccccacgu

SEQ ID NO: 72616 - RNA, 20 nt, Artificial Sequence
  MKO10072616_B_Armc8
  gRNA
aagcuugccuccgaugccuc

SEQ ID NO: 72617 - RNA, 20 nt, Artificial Sequence
  MKO10072617_B_Armc8
  gRNA
auacuacuuacaugacaccu

SEQ ID NO: 72618 - RNA, 20 nt, Artificial Sequence
  MKO10072618_B_Armc8
  gRNA
ggcaagcuucaaugaacuuc

SEQ ID NO: 72619 - RNA, 20 nt, Artificial Sequence
  MKO10072619_B_Armc9
  gRNA
cuccaagucgcucguaaucc

SEQ ID NO: 72620 - RNA, 20 nt, Artificial Sequence
  MKO10072620_B_Armc9
  gRNA
acaagucaaagaacgccuuc

SEQ ID NO: 72621 - RNA, 20 nt, Artificial Sequence
  MKO10072621_B_Armc9
  gRNA
ucuuccgcagagggauuugg

SEQ ID NO: 72622 - RNA, 20 nt, Artificial Sequence
  MKO10072622_B_Armcx1
  gRNA
ucaagugugugacgauacca

SEQ ID NO: 72623 - RNA, 20 nt, Artificial Sequence
  MKO10072623_B_Armcx1
  gRNA
gacuccacccagcucacgga

SEQ ID NO: 72624 - RNA, 20 nt, Artificial Sequence
  MKO10072624_B_Armcx1
  gRNA
ugaguccaagcggcaaacca

SEQ ID NO: 72625 - RNA, 20 nt, Artificial Sequence
  MKO10072625_B_Armcx2
  gRNA
caccccccugagauaacaag

SEQ ID NO: 72626 - RNA, 20 nt, Artificial Sequence
  MKO10072626_B_Armcx2
  gRNA
gcacuacuaccccaguagau

SEQ ID NO: 72627 - RNA, 20 nt, Artificial Sequence
  MKO10072627_B_Armcx2
  gRNA
ccccaucaucaguacuuccc

SEQ ID NO: 72628 - RNA, 20 nt, Artificial Sequence
  MKO10072628_B_Armcx3
  gRNA
acgauugcaugggcuacgcc

SEQ ID NO: 72629 - RNA, 20 nt, Artificial Sequence
  MKO10072629_B_Armcx3
  gRNA
cucguuaguaacagucauau

SEQ ID NO: 72630 - RNA, 20 nt, Artificial Sequence
  MKO10072630_B_Armcx3
  gRNA
cucgaagagcuguacagaaa

SEQ ID NO: 72631 - RNA, 20 nt, Artificial Sequence
  MKO10072631_B_Armcx4
  gRNA
ugauuacaugggccguguac

SEQ ID NO: 72632 - RNA, 20 nt, Artificial Sequence
  MKO10072632_B_Armcx4
  gRNA
acuaguggcuguacuaaauc

SEQ ID NO: 72633 - RNA, 20 nt, Artificial Sequence
  MKO10072633_B_Armcx4
  gRNA
gucuggggcaaguacaauac

SEQ ID NO: 72634 - RNA, 20 nt, Artificial Sequence
  MKO10072634_B_Armcx5
  gRNA
acgagcuuaucaaagucaac

SEQ ID NO: 72635 - RNA, 20 nt, Artificial Sequence
  MKO10072635_B_Armcx5
  gRNA
uucacuucuucgggggcauc

SEQ ID NO: 72636 - RNA, 20 nt, Artificial Sequence
  MKO10072636_B_Armcx5
  gRNA
aaccuuaauugaaacucccc

SEQ ID NO: 72637 - RNA, 20 nt, Artificial Sequence
  MKO10072637_B_Armcx6
  gRNA
caguuuguacaugcaguaac

SEQ ID NO: 72638 - RNA, 20 nt, Artificial Sequence
  MKO10072638_B_Armcx6
  gRNA
aagaagugaggggaacgagc

SEQ ID NO: 72639 - RNA, 20 nt, Artificial Sequence
  MKO10072639_B_Armcx6
  gRNA
ccccaauaucaguaaacauc

SEQ ID NO: 72640 - RNA, 20 nt, Artificial Sequence
  MKO10072640_B_Arnt2
  gRNA
accggcaacaaaucgacuga

SEQ ID NO: 72641 - RNA, 20 nt, Artificial Sequence
  MKO10072641_B_Arnt2
  gRNA
ugugcgagaccgccaugcgc

SEQ ID NO: 72642 - RNA, 20 nt, Artificial Sequence
  MKO10072642_B_Arnt2
  gRNA
ggggccaugccugcccgagg

SEQ ID NO: 72643 - RNA, 20 nt, Artificial Sequence
  MKO10072643_B_Arntl2
  gRNA
uaucagcgcccaguggcauc

SEQ ID NO: 72644 - RNA, 20 nt, Artificial Sequence
  MKO10072644_B_Arntl2
  gRNA
cgcugagcuuguccaguuug

SEQ ID NO: 72645 - RNA, 20 nt, Artificial Sequence
  MKO10072645_B_Arntl2
  gRNA
ggaaacuuaccugaugccac

SEQ ID NO: 72646 - RNA, 20 nt, Artificial Sequence
  MKO10072646_B_Arntl
  gRNA
cccacagucagauugaaaag

SEQ ID NO: 72647 - RNA, 20 nt, Artificial Sequence
  MKO10072647_B_Arntl
  gRNA
aacugaaacaccuaauucuc

SEQ ID NO: 72648 - RNA, 20 nt, Artificial Sequence
  MKO10072648_B_Arntl
  gRNA
acagacaaagaugacccuca

SEQ ID NO: 72649 - RNA, 20 nt, Artificial Sequence
  MKO10072649_B_Arnt
  gRNA
gcuccuccaccuugaauccc

SEQ ID NO: 72650 - RNA, 20 nt, Artificial Sequence
  MKO10072650_B_Arnt
  gRNA
gcucuuugucauuacacauc

SEQ ID NO: 72651 - RNA, 20 nt, Artificial Sequence
  MKO10072651_B_Arnt
  gRNA
agauguguaaugacaaagag

SEQ ID NO: 72652 - RNA, 20 nt, Artificial Sequence
  MKO10072652_B_Arpc1a
  gRNA
ccugagccccaauaaccaug

SEQ ID NO: 72653 - RNA, 20 nt, Artificial Sequence
  MKO10072653_B_Arpc1a
  gRNA
uggcaguggcaccggcggcu

SEQ ID NO: 72654 - RNA, 20 nt, Artificial Sequence
  MKO10072654_B_Arpc1a
  gRNA
uggcaucuggaagcccaccc

SEQ ID NO: 72655 - RNA, 20 nt, Artificial Sequence
  MKO10072655_B_Arpc1b
  gRNA
ggugcauggggucugcuucu

SEQ ID NO: 72656 - RNA, 20 nt, Artificial Sequence
  MKO10072656_B_Arpc1b
  gRNA
ccgcuccacagugcucagcc

SEQ ID NO: 72657 - RNA, 20 nt, Artificial Sequence
  MKO10072657_B_Arpc1b
  gRNA
ucaccugcacuugaagucac

SEQ ID NO: 72658 - RNA, 20 nt, Artificial Sequence
  MKO10072658_B_Arpc2
  gRNA
gcuguagaaguaacauuugc

SEQ ID NO: 72659 - RNA, 20 nt, Artificial Sequence
  MKO10072659_B_Arpc2
  gRNA
gaaguauuucucaaacacag

SEQ ID NO: 72660 - RNA, 20 nt, Artificial Sequence
  MKO10072660_B_Arpc2
  gRNA
uaucauauuucaaauccuaa

SEQ ID NO: 72661 - RNA, 20 nt, Artificial Sequence
  MKO10072661_B_Arpc3
  gRNA
ccuuguagaaugaagcggac

SEQ ID NO: 72662 - RNA, 20 nt, Artificial Sequence
  MKO10072662_B_Arpc3
  gRNA
auccacaauguccgugucuu

SEQ ID NO: 72663 - RNA, 20 nt, Artificial Sequence
  MKO10072663_B_Arpc3
  gRNA
ugccaagccugcgagcaaac

SEQ ID NO: 72664 - RNA, 20 nt, Artificial Sequence
  MKO10072664_B_Arpc4
  gRNA
agaacuucuuuauccuucga

SEQ ID NO: 72665 - RNA, 20 nt, Artificial Sequence
  MKO10072665_B_Arpc4
  gRNA
ccucagcuacgauacgagcc

SEQ ID NO: 72666 - RNA, 20 nt, Artificial Sequence
  MKO10072666_B_Arpc4
  gRNA
ugucgaucuccuccaugaag

SEQ ID NO: 72667 - RNA, 20 nt, Artificial Sequence
  MKO10072667_B_Arpc5l
  gRNA
gugaguuccgcaaagcugca

SEQ ID NO: 72668 - RNA, 20 nt, Artificial Sequence
  MKO10072668_B_Arpc5l
  gRNA
gcagugcagugcuacuccag

SEQ ID NO: 72669 - RNA, 20 nt, Artificial Sequence
  MKO10072669_B_Arpc5l
  gRNA
ucuccacaggccuuagcugu

SEQ ID NO: 72670 - RNA, 20 nt, Artificial Sequence
  MKO10072670_B_Arpc5
  gRNA
ugcaggcagcaucgucuuga

SEQ ID NO: 72671 - RNA, 20 nt, Artificial Sequence
  MKO10072671_B_Arpc5
  gRNA
auaugacgagaacaaguucg

SEQ ID NO: 72672 - RNA, 20 nt, Artificial Sequence
  MKO10072672_B_Arpc5
  gRNA
accccacuccuccagcagca

SEQ ID NO: 72673 - RNA, 20 nt, Artificial Sequence
  MKO10072673_B_Arpp19
  gRNA
cccucagcggaaaccguccc

SEQ ID NO: 72674 - RNA, 20 nt, Artificial Sequence
  MKO10072674_B_Arpp19
  gRNA
agcgucugcggaggagcaaa

SEQ ID NO: 72675 - RNA, 20 nt, Artificial Sequence
  MKO10072675_B_Arpp19
  gRNA
cagccagcuugcuagcaacc

SEQ ID NO: 72676 - RNA, 20 nt, Artificial Sequence
  MKO10072676_B_Arpp21
  gRNA
uagauuuauccuccucuugc

SEQ ID NO: 72677 - RNA, 20 nt, Artificial Sequence
  MKO10072677_B_Arpp21
  gRNA
cgucugcccuucuuccagua

SEQ ID NO: 72678 - RNA, 20 nt, Artificial Sequence
  MKO10072678_B_Arpp21
  gRNA
aggggaaagucaccaggauc

SEQ ID NO: 72679 - RNA, 20 nt, Artificial Sequence
  MKO10072679_B_Arr3
  gRNA
gucaguaccugaaguguaaa

SEQ ID NO: 72680 - RNA, 20 nt, Artificial Sequence
  MKO10072680_B_Arr3
  gRNA
cgugaugacuuggaugugau

SEQ ID NO: 72681 - RNA, 20 nt, Artificial Sequence
  MKO10072681_B_Arr3
  gRNA
uuuaagaagacuagcuccaa

SEQ ID NO: 72682 - RNA, 20 nt, Artificial Sequence
  MKO10072682_B_Arrb1
  gRNA
cgccuuucuuugagauacuc

SEQ ID NO: 72683 - RNA, 20 nt, Artificial Sequence
  MKO10072683_B_Arrb1
  gRNA
uguggaccacauugaccucg

SEQ ID NO: 72684 - RNA, 20 nt, Artificial Sequence
  MKO10072684_B_Arrb1
  gRNA
ucccccagaugguguggucc

SEQ ID NO: 72685 - RNA, 20 nt, Artificial Sequence
  MKO10072685_B_Arrb2
  gRNA
ccgagaagaccuggauguac

SEQ ID NO: 72686 - RNA, 20 nt, Artificial Sequence
  MKO10072686_B_Arrb2
  gRNA
uccucagcucaccguguacu

SEQ ID NO: 72687 - RNA, 20 nt, Artificial Sequence
  MKO10072687_B_Arrb2
  gRNA
uuccgguccuucaaguaguc

SEQ ID NO: 72688 - RNA, 20 nt, Artificial Sequence
  MKO10072688_B_Arrdc1
  gRNA
cuuugggaagauuguacacc

SEQ ID NO: 72689 - RNA, 20 nt, Artificial Sequence
  MKO10072689_B_Arrdc1
  gRNA
caccacccaugccccaucgu

SEQ ID NO: 72690 - RNA, 20 nt, Artificial Sequence
  MKO10072690_B_Arrdc1
  gRNA
agcuauccgggugaccugca

SEQ ID NO: 72691 - RNA, 20 nt, Artificial Sequence
  MKO10072691_B_Arrdc2
  gRNA
gggaaacucguggcguccag

SEQ ID NO: 72692 - RNA, 20 nt, Artificial Sequence
  MKO10072692_B_Arrdc2
  gRNA
gggagaagguggcacgaucc

SEQ ID NO: 72693 - RNA, 20 nt, Artificial Sequence
  MKO10072693_B_Arrdc2
  gRNA
aggaucgugccaccuucucc

SEQ ID NO: 72694 - RNA, 20 nt, Artificial Sequence
  MKO10072694_B_Arrdc3
  gRNA
gacauggcagugugcgcuau

SEQ ID NO: 72695 - RNA, 20 nt, Artificial Sequence
  MKO10072695_B_Arrdc3
  gRNA
gccuuccugaaugaauagug

SEQ ID NO: 72696 - RNA, 20 nt, Artificial Sequence
  MKO10072696_B_Arrdc3
  gRNA
guagcccuuccuuucaaucu

SEQ ID NO: 72697 - RNA, 20 nt, Artificial Sequence
  MKO10072697_B_Arrdc4
  gRNA
ccuuuggcaacaucguuuac

SEQ ID NO: 72698 - RNA, 20 nt, Artificial Sequence
  MKO10072698_B_Arrdc4
  gRNA
gacuccuaugcugaagacgc

SEQ ID NO: 72699 - RNA, 20 nt, Artificial Sequence
  MKO10072699_B_Arrdc4
  gRNA
gagcgucaagaucgagagaa

SEQ ID NO: 72700 - RNA, 20 nt, Artificial Sequence
  MKO10072700_B_Arrdc5
  gRNA
cuuggaccgggagcauaucc

SEQ ID NO: 72701 - RNA, 20 nt, Artificial Sequence
  MKO10072701_B_Arrdc5
  gRNA
uagugccuucaaccugccgc

SEQ ID NO: 72702 - RNA, 20 nt, Artificial Sequence
  MKO10072702_B_Arrdc5
  gRNA
guggccgaucuuacuguuga

SEQ ID NO: 72703 - RNA, 20 nt, Artificial Sequence
  MKO10072703_B_Arsa
  gRNA
gaguugaugcgcauguccaa

SEQ ID NO: 72704 - RNA, 20 nt, Artificial Sequence
  MKO10072704_B_Arsa
  gRNA
ugccugaucgaacugggagc

SEQ ID NO: 72705 - RNA, 20 nt, Artificial Sequence
  MKO10072705_B_Arsa
  gRNA
caaagcuucaccaagcgcuc

SEQ ID NO: 72706 - RNA, 20 nt, Artificial Sequence
  MKO10072706_B_Arsb
  gRNA
uaugacgguuguagcccuuu

SEQ ID NO: 72707 - RNA, 20 nt, Artificial Sequence
  MKO10072707_B_Arsb
  gRNA
cgaaguagguaucgaauccu

SEQ ID NO: 72708 - RNA, 20 nt, Artificial Sequence
  MKO10072708_B_Arsb
  gRNA
ugaagacuauuacacccacg

SEQ ID NO: 72709 - RNA, 20 nt, Artificial Sequence
  MKO10072709_B_Arsg
  gRNA
cuuccccaccgugauagcuc

SEQ ID NO: 72710 - RNA, 20 nt, Artificial Sequence
  MKO10072710_B_Arsg
  gRNA
aacuaccugccguugccaac

SEQ ID NO: 72711 - RNA, 20 nt, Artificial Sequence
  MKO10072711_B_Arsg
  gRNA
acguuggcuggaacucugcc

SEQ ID NO: 72712 - RNA, 20 nt, Artificial Sequence
  MKO10072712_B_Arsi
  gRNA
agcagcugagggcgucaaac

SEQ ID NO: 72713 - RNA, 20 nt, Artificial Sequence
  MKO10072713_B_Arsi
  gRNA
uagcgguauagguauucucg

SEQ ID NO: 72714 - RNA, 20 nt, Artificial Sequence
  MKO10072714_B_Arsi
  gRNA
gccagguccucucguucgua

SEQ ID NO: 72715 - RNA, 20 nt, Artificial Sequence
  MKO10072715_B_Arsj
  gRNA
cuccuggacggugugcaaau

SEQ ID NO: 72716 - RNA, 20 nt, Artificial Sequence
  MKO10072716_B_Arsj
  gRNA
acgaaaacgacaaugcagcu

SEQ ID NO: 72717 - RNA, 20 nt, Artificial Sequence
  MKO10072717_B_Arsj
  gRNA
agugccacuucccaaccaua

SEQ ID NO: 72718 - RNA, 20 nt, Artificial Sequence
  MKO10072718_B_Arsk
  gRNA
uccuauacaaaaaacugcac

SEQ ID NO: 72719 - RNA, 20 nt, Artificial Sequence
  MKO10072719_B_Arsk
  gRNA
uggauccaaauuauacgaca

SEQ ID NO: 72720 - RNA, 20 nt, Artificial Sequence
  MKO10072720_B_Arsk
  gRNA
ucaguaaccguguggaagca

SEQ ID NO: 72721 - RNA, 20 nt, Artificial Sequence
  MKO10072721_B_Art1
  gRNA
cuggaagggcgcucagcaca

SEQ ID NO: 72722 - RNA, 20 nt, Artificial Sequence
  MKO10072722_B_Art1
  gRNA
ugcuaugaugucucuccuac

SEQ ID NO: 72723 - RNA, 20 nt, Artificial Sequence
  MKO10072723_B_Art1
  gRNA
caucauagcaggaaucuuca

SEQ ID NO: 72724 - RNA, 20 nt, Artificial Sequence
  MKO10072724_B_Art2a-ps
  gRNA
gcuggguuagccaccaaguu

SEQ ID NO: 72725 - RNA, 20 nt, Artificial Sequence
  MKO10072725_B_Art2a-ps
  gRNA
cuguguaucccuguuccuug

SEQ ID NO: 72726 - RNA, 20 nt, Artificial Sequence
  MKO10072726_B_Art2a-ps
  gRNA
gcucagcaagaguaagcugc

SEQ ID NO: 72727 - RNA, 20 nt, Artificial Sequence
  MKO10072727_B_Art2b
  gRNA
cuguguaucccuguuccuug

SEQ ID NO: 72728 - RNA, 20 nt, Artificial Sequence
  MKO10072728_B_Art2b
  gRNA
gcucagcaagaguaagcugc

SEQ ID NO: 72729 - RNA, 20 nt, Artificial Sequence
  MKO10072729_B_Art2b
  gRNA
cuccucauucccucgugaag

SEQ ID NO: 72730 - RNA, 20 nt, Artificial Sequence
  MKO10072730_B_Art3
  gRNA
uuucagaauauauugacccu

SEQ ID NO: 72731 - RNA, 20 nt, Artificial Sequence
  MKO10072731_B_Art3
  gRNA
aaucagaagcuugaagacuc

SEQ ID NO: 72732 - RNA, 20 nt, Artificial Sequence
  MKO10072732_B_Art3
  gRNA
ccuggguuguagagauaccu

SEQ ID NO: 72733 - RNA, 20 nt, Artificial Sequence
  MKO10072733_B_Art4
  gRNA
gacacccgcggggagcacug

SEQ ID NO: 72734 - RNA, 20 nt, Artificial Sequence
  MKO10072734_B_Art4
  gRNA
cccuaccucagugcuccccg

SEQ ID NO: 72735 - RNA, 20 nt, Artificial Sequence
  MKO10072735_B_Art4
  gRNA
cagccgauaaccacuggagc

SEQ ID NO: 72736 - RNA, 20 nt, Artificial Sequence
  MKO10072736_B_Art5
  gRNA
ucguccuaggaugauucugg

SEQ ID NO: 72737 - RNA, 20 nt, Artificial Sequence
  MKO10072737_B_Art5
  gRNA
agacacugcucuuggaccca

SEQ ID NO: 72738 - RNA, 20 nt, Artificial Sequence
  MKO10072738_B_Art5
  gRNA
uccagcagucgggcagccag

SEQ ID NO: 72739 - RNA, 20 nt, Artificial Sequence
  MKO10072739_B_Artn
  gRNA
gcacggaccacagaugcgcg

SEQ ID NO: 72740 - RNA, 20 nt, Artificial Sequence
  MKO10072740_B_Artn
  gRNA
cagcgacucaccugccaccu

SEQ ID NO: 72741 - RNA, 20 nt, Artificial Sequence
  MKO10072741_B_Artn
  gRNA
aggcagugggacaaugcagu

SEQ ID NO: 72742 - RNA, 20 nt, Artificial Sequence
  MKO10072742_B_Arv1
  gRNA
cagcccccgaugacgugauc

SEQ ID NO: 72743 - RNA, 20 nt, Artificial Sequence
  MKO10072743_B_Arv1
  gRNA
uagcaggagcuucccguagc

SEQ ID NO: 72744 - RNA, 20 nt, Artificial Sequence
  MKO10072744_B_Arv1
  gRNA
agagccuccgguuuguguuc

SEQ ID NO: 72745 - RNA, 20 nt, Artificial Sequence
  MKO10072745_B_Arvcf
  gRNA
cggcgacuccgugagugcga

SEQ ID NO: 72746 - RNA, 20 nt, Artificial Sequence
  MKO10072746_B_Arvcf
  gRNA
cugacuauagcacggcaacc

SEQ ID NO: 72747 - RNA, 20 nt, Artificial Sequence
  MKO10072747_B_Arvcf
  gRNA
auaccuuagucucaguccgc

SEQ ID NO: 72748 - RNA, 20 nt, Artificial Sequence
  MKO10072748_B_Arxes1
  gRNA
caaaagcaacgcugugaacc

SEQ ID NO: 72749 - RNA, 20 nt, Artificial Sequence
  MKO10072749_B_Arxes1
  gRNA
ugggacaagauccuucugcg

SEQ ID NO: 72750 - RNA, 20 nt, Artificial Sequence
  MKO10072750_B_Arxes1
  gRNA
ccuggagacgugcaggcgca

SEQ ID NO: 72751 - RNA, 20 nt, Artificial Sequence
  MKO10072751_B_Arxes2
  gRNA
caaaagcaacgcugugaacc

SEQ ID NO: 72752 - RNA, 20 nt, Artificial Sequence
  MKO10072752_B_Arxes2
  gRNA
ugggacaagauccuucugcg

SEQ ID NO: 72753 - RNA, 20 nt, Artificial Sequence
  MKO10072753_B_Arxes2
  gRNA
ccuggagacgugcaggcgca

SEQ ID NO: 72754 - RNA, 20 nt, Artificial Sequence
  MKO10072754_B_Arx
  gRNA
cgucaagcauagccgcgcug

SEQ ID NO: 72755 - RNA, 20 nt, Artificial Sequence
  MKO10072755_B_Arx
  gRNA
gcaucacccugcgcuugauu

SEQ ID NO: 72756 - RNA, 20 nt, Artificial Sequence
  MKO10072756_B_Arx
  gRNA
guccaggccgaaucaagcgc

SEQ ID NO: 72757 - RNA, 20 nt, Artificial Sequence
  MKO10072757_B_Ar
  gRNA
uguccggcacacaccacucc

SEQ ID NO: 72758 - RNA, 20 nt, Artificial Sequence
  MKO10072758_B_Ar
  gRNA
auugcccaucuugucgucuc

SEQ ID NO: 72759 - RNA, 20 nt, Artificial Sequence
  MKO10072759_B_Ar
  gRNA
ggguggaaaguaauagucga

SEQ ID NO: 72760 - RNA, 20 nt, Artificial Sequence
  MKO10072760_B_As3mt
  gRNA
cacuacccagauccaaaauu

SEQ ID NO: 72761 - RNA, 20 nt, Artificial Sequence
  MKO10072761_B_As3mt
  gRNA
ucccucagguauuauggcug

SEQ ID NO: 72762 - RNA, 20 nt, Artificial Sequence
  MKO10072762_B_As3mt
  gRNA
aaccuaucuugaacaccaca

SEQ ID NO: 72763 - RNA, 20 nt, Artificial Sequence
  MKO10072763_B_Asah1
  gRNA
ggaaggcugccaaucauacc

SEQ ID NO: 72764 - RNA, 20 nt, Artificial Sequence
  MKO10072764_B_Asah1
  gRNA
aggggaauugcagauguuac

SEQ ID NO: 72765 - RNA, 20 nt, Artificial Sequence
  MKO10072765_B_Asah1
  gRNA
gcuauagaggaccaguuccg

SEQ ID NO: 72766 - RNA, 20 nt, Artificial Sequence
  MKO10072766_B_Asah2
  gRNA
uccagaugggucaaaucgaa

SEQ ID NO: 72767 - RNA, 20 nt, Artificial Sequence
  MKO10072767_B_Asah2
  gRNA
ccacugaaguuccgaaauga

SEQ ID NO: 72768 - RNA, 20 nt, Artificial Sequence
  MKO10072768_B_Asah2
  gRNA
acaagugucagauaucaauu

SEQ ID NO: 72769 - RNA, 20 nt, Artificial Sequence
  MKO10072769_B_Asap1
  gRNA
ccacaaugugaucuucaccu

SEQ ID NO: 72770 - RNA, 20 nt, Artificial Sequence
  MKO10072770_B_Asap1
  gRNA
ccaaggugaagaucacauug

SEQ ID NO: 72771 - RNA, 20 nt, Artificial Sequence
  MKO10072771_B_Asap1
  gRNA
agaaaacuaugcacaaguuc

SEQ ID NO: 72772 - RNA, 20 nt, Artificial Sequence
  MKO10072772_B_Asap2
  gRNA
uugcugaaaggagaucugaa

SEQ ID NO: 72773 - RNA, 20 nt, Artificial Sequence
  MKO10072773_B_Asap2
  gRNA
caaaaugaagaaaucuguga

SEQ ID NO: 72774 - RNA, 20 nt, Artificial Sequence
  MKO10072774_B_Asap2
  gRNA
caccuccucgauggccgcca

SEQ ID NO: 72775 - RNA, 20 nt, Artificial Sequence
  MKO10072775_B_Asap3
  gRNA
gcauuaccgagaggccgugg

SEQ ID NO: 72776 - RNA, 20 nt, Artificial Sequence
  MKO10072776_B_Asap3
  gRNA
ccucucuggugaauacagcc

SEQ ID NO: 72777 - RNA, 20 nt, Artificial Sequence
  MKO10072777_B_Asap3
  gRNA
ccaggauuccaaaaagcauc

SEQ ID NO: 72778 - RNA, 20 nt, Artificial Sequence
  MKO10072778_B_Asb10
  gRNA
ucuugcaggugcuggaucgc

SEQ ID NO: 72779 - RNA, 20 nt, Artificial Sequence
  MKO10072779_B_Asb10
  gRNA
cauguccccacggaccaucg

SEQ ID NO: 72780 - RNA, 20 nt, Artificial Sequence
  MKO10072780_B_Asb10
  gRNA
uugugcgcuccgcagucacc

SEQ ID NO: 72781 - RNA, 20 nt, Artificial Sequence
  MKO10072781_B_Asb11
  gRNA
auccacgaagcagugaagcg

SEQ ID NO: 72782 - RNA, 20 nt, Artificial Sequence
  MKO10072782_B_Asb11
  gRNA
gcugggaacgccucuguaug

SEQ ID NO: 72783 - RNA, 20 nt, Artificial Sequence
  MKO10072783_B_Asb11
  gRNA
ucuucacacaaucaacucuc

SEQ ID NO: 72784 - RNA, 20 nt, Artificial Sequence
  MKO10072784_B_Asb12
  gRNA
uggcuugugacugguucgcc

SEQ ID NO: 72785 - RNA, 20 nt, Artificial Sequence
  MKO10072785_B_Asb12
  gRNA
ugaaccguuuauaacguucc

SEQ ID NO: 72786 - RNA, 20 nt, Artificial Sequence
  MKO10072786_B_Asb12
  gRNA
gaacacgacuuaaaaggccc

SEQ ID NO: 72787 - RNA, 20 nt, Artificial Sequence
  MKO10072787_B_Asb13
  gRNA
gcgcacgcccguucaugagg

SEQ ID NO: 72788 - RNA, 20 nt, Artificial Sequence
  MKO10072788_B_Asb13
  gRNA
agaagcccucggacuacacg

SEQ ID NO: 72789 - RNA, 20 nt, Artificial Sequence
  MKO10072789_B_Asb13
  gRNA
ccgcugagccgccucaugaa

SEQ ID NO: 72790 - RNA, 20 nt, Artificial Sequence
  MKO10072790_B_Asb14
  gRNA
ugcacugcugccuuaugcag

SEQ ID NO: 72791 - RNA, 20 nt, Artificial Sequence
  MKO10072791_B_Asb14
  gRNA
auucccauuggcuucaucaa

SEQ ID NO: 72792 - RNA, 20 nt, Artificial Sequence
  MKO10072792_B_Asb14
  gRNA
aucuucuuauaaucaucacu

SEQ ID NO: 72793 - RNA, 20 nt, Artificial Sequence
  MKO10072793_B_Asb15
  gRNA
caaggguguuucuccaucac

SEQ ID NO: 72794 - RNA, 20 nt, Artificial Sequence
  MKO10072794_B_Asb15
  gRNA
ugcccacucaccuugccuua

SEQ ID NO: 72795 - RNA, 20 nt, Artificial Sequence
  MKO10072795_B_Asb15
  gRNA
cgucucaaguaucuguugaa

SEQ ID NO: 72796 - RNA, 20 nt, Artificial Sequence
  MKO10072796_B_Asb16
  gRNA
cucgaacagccaagcgugcc

SEQ ID NO: 72797 - RNA, 20 nt, Artificial Sequence
  MKO10072797_B_Asb16
  gRNA
uugggcacacgccucgugca

SEQ ID NO: 72798 - RNA, 20 nt, Artificial Sequence
  MKO10072798_B_Asb16
  gRNA
gggccgcagccugacgacag

SEQ ID NO: 72799 - RNA, 20 nt, Artificial Sequence
  MKO10072799_B_Asb17
  gRNA
caaaagcaauauaguccgug

SEQ ID NO: 72800 - RNA, 20 nt, Artificial Sequence
  MKO10072800_B_Asb17
  gRNA
gacgcccaauuauucaaaau

SEQ ID NO: 72801 - RNA, 20 nt, Artificial Sequence
  MKO10072801_B_Asb17
  gRNA
caucccgccaacaagauaca

SEQ ID NO: 72802 - RNA, 20 nt, Artificial Sequence
  MKO10072802_B_Asb18
  gRNA
ggcgguaugguucccgagac

SEQ ID NO: 72803 - RNA, 20 nt, Artificial Sequence
  MKO10072803_B_Asb18
  gRNA
acugaucucaaacaccgcgu

SEQ ID NO: 72804 - RNA, 20 nt, Artificial Sequence
  MKO10072804_B_Asb18
  gRNA
caucccugaagaaguauacc

SEQ ID NO: 72805 - RNA, 20 nt, Artificial Sequence
  MKO10072805_B_Asb1
  gRNA
ccucggccccuuugcguaug

SEQ ID NO: 72806 - RNA, 20 nt, Artificial Sequence
  MKO10072806_B_Asb1
  gRNA
ggaccuugcugaguuugugc

SEQ ID NO: 72807 - RNA, 20 nt, Artificial Sequence
  MKO10072807_B_Asb1
  gRNA
cagugcagguccuaaucuga

SEQ ID NO: 72808 - RNA, 20 nt, Artificial Sequence
  MKO10072808_B_Asb2
  gRNA
cauugaccaacgcacacugc

SEQ ID NO: 72809 - RNA, 20 nt, Artificial Sequence
  MKO10072809_B_Asb2
  gRNA
uucgucucccgagaacccac

SEQ ID NO: 72810 - RNA, 20 nt, Artificial Sequence
  MKO10072810_B_Asb2
  gRNA
ggccauaguaggcagccucg

SEQ ID NO: 72811 - RNA, 20 nt, Artificial Sequence
  MKO10072811_B_Asb3
  gRNA
aaaugucaauugccaagccu

SEQ ID NO: 72812 - RNA, 20 nt, Artificial Sequence
  MKO10072812_B_Asb3
  gRNA
ucuugugcagcaauaaacaa

SEQ ID NO: 72813 - RNA, 20 nt, Artificial Sequence
  MKO10072813_B_Asb3
  gRNA
cuguuuguggcugcucagua

SEQ ID NO: 72814 - RNA, 20 nt, Artificial Sequence
  MKO10072814_B_Asb4
  gRNA
augccuaugaacacauucga

SEQ ID NO: 72815 - RNA, 20 nt, Artificial Sequence
  MKO10072815_B_Asb4
  gRNA
accaucaacugucgucccaa

SEQ ID NO: 72816 - RNA, 20 nt, Artificial Sequence
  MKO10072816_B_Asb4
  gRNA
guuccaucgaauguguucau

SEQ ID NO: 72817 - RNA, 20 nt, Artificial Sequence
  MKO10072817_B_Asb5
  gRNA
gaguccuugcacaggccacg

SEQ ID NO: 72818 - RNA, 20 nt, Artificial Sequence
  MKO10072818_B_Asb5
  gRNA
ccuaggcaggccucauggag

SEQ ID NO: 72819 - RNA, 20 nt, Artificial Sequence
  MKO10072819_B_Asb5
  gRNA
cacagcaguuccauugcauc

SEQ ID NO: 72820 - RNA, 20 nt, Artificial Sequence
  MKO10072820_B_Asb6
  gRNA
accagcagcucaaccauguc

SEQ ID NO: 72821 - RNA, 20 nt, Artificial Sequence
  MKO10072821_B_Asb6
  gRNA
gcugcugaccuucgaaauug

SEQ ID NO: 72822 - RNA, 20 nt, Artificial Sequence
  MKO10072822_B_Asb6
  gRNA
gcccugccugcagcgccucu

SEQ ID NO: 72823 - RNA, 20 nt, Artificial Sequence
  MKO10072823_B_Asb7
  gRNA
guagcucaucaagcagcuuc

SEQ ID NO: 72824 - RNA, 20 nt, Artificial Sequence
  MKO10072824_B_Asb7
  gRNA
auuaaaauucgacaguguau

SEQ ID NO: 72825 - RNA, 20 nt, Artificial Sequence
  MKO10072825_B_Asb7
  gRNA
ccaaauggccgagaugccaa

SEQ ID NO: 72826 - RNA, 20 nt, Artificial Sequence
  MKO10072826_B_Asb8
  gRNA
cuucccacaugacaacguag

SEQ ID NO: 72827 - RNA, 20 nt, Artificial Sequence
  MKO10072827_B_Asb8
  gRNA
cucuacguugucauguggga

SEQ ID NO: 72828 - RNA, 20 nt, Artificial Sequence
  MKO10072828_B_Asb8
  gRNA
cgacugcguagagcuccucc

SEQ ID NO: 72829 - RNA, 20 nt, Artificial Sequence
  MKO10072829_B_Asb9
  gRNA
auccaugaggcugcuaaaag

SEQ ID NO: 72830 - RNA, 20 nt, Artificial Sequence
  MKO10072830_B_Asb9
  gRNA
gugaaucugcugcuacagca

SEQ ID NO: 72831 - RNA, 20 nt, Artificial Sequence
  MKO10072831_B_Asb9
  gRNA
gcugauguuauagucaauau

SEQ ID NO: 72832 - RNA, 20 nt, Artificial Sequence
  MKO10072832_B_Ascc1
  gRNA
gauccugcagcgcuguaaag

SEQ ID NO: 72833 - RNA, 20 nt, Artificial Sequence
  MKO10072833_B_Ascc1
  gRNA
ucuauuaacauuccgaagca

SEQ ID NO: 72834 - RNA, 20 nt, Artificial Sequence
  MKO10072834_B_Ascc1
  gRNA
guugguacuucuaagugagc

SEQ ID NO: 72835 - RNA, 20 nt, Artificial Sequence
  MKO10072835_B_Ascc2
  gRNA
uaccccgaaaguuugaugag

SEQ ID NO: 72836 - RNA, 20 nt, Artificial Sequence
  MKO10072836_B_Ascc2
  gRNA
ggaucuucgggaugucaaag

SEQ ID NO: 72837 - RNA, 20 nt, Artificial Sequence
  MKO10072837_B_Ascc2
  gRNA
gccaaguuacuauacugacc

SEQ ID NO: 72838 - RNA, 20 nt, Artificial Sequence
  MKO10072838_B_Ascc3
  gRNA
ucaaucagauccaguccuuc

SEQ ID NO: 72839 - RNA, 20 nt, Artificial Sequence
  MKO10072839_B_Ascc3
  gRNA
gugacuugacauccauaauu

SEQ ID NO: 72840 - RNA, 20 nt, Artificial Sequence
  MKO10072840_B_Ascc3
  gRNA
uuguuuacuaccucuguauc

SEQ ID NO: 72841 - RNA, 20 nt, Artificial Sequence
  MKO10072841_B_Ascl1
  gRNA
cgcggugagcgcugccuuuc

SEQ ID NO: 72842 - RNA, 20 nt, Artificial Sequence
  MKO10072842_B_Ascl1
  gRNA
gcgcucguugcggcgcgcca

SEQ ID NO: 72843 - RNA, 20 nt, Artificial Sequence
  MKO10072843_B_Ascl1
  gRNA
cgaagccgcugaaguugagc

SEQ ID NO: 72844 - RNA, 20 nt, Artificial Sequence
  MKO10072844_B_Ascl2
  gRNA
cccgcgcuccgccuacucgu

SEQ ID NO: 72845 - RNA, 20 nt, Artificial Sequence
  MKO10072845_B_Ascl2
  gRNA
gccgcaccagaacucguagc

SEQ ID NO: 72846 - RNA, 20 nt, Artificial Sequence
  MKO10072846_B_Ascl2
  gRNA
aguacauucgugcgcugcag

SEQ ID NO: 72847 - RNA, 20 nt, Artificial Sequence
  MKO10072847_B_Ascl3
  gRNA
cggcccacuuaccacugucc

SEQ ID NO: 72848 - RNA, 20 nt, Artificial Sequence
  MKO10072848_B_Ascl3
  gRNA
ccaugccuuacaccaacuac

SEQ ID NO: 72849 - RNA, 20 nt, Artificial Sequence
  MKO10072849_B_Ascl3
  gRNA
gagccgcagcuggcuguucg

SEQ ID NO: 72850 - RNA, 20 nt, Artificial Sequence
  MKO10072850_B_Ascl4
  gRNA
gccgcucgcgcucguugcgu

SEQ ID NO: 72851 - RNA, 20 nt, Artificial Sequence
  MKO10072851_B_Ascl4
  gRNA
gcgcgugcgcugugugaacg

SEQ ID NO: 72852 - RNA, 20 nt, Artificial Sequence
  MKO10072852_B_Ascl4
  gRNA
cucgcccugcagcgagucug

SEQ ID NO: 72853 - RNA, 20 nt, Artificial Sequence
  MKO10072853_B_Ascl5
  gRNA
gcgcgucaagugcgugaaug

SEQ ID NO: 72854 - RNA, 20 nt, Artificial Sequence
  MKO10072854_B_Ascl5
  gRNA
agaagcgcaacgagcgagag

SEQ ID NO: 72855 - RNA, 20 nt, Artificial Sequence
  MKO10072855_B_Ascl5
  gRNA
ggcgggagguggcgcgccgu

SEQ ID NO: 72856 - RNA, 20 nt, Artificial Sequence
  MKO10072856_B_Asf1a
  gRNA
uaggcugaugcaccgaaugc

SEQ ID NO: 72857 - RNA, 20 nt, Artificial Sequence
  MKO10072857_B_Asf1a
  gRNA
ugcauuaccgucagcgucaa

SEQ ID NO: 72858 - RNA, 20 nt, Artificial Sequence
  MKO10072858_B_Asf1a
  gRNA
uguuauguuagaaucccaca

SEQ ID NO: 72859 - RNA, 20 nt, Artificial Sequence
  MKO10072859_B_Asf1b
  gRNA
ugucccaguugauauggaau

SEQ ID NO: 72860 - RNA, 20 nt, Artificial Sequence
  MKO10072860_B_Asf1b
  gRNA
uguugacauaguagcccaca

SEQ ID NO: 72861 - RNA, 20 nt, Artificial Sequence
  MKO10072861_B_Asf1b
  gRNA
cauaaaugaucuuccacucc

SEQ ID NO: 72862 - RNA, 20 nt, Artificial Sequence
  MKO10072862_B_Asgr1
  gRNA
uuagagccagcagaucuucc

SEQ ID NO: 72863 - RNA, 20 nt, Artificial Sequence
  MKO10072863_B_Asgr1
  gRNA
gagccucagcauucuguugc

SEQ ID NO: 72864 - RNA, 20 nt, Artificial Sequence
  MKO10072864_B_Asgr1
  gRNA
cuugcuuagauucccaacuc

SEQ ID NO: 72865 - RNA, 20 nt, Artificial Sequence
  MKO10072865_B_Asgr2
  gRNA
ccagagccccgaacuccauc

SEQ ID NO: 72866 - RNA, 20 nt, Artificial Sequence
  MKO10072866_B_Asgr2
  gRNA
aacguggagcagaggcgcug

SEQ ID NO: 72867 - RNA, 20 nt, Artificial Sequence
  MKO10072867_B_Asgr2
  gRNA
uacagcugcaagaagaguuu

SEQ ID NO: 72868 - RNA, 20 nt, Artificial Sequence
  MKO10072868_B_Ash1l
  gRNA
auuguagcccuacucguaaa

SEQ ID NO: 72869 - RNA, 20 nt, Artificial Sequence
  MKO10072869_B_Ash1l
  gRNA
aagguuuaucggaagcugac

SEQ ID NO: 72870 - RNA, 20 nt, Artificial Sequence
  MKO10072870_B_Ash1l
  gRNA
ggccgcccaguuugucagcc

SEQ ID NO: 72871 - RNA, 20 nt, Artificial Sequence
  MKO10072871_B_Ash2l
  gRNA
ucacgacgugucuauuccaa

SEQ ID NO: 72872 - RNA, 20 nt, Artificial Sequence
  MKO10072872_B_Ash2l
  gRNA
auugcaauggaagcuguagu

SEQ ID NO: 72873 - RNA, 20 nt, Artificial Sequence
  MKO10072873_B_Ash2l
  gRNA
caauaacauugucaaaacaa

SEQ ID NO: 72874 - RNA, 20 nt, Artificial Sequence
  MKO10072874_B_Asic1
  gRNA
gggcuugaagcuacggaagu

SEQ ID NO: 72875 - RNA, 20 nt, Artificial Sequence
  MKO10072875_B_Asic1
  gRNA
ggaaaacugcaacugccgua

SEQ ID NO: 72876 - RNA, 20 nt, Artificial Sequence
  MKO10072876_B_Asic1
  gRNA
ugauugugaaacccguuacc

SEQ ID NO: 72877 - RNA, 20 nt, Artificial Sequence
  MKO10072877_B_Asic2
  gRNA
ucaagggggggacgggcaac

SEQ ID NO: 72878 - RNA, 20 nt, Artificial Sequence
  MKO10072878_B_Asic2
  gRNA
gaggaaacaacguuugaagc

SEQ ID NO: 72879 - RNA, 20 nt, Artificial Sequence
  MKO10072879_B_Asic2
  gRNA
uccgggguuccagaccuucg

SEQ ID NO: 72880 - RNA, 20 nt, Artificial Sequence
  MKO10072880_B_Asic3
  gRNA
gccaacauacuugcuguugc

SEQ ID NO: 72881 - RNA, 20 nt, Artificial Sequence
  MKO10072881_B_Asic3
  gRNA
acucggauccccaccucaaa

SEQ ID NO: 72882 - RNA, 20 nt, Artificial Sequence
  MKO10072882_B_Asic3
  gRNA
agagcugcucaccacuccua

SEQ ID NO: 72883 - RNA, 20 nt, Artificial Sequence
  MKO10072883_B_Asic4
  gRNA
gccgggcggaaagcgagcuc

SEQ ID NO: 72884 - RNA, 20 nt, Artificial Sequence
  MKO10072884_B_Asic4
  gRNA
aggcggcauggguaguggcc

SEQ ID NO: 72885 - RNA, 20 nt, Artificial Sequence
  MKO10072885_B_Asic4
  gRNA
ggaugcucacccgcuguucc

SEQ ID NO: 72886 - RNA, 20 nt, Artificial Sequence
  MKO10072886_B_Asic5
  gRNA
cuccaaaguccuccgccuuc

SEQ ID NO: 72887 - RNA, 20 nt, Artificial Sequence
  MKO10072887_B_Asic5
  gRNA
gaaccagaacaaaguucgaa

SEQ ID NO: 72888 - RNA, 20 nt, Artificial Sequence
  MKO10072888_B_Asic5
  gRNA
uuaucucaauaacgacacuu

SEQ ID NO: 72889 - RNA, 20 nt, Artificial Sequence
  MKO10072889_B_Asl
  gRNA
gggugcugucgaccccauca

SEQ ID NO: 72890 - RNA, 20 nt, Artificial Sequence
  MKO10072890_B_Asl
  gRNA
uuggccagagcgggaagcua

SEQ ID NO: 72891 - RNA, 20 nt, Artificial Sequence
  MKO10072891_B_Asl
  gRNA
cacagguggucacggaccuc

SEQ ID NO: 72892 - RNA, 20 nt, Artificial Sequence
  MKO10072892_B_Asmt
  gRNA
gcgagaggucgaaggccgug

SEQ ID NO: 72893 - RNA, 20 nt, Artificial Sequence
  MKO10072893_B_Asmt
  gRNA
aagggcggagccaguacgcg

SEQ ID NO: 72894 - RNA, 20 nt, Artificial Sequence
  MKO10072894_B_Asmt
  gRNA
acagguagguggugcccgcc

SEQ ID NO: 72895 - RNA, 20 nt, Artificial Sequence
  MKO10072895_B_Asna1
  gRNA
gucuuccucgaagaacucgu

SEQ ID NO: 72896 - RNA, 20 nt, Artificial Sequence
  MKO10072896_B_Asna1
  gRNA
aucuguuagcgaacaguuca

SEQ ID NO: 72897 - RNA, 20 nt, Artificial Sequence
  MKO10072897_B_Asna1
  gRNA
ccuggcaguccagcugucga

SEQ ID NO: 72898 - RNA, 20 nt, Artificial Sequence
  MKO10072898_B_Asnsd1
  gRNA
guagaccucacucugccccg

SEQ ID NO: 72899 - RNA, 20 nt, Artificial Sequence
  MKO10072899_B_Asnsd1
  gRNA
uaacucugucaucacgacca

SEQ ID NO: 72900 - RNA, 20 nt, Artificial Sequence
  MKO10072900_B_Asnsd1
  gRNA
gacagaguuauuggugauca

SEQ ID NO: 72901 - RNA, 20 nt, Artificial Sequence
  MKO10072901_B_Asns
  gRNA
cgaugccuccuuugucauag

SEQ ID NO: 72902 - RNA, 20 nt, Artificial Sequence
  MKO10072902_B_Asns
  gRNA
cagcaaccaagcucgagucc

SEQ ID NO: 72903 - RNA, 20 nt, Artificial Sequence
  MKO10072903_B_Asns
  gRNA
cgagaaaaccaucuguaugc

SEQ ID NO: 72904 - RNA, 20 nt, Artificial Sequence
  MKO10072904_B_Aspa
  gRNA
ucagcucuaaggacaccgug

SEQ ID NO: 72905 - RNA, 20 nt, Artificial Sequence
  MKO10072905_B_Aspa
  gRNA
gugguugcauauuugaguga

SEQ ID NO: 72906 - RNA, 20 nt, Artificial Sequence
  MKO10072906_B_Aspa
  gRNA
ucagauguuucacuauauua

SEQ ID NO: 72907 - RNA, 20 nt, Artificial Sequence
  MKO10072907_B_Aspdh
  gRNA
ccgugucauuggggugcuug

SEQ ID NO: 72908 - RNA, 20 nt, Artificial Sequence
  MKO10072908_B_Aspdh
  gRNA
cucgggccacaaacacagug

SEQ ID NO: 72909 - RNA, 20 nt, Artificial Sequence
  MKO10072909_B_Aspdh
  gRNA
ccuucgccaugcaaaccucc

SEQ ID NO: 72910 - RNA, 20 nt, Artificial Sequence
  MKO10072910_B_Aspg
  gRNA
gcaccguguagaugauccuc

SEQ ID NO: 72911 - RNA, 20 nt, Artificial Sequence
  MKO10072911_B_Aspg
  gRNA
ccacgaugaagaguaugcac

SEQ ID NO: 72912 - RNA, 20 nt, Artificial Sequence
  MKO10072912_B_Aspg
  gRNA
cacccucuaccucuaugguu

SEQ ID NO: 72913 - RNA, 20 nt, Artificial Sequence
  MKO10072913_B_Asphd1
  gRNA
gccucgaguggucuucauug

SEQ ID NO: 72914 - RNA, 20 nt, Artificial Sequence
  MKO10072914_B_Asphd1
  gRNA
ccaacaaccaacucacaacc

SEQ ID NO: 72915 - RNA, 20 nt, Artificial Sequence
  MKO10072915_B_Asphd1
  gRNA
acaggccugaagaucccucc

SEQ ID NO: 72916 - RNA, 20 nt, Artificial Sequence
  MKO10072916_B_Asphd2
  gRNA
acguucagcagcugccacgu

SEQ ID NO: 72917 - RNA, 20 nt, Artificial Sequence
  MKO10072917_B_Asphd2
  gRNA
cuucauggaacgcagugugc

SEQ ID NO: 72918 - RNA, 20 nt, Artificial Sequence
  MKO10072918_B_Asphd2
  gRNA
uggggggcgagccccagugc

SEQ ID NO: 72919 - RNA, 20 nt, Artificial Sequence
  MKO10072919_B_Asph
  gRNA
uggcgauggagacuuugaug

SEQ ID NO: 72920 - RNA, 20 nt, Artificial Sequence
  MKO10072920_B_Asph
  gRNA
guaccucugauaaguuauaa

SEQ ID NO: 72921 - RNA, 20 nt, Artificial Sequence
  MKO10072921_B_Asph
  gRNA
guacuugccuaauaaaacuu

SEQ ID NO: 72922 - RNA, 20 nt, Artificial Sequence
  MKO10072922_B_Aspm
  gRNA
cugcaacuguugucguugcu

SEQ ID NO: 72923 - RNA, 20 nt, Artificial Sequence
  MKO10072923_B_Aspm
  gRNA
cauuuccuaguaauauagcc

SEQ ID NO: 72924 - RNA, 20 nt, Artificial Sequence
  MKO10072924_B_Aspm
  gRNA
ccguuuaccuuuagaaacau

SEQ ID NO: 72925 - RNA, 20 nt, Artificial Sequence
  MKO10072925_B_Aspn
  gRNA
gcaaacccucuugagaacaa

SEQ ID NO: 72926 - RNA, 20 nt, Artificial Sequence
  MKO10072926_B_Aspn
  gRNA
uaaguggaauuucacuuagu

SEQ ID NO: 72927 - RNA, 20 nt, Artificial Sequence
  MKO10072927_B_Aspn
  gRNA
aaaugaagcuccagcaaagu

SEQ ID NO: 72928 - RNA, 20 nt, Artificial Sequence
  MKO10072928_B_Asprv1
  gRNA
ucccuucaacucguccaggc

SEQ ID NO: 72929 - RNA, 20 nt, Artificial Sequence
  MKO10072929_B_Asprv1
  gRNA
uccuccaaggagcucccgac

SEQ ID NO: 72930 - RNA, 20 nt, Artificial Sequence
  MKO10072930_B_Asprv1
  gRNA
guuccugaaagagucgcuca

SEQ ID NO: 72931 - RNA, 20 nt, Artificial Sequence
  MKO10072931_B_Aspscr1
  gRNA
acagaaagcguccugcaacc

SEQ ID NO: 72932 - RNA, 20 nt, Artificial Sequence
  MKO10072932_B_Aspscr1
  gRNA
gaacacaacccuucagucac

SEQ ID NO: 72933 - RNA, 20 nt, Artificial Sequence
  MKO10072933_B_Aspscr1
  gRNA
cugaaggguuguguucugua

SEQ ID NO: 72934 - RNA, 20 nt, Artificial Sequence
  MKO10072934_B_Asrgl1
  gRNA
gcgcgagggcaucgccagag

SEQ ID NO: 72935 - RNA, 20 nt, Artificial Sequence
  MKO10072935_B_Asrgl1
  gRNA
guuggagacucgccuugcau

SEQ ID NO: 72936 - RNA, 20 nt, Artificial Sequence
  MKO10072936_B_Asrgl1
  gRNA
aacaagccgugcaaguuuaa

SEQ ID NO: 72937 - RNA, 20 nt, Artificial Sequence
  MKO10072937_B_Ass1
  gRNA
uaacaucuuaccuuaaucug

SEQ ID NO: 72938 - RNA, 20 nt, Artificial Sequence
  MKO10072938_B_Ass1
  gRNA
acaggccaacauuggccaga

SEQ ID NO: 72939 - RNA, 20 nt, Artificial Sequence
  MKO10072939_B_Ass1
  gRNA
aagcuucagcgccuucuucc

SEQ ID NO: 72940 - RNA, 20 nt, Artificial Sequence
  MKO10072940_B_Aste1
  gRNA
ccuaccagggcuguugacga

SEQ ID NO: 72941 - RNA, 20 nt, Artificial Sequence
  MKO10072941_B_Aste1
  gRNA
caugcggccggguccaagag

SEQ ID NO: 72942 - RNA, 20 nt, Artificial Sequence
  MKO10072942_B_Aste1
  gRNA
ggugcuuaccaaguuagguu

SEQ ID NO: 72943 - RNA, 20 nt, Artificial Sequence
  MKO10072943_B_Astl
  gRNA
accgcuacauccaagucaac

SEQ ID NO: 72944 - RNA, 20 nt, Artificial Sequence
  MKO10072944_B_Astl
  gRNA
ucccagaugaacucagccgc

SEQ ID NO: 72945 - RNA, 20 nt, Artificial Sequence
  MKO10072945_B_Astl
  gRNA
ggauaauguccccuucuacc

SEQ ID NO: 72946 - RNA, 20 nt, Artificial Sequence
  MKO10072946_B_Astn1
  gRNA
auugcugccuccagcgcacc

SEQ ID NO: 72947 - RNA, 20 nt, Artificial Sequence
  MKO10072947_B_Astn1
  gRNA
guccccuucaggguucaaga

SEQ ID NO: 72948 - RNA, 20 nt, Artificial Sequence
  MKO10072948_B_Astn1
  gRNA
uaucauagccacaagccccg

SEQ ID NO: 72949 - RNA, 20 nt, Artificial Sequence
  MKO10072949_B_Astn2
  gRNA
agccaaccacgucucccgug

SEQ ID NO: 72950 - RNA, 20 nt, Artificial Sequence
  MKO10072950_B_Astn2
  gRNA
cacuguaugcccagcgacgc

SEQ ID NO: 72951 - RNA, 20 nt, Artificial Sequence
  MKO10072951_B_Astn2
  gRNA
gcgguacugcucuguguaga

SEQ ID NO: 72952 - RNA, 20 nt, Artificial Sequence
  MKO10072952_B_Asun
  gRNA
acaaggcuaucuucaccaac

SEQ ID NO: 72953 - RNA, 20 nt, Artificial Sequence
  MKO10072953_B_Asun
  gRNA
uugauucacaccuacccagu

SEQ ID NO: 72954 - RNA, 20 nt, Artificial Sequence
  MKO10072954_B_Asun
  gRNA
gaauuucauuguuagugauu

SEQ ID NO: 72955 - RNA, 20 nt, Artificial Sequence
  MKO10072955_B_Asxl1
  gRNA
augaccugcagaaucuguuu

SEQ ID NO: 72956 - RNA, 20 nt, Artificial Sequence
  MKO10072956_B_Asxl1
  gRNA
gacaccaaaacagauucugc

SEQ ID NO: 72957 - RNA, 20 nt, Artificial Sequence
  MKO10072957_B_Asxl1
  gRNA
cccacagcuuuccacaucag

SEQ ID NO: 72958 - RNA, 20 nt, Artificial Sequence
  MKO10072958_B_Asxl2
  gRNA
gagucauaaagaaauucuuc

SEQ ID NO: 72959 - RNA, 20 nt, Artificial Sequence
  MKO10072959_B_Asxl2
  gRNA
aagaauuucuuuaugacuca

SEQ ID NO: 72960 - RNA, 20 nt, Artificial Sequence
  MKO10072960_B_Asxl2
  gRNA
uuucagaaagaugugccaga

SEQ ID NO: 72961 - RNA, 20 nt, Artificial Sequence
  MKO10072961_B_Asxl3
  gRNA
uuaggauccgagucuaaaaa

SEQ ID NO: 72962 - RNA, 20 nt, Artificial Sequence
  MKO10072962_B_Asxl3
  gRNA
cugccaucucagcgccaucc

SEQ ID NO: 72963 - RNA, 20 nt, Artificial Sequence
  MKO10072963_B_Asxl3
  gRNA
ugcucaucagacaccuuuaa

SEQ ID NO: 72964 - RNA, 20 nt, Artificial Sequence
  MKO10072964_B_Asz1
  gRNA
agagcugguucgcuuccuuu

SEQ ID NO: 72965 - RNA, 20 nt, Artificial Sequence
  MKO10072965_B_Asz1
  gRNA
auaagugcuuguucugcucg

SEQ ID NO: 72966 - RNA, 20 nt, Artificial Sequence
  MKO10072966_B_Asz1
  gRNA
ucuuaccuacaagcaguauu

SEQ ID NO: 72967 - RNA, 20 nt, Artificial Sequence
  MKO10072967_B_Auad1
  gRNA
ucaucaucgcuguagcuucg

SEQ ID NO: 72968 - RNA, 20 nt, Artificial Sequence
  MKO10072968_B_Auad1
  gRNA
agacuacugcagccuccaaa

SEQ ID NO: 72969 - RNA, 20 nt, Artificial Sequence
  MKO10072969_B_Auad1
  gRNA
auacgcacaugcauauuaag

SEQ ID NO: 72970 - RNA, 20 nt, Artificial Sequence
  MKO10072970_B_Auad2b
  gRNA
uguuucaaagugcguuuggc

SEQ ID NO: 72971 - RNA, 20 nt, Artificial Sequence
  MKO10072971_B_Auad2b
  gRNA
ggcgaccuuucauguauaaa

SEQ ID NO: 72972 - RNA, 20 nt, Artificial Sequence
  MKO10072972_B_Auad2b
  gRNA
cuucgaagccacccccuucg

SEQ ID NO: 72973 - RNA, 20 nt, Artificial Sequence
  MKO10072973_B_Auad2
  gRNA
accuuaaagagcgcguguug

SEQ ID NO: 72974 - RNA, 20 nt, Artificial Sequence
  MKO10072974_B_Auad2
  gRNA
ucgugcaaauguucugcagu

SEQ ID NO: 72975 - RNA, 20 nt, Artificial Sequence
  MKO10072975_B_Auad2
  gRNA
ugaaaaagaugcgcagacag

SEQ ID NO: 72976 - RNA, 20 nt, Artificial Sequence
  MKO10072976_B_Auad3a
  gRNA
guucccugcaggccaugcca

SEQ ID NO: 72977 - RNA, 20 nt, Artificial Sequence
  MKO10072977_B_Auad3a
  gRNA
ugcgagacucagugccuccu

SEQ ID NO: 72978 - RNA, 20 nt, Artificial Sequence
  MKO10072978_B_Auad3a
  gRNA
uucgcucuucagcugcucua

SEQ ID NO: 72979 - RNA, 20 nt, Artificial Sequence
  MKO10072979_B_Auad5
  gRNA
ugccuagaggaccgccucaa

SEQ ID NO: 72980 - RNA, 20 nt, Artificial Sequence
  MKO10072980_B_Auad5
  gRNA
cagaaucugaaugauguacu

SEQ ID NO: 72981 - RNA, 20 nt, Artificial Sequence
  MKO10072981_B_Auad5
  gRNA
uaagaaaucugaaacaacug

SEQ ID NO: 72982 - RNA, 20 nt, Artificial Sequence
  MKO10072982_B_Auau1
  gRNA
uaagacucacggucgggcug

SEQ ID NO: 72983 - RNA, 20 nt, Artificial Sequence
  MKO10072983_B_Auau1
  gRNA
caugacuauuguagaugagc

SEQ ID NO: 72984 - RNA, 20 nt, Artificial Sequence
  MKO10072984_B_Auau1
  gRNA
gcuucuuguauccaacuuug

SEQ ID NO: 72985 - RNA, 20 nt, Artificial Sequence
  MKO10072985_B_Aucay
  gRNA
acagcagagagcccucgcuu

SEQ ID NO: 72986 - RNA, 20 nt, Artificial Sequence
  MKO10072986_B_Aucay
  gRNA
uccaugauguagugauaguc

SEQ ID NO: 72987 - RNA, 20 nt, Artificial Sequence
  MKO10072987_B_Aucay
  gRNA
cccagacuaucacuacauca

SEQ ID NO: 72988 - RNA, 20 nt, Artificial Sequence
  MKO10072988_B_Ate1
  gRNA
cagcauguuugauccaugac

SEQ ID NO: 72989 - RNA, 20 nt, Artificial Sequence
  MKO10072989_B_Ate1
  gRNA
cugauaauccugcacuguca

SEQ ID NO: 72990 - RNA, 20 nt, Artificial Sequence
  MKO10072990_B_Ate1
  gRNA
gcuguccucaguauacaaua

SEQ ID NO: 72991 - RNA, 20 nt, Artificial Sequence
  MKO10072991_B_Atf1
  gRNA
aaaguacugaccuguaggau

SEQ ID NO: 72992 - RNA, 20 nt, Artificial Sequence
  MKO10072992_B_Atf1
  gRNA
acuuacucuguacaaccacc

SEQ ID NO: 72993 - RNA, 20 nt, Artificial Sequence
  MKO10072993_B_Atf1
  gRNA
gucaucguuaucagaaagug

SEQ ID NO: 72994 - RNA, 20 nt, Artificial Sequence
  MKO10072994_B_Atf2
  gRNA
cguucguccagcaucauuac

SEQ ID NO: 72995 - RNA, 20 nt, Artificial Sequence
  MKO10072995_B_Atf2
  gRNA
uauguuaccuggccacaccc

SEQ ID NO: 72996 - RNA, 20 nt, Artificial Sequence
  MKO10072996_B_Atf2
  gRNA
ccuaaaaaacugugaagaag

SEQ ID NO: 72997 - RNA, 20 nt, Artificial Sequence
  MKO10072997_B_Atf3
  gRNA
gauggcagagguguuuauuc

SEQ ID NO: 72998 - RNA, 20 nt, Artificial Sequence
  MKO10072998_B_Atf3
  gRNA
cggccccugaagaagaugag

SEQ ID NO: 72999 - RNA, 20 nt, Artificial Sequence
  MKO10072999_B_Atf3
  gRNA
caagugucgaaacaagaaaa

SEQ ID NO: 73000 - RNA, 20 nt, Artificial Sequence
  MKO10073000_B_Atf4
  gRNA
gggucauaagguuugggccg

SEQ ID NO: 73001 - RNA, 20 nt, Artificial Sequence
  MKO10073001_B_Atf4
  gRNA
cuucagcccccaaacccgac

SEQ ID NO: 73002 - RNA, 20 nt, Artificial Sequence
  MKO10073002_B_Atf4
  gRNA
gcuccuuacacucgccagug

SEQ ID NO: 73003 - RNA, 20 nt, Artificial Sequence
  MKO10073003_B_Atf5
  gRNA
agacuaugggaaacuccccc

SEQ ID NO: 73004 - RNA, 20 nt, Artificial Sequence
  MKO10073004_B_Atf5
  gRNA
ccuaguccugccagcacacg

SEQ ID NO: 73005 - RNA, 20 nt, Artificial Sequence
  MKO10073005_B_Atf5
  gRNA
cgugaaggaccugcuaauug

SEQ ID NO: 73006 - RNA, 20 nt, Artificial Sequence
  MKO10073006_B_Atf6b
  gRNA
augcuggaucaucccccagc

SEQ ID NO: 73007 - RNA, 20 nt, Artificial Sequence
  MKO10073007_B_Atf6b
  gRNA
agagggucccaagggggcuc

SEQ ID NO: 73008 - RNA, 20 nt, Artificial Sequence
  MKO10073008_B_Atf6b
  gRNA
gggcgccuuaccugggaaga

SEQ ID NO: 73009 - RNA, 20 nt, Artificial Sequence
  MKO10073009_B_Atf6
  gRNA
gcacuuugaugcagcacaug

SEQ ID NO: 73010 - RNA, 20 nt, Artificial Sequence
  MKO10073010_B_Atf6
  gRNA
caguccccccuuuccuuaua

SEQ ID NO: 73011 - RNA, 20 nt, Artificial Sequence
  MKO10073011_B_Atf6
  gRNA
ugccuugggagucagaccua

SEQ ID NO: 73012 - RNA, 20 nt, Artificial Sequence
  MKO10073012_B_Atf7ip2
  gRNA
caacauucguugacuuguuc

SEQ ID NO: 73013 - RNA, 20 nt, Artificial Sequence
  MKO10073013_B_Atf7ip2
  gRNA
aaaaaacaaagaaaauguua

SEQ ID NO: 73014 - RNA, 20 nt, Artificial Sequence
  MKO10073014_B_Atf7ip2
  gRNA
cuucaugucuacucuugcac

SEQ ID NO: 73015 - RNA, 20 nt, Artificial Sequence
  MKO10073015_B_Atf7ip
  gRNA
ugcuguguuugauaagacgu

SEQ ID NO: 73016 - RNA, 20 nt, Artificial Sequence
  MKO10073016_B_Atf7ip
  gRNA
auucuucauccauauaucgc

SEQ ID NO: 73017 - RNA, 20 nt, Artificial Sequence
  MKO10073017_B_Atf7ip
  gRNA
agaggagcgaguuccagccg

SEQ ID NO: 73018 - RNA, 20 nt, Artificial Sequence
  MKO10073018_B_Atf7
  gRNA
gcuuauguuuaugaacugcc

SEQ ID NO: 73019 - RNA, 20 nt, Artificial Sequence
  MKO10073019_B_Atf7
  gRNA
acggacucagucaucauugc

SEQ ID NO: 73020 - RNA, 20 nt, Artificial Sequence
  MKO10073020_B_Atf7
  gRNA
uuuccuaacagggugcugcu

SEQ ID NO: 73021 - RNA, 20 nt, Artificial Sequence
  MKO10073021_B_Aug10
  gRNA
aucacuucugccaccgcugc

SEQ ID NO: 73022 - RNA, 20 nt, Artificial Sequence
  MKO10073022_B_Aug10
  gRNA
uuacaggaacauccaauacu

SEQ ID NO: 73023 - RNA, 20 nt, Artificial Sequence
  MKO10073023_B_Aug10
  gRNA
aaaaaugguugcccaaguau

SEQ ID NO: 73024 - RNA, 20 nt, Artificial Sequence
  MKO10073024_B_Aug12
  gRNA
ucaucauaccaacuguuccg

SEQ ID NO: 73025 - RNA, 20 nt, Artificial Sequence
  MKO10073025_B_Aug12
  gRNA
ccugcauuacugcaaauccc

SEQ ID NO: 73026 - RNA, 20 nt, Artificial Sequence
  MKO10073026_B_Aug12
  gRNA
uucuggcucauccccaugcc

SEQ ID NO: 73027 - RNA, 20 nt, Artificial Sequence
  MKO10073027_B_Aug13
  gRNA
ccgucuguagggagauucua

SEQ ID NO: 73028 - RNA, 20 nt, Artificial Sequence
  MKO10073028_B_Aug13
  gRNA
cacauagaucgccccacagc

SEQ ID NO: 73029 - RNA, 20 nt, Artificial Sequence
  MKO10073029_B_Aug13
  gRNA
agucucuucucgcuauuaca

SEQ ID NO: 73030 - RNA, 20 nt, Artificial Sequence
  MKO10073030_B_Aug14
  gRNA
aaacagguuuauugacaaga

SEQ ID NO: 73031 - RNA, 20 nt, Artificial Sequence
  MKO10073031_B_Aug14
  gRNA
cugaagcaaacaauauguaa

SEQ ID NO: 73032 - RNA, 20 nt, Artificial Sequence
  MKO10073032_B_Aug14
  gRNA
auacagaguacuaaaagcua

SEQ ID NO: 73033 - RNA, 20 nt, Artificial Sequence
  MKO10073033_B_Aug16l1
  gRNA
accgaacugcacaagaagcg

SEQ ID NO: 73034 - RNA, 20 nt, Artificial Sequence
  MKO10073034_B_Aug16l1
  gRNA
uaccuuauuucaugccuauu

SEQ ID NO: 73035 - RNA, 20 nt, Artificial Sequence
  MKO10073035_B_Aug16l1
  gRNA
auauacagauaccaaguugc

SEQ ID NO: 73036 - RNA, 20 nt, Artificial Sequence
  MKO10073036_B_Aug16l2
  gRNA
ugccaucuccacccgacaug

SEQ ID NO: 73037 - RNA, 20 nt, Artificial Sequence
  MKO10073037_B_Aug16l2
  gRNA
cugcgcucuucuucaccacc

SEQ ID NO: 73038 - RNA, 20 nt, Artificial Sequence
  MKO10073038_B_Aug16l2
  gRNA
cugccacuucacccucagag

SEQ ID NO: 73039 - RNA, 20 nt, Artificial Sequence
  MKO10073039_B_Aug2a
  gRNA
caugaccacaagcuugcagc

SEQ ID NO: 73040 - RNA, 20 nt, Artificial Sequence
  MKO10073040_B_Aug2a
  gRNA
aagcagaacgaggccuuucc

SEQ ID NO: 73041 - RNA, 20 nt, Artificial Sequence
  MKO10073041_B_Aug2a
  gRNA
cacagugcuccggaggauca

SEQ ID NO: 73042 - RNA, 20 nt, Artificial Sequence
  MKO10073042_B_Aug2b
  gRNA
auagugcaaaccuguuucga

SEQ ID NO: 73043 - RNA, 20 nt, Artificial Sequence
  MKO10073043_B_Aug2b
  gRNA
cguguguucaacugcaccag

SEQ ID NO: 73044 - RNA, 20 nt, Artificial Sequence
  MKO10073044_B_Aug2b
  gRNA
cacuugaaauccgaguagac

SEQ ID NO: 73045 - RNA, 20 nt, Artificial Sequence
  MKO10073045_B_Aug3
  gRNA
ccugcauaguuuguggcagc

SEQ ID NO: 73046 - RNA, 20 nt, Artificial Sequence
  MKO10073046_B_Aug3
  gRNA
uaguccaccacuguccaaca

SEQ ID NO: 73047 - RNA, 20 nt, Artificial Sequence
  MKO10073047_B_Aug3
  gRNA
accaaaaauuguuugucugu

SEQ ID NO: 73048 - RNA, 20 nt, Artificial Sequence
  MKO10073048_B_Aug4a
  gRNA
cucuaugaauucugccccug

SEQ ID NO: 73049 - RNA, 20 nt, Artificial Sequence
  MKO10073049_B_Aug4a
  gRNA
gcucauugugccccuucgcu

SEQ ID NO: 73050 - RNA, 20 nt, Artificial Sequence
  MKO10073050_B_Aug4a
  gRNA
cugauauaagugcucgccua

SEQ ID NO: 73051 - RNA, 20 nt, Artificial Sequence
  MKO10073051_B_Aug4b
  gRNA
aguagcuguccuuccugucg

SEQ ID NO: 73052 - RNA, 20 nt, Artificial Sequence
  MKO10073052_B_Aug4b
  gRNA
gaugaucuuugcccaggccc

SEQ ID NO: 73053 - RNA, 20 nt, Artificial Sequence
  MKO10073053_B_Aug4b
  gRNA
cugauguugcauccagacuu

SEQ ID NO: 73054 - RNA, 20 nt, Artificial Sequence
  MKO10073054_B_Aug4c
  gRNA
gcuaacuauuuauguugccc

SEQ ID NO: 73055 - RNA, 20 nt, Artificial Sequence
  MKO10073055_B_Aug4c
  gRNA
gaauguggaagaguuccgua

SEQ ID NO: 73056 - RNA, 20 nt, Artificial Sequence
  MKO10073056_B_Aug4c
  gRNA
acaccauaccuguacagucc

SEQ ID NO: 73057 - RNA, 20 nt, Artificial Sequence
  MKO10073057_B_Aug4d
  gRNA
gggacuuuguaucucgacua

SEQ ID NO: 73058 - RNA, 20 nt, Artificial Sequence
  MKO10073058_B_Aug4d
  gRNA
cgggacuucccaccccuugc

SEQ ID NO: 73059 - RNA, 20 nt, Artificial Sequence
  MKO10073059_B_Aug4d
  gRNA
augcuaccauuucgagggag

SEQ ID NO: 73060 - RNA, 20 nt, Artificial Sequence
  MKO10073060_B_Aug5
  gRNA
gucccauccagagcugcuug

SEQ ID NO: 73061 - RNA, 20 nt, Artificial Sequence
  MKO10073061_B_Aug5
  gRNA
gugagccucaaccgcauccu

SEQ ID NO: 73062 - RNA, 20 nt, Artificial Sequence
  MKO10073062_B_Aug5
  gRNA
aaauguacugugauguucca

SEQ ID NO: 73063 - RNA, 20 nt, Artificial Sequence
  MKO10073063_B_Aug7
  gRNA
ucugcccacccgcuugacgu

SEQ ID NO: 73064 - RNA, 20 nt, Artificial Sequence
  MKO10073064_B_Aug7
  gRNA
cacugaacuccaacgucaag

SEQ ID NO: 73065 - RNA, 20 nt, Artificial Sequence
  MKO10073065_B_Aug7
  gRNA
gagagcagcaccugacuuua

SEQ ID NO: 73066 - RNA, 20 nt, Artificial Sequence
  MKO10073066_B_Aug9a
  gRNA
ucuauaacauuugcugcuau

SEQ ID NO: 73067 - RNA, 20 nt, Artificial Sequence
  MKO10073067_B_Aug9a
  gRNA
uacaugugaagccauucuuc

SEQ ID NO: 73068 - RNA, 20 nt, Artificial Sequence
  MKO10073068_B_Aug9a
  gRNA
aggauauucgagagaagaag

SEQ ID NO: 73069 - RNA, 20 nt, Artificial Sequence
  MKO10073069_B_Aug9b
  gRNA
ugcagaccgagcgaagcagc

SEQ ID NO: 73070 - RNA, 20 nt, Artificial Sequence
  MKO10073070_B_Aug9b
  gRNA
cuggcaucacauccagaacc

SEQ ID NO: 73071 - RNA, 20 nt, Artificial Sequence
  MKO10073071_B_Aug9b
  gRNA
uggcuuugccuguauccugc

SEQ ID NO: 73072 - RNA, 20 nt, Artificial Sequence
  MKO10073072_B_Athl1
  gRNA
uguuccacccagaagccgcc

SEQ ID NO: 73073 - RNA, 20 nt, Artificial Sequence
  MKO10073073_B_Athl1
  gRNA
ggggagaagucugcccguaa

SEQ ID NO: 73074 - RNA, 20 nt, Artificial Sequence
  MKO10073074_B_Athl1
  gRNA
cugaugaauccuugagugcc

SEQ ID NO: 73075 - RNA, 20 nt, Artificial Sequence
  MKO10073075_B_Atic
  gRNA
accaagagacgcgagacuuc

SEQ ID NO: 73076 - RNA, 20 nt, Artificial Sequence
  MKO10073076_B_Atic
  gRNA
ggcuugauuucaaccuugua

SEQ ID NO: 73077 - RNA, 20 nt, Artificial Sequence
  MKO10073077_B_Atic
  gRNA
uacaagguugaaaucaagcc

SEQ ID NO: 73078 - RNA, 20 nt, Artificial Sequence
  MKO10073078_B_Atl1
  gRNA
ugugcuaagcgcaaauacug

SEQ ID NO: 73079 - RNA, 20 nt, Artificial Sequence
  MKO10073079_B_Atl1
  gRNA
cacaaugauaagcucaauac

SEQ ID NO: 73080 - RNA, 20 nt, Artificial Sequence
  MKO10073080_B_Atl1
  gRNA
gaucauccuccuggacauuc

SEQ ID NO: 73081 - RNA, 20 nt, Artificial Sequence
  MKO10073081_B_Atl2
  gRNA
agaugaucuucaacaucuac

SEQ ID NO: 73082 - RNA, 20 nt, Artificial Sequence
  MKO10073082_B_Atl2
  gRNA
acuggcuaucaaaggcaccc

SEQ ID NO: 73083 - RNA, 20 nt, Artificial Sequence
  MKO10073083_B_Atl2
  gRNA
ugcuuaccugaaauggcuuc

SEQ ID NO: 73084 - RNA, 20 nt, Artificial Sequence
  MKO10073084_B_Atl3
  gRNA
agaugaucuucagcagcuac

SEQ ID NO: 73085 - RNA, 20 nt, Artificial Sequence
  MKO10073085_B_Atl3
  gRNA
cacuaugacuaguucuguuc

SEQ ID NO: 73086 - RNA, 20 nt, Artificial Sequence
  MKO10073086_B_Atl3
  gRNA
aucugaaucccaguaguuuc

SEQ ID NO: 73087 - RNA, 20 nt, Artificial Sequence
  MKO10073087_B_Atmin
  gRNA
ugacuuccuucuagccgauc

SEQ ID NO: 73088 - RNA, 20 nt, Artificial Sequence
  MKO10073088_B_Atmin
  gRNA
cagucucacaucuaccgaac

SEQ ID NO: 73089 - RNA, 20 nt, Artificial Sequence
  MKO10073089_B_Atmin
  gRNA
agggacagccgcacguacac

SEQ ID NO: 73090 - RNA, 20 nt, Artificial Sequence
  MKO10073090_B_Atm
  gRNA
acucuauuaauguccuguga

SEQ ID NO: 73091 - RNA, 20 nt, Artificial Sequence
  MKO10073091_B_Atm
  gRNA
aaacaguucaacauuuagau

SEQ ID NO: 73092 - RNA, 20 nt, Artificial Sequence
  MKO10073092_B_Atm
  gRNA
uauccaugacauaauucaag

SEQ ID NO: 73093 - RNA, 20 nt, Artificial Sequence
  MKO10073093_B_Atn1
  gRNA
cgaggcaccucuccgccagc

SEQ ID NO: 73094 - RNA, 20 nt, Artificial Sequence
  MKO10073094_B_Atn1
  gRNA
cuaacagaaggcccggauag

SEQ ID NO: 73095 - RNA, 20 nt, Artificial Sequence
  MKO10073095_B_Atn1
  gRNA
gcccaaaaagaccaaaaccg

SEQ ID NO: 73096 - RNA, 20 nt, Artificial Sequence
  MKO10073096_B_Atoh1
  gRNA
aggaugcccccgggcagcga

SEQ ID NO: 73097 - RNA, 20 nt, Artificial Sequence
  MKO10073097_B_Atoh1
  gRNA
cggcgguugcucuccgacau

SEQ ID NO: 73098 - RNA, 20 nt, Artificial Sequence
  MKO10073098_B_Atoh1
  gRNA
cugggccugagaagcgaguc

SEQ ID NO: 73099 - RNA, 20 nt, Artificial Sequence
  MKO10073099_B_Atoh7
  gRNA
ucgcggcgcgcccccgugcg

SEQ ID NO: 73100 - RNA, 20 nt, Artificial Sequence
  MKO10073100_B_Atoh7
  gRNA
ucgggcugcgcugcgagcag

SEQ ID NO: 73101 - RNA, 20 nt, Artificial Sequence
  MKO10073101_B_Atoh7
  gRNA
gcauccuagccgaagccgag

SEQ ID NO: 73102 - RNA, 20 nt, Artificial Sequence
  MKO10073102_B_Atoh8
  gRNA
aauccucaggauggccaguu

SEQ ID NO: 73103 - RNA, 20 nt, Artificial Sequence
  MKO10073103_B_Atoh8
  gRNA
uacgugugaaauugacgagu

SEQ ID NO: 73104 - RNA, 20 nt, Artificial Sequence
  MKO10073104_B_Atoh8
  gRNA
auugugugggacgcgcggga

SEQ ID NO: 73105 - RNA, 20 nt, Artificial Sequence
  MKO10073105_B_Atox1
  gRNA
ggcuucagcacagcccucac

SEQ ID NO: 73106 - RNA, 20 nt, Artificial Sequence
  MKO10073106_B_Atox1
  gRNA
guccuggcuacuuggggcca

SEQ ID NO: 73107 - RNA, 20 nt, Artificial Sequence
  MKO10073107_B_Atox1
  gRNA
acucaccucccagcuuguug

SEQ ID NO: 73108 - RNA, 20 nt, Artificial Sequence
  MKO10073108_B_Atp10a
  gRNA
cuucucacacucgauuacac

SEQ ID NO: 73109 - RNA, 20 nt, Artificial Sequence
  MKO10073109_B_Atp10a
  gRNA
uguagccacgaaaccuacuc

SEQ ID NO: 73110 - RNA, 20 nt, Artificial Sequence
  MKO10073110_B_Atp10a
  gRNA
agaugaacugcgauguccuc

SEQ ID NO: 73111 - RNA, 20 nt, Artificial Sequence
  MKO10073111_B_Atp10b
  gRNA
gacaaugccagccgccaccu

SEQ ID NO: 73112 - RNA, 20 nt, Artificial Sequence
  MKO10073112_B_Atp10b
  gRNA
ggaaaucaccauauuuccac

SEQ ID NO: 73113 - RNA, 20 nt, Artificial Sequence
  MKO10073113_B_Atp10b
  gRNA
ucugaacuggaugcccucca

SEQ ID NO: 73114 - RNA, 20 nt, Artificial Sequence
  MKO10073114_B_Atp10d
  gRNA
aaucggcugaggucauuguu

SEQ ID NO: 73115 - RNA, 20 nt, Artificial Sequence
  MKO10073115_B_Atp10d
  gRNA
cacucaccuacuguaaacuu

SEQ ID NO: 73116 - RNA, 20 nt, Artificial Sequence
  MKO10073116_B_Atp10d
  gRNA
cuaccaaaggcacccaguuc

SEQ ID NO: 73117 - RNA, 20 nt, Artificial Sequence
  MKO10073117_B_Atp11a
  gRNA
cccgugcacuuuauccagca

SEQ ID NO: 73118 - RNA, 20 nt, Artificial Sequence
  MKO10073118_B_Atp11a
  gRNA
cccgcuugucacuggacuug

SEQ ID NO: 73119 - RNA, 20 nt, Artificial Sequence
  MKO10073119_B_Atp11a
  gRNA
gaacuguucaaauaaguucu

SEQ ID NO: 73120 - RNA, 20 nt, Artificial Sequence
  MKO10073120_B_Atp11b
  gRNA
cuuucuccuaguauacuaua

SEQ ID NO: 73121 - RNA, 20 nt, Artificial Sequence
  MKO10073121_B_Atp11b
  gRNA
ccuaccaguccaauuaccag

SEQ ID NO: 73122 - RNA, 20 nt, Artificial Sequence
  MKO10073122_B_Atp11b
  gRNA
uaaauuucugagguguguaa

SEQ ID NO: 73123 - RNA, 20 nt, Artificial Sequence
  MKO10073123_B_Atp11c
  gRNA
guuggcaaucaucccauuuc

SEQ ID NO: 73124 - RNA, 20 nt, Artificial Sequence
  MKO10073124_B_Atp11c
  gRNA
aacuguuacagcaaucaagc

SEQ ID NO: 73125 - RNA, 20 nt, Artificial Sequence
  MKO10073125_B_Atp11c
  gRNA
aaguccacugguaacugggc

SEQ ID NO: 73126 - RNA, 20 nt, Artificial Sequence
  MKO10073126_B_Atp12a
  gRNA
cacauaugcgauccagcaca

SEQ ID NO: 73127 - RNA, 20 nt, Artificial Sequence
  MKO10073127_B_Atp12a
  gRNA
aucuauucuguagagcucaa

SEQ ID NO: 73128 - RNA, 20 nt, Artificial Sequence
  MKO10073128_B_Atp12a
  gRNA
cucagaacccaacaagaguc

SEQ ID NO: 73129 - RNA, 20 nt, Artificial Sequence
  MKO10073129_B_Atp13a1
  gRNA
gguuggcaccaccuucacaa

SEQ ID NO: 73130 - RNA, 20 nt, Artificial Sequence
  MKO10073130_B_Atp13a1
  gRNA
agccccuuucuucguguuuc

SEQ ID NO: 73131 - RNA, 20 nt, Artificial Sequence
  MKO10073131_B_Atp13a1
  gRNA
caaauauuccuaugaugccc

SEQ ID NO: 73132 - RNA, 20 nt, Artificial Sequence
  MKO10073132_B_Atp13a2
  gRNA
gcagcacgccccccagcuau

SEQ ID NO: 73133 - RNA, 20 nt, Artificial Sequence
  MKO10073133_B_Atp13a2
  gRNA
uagcuccagacagcucuuca

SEQ ID NO: 73134 - RNA, 20 nt, Artificial Sequence
  MKO10073134_B_Atp13a2
  gRNA
gcagacugaggcuguuguuc

SEQ ID NO: 73135 - RNA, 20 nt, Artificial Sequence
  MKO10073135_B_Atp13a3
  gRNA
cucacagagucagucacaac

SEQ ID NO: 73136 - RNA, 20 nt, Artificial Sequence
  MKO10073136_B_Atp13a3
  gRNA
ugcaaaauguuuaguuaaug

SEQ ID NO: 73137 - RNA, 20 nt, Artificial Sequence
  MKO10073137_B_Atp13a3
  gRNA
uccagaaauaucuuaugcua

SEQ ID NO: 73138 - RNA, 20 nt, Artificial Sequence
  MKO10073138_B_Atp13a4
  gRNA
ugcagaaaauacgauauguu

SEQ ID NO: 73139 - RNA, 20 nt, Artificial Sequence
  MKO10073139_B_Atp13a4
  gRNA
cuucauugaguaaagcaugc

SEQ ID NO: 73140 - RNA, 20 nt, Artificial Sequence
  MKO10073140_B_Atp13a4
  gRNA
cuucucaagguggucaccca

SEQ ID NO: 73141 - RNA, 20 nt, Artificial Sequence
  MKO10073141_B_Atp13a5
  gRNA
ucagcuaccagagguuccuc

SEQ ID NO: 73142 - RNA, 20 nt, Artificial Sequence
  MKO10073142_B_Atp13a5
  gRNA
caguucagcugauguucuac

SEQ ID NO: 73143 - RNA, 20 nt, Artificial Sequence
  MKO10073143_B_Atp13a5
  gRNA
uccuauaagcaagaacccag

SEQ ID NO: 73144 - RNA, 20 nt, Artificial Sequence
  MKO10073144_B_Atp1a1
  gRNA
uuucacccauucgggaguag

SEQ ID NO: 73145 - RNA, 20 nt, Artificial Sequence
  MKO10073145_B_Atp1a1
  gRNA
acacaacucacaucaucguu

SEQ ID NO: 73146 - RNA, 20 nt, Artificial Sequence
  MKO10073146_B_Atp1a1
  gRNA
ggacgaccauaaacucagcc

SEQ ID NO: 73147 - RNA, 20 nt, Artificial Sequence
  MKO10073147_B_Atp1a2
  gRNA
gcugggccgaaaauaccaag

SEQ ID NO: 73148 - RNA, 20 nt, Artificial Sequence
  MKO10073148_B_Atp1a2
  gRNA
ucaccuuagacagauccacu

SEQ ID NO: 73149 - RNA, 20 nt, Artificial Sequence
  MKO10073149_B_Atp1a2
  gRNA
gcucgaugagcugaagaagg

SEQ ID NO: 73150 - RNA, 20 nt, Artificial Sequence
  MKO10073150_B_Atp1a3
  gRNA
cgcagucaguauuguauuuc

SEQ ID NO: 73151 - RNA, 20 nt, Artificial Sequence
  MKO10073151_B_Atp1a3
  gRNA
gggacggaggaugacccuuc

SEQ ID NO: 73152 - RNA, 20 nt, Artificial Sequence
  MKO10073152_B_Atp1a3
  gRNA
gagcucgcccaagaagagca

SEQ ID NO: 73153 - RNA, 20 nt, Artificial Sequence
  MKO10073153_B_Atp1a4
  gRNA
ucugccguggucaucauuac

SEQ ID NO: 73154 - RNA, 20 nt, Artificial Sequence
  MKO10073154_B_Atp1a4
  gRNA
cggcagauaguacaaucccc

SEQ ID NO: 73155 - RNA, 20 nt, Artificial Sequence
  MKO10073155_B_Atp1a4
  gRNA
ggaggaggaguuaguacauu

SEQ ID NO: 73156 - RNA, 20 nt, Artificial Sequence
  MKO10073156_B_Atp1b1
  gRNA
uaaugaccccaagagcuacg

SEQ ID NO: 73157 - RNA, 20 nt, Artificial Sequence
  MKO10073157_B_Atp1b1
  gRNA
accuugccagugcacugaac

SEQ ID NO: 73158 - RNA, 20 nt, Artificial Sequence
  MKO10073158_B_Atp1b1
  gRNA
ucccgaugaagaugccagcc

SEQ ID NO: 73159 - RNA, 20 nt, Artificial Sequence
  MKO10073159_B_Atp1b2
  gRNA
uaggucaucaacuucuaugc

SEQ ID NO: 73160 - RNA, 20 nt, Artificial Sequence
  MKO10073160_B_Atp1b2
  gRNA
ugaccauacccccaaguacc

SEQ ID NO: 73161 - RNA, 20 nt, Artificial Sequence
  MKO10073161_B_Atp1b2
  gRNA
ucagaagcucaacaaguucu

SEQ ID NO: 73162 - RNA, 20 nt, Artificial Sequence
  MKO10073162_B_Atp1b3
  gRNA
uucagcaugguccugacuau

SEQ ID NO: 73163 - RNA, 20 nt, Artificial Sequence
  MKO10073163_B_Atp1b3
  gRNA
aaccucacaaguuguccuga

SEQ ID NO: 73164 - RNA, 20 nt, Artificial Sequence
  MKO10073164_B_Atp1b3
  gRNA
ccaagaacccauaaaaaacu

SEQ ID NO: 73165 - RNA, 20 nt, Artificial Sequence
  MKO10073165_B_Atp1b4
  gRNA
gaugauggugccuggucuag

SEQ ID NO: 73166 - RNA, 20 nt, Artificial Sequence
  MKO10073166_B_Atp1b4
  gRNA
ggucggcauguaaggacuga

SEQ ID NO: 73167 - RNA, 20 nt, Artificial Sequence
  MKO10073167_B_Atp1b4
  gRNA
gcauccuccucaagaugaac

SEQ ID NO: 73168 - RNA, 20 nt, Artificial Sequence
  MKO10073168_B_Atp2a1
  gRNA
ggagaagaauccgcacaagc

SEQ ID NO: 73169 - RNA, 20 nt, Artificial Sequence
  MKO10073169_B_Atp2a1
  gRNA
gguaacuuaccuuccucagc

SEQ ID NO: 73170 - RNA, 20 nt, Artificial Sequence
  MKO10073170_B_Atp2a1
  gRNA
aguucgaagaccugcuugug

SEQ ID NO: 73171 - RNA, 20 nt, Artificial Sequence
  MKO10073171_B_Atp2a2
  gRNA
ccaaugcaaucgugggugug

SEQ ID NO: 73172 - RNA, 20 nt, Artificial Sequence
  MKO10073172_B_Atp2a2
  gRNA
ccacacacccacgauugcau

SEQ ID NO: 73173 - RNA, 20 nt, Artificial Sequence
  MKO10073173_B_Atp2a2
  gRNA
cucaaucacaaguuccagca

SEQ ID NO: 73174 - RNA, 20 nt, Artificial Sequence
  MKO10073174_B_Atp2a3
  gRNA
cgagaauuagcaugaugacc

SEQ ID NO: 73175 - RNA, 20 nt, Artificial Sequence
  MKO10073175_B_Atp2a3
  gRNA
ggucaucaugcuaauucucg

SEQ ID NO: 73176 - RNA, 20 nt, Artificial Sequence
  MKO10073176_B_Atp2a3
  gRNA
caugccucaccuuccucggu

SEQ ID NO: 73177 - RNA, 20 nt, Artificial Sequence
  MKO10073177_B_Atp2b1
  gRNA
ugggcuuaccguacuucacu

SEQ ID NO: 73178 - RNA, 20 nt, Artificial Sequence
  MKO10073178_B_Atp2b1
  gRNA
ggaaucaucuucaccuuacu

SEQ ID NO: 73179 - RNA, 20 nt, Artificial Sequence
  MKO10073179_B_Atp2b1
  gRNA
ugcuauagguacucauguga

SEQ ID NO: 73180 - RNA, 20 nt, Artificial Sequence
  MKO10073180_B_Atp2b2
  gRNA
ggcaucauauuuacccugcu

SEQ ID NO: 73181 - RNA, 20 nt, Artificial Sequence
  MKO10073181_B_Atp2b2
  gRNA
ugaccaggugcgcaagucug

SEQ ID NO: 73182 - RNA, 20 nt, Artificial Sequence
  MKO10073182_B_Atp2b2
  gRNA
aauguccccgaccacgaucu

SEQ ID NO: 73183 - RNA, 20 nt, Artificial Sequence
  MKO10073183_B_Atp2b3
  gRNA
ccuaccaccagggccgccac

SEQ ID NO: 73184 - RNA, 20 nt, Artificial Sequence
  MKO10073184_B_Atp2b3
  gRNA
ugaugagagucacguccugc

SEQ ID NO: 73185 - RNA, 20 nt, Artificial Sequence
  MKO10073185_B_Atp2b3
  gRNA
ggagaucuucugccugccga

SEQ ID NO: 73186 - RNA, 20 nt, Artificial Sequence
  MKO10073186_B_Atp2b4
  gRNA
cagaucagugcccacuacgg

SEQ ID NO: 73187 - RNA, 20 nt, Artificial Sequence
  MKO10073187_B_Atp2b4
  gRNA
uacuauacccgagagcaaca

SEQ ID NO: 73188 - RNA, 20 nt, Artificial Sequence
  MKO10073188_B_Atp2b4
  gRNA
ccuguccuucuaccgaccuc

SEQ ID NO: 73189 - RNA, 20 nt, Artificial Sequence
  MKO10073189_B_Atp2c1
  gRNA
ugaugccgucaguaucacug

SEQ ID NO: 73190 - RNA, 20 nt, Artificial Sequence
  MKO10073190_B_Atp2c1
  gRNA
uaauaggcugaucuucagaa

SEQ ID NO: 73191 - RNA, 20 nt, Artificial Sequence
  MKO10073191_B_Atp2c1
  gRNA
uaucaaauucauuccaacca

SEQ ID NO: 73192 - RNA, 20 nt, Artificial Sequence
  MKO10073192_B_Atp2c2
  gRNA
cuuccaggcaguucucaucg

SEQ ID NO: 73193 - RNA, 20 nt, Artificial Sequence
  MKO10073193_B_Atp2c2
  gRNA
aauuugcaguggcccagcgc

SEQ ID NO: 73194 - RNA, 20 nt, Artificial Sequence
  MKO10073194_B_Atp2c2
  gRNA
acgcaccuggaugaagccaa

SEQ ID NO: 73195 - RNA, 20 nt, Artificial Sequence
  MKO10073195_B_Atp4a
  gRNA
cuucaagaaucuuguacccc

SEQ ID NO: 73196 - RNA, 20 nt, Artificial Sequence
  MKO10073196_B_Atp4a
  gRNA
cagcaaugagugccaccgcc

SEQ ID NO: 73197 - RNA, 20 nt, Artificial Sequence
  MKO10073197_B_Atp4a
  gRNA
ccagcucagacacugauagc

SEQ ID NO: 73198 - RNA, 20 nt, Artificial Sequence
  MKO10073198_B_Atp4b
  gRNA
cauagaaaccugcguaguac

SEQ ID NO: 73199 - RNA, 20 nt, Artificial Sequence
  MKO10073199_B_Atp4b
  gRNA
caacaacacagcuccccgag

SEQ ID NO: 73200 - RNA, 20 nt, Artificial Sequence
  MKO10073200_B_Atp4b
  gRNA
ccccuccucgaagccgaagc

SEQ ID NO: 73201 - RNA, 20 nt, Artificial Sequence
  MKO10073201_B_Atp5a1
  gRNA
uaaucagcucacgcugaccc

SEQ ID NO: 73202 - RNA, 20 nt, Artificial Sequence
  MKO10073202_B_Atp5a1
  gRNA
cacgacaacuccaacauugu

SEQ ID NO: 73203 - RNA, 20 nt, Artificial Sequence
  MKO10073203_B_Atp5a1
  gRNA
cuucugaagucgaguguuag

SEQ ID NO: 73204 - RNA, 20 nt, Artificial Sequence
  MKO10073204_B_Atp5b
  gRNA
cuuaaacuaggacucuuugg

SEQ ID NO: 73205 - RNA, 20 nt, Artificial Sequence
  MKO10073205_B_Atp5b
  gRNA
ccccugaauccaguacuuuc

SEQ ID NO: 73206 - RNA, 20 nt, Artificial Sequence
  MKO10073206_B_Atp5b
  gRNA
gcaccaaucaaaauuccugu

SEQ ID NO: 73207 - RNA, 20 nt, Artificial Sequence
  MKO10073207_B_Atp5c1
  gRNA
aagaaccugucccauacacu

SEQ ID NO: 73208 - RNA, 20 nt, Artificial Sequence
  MKO10073208_B_Atp5c1
  gRNA
ugucauucaaagauguggga

SEQ ID NO: 73209 - RNA, 20 nt, Artificial Sequence
  MKO10073209_B_Atp5c1
  gRNA
aaaucaagggcauacuuuau

SEQ ID NO: 73210 - RNA, 20 nt, Artificial Sequence
  MKO10073210_B_Atp5d
  gRNA
cacguccacuugcuugacgu

SEQ ID NO: 73211 - RNA, 20 nt, Artificial Sequence
  MKO10073211_B_Atp5d
  gRNA
ugcggcggacgaggcagcac

SEQ ID NO: 73212 - RNA, 20 nt, Artificial Sequence
  MKO10073212_B_Atp5d
  gRNA
cucaccaaaguacuuagucg

SEQ ID NO: 73213 - RNA, 20 nt, Artificial Sequence
  MKO10073213_B_Atp5e
  gRNA
agcgaacgcugagaagacuu

SEQ ID NO: 73214 - RNA, 20 nt, Artificial Sequence
  MKO10073214_B_Atp5e
  gRNA
cucagcguucgcuuugaacu

SEQ ID NO: 73215 - RNA, 20 nt, Artificial Sequence
  MKO10073215_B_Atp5e
  gRNA
agaucugugcaaaagcagug

SEQ ID NO: 73216 - RNA, 20 nt, Artificial Sequence
  MKO10073216_B_Atp5f1
  gRNA
agccccgugucugaagaacg

SEQ ID NO: 73217 - RNA, 20 nt, Artificial Sequence
  MKO10073217_B_Atp5f1
  gRNA
uuucuaggaccuuaugugcu

SEQ ID NO: 73218 - RNA, 20 nt, Artificial Sequence
  MKO10073218_B_Atp5f1
  gRNA
auuaccucuucgaugugcag

SEQ ID NO: 73219 - RNA, 20 nt, Artificial Sequence
  MKO10073219_B_Atp5g1
  gRNA
uugaaaaaugcagaccacca

SEQ ID NO: 73220 - RNA, 20 nt, Artificial Sequence
  MKO10073220_B_Atp5g1
  gRNA
cugcagcagcuccccucucc

SEQ ID NO: 73221 - RNA, 20 nt, Artificial Sequence
  MKO10073221_B_Atp5g1
  gRNA
ugauccagccacaccaacug

SEQ ID NO: 73222 - RNA, 20 nt, Artificial Sequence
  MKO10073222_B_Atp5g2
  gRNA
agaucaggagcaccucucuc

SEQ ID NO: 73223 - RNA, 20 nt, Artificial Sequence
  MKO10073223_B_Atp5g2
  gRNA
ggagcggguagagacgaacu

SEQ ID NO: 73224 - RNA, 20 nt, Artificial Sequence
  MKO10073224_B_Atp5g2
  gRNA
agccccagcuccaaugaacu

SEQ ID NO: 73225 - RNA, 20 nt, Artificial Sequence
  MKO10073225_B_Atp5g3
  gRNA
uacgcaccagagcgggggug

SEQ ID NO: 73226 - RNA, 20 nt, Artificial Sequence
  MKO10073226_B_Atp5g3
  gRNA
accucuccaguccuagucuc

SEQ ID NO: 73227 - RNA, 20 nt, Artificial Sequence
  MKO10073227_B_Atp5g3
  gRNA
augcaacucuggauccagcu

SEQ ID NO: 73228 - RNA, 20 nt, Artificial Sequence
  MKO10073228_B_Atp5h
  gRNA
acaaaaagaaguacccguac

SEQ ID NO: 73229 - RNA, 20 nt, Artificial Sequence
  MKO10073229_B_Atp5h
  gRNA
uuacauccuccuucuccucc

SEQ ID NO: 73230 - RNA, 20 nt, Artificial Sequence
  MKO10073230_B_Atp5h
  gRNA
agaaaccaccugcgauugac

SEQ ID NO: 73231 - RNA, 20 nt, Artificial Sequence
  MKO10073231_B_Atp5j2
  gRNA
aagcucauggaagucaaacu

SEQ ID NO: 73232 - RNA, 20 nt, Artificial Sequence
  MKO10073232_B_Atp5j2
  gRNA
gcaguagcugaaaaccacgu

SEQ ID NO: 73233 - RNA, 20 nt, Artificial Sequence
  MKO10073233_B_Atp5j2
  gRNA
augagcuucuucuccuucag

SEQ ID NO: 73234 - RNA, 20 nt, Artificial Sequence
  MKO10073234_B_Atp5j
  gRNA
uuauacaccagggcaucugg

SEQ ID NO: 73235 - RNA, 20 nt, Artificial Sequence
  MKO10073235_B_Atp5j
  gRNA
aucgacaaaccccaguccug

SEQ ID NO: 73236 - RNA, 20 nt, Artificial Sequence
  MKO10073236_B_Atp5j
  gRNA
uuguauguuccucaggacug

SEQ ID NO: 73237 - RNA, 20 nt, Artificial Sequence
  MKO10073237_B_Atp5k
  gRNA
ugaggauucaccuugaugag

SEQ ID NO: 73238 - RNA, 20 nt, Artificial Sequence
  MKO10073238_B_Atp5k
  gRNA
cgguacuccgcucugaucau

SEQ ID NO: 73239 - RNA, 20 nt, Artificial Sequence
  MKO10073239_B_Atp5k
  gRNA
ucaggucucuccacucauca

SEQ ID NO: 73240 - RNA, 20 nt, Artificial Sequence
  MKO10073240_B_Atp5l
  gRNA
uuccaggaagcugugcugaa

SEQ ID NO: 73241 - RNA, 20 nt, Artificial Sequence
  MKO10073241_B_Atp5l
  gRNA
gacuuacucgaagccucgau

SEQ ID NO: 73242 - RNA, 20 nt, Artificial Sequence
  MKO10073242_B_Atp5l
  gRNA
aaaccacauccacaccucag

SEQ ID NO: 73243 - RNA, 20 nt, Artificial Sequence
  MKO10073243_B_Atp5o
  gRNA
cgcccacucacucaugaggu

SEQ ID NO: 73244 - RNA, 20 nt, Artificial Sequence
  MKO10073244_B_Atp5o
  gRNA
ccuguacucugcugcaucua

SEQ ID NO: 73245 - RNA, 20 nt, Artificial Sequence
  MKO10073245_B_Atp5o
  gRNA
ccagauuuacuugcugaaaa

SEQ ID NO: 73246 - RNA, 20 nt, Artificial Sequence
  MKO10073246_B_Atp5sl
  gRNA
aaggccccguucugagauuc

SEQ ID NO: 73247 - RNA, 20 nt, Artificial Sequence
  MKO10073247_B_Atp5sl
  gRNA
cagauccuucacuaacaucc

SEQ ID NO: 73248 - RNA, 20 nt, Artificial Sequence
  MKO10073248_B_Atp5sl
  gRNA
uucuucucccgacugcuguc

SEQ ID NO: 73249 - RNA, 20 nt, Artificial Sequence
  MKO10073249_B_Atp5s
  gRNA
aaauuuacgaaaaagccuau

SEQ ID NO: 73250 - RNA, 20 nt, Artificial Sequence
  MKO10073250_B_Atp5s
  gRNA
ucuagaucaaugaugauguu

SEQ ID NO: 73251 - RNA, 20 nt, Artificial Sequence
  MKO10073251_B_Atp5s
  gRNA
caaccauucccagaaguauc

SEQ ID NO: 73252 - RNA, 20 nt, Artificial Sequence
  MKO10073252_B_Atp6ap1l
  gRNA
gaccaagugcuucgucugug

SEQ ID NO: 73253 - RNA, 20 nt, Artificial Sequence
  MKO10073253_B_Atp6ap1l
  gRNA
aucccaaggauauugacaua

SEQ ID NO: 73254 - RNA, 20 nt, Artificial Sequence
  MKO10073254_B_Atp6ap1l
  gRNA
gacagccauaccugugcaau

SEQ ID NO: 73255 - RNA, 20 nt, Artificial Sequence
  MKO10073255_B_Atp6ap1
  gRNA
cauuacggggacccagcucc

SEQ ID NO: 73256 - RNA, 20 nt, Artificial Sequence
  MKO10073256_B_Atp6ap1
  gRNA
uggggcuagccccuugcaug

SEQ ID NO: 73257 - RNA, 20 nt, Artificial Sequence
  MKO10073257_B_Atp6ap1
  gRNA
auugcauaccaguccacagc

SEQ ID NO: 73258 - RNA, 20 nt, Artificial Sequence
  MKO10073258_B_Atp6ap2
  gRNA
acgggcuaccauuaugguga

SEQ ID NO: 73259 - RNA, 20 nt, Artificial Sequence
  MKO10073259_B_Atp6ap2
  gRNA
uugucacuuaccuccucgcu

SEQ ID NO: 73260 - RNA, 20 nt, Artificial Sequence
  MKO10073260_B_Atp6ap2
  gRNA
cuccuugcagagaguguaua

SEQ ID NO: 73261 - RNA, 20 nt, Artificial Sequence
  MKO10073261_B_Atp6v0a1
  gRNA
ugaccucaucgaaaaacugc

SEQ ID NO: 73262 - RNA, 20 nt, Artificial Sequence
  MKO10073262_B_Atp6v0a1
  gRNA
aacaucccaauuauggacac

SEQ ID NO: 73263 - RNA, 20 nt, Artificial Sequence
  MKO10073263_B_Atp6v0a1
  gRNA
cuucauucacaaauuuccuc

SEQ ID NO: 73264 - RNA, 20 nt, Artificial Sequence
  MKO10073264_B_Atp6v0a2
  gRNA
ucuucgugacccucagcaug

SEQ ID NO: 73265 - RNA, 20 nt, Artificial Sequence
  MKO10073265_B_Atp6v0a2
  gRNA
uguacuccaccagcuccaac

SEQ ID NO: 73266 - RNA, 20 nt, Artificial Sequence
  MKO10073266_B_Atp6v0a2
  gRNA
cucuggugauuuccugcacc

SEQ ID NO: 73267 - RNA, 20 nt, Artificial Sequence
  MKO10073267_B_Atp6v0a4
  gRNA
ucuccagugacucacaccuu

SEQ ID NO: 73268 - RNA, 20 nt, Artificial Sequence
  MKO10073268_B_Atp6v0a4
  gRNA
ccccaacuuuccagucauga

SEQ ID NO: 73269 - RNA, 20 nt, Artificial Sequence
  MKO10073269_B_Atp6v0a4
  gRNA
aaagaaaucuucaccuaagu

SEQ ID NO: 73270 - RNA, 20 nt, Artificial Sequence
  MKO10073270_B_Atp6v0b
  gRNA
cugcuacaccaucuuugacc

SEQ ID NO: 73271 - RNA, 20 nt, Artificial Sequence
  MKO10073271_B_Atp6v0b
  gRNA
ccacaucaaagcgaaagccc

SEQ ID NO: 73272 - RNA, 20 nt, Artificial Sequence
  MKO10073272_B_Atp6v0b
  gRNA
ggccaucuauggcaucauca

SEQ ID NO: 73273 - RNA, 20 nt, Artificial Sequence
  MKO10073273_B_Atp6v0c
  gRNA
caugggcgccucguccgcca

SEQ ID NO: 73274 - RNA, 20 nt, Artificial Sequence
  MKO10073274_B_Atp6v0c
  gRNA
aaaaggacuacuuuguggag

SEQ ID NO: 73275 - RNA, 20 nt, Artificial Sequence
  MKO10073275_B_Atp6v0c
  gRNA
ggccugaguguggggcugag

SEQ ID NO: 73276 - RNA, 20 nt, Artificial Sequence
  MKO10073276_B_Atp6v0d1
  gRNA
cuaccuuguaaagcguauuu

SEQ ID NO: 73277 - RNA, 20 nt, Artificial Sequence
  MKO10073277_B_Atp6v0d1
  gRNA
aauccgaaauacgcuuuaca

SEQ ID NO: 73278 - RNA, 20 nt, Artificial Sequence
  MKO10073278_B_Atp6v0d1
  gRNA
gugcccaagugccauccgcu

SEQ ID NO: 73279 - RNA, 20 nt, Artificial Sequence
  MKO10073279_B_Atp6v0d2
  gRNA
aguugccauaguccgugguc

SEQ ID NO: 73280 - RNA, 20 nt, Artificial Sequence
  MKO10073280_B_Atp6v0d2
  gRNA
ucuagccaagugucacccac

SEQ ID NO: 73281 - RNA, 20 nt, Artificial Sequence
  MKO10073281_B_Atp6v0d2
  gRNA
acugcgcaauaaacuauaca

SEQ ID NO: 73282 - RNA, 20 nt, Artificial Sequence
  MKO10073282_B_Atp6v0e2
  gRNA
accccaggggucacucccac

SEQ ID NO: 73283 - RNA, 20 nt, Artificial Sequence
  MKO10073283_B_Atp6v0e2
  gRNA
cagggugaucaucaccaugc

SEQ ID NO: 73284 - RNA, 20 nt, Artificial Sequence
  MKO10073284_B_Atp6v0e2
  gRNA
gacagcaguagcuaccagca

SEQ ID NO: 73285 - RNA, 20 nt, Artificial Sequence
  MKO10073285_B_Atp6v0e
  gRNA
uagaguuaucaucaccaugu

SEQ ID NO: 73286 - RNA, 20 nt, Artificial Sequence
  MKO10073286_B_Atp6v0e
  gRNA
aacugaacaagucaccaaca

SEQ ID NO: 73287 - RNA, 20 nt, Artificial Sequence
  MKO10073287_B_Atp6v0e
  gRNA
cugaaguaccacuggccuug

SEQ ID NO: 73288 - RNA, 20 nt, Artificial Sequence
  MKO10073288_B_Atp6v1a
  gRNA
cuuacgggaaaagggcaucg

SEQ ID NO: 73289 - RNA, 20 nt, Artificial Sequence
  MKO10073289_B_Atp6v1a
  gRNA
acggaugcaucauaauuccc

SEQ ID NO: 73290 - RNA, 20 nt, Artificial Sequence
  MKO10073290_B_Atp6v1a
  gRNA
ggagaaauuauucgauugga

SEQ ID NO: 73291 - RNA, 20 nt, Artificial Sequence
  MKO10073291_B_Atp6v1b1
  gRNA
ucuggcaaacccauugacaa

SEQ ID NO: 73292 - RNA, 20 nt, Artificial Sequence
  MKO10073292_B_Atp6v1b1
  gRNA
ccacuccucugaguaccauc

SEQ ID NO: 73293 - RNA, 20 nt, Artificial Sequence
  MKO10073293_B_Atp6v1b1
  gRNA
gccucugguggugcuggacc

SEQ ID NO: 73294 - RNA, 20 nt, Artificial Sequence
  MKO10073294_B_Atp6v1b2
  gRNA
guccacuugacauuaccaga

SEQ ID NO: 73295 - RNA, 20 nt, Artificial Sequence
  MKO10073295_B_Atp6v1b2
  gRNA
gcagccuacaagacugucuc

SEQ ID NO: 73296 - RNA, 20 nt, Artificial Sequence
  MKO10073296_B_Atp6v1b2
  gRNA
uguauaggucgaguauucaa

SEQ ID NO: 73297 - RNA, 20 nt, Artificial Sequence
  MKO10073297_B_Atp6v1c1
  gRNA
augcagacgcccgagacuuu

SEQ ID NO: 73298 - RNA, 20 nt, Artificial Sequence
  MKO10073298_B_Atp6v1c1
  gRNA
ucaguacauggcugaugugc

SEQ ID NO: 73299 - RNA, 20 nt, Artificial Sequence
  MKO10073299_B_Atp6v1c1
  gRNA
ggacagcaaagauaaaguuc

SEQ ID NO: 73300 - RNA, 20 nt, Artificial Sequence
  MKO10073300_B_Atp6v1c2
  gRNA
ccacucgaagugcgucacga

SEQ ID NO: 73301 - RNA, 20 nt, Artificial Sequence
  MKO10073301_B_Atp6v1c2
  gRNA
gaaagcacacgagacccucc

SEQ ID NO: 73302 - RNA, 20 nt, Artificial Sequence
  MKO10073302_B_Atp6v1c2
  gRNA
ggauaucuuaccuugaaguc

SEQ ID NO: 73303 - RNA, 20 nt, Artificial Sequence
  MKO10073303_B_Atp6v1d
  gRNA
cgauuaaaaggagcacagac

SEQ ID NO: 73304 - RNA, 20 nt, Artificial Sequence
  MKO10073304_B_Atp6v1d
  gRNA
gagagaagcugccuucucau

SEQ ID NO: 73305 - RNA, 20 nt, Artificial Sequence
  MKO10073305_B_Atp6v1d
  gRNA
gaaguccccugcugugaauu

SEQ ID NO: 73306 - RNA, 20 nt, Artificial Sequence
  MKO10073306_B_Atp6v1e1
  gRNA
ucagucuuugcguuugcaca

SEQ ID NO: 73307 - RNA, 20 nt, Artificial Sequence
  MKO10073307_B_Atp6v1e1
  gRNA
uuuguaggaucugcuaaaug

SEQ ID NO: 73308 - RNA, 20 nt, Artificial Sequence
  MKO10073308_B_Atp6v1e1
  gRNA
aacgcaaagacugaagauua

SEQ ID NO: 73309 - RNA, 20 nt, Artificial Sequence
  MKO10073309_B_Atp6v1e2
  gRNA
aacagaaucccucguauuuc

SEQ ID NO: 73310 - RNA, 20 nt, Artificial Sequence
  MKO10073310_B_Atp6v1e2
  gRNA
ucaggaccgugaugcgagcc

SEQ ID NO: 73311 - RNA, 20 nt, Artificial Sequence
  MKO10073311_B_Atp6v1e2
  gRNA
cugugaugauuguccgcugc

SEQ ID NO: 73312 - RNA, 20 nt, Artificial Sequence
  MKO10073312_B_Atp6v1f
  gRNA
ccaacaggcaauuucuaaac

SEQ ID NO: 73313 - RNA, 20 nt, Artificial Sequence
  MKO10073313_B_Atp6v1f
  gRNA
gaaccgccacccuaauuucc

SEQ ID NO: 73314 - RNA, 20 nt, Artificial Sequence
  MKO10073314_B_Atp6v1f
  gRNA
agugucuucgaucucauuga

SEQ ID NO: 73315 - RNA, 20 nt, Artificial Sequence
  MKO10073315_B_Atp6v1g1
  gRNA
cugcaggcauugggcuccca

SEQ ID NO: 73316 - RNA, 20 nt, Artificial Sequence
  MKO10073316_B_Atp6v1g1
  gRNA
agcaauggcgagucagucgc

SEQ ID NO: 73317 - RNA, 20 nt, Artificial Sequence
  MKO10073317_B_Atp6v1g1
  gRNA
ccaccuccuauccguuuaug

SEQ ID NO: 73318 - RNA, 20 nt, Artificial Sequence
  MKO10073318_B_Atp6v1g2
  gRNA
gaaggcccggcgacugaagc

SEQ ID NO: 73319 - RNA, 20 nt, Artificial Sequence
  MKO10073319_B_Atp6v1g2
  gRNA
ccgcugcccgcuucucagcc

SEQ ID NO: 73320 - RNA, 20 nt, Artificial Sequence
  MKO10073320_B_Atp6v1g2
  gRNA
cggagaagguggccgaugcc

SEQ ID NO: 73321 - RNA, 20 nt, Artificial Sequence
  MKO10073321_B_Atp6v1g3
  gRNA
ugcucaccuuagccugcuuc

SEQ ID NO: 73322 - RNA, 20 nt, Artificial Sequence
  MKO10073322_B_Atp6v1g3
  gRNA
ugccucaucuagcuuguccu

SEQ ID NO: 73323 - RNA, 20 nt, Artificial Sequence
  MKO10073323_B_Atp6v1g3
  gRNA
caccaugaccagccagucuc

SEQ ID NO: 73324 - RNA, 20 nt, Artificial Sequence
  MKO10073324_B_Atp6v1h
  gRNA
uuucccccaagcagcuaacu

SEQ ID NO: 73325 - RNA, 20 nt, Artificial Sequence
  MKO10073325_B_Atp6v1h
  gRNA
guacugcacugucuguucuu

SEQ ID NO: 73326 - RNA, 20 nt, Artificial Sequence
  MKO10073326_B_Atp6v1h
  gRNA
ugaaaugaaaagaaguuccg

SEQ ID NO: 73327 - RNA, 20 nt, Artificial Sequence
  MKO10073327_B_Atp7a
  gRNA
cuucaggcgcucaacaucaa

SEQ ID NO: 73328 - RNA, 20 nt, Artificial Sequence
  MKO10073328_B_Atp7a
  gRNA
guuugcuacacaagaagcac

SEQ ID NO: 73329 - RNA, 20 nt, Artificial Sequence
  MKO10073329_B_Atp7a
  gRNA
cgcaauuuaagacgagaaga

SEQ ID NO: 73330 - RNA, 20 nt, Artificial Sequence
  MKO10073330_B_Atp7b
  gRNA
cuucgaagcgucagucaugg

SEQ ID NO: 73331 - RNA, 20 nt, Artificial Sequence
  MKO10073331_B_Atp7b
  gRNA
uggcaucacuuacgccucug

SEQ ID NO: 73332 - RNA, 20 nt, Artificial Sequence
  MKO10073332_B_Atp7b
  gRNA
aagugcuucguacagaucaa

SEQ ID NO: 73333 - RNA, 20 nt, Artificial Sequence
  MKO10073333_B_Atp8a1
  gRNA
auuccugaugugucgccgac

SEQ ID NO: 73334 - RNA, 20 nt, Artificial Sequence
  MKO10073334_B_Atp8a1
  gRNA
agaacgaauuagccgcucuu

SEQ ID NO: 73335 - RNA, 20 nt, Artificial Sequence
  MKO10073335_B_Atp8a1
  gRNA
aauucugcaacaaccacguc

SEQ ID NO: 73336 - RNA, 20 nt, Artificial Sequence
  MKO10073336_B_Atp8a2
  gRNA
ccuguaacagaaacgacaua

SEQ ID NO: 73337 - RNA, 20 nt, Artificial Sequence
  MKO10073337_B_Atp8a2
  gRNA
gauuccuguaugagcagauu

SEQ ID NO: 73338 - RNA, 20 nt, Artificial Sequence
  MKO10073338_B_Atp8a2
  gRNA
gcacacuaucauguggaaag

SEQ ID NO: 73339 - RNA, 20 nt, Artificial Sequence
  MKO10073339_B_Atp8b1
  gRNA
ucaugaaaugagguuguucg

SEQ ID NO: 73340 - RNA, 20 nt, Artificial Sequence
  MKO10073340_B_Atp8b1
  gRNA
uccuuaccacaucaucuacc

SEQ ID NO: 73341 - RNA, 20 nt, Artificial Sequence
  MKO10073341_B_Atp8b1
  gRNA
caucacggccaucaaagacc

SEQ ID NO: 73342 - RNA, 20 nt, Artificial Sequence
  MKO10073342_B_Atp8b2
  gRNA
aguagguguuggcaacuucc

SEQ ID NO: 73343 - RNA, 20 nt, Artificial Sequence
  MKO10073343_B_Atp8b2
  gRNA
gaaggugacaauauuguacu

SEQ ID NO: 73344 - RNA, 20 nt, Artificial Sequence
  MKO10073344_B_Atp8b2
  gRNA
accaggacagggacgagauc

SEQ ID NO: 73345 - RNA, 20 nt, Artificial Sequence
  MKO10073345_B_Atp8b3
  gRNA
gucauccacaagaucacgag

SEQ ID NO: 73346 - RNA, 20 nt, Artificial Sequence
  MKO10073346_B_Atp8b3
  gRNA
aacugcucguacagguucag

SEQ ID NO: 73347 - RNA, 20 nt, Artificial Sequence
  MKO10073347_B_Atp8b3
  gRNA
gcgauaagaucaucaacaac

SEQ ID NO: 73348 - RNA, 20 nt, Artificial Sequence
  MKO10073348_B_Atp8b4
  gRNA
agauuaccuguaguaucaga

SEQ ID NO: 73349 - RNA, 20 nt, Artificial Sequence
  MKO10073349_B_Atp8b4
  gRNA
ugaugagcaccuuagacugc

SEQ ID NO: 73350 - RNA, 20 nt, Artificial Sequence
  MKO10073350_B_Atp8b4
  gRNA
gugauaaucaagugaauaac

SEQ ID NO: 73351 - RNA, 20 nt, Artificial Sequence
  MKO10073351_B_Atp8b5
  gRNA
acugcucugcaaugcaagag

SEQ ID NO: 73352 - RNA, 20 nt, Artificial Sequence
  MKO10073352_B_Atp8b5
  gRNA
aacuguucaaacagguucau

SEQ ID NO: 73353 - RNA, 20 nt, Artificial Sequence
  MKO10073353_B_Atp8b5
  gRNA
accauacuuugaugucuuga

SEQ ID NO: 73354 - RNA, 20 nt, Artificial Sequence
  MKO10073354_B_Atp9a
  gRNA
ugacauuucgaggguaccgc

SEQ ID NO: 73355 - RNA, 20 nt, Artificial Sequence
  MKO10073355_B_Atp9a
  gRNA
acugcgagcaggcgagaagc

SEQ ID NO: 73356 - RNA, 20 nt, Artificial Sequence
  MKO10073356_B_Atp9a
  gRNA
gguugggacaccccgagaag

SEQ ID NO: 73357 - RNA, 20 nt, Artificial Sequence
  MKO10073357_B_Atp9b
  gRNA
cuccguguuauccuagcucg

SEQ ID NO: 73358 - RNA, 20 nt, Artificial Sequence
  MKO10073358_B_Atp9b
  gRNA
uauagcaagcuuacaguaag

SEQ ID NO: 73359 - RNA, 20 nt, Artificial Sequence
  MKO10073359_B_Atp9b
  gRNA
cuacaccuacugggcuccuc

SEQ ID NO: 73360 - RNA, 20 nt, Artificial Sequence
  MKO10073360_B_Atpaf1
  gRNA
agugccccacuggcugcuuu

SEQ ID NO: 73361 - RNA, 20 nt, Artificial Sequence
  MKO10073361_B_Atpaf1
  gRNA
uuagugaauccuuugcucac

SEQ ID NO: 73362 - RNA, 20 nt, Artificial Sequence
  MKO10073362_B_Atpaf1
  gRNA
uucagucuucaacguugaga

SEQ ID NO: 73363 - RNA, 20 nt, Artificial Sequence
  MKO10073363_B_Atpaf2
  gRNA
uacuguccccagcgaagccc

SEQ ID NO: 73364 - RNA, 20 nt, Artificial Sequence
  MKO10073364_B_Atpaf2
  gRNA
caaggauguguugcacaaug

SEQ ID NO: 73365 - RNA, 20 nt, Artificial Sequence
  MKO10073365_B_Atpaf2
  gRNA
ugaaguuccacuaaugucuc

SEQ ID NO: 73366 - RNA, 20 nt, Artificial Sequence
  MKO10073366_B_Atpif1
  gRNA
augaagguccugcaaacccg

SEQ ID NO: 73367 - RNA, 20 nt, Artificial Sequence
  MKO10073367_B_Atpif1
  gRNA
ugagauugaccaccauucga

SEQ ID NO: 73368 - RNA, 20 nt, Artificial Sequence
  MKO10073368_B_Atpif1
  gRNA
caucuucaugguguuuccuc

SEQ ID NO: 73369 - RNA, 20 nt, Artificial Sequence
  MKO10073369_B_Atraid
  gRNA
ggcuuccagugcuauugcaa

SEQ ID NO: 73370 - RNA, 20 nt, Artificial Sequence
  MKO10073370_B_Atraid
  gRNA
ugcaauagcacuggaagccc

SEQ ID NO: 73371 - RNA, 20 nt, Artificial Sequence
  MKO10073371_B_Atraid
  gRNA
ccuucaggcaaauccucuca

SEQ ID NO: 73372 - RNA, 20 nt, Artificial Sequence
  MKO10073372_B_Atrip
  gRNA
cagauuucuggugggccaag

SEQ ID NO: 73373 - RNA, 20 nt, Artificial Sequence
  MKO10073373_B_Atrip
  gRNA
cucccuccgucucccacguc

SEQ ID NO: 73374 - RNA, 20 nt, Artificial Sequence
  MKO10073374_B_Atrip
  gRNA
cuuccaccccugucagacug

SEQ ID NO: 73375 - RNA, 20 nt, Artificial Sequence
  MKO10073375_B_Atrnl1
  gRNA
ccuuacuguaaagccaauug

SEQ ID NO: 73376 - RNA, 20 nt, Artificial Sequence
  MKO10073376_B_Atrnl1
  gRNA
caccuaaguacagcuacuaa

SEQ ID NO: 73377 - RNA, 20 nt, Artificial Sequence
  MKO10073377_B_Atrnl1
  gRNA
cuuaaccuuagcacugcauu

SEQ ID NO: 73378 - RNA, 20 nt, Artificial Sequence
  MKO10073378_B_Atrn
  gRNA
gaugcugcuuauaaucugac

SEQ ID NO: 73379 - RNA, 20 nt, Artificial Sequence
  MKO10073379_B_Atrn
  gRNA
uacagacuaacuggcucuuc

SEQ ID NO: 73380 - RNA, 20 nt, Artificial Sequence
  MKO10073380_B_Atrn
  gRNA
caccucugauugcugccuuu

SEQ ID NO: 73381 - RNA, 20 nt, Artificial Sequence
  MKO10073381_B_Atrx
  gRNA
uggacuuaauucugauauga

SEQ ID NO: 73382 - RNA, 20 nt, Artificial Sequence
  MKO10073382_B_Atrx
  gRNA
acuaugcaaagcuugccaaa

SEQ ID NO: 73383 - RNA, 20 nt, Artificial Sequence
  MKO10073383_B_Atrx
  gRNA
ccuugaugaaccugaagauc

SEQ ID NO: 73384 - RNA, 20 nt, Artificial Sequence
  MKO10073384_B_Atr
  gRNA
aauucaaugccaagcucaac

SEQ ID NO: 73385 - RNA, 20 nt, Artificial Sequence
  MKO10073385_B_Atr
  gRNA
cuuaccaauacaacugucuu

SEQ ID NO: 73386 - RNA, 20 nt, Artificial Sequence
  MKO10073386_B_Atr
  gRNA
ugagauucuccuguugagcu

SEQ ID NO: 73387 - RNA, 20 nt, Artificial Sequence
  MKO10073387_B_Atxn10
  gRNA
cagcaacuccgaucguaucc

SEQ ID NO: 73388 - RNA, 20 nt, Artificial Sequence
  MKO10073388_B_Atxn10
  gRNA
ugacguuaauugcaauauug

SEQ ID NO: 73389 - RNA, 20 nt, Artificial Sequence
  MKO10073389_B_Atxn10
  gRNA
gucuacucaugcuguugagc

SEQ ID NO: 73390 - RNA, 20 nt, Artificial Sequence
  MKO10073390_B_Atxn1l
  gRNA
guucuacccgcagucccauc

SEQ ID NO: 73391 - RNA, 20 nt, Artificial Sequence
  MKO10073391_B_Atxn1l
  gRNA
aauugacucuagcacagucg

SEQ ID NO: 73392 - RNA, 20 nt, Artificial Sequence
  MKO10073392_B_Atxn1l
  gRNA
uccugacuccgcucaugaac

SEQ ID NO: 73393 - RNA, 20 nt, Artificial Sequence
  MKO10073393_B_Atxn1
  gRNA
uggggaggccucucgaugcg

SEQ ID NO: 73394 - RNA, 20 nt, Artificial Sequence
  MKO10073394_B_Atxn1
  gRNA
ucuacuugcccacguuagau

SEQ ID NO: 73395 - RNA, 20 nt, Artificial Sequence
  MKO10073395_B_Atxn1
  gRNA
ccagcagaccacgcaucgag

SEQ ID NO: 73396 - RNA, 20 nt, Artificial Sequence
  MKO10073396_B_Atxn2l
  gRNA
uuuaauaggggacagaccac

SEQ ID NO: 73397 - RNA, 20 nt, Artificial Sequence
  MKO10073397_B_Atxn2l
  gRNA
gaaaaauggcaccacuuacg

SEQ ID NO: 73398 - RNA, 20 nt, Artificial Sequence
  MKO10073398_B_Atxn2l
  gRNA
aaggugucuauaacaauucc

SEQ ID NO: 73399 - RNA, 20 nt, Artificial Sequence
  MKO10073399_B_Atxn2
  gRNA
agaggucggaacaguagcaa

SEQ ID NO: 73400 - RNA, 20 nt, Artificial Sequence
  MKO10073400_B_Atxn2
  gRNA
aaucuaugcaaacgugagga

SEQ ID NO: 73401 - RNA, 20 nt, Artificial Sequence
  MKO10073401_B_Atxn2
  gRNA
ugugaaguacaagugaaaaa

SEQ ID NO: 73402 - RNA, 20 nt, Artificial Sequence
  MKO10073402_B_Atxn3
  gRNA
acagcagccuucuggaaaua

SEQ ID NO: 73403 - RNA, 20 nt, Artificial Sequence
  MKO10073403_B_Atxn3
  gRNA
uaggaucaauucugagccuc

SEQ ID NO: 73404 - RNA, 20 nt, Artificial Sequence
  MKO10073404_B_Atxn3
  gRNA
cugucauccauauuuccaga

SEQ ID NO: 73405 - RNA, 20 nt, Artificial Sequence
  MKO10073405_B_Atxn7l1
  gRNA
aggugcugcugacagcgcua

SEQ ID NO: 73406 - RNA, 20 nt, Artificial Sequence
  MKO10073406_B_Atxn7l1
  gRNA
uugccugugcuagcgauguc

SEQ ID NO: 73407 - RNA, 20 nt, Artificial Sequence
  MKO10073407_B_Atxn7l1
  gRNA
guuaugaggcuuaauaaaga

SEQ ID NO: 73408 - RNA, 20 nt, Artificial Sequence
  MKO10073408_B_Atxn7l2
  gRNA
acuacucacgagccaucuuu

SEQ ID NO: 73409 - RNA, 20 nt, Artificial Sequence
  MKO10073409_B_Atxn7l2
  gRNA
ggcccugcccauucacuaca

SEQ ID NO: 73410 - RNA, 20 nt, Artificial Sequence
  MKO10073410_B_Atxn7l2
  gRNA
uacacgccuauugacuugca

SEQ ID NO: 73411 - RNA, 20 nt, Artificial Sequence
  MKO10073411_B_Atxn7l3b
  gRNA
ggcccguccccgggaucccc

SEQ ID NO: 73412 - RNA, 20 nt, Artificial Sequence
  MKO10073412_B_Atxn7l3b
  gRNA
uaagauggaggagauuucgu

SEQ ID NO: 73413 - RNA, 20 nt, Artificial Sequence
  MKO10073413_B_Atxn7l3b
  gRNA
uuucggcauccagccagugg

SEQ ID NO: 73414 - RNA, 20 nt, Artificial Sequence
  MKO10073414_B_Atxn7l3
  gRNA
cggggcccaggccaucgcuc

SEQ ID NO: 73415 - RNA, 20 nt, Artificial Sequence
  MKO10073415_B_Atxn7l3
  gRNA
ccucuaguuugcuguuaucc

SEQ ID NO: 73416 - RNA, 20 nt, Artificial Sequence
  MKO10073416_B_Atxn7l3
  gRNA
augacaucaaugacaaugac

SEQ ID NO: 73417 - RNA, 20 nt, Artificial Sequence
  MKO10073417_B_Atxn7
  gRNA
caaccaaguugucaaaccgc

SEQ ID NO: 73418 - RNA, 20 nt, Artificial Sequence
  MKO10073418_B_Atxn7
  gRNA
ccaaagagaaacuuccgcuc

SEQ ID NO: 73419 - RNA, 20 nt, Artificial Sequence
  MKO10073419_B_Atxn7
  gRNA
gcgaagucauggggcucugc

SEQ ID NO: 73420 - RNA, 20 nt, Artificial Sequence
  MKO10073420_B_Auh
  gRNA
cuuugucuccaagauccgau

SEQ ID NO: 73421 - RNA, 20 nt, Artificial Sequence
  MKO10073421_B_Auh
  gRNA
cuaccagcacagaauauccc

SEQ ID NO: 73422 - RNA, 20 nt, Artificial Sequence
  MKO10073422_B_Auh
  gRNA
aucaucagaagugaaguccc

SEQ ID NO: 73423 - RNA, 20 nt, Artificial Sequence
  MKO10073423_B_Aup1
  gRNA
gacgcggugaucgcggaguc

SEQ ID NO: 73424 - RNA, 20 nt, Artificial Sequence
  MKO10073424_B_Aup1
  gRNA
accacguccugaauagaaaa

SEQ ID NO: 73425 - RNA, 20 nt, Artificial Sequence
  MKO10073425_B_Aup1
  gRNA
gaggccaccaauggccgaga

SEQ ID NO: 73426 - RNA, 20 nt, Artificial Sequence
  MKO10073426_B_Aurkaip1
  gRNA
agaaagacuugaagcgcauc

SEQ ID NO: 73427 - RNA, 20 nt, Artificial Sequence
  MKO10073427_B_Aurkaip1
  gRNA
uccuggcgcgccugacuuca

SEQ ID NO: 73428 - RNA, 20 nt, Artificial Sequence
  MKO10073428_B_Aurkaip1
  gRNA
uucggggucugccaguucuc

SEQ ID NO: 73429 - RNA, 20 nt, Artificial Sequence
  MKO10073429_B_Aurka
  gRNA
cgaacguggagcaccagcuu

SEQ ID NO: 73430 - RNA, 20 nt, Artificial Sequence
  MKO10073430_B_Aurka
  gRNA
auucuguaccuuaacaggcc

SEQ ID NO: 73431 - RNA, 20 nt, Artificial Sequence
  MKO10073431_B_Aurka
  gRNA
guaaagaaaacugugucucc

SEQ ID NO: 73432 - RNA, 20 nt, Artificial Sequence
  MKO10073432_B_Aurkb
  gRNA
ucgccgagagaucgaaaucc

SEQ ID NO: 73433 - RNA, 20 nt, Artificial Sequence
  MKO10073433_B_Aurkb
  gRNA
gagagcaagcgcagaugucg

SEQ ID NO: 73434 - RNA, 20 nt, Artificial Sequence
  MKO10073434_B_Aurkb
  gRNA
cagggcuccacugccucgca

SEQ ID NO: 73435 - RNA, 20 nt, Artificial Sequence
  MKO10073435_B_Aurkc
  gRNA
aggcuuacuguaggugugcc

SEQ ID NO: 73436 - RNA, 20 nt, Artificial Sequence
  MKO10073436_B_Aurkc
  gRNA
accaucaaugacuuugaaau

SEQ ID NO: 73437 - RNA, 20 nt, Artificial Sequence
  MKO10073437_B_Aurkc
  gRNA
acuacuucuaugaugacacu

SEQ ID NO: 73438 - RNA, 20 nt, Artificial Sequence
  MKO10073438_B_Auus2
  gRNA
gugcgacagugacagcgacc

SEQ ID NO: 73439 - RNA, 20 nt, Artificial Sequence
  MKO10073439_B_Auus2
  gRNA
ucucccgagagcugcuccgc

SEQ ID NO: 73440 - RNA, 20 nt, Artificial Sequence
  MKO10073440_B_Auus2
  gRNA
gaaguagccuguccccaagc

SEQ ID NO: 73441 - RNA, 20 nt, Artificial Sequence
  MKO10073441_B_Aven
  gRNA
uucacaguuccgauuugcug

SEQ ID NO: 73442 - RNA, 20 nt, Artificial Sequence
  MKO10073442_B_Aven
  gRNA
gcuuucugcaaaccuucuaa

SEQ ID NO: 73443 - RNA, 20 nt, Artificial Sequence
  MKO10073443_B_Aven
  gRNA
uguugcuucagaauugaucc

SEQ ID NO: 73444 - RNA, 20 nt, Artificial Sequence
  MKO10073444_B_Avil
  gRNA
ccagcaggaagacaucgccu

SEQ ID NO: 73445 - RNA, 20 nt, Artificial Sequence
  MKO10073445_B_Avil
  gRNA
agacugcuacaucguccucu

SEQ ID NO: 73446 - RNA, 20 nt, Artificial Sequence
  MKO10073446_B_Avil
  gRNA
acacgcagguggaaaugagc

SEQ ID NO: 73447 - RNA, 20 nt, Artificial Sequence
  MKO10073447_B_Avl9
  gRNA
gcuugaaguaagccauaaag

SEQ ID NO: 73448 - RNA, 20 nt, Artificial Sequence
  MKO10073448_B_Avl9
  gRNA
acaagagauaccauauacug

SEQ ID NO: 73449 - RNA, 20 nt, Artificial Sequence
  MKO10073449_B_Avl9
  gRNA
uucccaaauuuccauucuaa

SEQ ID NO: 73450 - RNA, 20 nt, Artificial Sequence
  MKO10073450_B_Avpi1
  gRNA
gggucagacgcuguagaacc

SEQ ID NO: 73451 - RNA, 20 nt, Artificial Sequence
  MKO10073451_B_Avpi1
  gRNA
ggcucgcucacgacagaggc

SEQ ID NO: 73452 - RNA, 20 nt, Artificial Sequence
  MKO10073452_B_Avpi1
  gRNA
ccuaccuaagccggcugcag

SEQ ID NO: 73453 - RNA, 20 nt, Artificial Sequence
  MKO10073453_B_Avpr1a
  gRNA
cauagcgcagaaauucgcca

SEQ ID NO: 73454 - RNA, 20 nt, Artificial Sequence
  MKO10073454_B_Avpr1a
  gRNA
uccucguugcguacgucccc

SEQ ID NO: 73455 - RNA, 20 nt, Artificial Sequence
  MKO10073455_B_Avpr1a
  gRNA
gccgggggacguacgcaacg

SEQ ID NO: 73456 - RNA, 20 nt, Artificial Sequence
  MKO10073456_B_Avpr1b
  gRNA
uuucaccaucucgaugcuuc

SEQ ID NO: 73457 - RNA, 20 nt, Artificial Sequence
  MKO10073457_B_Avpr1b
  gRNA
gcgccacgcccaggucgguc

SEQ ID NO: 73458 - RNA, 20 nt, Artificial Sequence
  MKO10073458_B_Avpr1b
  gRNA
ccgggcugucaaauaucuac

SEQ ID NO: 73459 - RNA, 20 nt, Artificial Sequence
  MKO10073459_B_Avpr2
  gRNA
uuaacagcuguaccaacccc

SEQ ID NO: 73460 - RNA, 20 nt, Artificial Sequence
  MKO10073460_B_Avpr2
  gRNA
agggguugguacagcuguua

SEQ ID NO: 73461 - RNA, 20 nt, Artificial Sequence
  MKO10073461_B_Avpr2
  gRNA
auccuggugucuaccacguc

SEQ ID NO: 73462 - RNA, 20 nt, Artificial Sequence
  MKO10073462_B_Avp
  gRNA
cgcuuguuuccugagccugc

SEQ ID NO: 73463 - RNA, 20 nt, Artificial Sequence
  MKO10073463_B_Avp
  gRNA
gucgcugcagcagaugccca

SEQ ID NO: 73464 - RNA, 20 nt, Artificial Sequence
  MKO10073464_B_Avp
  gRNA
cuggccggacuggcagggcg

SEQ ID NO: 73465 - RNA, 20 nt, Artificial Sequence
  MKO10073465_B_Awau1
  gRNA
gccuauuguucacacccuug

SEQ ID NO: 73466 - RNA, 20 nt, Artificial Sequence
  MKO10073466_B_Awau1
  gRNA
ucuucaagauccccauuauu

SEQ ID NO: 73467 - RNA, 20 nt, Artificial Sequence
  MKO10073467_B_Awau1
  gRNA
guugcagauccugaagacua

SEQ ID NO: 73468 - RNA, 20 nt, Artificial Sequence
  MKO10073468_B_Awau2
  gRNA
gcuauccuuacccauguuua

SEQ ID NO: 73469 - RNA, 20 nt, Artificial Sequence
  MKO10073469_B_Awau2
  gRNA
gagugcagauacagcacgcc

SEQ ID NO: 73470 - RNA, 20 nt, Artificial Sequence
  MKO10073470_B_Awau2
  gRNA
gacuggaagaccccugagcg

SEQ ID NO: 73471 - RNA, 20 nt, Artificial Sequence
  MKO10073471_B_Axin1
  gRNA
gcgcacuuaccgaaugccaa

SEQ ID NO: 73472 - RNA, 20 nt, Artificial Sequence
  MKO10073472_B_Axin1
  gRNA
aaccccuacuacgucaacuc

SEQ ID NO: 73473 - RNA, 20 nt, Artificial Sequence
  MKO10073473_B_Axin1
  gRNA
ugcugcuuacggauccugua

SEQ ID NO: 73474 - RNA, 20 nt, Artificial Sequence
  MKO10073474_B_Axin2
  gRNA
ucgccgccgagcucaucucc

SEQ ID NO: 73475 - RNA, 20 nt, Artificial Sequence
  MKO10073475_B_Axin2
  gRNA
uggagucccuccuuaccgca

SEQ ID NO: 73476 - RNA, 20 nt, Artificial Sequence
  MKO10073476_B_Axin2
  gRNA
gggcuauagcgacccacacc

SEQ ID NO: 73477 - RNA, 20 nt, Artificial Sequence
  MKO10073477_B_Axl
  gRNA
ucacggguuccggggguccc

SEQ ID NO: 73478 - RNA, 20 nt, Artificial Sequence
  MKO10073478_B_Axl
  gRNA
agcccguuuguggggaaccc

SEQ ID NO: 73479 - RNA, 20 nt, Artificial Sequence
  MKO10073479_B_Axl
  gRNA
cuucuagaugcaccauacac

SEQ ID NO: 73480 - RNA, 20 nt, Artificial Sequence
  MKO10073480_B_Aym1
  gRNA
uuccauuaucucuuagagag

SEQ ID NO: 73481 - RNA, 20 nt, Artificial Sequence
  MKO10073481_B_Aym1
  gRNA
cagaaaguucugugagagca

SEQ ID NO: 73482 - RNA, 20 nt, Artificial Sequence
  MKO10073482_B_Aym1
  gRNA
cugagcuuguugcugugcuc

SEQ ID NO: 73483 - RNA, 20 nt, Artificial Sequence
  MKO10073483_B_Azgp1
  gRNA
ggacaacccgguguagagaa

SEQ ID NO: 73484 - RNA, 20 nt, Artificial Sequence
  MKO10073484_B_Azgp1
  gRNA
cccaaucucucucggugcag

SEQ ID NO: 73485 - RNA, 20 nt, Artificial Sequence
  MKO10073485_B_Azgp1
  gRNA
cccacugcaccgagagagau

SEQ ID NO: 73486 - RNA, 20 nt, Artificial Sequence
  MKO10073486_B_Azi1
  gRNA
gggcgacaccaucuucgagg

SEQ ID NO: 73487 - RNA, 20 nt, Artificial Sequence
  MKO10073487_B_Azi1
  gRNA
ccacuaugccuccucgaaga

SEQ ID NO: 73488 - RNA, 20 nt, Artificial Sequence
  MKO10073488_B_Azi1
  gRNA
agucauggacgggcuccccc

SEQ ID NO: 73489 - RNA, 20 nt, Artificial Sequence
  MKO10073489_B_Azi2
  gRNA
aucuucuacuagcgugucca

SEQ ID NO: 73490 - RNA, 20 nt, Artificial Sequence
  MKO10073490_B_Azi2
  gRNA
uaaacccacccucauccagc

SEQ ID NO: 73491 - RNA, 20 nt, Artificial Sequence
  MKO10073491_B_Azi2
  gRNA
agcaagagcugggacuacug

SEQ ID NO: 73492 - RNA, 20 nt, Artificial Sequence
  MKO10073492_B_Azin1
  gRNA
gaacuugauguccaaauaau

SEQ ID NO: 73493 - RNA, 20 nt, Artificial Sequence
  MKO10073493_B_Azin1
  gRNA
aauggcuuuagugcaagaau

SEQ ID NO: 73494 - RNA, 20 nt, Artificial Sequence
  MKO10073494_B_Azin1
  gRNA
cucacuuaaccccaauuauu

SEQ ID NO: 73495 - RNA, 20 nt, Artificial Sequence
  MKO10073495_B_B020004C17Rik
  gRNA
uuagcagucgccuuucuaau

SEQ ID NO: 73496 - RNA, 20 nt, Artificial Sequence
  MKO10073496_B_B020004C17Rik
  gRNA
ucugaauaccugaggaacuu

SEQ ID NO: 73497 - RNA, 20 nt, Artificial Sequence
  MKO10073497_B_B020004C17Rik
  gRNA
gaaacgaccaagaagccaau

SEQ ID NO: 73498 - RNA, 20 nt, Artificial Sequence
  MKO10073498_B_B020004J07Rik
  gRNA
ccccguccagugcgagcugc

SEQ ID NO: 73499 - RNA, 20 nt, Artificial Sequence
  MKO10073499_B_B020004J07Rik
  gRNA
aucugcaacucuacagaccc

SEQ ID NO: 73500 - RNA, 20 nt, Artificial Sequence
  MKO10073500_B_B020004J07Rik
  gRNA
cacacuccugcagcucgcac

SEQ ID NO: 73501 - RNA, 20 nt, Artificial Sequence
  MKO10073501_B_B020031M17Rik
  gRNA
cucacuucuucuucuucuuc

SEQ ID NO: 73502 - RNA, 20 nt, Artificial Sequence
  MKO10073502_B_B020031M17Rik
  gRNA
aacccucgccaagcuugcuu

SEQ ID NO: 73503 - RNA, 20 nt, Artificial Sequence
  MKO10073503_B_B020031M17Rik
  gRNA
uccagccuuccucagagcag

SEQ ID NO: 73504 - RNA, 20 nt, Artificial Sequence
  MKO10073504_B_B230118H07Rik
  gRNA
uccacagaaggaucauaaga

SEQ ID NO: 73505 - RNA, 20 nt, Artificial Sequence
  MKO10073505_B_B230118H07Rik
  gRNA
aguuccaugugcuccccauu

SEQ ID NO: 73506 - RNA, 20 nt, Artificial Sequence
  MKO10073506_B_B230118H07Rik
  gRNA
gaaaggaacucccaacuuug

SEQ ID NO: 73507 - RNA, 20 nt, Artificial Sequence
  MKO10073507_B_B230216G23Rik
  gRNA
cauuaccuguggagcaccgc

SEQ ID NO: 73508 - RNA, 20 nt, Artificial Sequence
  MKO10073508_B_B230216G23Rik
  gRNA
ugcagcgacucucugagaag

SEQ ID NO: 73509 - RNA, 20 nt, Artificial Sequence
  MKO10073509_B_B230216G23Rik
  gRNA
ugaacugcugacucucccag

SEQ ID NO: 73510 - RNA, 20 nt, Artificial Sequence
  MKO10073510_B_B230217C12Rik
  gRNA
auacacuggaagagaucagu

SEQ ID NO: 73511 - RNA, 20 nt, Artificial Sequence
  MKO10073511_B_B230217C12Rik
  gRNA
cagaggaguccccucgauuc

SEQ ID NO: 73512 - RNA, 20 nt, Artificial Sequence
  MKO10073512_B_B230217C12Rik
  gRNA
cugcuuguacugagccaugc

SEQ ID NO: 73513 - RNA, 20 nt, Artificial Sequence
  MKO10073513_B_B230219D22Rik
  gRNA
aaaaugaugcaccccguugc

SEQ ID NO: 73514 - RNA, 20 nt, Artificial Sequence
  MKO10073514_B_B230219D22Rik
  gRNA
cugucccgccuugcagaucu

SEQ ID NO: 73515 - RNA, 20 nt, Artificial Sequence
  MKO10073515_B_B230219D22Rik
  gRNA
aauccagcguucugugggcc

SEQ ID NO: 73516 - RNA, 20 nt, Artificial Sequence
  MKO10073516_B_B2m
  gRNA
cuggugcuugucucacugac

SEQ ID NO: 73517 - RNA, 20 nt, Artificial Sequence
  MKO10073517_B_B2m
  gRNA
acguagcaguucaguauguu

SEQ ID NO: 73518 - RNA, 20 nt, Artificial Sequence
  MKO10073518_B_B2m
  gRNA
cguauguaucagucucagug

SEQ ID NO: 73519 - RNA, 20 nt, Artificial Sequence
  MKO10073519_B_B3galnt1
  gRNA
cgcgcucgaucacauuguag

SEQ ID NO: 73520 - RNA, 20 nt, Artificial Sequence
  MKO10073520_B_B3galnt1
  gRNA
gagaacaguucgaguguucg

SEQ ID NO: 73521 - RNA, 20 nt, Artificial Sequence
  MKO10073521_B_B3galnt1
  gRNA
auaccaagaguaccccuuca

SEQ ID NO: 73522 - RNA, 20 nt, Artificial Sequence
  MKO10073522_B_B3galnt2
  gRNA
aucguagaacacuccaagac

SEQ ID NO: 73523 - RNA, 20 nt, Artificial Sequence
  MKO10073523_B_B3galnt2
  gRNA
uucacuuguacgccacaacu

SEQ ID NO: 73524 - RNA, 20 nt, Artificial Sequence
  MKO10073524_B_B3galnt2
  gRNA
ccaaucgugauuaccagucu

SEQ ID NO: 73525 - RNA, 20 nt, Artificial Sequence
  MKO10073525_B_B3galt1
  gRNA
auguauugaccguugugugc

SEQ ID NO: 73526 - RNA, 20 nt, Artificial Sequence
  MKO10073526_B_B3galt1
  gRNA
ucugguggacagugaugacg

SEQ ID NO: 73527 - RNA, 20 nt, Artificial Sequence
  MKO10073527_B_B3galt1
  gRNA
ucagggauguccgcaguaag

SEQ ID NO: 73528 - RNA, 20 nt, Artificial Sequence
  MKO10073528_B_B3galt2
  gRNA
cuagagaaagcacacccgua

SEQ ID NO: 73529 - RNA, 20 nt, Artificial Sequence
  MKO10073529_B_B3galt2
  gRNA
cuucuugcuucgauuugucc

SEQ ID NO: 73530 - RNA, 20 nt, Artificial Sequence
  MKO10073530_B_B3galt2
  gRNA
caucuuccaagugcaaacga

SEQ ID NO: 73531 - RNA, 20 nt, Artificial Sequence
  MKO10073531_B_B3galt4
  gRNA
ccuccuggcgguccuacuac

SEQ ID NO: 73532 - RNA, 20 nt, Artificial Sequence
  MKO10073532_B_B3galt4
  gRNA
caguacauauccugugcccg

SEQ ID NO: 73533 - RNA, 20 nt, Artificial Sequence
  MKO10073533_B_B3galt4
  gRNA
cccuucugccauugcuccga

SEQ ID NO: 73534 - RNA, 20 nt, Artificial Sequence
  MKO10073534_B_B3galt5
  gRNA
gcauggccauccgcaagacg

SEQ ID NO: 73535 - RNA, 20 nt, Artificial Sequence
  MKO10073535_B_B3galt5
  gRNA
gagugcgcccaucaugagaa

SEQ ID NO: 73536 - RNA, 20 nt, Artificial Sequence
  MKO10073536_B_B3galt5
  gRNA
caagcagaagccgccuuucc

SEQ ID NO: 73537 - RNA, 20 nt, Artificial Sequence
  MKO10073537_B_B3galt6
  gRNA
auagccaccgcccaacgcgu

SEQ ID NO: 73538 - RNA, 20 nt, Artificial Sequence
  MKO10073538_B_B3galt6
  gRNA
uccugguggaccuacgcgca

SEQ ID NO: 73539 - RNA, 20 nt, Artificial Sequence
  MKO10073539_B_B3galt6
  gRNA
cuucacugugccacgcgcgc

SEQ ID NO: 73540 - RNA, 20 nt, Artificial Sequence
  MKO10073540_B_B3galtl
  gRNA
aguccuccuucuccaucagu

SEQ ID NO: 73541 - RNA, 20 nt, Artificial Sequence
  MKO10073541_B_B3galtl
  gRNA
gaaaggaauuacuuugacuc

SEQ ID NO: 73542 - RNA, 20 nt, Artificial Sequence
  MKO10073542_B_B3galtl
  gRNA
uuucaacuguucugcucucu

SEQ ID NO: 73543 - RNA, 20 nt, Artificial Sequence
  MKO10073543_B_B3gau1
  gRNA
cggauaugcagaucuugguc

SEQ ID NO: 73544 - RNA, 20 nt, Artificial Sequence
  MKO10073544_B_B3gau1
  gRNA
agacagucuucgacccccac

SEQ ID NO: 73545 - RNA, 20 nt, Artificial Sequence
  MKO10073545_B_B3gau1
  gRNA
gcaaggaugucccgucucuu

SEQ ID NO: 73546 - RNA, 20 nt, Artificial Sequence
  MKO10073546_B_B3gau2
  gRNA
gcgacgcuaugaacguccgu

SEQ ID NO: 73547 - RNA, 20 nt, Artificial Sequence
  MKO10073547_B_B3gau2
  gRNA
aaagcuguauuuaagcgccg

SEQ ID NO: 73548 - RNA, 20 nt, Artificial Sequence
  MKO10073548_B_B3gau2
  gRNA
cgcccaccaacuagucccac

SEQ ID NO: 73549 - RNA, 20 nt, Artificial Sequence
  MKO10073549_B_B3gau3
  gRNA
gacggagaucagcuugcaac

SEQ ID NO: 73550 - RNA, 20 nt, Artificial Sequence
  MKO10073550_B_B3gau3
  gRNA
acgcggccauccuguaccug

SEQ ID NO: 73551 - RNA, 20 nt, Artificial Sequence
  MKO10073551_B_B3gau3
  gRNA
cagcaaaauacacgacuccu

SEQ ID NO: 73552 - RNA, 20 nt, Artificial Sequence
  MKO10073552_B_B3gnt1
  gRNA
ccuuuaccgccaguucaaac

SEQ ID NO: 73553 - RNA, 20 nt, Artificial Sequence
  MKO10073553_B_B3gnt1
  gRNA
cgugugccccucgcgcuaug

SEQ ID NO: 73554 - RNA, 20 nt, Artificial Sequence
  MKO10073554_B_B3gnt1
  gRNA
gucuccgcgauccguagacc

SEQ ID NO: 73555 - RNA, 20 nt, Artificial Sequence
  MKO10073555_B_B3gnt2
  gRNA
cgucgaagagucaaguugcu

SEQ ID NO: 73556 - RNA, 20 nt, Artificial Sequence
  MKO10073556_B_B3gnt2
  gRNA
caagcaauucgggagucuug

SEQ ID NO: 73557 - RNA, 20 nt, Artificial Sequence
  MKO10073557_B_B3gnt2
  gRNA
cuauugugaaccagacucga

SEQ ID NO: 73558 - RNA, 20 nt, Artificial Sequence
  MKO10073558_B_B3gnt3
  gRNA
cacgucgucgauugggaaca

SEQ ID NO: 73559 - RNA, 20 nt, Artificial Sequence
  MKO10073559_B_B3gnt3
  gRNA
gccagaugcugcgcacgacg

SEQ ID NO: 73560 - RNA, 20 nt, Artificial Sequence
  MKO10073560_B_B3gnt3
  gRNA
gcgcccauaguuugcaggcg

SEQ ID NO: 73561 - RNA, 20 nt, Artificial Sequence
  MKO10073561_B_B3gnt4
  gRNA
guaguggcgggcccuguaca

SEQ ID NO: 73562 - RNA, 20 nt, Artificial Sequence
  MKO10073562_B_B3gnt4
  gRNA
agcucucauagaccaacagc

SEQ ID NO: 73563 - RNA, 20 nt, Artificial Sequence
  MKO10073563_B_B3gnt4
  gRNA
cgucucccuuuaguaugaag

SEQ ID NO: 73564 - RNA, 20 nt, Artificial Sequence
  MKO10073564_B_B3gnt5
  gRNA
cugcgaugccucauagauuu

SEQ ID NO: 73565 - RNA, 20 nt, Artificial Sequence
  MKO10073565_B_B3gnt5
  gRNA
agauuggaguucgagacuuu

SEQ ID NO: 73566 - RNA, 20 nt, Artificial Sequence
  MKO10073566_B_B3gnt5
  gRNA
guucugcaaucagaaaaacg

SEQ ID NO: 73567 - RNA, 20 nt, Artificial Sequence
  MKO10073567_B_B3gnt6
  gRNA
cgacgacgucuucgugcaca

SEQ ID NO: 73568 - RNA, 20 nt, Artificial Sequence
  MKO10073568_B_B3gnt6
  gRNA
ucgcgagccgccuccucggg

SEQ ID NO: 73569 - RNA, 20 nt, Artificial Sequence
  MKO10073569_B_B3gnt6
  gRNA
ucugugccuguucgcgaaag

SEQ ID NO: 73570 - RNA, 20 nt, Artificial Sequence
  MKO10073570_B_B3gnt7
  gRNA
cccgacucaccacagagaca

SEQ ID NO: 73571 - RNA, 20 nt, Artificial Sequence
  MKO10073571_B_B3gnt7
  gRNA
agcauagagacgguccucgu

SEQ ID NO: 73572 - RNA, 20 nt, Artificial Sequence
  MKO10073572_B_B3gnt7
  gRNA
aguaaaugucgagccacuug

SEQ ID NO: 73573 - RNA, 20 nt, Artificial Sequence
  MKO10073573_B_B3gnt8
  gRNA
uuagcaccccgugcccaucc

SEQ ID NO: 73574 - RNA, 20 nt, Artificial Sequence
  MKO10073574_B_B3gnt8
  gRNA
ccaagucugacaguccguac

SEQ ID NO: 73575 - RNA, 20 nt, Artificial Sequence
  MKO10073575_B_B3gnt8
  gRNA
auccgaguccuggcuuaaaa

SEQ ID NO: 73576 - RNA, 20 nt, Artificial Sequence
  MKO10073576_B_B3gnt9
  gRNA
cgugcgccgaguguucuugu

SEQ ID NO: 73577 - RNA, 20 nt, Artificial Sequence
  MKO10073577_B_B3gnt9
  gRNA
cccguuuacccugccuacgc

SEQ ID NO: 73578 - RNA, 20 nt, Artificial Sequence
  MKO10073578_B_B3gnt9
  gRNA
gcucccuaacaccgcccgcg

SEQ ID NO: 73579 - RNA, 20 nt, Artificial Sequence
  MKO10073579_B_B3gntl1
  gRNA
ccgugcacaacgcugagcag

SEQ ID NO: 73580 - RNA, 20 nt, Artificial Sequence
  MKO10073580_B_B3gntl1
  gRNA
ucuggaaucucuguagucau

SEQ ID NO: 73581 - RNA, 20 nt, Artificial Sequence
  MKO10073581_B_B3gntl1
  gRNA
cauacuuacaggacaagucu

SEQ ID NO: 73582 - RNA, 20 nt, Artificial Sequence
  MKO10073582_B_B430306N03Rik
  gRNA
accagaguuacuucgagcac

SEQ ID NO: 73583 - RNA, 20 nt, Artificial Sequence
  MKO10073583_B_B430306N03Rik
  gRNA
ccugcaguaccuguuaguga

SEQ ID NO: 73584 - RNA, 20 nt, Artificial Sequence
  MKO10073584_B_B430306N03Rik
  gRNA
accacuccgaugagaagauc

SEQ ID NO: 73585 - RNA, 20 nt, Artificial Sequence
  MKO10073585_B_B4galnt1
  gRNA
ugagggcuguuucugucgcc

SEQ ID NO: 73586 - RNA, 20 nt, Artificial Sequence
  MKO10073586_B_B4galnt1
  gRNA
ccucagcuccucagcgucaa

SEQ ID NO: 73587 - RNA, 20 nt, Artificial Sequence
  MKO10073587_B_B4galnt1
  gRNA
gacguggcaggggaaguaac

SEQ ID NO: 73588 - RNA, 20 nt, Artificial Sequence
  MKO10073588_B_B4galnt2
  gRNA
ucucaccauaaacgcaacag

SEQ ID NO: 73589 - RNA, 20 nt, Artificial Sequence
  MKO10073589_B_B4galnt2
  gRNA
caucuggcccuucauacugg

SEQ ID NO: 73590 - RNA, 20 nt, Artificial Sequence
  MKO10073590_B_B4galnt2
  gRNA
cugcauacaauucucauccc

SEQ ID NO: 73591 - RNA, 20 nt, Artificial Sequence
  MKO10073591_B_B4galnt3
  gRNA
accaagaaauugcccgaagu

SEQ ID NO: 73592 - RNA, 20 nt, Artificial Sequence
  MKO10073592_B_B4galnt3
  gRNA
guacucacguggggguagag

SEQ ID NO: 73593 - RNA, 20 nt, Artificial Sequence
  MKO10073593_B_B4galnt3
  gRNA
aacggcugggauguuccugc

SEQ ID NO: 73594 - RNA, 20 nt, Artificial Sequence
  MKO10073594_B_B4galnt4
  gRNA
gagcuuaccucuucccgcca

SEQ ID NO: 73595 - RNA, 20 nt, Artificial Sequence
  MKO10073595_B_B4galnt4
  gRNA
accaguccucaaacacgugc

SEQ ID NO: 73596 - RNA, 20 nt, Artificial Sequence
  MKO10073596_B_B4galnt4
  gRNA
accugcacguguuugaggac

SEQ ID NO: 73597 - RNA, 20 nt, Artificial Sequence
  MKO10073597_B_B4galt1
  gRNA
uggacgaccguaaugccuac

SEQ ID NO: 73598 - RNA, 20 nt, Artificial Sequence
  MKO10073598_B_B4galt1
  gRNA
ucacguccaaaugcuguagu

SEQ ID NO: 73599 - RNA, 20 nt, Artificial Sequence
  MKO10073599_B_B4galt1
  gRNA
ccccaaccccaauaauuauu

SEQ ID NO: 73600 - RNA, 20 nt, Artificial Sequence
  MKO10073600_B_B4galt2
  gRNA
gauaguggagccaauagcgu

SEQ ID NO: 73601 - RNA, 20 nt, Artificial Sequence
  MKO10073601_B_B4galt2
  gRNA
ccgccacuuugccaucgcca

SEQ ID NO: 73602 - RNA, 20 nt, Artificial Sequence
  MKO10073602_B_B4galt2
  gRNA
cggugucuaugucaucaacc

SEQ ID NO: 73603 - RNA, 20 nt, Artificial Sequence
  MKO10073603_B_B4galt3
  gRNA
accuguaugugugcgacccc

SEQ ID NO: 73604 - RNA, 20 nt, Artificial Sequence
  MKO10073604_B_B4galt3
  gRNA
cugaaacuccgccaaaguac

SEQ ID NO: 73605 - RNA, 20 nt, Artificial Sequence
  MKO10073605_B_B4galt3
  gRNA
aggaugacgacauugcuacc

SEQ ID NO: 73606 - RNA, 20 nt, Artificial Sequence
  MKO10073606_B_B4galt4
  gRNA
ccucuauuuccuccaacgug

SEQ ID NO: 73607 - RNA, 20 nt, Artificial Sequence
  MKO10073607_B_B4galt4
  gRNA
ccucacguuggaggaaauag

SEQ ID NO: 73608 - RNA, 20 nt, Artificial Sequence
  MKO10073608_B_B4galt4
  gRNA
auggauucucuaacaacuac

SEQ ID NO: 73609 - RNA, 20 nt, Artificial Sequence
  MKO10073609_B_B4galt5
  gRNA
aaacaugagugagaucgcaa

SEQ ID NO: 73610 - RNA, 20 nt, Artificial Sequence
  MKO10073610_B_B4galt5
  gRNA
ugugaggaccaucggugccc

SEQ ID NO: 73611 - RNA, 20 nt, Artificial Sequence
  MKO10073611_B_B4galt5
  gRNA
ccauuaagcucggagggcac

SEQ ID NO: 73612 - RNA, 20 nt, Artificial Sequence
  MKO10073612_B_B4galt6
  gRNA
aauaaaaacacuacgcucaa

SEQ ID NO: 73613 - RNA, 20 nt, Artificial Sequence
  MKO10073613_B_B4galt6
  gRNA
ucacuuguauuauugccuuc

SEQ ID NO: 73614 - RNA, 20 nt, Artificial Sequence
  MKO10073614_B_B4galt6
  gRNA
cgcauguaaggcagcuucuc

SEQ ID NO: 73615 - RNA, 20 nt, Artificial Sequence
  MKO10073615_B_B4galt7
  gRNA
gcccuuucgugagcgcuuug

SEQ ID NO: 73616 - RNA, 20 nt, Artificial Sequence
  MKO10073616_B_B4galt7
  gRNA
gagggaccaaaaacgcauug

SEQ ID NO: 73617 - RNA, 20 nt, Artificial Sequence
  MKO10073617_B_B4galt7
  gRNA
gccacuugcaugacccugcc

SEQ ID NO: 73618 - RNA, 20 nt, Artificial Sequence
  MKO10073618_B_B630005N14Rik
  gRNA
cuggaguggucuuaguggcg

SEQ ID NO: 73619 - RNA, 20 nt, Artificial Sequence
  MKO10073619_B_B630005N14Rik
  gRNA
gucgcauugaaugguguugu

SEQ ID NO: 73620 - RNA, 20 nt, Artificial Sequence
  MKO10073620_B_B630005N14Rik
  gRNA
ucacugggcaaaaacuugug

SEQ ID NO: 73621 - RNA, 20 nt, Artificial Sequence
  MKO10073621_B_B930041F14Rik
  gRNA
cgcacgcugucgugcacguc

SEQ ID NO: 73622 - RNA, 20 nt, Artificial Sequence
  MKO10073622_B_B930041F14Rik
  gRNA
cccaaaagcacgcgaucgca

SEQ ID NO: 73623 - RNA, 20 nt, Artificial Sequence
  MKO10073623_B_B930041F14Rik
  gRNA
uagcagguagucgcggcaag

SEQ ID NO: 73624 - RNA, 20 nt, Artificial Sequence
  MKO10073624_B_B9d1
  gRNA
agacucacagccauaggggu

SEQ ID NO: 73625 - RNA, 20 nt, Artificial Sequence
  MKO10073625_B_B9d1
  gRNA
cuacacuacagaaguucaca

SEQ ID NO: 73626 - RNA, 20 nt, Artificial Sequence
  MKO10073626_B_B9d1
  gRNA
gcaccuaccguccuggagag

SEQ ID NO: 73627 - RNA, 20 nt, Artificial Sequence
  MKO10073627_B_B9d2
  gRNA
auggcugaagugcacgugau

SEQ ID NO: 73628 - RNA, 20 nt, Artificial Sequence
  MKO10073628_B_B9d2
  gRNA
gaccuuuaguagcgaagugc

SEQ ID NO: 73629 - RNA, 20 nt, Artificial Sequence
  MKO10073629_B_B9d2
  gRNA
cauaggggccaccgguuucu

SEQ ID NO: 73630 - RNA, 20 nt, Artificial Sequence
  MKO10073630_B_BB287469
  gRNA
acaugccaaaaucaaugaaa

SEQ ID NO: 73631 - RNA, 20 nt, Artificial Sequence
  MKO10073631_B_BB287469
  gRNA
gaaaucguguuugaugauau

SEQ ID NO: 73632 - RNA, 20 nt, Artificial Sequence
  MKO10073632_B_BB287469
  gRNA
auguucuggaaguucuccau

SEQ ID NO: 73633 - RNA, 20 nt, Artificial Sequence
  MKO10073633_B_BC003331
  gRNA
caaacagccgagagcuaagu

SEQ ID NO: 73634 - RNA, 20 nt, Artificial Sequence
  MKO10073634_B_BC003331
  gRNA
uagguguccagaaugcuccc

SEQ ID NO: 73635 - RNA, 20 nt, Artificial Sequence
  MKO10073635_B_BC003331
  gRNA
ccaagaaccacaaguccucc

SEQ ID NO: 73636 - RNA, 20 nt, Artificial Sequence
  MKO10073636_B_BC003965
  gRNA
ugaacaguguccugugcuca

SEQ ID NO: 73637 - RNA, 20 nt, Artificial Sequence
  MKO10073637_B_BC003965
  gRNA
aguuugcauccgccgccccg

SEQ ID NO: 73638 - RNA, 20 nt, Artificial Sequence
  MKO10073638_B_BC003965
  gRNA
ugcuccacgguccagcggau

SEQ ID NO: 73639 - RNA, 20 nt, Artificial Sequence
  MKO10073639_B_BC004004
  gRNA
gcucacucguucaucacauu

SEQ ID NO: 73640 - RNA, 20 nt, Artificial Sequence
  MKO10073640_B_BC004004
  gRNA
aggaaagcagcgccaccacu

SEQ ID NO: 73641 - RNA, 20 nt, Artificial Sequence
  MKO10073641_B_BC004004
  gRNA
ugaaucucugcagacgacag

SEQ ID NO: 73642 - RNA, 20 nt, Artificial Sequence
  MKO10073642_B_BC005537
  gRNA
gcgagauuccagcuauuccu

SEQ ID NO: 73643 - RNA, 20 nt, Artificial Sequence
  MKO10073643_B_BC005537
  gRNA
caaaccugaacaggccuaaa

SEQ ID NO: 73644 - RNA, 20 nt, Artificial Sequence
  MKO10073644_B_BC005537
  gRNA
accgugaugaaauucaaauu

SEQ ID NO: 73645 - RNA, 20 nt, Artificial Sequence
  MKO10073645_B_BC005561
  gRNA
cccuaauucaacaaucagcu

SEQ ID NO: 73646 - RNA, 20 nt, Artificial Sequence
  MKO10073646_B_BC005561
  gRNA
gcaguuuaaccuuaucgauu

SEQ ID NO: 73647 - RNA, 20 nt, Artificial Sequence
  MKO10073647_B_BC005561
  gRNA
gagccuauuuaccgaagagu

SEQ ID NO: 73648 - RNA, 20 nt, Artificial Sequence
  MKO10073648_B_BC005624
  gRNA
gcaggaugauccuuuccaaa

SEQ ID NO: 73649 - RNA, 20 nt, Artificial Sequence
  MKO10073649_B_BC005624
  gRNA
cugcagaaaacgaugucccc

SEQ ID NO: 73650 - RNA, 20 nt, Artificial Sequence
  MKO10073650_B_BC005624
  gRNA
gaaccuucucuccuaccagc

SEQ ID NO: 73651 - RNA, 20 nt, Artificial Sequence
  MKO10073651_B_BC005764
  gRNA
gaaguacucacugaggccgc

SEQ ID NO: 73652 - RNA, 20 nt, Artificial Sequence
  MKO10073652_B_BC005764
  gRNA
gucgaacccuuacaucacac

SEQ ID NO: 73653 - RNA, 20 nt, Artificial Sequence
  MKO10073653_B_BC005764
  gRNA
ccacaaagcgcacugugcgc

SEQ ID NO: 73654 - RNA, 20 nt, Artificial Sequence
  MKO10073654_B_BC016423
  gRNA
cauacuuaaaaucuaguucc

SEQ ID NO: 73655 - RNA, 20 nt, Artificial Sequence
  MKO10073655_B_BC016423
  gRNA
guugaauugacaaacaaaca

SEQ ID NO: 73656 - RNA, 20 nt, Artificial Sequence
  MKO10073656_B_BC016423
  gRNA
agaaaacauagauaagcuaa

SEQ ID NO: 73657 - RNA, 20 nt, Artificial Sequence
  MKO10073657_B_BC016579
  gRNA
caucacgcucaagauuccag

SEQ ID NO: 73658 - RNA, 20 nt, Artificial Sequence
  MKO10073658_B_BC016579
  gRNA
auaucuaccugugagagucu

SEQ ID NO: 73659 - RNA, 20 nt, Artificial Sequence
  MKO10073659_B_BC016579
  gRNA
gugaaaaaacgacucagaga

SEQ ID NO: 73660 - RNA, 20 nt, Artificial Sequence
  MKO10073660_B_BC017158
  gRNA
uuucagcugccacguccacc

SEQ ID NO: 73661 - RNA, 20 nt, Artificial Sequence
  MKO10073661_B_BC017158
  gRNA
acaugggagccauaaucucu

SEQ ID NO: 73662 - RNA, 20 nt, Artificial Sequence
  MKO10073662_B_BC017158
  gRNA
cccagauucaacuggcaugu

SEQ ID NO: 73663 - RNA, 20 nt, Artificial Sequence
  MKO10073663_B_BC017643
  gRNA
ucucacucagagugcaguca

SEQ ID NO: 73664 - RNA, 20 nt, Artificial Sequence
  MKO10073664_B_BC017643
  gRNA
aguucuguacagccacaaau

SEQ ID NO: 73665 - RNA, 20 nt, Artificial Sequence
  MKO10073665_B_BC017643
  gRNA
ucuacaggaauauuauccac

SEQ ID NO: 73666 - RNA, 20 nt, Artificial Sequence
  MKO10073666_B_BC018242
  gRNA
uugucccgcauuugcaaaaa

SEQ ID NO: 73667 - RNA, 20 nt, Artificial Sequence
  MKO10073667_B_BC018242
  gRNA
ggagagcaccaucguguccg

SEQ ID NO: 73668 - RNA, 20 nt, Artificial Sequence
  MKO10073668_B_BC018242
  gRNA
acaccaucucaccgugaggg

SEQ ID NO: 73669 - RNA, 20 nt, Artificial Sequence
  MKO10073669_B_BC018507
  gRNA
ccuuugcaguaaccugcuga

SEQ ID NO: 73670 - RNA, 20 nt, Artificial Sequence
  MKO10073670_B_BC018507
  gRNA
cagcacacugcaucaccaag

SEQ ID NO: 73671 - RNA, 20 nt, Artificial Sequence
  MKO10073671_B_BC018507
  gRNA
gcagaagugucaagaagaau

SEQ ID NO: 73672 - RNA, 20 nt, Artificial Sequence
  MKO10073672_B_BC021614
  gRNA
caccuggucaccaacaauga

SEQ ID NO: 73673 - RNA, 20 nt, Artificial Sequence
  MKO10073673_B_BC021614
  gRNA
accaauccaauacuauccua

SEQ ID NO: 73674 - RNA, 20 nt, Artificial Sequence
  MKO10073674_B_BC021614
  gRNA
gguggccaguccuucauugu

SEQ ID NO: 73675 - RNA, 20 nt, Artificial Sequence
  MKO10073675_B_BC021785
  gRNA
uaccgcgaacaccgagucua

SEQ ID NO: 73676 - RNA, 20 nt, Artificial Sequence
  MKO10073676_B_BC021785
  gRNA
gaggugcugcucaacagacg

SEQ ID NO: 73677 - RNA, 20 nt, Artificial Sequence
  MKO10073677_B_BC021785
  gRNA
cagagccgcacaaguagccg

SEQ ID NO: 73678 - RNA, 20 nt, Artificial Sequence
  MKO10073678_B_BC021891
  gRNA
gauggacuggcuguggcgua

SEQ ID NO: 73679 - RNA, 20 nt, Artificial Sequence
  MKO10073679_B_BC021891
  gRNA
accaccaggaugagcgcagc

SEQ ID NO: 73680 - RNA, 20 nt, Artificial Sequence
  MKO10073680_B_BC021891
  gRNA
acuuugggcuagcgagggaa

SEQ ID NO: 73681 - RNA, 20 nt, Artificial Sequence
  MKO10073681_B_BC022687
  gRNA
cugcaucugugccgagacuc

SEQ ID NO: 73682 - RNA, 20 nt, Artificial Sequence
  MKO10073682_B_BC022687
  gRNA
uacuccacgcaaccugaaaa

SEQ ID NO: 73683 - RNA, 20 nt, Artificial Sequence
  MKO10073683_B_BC022687
  gRNA
cgcucaccuuggucugaauc

SEQ ID NO: 73684 - RNA, 20 nt, Artificial Sequence
  MKO10073684_B_BC023829
  gRNA
auuaacuuccacaaccauau

SEQ ID NO: 73685 - RNA, 20 nt, Artificial Sequence
  MKO10073685_B_BC023829
  gRNA
gaaugaugccauccaaacga

SEQ ID NO: 73686 - RNA, 20 nt, Artificial Sequence
  MKO10073686_B_BC023829
  gRNA
cauccaguuugugaaccagc

SEQ ID NO: 73687 - RNA, 20 nt, Artificial Sequence
  MKO10073687_B_BC024139
  gRNA
guaggcgccucuagcagccc

SEQ ID NO: 73688 - RNA, 20 nt, Artificial Sequence
  MKO10073688_B_BC024139
  gRNA
caacgacuccucaaggcccu

SEQ ID NO: 73689 - RNA, 20 nt, Artificial Sequence
  MKO10073689_B_BC024139
  gRNA
ugcuucucagcugcgggaac

SEQ ID NO: 73690 - RNA, 20 nt, Artificial Sequence
  MKO10073690_B_BC024978
  gRNA
guucuacagcaccucaucac

SEQ ID NO: 73691 - RNA, 20 nt, Artificial Sequence
  MKO10073691_B_BC024978
  gRNA
cucugggaugcggaaugagc

SEQ ID NO: 73692 - RNA, 20 nt, Artificial Sequence
  MKO10073692_B_BC024978
  gRNA
guucuuacugagggccuucc

SEQ ID NO: 73693 - RNA, 20 nt, Artificial Sequence
  MKO10073693_B_BC026585
  gRNA
gcggggagccaccucuugaa

SEQ ID NO: 73694 - RNA, 20 nt, Artificial Sequence
  MKO10073694_B_BC026585
  gRNA
cuccagggagaucgaguuau

SEQ ID NO: 73695 - RNA, 20 nt, Artificial Sequence
  MKO10073695_B_BC026585
  gRNA
gcagugcaucacggaccaga

SEQ ID NO: 73696 - RNA, 20 nt, Artificial Sequence
  MKO10073696_B_BC026590
  gRNA
ucccauccaguucuucaaag

SEQ ID NO: 73697 - RNA, 20 nt, Artificial Sequence
  MKO10073697_B_BC026590
  gRNA
gagcaguauaucuuacacag

SEQ ID NO: 73698 - RNA, 20 nt, Artificial Sequence
  MKO10073698_B_BC026590
  gRNA
uguaagauauacugcucuga

SEQ ID NO: 73699 - RNA, 20 nt, Artificial Sequence
  MKO10073699_B_BC027072
  gRNA
ccgcgguucauucgggcuuc

SEQ ID NO: 73700 - RNA, 20 nt, Artificial Sequence
  MKO10073700_B_BC027072
  gRNA
gaugucccguucguuguccc

SEQ ID NO: 73701 - RNA, 20 nt, Artificial Sequence
  MKO10073701_B_BC027072
  gRNA
uugacgaugacguuguguga

SEQ ID NO: 73702 - RNA, 20 nt, Artificial Sequence
  MKO10073702_B_BC027231
  gRNA
gcguuugaaacauaugaauu

SEQ ID NO: 73703 - RNA, 20 nt, Artificial Sequence
  MKO10073703_B_BC027231
  gRNA
ccgcgucguccccagccagc

SEQ ID NO: 73704 - RNA, 20 nt, Artificial Sequence
  MKO10073704_B_BC027231
  gRNA
agguugacugugaagcacuu

SEQ ID NO: 73705 - RNA, 20 nt, Artificial Sequence
  MKO10073705_B_BC028528
  gRNA
uuacuccguguuugagucag

SEQ ID NO: 73706 - RNA, 20 nt, Artificial Sequence
  MKO10073706_B_BC028528
  gRNA
gacauggcaucauucugauu

SEQ ID NO: 73707 - RNA, 20 nt, Artificial Sequence
  MKO10073707_B_BC028528
  gRNA
uucgugguuacaggauucug

SEQ ID NO: 73708 - RNA, 20 nt, Artificial Sequence
  MKO10073708_B_BC029214
  gRNA
ucccagcagaaagcccgauu

SEQ ID NO: 73709 - RNA, 20 nt, Artificial Sequence
  MKO10073709_B_BC029214
  gRNA
agcauguaugcaaccuagag

SEQ ID NO: 73710 - RNA, 20 nt, Artificial Sequence
  MKO10073710_B_BC029214
  gRNA
uaccugccagccgccucucu

SEQ ID NO: 73711 - RNA, 20 nt, Artificial Sequence
  MKO10073711_B_BC030307
  gRNA
gaagcuccaugacgaaguag

SEQ ID NO: 73712 - RNA, 20 nt, Artificial Sequence
  MKO10073712_B_BC030307
  gRNA
uguagguccccggcuugaaa

SEQ ID NO: 73713 - RNA, 20 nt, Artificial Sequence
  MKO10073713_B_BC030307
  gRNA
cuucgaucccgucuaguacc

SEQ ID NO: 73714 - RNA, 20 nt, Artificial Sequence
  MKO10073714_B_BC030336
  gRNA
uugucugacacugccgcacc

SEQ ID NO: 73715 - RNA, 20 nt, Artificial Sequence
  MKO10073715_B_BC030336
  gRNA
uuagggcagccauacagaaa

SEQ ID NO: 73716 - RNA, 20 nt, Artificial Sequence
  MKO10073716_B_BC030336
  gRNA
uuacccaacaacacaguagu

SEQ ID NO: 73717 - RNA, 20 nt, Artificial Sequence
  MKO10073717_B_BC030476
  gRNA
cagcagcgcccucaacaaag

SEQ ID NO: 73718 - RNA, 20 nt, Artificial Sequence
  MKO10073718_B_BC030476
  gRNA
gcuguggaucuuggagcagc

SEQ ID NO: 73719 - RNA, 20 nt, Artificial Sequence
  MKO10073719_B_BC030476
  gRNA
ucuaggugagacaggagaaa

SEQ ID NO: 73720 - RNA, 20 nt, Artificial Sequence
  MKO10073720_B_BC030499
  gRNA
cgggaaacucugguagaaag

SEQ ID NO: 73721 - RNA, 20 nt, Artificial Sequence
  MKO10073721_B_BC030499
  gRNA
ucccccaaacuguguacaaa

SEQ ID NO: 73722 - RNA, 20 nt, Artificial Sequence
  MKO10073722_B_BC030499
  gRNA
ucagucacucacuaauaaag

SEQ ID NO: 73723 - RNA, 20 nt, Artificial Sequence
  MKO10073723_B_BC030500
  gRNA
ucccacuugccuguaaagcc

SEQ ID NO: 73724 - RNA, 20 nt, Artificial Sequence
  MKO10073724_B_BC030500
  gRNA
uuccucgcugcgaucccauc

SEQ ID NO: 73725 - RNA, 20 nt, Artificial Sequence
  MKO10073725_B_BC030500
  gRNA
ggcuaacaacgcuguccacg

SEQ ID NO: 73726 - RNA, 20 nt, Artificial Sequence
  MKO10073726_B_BC030867
  gRNA
agguggggucucccucgucc

SEQ ID NO: 73727 - RNA, 20 nt, Artificial Sequence
  MKO10073727_B_BC030867
  gRNA
ccucagucuggaauuuagcc

SEQ ID NO: 73728 - RNA, 20 nt, Artificial Sequence
  MKO10073728_B_BC030867
  gRNA
uagcaccaugacaauacugu

SEQ ID NO: 73729 - RNA, 20 nt, Artificial Sequence
  MKO10073729_B_BC031181
  gRNA
aaaaggaccaacagaagucu

SEQ ID NO: 73730 - RNA, 20 nt, Artificial Sequence
  MKO10073730_B_BC031181
  gRNA
uugucauuccaguccugcuc

SEQ ID NO: 73731 - RNA, 20 nt, Artificial Sequence
  MKO10073731_B_BC031181
  gRNA
cuugcucauauucuuaucgc

SEQ ID NO: 73732 - RNA, 20 nt, Artificial Sequence
  MKO10073732_B_BC035044
  gRNA
ccauuccaugaagcagauca

SEQ ID NO: 73733 - RNA, 20 nt, Artificial Sequence
  MKO10073733_B_BC035044
  gRNA
ccuuuccagaugacuuaaaa

SEQ ID NO: 73734 - RNA, 20 nt, Artificial Sequence
  MKO10073734_B_BC035044
  gRNA
aaggugacuacucauggcug

SEQ ID NO: 73735 - RNA, 20 nt, Artificial Sequence
  MKO10073735_B_BC037034
  gRNA
aaagcacuugaccgugcuca

SEQ ID NO: 73736 - RNA, 20 nt, Artificial Sequence
  MKO10073736_B_BC037034
  gRNA
uaucuaccugucaugccuga

SEQ ID NO: 73737 - RNA, 20 nt, Artificial Sequence
  MKO10073737_B_BC037034
  gRNA
cuucccacucaccguuucac

SEQ ID NO: 73738 - RNA, 20 nt, Artificial Sequence
  MKO10073738_B_BC048403
  gRNA
ggguaucuucucuuacgaca

SEQ ID NO: 73739 - RNA, 20 nt, Artificial Sequence
  MKO10073739_B_BC048403
  gRNA
ccguuccgcccggggcgccg

SEQ ID NO: 73740 - RNA, 20 nt, Artificial Sequence
  MKO10073740_B_BC048403
  gRNA
gggagaagcuccuccacgug

SEQ ID NO: 73741 - RNA, 20 nt, Artificial Sequence
  MKO10073741_B_BC048502
  gRNA
ccccaagacuugaagcuguu

SEQ ID NO: 73742 - RNA, 20 nt, Artificial Sequence
  MKO10073742_B_BC048502
  gRNA
ugcaguccuguugauacagu

SEQ ID NO: 73743 - RNA, 20 nt, Artificial Sequence
  MKO10073743_B_BC048502
  gRNA
caaagaagcuaguuugugag

SEQ ID NO: 73744 - RNA, 20 nt, Artificial Sequence
  MKO10073744_B_BC048507
  gRNA
ugcuguacuucuccagcgcc

SEQ ID NO: 73745 - RNA, 20 nt, Artificial Sequence
  MKO10073745_B_BC048507
  gRNA
ugcauugugggccggaacuu

SEQ ID NO: 73746 - RNA, 20 nt, Artificial Sequence
  MKO10073746_B_BC048507
  gRNA
agaugcagcaggacucggug

SEQ ID NO: 73747 - RNA, 20 nt, Artificial Sequence
  MKO10073747_B_BC048546
  gRNA
ucuuaccugaacggugauca

SEQ ID NO: 73748 - RNA, 20 nt, Artificial Sequence
  MKO10073748_B_BC048546
  gRNA
gcguugugacacugaacauc

SEQ ID NO: 73749 - RNA, 20 nt, Artificial Sequence
  MKO10073749_B_BC048546
  gRNA
gaacucaccaagucaucaac

SEQ ID NO: 73750 - RNA, 20 nt, Artificial Sequence
  MKO10073750_B_BC048562
  gRNA
uagcacaacagugguuucua

SEQ ID NO: 73751 - RNA, 20 nt, Artificial Sequence
  MKO10073751_B_BC048562
  gRNA
aagaugcaaggugcuuuaau

SEQ ID NO: 73752 - RNA, 20 nt, Artificial Sequence
  MKO10073752_B_BC048562
  gRNA
ucacuuugucgaaggaagug

SEQ ID NO: 73753 - RNA, 20 nt, Artificial Sequence
  MKO10073753_B_BC048609
  gRNA
ucuggccaucaauuaccgag

SEQ ID NO: 73754 - RNA, 20 nt, Artificial Sequence
  MKO10073754_B_BC048609
  gRNA
guucuucaaccgccugugcc

SEQ ID NO: 73755 - RNA, 20 nt, Artificial Sequence
  MKO10073755_B_BC048609
  gRNA
gcaucuaagaaacuugucac

SEQ ID NO: 73756 - RNA, 20 nt, Artificial Sequence
  MKO10073756_B_BC048644
  gRNA
gccgcuucauacgugacgua

SEQ ID NO: 73757 - RNA, 20 nt, Artificial Sequence
  MKO10073757_B_BC048644
  gRNA
ccgugacuccgcgaagucca

SEQ ID NO: 73758 - RNA, 20 nt, Artificial Sequence
  MKO10073758_B_BC048644
  gRNA
gcaaacuucgcucguccuuc

SEQ ID NO: 73759 - RNA, 20 nt, Artificial Sequence
  MKO10073759_B_BC048671
  gRNA
cccucugugauggacucaaa

SEQ ID NO: 73760 - RNA, 20 nt, Artificial Sequence
  MKO10073760_B_BC048671
  gRNA
uucuagguuaccucauuuga

SEQ ID NO: 73761 - RNA, 20 nt, Artificial Sequence
  MKO10073761_B_BC048671
  gRNA
uggcaccagauucuucugua

SEQ ID NO: 73762 - RNA, 20 nt, Artificial Sequence
  MKO10073762_B_BC048679
  gRNA
gaaaacuacgagccucagcc

SEQ ID NO: 73763 - RNA, 20 nt, Artificial Sequence
  MKO10073763_B_BC048679
  gRNA
cugguaccuggguugagaug

SEQ ID NO: 73764 - RNA, 20 nt, Artificial Sequence
  MKO10073764_B_BC048679
  gRNA
cuagaugagcuucaagugcc

SEQ ID NO: 73765 - RNA, 20 nt, Artificial Sequence
  MKO10073765_B_BC048943
  gRNA
cagaaaacgauguacuuccc

SEQ ID NO: 73766 - RNA, 20 nt, Artificial Sequence
  MKO10073766_B_BC048943
  gRNA
agcguagcguguuuguuugu

SEQ ID NO: 73767 - RNA, 20 nt, Artificial Sequence
  MKO10073767_B_BC048943
  gRNA
caaguacaaccuugucaagc

SEQ ID NO: 73768 - RNA, 20 nt, Artificial Sequence
  MKO10073768_B_BC049352
  gRNA
ucuucaacuuauaucaaauc

SEQ ID NO: 73769 - RNA, 20 nt, Artificial Sequence
  MKO10073769_B_BC049352
  gRNA
gcuccaucagacucugucau

SEQ ID NO: 73770 - RNA, 20 nt, Artificial Sequence
  MKO10073770_B_BC049352
  gRNA
uauaaguugaagacaaaguu

SEQ ID NO: 73771 - RNA, 20 nt, Artificial Sequence
  MKO10073771_B_BC049635
  gRNA
ugaagugaaaugcgacagac

SEQ ID NO: 73772 - RNA, 20 nt, Artificial Sequence
  MKO10073772_B_BC049635
  gRNA
uucugccaaaguccgagcag

SEQ ID NO: 73773 - RNA, 20 nt, Artificial Sequence
  MKO10073773_B_BC049635
  gRNA
ccucuuagcguucuaucacu

SEQ ID NO: 73774 - RNA, 20 nt, Artificial Sequence
  MKO10073774_B_BC049715
  gRNA
cuucuuccacauacgagacc

SEQ ID NO: 73775 - RNA, 20 nt, Artificial Sequence
  MKO10073775_B_BC049715
  gRNA
acuuaaucgaagacccauga

SEQ ID NO: 73776 - RNA, 20 nt, Artificial Sequence
  MKO10073776_B_BC049715
  gRNA
ggauaucuuuguacuuacgc

SEQ ID NO: 73777 - RNA, 20 nt, Artificial Sequence
  MKO10073777_B_BC049730
  gRNA
uaagaugcacucacuauucc

SEQ ID NO: 73778 - RNA, 20 nt, Artificial Sequence
  MKO10073778_B_BC049730
  gRNA
gcauagcauuucguguccuu

SEQ ID NO: 73779 - RNA, 20 nt, Artificial Sequence
  MKO10073779_B_BC049730
  gRNA
aguuuggccaaaacuucagu

SEQ ID NO: 73780 - RNA, 20 nt, Artificial Sequence
  MKO10073780_B_BC049762
  gRNA
aaggcgccugcaaagagccc

SEQ ID NO: 73781 - RNA, 20 nt, Artificial Sequence
  MKO10073781_B_BC049762
  gRNA
acccuagcuuccagcaaccg

SEQ ID NO: 73782 - RNA, 20 nt, Artificial Sequence
  MKO10073782_B_BC049762
  gRNA
cucucagguccucucgauga

SEQ ID NO: 73783 - RNA, 20 nt, Artificial Sequence
  MKO10073783_B_BC051019
  gRNA
gugacaagguguuggcaccc

SEQ ID NO: 73784 - RNA, 20 nt, Artificial Sequence
  MKO10073784_B_BC051019
  gRNA
ccgcugcugccccgguuccc

SEQ ID NO: 73785 - RNA, 20 nt, Artificial Sequence
  MKO10073785_B_BC051019
  gRNA
uuauuaucuggcucagauaa

SEQ ID NO: 73786 - RNA, 20 nt, Artificial Sequence
  MKO10073786_B_BC051142
  gRNA
uucauaaaagguauuuccca

SEQ ID NO: 73787 - RNA, 20 nt, Artificial Sequence
  MKO10073787_B_BC051142
  gRNA
ucuuauuucagaaauaguuu

SEQ ID NO: 73788 - RNA, 20 nt, Artificial Sequence
  MKO10073788_B_BC051142
  gRNA
ucagaauagucagaauagca

SEQ ID NO: 73789 - RNA, 20 nt, Artificial Sequence
  MKO10073789_B_BC051628
  gRNA
gucucuuccaggagagcccc

SEQ ID NO: 73790 - RNA, 20 nt, Artificial Sequence
  MKO10073790_B_BC051628
  gRNA
ggaacucacgcagcacguug

SEQ ID NO: 73791 - RNA, 20 nt, Artificial Sequence
  MKO10073791_B_BC051628
  gRNA
ggaugguuacaaaccagcgc

SEQ ID NO: 73792 - RNA, 20 nt, Artificial Sequence
  MKO10073792_B_BC051665
  gRNA
cacuggccacggcauucauc

SEQ ID NO: 73793 - RNA, 20 nt, Artificial Sequence
  MKO10073793_B_BC051665
  gRNA
auguuaacugcagaguacuu

SEQ ID NO: 73794 - RNA, 20 nt, Artificial Sequence
  MKO10073794_B_BC051665
  gRNA
auguccccaagucuguugau

SEQ ID NO: 73795 - RNA, 20 nt, Artificial Sequence
  MKO10073795_B_BC052040
  gRNA
acuaaccaaagcccaguacg

SEQ ID NO: 73796 - RNA, 20 nt, Artificial Sequence
  MKO10073796_B_BC052040
  gRNA
cgauugaaaguuacuaccag

SEQ ID NO: 73797 - RNA, 20 nt, Artificial Sequence
  MKO10073797_B_BC052040
  gRNA
aacuucuaaccugguacucc

SEQ ID NO: 73798 - RNA, 20 nt, Artificial Sequence
  MKO10073798_B_BC053393
  gRNA
cucuaggaagcaguucagcc

SEQ ID NO: 73799 - RNA, 20 nt, Artificial Sequence
  MKO10073799_B_BC053393
  gRNA
cagaacuuuacuaaauaaag

SEQ ID NO: 73800 - RNA, 20 nt, Artificial Sequence
  MKO10073800_B_BC053393
  gRNA
auuacauccuuaugaaaaag

SEQ ID NO: 73801 - RNA, 20 nt, Artificial Sequence
  MKO10073801_B_BC053749
  gRNA
ugaccacucgagucugcugu

SEQ ID NO: 73802 - RNA, 20 nt, Artificial Sequence
  MKO10073802_B_BC053749
  gRNA
cagcucggcuuuguaggcuu

SEQ ID NO: 73803 - RNA, 20 nt, Artificial Sequence
  MKO10073803_B_BC053749
  gRNA
gccuacaaagccgagcugcc

SEQ ID NO: 73804 - RNA, 20 nt, Artificial Sequence
  MKO10073804_B_BC055111
  gRNA
caguuccaccgaaugauguc

SEQ ID NO: 73805 - RNA, 20 nt, Artificial Sequence
  MKO10073805_B_BC055111
  gRNA
gcccugcagaauuauuaucc

SEQ ID NO: 73806 - RNA, 20 nt, Artificial Sequence
  MKO10073806_B_BC055111
  gRNA
cacguaccccaauaaaaccu

SEQ ID NO: 73807 - RNA, 20 nt, Artificial Sequence
  MKO10073807_B_BC055324
  gRNA
cagccaaaauuuagaaaucc

SEQ ID NO: 73808 - RNA, 20 nt, Artificial Sequence
  MKO10073808_B_BC055324
  gRNA
cagaguauaaaauuguuuga

SEQ ID NO: 73809 - RNA, 20 nt, Artificial Sequence
  MKO10073809_B_BC055324
  gRNA
ugauuuacaggcaauggugc

SEQ ID NO: 73810 - RNA, 20 nt, Artificial Sequence
  MKO10073810_B_BC056474
  gRNA
ccccacccaccuuaagcaug

SEQ ID NO: 73811 - RNA, 20 nt, Artificial Sequence
  MKO10073811_B_BC056474
  gRNA
aaagccggguugcacucacu

SEQ ID NO: 73812 - RNA, 20 nt, Artificial Sequence
  MKO10073812_B_BC056474
  gRNA
gcucuucuagcugugaaaga

SEQ ID NO: 73813 - RNA, 20 nt, Artificial Sequence
  MKO10073813_B_BC061194
  gRNA
uauauugcaaggcauaaugc

SEQ ID NO: 73814 - RNA, 20 nt, Artificial Sequence
  MKO10073814_B_BC061194
  gRNA
ucgagcuguaccagaacgcc

SEQ ID NO: 73815 - RNA, 20 nt, Artificial Sequence
  MKO10073815_B_BC061194
  gRNA
agcccgagacugcuuugaaa

SEQ ID NO: 73816 - RNA, 20 nt, Artificial Sequence
  MKO10073816_B_BC061212
  gRNA
accugaagaccugacucaug

SEQ ID NO: 73817 - RNA, 20 nt, Artificial Sequence
  MKO10073817_B_BC061212
  gRNA
uaggugcuugaugacacccu

SEQ ID NO: 73818 - RNA, 20 nt, Artificial Sequence
  MKO10073818_B_BC061212
  gRNA
ccgccagcaaaaacaaaguc

SEQ ID NO: 73819 - RNA, 20 nt, Artificial Sequence
  MKO10073819_B_BC061237
  gRNA
uauauuugucuuugaucuuc

SEQ ID NO: 73820 - RNA, 20 nt, Artificial Sequence
  MKO10073820_B_BC061237
  gRNA
caacugcuuguacuuguaca

SEQ ID NO: 73821 - RNA, 20 nt, Artificial Sequence
  MKO10073821_B_BC061237
  gRNA
gucauucaaauccuuguacu

SEQ ID NO: 73822 - RNA, 20 nt, Artificial Sequence
  MKO10073822_B_BC068157
  gRNA
cccaauucagcaucgcuaag

SEQ ID NO: 73823 - RNA, 20 nt, Artificial Sequence
  MKO10073823_B_BC068157
  gRNA
gagacuccaaccuccgacua

SEQ ID NO: 73824 - RNA, 20 nt, Artificial Sequence
  MKO10073824_B_BC068157
  gRNA
cugaacucuggaacacgaag

SEQ ID NO: 73825 - RNA, 20 nt, Artificial Sequence
  MKO10073825_B_BC068281
  gRNA
gaggccaaacaucuguugaa

SEQ ID NO: 73826 - RNA, 20 nt, Artificial Sequence
  MKO10073826_B_BC068281
  gRNA
acucacaaccuccauggacc

SEQ ID NO: 73827 - RNA, 20 nt, Artificial Sequence
  MKO10073827_B_BC068281
  gRNA
gucuucagacacuccagaag

SEQ ID NO: 73828 - RNA, 20 nt, Artificial Sequence
  MKO10073828_B_BC080695
  gRNA
aucuuccuuacagugugcau

SEQ ID NO: 73829 - RNA, 20 nt, Artificial Sequence
  MKO10073829_B_BC080695
  gRNA
cuccuauuuacuggcaacaa

SEQ ID NO: 73830 - RNA, 20 nt, Artificial Sequence
  MKO10073830_B_BC080695
  gRNA
uaggugucugaagacuccgc

SEQ ID NO: 73831 - RNA, 20 nt, Artificial Sequence
  MKO10073831_B_BC089491
  gRNA
acccacaaguuucuucagac

SEQ ID NO: 73832 - RNA, 20 nt, Artificial Sequence
  MKO10073832_B_BC089491
  gRNA
gaagcugauccauuccaaga

SEQ ID NO: 73833 - RNA, 20 nt, Artificial Sequence
  MKO10073833_B_BC089491
  gRNA
gcaucaauucccaaaccuuc

SEQ ID NO: 73834 - RNA, 20 nt, Artificial Sequence
  MKO10073834_B_BC089597
  gRNA
agcuuucacagggcuuuguc

SEQ ID NO: 73835 - RNA, 20 nt, Artificial Sequence
  MKO10073835_B_BC089597
  gRNA
cgccaccauguagagccaca

SEQ ID NO: 73836 - RNA, 20 nt, Artificial Sequence
  MKO10073836_B_BC089597
  gRNA
ugacacucugcccaagaugc

SEQ ID NO: 73837 - RNA, 20 nt, Artificial Sequence
  MKO10073837_B_BC094916
  gRNA
aagagaauuguucuucugac

SEQ ID NO: 73838 - RNA, 20 nt, Artificial Sequence
  MKO10073838_B_BC094916
  gRNA
uuagcaaugucuccaagucc

SEQ ID NO: 73839 - RNA, 20 nt, Artificial Sequence
  MKO10073839_B_BC094916
  gRNA
agccaccauaccuguguguc

SEQ ID NO: 73840 - RNA, 20 nt, Artificial Sequence
  MKO10073840_B_BC100451
  gRNA
aaacucuugcaagcguuucc

SEQ ID NO: 73841 - RNA, 20 nt, Artificial Sequence
  MKO10073841_B_BC100451
  gRNA
gagacgggugucuucaagua

SEQ ID NO: 73842 - RNA, 20 nt, Artificial Sequence
  MKO10073842_B_BC100451
  gRNA
gcaccccaagucccggaaaa

SEQ ID NO: 73843 - RNA, 20 nt, Artificial Sequence
  MKO10073843_B_BC100530
  gRNA
uuucagauggauguagguca

SEQ ID NO: 73844 - RNA, 20 nt, Artificial Sequence
  MKO10073844_B_BC100530
  gRNA
guaggucagcucaucauccu

SEQ ID NO: 73845 - RNA, 20 nt, Artificial Sequence
  MKO10073845_B_BC100530
  gRNA
aauccagaagauugcugaca

SEQ ID NO: 73846 - RNA, 20 nt, Artificial Sequence
  MKO10073846_B_BC107364
  gRNA
guucugccaccaugacacgu

SEQ ID NO: 73847 - RNA, 20 nt, Artificial Sequence
  MKO10073847_B_BC107364
  gRNA
caggcgaguaacucaaauuc

SEQ ID NO: 73848 - RNA, 20 nt, Artificial Sequence
  MKO10073848_B_BC107364
  gRNA
cacugcaguucgcuucugug

SEQ ID NO: 73849 - RNA, 20 nt, Artificial Sequence
  MKO10073849_B_BC117090
  gRNA
ucaccuugucagcaaucuuc

SEQ ID NO: 73850 - RNA, 20 nt, Artificial Sequence
  MKO10073850_B_BC117090
  gRNA
uauaaaacucaagccgucgc

SEQ ID NO: 73851 - RNA, 20 nt, Artificial Sequence
  MKO10073851_B_BC117090
  gRNA
auucacauaaaagucuucag

SEQ ID NO: 73852 - RNA, 20 nt, Artificial Sequence
  MKO10073852_B_BC147527
  gRNA
aagaugaugcuguccuuccc

SEQ ID NO: 73853 - RNA, 20 nt, Artificial Sequence
  MKO10073853_B_BC147527
  gRNA
gaaggacagcaucaucuucu

SEQ ID NO: 73854 - RNA, 20 nt, Artificial Sequence
  MKO10073854_B_BC147527
  gRNA
acucccucugacacucacuc

SEQ ID NO: 73855 - RNA, 20 nt, Artificial Sequence
  MKO10073855_B_Baalc
  gRNA
ggugcuccgaccugcagccc

SEQ ID NO: 73856 - RNA, 20 nt, Artificial Sequence
  MKO10073856_B_Baalc
  gRNA
aaacacguucucacucugcg

SEQ ID NO: 73857 - RNA, 20 nt, Artificial Sequence
  MKO10073857_B_Baalc
  gRNA
uggcacacgugauaccccuu

SEQ ID NO: 73858 - RNA, 20 nt, Artificial Sequence
  MKO10073858_B_Baau
  gRNA
accugaccaugauauacaug

SEQ ID NO: 73859 - RNA, 20 nt, Artificial Sequence
  MKO10073859_B_Baau
  gRNA
cugacgacuaugucuuguaa

SEQ ID NO: 73860 - RNA, 20 nt, Artificial Sequence
  MKO10073860_B_Baau
  gRNA
gaucaaaaugggcauccuug

SEQ ID NO: 73861 - RNA, 20 nt, Artificial Sequence
  MKO10073861_B_Babam1
  gRNA
uauguuucagaucaucuguc

SEQ ID NO: 73862 - RNA, 20 nt, Artificial Sequence
  MKO10073862_B_Babam1
  gRNA
gcagagcucacgugggucag

SEQ ID NO: 73863 - RNA, 20 nt, Artificial Sequence
  MKO10073863_B_Babam1
  gRNA
ggagaugucugugccaaagc

SEQ ID NO: 73864 - RNA, 20 nt, Artificial Sequence
  MKO10073864_B_Bace1
  gRNA
gaccaccuuaccgucugugg

SEQ ID NO: 73865 - RNA, 20 nt, Artificial Sequence
  MKO10073865_B_Bace1
  gRNA
gaagggcuccaaagagucgu

SEQ ID NO: 73866 - RNA, 20 nt, Artificial Sequence
  MKO10073866_B_Bace1
  gRNA
guuggcacgcacagugacgu

SEQ ID NO: 73867 - RNA, 20 nt, Artificial Sequence
  MKO10073867_B_Bace2
  gRNA
auucucagacucgaaaauag

SEQ ID NO: 73868 - RNA, 20 nt, Artificial Sequence
  MKO10073868_B_Bace2
  gRNA
ggauugccaguagcugguuc

SEQ ID NO: 73869 - RNA, 20 nt, Artificial Sequence
  MKO10073869_B_Bace2
  gRNA
uaguaccauuccucuuuaau

SEQ ID NO: 73870 - RNA, 20 nt, Artificial Sequence
  MKO10073870_B_Bach1
  gRNA
uguaaaagcaagcucgccgu

SEQ ID NO: 73871 - RNA, 20 nt, Artificial Sequence
  MKO10073871_B_Bach1
  gRNA
ucuaagcguacacaauaucg

SEQ ID NO: 73872 - RNA, 20 nt, Artificial Sequence
  MKO10073872_B_Bach1
  gRNA
ucggaguaguguggagcgag

SEQ ID NO: 73873 - RNA, 20 nt, Artificial Sequence
  MKO10073873_B_Bach2
  gRNA
cagcccagcgcugucgaaag

SEQ ID NO: 73874 - RNA, 20 nt, Artificial Sequence
  MKO10073874_B_Bach2
  gRNA
ugcgguucuuacuccgccuc

SEQ ID NO: 73875 - RNA, 20 nt, Artificial Sequence
  MKO10073875_B_Bach2
  gRNA
agagaauguccuucuuccgu

SEQ ID NO: 73876 - RNA, 20 nt, Artificial Sequence
  MKO10073876_B_Bad
  gRNA
ggacgcgcauuauccagucc

SEQ ID NO: 73877 - RNA, 20 nt, Artificial Sequence
  MKO10073877_B_Bad
  gRNA
gaucggacuuccucaagccu

SEQ ID NO: 73878 - RNA, 20 nt, Artificial Sequence
  MKO10073878_B_Bad
  gRNA
cuggauaaugcgcguccagc

SEQ ID NO: 73879 - RNA, 20 nt, Artificial Sequence
  MKO10073879_B_Bag1
  gRNA
ugagccaguuguccaagacu

SEQ ID NO: 73880 - RNA, 20 nt, Artificial Sequence
  MKO10073880_B_Bag1
  gRNA
uuucaccaauuaacaugacu

SEQ ID NO: 73881 - RNA, 20 nt, Artificial Sequence
  MKO10073881_B_Bag1
  gRNA
guguuuccauuuccuccguc

SEQ ID NO: 73882 - RNA, 20 nt, Artificial Sequence
  MKO10073882_B_Bag2
  gRNA
gaagcggcccucgugggccu

SEQ ID NO: 73883 - RNA, 20 nt, Artificial Sequence
  MKO10073883_B_Bag2
  gRNA
cgcuaaucugccucaugucc

SEQ ID NO: 73884 - RNA, 20 nt, Artificial Sequence
  MKO10073884_B_Bag2
  gRNA
cgcagcuacugcuguugagc

SEQ ID NO: 73885 - RNA, 20 nt, Artificial Sequence
  MKO10073885_B_Bag3
  gRNA
uguuucggcuucucccgauu

SEQ ID NO: 73886 - RNA, 20 nt, Artificial Sequence
  MKO10073886_B_Bag3
  gRNA
cgacccgcgugugccccccg

SEQ ID NO: 73887 - RNA, 20 nt, Artificial Sequence
  MKO10073887_B_Bag3
  gRNA
gaaggcucgcccgccagaag

SEQ ID NO: 73888 - RNA, 20 nt, Artificial Sequence
  MKO10073888_B_Bag4
  gRNA
uauggaccgccuuacccucc

SEQ ID NO: 73889 - RNA, 20 nt, Artificial Sequence
  MKO10073889_B_Bag4
  gRNA
ccaaacaccuaccguucacc

SEQ ID NO: 73890 - RNA, 20 nt, Artificial Sequence
  MKO10073890_B_Bag4
  gRNA
uucauacugauggacgcugc

SEQ ID NO: 73891 - RNA, 20 nt, Artificial Sequence
  MKO10073891_B_Bag5
  gRNA
cuccuguaccgcgcagaucu

SEQ ID NO: 73892 - RNA, 20 nt, Artificial Sequence
  MKO10073892_B_Bag5
  gRNA
gcgguaccuggcuuuccgca

SEQ ID NO: 73893 - RNA, 20 nt, Artificial Sequence
  MKO10073893_B_Bag5
  gRNA
gcagauccugaucacguacc

SEQ ID NO: 73894 - RNA, 20 nt, Artificial Sequence
  MKO10073894_B_Bag6
  gRNA
gcaucccuuccgagaaacag

SEQ ID NO: 73895 - RNA, 20 nt, Artificial Sequence
  MKO10073895_B_Bag6
  gRNA
cggucaugaacagaagcccc

SEQ ID NO: 73896 - RNA, 20 nt, Artificial Sequence
  MKO10073896_B_Bag6
  gRNA
gccaacagcuaugucauggu

SEQ ID NO: 73897 - RNA, 20 nt, Artificial Sequence
  MKO10073897_B_Bahcc1
  gRNA
uccucgguaggccggcucag

SEQ ID NO: 73898 - RNA, 20 nt, Artificial Sequence
  MKO10073898_B_Bahcc1
  gRNA
ucuagcgcauggcuggcacg

SEQ ID NO: 73899 - RNA, 20 nt, Artificial Sequence
  MKO10073899_B_Bahcc1
  gRNA
gauccaaguggcucacgggu

SEQ ID NO: 73900 - RNA, 20 nt, Artificial Sequence
  MKO10073900_B_Bahd1
  gRNA
cagagcgccaagccuccgag

SEQ ID NO: 73901 - RNA, 20 nt, Artificial Sequence
  MKO10073901_B_Bahd1
  gRNA
aaagacgucuacaccuuaug

SEQ ID NO: 73902 - RNA, 20 nt, Artificial Sequence
  MKO10073902_B_Bahd1
  gRNA
auagcacuucucuucaaugc

SEQ ID NO: 73903 - RNA, 20 nt, Artificial Sequence
  MKO10073903_B_Bai1
  gRNA
ccccagcggccccgcgagcu

SEQ ID NO: 73904 - RNA, 20 nt, Artificial Sequence
  MKO10073904_B_Bai1
  gRNA
ccccaaacuccucacgucgc

SEQ ID NO: 73905 - RNA, 20 nt, Artificial Sequence
  MKO10073905_B_Bai1
  gRNA
acugcacugaguacuguacg

SEQ ID NO: 73906 - RNA, 20 nt, Artificial Sequence
  MKO10073906_B_Bai2
  gRNA
gcgcuacugacccgggcagg

SEQ ID NO: 73907 - RNA, 20 nt, Artificial Sequence
  MKO10073907_B_Bai2
  gRNA
gucugcgccauguauagccc

SEQ ID NO: 73908 - RNA, 20 nt, Artificial Sequence
  MKO10073908_B_Bai2
  gRNA
cgugagggcaccugcgcacg

SEQ ID NO: 73909 - RNA, 20 nt, Artificial Sequence
  MKO10073909_B_Bai3
  gRNA
gaggccaaagaacacgaacc

SEQ ID NO: 73910 - RNA, 20 nt, Artificial Sequence
  MKO10073910_B_Bai3
  gRNA
ugcuacaacccugaauguac

SEQ ID NO: 73911 - RNA, 20 nt, Artificial Sequence
  MKO10073911_B_Bai3
  gRNA
cucgaucuguccaugagaaa

SEQ ID NO: 73912 - RNA, 20 nt, Artificial Sequence
  MKO10073912_B_Baiap2l1
  gRNA
aauuaugaaaaagcggugaa

SEQ ID NO: 73913 - RNA, 20 nt, Artificial Sequence
  MKO10073913_B_Baiap2l1
  gRNA
gagucucauugaguuucuug

SEQ ID NO: 73914 - RNA, 20 nt, Artificial Sequence
  MKO10073914_B_Baiap2l1
  gRNA
acaguucaaaaaauuccaua

SEQ ID NO: 73915 - RNA, 20 nt, Artificial Sequence
  MKO10073915_B_Baiap2l2
  gRNA
uucagcgccauacagaagau

SEQ ID NO: 73916 - RNA, 20 nt, Artificial Sequence
  MKO10073916_B_Baiap2l2
  gRNA
ugugcugaagcaagucuccg

SEQ ID NO: 73917 - RNA, 20 nt, Artificial Sequence
  MKO10073917_B_Baiap2l2
  gRNA
gaugaacugcauguccagcu

SEQ ID NO: 73918 - RNA, 20 nt, Artificial Sequence
  MKO10073918_B_Baiap2
  gRNA
cgaugaaguugcggaggcug

SEQ ID NO: 73919 - RNA, 20 nt, Artificial Sequence
  MKO10073919_B_Baiap2
  gRNA
ggugucaccuucgcugccaa

SEQ ID NO: 73920 - RNA, 20 nt, Artificial Sequence
  MKO10073920_B_Baiap2
  gRNA
ccuccgcaacuucaucgcca

SEQ ID NO: 73921 - RNA, 20 nt, Artificial Sequence
  MKO10073921_B_Baiap3
  gRNA
ucacagguucuucuucgaag

SEQ ID NO: 73922 - RNA, 20 nt, Artificial Sequence
  MKO10073922_B_Baiap3
  gRNA
cuugcuaagcuaccuucagc

SEQ ID NO: 73923 - RNA, 20 nt, Artificial Sequence
  MKO10073923_B_Baiap3
  gRNA
ggccuucuucacacgcauga

SEQ ID NO: 73924 - RNA, 20 nt, Artificial Sequence
  MKO10073924_B_Bak1
  gRNA
cugguaccuggaggcgaucu

SEQ ID NO: 73925 - RNA, 20 nt, Artificial Sequence
  MKO10073925_B_Bak1
  gRNA
ucuucaccaagaucgccucc

SEQ ID NO: 73926 - RNA, 20 nt, Artificial Sequence
  MKO10073926_B_Bak1
  gRNA
cgccccugccaaccccgaga

SEQ ID NO: 73927 - RNA, 20 nt, Artificial Sequence
  MKO10073927_B_Bambi
  gRNA
agacaucugccgagccaaac

SEQ ID NO: 73928 - RNA, 20 nt, Artificial Sequence
  MKO10073928_B_Bambi
  gRNA
cagccagaugaagaaguagc

SEQ ID NO: 73929 - RNA, 20 nt, Artificial Sequence
  MKO10073929_B_Bambi
  gRNA
gcagcuggagcucugcgcca

SEQ ID NO: 73930 - RNA, 20 nt, Artificial Sequence
  MKO10073930_B_Banf1
  gRNA
aaagcagucccgggacugcu

SEQ ID NO: 73931 - RNA, 20 nt, Artificial Sequence
  MKO10073931_B_Banf1
  gRNA
gcuuugggugccuucgagaa

SEQ ID NO: 73932 - RNA, 20 nt, Artificial Sequence
  MKO10073932_B_Banf1
  gRNA
cuuucuuuagcaccagaaac

SEQ ID NO: 73933 - RNA, 20 nt, Artificial Sequence
  MKO10073933_B_Banf2
  gRNA
cagagauaucuauaggaaac

SEQ ID NO: 73934 - RNA, 20 nt, Artificial Sequence
  MKO10073934_B_Banf2
  gRNA
gccuuucucucugaacccau

SEQ ID NO: 73935 - RNA, 20 nt, Artificial Sequence
  MKO10073935_B_Banf2
  gRNA
ucagaagaaacugucccagc

SEQ ID NO: 73936 - RNA, 20 nt, Artificial Sequence
  MKO10073936_B_Bank1
  gRNA
cucaagagccaaguauccug

SEQ ID NO: 73937 - RNA, 20 nt, Artificial Sequence
  MKO10073937_B_Bank1
  gRNA
accuggcacaaacucuugcc

SEQ ID NO: 73938 - RNA, 20 nt, Artificial Sequence
  MKO10073938_B_Bank1
  gRNA
uugacagugaccgagccagc

SEQ ID NO: 73939 - RNA, 20 nt, Artificial Sequence
  MKO10073939_B_Banp
  gRNA
ccacacgguaccuuuauaga

SEQ ID NO: 73940 - RNA, 20 nt, Artificial Sequence
  MKO10073940_B_Banp
  gRNA
agaccugcaacaaagugcga

SEQ ID NO: 73941 - RNA, 20 nt, Artificial Sequence
  MKO10073941_B_Banp
  gRNA
uccggugcccuguugcucaa

SEQ ID NO: 73942 - RNA, 20 nt, Artificial Sequence
  MKO10073942_B_Bap1
  gRNA
auccuucauucggcucagcg

SEQ ID NO: 73943 - RNA, 20 nt, Artificial Sequence
  MKO10073943_B_Bap1
  gRNA
ccugaucguaggugucaaag

SEQ ID NO: 73944 - RNA, 20 nt, Artificial Sequence
  MKO10073944_B_Bap1
  gRNA
ucuuaccgaaaucuuccacc

SEQ ID NO: 73945 - RNA, 20 nt, Artificial Sequence
  MKO10073945_B_Bard1
  gRNA
ccaacgguguccauccagca

SEQ ID NO: 73946 - RNA, 20 nt, Artificial Sequence
  MKO10073946_B_Bard1
  gRNA
ccaauugucgguuuaucuug

SEQ ID NO: 73947 - RNA, 20 nt, Artificial Sequence
  MKO10073947_B_Bard1
  gRNA
aaucagugcuaauauucuga

SEQ ID NO: 73948 - RNA, 20 nt, Artificial Sequence
  MKO10073948_B_Barhl1
  gRNA
cgccuucaccgaccaucagc

SEQ ID NO: 73949 - RNA, 20 nt, Artificial Sequence
  MKO10073949_B_Barhl1
  gRNA
uacagauagagugcggcacc

SEQ ID NO: 73950 - RNA, 20 nt, Artificial Sequence
  MKO10073950_B_Barhl1
  gRNA
gucuggagaccaguaccucg

SEQ ID NO: 73951 - RNA, 20 nt, Artificial Sequence
  MKO10073951_B_Barhl2
  gRNA
uugagggccggcuguccccc

SEQ ID NO: 73952 - RNA, 20 nt, Artificial Sequence
  MKO10073952_B_Barhl2
  gRNA
cugcagcgcggaguaguucc

SEQ ID NO: 73953 - RNA, 20 nt, Artificial Sequence
  MKO10073953_B_Barhl2
  gRNA
gcucuccucaccuucgguuc

SEQ ID NO: 73954 - RNA, 20 nt, Artificial Sequence
  MKO10073954_B_Barx1
  gRNA
gcgggcgagcugcucaaguu

SEQ ID NO: 73955 - RNA, 20 nt, Artificial Sequence
  MKO10073955_B_Barx1
  gRNA
ccuggcgcgaaagccaagaa

SEQ ID NO: 73956 - RNA, 20 nt, Artificial Sequence
  MKO10073956_B_Barx1
  gRNA
agcagccgagcggcgccagu

SEQ ID NO: 73957 - RNA, 20 nt, Artificial Sequence
  MKO10073957_B_Barx2
  gRNA
aagauggugcgacuucugcg

SEQ ID NO: 73958 - RNA, 20 nt, Artificial Sequence
  MKO10073958_B_Barx2
  gRNA
ucgccauccagucgccgcug

SEQ ID NO: 73959 - RNA, 20 nt, Artificial Sequence
  MKO10073959_B_Barx2
  gRNA
caaagcgugccuuguccccu

SEQ ID NO: 73960 - RNA, 20 nt, Artificial Sequence
  MKO10073960_B_Basp1
  gRNA
cgaagcgagcgccgagagca

SEQ ID NO: 73961 - RNA, 20 nt, Artificial Sequence
  MKO10073961_B_Basp1
  gRNA
uuuagagucugaagccgccg

SEQ ID NO: 73962 - RNA, 20 nt, Artificial Sequence
  MKO10073962_B_Basp1
  gRNA
gggggccuuggccgcggaac

SEQ ID NO: 73963 - RNA, 20 nt, Artificial Sequence
  MKO10073963_B_Bauf2
  gRNA
aucuguggccccuagcccac

SEQ ID NO: 73964 - RNA, 20 nt, Artificial Sequence
  MKO10073964_B_Bauf2
  gRNA
gcuacucccacagaguugca

SEQ ID NO: 73965 - RNA, 20 nt, Artificial Sequence
  MKO10073965_B_Bauf2
  gRNA
gccuaagccaugcaacucug

SEQ ID NO: 73966 - RNA, 20 nt, Artificial Sequence
  MKO10073966_B_Bauf3
  gRNA
ucucugcagcacgcugaccg

SEQ ID NO: 73967 - RNA, 20 nt, Artificial Sequence
  MKO10073967_B_Bauf3
  gRNA
ggagcugcgucaccugagcg

SEQ ID NO: 73968 - RNA, 20 nt, Artificial Sequence
  MKO10073968_B_Bauf3
  gRNA
aacuuuccugucaucguccu

SEQ ID NO: 73969 - RNA, 20 nt, Artificial Sequence
  MKO10073969_B_Bauf
  gRNA
agagaucaaacagcucaccg

SEQ ID NO: 73970 - RNA, 20 nt, Artificial Sequence
  MKO10073970_B_Bauf
  gRNA
gaaggggguaccuguuugcc

SEQ ID NO: 73971 - RNA, 20 nt, Artificial Sequence
  MKO10073971_B_Bauf
  gRNA
uucagccgcucuccuccccc

SEQ ID NO: 73972 - RNA, 20 nt, Artificial Sequence
  MKO10073972_B_Bax
  gRNA
cacucaccccuguagcaaaa

SEQ ID NO: 73973 - RNA, 20 nt, Artificial Sequence
  MKO10073973_B_Bax
  gRNA
ccccccgagaggucuucuuc

SEQ ID NO: 73974 - RNA, 20 nt, Artificial Sequence
  MKO10073974_B_Bax
  gRNA
gcuugucuggauccaagacc

SEQ ID NO: 73975 - RNA, 20 nt, Artificial Sequence
  MKO10073975_B_Baz1a
  gRNA
gcaaaaccauucugauguaa

SEQ ID NO: 73976 - RNA, 20 nt, Artificial Sequence
  MKO10073976_B_Baz1a
  gRNA
aacccuguaucugaauaaua

SEQ ID NO: 73977 - RNA, 20 nt, Artificial Sequence
  MKO10073977_B_Baz1a
  gRNA
caacacugugaagcacaaga

SEQ ID NO: 73978 - RNA, 20 nt, Artificial Sequence
  MKO10073978_B_Baz1b
  gRNA
aaagauacagugaacgcauu

SEQ ID NO: 73979 - RNA, 20 nt, Artificial Sequence
  MKO10073979_B_Baz1b
  gRNA
gauagugaagauucauccuu

SEQ ID NO: 73980 - RNA, 20 nt, Artificial Sequence
  MKO10073980_B_Baz1b
  gRNA
ugcguucacuguaucuuucc

SEQ ID NO: 73981 - RNA, 20 nt, Artificial Sequence
  MKO10073981_B_Baz2a
  gRNA
gcugaucgagaagagacgac

SEQ ID NO: 73982 - RNA, 20 nt, Artificial Sequence
  MKO10073982_B_Baz2a
  gRNA
acaccaagaagucuccgucc

SEQ ID NO: 73983 - RNA, 20 nt, Artificial Sequence
  MKO10073983_B_Baz2a
  gRNA
aagacagacuccccuaagac

SEQ ID NO: 73984 - RNA, 20 nt, Artificial Sequence
  MKO10073984_B_Baz2b
  gRNA
gcugcuaaugccuucacucg

SEQ ID NO: 73985 - RNA, 20 nt, Artificial Sequence
  MKO10073985_B_Baz2b
  gRNA
agccgacagaaucaaagaua

SEQ ID NO: 73986 - RNA, 20 nt, Artificial Sequence
  MKO10073986_B_Baz2b
  gRNA
guaucaccugacucaguguc

SEQ ID NO: 73987 - RNA, 20 nt, Artificial Sequence
  MKO10073987_B_Bbc3
  gRNA
accucaacgcgcaguacgag

SEQ ID NO: 73988 - RNA, 20 nt, Artificial Sequence
  MKO10073988_B_Bbc3
  gRNA
gagauuguacaugacccucc

SEQ ID NO: 73989 - RNA, 20 nt, Artificial Sequence
  MKO10073989_B_Bbc3
  gRNA
aucgacaccgacccucaccc

SEQ ID NO: 73990 - RNA, 20 nt, Artificial Sequence
  MKO10073990_B_Bbip1
  gRNA
uacaguccgucaacaagaaa

SEQ ID NO: 73991 - RNA, 20 nt, Artificial Sequence
  MKO10073991_B_Bbip1
  gRNA
auuaauagggcaguugucug

SEQ ID NO: 73992 - RNA, 20 nt, Artificial Sequence
  MKO10073992_B_Bbip1
  gRNA
gaaaaugcagcaagcagcac

SEQ ID NO: 73993 - RNA, 20 nt, Artificial Sequence
  MKO10073993_B_Bbox1
  gRNA
caagauugaugccaacaaug

SEQ ID NO: 73994 - RNA, 20 nt, Artificial Sequence
  MKO10073994_B_Bbox1
  gRNA
cagacacacuuggcaagugc

SEQ ID NO: 73995 - RNA, 20 nt, Artificial Sequence
  MKO10073995_B_Bbox1
  gRNA
aauacacagaaugucaguac

SEQ ID NO: 73996 - RNA, 20 nt, Artificial Sequence
  MKO10073996_B_Bbs10
  gRNA
uuacauucugaccacgcaag

SEQ ID NO: 73997 - RNA, 20 nt, Artificial Sequence
  MKO10073997_B_Bbs10
  gRNA
aagccgccgucaccgacccc

SEQ ID NO: 73998 - RNA, 20 nt, Artificial Sequence
  MKO10073998_B_Bbs10
  gRNA
gcucuaagugcagcgccucc

SEQ ID NO: 73999 - RNA, 20 nt, Artificial Sequence
  MKO10073999_B_Bbs12
  gRNA
gcugagcaaucuuuaaauag

SEQ ID NO: 74000 - RNA, 20 nt, Artificial Sequence
  MKO10074000_B_Bbs12
  gRNA
guucuagaaauccaucaugu

SEQ ID NO: 74001 - RNA, 20 nt, Artificial Sequence
  MKO10074001_B_Bbs12
  gRNA
auucaacagcaccaccgcca

SEQ ID NO: 74002 - RNA, 20 nt, Artificial Sequence
  MKO10074002_B_Bbs1
  gRNA
ugcguccagccauuuagaau

SEQ ID NO: 74003 - RNA, 20 nt, Artificial Sequence
  MKO10074003_B_Bbs1
  gRNA
cuagcacuggcagauuugca

SEQ ID NO: 74004 - RNA, 20 nt, Artificial Sequence
  MKO10074004_B_Bbs1
  gRNA
gauugaccccuuaacccuga

SEQ ID NO: 74005 - RNA, 20 nt, Artificial Sequence
  MKO10074005_B_Bbs2
  gRNA
uuuccaccgaugauugcaag

SEQ ID NO: 74006 - RNA, 20 nt, Artificial Sequence
  MKO10074006_B_Bbs2
  gRNA
cugugugacuuugacgguga

SEQ ID NO: 74007 - RNA, 20 nt, Artificial Sequence
  MKO10074007_B_Bbs2
  gRNA
uggagacaaugugcauuccu

SEQ ID NO: 74008 - RNA, 20 nt, Artificial Sequence
  MKO10074008_B_Bbs4
  gRNA
gugugcugauaaucucaagc

SEQ ID NO: 74009 - RNA, 20 nt, Artificial Sequence
  MKO10074009_B_Bbs4
  gRNA
uugagauuaucagcacacug

SEQ ID NO: 74010 - RNA, 20 nt, Artificial Sequence
  MKO10074010_B_Bbs4
  gRNA
cuguugaaucucaaaaaccu

SEQ ID NO: 74011 - RNA, 20 nt, Artificial Sequence
  MKO10074011_B_Bbs5
  gRNA
gacucuuagucacaaacuua

SEQ ID NO: 74012 - RNA, 20 nt, Artificial Sequence
  MKO10074012_B_Bbs5
  gRNA
acagucaaugaggacuuccc

SEQ ID NO: 74013 - RNA, 20 nt, Artificial Sequence
  MKO10074013_B_Bbs5
  gRNA
gauuccauugaagacacaaa

SEQ ID NO: 74014 - RNA, 20 nt, Artificial Sequence
  MKO10074014_B_Bbs7
  gRNA
ccgggugcuccgagucuuac

SEQ ID NO: 74015 - RNA, 20 nt, Artificial Sequence
  MKO10074015_B_Bbs7
  gRNA
uagcuuuaaugcuuuccgug

SEQ ID NO: 74016 - RNA, 20 nt, Artificial Sequence
  MKO10074016_B_Bbs7
  gRNA
gugguuguuggagaucaaga

SEQ ID NO: 74017 - RNA, 20 nt, Artificial Sequence
  MKO10074017_B_Bbs9
  gRNA
uacuucuagaagugcaucug

SEQ ID NO: 74018 - RNA, 20 nt, Artificial Sequence
  MKO10074018_B_Bbs9
  gRNA
ugcaggccguccucugaaga

SEQ ID NO: 74019 - RNA, 20 nt, Artificial Sequence
  MKO10074019_B_Bbs9
  gRNA
gugcggggacuguaagcaag

SEQ ID NO: 74020 - RNA, 20 nt, Artificial Sequence
  MKO10074020_B_Bbx
  gRNA
aaggcccaaaguuucuuccg

SEQ ID NO: 74021 - RNA, 20 nt, Artificial Sequence
  MKO10074021_B_Bbx
  gRNA
cucuuuagauccuacucaga

SEQ ID NO: 74022 - RNA, 20 nt, Artificial Sequence
  MKO10074022_B_Bbx
  gRNA
accauuguuucaguuugccg

SEQ ID NO: 74023 - RNA, 20 nt, Artificial Sequence
  MKO10074023_B_Bcam
  gRNA
accccgugccucggaucaca

SEQ ID NO: 74024 - RNA, 20 nt, Artificial Sequence
  MKO10074024_B_Bcam
  gRNA
cuuccagacgcugcccguuu

SEQ ID NO: 74025 - RNA, 20 nt, Artificial Sequence
  MKO10074025_B_Bcam
  gRNA
gcucccguggagugcagucc

SEQ ID NO: 74026 - RNA, 20 nt, Artificial Sequence
  MKO10074026_B_Bcan
  gRNA
acuccguaguuccgcacgcc

SEQ ID NO: 74027 - RNA, 20 nt, Artificial Sequence
  MKO10074027_B_Bcan
  gRNA
cgugcggaacuacggagugg

SEQ ID NO: 74028 - RNA, 20 nt, Artificial Sequence
  MKO10074028_B_Bcan
  gRNA
ggugcacagaucgcuagcac

SEQ ID NO: 74029 - RNA, 20 nt, Artificial Sequence
  MKO10074029_B_Bcap29
  gRNA
ucaagcagaaaauaccaaua

SEQ ID NO: 74030 - RNA, 20 nt, Artificial Sequence
  MKO10074030_B_Bcap29
  gRNA
ccucagaguguugagacguc

SEQ ID NO: 74031 - RNA, 20 nt, Artificial Sequence
  MKO10074031_B_Bcap29
  gRNA
acacacagaugaagcucuuc

SEQ ID NO: 74032 - RNA, 20 nt, Artificial Sequence
  MKO10074032_B_Bcap31
  gRNA
guggaguugguagugaccua

SEQ ID NO: 74033 - RNA, 20 nt, Artificial Sequence
  MKO10074033_B_Bcap31
  gRNA
caucgucauccuuguacugu

SEQ ID NO: 74034 - RNA, 20 nt, Artificial Sequence
  MKO10074034_B_Bcap31
  gRNA
ccagaacaauccaggugcca

SEQ ID NO: 74035 - RNA, 20 nt, Artificial Sequence
  MKO10074035_B_Bcar1
  gRNA
guaugacgugcccccuagug

SEQ ID NO: 74036 - RNA, 20 nt, Artificial Sequence
  MKO10074036_B_Bcar1
  gRNA
gacaggcgcuugccauccgu

SEQ ID NO: 74037 - RNA, 20 nt, Artificial Sequence
  MKO10074037_B_Bcar1
  gRNA
uuaggaagcaguccucgaac

SEQ ID NO: 74038 - RNA, 20 nt, Artificial Sequence
  MKO10074038_B_Bcar3
  gRNA
cgcauaccugucgggggauc

SEQ ID NO: 74039 - RNA, 20 nt, Artificial Sequence
  MKO10074039_B_Bcar3
  gRNA
uuggcaggugacucuccgac

SEQ ID NO: 74040 - RNA, 20 nt, Artificial Sequence
  MKO10074040_B_Bcar3
  gRNA
cgccugccuggaucacgugc

SEQ ID NO: 74041 - RNA, 20 nt, Artificial Sequence
  MKO10074041_B_Bcas1
  gRNA
agaggugccggggaccacga

SEQ ID NO: 74042 - RNA, 20 nt, Artificial Sequence
  MKO10074042_B_Bcas1
  gRNA
ucugugguaucgaccaccug

SEQ ID NO: 74043 - RNA, 20 nt, Artificial Sequence
  MKO10074043_B_Bcas1
  gRNA
auaguguugaauuacacgag

SEQ ID NO: 74044 - RNA, 20 nt, Artificial Sequence
  MKO10074044_B_Bcas2
  gRNA
ugcgcgucuccuccuccacc

SEQ ID NO: 74045 - RNA, 20 nt, Artificial Sequence
  MKO10074045_B_Bcas2
  gRNA
uucaugcugaguaauucaau

SEQ ID NO: 74046 - RNA, 20 nt, Artificial Sequence
  MKO10074046_B_Bcas2
  gRNA
uugaauuacucagcaugaaa

SEQ ID NO: 74047 - RNA, 20 nt, Artificial Sequence
  MKO10074047_B_Bcas3
  gRNA
uuaauuugcaggcuuacagu

SEQ ID NO: 74048 - RNA, 20 nt, Artificial Sequence
  MKO10074048_B_Bcas3
  gRNA
acagugacggaaugcagguc

SEQ ID NO: 74049 - RNA, 20 nt, Artificial Sequence
  MKO10074049_B_Bcas3
  gRNA
ccuccucugcugguuaugau

SEQ ID NO: 74050 - RNA, 20 nt, Artificial Sequence
  MKO10074050_B_Bcau1
  gRNA
uaccucaguuccgauaaaug

SEQ ID NO: 74051 - RNA, 20 nt, Artificial Sequence
  MKO10074051_B_Bcau1
  gRNA
gcgccguuugcuggagaaag

SEQ ID NO: 74052 - RNA, 20 nt, Artificial Sequence
  MKO10074052_B_Bcau1
  gRNA
auaacaagauccgauuguuc

SEQ ID NO: 74053 - RNA, 20 nt, Artificial Sequence
  MKO10074053_B_Bcau2
  gRNA
cagggcacagaaugacguac

SEQ ID NO: 74054 - RNA, 20 nt, Artificial Sequence
  MKO10074054_B_Bcau2
  gRNA
acaggaugcuacguucugcu

SEQ ID NO: 74055 - RNA, 20 nt, Artificial Sequence
  MKO10074055_B_Bcau2
  gRNA
gaggcucguuccguugccau

SEQ ID NO: 74056 - RNA, 20 nt, Artificial Sequence
  MKO10074056_B_Bccip
  gRNA
ccuuaaucacacucccaaug

SEQ ID NO: 74057 - RNA, 20 nt, Artificial Sequence
  MKO10074057_B_Bccip
  gRNA
ugcaugggcagggcaaucug

SEQ ID NO: 74058 - RNA, 20 nt, Artificial Sequence
  MKO10074058_B_Bccip
  gRNA
ugcugaacaaauuaaagagu

SEQ ID NO: 74059 - RNA, 20 nt, Artificial Sequence
  MKO10074059_B_Bcdin3d
  gRNA
caucugaaccacggggaccg

SEQ ID NO: 74060 - RNA, 20 nt, Artificial Sequence
  MKO10074060_B_Bcdin3d
  gRNA
ccgauccuagggcucgacgu

SEQ ID NO: 74061 - RNA, 20 nt, Artificial Sequence
  MKO10074061_B_Bcdin3d
  gRNA
caagauccgcacgaucugcu

SEQ ID NO: 74062 - RNA, 20 nt, Artificial Sequence
  MKO10074062_B_Bche
  gRNA
gugcuccccaaugucaguuc

SEQ ID NO: 74063 - RNA, 20 nt, Artificial Sequence
  MKO10074063_B_Bche
  gRNA
auagucuccagaacugacau

SEQ ID NO: 74064 - RNA, 20 nt, Artificial Sequence
  MKO10074064_B_Bche
  gRNA
uacaggagauauugaugaaa

SEQ ID NO: 74065 - RNA, 20 nt, Artificial Sequence
  MKO10074065_B_Bckdha
  gRNA
uguccccuccucgccauagu

SEQ ID NO: 74066 - RNA, 20 nt, Artificial Sequence
  MKO10074066_B_Bckdha
  gRNA
acucacguggggaucuucac

SEQ ID NO: 74067 - RNA, 20 nt, Artificial Sequence
  MKO10074067_B_Bckdha
  gRNA
acauaccugccucccgguac

SEQ ID NO: 74068 - RNA, 20 nt, Artificial Sequence
  MKO10074068_B_Bckdhb
  gRNA
caccggugcuacagcuauug

SEQ ID NO: 74069 - RNA, 20 nt, Artificial Sequence
  MKO10074069_B_Bckdhb
  gRNA
ggagucuuccgaugcacugu

SEQ ID NO: 74070 - RNA, 20 nt, Artificial Sequence
  MKO10074070_B_Bckdhb
  gRNA
aauaccccgaagcccuuucc

SEQ ID NO: 74071 - RNA, 20 nt, Artificial Sequence
  MKO10074071_B_Bckdk
  gRNA
aguacugggccucaucugcc

SEQ ID NO: 74072 - RNA, 20 nt, Artificial Sequence
  MKO10074072_B_Bckdk
  gRNA
gcugccauccugugagcgac

SEQ ID NO: 74073 - RNA, 20 nt, Artificial Sequence
  MKO10074073_B_Bckdk
  gRNA
cacgaagacccucagcuaac

SEQ ID NO: 74074 - RNA, 20 nt, Artificial Sequence
  MKO10074074_B_Bcl10
  gRNA
ccccaggggccuggacaccc

SEQ ID NO: 74075 - RNA, 20 nt, Artificial Sequence
  MKO10074075_B_Bcl10
  gRNA
cagucaaauccuccuccgug

SEQ ID NO: 74076 - RNA, 20 nt, Artificial Sequence
  MKO10074076_B_Bcl10
  gRNA
ugaaagagcccgugaccgua

SEQ ID NO: 74077 - RNA, 20 nt, Artificial Sequence
  MKO10074077_B_Bcl11a
  gRNA
gagugcagaauaugccccgc

SEQ ID NO: 74078 - RNA, 20 nt, Artificial Sequence
  MKO10074078_B_Bcl11a
  gRNA
uguuuaucaacgucaucuag

SEQ ID NO: 74079 - RNA, 20 nt, Artificial Sequence
  MKO10074079_B_Bcl11a
  gRNA
ggcauauucugcacucaucc

SEQ ID NO: 74080 - RNA, 20 nt, Artificial Sequence
  MKO10074080_B_Bcl11b
  gRNA
ggcaaugucccgccgcaaac

SEQ ID NO: 74081 - RNA, 20 nt, Artificial Sequence
  MKO10074081_B_Bcl11b
  gRNA
gcacgccccaucucgggcga

SEQ ID NO: 74082 - RNA, 20 nt, Artificial Sequence
  MKO10074082_B_Bcl11b
  gRNA
uacgcgugaugaguucccuc

SEQ ID NO: 74083 - RNA, 20 nt, Artificial Sequence
  MKO10074083_B_Bcl2a1a
  gRNA
aagaaguuugaacccaaauc

SEQ ID NO: 74084 - RNA, 20 nt, Artificial Sequence
  MKO10074084_B_Bcl2a1a
  gRNA
uaugaauucugccacaaaac

SEQ ID NO: 74085 - RNA, 20 nt, Artificial Sequence
  MKO10074085_B_Bcl2a1a
  gRNA
gcucaugcauauccacuccc

SEQ ID NO: 74086 - RNA, 20 nt, Artificial Sequence
  MKO10074086_B_Bcl2a1b
  gRNA
aagaaguuugaacccaaauc

SEQ ID NO: 74087 - RNA, 20 nt, Artificial Sequence
  MKO10074087_B_Bcl2a1b
  gRNA
cuaucuucaguaugugcuac

SEQ ID NO: 74088 - RNA, 20 nt, Artificial Sequence
  MKO10074088_B_Bcl2a1b
  gRNA
uccgcaagagcagauugccc

SEQ ID NO: 74089 - RNA, 20 nt, Artificial Sequence
  MKO10074089_B_Bcl2a1c
  gRNA
guuuguaagcacguacaucc

SEQ ID NO: 74090 - RNA, 20 nt, Artificial Sequence
  MKO10074090_B_Bcl2a1c
  gRNA
aaagaaccuaaagucauacu

SEQ ID NO: 74091 - RNA, 20 nt, Artificial Sequence
  MKO10074091_B_Bcl2a1c
  gRNA
uuuguagcacucugaaugcu

SEQ ID NO: 74092 - RNA, 20 nt, Artificial Sequence
  MKO10074092_B_Bcl2a1d
  gRNA
aaaagucagccagccagauu

SEQ ID NO: 74093 - RNA, 20 nt, Artificial Sequence
  MKO10074093_B_Bcl2a1d
  gRNA
gaauucauaaugaauaacac

SEQ ID NO: 74094 - RNA, 20 nt, Artificial Sequence
  MKO10074094_B_Bcl2a1d
  gRNA
gaauggauacggcggaaugg

SEQ ID NO: 74095 - RNA, 20 nt, Artificial Sequence
  MKO10074095_B_Bcl2l10
  gRNA
aaucuucuccagaagccgag

SEQ ID NO: 74096 - RNA, 20 nt, Artificial Sequence
  MKO10074096_B_Bcl2l10
  gRNA
gccucgacagacgugggcgg

SEQ ID NO: 74097 - RNA, 20 nt, Artificial Sequence
  MKO10074097_B_Bcl2l10
  gRNA
ccaaaggauggccgacucgc

SEQ ID NO: 74098 - RNA, 20 nt, Artificial Sequence
  MKO10074098_B_Bcl2l11
  gRNA
uccugugcaauccguaucuc

SEQ ID NO: 74099 - RNA, 20 nt, Artificial Sequence
  MKO10074099_B_Bcl2l11
  gRNA
ucccuacagacagaaccgca

SEQ ID NO: 74100 - RNA, 20 nt, Artificial Sequence
  MKO10074100_B_Bcl2l11
  gRNA
uaccuugcgguucugucugu

SEQ ID NO: 74101 - RNA, 20 nt, Artificial Sequence
  MKO10074101_B_Bcl2l12
  gRNA
ggccccgggcacggcagaga

SEQ ID NO: 74102 - RNA, 20 nt, Artificial Sequence
  MKO10074102_B_Bcl2l12
  gRNA
cugaaguccccgcccaguuc

SEQ ID NO: 74103 - RNA, 20 nt, Artificial Sequence
  MKO10074103_B_Bcl2l12
  gRNA
accaggcucggaaccauagc

SEQ ID NO: 74104 - RNA, 20 nt, Artificial Sequence
  MKO10074104_B_Bcl2l13
  gRNA
cgauaugccucauaugucac

SEQ ID NO: 74105 - RNA, 20 nt, Artificial Sequence
  MKO10074105_B_Bcl2l13
  gRNA
uucaggaguucaacuagaug

SEQ ID NO: 74106 - RNA, 20 nt, Artificial Sequence
  MKO10074106_B_Bcl2l13
  gRNA
gagcuccauagaagacugcu

SEQ ID NO: 74107 - RNA, 20 nt, Artificial Sequence
  MKO10074107_B_Bcl2l14
  gRNA
caacaaucuugcuuauuauu

SEQ ID NO: 74108 - RNA, 20 nt, Artificial Sequence
  MKO10074108_B_Bcl2l14
  gRNA
uucaguuguggauuccaaag

SEQ ID NO: 74109 - RNA, 20 nt, Artificial Sequence
  MKO10074109_B_Bcl2l14
  gRNA
ucccuuuaggaaaaaauacu

SEQ ID NO: 74110 - RNA, 20 nt, Artificial Sequence
  MKO10074110_B_Bcl2l15
  gRNA
agccauccgcgaguuuaucc

SEQ ID NO: 74111 - RNA, 20 nt, Artificial Sequence
  MKO10074111_B_Bcl2l15
  gRNA
cgguuagcagcgugggauag

SEQ ID NO: 74112 - RNA, 20 nt, Artificial Sequence
  MKO10074112_B_Bcl2l15
  gRNA
acugaucacccaguauucga

SEQ ID NO: 74113 - RNA, 20 nt, Artificial Sequence
  MKO10074113_B_Bcl2l1
  gRNA
gccaggagcgcuucaaccgc

SEQ ID NO: 74114 - RNA, 20 nt, Artificial Sequence
  MKO10074114_B_Bcl2l1
  gRNA
cuuuggcggggcacugugcg

SEQ ID NO: 74115 - RNA, 20 nt, Artificial Sequence
  MKO10074115_B_Bcl2l1
  gRNA
uuagaucacugaacgcucuc

SEQ ID NO: 74116 - RNA, 20 nt, Artificial Sequence
  MKO10074116_B_Bcl2l2
  gRNA
gcggaguucacagcucuaua

SEQ ID NO: 74117 - RNA, 20 nt, Artificial Sequence
  MKO10074117_B_Bcl2l2
  gRNA
acccgcugcaccaagccaug

SEQ ID NO: 74118 - RNA, 20 nt, Artificial Sequence
  MKO10074118_B_Bcl2l2
  gRNA
ggccuaccuggagacacguc

SEQ ID NO: 74119 - RNA, 20 nt, Artificial Sequence
  MKO10074119_B_Bcl2
  gRNA
gucgaccucacuuguggccc

SEQ ID NO: 74120 - RNA, 20 nt, Artificial Sequence
  MKO10074120_B_Bcl2
  gRNA
accugacgcccuucaccgcg

SEQ ID NO: 74121 - RNA, 20 nt, Artificial Sequence
  MKO10074121_B_Bcl2
  gRNA
uguacuucaucacgaucucc

SEQ ID NO: 74122 - RNA, 20 nt, Artificial Sequence
  MKO10074122_B_Bcl3
  gRNA
cgauguccgcgccacgcucc

SEQ ID NO: 74123 - RNA, 20 nt, Artificial Sequence
  MKO10074123_B_Bcl3
  gRNA
cggccagacugcaauucacc

SEQ ID NO: 74124 - RNA, 20 nt, Artificial Sequence
  MKO10074124_B_Bcl3
  gRNA
cgugaacaccgggugccagg

SEQ ID NO: 74125 - RNA, 20 nt, Artificial Sequence
  MKO10074125_B_Bcl6b
  gRNA
gucaccguuucauccaagcc

SEQ ID NO: 74126 - RNA, 20 nt, Artificial Sequence
  MKO10074126_B_Bcl6b
  gRNA
cauccaccccgagucccgcu

SEQ ID NO: 74127 - RNA, 20 nt, Artificial Sequence
  MKO10074127_B_Bcl6b
  gRNA
accacugcacgauucaagug

SEQ ID NO: 74128 - RNA, 20 nt, Artificial Sequence
  MKO10074128_B_Bcl6
  gRNA
gagccgcaggaugugcacuu

SEQ ID NO: 74129 - RNA, 20 nt, Artificial Sequence
  MKO10074129_B_Bcl6
  gRNA
uagaauccgaauacucugac

SEQ ID NO: 74130 - RNA, 20 nt, Artificial Sequence
  MKO10074130_B_Bcl6
  gRNA
uacccguguggacagucuug

SEQ ID NO: 74131 - RNA, 20 nt, Artificial Sequence
  MKO10074131_B_Bcl7a
  gRNA
agaaacgucggcagucucuc

SEQ ID NO: 74132 - RNA, 20 nt, Artificial Sequence
  MKO10074132_B_Bcl7a
  gRNA
ggacccacuuguagauucgu

SEQ ID NO: 74133 - RNA, 20 nt, Artificial Sequence
  MKO10074133_B_Bcl7a
  gRNA
auacucacaucaucaaccuu

SEQ ID NO: 74134 - RNA, 20 nt, Artificial Sequence
  MKO10074134_B_Bcl7b
  gRNA
gccagugccgguggagacac

SEQ ID NO: 74135 - RNA, 20 nt, Artificial Sequence
  MKO10074135_B_Bcl7b
  gRNA
ggggcugggagucaucagug

SEQ ID NO: 74136 - RNA, 20 nt, Artificial Sequence
  MKO10074136_B_Bcl7b
  gRNA
acucacccuccaggaucucc

SEQ ID NO: 74137 - RNA, 20 nt, Artificial Sequence
  MKO10074137_B_Bcl7c
  gRNA
acauaccauugagauccagu

SEQ ID NO: 74138 - RNA, 20 nt, Artificial Sequence
  MKO10074138_B_Bcl7c
  gRNA
gggaggcccccucauccuac

SEQ ID NO: 74139 - RNA, 20 nt, Artificial Sequence
  MKO10074139_B_Bcl7c
  gRNA
aaccagaguuuccauucuga

SEQ ID NO: 74140 - RNA, 20 nt, Artificial Sequence
  MKO10074140_B_Bcl9l
  gRNA
uugucguccuccucgcuguc

SEQ ID NO: 74141 - RNA, 20 nt, Artificial Sequence
  MKO10074141_B_Bcl9l
  gRNA
ccuucggccagacguuccug

SEQ ID NO: 74142 - RNA, 20 nt, Artificial Sequence
  MKO10074142_B_Bcl9l
  gRNA
cccgaggcacauucugcugg

SEQ ID NO: 74143 - RNA, 20 nt, Artificial Sequence
  MKO10074143_B_Bcl9
  gRNA
cgucaacugcuacagccccc

SEQ ID NO: 74144 - RNA, 20 nt, Artificial Sequence
  MKO10074144_B_Bcl9
  gRNA
cauaccccuaaagcacuccc

SEQ ID NO: 74145 - RNA, 20 nt, Artificial Sequence
  MKO10074145_B_Bcl9
  gRNA
ggauuccaaauucuccaauc

SEQ ID NO: 74146 - RNA, 20 nt, Artificial Sequence
  MKO10074146_B_Bclaf1
  gRNA
gaccgugaccgaccucgucu

SEQ ID NO: 74147 - RNA, 20 nt, Artificial Sequence
  MKO10074147_B_Bclaf1
  gRNA
cagcuuaauguggucaaaga

SEQ ID NO: 74148 - RNA, 20 nt, Artificial Sequence
  MKO10074148_B_Bclaf1
  gRNA
cugccuccuugacuaaagac

SEQ ID NO: 74149 - RNA, 20 nt, Artificial Sequence
  MKO10074149_B_Bcmo1
  gRNA
cugaucaacaucaugaaaug

SEQ ID NO: 74150 - RNA, 20 nt, Artificial Sequence
  MKO10074150_B_Bcmo1
  gRNA
gguuccauggagauaauauu

SEQ ID NO: 74151 - RNA, 20 nt, Artificial Sequence
  MKO10074151_B_Bcmo1
  gRNA
cccccagacccuagagaccu

SEQ ID NO: 74152 - RNA, 20 nt, Artificial Sequence
  MKO10074152_B_Bco2
  gRNA
ugcuccgugaaucgucuccc

SEQ ID NO: 74153 - RNA, 20 nt, Artificial Sequence
  MKO10074153_B_Bco2
  gRNA
cguucaaagaugcucuugca

SEQ ID NO: 74154 - RNA, 20 nt, Artificial Sequence
  MKO10074154_B_Bco2
  gRNA
auguuguaugcugucccauc

SEQ ID NO: 74155 - RNA, 20 nt, Artificial Sequence
  MKO10074155_B_Bcorl1
  gRNA
uccugaaucuaaagccccuc

SEQ ID NO: 74156 - RNA, 20 nt, Artificial Sequence
  MKO10074156_B_Bcorl1
  gRNA
acucggacacgcagucaguc

SEQ ID NO: 74157 - RNA, 20 nt, Artificial Sequence
  MKO10074157_B_Bcorl1
  gRNA
aaaacgaacagauggucaug

SEQ ID NO: 74158 - RNA, 20 nt, Artificial Sequence
  MKO10074158_B_Bcor
  gRNA
cugugaacguucccauacag

SEQ ID NO: 74159 - RNA, 20 nt, Artificial Sequence
  MKO10074159_B_Bcor
  gRNA
gaagcgucgccaucauucac

SEQ ID NO: 74160 - RNA, 20 nt, Artificial Sequence
  MKO10074160_B_Bcor
  gRNA
acagcuggaugaacagcgag

SEQ ID NO: 74161 - RNA, 20 nt, Artificial Sequence
  MKO10074161_B_Bcr
  gRNA
ugaggaacagcgccggcacc

SEQ ID NO: 74162 - RNA, 20 nt, Artificial Sequence
  MKO10074162_B_Bcr
  gRNA
gacguaccugagccaucugg

SEQ ID NO: 74163 - RNA, 20 nt, Artificial Sequence
  MKO10074163_B_Bcr
  gRNA
cgagccuuuguggauaacua

SEQ ID NO: 74164 - RNA, 20 nt, Artificial Sequence
  MKO10074164_B_Bcs1l
  gRNA
aagaagguagccacgucugu

SEQ ID NO: 74165 - RNA, 20 nt, Artificial Sequence
  MKO10074165_B_Bcs1l
  gRNA
aucugucaccuucacggccc

SEQ ID NO: 74166 - RNA, 20 nt, Artificial Sequence
  MKO10074166_B_Bcs1l
  gRNA
acuugcaaacagggacuccu

SEQ ID NO: 74167 - RNA, 20 nt, Artificial Sequence
  MKO10074167_B_Bdh1
  gRNA
ccccuucuccgaagagccaa

SEQ ID NO: 74168 - RNA, 20 nt, Artificial Sequence
  MKO10074168_B_Bdh1
  gRNA
acucaccgcaucugccugac

SEQ ID NO: 74169 - RNA, 20 nt, Artificial Sequence
  MKO10074169_B_Bdh1
  gRNA
ggcaaagcuauccugaucac

SEQ ID NO: 74170 - RNA, 20 nt, Artificial Sequence
  MKO10074170_B_Bdh2
  gRNA
cucgguaacuuuccagcucc

SEQ ID NO: 74171 - RNA, 20 nt, Artificial Sequence
  MKO10074171_B_Bdh2
  gRNA
uggauugcgaggaaaaagac

SEQ ID NO: 74172 - RNA, 20 nt, Artificial Sequence
  MKO10074172_B_Bdh2
  gRNA
aucaauucucucgauuucug

SEQ ID NO: 74173 - RNA, 20 nt, Artificial Sequence
  MKO10074173_B_Bdkrb1
  gRNA
uuccggggcgcccucgcagg

SEQ ID NO: 74174 - RNA, 20 nt, Artificial Sequence
  MKO10074174_B_Bdkrb1
  gRNA
ugguauaccccaugaccagc

SEQ ID NO: 74175 - RNA, 20 nt, Artificial Sequence
  MKO10074175_B_Bdkrb1
  gRNA
uuacaaagugccaagcuucg

SEQ ID NO: 74176 - RNA, 20 nt, Artificial Sequence
  MKO10074176_B_Bdkrb2
  gRNA
cagaaacccgaguagcuucc

SEQ ID NO: 74177 - RNA, 20 nt, Artificial Sequence
  MKO10074177_B_Bdkrb2
  gRNA
ugaucgugggcaagcgcuuc

SEQ ID NO: 74178 - RNA, 20 nt, Artificial Sequence
  MKO10074178_B_Bdkrb2
  gRNA
ggucgauacucacgagcauc

SEQ ID NO: 74179 - RNA, 20 nt, Artificial Sequence
  MKO10074179_B_Bdnf
  gRNA
aggucugacgacgacaucac

SEQ ID NO: 74180 - RNA, 20 nt, Artificial Sequence
  MKO10074180_B_Bdnf
  gRNA
uucauacuucgguugcauga

SEQ ID NO: 74181 - RNA, 20 nt, Artificial Sequence
  MKO10074181_B_Bdnf
  gRNA
augccgcaaacaugucuaug

SEQ ID NO: 74182 - RNA, 20 nt, Artificial Sequence
  MKO10074182_B_Bdp1
  gRNA
aucgugaucaacuguagaua

SEQ ID NO: 74183 - RNA, 20 nt, Artificial Sequence
  MKO10074183_B_Bdp1
  gRNA
gguggaugaugggccacuuc

SEQ ID NO: 74184 - RNA, 20 nt, Artificial Sequence
  MKO10074184_B_Bdp1
  gRNA
cgaguaaaaguggcagaaga

SEQ ID NO: 74185 - RNA, 20 nt, Artificial Sequence
  MKO10074185_B_Bean1
  gRNA
acaggggcaagggcguuuga

SEQ ID NO: 74186 - RNA, 20 nt, Artificial Sequence
  MKO10074186_B_Bean1
  gRNA
guagggcgguggugcauccg

SEQ ID NO: 74187 - RNA, 20 nt, Artificial Sequence
  MKO10074187_B_Bean1
  gRNA
ggcgcccuugacucagacag

SEQ ID NO: 74188 - RNA, 20 nt, Artificial Sequence
  MKO10074188_B_Becn1
  gRNA
gcuaauagcuucacucugau

SEQ ID NO: 74189 - RNA, 20 nt, Artificial Sequence
  MKO10074189_B_Becn1
  gRNA
gaaccucagccggagacuca

SEQ ID NO: 74190 - RNA, 20 nt, Artificial Sequence
  MKO10074190_B_Becn1
  gRNA
uccugguuucgccugggcug

SEQ ID NO: 74191 - RNA, 20 nt, Artificial Sequence
  MKO10074191_B_Begain
  gRNA
guccuccgacagcuugucaa

SEQ ID NO: 74192 - RNA, 20 nt, Artificial Sequence
  MKO10074192_B_Begain
  gRNA
caggauucagagcaacuaca

SEQ ID NO: 74193 - RNA, 20 nt, Artificial Sequence
  MKO10074193_B_Begain
  gRNA
gcagaggaucaaccaagagc

SEQ ID NO: 74194 - RNA, 20 nt, Artificial Sequence
  MKO10074194_B_Bend3
  gRNA
guccagcugcuugcgcuugc

SEQ ID NO: 74195 - RNA, 20 nt, Artificial Sequence
  MKO10074195_B_Bend3
  gRNA
aucagugaagauguagaaga

SEQ ID NO: 74196 - RNA, 20 nt, Artificial Sequence
  MKO10074196_B_Bend3
  gRNA
cgacaccgcucaucaaugcu

SEQ ID NO: 74197 - RNA, 20 nt, Artificial Sequence
  MKO10074197_B_Bend4
  gRNA
gaugagcuuaaguacucaug

SEQ ID NO: 74198 - RNA, 20 nt, Artificial Sequence
  MKO10074198_B_Bend4
  gRNA
aaaacgagccaccguugugc

SEQ ID NO: 74199 - RNA, 20 nt, Artificial Sequence
  MKO10074199_B_Bend4
  gRNA
gcacugucuucagguaaucg

SEQ ID NO: 74200 - RNA, 20 nt, Artificial Sequence
  MKO10074200_B_Bend5
  gRNA
agaaugucucgagcccgagc

SEQ ID NO: 74201 - RNA, 20 nt, Artificial Sequence
  MKO10074201_B_Bend5
  gRNA
caccagcuacaaguuaccca

SEQ ID NO: 74202 - RNA, 20 nt, Artificial Sequence
  MKO10074202_B_Bend5
  gRNA
uuuacagcuuagacacauca

SEQ ID NO: 74203 - RNA, 20 nt, Artificial Sequence
  MKO10074203_B_Bend6
  gRNA
ugaccaaagacugucgaagc

SEQ ID NO: 74204 - RNA, 20 nt, Artificial Sequence
  MKO10074204_B_Bend6
  gRNA
uguaguucacgauugagaga

SEQ ID NO: 74205 - RNA, 20 nt, Artificial Sequence
  MKO10074205_B_Bend6
  gRNA
gcucuccagagaguagacgc

SEQ ID NO: 74206 - RNA, 20 nt, Artificial Sequence
  MKO10074206_B_Bend7
  gRNA
acgccccacgugaauuagag

SEQ ID NO: 74207 - RNA, 20 nt, Artificial Sequence
  MKO10074207_B_Bend7
  gRNA
ucacgcuuaggagaacuucc

SEQ ID NO: 74208 - RNA, 20 nt, Artificial Sequence
  MKO10074208_B_Bend7
  gRNA
ugcagagcgcaccuccaccg

SEQ ID NO: 74209 - RNA, 20 nt, Artificial Sequence
  MKO10074209_B_Best1
  gRNA
ggggcgcucacccagaacga

SEQ ID NO: 74210 - RNA, 20 nt, Artificial Sequence
  MKO10074210_B_Best1
  gRNA
ccggauucgaccuccaagau

SEQ ID NO: 74211 - RNA, 20 nt, Artificial Sequence
  MKO10074211_B_Best1
  gRNA
cgacuggauaaguaucccau

SEQ ID NO: 74212 - RNA, 20 nt, Artificial Sequence
  MKO10074212_B_Best2
  gRNA
cauaccccucgucuacaccc

SEQ ID NO: 74213 - RNA, 20 nt, Artificial Sequence
  MKO10074213_B_Best2
  gRNA
auccccgucucuuucguacu

SEQ ID NO: 74214 - RNA, 20 nt, Artificial Sequence
  MKO10074214_B_Best2
  gRNA
auucguccuacaacaaauac

SEQ ID NO: 74215 - RNA, 20 nt, Artificial Sequence
  MKO10074215_B_Best3
  gRNA
acuucagaugaggcgauuug

SEQ ID NO: 74216 - RNA, 20 nt, Artificial Sequence
  MKO10074216_B_Best3
  gRNA
aaucgccucaucugaaguac

SEQ ID NO: 74217 - RNA, 20 nt, Artificial Sequence
  MKO10074217_B_Best3
  gRNA
cccagucguaaccaaauaag

SEQ ID NO: 74218 - RNA, 20 nt, Artificial Sequence
  MKO10074218_B_Bet1l
  gRNA
accacugaccgauuuaagcc

SEQ ID NO: 74219 - RNA, 20 nt, Artificial Sequence
  MKO10074219_B_Bet1l
  gRNA
uuaccaugccgucuaaguaa

SEQ ID NO: 74220 - RNA, 20 nt, Artificial Sequence
  MKO10074220_B_Bet1l
  gRNA
uggagggcgcgauggcagau

SEQ ID NO: 74221 - RNA, 20 nt, Artificial Sequence
  MKO10074221_B_Bet1
  gRNA
guaggugauggagcaccucc

SEQ ID NO: 74222 - RNA, 20 nt, Artificial Sequence
  MKO10074222_B_Bet1
  gRNA
caaaaucuucagucuuccca

SEQ ID NO: 74223 - RNA, 20 nt, Artificial Sequence
  MKO10074223_B_Bet1
  gRNA
ucauagcuuuccauugaaau

SEQ ID NO: 74224 - RNA, 20 nt, Artificial Sequence
  MKO10074224_B_Bex1
  gRNA
guaauggaguccaaagauca

SEQ ID NO: 74225 - RNA, 20 nt, Artificial Sequence
  MKO10074225_B_Bex1
  gRNA
agcuguggcccugaccuccg

SEQ ID NO: 74226 - RNA, 20 nt, Artificial Sequence
  MKO10074226_B_Bex1
  gRNA
cacagcuggcucccuucuga

SEQ ID NO: 74227 - RNA, 20 nt, Artificial Sequence
  MKO10074227_B_Bex2
  gRNA
uuucacgccuuguuccacuu

SEQ ID NO: 74228 - RNA, 20 nt, Artificial Sequence
  MKO10074228_B_Bex2
  gRNA
agccacaggaugcuagcaaa

SEQ ID NO: 74229 - RNA, 20 nt, Artificial Sequence
  MKO10074229_B_Bex2
  gRNA
agcccaucgugcacuacaga

SEQ ID NO: 74230 - RNA, 20 nt, Artificial Sequence
  MKO10074230_B_Bex4
  gRNA
agcagcaggugaggccuuac

SEQ ID NO: 74231 - RNA, 20 nt, Artificial Sequence
  MKO10074231_B_Bex4
  gRNA
caaaagucguaaugauuguc

SEQ ID NO: 74232 - RNA, 20 nt, Artificial Sequence
  MKO10074232_B_Bex4
  gRNA
aaagacaaaaaagacaaaaa

SEQ ID NO: 74233 - RNA, 20 nt, Artificial Sequence
  MKO10074233_B_Bex6
  gRNA
ggauucuucuucacuguguc

SEQ ID NO: 74234 - RNA, 20 nt, Artificial Sequence
  MKO10074234_B_Bex6
  gRNA
agucauacaagaucucacug

SEQ ID NO: 74235 - RNA, 20 nt, Artificial Sequence
  MKO10074235_B_Bex6
  gRNA
uuguaugacuuguuugacuu

SEQ ID NO: 74236 - RNA, 20 nt, Artificial Sequence
  MKO10074236_B_Bfar
  gRNA
aacucgcucacagaaaucug

SEQ ID NO: 74237 - RNA, 20 nt, Artificial Sequence
  MKO10074237_B_Bfar
  gRNA
ucacacgcuccagcuccgug

SEQ ID NO: 74238 - RNA, 20 nt, Artificial Sequence
  MKO10074238_B_Bfar
  gRNA
cagguauagcaagccaaguc

SEQ ID NO: 74239 - RNA, 20 nt, Artificial Sequence
  MKO10074239_B_Bfsp1
  gRNA
ggcugcccugcagaaccagc

SEQ ID NO: 74240 - RNA, 20 nt, Artificial Sequence
  MKO10074240_B_Bfsp1
  gRNA
agaggcagucacccaccugc

SEQ ID NO: 74241 - RNA, 20 nt, Artificial Sequence
  MKO10074241_B_Bfsp1
  gRNA
ccucccucaucccaguaacc

SEQ ID NO: 74242 - RNA, 20 nt, Artificial Sequence
  MKO10074242_B_Bfsp2
  gRNA
augaaaacgagcagccauuc

SEQ ID NO: 74243 - RNA, 20 nt, Artificial Sequence
  MKO10074243_B_Bfsp2
  gRNA
cuucaucgaugacuuuguac

SEQ ID NO: 74244 - RNA, 20 nt, Artificial Sequence
  MKO10074244_B_Bfsp2
  gRNA
aggcuguccuagaaaacgcc

SEQ ID NO: 74245 - RNA, 20 nt, Artificial Sequence
  MKO10074245_B_Bglap2
  gRNA
cagagagacagagcgcagcc

SEQ ID NO: 74246 - RNA, 20 nt, Artificial Sequence
  MKO10074246_B_Bglap2
  gRNA
uuuacagaugccaagcccag

SEQ ID NO: 74247 - RNA, 20 nt, Artificial Sequence
  MKO10074247_B_Bglap2
  gRNA
cacagccuucauguccaagc

SEQ ID NO: 74248 - RNA, 20 nt, Artificial Sequence
  MKO10074248_B_Bglap3
  gRNA
ccucucucugcucacucugc

SEQ ID NO: 74249 - RNA, 20 nt, Artificial Sequence
  MKO10074249_B_Bglap3
  gRNA
cagagagacagagcgcagcc

SEQ ID NO: 74250 - RNA, 20 nt, Artificial Sequence
  MKO10074250_B_Bglap3
  gRNA
ccaguaccuuugucagacuc

SEQ ID NO: 74251 - RNA, 20 nt, Artificial Sequence
  MKO10074251_B_Bglap
  gRNA
uuuacagaugccaagcccag

SEQ ID NO: 74252 - RNA, 20 nt, Artificial Sequence
  MKO10074252_B_Bglap
  gRNA
ccaguaccuuugucagacuc

SEQ ID NO: 74253 - RNA, 20 nt, Artificial Sequence
  MKO10074253_B_Bglap
  gRNA
cacagccuucauguccaagc

SEQ ID NO: 74254 - RNA, 20 nt, Artificial Sequence
  MKO10074254_B_Bgn
  gRNA
gguccaggugaaguucguuc

SEQ ID NO: 74255 - RNA, 20 nt, Artificial Sequence
  MKO10074255_B_Bgn
  gRNA
ggaggcuuacguagaggugc

SEQ ID NO: 74256 - RNA, 20 nt, Artificial Sequence
  MKO10074256_B_Bgn
  gRNA
agagaugggcgggaaucccc

SEQ ID NO: 74257 - RNA, 20 nt, Artificial Sequence
  MKO10074257_B_Bhlha15
  gRNA
ucuguguagaguagcguugc

SEQ ID NO: 74258 - RNA, 20 nt, Artificial Sequence
  MKO10074258_B_Bhlha15
  gRNA
guguucggcgccgagggggc

SEQ ID NO: 74259 - RNA, 20 nt, Artificial Sequence
  MKO10074259_B_Bhlha15
  gRNA
cagcgugagggucucgaucu

SEQ ID NO: 74260 - RNA, 20 nt, Artificial Sequence
  MKO10074260_B_Bhlha9
  gRNA
aggcguucaacgcgcuccgc

SEQ ID NO: 74261 - RNA, 20 nt, Artificial Sequence
  MKO10074261_B_Bhlha9
  gRNA
auaggagacggcgcugaccg

SEQ ID NO: 74262 - RNA, 20 nt, Artificial Sequence
  MKO10074262_B_Bhlha9
  gRNA
acgguccaaggcucggcgca

SEQ ID NO: 74263 - RNA, 20 nt, Artificial Sequence
  MKO10074263_B_Bhlhb9
  gRNA
acugguccgagguaacuaua

SEQ ID NO: 74264 - RNA, 20 nt, Artificial Sequence
  MKO10074264_B_Bhlhb9
  gRNA
cgggcuccucagcacgagcc

SEQ ID NO: 74265 - RNA, 20 nt, Artificial Sequence
  MKO10074265_B_Bhlhb9
  gRNA
ccagaaccaguuaucacuac

SEQ ID NO: 74266 - RNA, 20 nt, Artificial Sequence
  MKO10074266_B_Bhlhe22
  gRNA
uucgagcccgcugaucccga

SEQ ID NO: 74267 - RNA, 20 nt, Artificial Sequence
  MKO10074267_B_Bhlhe22
  gRNA
ccccgacccgcgggcaucgc

SEQ ID NO: 74268 - RNA, 20 nt, Artificial Sequence
  MKO10074268_B_Bhlhe22
  gRNA
gcucauccagagcgucguuc

SEQ ID NO: 74269 - RNA, 20 nt, Artificial Sequence
  MKO10074269_B_Bhlhe23
  gRNA
ccgugcgucaaccgcaaccc

SEQ ID NO: 74270 - RNA, 20 nt, Artificial Sequence
  MKO10074270_B_Bhlhe23
  gRNA
ccggagaccacacgcggcuu

SEQ ID NO: 74271 - RNA, 20 nt, Artificial Sequence
  MKO10074271_B_Bhlhe23
  gRNA
gccgcgccucuaacgcccuu

SEQ ID NO: 74272 - RNA, 20 nt, Artificial Sequence
  MKO10074272_B_Bhlhe40
  gRNA
acauucgucccucgacucuu

SEQ ID NO: 74273 - RNA, 20 nt, Artificial Sequence
  MKO10074273_B_Bhlhe40
  gRNA
aaacuuacaaacugccgcac

SEQ ID NO: 74274 - RNA, 20 nt, Artificial Sequence
  MKO10074274_B_Bhlhe40
  gRNA
uguaccaaguguacaagucc

SEQ ID NO: 74275 - RNA, 20 nt, Artificial Sequence
  MKO10074275_B_Bhlhe41
  gRNA
gucucgcuucaagcuccuuu

SEQ ID NO: 74276 - RNA, 20 nt, Artificial Sequence
  MKO10074276_B_Bhlhe41
  gRNA
acugcagacacuggggcauu

SEQ ID NO: 74277 - RNA, 20 nt, Artificial Sequence
  MKO10074277_B_Bhlhe41
  gRNA
gagcaaugcauucauuaauu

SEQ ID NO: 74278 - RNA, 20 nt, Artificial Sequence
  MKO10074278_B_Bhmt2
  gRNA
ggauguucuaccacugcuuc

SEQ ID NO: 74279 - RNA, 20 nt, Artificial Sequence
  MKO10074279_B_Bhmt2
  gRNA
uucugcuacugaagacaaua

SEQ ID NO: 74280 - RNA, 20 nt, Artificial Sequence
  MKO10074280_B_Bhmt2
  gRNA
aaagagaggcuucgugaagg

SEQ ID NO: 74281 - RNA, 20 nt, Artificial Sequence
  MKO10074281_B_Bhmt
  gRNA
ucucaguucgucagcuucau

SEQ ID NO: 74282 - RNA, 20 nt, Artificial Sequence
  MKO10074282_B_Bhmt
  gRNA
ccuugcucaccucugcaaug

SEQ ID NO: 74283 - RNA, 20 nt, Artificial Sequence
  MKO10074283_B_Bhmt
  gRNA
accugcuuucaccagacgca

SEQ ID NO: 74284 - RNA, 20 nt, Artificial Sequence
  MKO10074284_B_Bicc1
  gRNA
aucggggcuaaauccaagaa

SEQ ID NO: 74285 - RNA, 20 nt, Artificial Sequence
  MKO10074285_B_Bicc1
  gRNA
uuauuuacagcugcagcuga

SEQ ID NO: 74286 - RNA, 20 nt, Artificial Sequence
  MKO10074286_B_Bicc1
  gRNA
cuuuccagauccccacauca

SEQ ID NO: 74287 - RNA, 20 nt, Artificial Sequence
  MKO10074287_B_Bicd1
  gRNA
ugcaaucucuuucagucgaa

SEQ ID NO: 74288 - RNA, 20 nt, Artificial Sequence
  MKO10074288_B_Bicd1
  gRNA
uauccaccguaaaguagcug

SEQ ID NO: 74289 - RNA, 20 nt, Artificial Sequence
  MKO10074289_B_Bicd1
  gRNA
ccucccggaauuuauauucu

SEQ ID NO: 74290 - RNA, 20 nt, Artificial Sequence
  MKO10074290_B_Bicd2
  gRNA
acuccuugaugucaucccgc

SEQ ID NO: 74291 - RNA, 20 nt, Artificial Sequence
  MKO10074291_B_Bicd2
  gRNA
gaaugagcgccucacgucug

SEQ ID NO: 74292 - RNA, 20 nt, Artificial Sequence
  MKO10074292_B_Bicd2
  gRNA
agauccagcguggucgccug

SEQ ID NO: 74293 - RNA, 20 nt, Artificial Sequence
  MKO10074293_B_Bid
  gRNA
cugugaugugcucggccccc

SEQ ID NO: 74294 - RNA, 20 nt, Artificial Sequence
  MKO10074294_B_Bid
  gRNA
uaauaaaguugacagucgug

SEQ ID NO: 74295 - RNA, 20 nt, Artificial Sequence
  MKO10074295_B_Bid
  gRNA
ucuaaccaaguuccucacau

SEQ ID NO: 74296 - RNA, 20 nt, Artificial Sequence
  MKO10074296_B_Bik
  gRNA
gacucgcugucaccuacagc

SEQ ID NO: 74297 - RNA, 20 nt, Artificial Sequence
  MKO10074297_B_Bik
  gRNA
caagacuguuccacacgacc

SEQ ID NO: 74298 - RNA, 20 nt, Artificial Sequence
  MKO10074298_B_Bik
  gRNA
aaggugcuuacccaggcgcc

SEQ ID NO: 74299 - RNA, 20 nt, Artificial Sequence
  MKO10074299_B_Bin1
  gRNA
guguaugagcccgaguggcc

SEQ ID NO: 74300 - RNA, 20 nt, Artificial Sequence
  MKO10074300_B_Bin1
  gRNA
cagcuucuucuguacguugc

SEQ ID NO: 74301 - RNA, 20 nt, Artificial Sequence
  MKO10074301_B_Bin1
  gRNA
gcggcagguccugcagaaac

SEQ ID NO: 74302 - RNA, 20 nt, Artificial Sequence
  MKO10074302_B_Bin2
  gRNA
acccaccuuugacugcacua

SEQ ID NO: 74303 - RNA, 20 nt, Artificial Sequence
  MKO10074303_B_Bin2
  gRNA
gucuacagcagcgacuggga

SEQ ID NO: 74304 - RNA, 20 nt, Artificial Sequence
  MKO10074304_B_Bin2
  gRNA
cgcugcuguagaccuccugc

SEQ ID NO: 74305 - RNA, 20 nt, Artificial Sequence
  MKO10074305_B_Bin3
  gRNA
uacaggauuccauuuaagau

SEQ ID NO: 74306 - RNA, 20 nt, Artificial Sequence
  MKO10074306_B_Bin3
  gRNA
ggucaccuucuccugguuga

SEQ ID NO: 74307 - RNA, 20 nt, Artificial Sequence
  MKO10074307_B_Bin3
  gRNA
agguggagagagacuuugaa

SEQ ID NO: 74308 - RNA, 20 nt, Artificial Sequence
  MKO10074308_B_Birc2
  gRNA
uacugagacaauaucauuga

SEQ ID NO: 74309 - RNA, 20 nt, Artificial Sequence
  MKO10074309_B_Birc2
  gRNA
auauccucaucuucuugagc

SEQ ID NO: 74310 - RNA, 20 nt, Artificial Sequence
  MKO10074310_B_Birc2
  gRNA
gaagaaaaugcugacccuac

SEQ ID NO: 74311 - RNA, 20 nt, Artificial Sequence
  MKO10074311_B_Birc3
  gRNA
ccuaccugcucaaguagaug

SEQ ID NO: 74312 - RNA, 20 nt, Artificial Sequence
  MKO10074312_B_Birc3
  gRNA
gcagauggagcaggcggccg

SEQ ID NO: 74313 - RNA, 20 nt, Artificial Sequence
  MKO10074313_B_Birc3
  gRNA
gggcugaggugcugggaauc

SEQ ID NO: 74314 - RNA, 20 nt, Artificial Sequence
  MKO10074314_B_Birc5
  gRNA
ccagcugcucaauugacuga

SEQ ID NO: 74315 - RNA, 20 nt, Artificial Sequence
  MKO10074315_B_Birc5
  gRNA
acucacucgcucuggggugc

SEQ ID NO: 74316 - RNA, 20 nt, Artificial Sequence
  MKO10074316_B_Birc5
  gRNA
ccgucagucaauugagcagc

SEQ ID NO: 74317 - RNA, 20 nt, Artificial Sequence
  MKO10074317_B_Birc6
  gRNA
auagacuucaauacgugaug

SEQ ID NO: 74318 - RNA, 20 nt, Artificial Sequence
  MKO10074318_B_Birc6
  gRNA
gcuggaacuucccgucacag

SEQ ID NO: 74319 - RNA, 20 nt, Artificial Sequence
  MKO10074319_B_Birc6
  gRNA
gauagauguuucuaguacag

SEQ ID NO: 74320 - RNA, 20 nt, Artificial Sequence
  MKO10074320_B_Birc7
  gRNA
gcccuuaccugggaaaccau

SEQ ID NO: 74321 - RNA, 20 nt, Artificial Sequence
  MKO10074321_B_Birc7
  gRNA
cuucuggaucugaguaacuc

SEQ ID NO: 74322 - RNA, 20 nt, Artificial Sequence
  MKO10074322_B_Birc7
  gRNA
ccuggcucacugacaucuuc

SEQ ID NO: 74323 - RNA, 20 nt, Artificial Sequence
  MKO10074323_B_Bivm
  gRNA
cccaccuauuacccaagaag

SEQ ID NO: 74324 - RNA, 20 nt, Artificial Sequence
  MKO10074324_B_Bivm
  gRNA
ccacaugaagucuuguacug

SEQ ID NO: 74325 - RNA, 20 nt, Artificial Sequence
  MKO10074325_B_Bivm
  gRNA
uauguucuauauaagcccca

SEQ ID NO: 74326 - RNA, 20 nt, Artificial Sequence
  MKO10074326_B_Blcap
  gRNA
cugcuccgauuccccacuuc

SEQ ID NO: 74327 - RNA, 20 nt, Artificial Sequence
  MKO10074327_B_Blcap
  gRNA
acguuaggugcccacaacac

SEQ ID NO: 74328 - RNA, 20 nt, Artificial Sequence
  MKO10074328_B_Blcap
  gRNA
agccccucaaccccgcucug

SEQ ID NO: 74329 - RNA, 20 nt, Artificial Sequence
  MKO10074329_B_Blk
  gRNA
ucuuccugugacgagugacc

SEQ ID NO: 74330 - RNA, 20 nt, Artificial Sequence
  MKO10074330_B_Blk
  gRNA
aaauuuaccuccucaagacc

SEQ ID NO: 74331 - RNA, 20 nt, Artificial Sequence
  MKO10074331_B_Blk
  gRNA
ucagccggaaggaugcugag

SEQ ID NO: 74332 - RNA, 20 nt, Artificial Sequence
  MKO10074332_B_Blmh
  gRNA
guuucaacacguugugccuc

SEQ ID NO: 74333 - RNA, 20 nt, Artificial Sequence
  MKO10074333_B_Blmh
  gRNA
gauaugcuugucaauauugu

SEQ ID NO: 74334 - RNA, 20 nt, Artificial Sequence
  MKO10074334_B_Blmh
  gRNA
cuuaugaacccuacaaauga

SEQ ID NO: 74335 - RNA, 20 nt, Artificial Sequence
  MKO10074335_B_Blm
  gRNA
uguucuuguagauuguucag

SEQ ID NO: 74336 - RNA, 20 nt, Artificial Sequence
  MKO10074336_B_Blm
  gRNA
cauaccaucacagucuuuac

SEQ ID NO: 74337 - RNA, 20 nt, Artificial Sequence
  MKO10074337_B_Blm
  gRNA
cuuccucguugaaauguucc

SEQ ID NO: 74338 - RNA, 20 nt, Artificial Sequence
  MKO10074338_B_Blnk
  gRNA
uacauacucgccccucguga

SEQ ID NO: 74339 - RNA, 20 nt, Artificial Sequence
  MKO10074339_B_Blnk
  gRNA
uuacagacagcuucaaaaga

SEQ ID NO: 74340 - RNA, 20 nt, Artificial Sequence
  MKO10074340_B_Blnk
  gRNA
caugauauuaagaacaauga

SEQ ID NO: 74341 - RNA, 20 nt, Artificial Sequence
  MKO10074341_B_Bloc1s1
  gRNA
cugggcuaggagcaucgagc

SEQ ID NO: 74342 - RNA, 20 nt, Artificial Sequence
  MKO10074342_B_Bloc1s1
  gRNA
guagacguauuccagcgcag

SEQ ID NO: 74343 - RNA, 20 nt, Artificial Sequence
  MKO10074343_B_Bloc1s1
  gRNA
cuugguguucuuugagcagg

SEQ ID NO: 74344 - RNA, 20 nt, Artificial Sequence
  MKO10074344_B_Bloc1s2
  gRNA
cagugaagacuacaaacucc

SEQ ID NO: 74345 - RNA, 20 nt, Artificial Sequence
  MKO10074345_B_Bloc1s2
  gRNA
auuucugguuuaaguccuuc

SEQ ID NO: 74346 - RNA, 20 nt, Artificial Sequence
  MKO10074346_B_Bloc1s2
  gRNA
ugcugaacuacagccauauc

SEQ ID NO: 74347 - RNA, 20 nt, Artificial Sequence
  MKO10074347_B_Bloc1s3
  gRNA
ccgccgugcgggucgcgaug

SEQ ID NO: 74348 - RNA, 20 nt, Artificial Sequence
  MKO10074348_B_Bloc1s3
  gRNA
ucaccgcagccgcuacgucg

SEQ ID NO: 74349 - RNA, 20 nt, Artificial Sequence
  MKO10074349_B_Bloc1s3
  gRNA
agccgcccacagcgugcgcc

SEQ ID NO: 74350 - RNA, 20 nt, Artificial Sequence
  MKO10074350_B_Bloc1s4
  gRNA
ccgcuccacgcggcgcccaa

SEQ ID NO: 74351 - RNA, 20 nt, Artificial Sequence
  MKO10074351_B_Bloc1s4
  gRNA
ucggggccgucaucguccca

SEQ ID NO: 74352 - RNA, 20 nt, Artificial Sequence
  MKO10074352_B_Bloc1s4
  gRNA
cgugccccggauccacgcua

SEQ ID NO: 74353 - RNA, 20 nt, Artificial Sequence
  MKO10074353_B_Bloc1s5
  gRNA
cgcucacgaacuccucccac

SEQ ID NO: 74354 - RNA, 20 nt, Artificial Sequence
  MKO10074354_B_Bloc1s5
  gRNA
gaucacagaccaguuaccca

SEQ ID NO: 74355 - RNA, 20 nt, Artificial Sequence
  MKO10074355_B_Bloc1s5
  gRNA
aucuuggagagauucauucc

SEQ ID NO: 74356 - RNA, 20 nt, Artificial Sequence
  MKO10074356_B_Bloc1s6
  gRNA
agcgacacgucuccagauga

SEQ ID NO: 74357 - RNA, 20 nt, Artificial Sequence
  MKO10074357_B_Bloc1s6
  gRNA
aguuguguuacuagauacac

SEQ ID NO: 74358 - RNA, 20 nt, Artificial Sequence
  MKO10074358_B_Bloc1s6
  gRNA
guguaucuaguaacacaacu

SEQ ID NO: 74359 - RNA, 20 nt, Artificial Sequence
  MKO10074359_B_Blvra
  gRNA
aaaggaucucuucgcuucac

SEQ ID NO: 74360 - RNA, 20 nt, Artificial Sequence
  MKO10074360_B_Blvra
  gRNA
uucugaaacagacgagaacu

SEQ ID NO: 74361 - RNA, 20 nt, Artificial Sequence
  MKO10074361_B_Blvra
  gRNA
ccagccacgaagacuauaua

SEQ ID NO: 74362 - RNA, 20 nt, Artificial Sequence
  MKO10074362_B_Blvrb
  gRNA
gguguguccgucauacucau

SEQ ID NO: 74363 - RNA, 20 nt, Artificial Sequence
  MKO10074363_B_Blvrb
  gRNA
ucccacuacaguaauguccg

SEQ ID NO: 74364 - RNA, 20 nt, Artificial Sequence
  MKO10074364_B_Blvrb
  gRNA
ugcugguucgagacuccagc

SEQ ID NO: 74365 - RNA, 20 nt, Artificial Sequence
  MKO10074365_B_Blzf1
  gRNA
aucacuuugaacgucuagcc

SEQ ID NO: 74366 - RNA, 20 nt, Artificial Sequence
  MKO10074366_B_Blzf1
  gRNA
agaugcccagagcgcuaucc

SEQ ID NO: 74367 - RNA, 20 nt, Artificial Sequence
  MKO10074367_B_Blzf1
  gRNA
cuuacuucgaccccaauccg

SEQ ID NO: 74368 - RNA, 20 nt, Artificial Sequence
  MKO10074368_B_Bmf
  gRNA
guauugcagaccaguuccau

SEQ ID NO: 74369 - RNA, 20 nt, Artificial Sequence
  MKO10074369_B_Bmf
  gRNA
gaagagcuggagucgacuga

SEQ ID NO: 74370 - RNA, 20 nt, Artificial Sequence
  MKO10074370_B_Bmf
  gRNA
cccccgaguguucuucaccc

SEQ ID NO: 74371 - RNA, 20 nt, Artificial Sequence
  MKO10074371_B_Bmi1
  gRNA
aauggcuccaaugaagaccg

SEQ ID NO: 74372 - RNA, 20 nt, Artificial Sequence
  MKO10074372_B_Bmi1
  gRNA
uugaguucuuugaucagagc

SEQ ID NO: 74373 - RNA, 20 nt, Artificial Sequence
  MKO10074373_B_Bmi1
  gRNA
caaaauuuaccaucagcuga

SEQ ID NO: 74374 - RNA, 20 nt, Artificial Sequence
  MKO10074374_B_Bmp10
  gRNA
cagaagccgagugagccacc

SEQ ID NO: 74375 - RNA, 20 nt, Artificial Sequence
  MKO10074375_B_Bmp10
  gRNA
cccacuauacaucgacuuca

SEQ ID NO: 74376 - RNA, 20 nt, Artificial Sequence
  MKO10074376_B_Bmp10
  gRNA
uccuugaagucgauguauag

SEQ ID NO: 74377 - RNA, 20 nt, Artificial Sequence
  MKO10074377_B_Bmp15
  gRNA
uguacucggguauuacccua

SEQ ID NO: 74378 - RNA, 20 nt, Artificial Sequence
  MKO10074378_B_Bmp15
  gRNA
gcaauguagggucgucagca

SEQ ID NO: 74379 - RNA, 20 nt, Artificial Sequence
  MKO10074379_B_Bmp15
  gRNA
augagacucgugaguuccgg

SEQ ID NO: 74380 - RNA, 20 nt, Artificial Sequence
  MKO10074380_B_Bmp1
  gRNA
gcacuaguggacagccgcag

SEQ ID NO: 74381 - RNA, 20 nt, Artificial Sequence
  MKO10074381_B_Bmp1
  gRNA
ucccugcucacccgcagggu

SEQ ID NO: 74382 - RNA, 20 nt, Artificial Sequence
  MKO10074382_B_Bmp1
  gRNA
guacgcgagaacauacagcc

SEQ ID NO: 74383 - RNA, 20 nt, Artificial Sequence
  MKO10074383_B_Bmp2k
  gRNA
ccgaccucaacauuuguaaa

SEQ ID NO: 74384 - RNA, 20 nt, Artificial Sequence
  MKO10074384_B_Bmp2k
  gRNA
aucuuaauggaauauugucg

SEQ ID NO: 74385 - RNA, 20 nt, Artificial Sequence
  MKO10074385_B_Bmp2k
  gRNA
gauuuguaggacuucugacu

SEQ ID NO: 74386 - RNA, 20 nt, Artificial Sequence
  MKO10074386_B_Bmp2
  gRNA
uuaaauugaagaagaagcgc

SEQ ID NO: 74387 - RNA, 20 nt, Artificial Sequence
  MKO10074387_B_Bmp2
  gRNA
gggcaccacgacguccuugc

SEQ ID NO: 74388 - RNA, 20 nt, Artificial Sequence
  MKO10074388_B_Bmp2
  gRNA
gucuuccgaaggccgggaca

SEQ ID NO: 74389 - RNA, 20 nt, Artificial Sequence
  MKO10074389_B_Bmp3
  gRNA
gagcacacgagcuacccaag

SEQ ID NO: 74390 - RNA, 20 nt, Artificial Sequence
  MKO10074390_B_Bmp3
  gRNA
ccaccgcucgcacuaugcuc

SEQ ID NO: 74391 - RNA, 20 nt, Artificial Sequence
  MKO10074391_B_Bmp3
  gRNA
cauccagagcauagugcgag

SEQ ID NO: 74392 - RNA, 20 nt, Artificial Sequence
  MKO10074392_B_Bmp4
  gRNA
aucagccgaucguuaccuca

SEQ ID NO: 74393 - RNA, 20 nt, Artificial Sequence
  MKO10074393_B_Bmp4
  gRNA
gaaaaaagucgccgagauuc

SEQ ID NO: 74394 - RNA, 20 nt, Artificial Sequence
  MKO10074394_B_Bmp4
  gRNA
gugucgccucgaagucccgc

SEQ ID NO: 74395 - RNA, 20 nt, Artificial Sequence
  MKO10074395_B_Bmp5
  gRNA
aagacacaagcuuuagaugu

SEQ ID NO: 74396 - RNA, 20 nt, Artificial Sequence
  MKO10074396_B_Bmp5
  gRNA
uucuaucuuaccuccagcac

SEQ ID NO: 74397 - RNA, 20 nt, Artificial Sequence
  MKO10074397_B_Bmp5
  gRNA
uucccuuguccuuauaaauc

SEQ ID NO: 74398 - RNA, 20 nt, Artificial Sequence
  MKO10074398_B_Bmp6
  gRNA
uccucuaguggaguacgaca

SEQ ID NO: 74399 - RNA, 20 nt, Artificial Sequence
  MKO10074399_B_Bmp6
  gRNA
gccgucaccgccucacccuc

SEQ ID NO: 74400 - RNA, 20 nt, Artificial Sequence
  MKO10074400_B_Bmp6
  gRNA
ggugacaccgcagcacaaca

SEQ ID NO: 74401 - RNA, 20 nt, Artificial Sequence
  MKO10074401_B_Bmp7
  gRNA
ggagucggaccucuucuugc

SEQ ID NO: 74402 - RNA, 20 nt, Artificial Sequence
  MKO10074402_B_Bmp7
  gRNA
gcugcgcugcuugccccccg

SEQ ID NO: 74403 - RNA, 20 nt, Artificial Sequence
  MKO10074403_B_Bmp7
  gRNA
ggucaacccucggcacaacc

SEQ ID NO: 74404 - RNA, 20 nt, Artificial Sequence
  MKO10074404_B_Bmp8a
  gRNA
gggcagcgagaccacugaag

SEQ ID NO: 74405 - RNA, 20 nt, Artificial Sequence
  MKO10074405_B_Bmp8a
  gRNA
cauccgcgguuuccacauag

SEQ ID NO: 74406 - RNA, 20 nt, Artificial Sequence
  MKO10074406_B_Bmp8a
  gRNA
uguguugagcgggugggugc

SEQ ID NO: 74407 - RNA, 20 nt, Artificial Sequence
  MKO10074407_B_Bmp8b
  gRNA
cuucucugccgugagaaccg

SEQ ID NO: 74408 - RNA, 20 nt, Artificial Sequence
  MKO10074408_B_Bmp8b
  gRNA
cauccucgguuuccacauag

SEQ ID NO: 74409 - RNA, 20 nt, Artificial Sequence
  MKO10074409_B_Bmp8b
  gRNA
uguguugagcggguggguac

SEQ ID NO: 74410 - RNA, 20 nt, Artificial Sequence
  MKO10074410_B_Bmper
  gRNA
uggucauuaccugggcaggu

SEQ ID NO: 74411 - RNA, 20 nt, Artificial Sequence
  MKO10074411_B_Bmper
  gRNA
aaaaaucccgcagagcauca

SEQ ID NO: 74412 - RNA, 20 nt, Artificial Sequence
  MKO10074412_B_Bmper
  gRNA
uguuuagguuguacccauga

SEQ ID NO: 74413 - RNA, 20 nt, Artificial Sequence
  MKO10074413_B_Bmpr1a
  gRNA
uggagugacuuuagcaccag

SEQ ID NO: 74414 - RNA, 20 nt, Artificial Sequence
  MKO10074414_B_Bmpr1a
  gRNA
aaucuagauaguaugcucca

SEQ ID NO: 74415 - RNA, 20 nt, Artificial Sequence
  MKO10074415_B_Bmpr1a
  gRNA
cauacacccagaaguuaaug

SEQ ID NO: 74416 - RNA, 20 nt, Artificial Sequence
  MKO10074416_B_Bmpr1b
  gRNA
uucuaguccuagacauccag

SEQ ID NO: 74417 - RNA, 20 nt, Artificial Sequence
  MKO10074417_B_Bmpr1b
  gRNA
caauugaaugcugcacagaa

SEQ ID NO: 74418 - RNA, 20 nt, Artificial Sequence
  MKO10074418_B_Bmpr1b
  gRNA
cucuuaccucuguccuugag

SEQ ID NO: 74419 - RNA, 20 nt, Artificial Sequence
  MKO10074419_B_Bmpr2
  gRNA
uccaaagggagcacguguua

SEQ ID NO: 74420 - RNA, 20 nt, Artificial Sequence
  MKO10074420_B_Bmpr2
  gRNA
ugaaacgauaaucauugcuu

SEQ ID NO: 74421 - RNA, 20 nt, Artificial Sequence
  MKO10074421_B_Bmpr2
  gRNA
accccacccucaauucagaa

SEQ ID NO: 74422 - RNA, 20 nt, Artificial Sequence
  MKO10074422_B_Bms1
  gRNA
uaugggaguucucacccauu

SEQ ID NO: 74423 - RNA, 20 nt, Artificial Sequence
  MKO10074423_B_Bms1
  gRNA
agacuuacaauuauugagug

SEQ ID NO: 74424 - RNA, 20 nt, Artificial Sequence
  MKO10074424_B_Bms1
  gRNA
cuccaugcaccauuccagaa

SEQ ID NO: 74425 - RNA, 20 nt, Artificial Sequence
  MKO10074425_B_Bmx
  gRNA
agccgcuccuuguaauuauu

SEQ ID NO: 74426 - RNA, 20 nt, Artificial Sequence
  MKO10074426_B_Bmx
  gRNA
aauggguacugucucuccac

SEQ ID NO: 74427 - RNA, 20 nt, Artificial Sequence
  MKO10074427_B_Bmx
  gRNA
augcagauuguguauaaaga

SEQ ID NO: 74428 - RNA, 20 nt, Artificial Sequence
  MKO10074428_B_Bmyc
  gRNA
ugccguuagcgaggcucacg

SEQ ID NO: 74429 - RNA, 20 nt, Artificial Sequence
  MKO10074429_B_Bmyc
  gRNA
auacuucaugugcgacgaug

SEQ ID NO: 74430 - RNA, 20 nt, Artificial Sequence
  MKO10074430_B_Bmyc
  gRNA
cagcucgggcaggucugcga

SEQ ID NO: 74431 - RNA, 20 nt, Artificial Sequence
  MKO10074431_B_Bnc1
  gRNA
uguucgccugaaaauccuau

SEQ ID NO: 74432 - RNA, 20 nt, Artificial Sequence
  MKO10074432_B_Bnc1
  gRNA
accgucagugugaacagugc

SEQ ID NO: 74433 - RNA, 20 nt, Artificial Sequence
  MKO10074433_B_Bnc1
  gRNA
caacucuggccccccuagcg

SEQ ID NO: 74434 - RNA, 20 nt, Artificial Sequence
  MKO10074434_B_Bnc2
  gRNA
ccugcgucccguagagcauc

SEQ ID NO: 74435 - RNA, 20 nt, Artificial Sequence
  MKO10074435_B_Bnc2
  gRNA
acccugagggacuauguccg

SEQ ID NO: 74436 - RNA, 20 nt, Artificial Sequence
  MKO10074436_B_Bnc2
  gRNA
ucaggccauccgcugcacau

SEQ ID NO: 74437 - RNA, 20 nt, Artificial Sequence
  MKO10074437_B_Bnip1
  gRNA
aggagcucgaacagucagca

SEQ ID NO: 74438 - RNA, 20 nt, Artificial Sequence
  MKO10074438_B_Bnip1
  gRNA
caguucaguaagcucacuua

SEQ ID NO: 74439 - RNA, 20 nt, Artificial Sequence
  MKO10074439_B_Bnip1
  gRNA
ggucugggccaaacucucuu

SEQ ID NO: 74440 - RNA, 20 nt, Artificial Sequence
  MKO10074440_B_Bnip2
  gRNA
auugaagcagauacacuaga

SEQ ID NO: 74441 - RNA, 20 nt, Artificial Sequence
  MKO10074441_B_Bnip2
  gRNA
uccagcuucauccaaaucau

SEQ ID NO: 74442 - RNA, 20 nt, Artificial Sequence
  MKO10074442_B_Bnip2
  gRNA
gucuuaccaggcugucuguc

SEQ ID NO: 74443 - RNA, 20 nt, Artificial Sequence
  MKO10074443_B_Bnip3l
  gRNA
ccgacucaugcugugcaucc

SEQ ID NO: 74444 - RNA, 20 nt, Artificial Sequence
  MKO10074444_B_Bnip3l
  gRNA
agcccuucaccacaagaaga

SEQ ID NO: 74445 - RNA, 20 nt, Artificial Sequence
  MKO10074445_B_Bnip3l
  gRNA
ucagaagaagaaguuguaga

SEQ ID NO: 74446 - RNA, 20 nt, Artificial Sequence
  MKO10074446_B_Bnip3
  gRNA
gaaauagacagccacagcuu

SEQ ID NO: 74447 - RNA, 20 nt, Artificial Sequence
  MKO10074447_B_Bnip3
  gRNA
ucagcucuguugguaucuug

SEQ ID NO: 74448 - RNA, 20 nt, Artificial Sequence
  MKO10074448_B_Bnip3
  gRNA
uccugaagaaaaacucagau

SEQ ID NO: 74449 - RNA, 20 nt, Artificial Sequence
  MKO10074449_B_Bnipl
  gRNA
uguguggccagcgcccuaug

SEQ ID NO: 74450 - RNA, 20 nt, Artificial Sequence
  MKO10074450_B_Bnipl
  gRNA
acaggaagagagacguuaga

SEQ ID NO: 74451 - RNA, 20 nt, Artificial Sequence
  MKO10074451_B_Bnipl
  gRNA
ccccucuagauugcuuccug

SEQ ID NO: 74452 - RNA, 20 nt, Artificial Sequence
  MKO10074452_B_Boc
  gRNA
caccauggaugaacgugacu

SEQ ID NO: 74453 - RNA, 20 nt, Artificial Sequence
  MKO10074453_B_Boc
  gRNA
gcgcacgcgcagccugucgc

SEQ ID NO: 74454 - RNA, 20 nt, Artificial Sequence
  MKO10074454_B_Boc
  gRNA
acugguaccgucccacagug

SEQ ID NO: 74455 - RNA, 20 nt, Artificial Sequence
  MKO10074455_B_Bod1l
  gRNA
uccauguaugaguugccaag

SEQ ID NO: 74456 - RNA, 20 nt, Artificial Sequence
  MKO10074456_B_Bod1l
  gRNA
gaaucuucugucauuaccca

SEQ ID NO: 74457 - RNA, 20 nt, Artificial Sequence
  MKO10074457_B_Bod1l
  gRNA
aguugucgugucugagagca

SEQ ID NO: 74458 - RNA, 20 nt, Artificial Sequence
  MKO10074458_B_Bod1
  gRNA
ucuccacaggucagguaugu

SEQ ID NO: 74459 - RNA, 20 nt, Artificial Sequence
  MKO10074459_B_Bod1
  gRNA
gcagaccuuaggaagcaucc

SEQ ID NO: 74460 - RNA, 20 nt, Artificial Sequence
  MKO10074460_B_Bod1
  gRNA
gccucagcccauuucgcaac

SEQ ID NO: 74461 - RNA, 20 nt, Artificial Sequence
  MKO10074461_B_Bok
  gRNA
gccgcgcgugcacguacucc

SEQ ID NO: 74462 - RNA, 20 nt, Artificial Sequence
  MKO10074462_B_Bok
  gRNA
ucuugcguacaaacuccccc

SEQ ID NO: 74463 - RNA, 20 nt, Artificial Sequence
  MKO10074463_B_Bok
  gRNA
ggcacgcucuggagcgcucc

SEQ ID NO: 74464 - RNA, 20 nt, Artificial Sequence
  MKO10074464_B_Bola1
  gRNA
gguggugagcucucguuucg

SEQ ID NO: 74465 - RNA, 20 nt, Artificial Sequence
  MKO10074465_B_Bola1
  gRNA
agcgcgggaucugcggcugc

SEQ ID NO: 74466 - RNA, 20 nt, Artificial Sequence
  MKO10074466_B_Bola1
  gRNA
ccgcgauacacacgagcgcg

SEQ ID NO: 74467 - RNA, 20 nt, Artificial Sequence
  MKO10074467_B_Bola2
  gRNA
ccccucauucacgccgcugu

SEQ ID NO: 74468 - RNA, 20 nt, Artificial Sequence
  MKO10074468_B_Bola2
  gRNA
cgcgaccagcuuccgagucc

SEQ ID NO: 74469 - RNA, 20 nt, Artificial Sequence
  MKO10074469_B_Bola2
  gRNA
auuaccuccgcgagaagcug

SEQ ID NO: 74470 - RNA, 20 nt, Artificial Sequence
  MKO10074470_B_Bola3
  gRNA
gccgcugcgccucugcugcg

SEQ ID NO: 74471 - RNA, 20 nt, Artificial Sequence
  MKO10074471_B_Bola3
  gRNA
cgcugcgcacagugccacag

SEQ ID NO: 74472 - RNA, 20 nt, Artificial Sequence
  MKO10074472_B_Bola3
  gRNA
guaugaaauuaaaaucgaau

SEQ ID NO: 74473 - RNA, 20 nt, Artificial Sequence
  MKO10074473_B_Boll
  gRNA
uacccuuauacuuaccauaa

SEQ ID NO: 74474 - RNA, 20 nt, Artificial Sequence
  MKO10074474_B_Boll
  gRNA
ccuaccugauagugauaugc

SEQ ID NO: 74475 - RNA, 20 nt, Artificial Sequence
  MKO10074475_B_Boll
  gRNA
acagccugcauaucacuauc

SEQ ID NO: 74476 - RNA, 20 nt, Artificial Sequence
  MKO10074476_B_Bop1
  gRNA
ugaagccugaaucuccgaac

SEQ ID NO: 74477 - RNA, 20 nt, Artificial Sequence
  MKO10074477_B_Bop1
  gRNA
gcggugacgaagacaaccau

SEQ ID NO: 74478 - RNA, 20 nt, Artificial Sequence
  MKO10074478_B_Bop1
  gRNA
cucucugaagccgguguacc

SEQ ID NO: 74479 - RNA, 20 nt, Artificial Sequence
  MKO10074479_B_Bora
  gRNA
cuucccucacagaagugcaa

SEQ ID NO: 74480 - RNA, 20 nt, Artificial Sequence
  MKO10074480_B_Bora
  gRNA
uuacugggaugaagcucuga

SEQ ID NO: 74481 - RNA, 20 nt, Artificial Sequence
  MKO10074481_B_Bora
  gRNA
guauagaauagauaaagaug

SEQ ID NO: 74482 - RNA, 20 nt, Artificial Sequence
  MKO10074482_B_Bpgm
  gRNA
guccgucguuguuaaguuuc

SEQ ID NO: 74483 - RNA, 20 nt, Artificial Sequence
  MKO10074483_B_Bpgm
  gRNA
cgugaccccaccuccuauag

SEQ ID NO: 74484 - RNA, 20 nt, Artificial Sequence
  MKO10074484_B_Bpgm
  gRNA
gaccagaaacuuaacaacga

SEQ ID NO: 74485 - RNA, 20 nt, Artificial Sequence
  MKO10074485_B_Bphl
  gRNA
augugaagcgcuucuuauuu

SEQ ID NO: 74486 - RNA, 20 nt, Artificial Sequence
  MKO10074486_B_Bphl
  gRNA
uccauauccucgaggguccc

SEQ ID NO: 74487 - RNA, 20 nt, Artificial Sequence
  MKO10074487_B_Bphl
  gRNA
caagguagucauauccauac

SEQ ID NO: 74488 - RNA, 20 nt, Artificial Sequence
  MKO10074488_B_Bpifa1
  gRNA
cuccagacuuuauaacaucc

SEQ ID NO: 74489 - RNA, 20 nt, Artificial Sequence
  MKO10074489_B_Bpifa1
  gRNA
ggugacugcacccacucccc

SEQ ID NO: 74490 - RNA, 20 nt, Artificial Sequence
  MKO10074490_B_Bpifa1
  gRNA
gauccgcagcugcuagaacu

SEQ ID NO: 74491 - RNA, 20 nt, Artificial Sequence
  MKO10074491_B_Bpifa2
  gRNA
cgguugacaauguacuugua

SEQ ID NO: 74492 - RNA, 20 nt, Artificial Sequence
  MKO10074492_B_Bpifa2
  gRNA
acccaucaucaacaguauuc

SEQ ID NO: 74493 - RNA, 20 nt, Artificial Sequence
  MKO10074493_B_Bpifa2
  gRNA
ugucccucagaaccugaauc

SEQ ID NO: 74494 - RNA, 20 nt, Artificial Sequence
  MKO10074494_B_Bpifa3
  gRNA
ggugaugggcaggugucgaa

SEQ ID NO: 74495 - RNA, 20 nt, Artificial Sequence
  MKO10074495_B_Bpifa3
  gRNA
accugacuuucuaccagauu

SEQ ID NO: 74496 - RNA, 20 nt, Artificial Sequence
  MKO10074496_B_Bpifa3
  gRNA
caacauuaccaaugugcagc

SEQ ID NO: 74497 - RNA, 20 nt, Artificial Sequence
  MKO10074497_B_Bpifa5
  gRNA
aucuugacuagagucauucc

SEQ ID NO: 74498 - RNA, 20 nt, Artificial Sequence
  MKO10074498_B_Bpifa5
  gRNA
caagaccaauuuccaguagc

SEQ ID NO: 74499 - RNA, 20 nt, Artificial Sequence
  MKO10074499_B_Bpifa5
  gRNA
cacuuaccacacccugcacc

SEQ ID NO: 74500 - RNA, 20 nt, Artificial Sequence
  MKO10074500_B_Bpifa6
  gRNA
gucgaguuccccagaauuca

SEQ ID NO: 74501 - RNA, 20 nt, Artificial Sequence
  MKO10074501_B_Bpifa6
  gRNA
uacugcccggcagcucuuca

SEQ ID NO: 74502 - RNA, 20 nt, Artificial Sequence
  MKO10074502_B_Bpifa6
  gRNA
ggugauacaggauuggaugc

SEQ ID NO: 74503 - RNA, 20 nt, Artificial Sequence
  MKO10074503_B_Bpifb1
  gRNA
gcagccuucaacuuaugacc

SEQ ID NO: 74504 - RNA, 20 nt, Artificial Sequence
  MKO10074504_B_Bpifb1
  gRNA
gcgcagggugcucucauugc

SEQ ID NO: 74505 - RNA, 20 nt, Artificial Sequence
  MKO10074505_B_Bpifb1
  gRNA
uuaguccagccaccaugucc

SEQ ID NO: 74506 - RNA, 20 nt, Artificial Sequence
  MKO10074506_B_Bpifb2
  gRNA
cacguggcccgggacucuau

SEQ ID NO: 74507 - RNA, 20 nt, Artificial Sequence
  MKO10074507_B_Bpifb2
  gRNA
cuuugaugugcuccugcacc

SEQ ID NO: 74508 - RNA, 20 nt, Artificial Sequence
  MKO10074508_B_Bpifb2
  gRNA
cccucuccagcgggcccugc

SEQ ID NO: 74509 - RNA, 20 nt, Artificial Sequence
  MKO10074509_B_Bpifb3
  gRNA
cccuauucugcaaaacgugc

SEQ ID NO: 74510 - RNA, 20 nt, Artificial Sequence
  MKO10074510_B_Bpifb3
  gRNA
acacuuacccggagccaugc

SEQ ID NO: 74511 - RNA, 20 nt, Artificial Sequence
  MKO10074511_B_Bpifb3
  gRNA
uguucuacgagcccaaagau

SEQ ID NO: 74512 - RNA, 20 nt, Artificial Sequence
  MKO10074512_B_Bpifb4
  gRNA
cagcgcucaaugaccaaccg

SEQ ID NO: 74513 - RNA, 20 nt, Artificial Sequence
  MKO10074513_B_Bpifb4
  gRNA
ugcaugcagguugcgcaucg

SEQ ID NO: 74514 - RNA, 20 nt, Artificial Sequence
  MKO10074514_B_Bpifb4
  gRNA
acgccuuccgcuccgcccug

SEQ ID NO: 74515 - RNA, 20 nt, Artificial Sequence
  MKO10074515_B_Bpifb5
  gRNA
ccauccugaucauacccucc

SEQ ID NO: 74516 - RNA, 20 nt, Artificial Sequence
  MKO10074516_B_Bpifb5
  gRNA
gccaaaccaacugcugaaac

SEQ ID NO: 74517 - RNA, 20 nt, Artificial Sequence
  MKO10074517_B_Bpifb5
  gRNA
agcgcagugugaucugcagc

SEQ ID NO: 74518 - RNA, 20 nt, Artificial Sequence
  MKO10074518_B_Bpifb6
  gRNA
aucacauugaacuuuguacc

SEQ ID NO: 74519 - RNA, 20 nt, Artificial Sequence
  MKO10074519_B_Bpifb6
  gRNA
acuguccacaaacuuguuga

SEQ ID NO: 74520 - RNA, 20 nt, Artificial Sequence
  MKO10074520_B_Bpifb6
  gRNA
cccucccaguaugaagguaa

SEQ ID NO: 74521 - RNA, 20 nt, Artificial Sequence
  MKO10074521_B_Bpifb9a
  gRNA
ucacucugcagacugaaggu

SEQ ID NO: 74522 - RNA, 20 nt, Artificial Sequence
  MKO10074522_B_Bpifb9a
  gRNA
acaaguaacuuuggacgaca

SEQ ID NO: 74523 - RNA, 20 nt, Artificial Sequence
  MKO10074523_B_Bpifb9a
  gRNA
ucauuuccuugacaugcaug

SEQ ID NO: 74524 - RNA, 20 nt, Artificial Sequence
  MKO10074524_B_Bpifb9b
  gRNA
ucacucugcagacugaaggu

SEQ ID NO: 74525 - RNA, 20 nt, Artificial Sequence
  MKO10074525_B_Bpifb9b
  gRNA
acaaguaacuuuggacgaca

SEQ ID NO: 74526 - RNA, 20 nt, Artificial Sequence
  MKO10074526_B_Bpifb9b
  gRNA
ucauuuccuugacaugcaug

SEQ ID NO: 74527 - RNA, 20 nt, Artificial Sequence
  MKO10074527_B_Bpifc
  gRNA
uggagccuugacgcuccagu

SEQ ID NO: 74528 - RNA, 20 nt, Artificial Sequence
  MKO10074528_B_Bpifc
  gRNA
agugcucugaugccuacccc

SEQ ID NO: 74529 - RNA, 20 nt, Artificial Sequence
  MKO10074529_B_Bpifc
  gRNA
aucgucaucccagauuugaa

SEQ ID NO: 74530 - RNA, 20 nt, Artificial Sequence
  MKO10074530_B_Bpi
  gRNA
acugggcagcaucucgaucu

SEQ ID NO: 74531 - RNA, 20 nt, Artificial Sequence
  MKO10074531_B_Bpi
  gRNA
ggcugauccgacuguuccac

SEQ ID NO: 74532 - RNA, 20 nt, Artificial Sequence
  MKO10074532_B_Bpi
  gRNA
gucaaugugacugucgcagu

SEQ ID NO: 74533 - RNA, 20 nt, Artificial Sequence
  MKO10074533_B_Bpnt1
  gRNA
uucccgaagcugaccaucau

SEQ ID NO: 74534 - RNA, 20 nt, Artificial Sequence
  MKO10074534_B_Bpnt1
  gRNA
cucgcaguacagugcuauca

SEQ ID NO: 74535 - RNA, 20 nt, Artificial Sequence
  MKO10074535_B_Bpnt1
  gRNA
cuugauagcacuguacugcg

SEQ ID NO: 74536 - RNA, 20 nt, Artificial Sequence
  MKO10074536_B_Bptf
  gRNA
agucuauuagcucugcuaac

SEQ ID NO: 74537 - RNA, 20 nt, Artificial Sequence
  MKO10074537_B_Bptf
  gRNA
cucguaucaucaccagacug

SEQ ID NO: 74538 - RNA, 20 nt, Artificial Sequence
  MKO10074538_B_Bptf
  gRNA
ggacucggaaacuucuccau

SEQ ID NO: 74539 - RNA, 20 nt, Artificial Sequence
  MKO10074539_B_Braf
  gRNA
gcaaaugauuaaguugacac

SEQ ID NO: 74540 - RNA, 20 nt, Artificial Sequence
  MKO10074540_B_Braf
  gRNA
ucuuccugcccaacaaacag

SEQ ID NO: 74541 - RNA, 20 nt, Artificial Sequence
  MKO10074541_B_Braf
  gRNA
cuugcugguguacucuucau

SEQ ID NO: 74542 - RNA, 20 nt, Artificial Sequence
  MKO10074542_B_Brap
  gRNA
caucuucgauugaguugaac

SEQ ID NO: 74543 - RNA, 20 nt, Artificial Sequence
  MKO10074543_B_Brap
  gRNA
ccucccuaaaagaagacguu

SEQ ID NO: 74544 - RNA, 20 nt, Artificial Sequence
  MKO10074544_B_Brap
  gRNA
cgaagaugacgucugccagc

SEQ ID NO: 74545 - RNA, 20 nt, Artificial Sequence
  MKO10074545_B_Brau1
  gRNA
cgccugagccccauacaagc

SEQ ID NO: 74546 - RNA, 20 nt, Artificial Sequence
  MKO10074546_B_Brau1
  gRNA
gucuagccuccaacuacuac

SEQ ID NO: 74547 - RNA, 20 nt, Artificial Sequence
  MKO10074547_B_Brau1
  gRNA
cccuagcgcccugcacuucc

SEQ ID NO: 74548 - RNA, 20 nt, Artificial Sequence
  MKO10074548_B_Brca1
  gRNA
auugugaaggcccuuucuuc

SEQ ID NO: 74549 - RNA, 20 nt, Artificial Sequence
  MKO10074549_B_Brca1
  gRNA
ucugauuucaggagccuaca

SEQ ID NO: 74550 - RNA, 20 nt, Artificial Sequence
  MKO10074550_B_Brca1
  gRNA
ucacuuacuugcaaaauaug

SEQ ID NO: 74551 - RNA, 20 nt, Artificial Sequence
  MKO10074551_B_Brca2
  gRNA
ugugugcaccgcagaguaag

SEQ ID NO: 74552 - RNA, 20 nt, Artificial Sequence
  MKO10074552_B_Brca2
  gRNA
guacuacaacgagaaaagcc

SEQ ID NO: 74553 - RNA, 20 nt, Artificial Sequence
  MKO10074553_B_Brca2
  gRNA
ucacugagacaagauuucag

SEQ ID NO: 74554 - RNA, 20 nt, Artificial Sequence
  MKO10074554_B_Brcc3
  gRNA
uacagguuggcugaacuaac

SEQ ID NO: 74555 - RNA, 20 nt, Artificial Sequence
  MKO10074555_B_Brcc3
  gRNA
gccgcaagaugaugacagaa

SEQ ID NO: 74556 - RNA, 20 nt, Artificial Sequence
  MKO10074556_B_Brcc3
  gRNA
gucccaugagaguuguuggc

SEQ ID NO: 74557 - RNA, 20 nt, Artificial Sequence
  MKO10074557_B_Brd1
  gRNA
uggacuggagccgccgcaac

SEQ ID NO: 74558 - RNA, 20 nt, Artificial Sequence
  MKO10074558_B_Brd1
  gRNA
agcgacccaucgcagccccu

SEQ ID NO: 74559 - RNA, 20 nt, Artificial Sequence
  MKO10074559_B_Brd1
  gRNA
gagcguagcagcacaguuag

SEQ ID NO: 74560 - RNA, 20 nt, Artificial Sequence
  MKO10074560_B_Brd2
  gRNA
caccgaugauauuguccuaa

SEQ ID NO: 74561 - RNA, 20 nt, Artificial Sequence
  MKO10074561_B_Brd2
  gRNA
aguagcauccaugccacaag

SEQ ID NO: 74562 - RNA, 20 nt, Artificial Sequence
  MKO10074562_B_Brd2
  gRNA
gcaggggccaguuguaaagc

SEQ ID NO: 74563 - RNA, 20 nt, Artificial Sequence
  MKO10074563_B_Brd3
  gRNA
acuauugcccccugcuccaa

SEQ ID NO: 74564 - RNA, 20 nt, Artificial Sequence
  MKO10074564_B_Brd3
  gRNA
acacggugggggguauguuc

SEQ ID NO: 74565 - RNA, 20 nt, Artificial Sequence
  MKO10074565_B_Brd3
  gRNA
cacagaugauauagugcuaa

SEQ ID NO: 74566 - RNA, 20 nt, Artificial Sequence
  MKO10074566_B_Brd4
  gRNA
aacugagaucaugauagucc

SEQ ID NO: 74567 - RNA, 20 nt, Artificial Sequence
  MKO10074567_B_Brd4
  gRNA
accggugaaggagucugaag

SEQ ID NO: 74568 - RNA, 20 nt, Artificial Sequence
  MKO10074568_B_Brd4
  gRNA
auuaagacgaugucaucucc

SEQ ID NO: 74569 - RNA, 20 nt, Artificial Sequence
  MKO10074569_B_Brd7
  gRNA
aucuuauagggacaugacac

SEQ ID NO: 74570 - RNA, 20 nt, Artificial Sequence
  MKO10074570_B_Brd7
  gRNA
ucgagaccgugcagagaaug

SEQ ID NO: 74571 - RNA, 20 nt, Artificial Sequence
  MKO10074571_B_Brd7
  gRNA
ccaguccauagaagaacuaa

SEQ ID NO: 74572 - RNA, 20 nt, Artificial Sequence
  MKO10074572_B_Brd8
  gRNA
agaacugaagaaagucauaa

SEQ ID NO: 74573 - RNA, 20 nt, Artificial Sequence
  MKO10074573_B_Brd8
  gRNA
aggccggccagguucugcaa

SEQ ID NO: 74574 - RNA, 20 nt, Artificial Sequence
  MKO10074574_B_Brd8
  gRNA
guuuagcaucuucugucaug

SEQ ID NO: 74575 - RNA, 20 nt, Artificial Sequence
  MKO10074575_B_Brd9
  gRNA
gaaggaacacugcgacucag

SEQ ID NO: 74576 - RNA, 20 nt, Artificial Sequence
  MKO10074576_B_Brd9
  gRNA
uucaucgugccaaaguccau

SEQ ID NO: 74577 - RNA, 20 nt, Artificial Sequence
  MKO10074577_B_Brd9
  gRNA
acgagagcacaccuauccag

SEQ ID NO: 74578 - RNA, 20 nt, Artificial Sequence
  MKO10074578_B_Brdt
  gRNA
cucuuggccuuuccaacagc

SEQ ID NO: 74579 - RNA, 20 nt, Artificial Sequence
  MKO10074579_B_Brdt
  gRNA
gccacaagaagagcaaguug

SEQ ID NO: 74580 - RNA, 20 nt, Artificial Sequence
  MKO10074580_B_Brdt
  gRNA
aaacugcuacuuauacaaca

SEQ ID NO: 74581 - RNA, 20 nt, Artificial Sequence
  MKO10074581_B_Bre
  gRNA
gugccaccugcucaccaaca

SEQ ID NO: 74582 - RNA, 20 nt, Artificial Sequence
  MKO10074582_B_Bre
  gRNA
cauucccacauaccuucuca

SEQ ID NO: 74583 - RNA, 20 nt, Artificial Sequence
  MKO10074583_B_Bre
  gRNA
aguacaacuugggguacacc

SEQ ID NO: 74584 - RNA, 20 nt, Artificial Sequence
  MKO10074584_B_Brf1
  gRNA
gcggcgccacauccaccacc

SEQ ID NO: 74585 - RNA, 20 nt, Artificial Sequence
  MKO10074585_B_Brf1
  gRNA
ugaccucagcgacuugcucc

SEQ ID NO: 74586 - RNA, 20 nt, Artificial Sequence
  MKO10074586_B_Brf1
  gRNA
cuaccuggagcaagucgcug

SEQ ID NO: 74587 - RNA, 20 nt, Artificial Sequence
  MKO10074587_B_Brf2
  gRNA
guuagucgcugccagcaacg

SEQ ID NO: 74588 - RNA, 20 nt, Artificial Sequence
  MKO10074588_B_Brf2
  gRNA
acuggcgggacguuuccucu

SEQ ID NO: 74589 - RNA, 20 nt, Artificial Sequence
  MKO10074589_B_Brf2
  gRNA
uugcggcuccuccgagcucg

SEQ ID NO: 74590 - RNA, 20 nt, Artificial Sequence
  MKO10074590_B_Bri3bp
  gRNA
cacucccugcacgaaccgcu

SEQ ID NO: 74591 - RNA, 20 nt, Artificial Sequence
  MKO10074591_B_Bri3bp
  gRNA
cugaccgagcgguucgugca

SEQ ID NO: 74592 - RNA, 20 nt, Artificial Sequence
  MKO10074592_B_Bri3bp
  gRNA
gcagcacccgcaacccggcc

SEQ ID NO: 74593 - RNA, 20 nt, Artificial Sequence
  MKO10074593_B_Bri3
  gRNA
gggauggccccguagccgug

SEQ ID NO: 74594 - RNA, 20 nt, Artificial Sequence
  MKO10074594_B_Bri3
  gRNA
ggccacuucugggcgucuua

SEQ ID NO: 74595 - RNA, 20 nt, Artificial Sequence
  MKO10074595_B_Bri3
  gRNA
ggccagggcgacuacgcgug

SEQ ID NO: 74596 - RNA, 20 nt, Artificial Sequence
  MKO10074596_B_Bricd5
  gRNA
guagggggucuuagucuggg

SEQ ID NO: 74597 - RNA, 20 nt, Artificial Sequence
  MKO10074597_B_Bricd5
  gRNA
gguagaucagccgcugucuc

SEQ ID NO: 74598 - RNA, 20 nt, Artificial Sequence
  MKO10074598_B_Bricd5
  gRNA
gcccaagagucacauguacc

SEQ ID NO: 74599 - RNA, 20 nt, Artificial Sequence
  MKO10074599_B_Brinp1
  gRNA
ggggcacugggugacggacc

SEQ ID NO: 74600 - RNA, 20 nt, Artificial Sequence
  MKO10074600_B_Brinp1
  gRNA
caaaggagcauccgucugcu

SEQ ID NO: 74601 - RNA, 20 nt, Artificial Sequence
  MKO10074601_B_Brinp1
  gRNA
gccuucucauggugccauca

SEQ ID NO: 74602 - RNA, 20 nt, Artificial Sequence
  MKO10074602_B_Brinp2
  gRNA
acaguugcauuccgggaaug

SEQ ID NO: 74603 - RNA, 20 nt, Artificial Sequence
  MKO10074603_B_Brinp2
  gRNA
uucccagugcccccaacuac

SEQ ID NO: 74604 - RNA, 20 nt, Artificial Sequence
  MKO10074604_B_Brinp2
  gRNA
uguuaccuuuauggccccug

SEQ ID NO: 74605 - RNA, 20 nt, Artificial Sequence
  MKO10074605_B_Brinp3
  gRNA
auggaagggcaauuacauuc

SEQ ID NO: 74606 - RNA, 20 nt, Artificial Sequence
  MKO10074606_B_Brinp3
  gRNA
cuuccgcaacauaagacuuu

SEQ ID NO: 74607 - RNA, 20 nt, Artificial Sequence
  MKO10074607_B_Brinp3
  gRNA
ucugugauuugcuguagagu

SEQ ID NO: 74608 - RNA, 20 nt, Artificial Sequence
  MKO10074608_B_Brip1
  gRNA
uaccuacagcgacacaaacc

SEQ ID NO: 74609 - RNA, 20 nt, Artificial Sequence
  MKO10074609_B_Brip1
  gRNA
guguauagaugccuguuucu

SEQ ID NO: 74610 - RNA, 20 nt, Artificial Sequence
  MKO10074610_B_Brip1
  gRNA
ugcuaaugcagaacaaagua

SEQ ID NO: 74611 - RNA, 20 nt, Artificial Sequence
  MKO10074611_B_Brix1
  gRNA
ucucuuuauagauacuaaaa

SEQ ID NO: 74612 - RNA, 20 nt, Artificial Sequence
  MKO10074612_B_Brix1
  gRNA
uaaauuauuugugauaaaug

SEQ ID NO: 74613 - RNA, 20 nt, Artificial Sequence
  MKO10074613_B_Brix1
  gRNA
cuuugaagcuaagaaaaaac

SEQ ID NO: 74614 - RNA, 20 nt, Artificial Sequence
  MKO10074614_B_Brk1
  gRNA
uggugaaucucccgcugcac

SEQ ID NO: 74615 - RNA, 20 nt, Artificial Sequence
  MKO10074615_B_Brk1
  gRNA
ggugcagcgggagauucacc

SEQ ID NO: 74616 - RNA, 20 nt, Artificial Sequence
  MKO10074616_B_Brk1
  gRNA
ugaugaucucaauguacucc

SEQ ID NO: 74617 - RNA, 20 nt, Artificial Sequence
  MKO10074617_B_Brms1l
  gRNA
uacaguccagagugagcuug

SEQ ID NO: 74618 - RNA, 20 nt, Artificial Sequence
  MKO10074618_B_Brms1l
  gRNA
caaguacgaaugugaaaucc

SEQ ID NO: 74619 - RNA, 20 nt, Artificial Sequence
  MKO10074619_B_Brms1l
  gRNA
uuuagaugagauguccaacc

SEQ ID NO: 74620 - RNA, 20 nt, Artificial Sequence
  MKO10074620_B_Brms1
  gRNA
ucccucugcagggaucuaca

SEQ ID NO: 74621 - RNA, 20 nt, Artificial Sequence
  MKO10074621_B_Brms1
  gRNA
uggaugaugaagacuaugag

SEQ ID NO: 74622 - RNA, 20 nt, Artificial Sequence
  MKO10074622_B_Brms1
  gRNA
cugcuguaugacacacugcu

SEQ ID NO: 74623 - RNA, 20 nt, Artificial Sequence
  MKO10074623_B_Brox
  gRNA
gccgcauucuucauuguuuc

SEQ ID NO: 74624 - RNA, 20 nt, Artificial Sequence
  MKO10074624_B_Brox
  gRNA
cagcgcuacauuaaauccca

SEQ ID NO: 74625 - RNA, 20 nt, Artificial Sequence
  MKO10074625_B_Brox
  gRNA
cacaaaauaugcuucaagau

SEQ ID NO: 74626 - RNA, 20 nt, Artificial Sequence
  MKO10074626_B_Brpf1
  gRNA
uuggcaccugucucccgcac

SEQ ID NO: 74627 - RNA, 20 nt, Artificial Sequence
  MKO10074627_B_Brpf1
  gRNA
cauccuccuccgaaaaaccu

SEQ ID NO: 74628 - RNA, 20 nt, Artificial Sequence
  MKO10074628_B_Brpf1
  gRNA
cgagccggucccucugucug

SEQ ID NO: 74629 - RNA, 20 nt, Artificial Sequence
  MKO10074629_B_Brpf3
  gRNA
cuugcccgaaucacccagau

SEQ ID NO: 74630 - RNA, 20 nt, Artificial Sequence
  MKO10074630_B_Brpf3
  gRNA
accgagcagcuguccgccuc

SEQ ID NO: 74631 - RNA, 20 nt, Artificial Sequence
  MKO10074631_B_Brpf3
  gRNA
gcagaaacuucgccaugacc

SEQ ID NO: 74632 - RNA, 20 nt, Artificial Sequence
  MKO10074632_B_Brs3
  gRNA
uccaacgauacuacacauaa

SEQ ID NO: 74633 - RNA, 20 nt, Artificial Sequence
  MKO10074633_B_Brs3
  gRNA
auuagugugacccuguucag

SEQ ID NO: 74634 - RNA, 20 nt, Artificial Sequence
  MKO10074634_B_Brs3
  gRNA
uggcucuguucgcacucugc

SEQ ID NO: 74635 - RNA, 20 nt, Artificial Sequence
  MKO10074635_B_Brsk1
  gRNA
ucgcugucaagaucgugaac

SEQ ID NO: 74636 - RNA, 20 nt, Artificial Sequence
  MKO10074636_B_Brsk1
  gRNA
uugguucuugagcacguuuc

SEQ ID NO: 74637 - RNA, 20 nt, Artificial Sequence
  MKO10074637_B_Brsk1
  gRNA
aguccagugcugacacgauc

SEQ ID NO: 74638 - RNA, 20 nt, Artificial Sequence
  MKO10074638_B_Brsk2
  gRNA
gaagggccggcugaccccca

SEQ ID NO: 74639 - RNA, 20 nt, Artificial Sequence
  MKO10074639_B_Brsk2
  gRNA
augcucgaugagcuucaaga

SEQ ID NO: 74640 - RNA, 20 nt, Artificial Sequence
  MKO10074640_B_Brsk2
  gRNA
ucaugcagcuucaguacaug

SEQ ID NO: 74641 - RNA, 20 nt, Artificial Sequence
  MKO10074641_B_Brwd1
  gRNA
aucgcccgcuaccucucagc

SEQ ID NO: 74642 - RNA, 20 nt, Artificial Sequence
  MKO10074642_B_Brwd1
  gRNA
cauuccagcuguugccgaag

SEQ ID NO: 74643 - RNA, 20 nt, Artificial Sequence
  MKO10074643_B_Brwd1
  gRNA
gggagggcaacgagcacaac

SEQ ID NO: 74644 - RNA, 20 nt, Artificial Sequence
  MKO10074644_B_Brwd3
  gRNA
agagcaccgaagaagcuucg

SEQ ID NO: 74645 - RNA, 20 nt, Artificial Sequence
  MKO10074645_B_Brwd3
  gRNA
ccuaguaaugucuguacccc

SEQ ID NO: 74646 - RNA, 20 nt, Artificial Sequence
  MKO10074646_B_Brwd3
  gRNA
gcaagagcucgaagagcauc

SEQ ID NO: 74647 - RNA, 20 nt, Artificial Sequence
  MKO10074647_B_Bscl2
  gRNA
uucgggcaguucaagcucua

SEQ ID NO: 74648 - RNA, 20 nt, Artificial Sequence
  MKO10074648_B_Bscl2
  gRNA
uuaccgcucgcagcugcucc

SEQ ID NO: 74649 - RNA, 20 nt, Artificial Sequence
  MKO10074649_B_Bscl2
  gRNA
augcccaagucuugauucac

SEQ ID NO: 74650 - RNA, 20 nt, Artificial Sequence
  MKO10074650_B_Bsdc1
  gRNA
ugccagaggguguacccauc

SEQ ID NO: 74651 - RNA, 20 nt, Artificial Sequence
  MKO10074651_B_Bsdc1
  gRNA
gucuuccacagggaggacgu

SEQ ID NO: 74652 - RNA, 20 nt, Artificial Sequence
  MKO10074652_B_Bsdc1
  gRNA
uccauaguccacggaagcuu

SEQ ID NO: 74653 - RNA, 20 nt, Artificial Sequence
  MKO10074653_B_Bsg
  gRNA
uugaucucgcuucugcccac

SEQ ID NO: 74654 - RNA, 20 nt, Artificial Sequence
  MKO10074654_B_Bsg
  gRNA
cucacauguacuucguaugc

SEQ ID NO: 74655 - RNA, 20 nt, Artificial Sequence
  MKO10074655_B_Bsg
  gRNA
cccgcucuuacccgccgcgc

SEQ ID NO: 74656 - RNA, 20 nt, Artificial Sequence
  MKO10074656_B_Bsnd
  gRNA
auuccaugacgaccuggacg

SEQ ID NO: 74657 - RNA, 20 nt, Artificial Sequence
  MKO10074657_B_Bsnd
  gRNA
agcccacguccaggucguca

SEQ ID NO: 74658 - RNA, 20 nt, Artificial Sequence
  MKO10074658_B_Bsnd
  gRNA
ccccuaccuuaggauagcau

SEQ ID NO: 74659 - RNA, 20 nt, Artificial Sequence
  MKO10074659_B_Bsn
  gRNA
cuuuaacccaacaccgcauc

SEQ ID NO: 74660 - RNA, 20 nt, Artificial Sequence
  MKO10074660_B_Bsn
  gRNA
uggacaugaccacugcgccu

SEQ ID NO: 74661 - RNA, 20 nt, Artificial Sequence
  MKO10074661_B_Bsn
  gRNA
caagaccucuagcagcgccc

SEQ ID NO: 74662 - RNA, 20 nt, Artificial Sequence
  MKO10074662_B_Bsph1
  gRNA
cacaguauuuccaguaaccu

SEQ ID NO: 74663 - RNA, 20 nt, Artificial Sequence
  MKO10074663_B_Bsph1
  gRNA
gaucuacugggauugcacag

SEQ ID NO: 74664 - RNA, 20 nt, Artificial Sequence
  MKO10074664_B_Bsph1
  gRNA
aucaacuuaccuucugucuc

SEQ ID NO: 74665 - RNA, 20 nt, Artificial Sequence
  MKO10074665_B_Bsph2
  gRNA
guggcgguacuguacagcac

SEQ ID NO: 74666 - RNA, 20 nt, Artificial Sequence
  MKO10074666_B_Bsph2
  gRNA
gguugcuuaccuuguucugg

SEQ ID NO: 74667 - RNA, 20 nt, Artificial Sequence
  MKO10074667_B_Bsph2
  gRNA
cauuuacauccuccagaaca

SEQ ID NO: 74668 - RNA, 20 nt, Artificial Sequence
  MKO10074668_B_Bspry
  gRNA
gcccacaguugcgucaguag

SEQ ID NO: 74669 - RNA, 20 nt, Artificial Sequence
  MKO10074669_B_Bspry
  gRNA
cccagugugcccgcugaguc

SEQ ID NO: 74670 - RNA, 20 nt, Artificial Sequence
  MKO10074670_B_Bspry
  gRNA
caggaccucggccauauacu

SEQ ID NO: 74671 - RNA, 20 nt, Artificial Sequence
  MKO10074671_B_Bst1
  gRNA
uccuuacccucucgugggau

SEQ ID NO: 74672 - RNA, 20 nt, Artificial Sequence
  MKO10074672_B_Bst1
  gRNA
aaaggagccuaucccacgag

SEQ ID NO: 74673 - RNA, 20 nt, Artificial Sequence
  MKO10074673_B_Bst1
  gRNA
cuucaagggggugcuggaca

SEQ ID NO: 74674 - RNA, 20 nt, Artificial Sequence
  MKO10074674_B_Bst2
  gRNA
ugaagucacgaagcugaacc

SEQ ID NO: 74675 - RNA, 20 nt, Artificial Sequence
  MKO10074675_B_Bst2
  gRNA
uucugaucaggugacccuuc

SEQ ID NO: 74676 - RNA, 20 nt, Artificial Sequence
  MKO10074676_B_Bst2
  gRNA
ggagacuucuagcacagugc

SEQ ID NO: 74677 - RNA, 20 nt, Artificial Sequence
  MKO10074677_B_Bsx
  gRNA
cccgacaucaggugaaaacg

SEQ ID NO: 74678 - RNA, 20 nt, Artificial Sequence
  MKO10074678_B_Bsx
  gRNA
guccucgaugaaaaacgacg

SEQ ID NO: 74679 - RNA, 20 nt, Artificial Sequence
  MKO10074679_B_Bsx
  gRNA
cgcucaucauccucugcaua

SEQ ID NO: 74680 - RNA, 20 nt, Artificial Sequence
  MKO10074680_B_Buaf1
  gRNA
acucuucaacgaugaagauu

SEQ ID NO: 74681 - RNA, 20 nt, Artificial Sequence
  MKO10074681_B_Buaf1
  gRNA
uacuacuccaguuacaagaa

SEQ ID NO: 74682 - RNA, 20 nt, Artificial Sequence
  MKO10074682_B_Buaf1
  gRNA
ucuucuguaauaauuuccgu

SEQ ID NO: 74683 - RNA, 20 nt, Artificial Sequence
  MKO10074683_B_Btbd10
  gRNA
ucacaugcuucucgcaguuc

SEQ ID NO: 74684 - RNA, 20 nt, Artificial Sequence
  MKO10074684_B_Btbd10
  gRNA
cucgugaucugucacuugac

SEQ ID NO: 74685 - RNA, 20 nt, Artificial Sequence
  MKO10074685_B_Btbd10
  gRNA
gacgugugaaauuauguucc

SEQ ID NO: 74686 - RNA, 20 nt, Artificial Sequence
  MKO10074686_B_Btbd11
  gRNA
uccaccuacuugagcuggcg

SEQ ID NO: 74687 - RNA, 20 nt, Artificial Sequence
  MKO10074687_B_Btbd11
  gRNA
uccaccccgagacccgccau

SEQ ID NO: 74688 - RNA, 20 nt, Artificial Sequence
  MKO10074688_B_Btbd11
  gRNA
gauugguaccuguucgcuca

SEQ ID NO: 74689 - RNA, 20 nt, Artificial Sequence
  MKO10074689_B_Btbd16
  gRNA
ggaguucccacuugaagccg

SEQ ID NO: 74690 - RNA, 20 nt, Artificial Sequence
  MKO10074690_B_Btbd16
  gRNA
gacccggcagucaccagagu

SEQ ID NO: 74691 - RNA, 20 nt, Artificial Sequence
  MKO10074691_B_Btbd16
  gRNA
gcucaccugcuuccccgcuu

SEQ ID NO: 74692 - RNA, 20 nt, Artificial Sequence
  MKO10074692_B_Btbd17
  gRNA
ccaggcugugggcaccgacg

SEQ ID NO: 74693 - RNA, 20 nt, Artificial Sequence
  MKO10074693_B_Btbd17
  gRNA
acgagugaccagucccacca

SEQ ID NO: 74694 - RNA, 20 nt, Artificial Sequence
  MKO10074694_B_Btbd17
  gRNA
aauagcccagaagcugcccc

SEQ ID NO: 74695 - RNA, 20 nt, Artificial Sequence
  MKO10074695_B_Btbd1
  gRNA
guuguucgaugagccccagc

SEQ ID NO: 74696 - RNA, 20 nt, Artificial Sequence
  MKO10074696_B_Btbd1
  gRNA
ugccuuuauguugcuuacuc

SEQ ID NO: 74697 - RNA, 20 nt, Artificial Sequence
  MKO10074697_B_Btbd1
  gRNA
ugacgguaaaaugaagaaag

SEQ ID NO: 74698 - RNA, 20 nt, Artificial Sequence
  MKO10074698_B_Btbd2
  gRNA
guacgcagugcccgcgcucg

SEQ ID NO: 74699 - RNA, 20 nt, Artificial Sequence
  MKO10074699_B_Btbd2
  gRNA
cacacagugggccucgagcg

SEQ ID NO: 74700 - RNA, 20 nt, Artificial Sequence
  MKO10074700_B_Btbd2
  gRNA
acacguacuugagcagcgcc

SEQ ID NO: 74701 - RNA, 20 nt, Artificial Sequence
  MKO10074701_B_Btbd3
  gRNA
uucgaucuuugcgcuguacu

SEQ ID NO: 74702 - RNA, 20 nt, Artificial Sequence
  MKO10074702_B_Btbd3
  gRNA
uuuaucccaccauccgagaa

SEQ ID NO: 74703 - RNA, 20 nt, Artificial Sequence
  MKO10074703_B_Btbd3
  gRNA
augcuuacuucagcauggcg

SEQ ID NO: 74704 - RNA, 20 nt, Artificial Sequence
  MKO10074704_B_Btbd6
  gRNA
gucugacugggcggcaccau

SEQ ID NO: 74705 - RNA, 20 nt, Artificial Sequence
  MKO10074705_B_Btbd6
  gRNA
cgcaagauccccguagaaca

SEQ ID NO: 74706 - RNA, 20 nt, Artificial Sequence
  MKO10074706_B_Btbd6
  gRNA
agaaauccacauucccgaug

SEQ ID NO: 74707 - RNA, 20 nt, Artificial Sequence
  MKO10074707_B_Btbd7
  gRNA
uauccagucugacuaccuac

SEQ ID NO: 74708 - RNA, 20 nt, Artificial Sequence
  MKO10074708_B_Btbd7
  gRNA
ugcacccacuuagagccgua

SEQ ID NO: 74709 - RNA, 20 nt, Artificial Sequence
  MKO10074709_B_Btbd7
  gRNA
gcagugccacucaguaaguu

SEQ ID NO: 74710 - RNA, 20 nt, Artificial Sequence
  MKO10074710_B_Btbd8
  gRNA
caagaguguauuacucuuca

SEQ ID NO: 74711 - RNA, 20 nt, Artificial Sequence
  MKO10074711_B_Btbd8
  gRNA
cucgcuguucaaagugcaca

SEQ ID NO: 74712 - RNA, 20 nt, Artificial Sequence
  MKO10074712_B_Btbd8
  gRNA
ucuccuccuaacucagacgc

SEQ ID NO: 74713 - RNA, 20 nt, Artificial Sequence
  MKO10074713_B_Btbd9
  gRNA
cugagcuucugaacgucgug

SEQ ID NO: 74714 - RNA, 20 nt, Artificial Sequence
  MKO10074714_B_Btbd9
  gRNA
gcucuccgaccgcacuuuga

SEQ ID NO: 74715 - RNA, 20 nt, Artificial Sequence
  MKO10074715_B_Btbd9
  gRNA
gaaggacucaccggcuguca

SEQ ID NO: 74716 - RNA, 20 nt, Artificial Sequence
  MKO10074716_B_Buc
  gRNA
ccugguggucugcuugauag

SEQ ID NO: 74717 - RNA, 20 nt, Artificial Sequence
  MKO10074717_B_Buc
  gRNA
gcaguaaugcuuguacugcu

SEQ ID NO: 74718 - RNA, 20 nt, Artificial Sequence
  MKO10074718_B_Buc
  gRNA
agcuccacaaagagagccau

SEQ ID NO: 74719 - RNA, 20 nt, Artificial Sequence
  MKO10074719_B_Btd
  gRNA
acccgugucuggagcccuuu

SEQ ID NO: 74720 - RNA, 20 nt, Artificial Sequence
  MKO10074720_B_Btd
  gRNA
gagcgguagcugguucaucc

SEQ ID NO: 74721 - RNA, 20 nt, Artificial Sequence
  MKO10074721_B_Btd
  gRNA
ggccgcguccuaugcgaagc

SEQ ID NO: 74722 - RNA, 20 nt, Artificial Sequence
  MKO10074722_B_Btf3l4
  gRNA
acuguucagcuaacuuucua

SEQ ID NO: 74723 - RNA, 20 nt, Artificial Sequence
  MKO10074723_B_Btf3l4
  gRNA
accagaagacaucgaugaag

SEQ ID NO: 74724 - RNA, 20 nt, Artificial Sequence
  MKO10074724_B_Btf3l4
  gRNA
uccucuucaucgaugucuuc

SEQ ID NO: 74725 - RNA, 20 nt, Artificial Sequence
  MKO10074725_B_Btf3
  gRNA
gaaagaaacaaucaugaacc

SEQ ID NO: 74726 - RNA, 20 nt, Artificial Sequence
  MKO10074726_B_Btf3
  gRNA
gcgcacuugugccugcaguu

SEQ ID NO: 74727 - RNA, 20 nt, Artificial Sequence
  MKO10074727_B_Btf3
  gRNA
guucaccccuaacuucuuua

SEQ ID NO: 74728 - RNA, 20 nt, Artificial Sequence
  MKO10074728_B_Bug1
  gRNA
gacugcucaguccaauccgc

SEQ ID NO: 74729 - RNA, 20 nt, Artificial Sequence
  MKO10074729_B_Bug1
  gRNA
cuguacgaagccucaccagc

SEQ ID NO: 74730 - RNA, 20 nt, Artificial Sequence
  MKO10074730_B_Bug1
  gRNA
cgguaaccugaucccuugca

SEQ ID NO: 74731 - RNA, 20 nt, Artificial Sequence
  MKO10074731_B_Bug2
  gRNA
ggcgaucuccgggagcaugu

SEQ ID NO: 74732 - RNA, 20 nt, Artificial Sequence
  MKO10074732_B_Bug2
  gRNA
gcgcuccaggacgcacugac

SEQ ID NO: 74733 - RNA, 20 nt, Artificial Sequence
  MKO10074733_B_Bug2
  gRNA
gcucaccggucagugcgucc

SEQ ID NO: 74734 - RNA, 20 nt, Artificial Sequence
  MKO10074734_B_Bug3
  gRNA
caccggcagcacaccucaca

SEQ ID NO: 74735 - RNA, 20 nt, Artificial Sequence
  MKO10074735_B_Bug3
  gRNA
aaaaaugaagaacgaaauug

SEQ ID NO: 74736 - RNA, 20 nt, Artificial Sequence
  MKO10074736_B_Bug3
  gRNA
cugcaucuuguacagcgacc

SEQ ID NO: 74737 - RNA, 20 nt, Artificial Sequence
  MKO10074737_B_Bug4
  gRNA
acaaccugguagacgcucuu

SEQ ID NO: 74738 - RNA, 20 nt, Artificial Sequence
  MKO10074738_B_Bug4
  gRNA
aucccuaugaggugugcugu

SEQ ID NO: 74739 - RNA, 20 nt, Artificial Sequence
  MKO10074739_B_Bug4
  gRNA
ucaccuacagcacaccucau

SEQ ID NO: 74740 - RNA, 20 nt, Artificial Sequence
  MKO10074740_B_Btk
  gRNA
cuuaccggaaucugucuuuc

SEQ ID NO: 74741 - RNA, 20 nt, Artificial Sequence
  MKO10074741_B_Btk
  gRNA
cccaccagaaagacagauuc

SEQ ID NO: 74742 - RNA, 20 nt, Artificial Sequence
  MKO10074742_B_Btk
  gRNA
cugaagagcugagaaagcgc

SEQ ID NO: 74743 - RNA, 20 nt, Artificial Sequence
  MKO10074743_B_Btla
  gRNA
ccagaugccaccaaugccuc

SEQ ID NO: 74744 - RNA, 20 nt, Artificial Sequence
  MKO10074744_B_Btla
  gRNA
uaaagcagccaaguccugcc

SEQ ID NO: 74745 - RNA, 20 nt, Artificial Sequence
  MKO10074745_B_Btla
  gRNA
ucuuaguagcuuucucacaa

SEQ ID NO: 74746 - RNA, 20 nt, Artificial Sequence
  MKO10074746_B_Btn1a1
  gRNA
gaaguagagaucuccuuacc

SEQ ID NO: 74747 - RNA, 20 nt, Artificial Sequence
  MKO10074747_B_Btn1a1
  gRNA
gauagccacagcuacuaucc

SEQ ID NO: 74748 - RNA, 20 nt, Artificial Sequence
  MKO10074748_B_Btn1a1
  gRNA
ugcauccagaauauccuccu

SEQ ID NO: 74749 - RNA, 20 nt, Artificial Sequence
  MKO10074749_B_Btn2a2
  gRNA
augcugauucuccucacauc

SEQ ID NO: 74750 - RNA, 20 nt, Artificial Sequence
  MKO10074750_B_Btn2a2
  gRNA
gcugaugucugugcgcauga

SEQ ID NO: 74751 - RNA, 20 nt, Artificial Sequence
  MKO10074751_B_Btn2a2
  gRNA
cugguccuaugacaguaaac

SEQ ID NO: 74752 - RNA, 20 nt, Artificial Sequence
  MKO10074752_B_Btnl10
  gRNA
cgggccgagugcaccucagc

SEQ ID NO: 74753 - RNA, 20 nt, Artificial Sequence
  MKO10074753_B_Btnl10
  gRNA
gauauggcaagggcacaccc

SEQ ID NO: 74754 - RNA, 20 nt, Artificial Sequence
  MKO10074754_B_Btnl10
  gRNA
gcucacagauaccuuaacua

SEQ ID NO: 74755 - RNA, 20 nt, Artificial Sequence
  MKO10074755_B_Btnl1
  gRNA
cgauuucuccuggucauaca

SEQ ID NO: 74756 - RNA, 20 nt, Artificial Sequence
  MKO10074756_B_Btnl1
  gRNA
cgagcaggaccaauaguaug

SEQ ID NO: 74757 - RNA, 20 nt, Artificial Sequence
  MKO10074757_B_Btnl1
  gRNA
uagacucaccuaggucggcc

SEQ ID NO: 74758 - RNA, 20 nt, Artificial Sequence
  MKO10074758_B_Btnl2
  gRNA
cucgggacgugcauacaagc

SEQ ID NO: 74759 - RNA, 20 nt, Artificial Sequence
  MKO10074759_B_Btnl2
  gRNA
ggaggagcugacacguuagc

SEQ ID NO: 74760 - RNA, 20 nt, Artificial Sequence
  MKO10074760_B_Btnl2
  gRNA
cagcuuguaugcacgucccg

SEQ ID NO: 74761 - RNA, 20 nt, Artificial Sequence
  MKO10074761_B_Btnl4
  gRNA
ggacaagcuaucuucucaga

SEQ ID NO: 74762 - RNA, 20 nt, Artificial Sequence
  MKO10074762_B_Btnl4
  gRNA
gcugucucucacaaccagca

SEQ ID NO: 74763 - RNA, 20 nt, Artificial Sequence
  MKO10074763_B_Btnl4
  gRNA
agacaagggaugaugcucug

SEQ ID NO: 74764 - RNA, 20 nt, Artificial Sequence
  MKO10074764_B_Btnl6
  gRNA
guauucacagcgcaccucuc

SEQ ID NO: 74765 - RNA, 20 nt, Artificial Sequence
  MKO10074765_B_Btnl6
  gRNA
guucagaacggagaccucgc

SEQ ID NO: 74766 - RNA, 20 nt, Artificial Sequence
  MKO10074766_B_Btnl6
  gRNA
acacauacuccaccgucuuc

SEQ ID NO: 74767 - RNA, 20 nt, Artificial Sequence
  MKO10074767_B_Btnl9
  gRNA
gcacaaucagacugagcggc

SEQ ID NO: 74768 - RNA, 20 nt, Artificial Sequence
  MKO10074768_B_Btnl9
  gRNA
acuccaccgcuuccccgacg

SEQ ID NO: 74769 - RNA, 20 nt, Artificial Sequence
  MKO10074769_B_Btnl9
  gRNA
uccuacccagaauguccccc

SEQ ID NO: 74770 - RNA, 20 nt, Artificial Sequence
  MKO10074770_B_Btrc
  gRNA
gauuucauaacugcacugcc

SEQ ID NO: 74771 - RNA, 20 nt, Artificial Sequence
  MKO10074771_B_Btrc
  gRNA
agacuuacaacagcugugcc

SEQ ID NO: 74772 - RNA, 20 nt, Artificial Sequence
  MKO10074772_B_Btrc
  gRNA
agagaagaauucacuuagac

SEQ ID NO: 74773 - RNA, 20 nt, Artificial Sequence
  MKO10074773_B_Bub1b
  gRNA
agagcgauagaagcacucca

SEQ ID NO: 74774 - RNA, 20 nt, Artificial Sequence
  MKO10074774_B_Bub1b
  gRNA
ccuugcguucaaucccuucc

SEQ ID NO: 74775 - RNA, 20 nt, Artificial Sequence
  MKO10074775_B_Bub1b
  gRNA
agaugacccucuggaugugu

SEQ ID NO: 74776 - RNA, 20 nt, Artificial Sequence
  MKO10074776_B_Bub1
  gRNA
ugaugaaucuugaaucauug

SEQ ID NO: 74777 - RNA, 20 nt, Artificial Sequence
  MKO10074777_B_Bub1
  gRNA
agcccauaugcaaagcuaca

SEQ ID NO: 74778 - RNA, 20 nt, Artificial Sequence
  MKO10074778_B_Bub1
  gRNA
caucauauauauacaugucc

SEQ ID NO: 74779 - RNA, 20 nt, Artificial Sequence
  MKO10074779_B_Bub3
  gRNA
gggguggguaccugcuuguu

SEQ ID NO: 74780 - RNA, 20 nt, Artificial Sequence
  MKO10074780_B_Bub3
  gRNA
cgggccgccgagugcuggug

SEQ ID NO: 74781 - RNA, 20 nt, Artificial Sequence
  MKO10074781_B_Bub3
  gRNA
uguaggauccaacgcaugcc

SEQ ID NO: 74782 - RNA, 20 nt, Artificial Sequence
  MKO10074782_B_Bud13
  gRNA
ggcuaucucuacugcuaagc

SEQ ID NO: 74783 - RNA, 20 nt, Artificial Sequence
  MKO10074783_B_Bud13
  gRNA
cugaccucucuccaccucga

SEQ ID NO: 74784 - RNA, 20 nt, Artificial Sequence
  MKO10074784_B_Bud13
  gRNA
ccuuccgcuccagugccaag

SEQ ID NO: 74785 - RNA, 20 nt, Artificial Sequence
  MKO10074785_B_Bud31
  gRNA
uuggcaccaacugcauuugc

SEQ ID NO: 74786 - RNA, 20 nt, Artificial Sequence
  MKO10074786_B_Bud31
  gRNA
aucaucgagugcacacacug

SEQ ID NO: 74787 - RNA, 20 nt, Artificial Sequence
  MKO10074787_B_Bud31
  gRNA
ggugucagccagagcaaccc

SEQ ID NO: 74788 - RNA, 20 nt, Artificial Sequence
  MKO10074788_B_Bves
  gRNA
cacaggauguacccuuuaug

SEQ ID NO: 74789 - RNA, 20 nt, Artificial Sequence
  MKO10074789_B_Bves
  gRNA
gcaguuaucaucugcaacaa

SEQ ID NO: 74790 - RNA, 20 nt, Artificial Sequence
  MKO10074790_B_Bves
  gRNA
cuuaccuuaucauuuaaagu

SEQ ID NO: 74791 - RNA, 20 nt, Artificial Sequence
  MKO10074791_B_Bysl
  gRNA
uggaaguuuaccgaggaguc

SEQ ID NO: 74792 - RNA, 20 nt, Artificial Sequence
  MKO10074792_B_Bysl
  gRNA
ucaucccugcacuguccaac

SEQ ID NO: 74793 - RNA, 20 nt, Artificial Sequence
  MKO10074793_B_Bysl
  gRNA
cagcaaugucaucucgcacu

SEQ ID NO: 74794 - RNA, 20 nt, Artificial Sequence
  MKO10074794_B_Bzrap1
  gRNA
cacugaggucucgggcucgc

SEQ ID NO: 74795 - RNA, 20 nt, Artificial Sequence
  MKO10074795_B_Bzrap1
  gRNA
gcagcgcuguaccauccuga

SEQ ID NO: 74796 - RNA, 20 nt, Artificial Sequence
  MKO10074796_B_Bzrap1
  gRNA
cuuacggcacaacuccaaac

SEQ ID NO: 74797 - RNA, 20 nt, Artificial Sequence
  MKO10074797_B_Bzw1
  gRNA
ccuauccagaugaaaaagag

SEQ ID NO: 74798 - RNA, 20 nt, Artificial Sequence
  MKO10074798_B_Bzw1
  gRNA
uaccugagcgaaugcuugca

SEQ ID NO: 74799 - RNA, 20 nt, Artificial Sequence
  MKO10074799_B_Bzw1
  gRNA
cagaaggacaccagucaaca

SEQ ID NO: 74800 - RNA, 20 nt, Artificial Sequence
  MKO10074800_B_Bzw2
  gRNA
guccaggggcuuaaugaagc

SEQ ID NO: 74801 - RNA, 20 nt, Artificial Sequence
  MKO10074801_B_Bzw2
  gRNA
acagacagcuuagucaaaga

SEQ ID NO: 74802 - RNA, 20 nt, Artificial Sequence
  MKO10074802_B_Bzw2
  gRNA
ggagggucccauugcccagc

SEQ ID NO: 74803 - RNA, 20 nt, Artificial Sequence
  MKO10074803_B_C030006K11Rik
  gRNA
ccgcgaguauuucuacuaug

SEQ ID NO: 74804 - RNA, 20 nt, Artificial Sequence
  MKO10074804_B_C030006K11Rik
  gRNA
guaagcaauaccuuugaagc

SEQ ID NO: 74805 - RNA, 20 nt, Artificial Sequence
  MKO10074805_B_C030006K11Rik
  gRNA
aacuuuaucaccugcuucaa

SEQ ID NO: 74806 - RNA, 20 nt, Artificial Sequence
  MKO10074806_B_C030039L03Rik
  gRNA
acaccuucugaguagcaucc

SEQ ID NO: 74807 - RNA, 20 nt, Artificial Sequence
  MKO10074807_B_C030039L03Rik
  gRNA
acagaccauguguugagaac

SEQ ID NO: 74808 - RNA, 20 nt, Artificial Sequence
  MKO10074808_B_C030039L03Rik
  gRNA
cagcuccaguucucaacaca

SEQ ID NO: 74809 - RNA, 20 nt, Artificial Sequence
  MKO10074809_B_C030046E11Rik
  gRNA
uauguuacaauuaacacacu

SEQ ID NO: 74810 - RNA, 20 nt, Artificial Sequence
  MKO10074810_B_C030046E11Rik
  gRNA
guccaucagaaguugcaaca

SEQ ID NO: 74811 - RNA, 20 nt, Artificial Sequence
  MKO10074811_B_C030046E11Rik
  gRNA
ugguacuguagacagauuga

SEQ ID NO: 74812 - RNA, 20 nt, Artificial Sequence
  MKO10074812_B_C130026I21Rik
  gRNA
ucaagaaacauguaagaacc

SEQ ID NO: 74813 - RNA, 20 nt, Artificial Sequence
  MKO10074813_B_C130026I21Rik
  gRNA
auguacagaagaaguuuagc

SEQ ID NO: 74814 - RNA, 20 nt, Artificial Sequence
  MKO10074814_B_C130026I21Rik
  gRNA
aacgaaugaugaacaagcag

SEQ ID NO: 74815 - RNA, 20 nt, Artificial Sequence
  MKO10074815_B_C130050O18Rik
  gRNA
acacaacgcucugucagcac

SEQ ID NO: 74816 - RNA, 20 nt, Artificial Sequence
  MKO10074816_B_C130050O18Rik
  gRNA
gcucaugaaccucgcagagc

SEQ ID NO: 74817 - RNA, 20 nt, Artificial Sequence
  MKO10074817_B_C130050O18Rik
  gRNA
aucgggcccgccugaagcug

SEQ ID NO: 74818 - RNA, 20 nt, Artificial Sequence
  MKO10074818_B_C130060K24Rik
  gRNA
aagucgcugcacaugccaca

SEQ ID NO: 74819 - RNA, 20 nt, Artificial Sequence
  MKO10074819_B_C130060K24Rik
  gRNA
uacuaugaccugcauugcug

SEQ ID NO: 74820 - RNA, 20 nt, Artificial Sequence
  MKO10074820_B_C130060K24Rik
  gRNA
gaagcgagcugugaucauga

SEQ ID NO: 74821 - RNA, 20 nt, Artificial Sequence
  MKO10074821_B_C130074G19Rik
  gRNA
gcagcguacuccgccccauu

SEQ ID NO: 74822 - RNA, 20 nt, Artificial Sequence
  MKO10074822_B_C130074G19Rik
  gRNA
cggggacuccgagcgcacgc

SEQ ID NO: 74823 - RNA, 20 nt, Artificial Sequence
  MKO10074823_B_C130074G19Rik
  gRNA
gcgaucgccccaggggccuu

SEQ ID NO: 74824 - RNA, 20 nt, Artificial Sequence
  MKO10074824_B_C130079G13Rik
  gRNA
ucccauaauacagaugcgug

SEQ ID NO: 74825 - RNA, 20 nt, Artificial Sequence
  MKO10074825_B_C130079G13Rik
  gRNA
ccaucuguucagaucaucau

SEQ ID NO: 74826 - RNA, 20 nt, Artificial Sequence
  MKO10074826_B_C130079G13Rik
  gRNA
ccuaugaugaucugaacaga

SEQ ID NO: 74827 - RNA, 20 nt, Artificial Sequence
  MKO10074827_B_C1d
  gRNA
ucacgagucuuuaacagccc

SEQ ID NO: 74828 - RNA, 20 nt, Artificial Sequence
  MKO10074828_B_C1d
  gRNA
uucccuuuauuagccacuuu

SEQ ID NO: 74829 - RNA, 20 nt, Artificial Sequence
  MKO10074829_B_C1d
  gRNA
uccaccuuugcuuguuccaa

SEQ ID NO: 74830 - RNA, 20 nt, Artificial Sequence
  MKO10074830_B_C1galt1c1
  gRNA
guguaccggcuuagggcauu

SEQ ID NO: 74831 - RNA, 20 nt, Artificial Sequence
  MKO10074831_B_C1galt1c1
  gRNA
aauaugcuuaugaucaauac

SEQ ID NO: 74832 - RNA, 20 nt, Artificial Sequence
  MKO10074832_B_C1galt1c1
  gRNA
ugugccuugaucacuaugcu

SEQ ID NO: 74833 - RNA, 20 nt, Artificial Sequence
  MKO10074833_B_C1galt1
  gRNA
gugaagcauguuaggcugaa

SEQ ID NO: 74834 - RNA, 20 nt, Artificial Sequence
  MKO10074834_B_C1galt1
  gRNA
gcagauuccagccaacauaa

SEQ ID NO: 74835 - RNA, 20 nt, Artificial Sequence
  MKO10074835_B_C1galt1
  gRNA
gcaauaucagaacagcaucc

SEQ ID NO: 74836 - RNA, 20 nt, Artificial Sequence
  MKO10074836_B_C1qa
  gRNA
ugcugaccaugacccuagua

SEQ ID NO: 74837 - RNA, 20 nt, Artificial Sequence
  MKO10074837_B_C1qa
  gRNA
uaaaaccucggauaccaguc

SEQ ID NO: 74838 - RNA, 20 nt, Artificial Sequence
  MKO10074838_B_C1qa
  gRNA
accgugcuucagcugcgacg

SEQ ID NO: 74839 - RNA, 20 nt, Artificial Sequence
  MKO10074839_B_C1qbp
  gRNA
aagucccuucccaagauguc

SEQ ID NO: 74840 - RNA, 20 nt, Artificial Sequence
  MKO10074840_B_C1qbp
  gRNA
ucagauuggacacgaagaug

SEQ ID NO: 74841 - RNA, 20 nt, Artificial Sequence
  MKO10074841_B_C1qbp
  gRNA
uccuccucaccaucaaaugu

SEQ ID NO: 74842 - RNA, 20 nt, Artificial Sequence
  MKO10074842_B_C1qb
  gRNA
accaggcacuccagggauaa

SEQ ID NO: 74843 - RNA, 20 nt, Artificial Sequence
  MKO10074843_B_C1qb
  gRNA
cgcggucccaaaggcgauuc

SEQ ID NO: 74844 - RNA, 20 nt, Artificial Sequence
  MKO10074844_B_C1qb
  gRNA
guaguccccagaaucgccuu

SEQ ID NO: 74845 - RNA, 20 nt, Artificial Sequence
  MKO10074845_B_C1qc
  gRNA
acgggcaugauggacuccag

SEQ ID NO: 74846 - RNA, 20 nt, Artificial Sequence
  MKO10074846_B_C1qc
  gRNA
cguucuagucgggaaacagu

SEQ ID NO: 74847 - RNA, 20 nt, Artificial Sequence
  MKO10074847_B_C1qc
  gRNA
gggugacugugaauaccgac

SEQ ID NO: 74848 - RNA, 20 nt, Artificial Sequence
  MKO10074848_B_C1ql1
  gRNA
gcgggccagugcaauugccc

SEQ ID NO: 74849 - RNA, 20 nt, Artificial Sequence
  MKO10074849_B_C1ql1
  gRNA
ccgcaucguaguuguugccu

SEQ ID NO: 74850 - RNA, 20 nt, Artificial Sequence
  MKO10074850_B_C1ql1
  gRNA
ccacgcguggccuucuacgc

SEQ ID NO: 74851 - RNA, 20 nt, Artificial Sequence
  MKO10074851_B_C1ql2
  gRNA
cgacuacgccagcaacagcg

SEQ ID NO: 74852 - RNA, 20 nt, Artificial Sequence
  MKO10074852_B_C1ql2
  gRNA
caucucguagugagccgcuc

SEQ ID NO: 74853 - RNA, 20 nt, Artificial Sequence
  MKO10074853_B_C1ql2
  gRNA
ggucgccccggaucacccuu

SEQ ID NO: 74854 - RNA, 20 nt, Artificial Sequence
  MKO10074854_B_C1ql3
  gRNA
gugaaggaccacacuguuac

SEQ ID NO: 74855 - RNA, 20 nt, Artificial Sequence
  MKO10074855_B_C1ql3
  gRNA
gcguucaggccgggcgcccc

SEQ ID NO: 74856 - RNA, 20 nt, Artificial Sequence
  MKO10074856_B_C1ql3
  gRNA
cccgggagagcccggaccgc

SEQ ID NO: 74857 - RNA, 20 nt, Artificial Sequence
  MKO10074857_B_C1ql4
  gRNA
acggugggaaggugcacggc

SEQ ID NO: 74858 - RNA, 20 nt, Artificial Sequence
  MKO10074858_B_C1ql4
  gRNA
caacgugggcaacgcuuacg

SEQ ID NO: 74859 - RNA, 20 nt, Artificial Sequence
  MKO10074859_B_C1ql4
  gRNA
accccgaauugccuucuacg

SEQ ID NO: 74860 - RNA, 20 nt, Artificial Sequence
  MKO10074860_B_C1qtnf1
  gRNA
uaccuugucacaggauccag

SEQ ID NO: 74861 - RNA, 20 nt, Artificial Sequence
  MKO10074861_B_C1qtnf1
  gRNA
uacuucucucguguuucuuc

SEQ ID NO: 74862 - RNA, 20 nt, Artificial Sequence
  MKO10074862_B_C1qtnf1
  gRNA
gagccuugugccacgaguuc

SEQ ID NO: 74863 - RNA, 20 nt, Artificial Sequence
  MKO10074863_B_C1qtnf2
  gRNA
ggcacaggccaagaguaccc

SEQ ID NO: 74864 - RNA, 20 nt, Artificial Sequence
  MKO10074864_B_C1qtnf2
  gRNA
ggccacuacaacgcguccag

SEQ ID NO: 74865 - RNA, 20 nt, Artificial Sequence
  MKO10074865_B_C1qtnf2
  gRNA
cggcaguagccgagccaagu

SEQ ID NO: 74866 - RNA, 20 nt, Artificial Sequence
  MKO10074866_B_C1qtnf3
  gRNA
ugcugcccccguucuccucg

SEQ ID NO: 74867 - RNA, 20 nt, Artificial Sequence
  MKO10074867_B_C1qtnf3
  gRNA
gggugguuuaccugcaguuc

SEQ ID NO: 74868 - RNA, 20 nt, Artificial Sequence
  MKO10074868_B_C1qtnf3
  gRNA
cacgaaauccauaaucucca

SEQ ID NO: 74869 - RNA, 20 nt, Artificial Sequence
  MKO10074869_B_C1qtnf4
  gRNA
ggcgcgccgagcgcguacug

SEQ ID NO: 74870 - RNA, 20 nt, Artificial Sequence
  MKO10074870_B_C1qtnf4
  gRNA
uggcuuucgacgagcagcga

SEQ ID NO: 74871 - RNA, 20 nt, Artificial Sequence
  MKO10074871_B_C1qtnf4
  gRNA
cuacuuagccacgaucacga

SEQ ID NO: 74872 - RNA, 20 nt, Artificial Sequence
  MKO10074872_B_C1qtnf5
  gRNA
gguaccgagcacucccccgc

SEQ ID NO: 74873 - RNA, 20 nt, Artificial Sequence
  MKO10074873_B_C1qtnf5
  gRNA
gggaucuuguugucguccag

SEQ ID NO: 74874 - RNA, 20 nt, Artificial Sequence
  MKO10074874_B_C1qtnf5
  gRNA
uacccggcucucggaucgcu

SEQ ID NO: 74875 - RNA, 20 nt, Artificial Sequence
  MKO10074875_B_C1qtnf6
  gRNA
uucaagcgggagcgggaaaa

SEQ ID NO: 74876 - RNA, 20 nt, Artificial Sequence
  MKO10074876_B_C1qtnf6
  gRNA
ugaagaaguagaggccgcgc

SEQ ID NO: 74877 - RNA, 20 nt, Artificial Sequence
  MKO10074877_B_C1qtnf6
  gRNA
aguuccagcuguguacguug

SEQ ID NO: 74878 - RNA, 20 nt, Artificial Sequence
  MKO10074878_B_C1qtnf7
  gRNA
accucgggccaaucaggcua

SEQ ID NO: 74879 - RNA, 20 nt, Artificial Sequence
  MKO10074879_B_C1qtnf7
  gRNA
aacccagcaaugcccaggaa

SEQ ID NO: 74880 - RNA, 20 nt, Artificial Sequence
  MKO10074880_B_C1qtnf7
  gRNA
aaguucauuugcgcuuuccc

SEQ ID NO: 74881 - RNA, 20 nt, Artificial Sequence
  MKO10074881_B_C1qtnf9
  gRNA
gccggagugcccuugccggc

SEQ ID NO: 74882 - RNA, 20 nt, Artificial Sequence
  MKO10074882_B_C1qtnf9
  gRNA
ccaggaaaggauggaauucg

SEQ ID NO: 74883 - RNA, 20 nt, Artificial Sequence
  MKO10074883_B_C1qtnf9
  gRNA
ccacgaauuccauccuuucc

SEQ ID NO: 74884 - RNA, 20 nt, Artificial Sequence
  MKO10074884_B_C1ra
  gRNA
uucugcugauaagcaaacac

SEQ ID NO: 74885 - RNA, 20 nt, Artificial Sequence
  MKO10074885_B_C1ra
  gRNA
ucuuucugaagcucauagcc

SEQ ID NO: 74886 - RNA, 20 nt, Artificial Sequence
  MKO10074886_B_C1ra
  gRNA
ugcaucgcagcccaacucag

SEQ ID NO: 74887 - RNA, 20 nt, Artificial Sequence
  MKO10074887_B_C1rb
  gRNA
uucugcugauaagcaaacac

SEQ ID NO: 74888 - RNA, 20 nt, Artificial Sequence
  MKO10074888_B_C1rb
  gRNA
ucuuucugaagcucauagcc

SEQ ID NO: 74889 - RNA, 20 nt, Artificial Sequence
  MKO10074889_B_C1rb
  gRNA
ugcaucgcagcccaacucag

SEQ ID NO: 74890 - RNA, 20 nt, Artificial Sequence
  MKO10074890_B_C1rl
  gRNA
cucuuucagauuucaacugg

SEQ ID NO: 74891 - RNA, 20 nt, Artificial Sequence
  MKO10074891_B_C1rl
  gRNA
aaccuugccgcccacacagc

SEQ ID NO: 74892 - RNA, 20 nt, Artificial Sequence
  MKO10074892_B_C1rl
  gRNA
gaccuuccaggacuuugauc

SEQ ID NO: 74893 - RNA, 20 nt, Artificial Sequence
  MKO10074893_B_C1s
  gRNA
ccuguccccuaauuaucccc

SEQ ID NO: 74894 - RNA, 20 nt, Artificial Sequence
  MKO10074894_B_C1s
  gRNA
acuuccuccacgaugacaug

SEQ ID NO: 74895 - RNA, 20 nt, Artificial Sequence
  MKO10074895_B_C1s
  gRNA
ugaauaccagauucagcugc

SEQ ID NO: 74896 - RNA, 20 nt, Artificial Sequence
  MKO10074896_B_C230052I12Rik
  gRNA
ggucuagcacaguaaacuuc

SEQ ID NO: 74897 - RNA, 20 nt, Artificial Sequence
  MKO10074897_B_C230052I12Rik
  gRNA
gaaugcaagauuugcuagac

SEQ ID NO: 74898 - RNA, 20 nt, Artificial Sequence
  MKO10074898_B_C230052I12Rik
  gRNA
ucgcuuaggcugggugaaga

SEQ ID NO: 74899 - RNA, 20 nt, Artificial Sequence
  MKO10074899_B_C2cd2l
  gRNA
ugaccaaucagagcgcacca

SEQ ID NO: 74900 - RNA, 20 nt, Artificial Sequence
  MKO10074900_B_C2cd2l
  gRNA
cagcacucagcccgccauga

SEQ ID NO: 74901 - RNA, 20 nt, Artificial Sequence
  MKO10074901_B_C2cd2l
  gRNA
ccgcccagaacucagccuaa

SEQ ID NO: 74902 - RNA, 20 nt, Artificial Sequence
  MKO10074902_B_C2cd2
  gRNA
aaagauggacaucauacagc

SEQ ID NO: 74903 - RNA, 20 nt, Artificial Sequence
  MKO10074903_B_C2cd2
  gRNA
cugagcuucuuugaccugcg

SEQ ID NO: 74904 - RNA, 20 nt, Artificial Sequence
  MKO10074904_B_C2cd2
  gRNA
cucauagguagaauuccaca

SEQ ID NO: 74905 - RNA, 20 nt, Artificial Sequence
  MKO10074905_B_C2cd3
  gRNA
ucuccaaguuucuucgaugc

SEQ ID NO: 74906 - RNA, 20 nt, Artificial Sequence
  MKO10074906_B_C2cd3
  gRNA
gaucauagacuggguguugc

SEQ ID NO: 74907 - RNA, 20 nt, Artificial Sequence
  MKO10074907_B_C2cd3
  gRNA
caaagaacccuuuacugcau

SEQ ID NO: 74908 - RNA, 20 nt, Artificial Sequence
  MKO10074908_B_C2cd4a
  gRNA
cgcgcgcuggccagacgucg

SEQ ID NO: 74909 - RNA, 20 nt, Artificial Sequence
  MKO10074909_B_C2cd4a
  gRNA
cggcucuugcgggaccgaga

SEQ ID NO: 74910 - RNA, 20 nt, Artificial Sequence
  MKO10074910_B_C2cd4a
  gRNA
agcgcgcgccccccgugccg

SEQ ID NO: 74911 - RNA, 20 nt, Artificial Sequence
  MKO10074911_B_C2cd4b
  gRNA
gcuggagcgcggacgaccgc

SEQ ID NO: 74912 - RNA, 20 nt, Artificial Sequence
  MKO10074912_B_C2cd4b
  gRNA
aggcggcgcauacggggcac

SEQ ID NO: 74913 - RNA, 20 nt, Artificial Sequence
  MKO10074913_B_C2cd4b
  gRNA
ucgagagcccgcacacgcgc

SEQ ID NO: 74914 - RNA, 20 nt, Artificial Sequence
  MKO10074914_B_C2cd4c
  gRNA
uaucugaaucacaugucgug

SEQ ID NO: 74915 - RNA, 20 nt, Artificial Sequence
  MKO10074915_B_C2cd4c
  gRNA
caucacagggccggucauac

SEQ ID NO: 74916 - RNA, 20 nt, Artificial Sequence
  MKO10074916_B_C2cd4c
  gRNA
ugcuggccgccggcgagcag

SEQ ID NO: 74917 - RNA, 20 nt, Artificial Sequence
  MKO10074917_B_C2cd4d
  gRNA
ugcgguccguacccuauaac

SEQ ID NO: 74918 - RNA, 20 nt, Artificial Sequence
  MKO10074918_B_C2cd4d
  gRNA
gacucgcggcgacgcgugug

SEQ ID NO: 74919 - RNA, 20 nt, Artificial Sequence
  MKO10074919_B_C2cd4d
  gRNA
ugagcuccaggccuaacgcg

SEQ ID NO: 74920 - RNA, 20 nt, Artificial Sequence
  MKO10074920_B_C2cd5
  gRNA
gguggacgaugaagauuuac

SEQ ID NO: 74921 - RNA, 20 nt, Artificial Sequence
  MKO10074921_B_C2cd5
  gRNA
uguggccggucgccauuugc

SEQ ID NO: 74922 - RNA, 20 nt, Artificial Sequence
  MKO10074922_B_C2cd5
  gRNA
accuguuugaaucauugaag

SEQ ID NO: 74923 - RNA, 20 nt, Artificial Sequence
  MKO10074923_B_C2
  gRNA
gacugcuuuaaccauccgag

SEQ ID NO: 74924 - RNA, 20 nt, Artificial Sequence
  MKO10074924_B_C2
  gRNA
gcugagggugaaauuaccac

SEQ ID NO: 74925 - RNA, 20 nt, Artificial Sequence
  MKO10074925_B_C2
  gRNA
ucagugggcacagcucggac

SEQ ID NO: 74926 - RNA, 20 nt, Artificial Sequence
  MKO10074926_B_C330006A16Rik
  gRNA
gcgcggccagcgcgccccaa

SEQ ID NO: 74927 - RNA, 20 nt, Artificial Sequence
  MKO10074927_B_C330006A16Rik
  gRNA
ugaucuugcuccguaaauug

SEQ ID NO: 74928 - RNA, 20 nt, Artificial Sequence
  MKO10074928_B_C330006A16Rik
  gRNA
aauuuacggagcaagaucag

SEQ ID NO: 74929 - RNA, 20 nt, Artificial Sequence
  MKO10074929_B_C330007P06Rik
  gRNA
acaaaacuugugagcauguu

SEQ ID NO: 74930 - RNA, 20 nt, Artificial Sequence
  MKO10074930_B_C330007P06Rik
  gRNA
agggcauugaacgucaguac

SEQ ID NO: 74931 - RNA, 20 nt, Artificial Sequence
  MKO10074931_B_C330007P06Rik
  gRNA
uacugacguucaaugcccuc

SEQ ID NO: 74932 - RNA, 20 nt, Artificial Sequence
  MKO10074932_B_C330018D20Rik
  gRNA
cuuugguaccuuugugaaua

SEQ ID NO: 74933 - RNA, 20 nt, Artificial Sequence
  MKO10074933_B_C330018D20Rik
  gRNA
ucuuuagcuucaucacacag

SEQ ID NO: 74934 - RNA, 20 nt, Artificial Sequence
  MKO10074934_B_C330018D20Rik
  gRNA
cagauugccaaauccuccuu

SEQ ID NO: 74935 - RNA, 20 nt, Artificial Sequence
  MKO10074935_B_C330021F23Rik
  gRNA
ugaggaaaaugaugaaguuc

SEQ ID NO: 74936 - RNA, 20 nt, Artificial Sequence
  MKO10074936_B_C330021F23Rik
  gRNA
uauuccuggaguccgcuuua

SEQ ID NO: 74937 - RNA, 20 nt, Artificial Sequence
  MKO10074937_B_C330021F23Rik
  gRNA
aguagccaauguuucucugu

SEQ ID NO: 74938 - RNA, 20 nt, Artificial Sequence
  MKO10074938_B_C330027C09Rik
  gRNA
uaucaguuugcugucucaac

SEQ ID NO: 74939 - RNA, 20 nt, Artificial Sequence
  MKO10074939_B_C330027C09Rik
  gRNA
aucagugaagcacuuauguu

SEQ ID NO: 74940 - RNA, 20 nt, Artificial Sequence
  MKO10074940_B_C330027C09Rik
  gRNA
agugcauucaacugcugcaa

SEQ ID NO: 74941 - RNA, 20 nt, Artificial Sequence
  MKO10074941_B_C3ar1
  gRNA
uucgcauucugaagacgaug

SEQ ID NO: 74942 - RNA, 20 nt, Artificial Sequence
  MKO10074942_B_C3ar1
  gRNA
aucuucaacaggaaacccgc

SEQ ID NO: 74943 - RNA, 20 nt, Artificial Sequence
  MKO10074943_B_C3ar1
  gRNA
guuccgagacuuggugaagu

SEQ ID NO: 74944 - RNA, 20 nt, Artificial Sequence
  MKO10074944_B_C3
  gRNA
gacagucgucauccucauug

SEQ ID NO: 74945 - RNA, 20 nt, Artificial Sequence
  MKO10074945_B_C3
  gRNA
cugugcaagacuuccuaaag

SEQ ID NO: 74946 - RNA, 20 nt, Artificial Sequence
  MKO10074946_B_C3
  gRNA
cgcauagauuccagccagua

SEQ ID NO: 74947 - RNA, 20 nt, Artificial Sequence
  MKO10074947_B_C4a
  gRNA
uugcucuacucuucccgacg

SEQ ID NO: 74948 - RNA, 20 nt, Artificial Sequence
  MKO10074948_B_C4a
  gRNA
cagagcccccuacauccagc

SEQ ID NO: 74949 - RNA, 20 nt, Artificial Sequence
  MKO10074949_B_C4a
  gRNA
uccuucucuuaguucguuau

SEQ ID NO: 74950 - RNA, 20 nt, Artificial Sequence
  MKO10074950_B_C4bp
  gRNA
cucguuggcagccccuucau

SEQ ID NO: 74951 - RNA, 20 nt, Artificial Sequence
  MKO10074951_B_C4bp
  gRNA
cucauccacuaguucuugug

SEQ ID NO: 74952 - RNA, 20 nt, Artificial Sequence
  MKO10074952_B_C4bp
  gRNA
uccgaggcaaaggaguugcc

SEQ ID NO: 74953 - RNA, 20 nt, Artificial Sequence
  MKO10074953_B_C4b
  gRNA
cagagccccccacauccagc

SEQ ID NO: 74954 - RNA, 20 nt, Artificial Sequence
  MKO10074954_B_C4b
  gRNA
ggugaaggcaucuuggaaga

SEQ ID NO: 74955 - RNA, 20 nt, Artificial Sequence
  MKO10074955_B_C4b
  gRNA
ccuucucuuaguucguuauc

SEQ ID NO: 74956 - RNA, 20 nt, Artificial Sequence
  MKO10074956_B_C530008M17Rik
  gRNA
acuguuguccagacgagcga

SEQ ID NO: 74957 - RNA, 20 nt, Artificial Sequence
  MKO10074957_B_C530008M17Rik
  gRNA
ccucugaaucuaccugaagc

SEQ ID NO: 74958 - RNA, 20 nt, Artificial Sequence
  MKO10074958_B_C530008M17Rik
  gRNA
gaacgccauucccaugaaga

SEQ ID NO: 74959 - RNA, 20 nt, Artificial Sequence
  MKO10074959_B_C5ar1
  gRNA
ggccgaccuccucucgugcu

SEQ ID NO: 74960 - RNA, 20 nt, Artificial Sequence
  MKO10074960_B_C5ar1
  gRNA
uagugccgaccguuuccugc

SEQ ID NO: 74961 - RNA, 20 nt, Artificial Sequence
  MKO10074961_B_C5ar1
  gRNA
cauacgaaacgcucucucug

SEQ ID NO: 74962 - RNA, 20 nt, Artificial Sequence
  MKO10074962_B_C5ar2
  gRNA
gucuucugggaugaaauaug

SEQ ID NO: 74963 - RNA, 20 nt, Artificial Sequence
  MKO10074963_B_C5ar2
  gRNA
gggcagucuacgggcacguc

SEQ ID NO: 74964 - RNA, 20 nt, Artificial Sequence
  MKO10074964_B_C5ar2
  gRNA
cucauagucauaauacucgc

SEQ ID NO: 74965 - RNA, 20 nt, Artificial Sequence
  MKO10074965_B_C6
  gRNA
gguugccccccaaacugacu

SEQ ID NO: 74966 - RNA, 20 nt, Artificial Sequence
  MKO10074966_B_C6
  gRNA
uccauugcauucuaacuugc

SEQ ID NO: 74967 - RNA, 20 nt, Artificial Sequence
  MKO10074967_B_C6
  gRNA
guccugcgcccaagucaguu

SEQ ID NO: 74968 - RNA, 20 nt, Artificial Sequence
  MKO10074968_B_C77080
  gRNA
agcgaaggagcacggugcug

SEQ ID NO: 74969 - RNA, 20 nt, Artificial Sequence
  MKO10074969_B_C77080
  gRNA
aaaugagucauggggucuga

SEQ ID NO: 74970 - RNA, 20 nt, Artificial Sequence
  MKO10074970_B_C77080
  gRNA
ggcugggcccugcgcccuga

SEQ ID NO: 74971 - RNA, 20 nt, Artificial Sequence
  MKO10074971_B_C77370
  gRNA
aaucagauuguugucuccau

SEQ ID NO: 74972 - RNA, 20 nt, Artificial Sequence
  MKO10074972_B_C77370
  gRNA
acaaacaucaaaugucuuuc

SEQ ID NO: 74973 - RNA, 20 nt, Artificial Sequence
  MKO10074973_B_C77370
  gRNA
ugagucucuucuucaaacac

SEQ ID NO: 74974 - RNA, 20 nt, Artificial Sequence
  MKO10074974_B_C78339
  gRNA
acagccuaugacauuguagc

SEQ ID NO: 74975 - RNA, 20 nt, Artificial Sequence
  MKO10074975_B_C78339
  gRNA
uugagcaucaugcaucucag

SEQ ID NO: 74976 - RNA, 20 nt, Artificial Sequence
  MKO10074976_B_C78339
  gRNA
gauugaugaagacacaucaa

SEQ ID NO: 74977 - RNA, 20 nt, Artificial Sequence
  MKO10074977_B_C7
  gRNA
caauccugcaaaccugaacg

SEQ ID NO: 74978 - RNA, 20 nt, Artificial Sequence
  MKO10074978_B_C7
  gRNA
aggaggcuuaucaauguugc

SEQ ID NO: 74979 - RNA, 20 nt, Artificial Sequence
  MKO10074979_B_C7
  gRNA
gagucccacuugcaguugac

SEQ ID NO: 74980 - RNA, 20 nt, Artificial Sequence
  MKO10074980_B_C86695
  gRNA
uuacagccaaguugaccugc

SEQ ID NO: 74981 - RNA, 20 nt, Artificial Sequence
  MKO10074981_B_C86695
  gRNA
uguuccagcucaaacagccc

SEQ ID NO: 74982 - RNA, 20 nt, Artificial Sequence
  MKO10074982_B_C86695
  gRNA
gacugaguuucuguagacca

SEQ ID NO: 74983 - RNA, 20 nt, Artificial Sequence
  MKO10074983_B_C87414
  gRNA
ugagcugaguacauugacug

SEQ ID NO: 74984 - RNA, 20 nt, Artificial Sequence
  MKO10074984_B_C87414
  gRNA
gcauuuguuauauugauaau

SEQ ID NO: 74985 - RNA, 20 nt, Artificial Sequence
  MKO10074985_B_C87414
  gRNA
ccacaggagggcaaaacuuc

SEQ ID NO: 74986 - RNA, 20 nt, Artificial Sequence
  MKO10074986_B_C87436
  gRNA
accaucaaacugauagugca

SEQ ID NO: 74987 - RNA, 20 nt, Artificial Sequence
  MKO10074987_B_C87436
  gRNA
augcaguaaacagcaaucua

SEQ ID NO: 74988 - RNA, 20 nt, Artificial Sequence
  MKO10074988_B_C87436
  gRNA
cuguggucagcuguuagaug

SEQ ID NO: 74989 - RNA, 20 nt, Artificial Sequence
  MKO10074989_B_C87499
  gRNA
gacuuaccugaucgggacac

SEQ ID NO: 74990 - RNA, 20 nt, Artificial Sequence
  MKO10074990_B_C87499
  gRNA
gauuucuaugaaugcgucuu

SEQ ID NO: 74991 - RNA, 20 nt, Artificial Sequence
  MKO10074991_B_C87499
  gRNA
agcuggagcuaaguuguauc

SEQ ID NO: 74992 - RNA, 20 nt, Artificial Sequence
  MKO10074992_B_C87977
  gRNA
gacugaaguucuucucauga

SEQ ID NO: 74993 - RNA, 20 nt, Artificial Sequence
  MKO10074993_B_C87977
  gRNA
cuggaggguggguggagaau

SEQ ID NO: 74994 - RNA, 20 nt, Artificial Sequence
  MKO10074994_B_C87977
  gRNA
ugaaggccaugauaccugcg

SEQ ID NO: 74995 - RNA, 20 nt, Artificial Sequence
  MKO10074995_B_C8a
  gRNA
guuuacgaugcuaaguauua

SEQ ID NO: 74996 - RNA, 20 nt, Artificial Sequence
  MKO10074996_B_C8a
  gRNA
ccaucugcaguggugauauc

SEQ ID NO: 74997 - RNA, 20 nt, Artificial Sequence
  MKO10074997_B_C8a
  gRNA
uguccugucaguugagugac

SEQ ID NO: 74998 - RNA, 20 nt, Artificial Sequence
  MKO10074998_B_C8b
  gRNA
auugugugacuuguccgaca

SEQ ID NO: 74999 - RNA, 20 nt, Artificial Sequence
  MKO10074999_B_C8b
  gRNA
agcaguacugggcaauugac

SEQ ID NO: 75000 - RNA, 20 nt, Artificial Sequence
  MKO10075000_B_C8b
  gRNA
acaucguacuugacuccugc

SEQ ID NO: 75001 - RNA, 20 nt, Artificial Sequence
  MKO10075001_B_C8g
  gRNA
cgccaacucuuugagaacac

SEQ ID NO: 75002 - RNA, 20 nt, Artificial Sequence
  MKO10075002_B_C8g
  gRNA
cucuucgugccgcuuucuuc

SEQ ID NO: 75003 - RNA, 20 nt, Artificial Sequence
  MKO10075003_B_C8g
  gRNA
ugggacucacagcuuucgga

SEQ ID NO: 75004 - RNA, 20 nt, Artificial Sequence
  MKO10075004_B_C920025E04Rik
  gRNA
gcuccauacauaccuacagc

SEQ ID NO: 75005 - RNA, 20 nt, Artificial Sequence
  MKO10075005_B_C920025E04Rik
  gRNA
aacagcaaugauuaccaugu

SEQ ID NO: 75006 - RNA, 20 nt, Artificial Sequence
  MKO10075006_B_C920025E04Rik
  gRNA
acauggaguuuguggagacc

SEQ ID NO: 75007 - RNA, 20 nt, Artificial Sequence
  MKO10075007_B_C9
  gRNA
agacauacuaucgcaaaccu

SEQ ID NO: 75008 - RNA, 20 nt, Artificial Sequence
  MKO10075008_B_C9
  gRNA
gcucugauucuuccgcuacu

SEQ ID NO: 75009 - RNA, 20 nt, Artificial Sequence
  MKO10075009_B_C9
  gRNA
gugauccuugccucaaacaa

SEQ ID NO: 75010 - RNA, 20 nt, Artificial Sequence
  MKO10075010_B_CK137956
  gRNA
ugucgggaguagcaccccag

SEQ ID NO: 75011 - RNA, 20 nt, Artificial Sequence
  MKO10075011_B_CK137956
  gRNA
cagcccguccauauccacuu

SEQ ID NO: 75012 - RNA, 20 nt, Artificial Sequence
  MKO10075012_B_CK137956
  gRNA
aaagaggcucucucgacuuu

SEQ ID NO: 75013 - RNA, 20 nt, Artificial Sequence
  MKO10075013_B_Caap1
  gRNA
gaaaguaccuucaguacauc

SEQ ID NO: 75014 - RNA, 20 nt, Artificial Sequence
  MKO10075014_B_Caap1
  gRNA
acaaaucuugaagauucuug

SEQ ID NO: 75015 - RNA, 20 nt, Artificial Sequence
  MKO10075015_B_Caap1
  gRNA
acuuacugacugauuaaauc

SEQ ID NO: 75016 - RNA, 20 nt, Artificial Sequence
  MKO10075016_B_Cab39l
  gRNA
ugguuacuaggcuucagaag

SEQ ID NO: 75017 - RNA, 20 nt, Artificial Sequence
  MKO10075017_B_Cab39l
  gRNA
gaacugauguacucgacagu

SEQ ID NO: 75018 - RNA, 20 nt, Artificial Sequence
  MKO10075018_B_Cab39l
  gRNA
ugcuaccaauacuuuauguc

SEQ ID NO: 75019 - RNA, 20 nt, Artificial Sequence
  MKO10075019_B_Cab39
  gRNA
agaugcauuugcuacauuca

SEQ ID NO: 75020 - RNA, 20 nt, Artificial Sequence
  MKO10075020_B_Cab39
  gRNA
gugcagauguauucaacagu

SEQ ID NO: 75021 - RNA, 20 nt, Artificial Sequence
  MKO10075021_B_Cab39
  gRNA
ccacaauuaagagcuauuuc

SEQ ID NO: 75022 - RNA, 20 nt, Artificial Sequence
  MKO10075022_B_Cabin1
  gRNA
cggucuccagguccucucgc

SEQ ID NO: 75023 - RNA, 20 nt, Artificial Sequence
  MKO10075023_B_Cabin1
  gRNA
aaaugccagcuccacgauug

SEQ ID NO: 75024 - RNA, 20 nt, Artificial Sequence
  MKO10075024_B_Cabin1
  gRNA
agugccucaccucccgcagc

SEQ ID NO: 75025 - RNA, 20 nt, Artificial Sequence
  MKO10075025_B_Cables1
  gRNA
cgacagcacgauaccaagaa

SEQ ID NO: 75026 - RNA, 20 nt, Artificial Sequence
  MKO10075026_B_Cables1
  gRNA
cacccaguuccacaccuuca

SEQ ID NO: 75027 - RNA, 20 nt, Artificial Sequence
  MKO10075027_B_Cables1
  gRNA
ggaaaacuuaccuccggaga

SEQ ID NO: 75028 - RNA, 20 nt, Artificial Sequence
  MKO10075028_B_Cables2
  gRNA
acauugcagugaccugaggg

SEQ ID NO: 75029 - RNA, 20 nt, Artificial Sequence
  MKO10075029_B_Cables2
  gRNA
uacagaaccaagcaugcauc

SEQ ID NO: 75030 - RNA, 20 nt, Artificial Sequence
  MKO10075030_B_Cables2
  gRNA
cccacuucaucaagaacaug

SEQ ID NO: 75031 - RNA, 20 nt, Artificial Sequence
  MKO10075031_B_Cabp1
  gRNA
uuacaucaacugccgggacc

SEQ ID NO: 75032 - RNA, 20 nt, Artificial Sequence
  MKO10075032_B_Cabp1
  gRNA
gcggauggcggcgagcucca

SEQ ID NO: 75033 - RNA, 20 nt, Artificial Sequence
  MKO10075033_B_Cabp1
  gRNA
cccuaaacuccuggcggaga

SEQ ID NO: 75034 - RNA, 20 nt, Artificial Sequence
  MKO10075034_B_Cabp2
  gRNA
gggagcuucgagacgccuuc

SEQ ID NO: 75035 - RNA, 20 nt, Artificial Sequence
  MKO10075035_B_Cabp2
  gRNA
cuaccacaguucgacaccaa

SEQ ID NO: 75036 - RNA, 20 nt, Artificial Sequence
  MKO10075036_B_Cabp2
  gRNA
ccauuaccuucgaucucuuc

SEQ ID NO: 75037 - RNA, 20 nt, Artificial Sequence
  MKO10075037_B_Cabp4
  gRNA
ugacucaccgucaaagucua

SEQ ID NO: 75038 - RNA, 20 nt, Artificial Sequence
  MKO10075038_B_Cabp4
  gRNA
gcgagcuaggugacugcaug

SEQ ID NO: 75039 - RNA, 20 nt, Artificial Sequence
  MKO10075039_B_Cabp4
  gRNA
gauggcaccauagacuuuga

SEQ ID NO: 75040 - RNA, 20 nt, Artificial Sequence
  MKO10075040_B_Cabp5
  gRNA
gauugcugaggugguacagg

SEQ ID NO: 75041 - RNA, 20 nt, Artificial Sequence
  MKO10075041_B_Cabp5
  gRNA
ugcugucucugcaagcaauu

SEQ ID NO: 75042 - RNA, 20 nt, Artificial Sequence
  MKO10075042_B_Cabp5
  gRNA
ugggggagaagcucacaccc

SEQ ID NO: 75043 - RNA, 20 nt, Artificial Sequence
  MKO10075043_B_Cabp7
  gRNA
ucuugcgcacacacgucugg

SEQ ID NO: 75044 - RNA, 20 nt, Artificial Sequence
  MKO10075044_B_Cabp7
  gRNA
cgauggcgaaggcgcagauc

SEQ ID NO: 75045 - RNA, 20 nt, Artificial Sequence
  MKO10075045_B_Cabp7
  gRNA
cugcgagcacuuguccauga

SEQ ID NO: 75046 - RNA, 20 nt, Artificial Sequence
  MKO10075046_B_Cabs1
  gRNA
agucccccccucaacugaaa

SEQ ID NO: 75047 - RNA, 20 nt, Artificial Sequence
  MKO10075047_B_Cabs1
  gRNA
gggcgauccaucuucagcca

SEQ ID NO: 75048 - RNA, 20 nt, Artificial Sequence
  MKO10075048_B_Cabs1
  gRNA
gacuuaucuaccaccaacuc

SEQ ID NO: 75049 - RNA, 20 nt, Artificial Sequence
  MKO10075049_B_Cabyr
  gRNA
ccauaggguacaacaagucu

SEQ ID NO: 75050 - RNA, 20 nt, Artificial Sequence
  MKO10075050_B_Cabyr
  gRNA
cccagacuuguuguacccua

SEQ ID NO: 75051 - RNA, 20 nt, Artificial Sequence
  MKO10075051_B_Cabyr
  gRNA
gauguagcuaaaaagaguuc

SEQ ID NO: 75052 - RNA, 20 nt, Artificial Sequence
  MKO10075052_B_Cacfd1
  gRNA
acgccagcugcgauguucag

SEQ ID NO: 75053 - RNA, 20 nt, Artificial Sequence
  MKO10075053_B_Cacfd1
  gRNA
cacccucugaacaucgcagc

SEQ ID NO: 75054 - RNA, 20 nt, Artificial Sequence
  MKO10075054_B_Cacfd1
  gRNA
aggcauggugaagccuugcg

SEQ ID NO: 75055 - RNA, 20 nt, Artificial Sequence
  MKO10075055_B_Cachd1
  gRNA
cacaauuccgccuuccauga

SEQ ID NO: 75056 - RNA, 20 nt, Artificial Sequence
  MKO10075056_B_Cachd1
  gRNA
gcucguagcugcccuuacac

SEQ ID NO: 75057 - RNA, 20 nt, Artificial Sequence
  MKO10075057_B_Cachd1
  gRNA
guagaggaucuucaauucgu

SEQ ID NO: 75058 - RNA, 20 nt, Artificial Sequence
  MKO10075058_B_Cacna1a
  gRNA
aguuugaccuacggacacug

SEQ ID NO: 75059 - RNA, 20 nt, Artificial Sequence
  MKO10075059_B_Cacna1a
  gRNA
gacacggaaccauacuucau

SEQ ID NO: 75060 - RNA, 20 nt, Artificial Sequence
  MKO10075060_B_Cacna1a
  gRNA
acuuugucguggugcuaaca

SEQ ID NO: 75061 - RNA, 20 nt, Artificial Sequence
  MKO10075061_B_Cacna1b
  gRNA
gcacagcccucagugugcgc

SEQ ID NO: 75062 - RNA, 20 nt, Artificial Sequence
  MKO10075062_B_Cacna1b
  gRNA
acucacuagucgcucagaca

SEQ ID NO: 75063 - RNA, 20 nt, Artificial Sequence
  MKO10075063_B_Cacna1b
  gRNA
cuggaaugucauggacuucg

SEQ ID NO: 75064 - RNA, 20 nt, Artificial Sequence
  MKO10075064_B_Cacna1c
  gRNA
cccaacgcuuaccuccgcaa

SEQ ID NO: 75065 - RNA, 20 nt, Artificial Sequence
  MKO10075065_B_Cacna1c
  gRNA
gccgcaguggacggagcacg

SEQ ID NO: 75066 - RNA, 20 nt, Artificial Sequence
  MKO10075066_B_Cacna1c
  gRNA
uccgcgugcuccguccacug

SEQ ID NO: 75067 - RNA, 20 nt, Artificial Sequence
  MKO10075067_B_Cacna1d
  gRNA
ccauuccuaacguaagcauu

SEQ ID NO: 75068 - RNA, 20 nt, Artificial Sequence
  MKO10075068_B_Cacna1d
  gRNA
guugguccuucaccagaaau

SEQ ID NO: 75069 - RNA, 20 nt, Artificial Sequence
  MKO10075069_B_Cacna1d
  gRNA
ugcauccuaaugcuuacguu

SEQ ID NO: 75070 - RNA, 20 nt, Artificial Sequence
  MKO10075070_B_Cacna1e
  gRNA
gguccacguggguguugaag

SEQ ID NO: 75071 - RNA, 20 nt, Artificial Sequence
  MKO10075071_B_Cacna1e
  gRNA
cgugcugaagucuaucauga

SEQ ID NO: 75072 - RNA, 20 nt, Artificial Sequence
  MKO10075072_B_Cacna1e
  gRNA
ucuaggguucaucuuccaua

SEQ ID NO: 75073 - RNA, 20 nt, Artificial Sequence
  MKO10075073_B_Cacna1f
  gRNA
acugauaccagcggggcguc

SEQ ID NO: 75074 - RNA, 20 nt, Artificial Sequence
  MKO10075074_B_Cacna1f
  gRNA
uuagggugcuacgaccucua

SEQ ID NO: 75075 - RNA, 20 nt, Artificial Sequence
  MKO10075075_B_Cacna1f
  gRNA
gccaggaggcuucgauguaa

SEQ ID NO: 75076 - RNA, 20 nt, Artificial Sequence
  MKO10075076_B_Cacna1g
  gRNA
guucgagcgagucagcaugc

SEQ ID NO: 75077 - RNA, 20 nt, Artificial Sequence
  MKO10075077_B_Cacna1g
  gRNA
uggagcgggcgccgaggagu

SEQ ID NO: 75078 - RNA, 20 nt, Artificial Sequence
  MKO10075078_B_Cacna1g
  gRNA
gguggugaagauggucgcuu

SEQ ID NO: 75079 - RNA, 20 nt, Artificial Sequence
  MKO10075079_B_Cacna1h
  gRNA
agaugcugcaacguucugaa

SEQ ID NO: 75080 - RNA, 20 nt, Artificial Sequence
  MKO10075080_B_Cacna1h
  gRNA
cagcaugauggaauacucuc

SEQ ID NO: 75081 - RNA, 20 nt, Artificial Sequence
  MKO10075081_B_Cacna1h
  gRNA
guucggccagaaaugcuacc

SEQ ID NO: 75082 - RNA, 20 nt, Artificial Sequence
  MKO10075082_B_Cacna1i
  gRNA
uaggauggucgaguacucuc

SEQ ID NO: 75083 - RNA, 20 nt, Artificial Sequence
  MKO10075083_B_Cacna1i
  gRNA
ucucccaggcaugcggauuc

SEQ ID NO: 75084 - RNA, 20 nt, Artificial Sequence
  MKO10075084_B_Cacna1i
  gRNA
uuuggcaagaagugcuaccu

SEQ ID NO: 75085 - RNA, 20 nt, Artificial Sequence
  MKO10075085_B_Cacna1s
  gRNA
gaacguuccagccacugcgc

SEQ ID NO: 75086 - RNA, 20 nt, Artificial Sequence
  MKO10075086_B_Cacna1s
  gRNA
cuguuccugagauucugccg

SEQ ID NO: 75087 - RNA, 20 nt, Artificial Sequence
  MKO10075087_B_Cacna1s
  gRNA
gcacccccgacaccagccgc

SEQ ID NO: 75088 - RNA, 20 nt, Artificial Sequence
  MKO10075088_B_Cacna2d1
  gRNA
aaccaguuggcgugcauugu

SEQ ID NO: 75089 - RNA, 20 nt, Artificial Sequence
  MKO10075089_B_Cacna2d1
  gRNA
cugcaaaaucuucccuccau

SEQ ID NO: 75090 - RNA, 20 nt, Artificial Sequence
  MKO10075090_B_Cacna2d1
  gRNA
aaguccaagcagcccaccaa

SEQ ID NO: 75091 - RNA, 20 nt, Artificial Sequence
  MKO10075091_B_Cacna2d2
  gRNA
aggcgugcagcagcuccgag

SEQ ID NO: 75092 - RNA, 20 nt, Artificial Sequence
  MKO10075092_B_Cacna2d2
  gRNA
auuuccagaaagcccaucgc

SEQ ID NO: 75093 - RNA, 20 nt, Artificial Sequence
  MKO10075093_B_Cacna2d2
  gRNA
ucuagaucuacaaggacaau

SEQ ID NO: 75094 - RNA, 20 nt, Artificial Sequence
  MKO10075094_B_Cacna2d3
  gRNA
ccaacgaacauguacaacaa

SEQ ID NO: 75095 - RNA, 20 nt, Artificial Sequence
  MKO10075095_B_Cacna2d3
  gRNA
aagacucacccucacugccu

SEQ ID NO: 75096 - RNA, 20 nt, Artificial Sequence
  MKO10075096_B_Cacna2d3
  gRNA
auccaucgcugccaaguacu

SEQ ID NO: 75097 - RNA, 20 nt, Artificial Sequence
  MKO10075097_B_Cacna2d4
  gRNA
cucgacuuuccuccgaagca

SEQ ID NO: 75098 - RNA, 20 nt, Artificial Sequence
  MKO10075098_B_Cacna2d4
  gRNA
ggucacugaccuucugcagc

SEQ ID NO: 75099 - RNA, 20 nt, Artificial Sequence
  MKO10075099_B_Cacna2d4
  gRNA
ucaugaguucaaugcaucuc

SEQ ID NO: 75100 - RNA, 20 nt, Artificial Sequence
  MKO10075100_B_Cacnb1
  gRNA
ggacagccuucgucugcugc

SEQ ID NO: 75101 - RNA, 20 nt, Artificial Sequence
  MKO10075101_B_Cacnb1
  gRNA
uuugcuguucggacaaaugu

SEQ ID NO: 75102 - RNA, 20 nt, Artificial Sequence
  MKO10075102_B_Cacnb1
  gRNA
gcggcucuuaccacuggcag

SEQ ID NO: 75103 - RNA, 20 nt, Artificial Sequence
  MKO10075103_B_Cacnb2
  gRNA
auccgauucagaugugucuu

SEQ ID NO: 75104 - RNA, 20 nt, Artificial Sequence
  MKO10075104_B_Cacnb2
  gRNA
auaggacggcugguuaaaga

SEQ ID NO: 75105 - RNA, 20 nt, Artificial Sequence
  MKO10075105_B_Cacnb2
  gRNA
cucauguucucuaguuugac

SEQ ID NO: 75106 - RNA, 20 nt, Artificial Sequence
  MKO10075106_B_Cacnb3
  gRNA
ggaagacuaccuagagacgg

SEQ ID NO: 75107 - RNA, 20 nt, Artificial Sequence
  MKO10075107_B_Cacnb3
  gRNA
aaccccacaguagcugacau

SEQ ID NO: 75108 - RNA, 20 nt, Artificial Sequence
  MKO10075108_B_Cacnb3
  gRNA
cuacaccagccgccccucuc

SEQ ID NO: 75109 - RNA, 20 nt, Artificial Sequence
  MKO10075109_B_Cacnb4
  gRNA
ccguguucuaggaaaucgag

SEQ ID NO: 75110 - RNA, 20 nt, Artificial Sequence
  MKO10075110_B_Cacnb4
  gRNA
caucccaaguccacugcgcu

SEQ ID NO: 75111 - RNA, 20 nt, Artificial Sequence
  MKO10075111_B_Cacnb4
  gRNA
gguguuacccgccaugaaaa

SEQ ID NO: 75112 - RNA, 20 nt, Artificial Sequence
  MKO10075112_B_Cacng1
  gRNA
accugcgaaggcauaaaaca

SEQ ID NO: 75113 - RNA, 20 nt, Artificial Sequence
  MKO10075113_B_Cacng1
  gRNA
guaaucacgcuuauucccga

SEQ ID NO: 75114 - RNA, 20 nt, Artificial Sequence
  MKO10075114_B_Cacng1
  gRNA
gaugaacgcggcacaugcac

SEQ ID NO: 75115 - RNA, 20 nt, Artificial Sequence
  MKO10075115_B_Cacng2
  gRNA
ccacggucuucauacgggcg

SEQ ID NO: 75116 - RNA, 20 nt, Artificial Sequence
  MKO10075116_B_Cacng2
  gRNA
auuauggggcuguuugaucg

SEQ ID NO: 75117 - RNA, 20 nt, Artificial Sequence
  MKO10075117_B_Cacng2
  gRNA
acucgcucgccgcgaugcag

SEQ ID NO: 75118 - RNA, 20 nt, Artificial Sequence
  MKO10075118_B_Cacng3
  gRNA
guaaguaccuuccaagcagc

SEQ ID NO: 75119 - RNA, 20 nt, Artificial Sequence
  MKO10075119_B_Cacng3
  gRNA
ccagcgaguuccaccgcagc

SEQ ID NO: 75120 - RNA, 20 nt, Artificial Sequence
  MKO10075120_B_Cacng3
  gRNA
cgaagaagaugccagcgcug

SEQ ID NO: 75121 - RNA, 20 nt, Artificial Sequence
  MKO10075121_B_Cacng4
  gRNA
acacccgccacagucccgaa

SEQ ID NO: 75122 - RNA, 20 nt, Artificial Sequence
  MKO10075122_B_Cacng4
  gRNA
ggcucugcaucggcgcuggg

SEQ ID NO: 75123 - RNA, 20 nt, Artificial Sequence
  MKO10075123_B_Cacng4
  gRNA
uggucguaaucauuguccuc

SEQ ID NO: 75124 - RNA, 20 nt, Artificial Sequence
  MKO10075124_B_Cacng5
  gRNA
cgucgcuggagauguccgag

SEQ ID NO: 75125 - RNA, 20 nt, Artificial Sequence
  MKO10075125_B_Cacng5
  gRNA
accuauuucaacuacaagua

SEQ ID NO: 75126 - RNA, 20 nt, Artificial Sequence
  MKO10075126_B_Cacng5
  gRNA
gagcaucucgucauugaugc

SEQ ID NO: 75127 - RNA, 20 nt, Artificial Sequence
  MKO10075127_B_Cacng6
  gRNA
cccucuugcagagguaaacc

SEQ ID NO: 75128 - RNA, 20 nt, Artificial Sequence
  MKO10075128_B_Cacng6
  gRNA
uuccguaggagcccugcugc

SEQ ID NO: 75129 - RNA, 20 nt, Artificial Sequence
  MKO10075129_B_Cacng6
  gRNA
ugcagagucccugcuccgau

SEQ ID NO: 75130 - RNA, 20 nt, Artificial Sequence
  MKO10075130_B_Cacng7
  gRNA
caguacuuucacuaucgcua

SEQ ID NO: 75131 - RNA, 20 nt, Artificial Sequence
  MKO10075131_B_Cacng7
  gRNA
ucccccagagacagugcgca

SEQ ID NO: 75132 - RNA, 20 nt, Artificial Sequence
  MKO10075132_B_Cacng7
  gRNA
cuucccaccaggucgggaga

SEQ ID NO: 75133 - RNA, 20 nt, Artificial Sequence
  MKO10075133_B_Cacng8
  gRNA
caugaggccaaaagccgcga

SEQ ID NO: 75134 - RNA, 20 nt, Artificial Sequence
  MKO10075134_B_Cacng8
  gRNA
gggcgcagggauccuguucg

SEQ ID NO: 75135 - RNA, 20 nt, Artificial Sequence
  MKO10075135_B_Cacng8
  gRNA
aacuggagucauugaaacgc

SEQ ID NO: 75136 - RNA, 20 nt, Artificial Sequence
  MKO10075136_B_Cacuin
  gRNA
gcucgugcaucuccaccgcc

SEQ ID NO: 75137 - RNA, 20 nt, Artificial Sequence
  MKO10075137_B_Cacuin
  gRNA
gguguacauggaacuagagc

SEQ ID NO: 75138 - RNA, 20 nt, Artificial Sequence
  MKO10075138_B_Cacuin
  gRNA
gauugccaagcuccgcaagc

SEQ ID NO: 75139 - RNA, 20 nt, Artificial Sequence
  MKO10075139_B_Cacul1
  gRNA
aagauuauaagagcacauac

SEQ ID NO: 75140 - RNA, 20 nt, Artificial Sequence
  MKO10075140_B_Cacul1
  gRNA
ccacuuagagcgagucucca

SEQ ID NO: 75141 - RNA, 20 nt, Artificial Sequence
  MKO10075141_B_Cacul1
  gRNA
ugaaagauuuaauauagcuc

SEQ ID NO: 75142 - RNA, 20 nt, Artificial Sequence
  MKO10075142_B_Cacybp
  gRNA
guugcagaaagaccuagaag

SEQ ID NO: 75143 - RNA, 20 nt, Artificial Sequence
  MKO10075143_B_Cacybp
  gRNA
uauugcuggaaaaguccacu

SEQ ID NO: 75144 - RNA, 20 nt, Artificial Sequence
  MKO10075144_B_Cacybp
  gRNA
gaacugcuuuccacagagau

SEQ ID NO: 75145 - RNA, 20 nt, Artificial Sequence
  MKO10075145_B_Cadm1
  gRNA
agucgucacucuuauugacc

SEQ ID NO: 75146 - RNA, 20 nt, Artificial Sequence
  MKO10075146_B_Cadm1
  gRNA
aucccagugugcggcggcag

SEQ ID NO: 75147 - RNA, 20 nt, Artificial Sequence
  MKO10075147_B_Cadm1
  gRNA
ugucuuacccaggacuguga

SEQ ID NO: 75148 - RNA, 20 nt, Artificial Sequence
  MKO10075148_B_Cadm2
  gRNA
cgcgcugcguuuccaaauca

SEQ ID NO: 75149 - RNA, 20 nt, Artificial Sequence
  MKO10075149_B_Cadm2
  gRNA
caugauuuggaaacgcagcg

SEQ ID NO: 75150 - RNA, 20 nt, Artificial Sequence
  MKO10075150_B_Cadm2
  gRNA
aaguacagagucuguugagc

SEQ ID NO: 75151 - RNA, 20 nt, Artificial Sequence
  MKO10075151_B_Cadm3
  gRNA
acuacucaccguggaguucu

SEQ ID NO: 75152 - RNA, 20 nt, Artificial Sequence
  MKO10075152_B_Cadm3
  gRNA
aggggaccaaacacgaaucc

SEQ ID NO: 75153 - RNA, 20 nt, Artificial Sequence
  MKO10075153_B_Cadm3
  gRNA
cucucuucuccccgaaguau

SEQ ID NO: 75154 - RNA, 20 nt, Artificial Sequence
  MKO10075154_B_Cadm4
  gRNA
caagcagacgcaguacgugc

SEQ ID NO: 75155 - RNA, 20 nt, Artificial Sequence
  MKO10075155_B_Cadm4
  gRNA
uggguucugaaugacgacua

SEQ ID NO: 75156 - RNA, 20 nt, Artificial Sequence
  MKO10075156_B_Cadm4
  gRNA
gaaggacgagcgauuccagc

SEQ ID NO: 75157 - RNA, 20 nt, Artificial Sequence
  MKO10075157_B_Cadps2
  gRNA
auuugugcaaacagccgaac

SEQ ID NO: 75158 - RNA, 20 nt, Artificial Sequence
  MKO10075158_B_Cadps2
  gRNA
acuugauggccgccugcagu

SEQ ID NO: 75159 - RNA, 20 nt, Artificial Sequence
  MKO10075159_B_Cadps2
  gRNA
aagccuucugcaaugccguc

SEQ ID NO: 75160 - RNA, 20 nt, Artificial Sequence
  MKO10075160_B_Cadps
  gRNA
ugcuuaccucauaguagcuc

SEQ ID NO: 75161 - RNA, 20 nt, Artificial Sequence
  MKO10075161_B_Cadps
  gRNA
aggcuucaucagcuacgauu

SEQ ID NO: 75162 - RNA, 20 nt, Artificial Sequence
  MKO10075162_B_Cadps
  gRNA
agcccagaucagacgagagc

SEQ ID NO: 75163 - RNA, 20 nt, Artificial Sequence
  MKO10075163_B_Cad
  gRNA
ccacguggcgggacuuguag

SEQ ID NO: 75164 - RNA, 20 nt, Artificial Sequence
  MKO10075164_B_Cad
  gRNA
ccacuacaagucccgccacg

SEQ ID NO: 75165 - RNA, 20 nt, Artificial Sequence
  MKO10075165_B_Cad
  gRNA
gugcuaacguauccucucau

SEQ ID NO: 75166 - RNA, 20 nt, Artificial Sequence
  MKO10075166_B_Cage1
  gRNA
aacuuguucccgcgccagug

SEQ ID NO: 75167 - RNA, 20 nt, Artificial Sequence
  MKO10075167_B_Cage1
  gRNA
ucugaagaaaacuucuccgc

SEQ ID NO: 75168 - RNA, 20 nt, Artificial Sequence
  MKO10075168_B_Cage1
  gRNA
cuuuacaagaagagcgauuc

SEQ ID NO: 75169 - RNA, 20 nt, Artificial Sequence
  MKO10075169_B_Calb1
  gRNA
uucgcgccugcagaagcucc

SEQ ID NO: 75170 - RNA, 20 nt, Artificial Sequence
  MKO10075170_B_Calb1
  gRNA
cuguccauauugauccacaa

SEQ ID NO: 75171 - RNA, 20 nt, Artificial Sequence
  MKO10075171_B_Calb1
  gRNA
uaccuucaugaauuccucgc

SEQ ID NO: 75172 - RNA, 20 nt, Artificial Sequence
  MKO10075172_B_Calb2
  gRNA
cccucauaccuugagcucau

SEQ ID NO: 75173 - RNA, 20 nt, Artificial Sequence
  MKO10075173_B_Calb2
  gRNA
gggcuccagcgcugaguuua

SEQ ID NO: 75174 - RNA, 20 nt, Artificial Sequence
  MKO10075174_B_Calb2
  gRNA
caucgaagccaaugagcuca

SEQ ID NO: 75175 - RNA, 20 nt, Artificial Sequence
  MKO10075175_B_Calca
  gRNA
cguaccucaaaggcacugcc

SEQ ID NO: 75176 - RNA, 20 nt, Artificial Sequence
  MKO10075176_B_Calca
  gRNA
ucagcagaccugccagccga

SEQ ID NO: 75177 - RNA, 20 nt, Artificial Sequence
  MKO10075177_B_Calca
  gRNA
aagccuucggccgccgccgc

SEQ ID NO: 75178 - RNA, 20 nt, Artificial Sequence
  MKO10075178_B_Calcb
  gRNA
caacuuugugcccaccgaug

SEQ ID NO: 75179 - RNA, 20 nt, Artificial Sequence
  MKO10075179_B_Calcb
  gRNA
gcagaccugcugagcagauc

SEQ ID NO: 75180 - RNA, 20 nt, Artificial Sequence
  MKO10075180_B_Calcb
  gRNA
acagagacaucauggacuuu

SEQ ID NO: 75181 - RNA, 20 nt, Artificial Sequence
  MKO10075181_B_Calcoco1
  gRNA
agaccauguggcccguaucc

SEQ ID NO: 75182 - RNA, 20 nt, Artificial Sequence
  MKO10075182_B_Calcoco1
  gRNA
guuccgguaugugaaccgcc

SEQ ID NO: 75183 - RNA, 20 nt, Artificial Sequence
  MKO10075183_B_Calcoco1
  gRNA
ggaugucauccucuaacucc

SEQ ID NO: 75184 - RNA, 20 nt, Artificial Sequence
  MKO10075184_B_Calcoco2
  gRNA
uucagcuuauuaccuuccca

SEQ ID NO: 75185 - RNA, 20 nt, Artificial Sequence
  MKO10075185_B_Calcoco2
  gRNA
gguaggguggaagaccacuc

SEQ ID NO: 75186 - RNA, 20 nt, Artificial Sequence
  MKO10075186_B_Calcoco2
  gRNA
ggagcuuuaccaacaaaacc

SEQ ID NO: 75187 - RNA, 20 nt, Artificial Sequence
  MKO10075187_B_Calcrl
  gRNA
auguuaccagaagaucaugc

SEQ ID NO: 75188 - RNA, 20 nt, Artificial Sequence
  MKO10075188_B_Calcrl
  gRNA
ccugggacggauggcuaugc

SEQ ID NO: 75189 - RNA, 20 nt, Artificial Sequence
  MKO10075189_B_Calcrl
  gRNA
aggcgugaaccaaacagacu

SEQ ID NO: 75190 - RNA, 20 nt, Artificial Sequence
  MKO10075190_B_Calcr
  gRNA
gcacugcccugacuacuucc

SEQ ID NO: 75191 - RNA, 20 nt, Artificial Sequence
  MKO10075191_B_Calcr
  gRNA
acaggaauggcuccugauca

SEQ ID NO: 75192 - RNA, 20 nt, Artificial Sequence
  MKO10075192_B_Calcr
  gRNA
acuuacacucuggaccuccu

SEQ ID NO: 75193 - RNA, 20 nt, Artificial Sequence
  MKO10075193_B_Cald1
  gRNA
gucucucuucucgucuagcc

SEQ ID NO: 75194 - RNA, 20 nt, Artificial Sequence
  MKO10075194_B_Cald1
  gRNA
aggaggcugaucgaaaagcu

SEQ ID NO: 75195 - RNA, 20 nt, Artificial Sequence
  MKO10075195_B_Cald1
  gRNA
aacaaaccgagaaugcuuuc

SEQ ID NO: 75196 - RNA, 20 nt, Artificial Sequence
  MKO10075196_B_Calhm1
  gRNA
uccagaacuugcucgccuac

SEQ ID NO: 75197 - RNA, 20 nt, Artificial Sequence
  MKO10075197_B_Calhm1
  gRNA
ugcgcucaaugucaauguag

SEQ ID NO: 75198 - RNA, 20 nt, Artificial Sequence
  MKO10075198_B_Calhm1
  gRNA
cucucaucgccccugucguc

SEQ ID NO: 75199 - RNA, 20 nt, Artificial Sequence
  MKO10075199_B_Calhm2
  gRNA
cucgccacucagcuaccguc

SEQ ID NO: 75200 - RNA, 20 nt, Artificial Sequence
  MKO10075200_B_Calhm2
  gRNA
uaguuccgggcgggugagca

SEQ ID NO: 75201 - RNA, 20 nt, Artificial Sequence
  MKO10075201_B_Calhm2
  gRNA
gguacuggcacucggcgacu

SEQ ID NO: 75202 - RNA, 20 nt, Artificial Sequence
  MKO10075202_B_Calm1
  gRNA
cgccacgucaugacaaacuu

SEQ ID NO: 75203 - RNA, 20 nt, Artificial Sequence
  MKO10075203_B_Calm1
  gRNA
uagcgaagaagagauccgcg

SEQ ID NO: 75204 - RNA, 20 nt, Artificial Sequence
  MKO10075204_B_Calm1
  gRNA
cccagaguucuugacuauga

SEQ ID NO: 75205 - RNA, 20 nt, Artificial Sequence
  MKO10075205_B_Calm2
  gRNA
guccugcaguucugcuucug

SEQ ID NO: 75206 - RNA, 20 nt, Artificial Sequence
  MKO10075206_B_Calm2
  gRNA
cugacugaagagcagauugc

SEQ ID NO: 75207 - RNA, 20 nt, Artificial Sequence
  MKO10075207_B_Calm2
  gRNA
caaucugcucuucagucagu

SEQ ID NO: 75208 - RNA, 20 nt, Artificial Sequence
  MKO10075208_B_Calm3
  gRNA
guccugcagcuccgccucag

SEQ ID NO: 75209 - RNA, 20 nt, Artificial Sequence
  MKO10075209_B_Calm3
  gRNA
gaugaaggauacagacagcg

SEQ ID NO: 75210 - RNA, 20 nt, Artificial Sequence
  MKO10075210_B_Calm3
  gRNA
caaucuguuccucagucagc

SEQ ID NO: 75211 - RNA, 20 nt, Artificial Sequence
  MKO10075211_B_Calm4
  gRNA
cauaucagcgucgaggaacu

SEQ ID NO: 75212 - RNA, 20 nt, Artificial Sequence
  MKO10075212_B_Calm4
  gRNA
gggcaagaaccucccagaga

SEQ ID NO: 75213 - RNA, 20 nt, Artificial Sequence
  MKO10075213_B_Calm4
  gRNA
caauagguuugacaagaaua

SEQ ID NO: 75214 - RNA, 20 nt, Artificial Sequence
  MKO10075214_B_Calm5
  gRNA
ccucucacaugaggaacuga

SEQ ID NO: 75215 - RNA, 20 nt, Artificial Sequence
  MKO10075215_B_Calm5
  gRNA
gagggcaugauccauguguu

SEQ ID NO: 75216 - RNA, 20 nt, Artificial Sequence
  MKO10075216_B_Calm5
  gRNA
cuacauugagacuguauaca

SEQ ID NO: 75217 - RNA, 20 nt, Artificial Sequence
  MKO10075217_B_Calml3
  gRNA
ggccuuccgaguguucgaca

SEQ ID NO: 75218 - RNA, 20 nt, Artificial Sequence
  MKO10075218_B_Calml3
  gRNA
cgauuugcuccucagucagc

SEQ ID NO: 75219 - RNA, 20 nt, Artificial Sequence
  MKO10075219_B_Calml3
  gRNA
caguaucaccacccaagaau

SEQ ID NO: 75220 - RNA, 20 nt, Artificial Sequence
  MKO10075220_B_Calml4
  gRNA
ccuagacaagaacggagagc

SEQ ID NO: 75221 - RNA, 20 nt, Artificial Sequence
  MKO10075221_B_Calml4
  gRNA
acaucauggcgucugagcug

SEQ ID NO: 75222 - RNA, 20 nt, Artificial Sequence
  MKO10075222_B_Calml4
  gRNA
acaggccaaguuccuuuccc

SEQ ID NO: 75223 - RNA, 20 nt, Artificial Sequence
  MKO10075223_B_Caln1
  gRNA
caugccgagcgaaguggagc

SEQ ID NO: 75224 - RNA, 20 nt, Artificial Sequence
  MKO10075224_B_Caln1
  gRNA
ccguuccaccauguaaccgc

SEQ ID NO: 75225 - RNA, 20 nt, Artificial Sequence
  MKO10075225_B_Caln1
  gRNA
acauccuguaccacgccuuc

SEQ ID NO: 75226 - RNA, 20 nt, Artificial Sequence
  MKO10075226_B_Calr3
  gRNA
gauggccaguccauugaguc

SEQ ID NO: 75227 - RNA, 20 nt, Artificial Sequence
  MKO10075227_B_Calr3
  gRNA
gcacucaccuugcaucugau

SEQ ID NO: 75228 - RNA, 20 nt, Artificial Sequence
  MKO10075228_B_Calr3
  gRNA
caccagaagaugagaccugc

SEQ ID NO: 75229 - RNA, 20 nt, Artificial Sequence
  MKO10075229_B_Calr4
  gRNA
gauaccaaacgucaaguaca

SEQ ID NO: 75230 - RNA, 20 nt, Artificial Sequence
  MKO10075230_B_Calr4
  gRNA
auugcugaauggcuuaaacc

SEQ ID NO: 75231 - RNA, 20 nt, Artificial Sequence
  MKO10075231_B_Calr4
  gRNA
uuaaccucauaaguagcauu

SEQ ID NO: 75232 - RNA, 20 nt, Artificial Sequence
  MKO10075232_B_Calr
  gRNA
gugcguaaaaucgggcaucu

SEQ ID NO: 75233 - RNA, 20 nt, Artificial Sequence
  MKO10075233_B_Calr
  gRNA
gccaaaaucggacuuauguu

SEQ ID NO: 75234 - RNA, 20 nt, Artificial Sequence
  MKO10075234_B_Calr
  gRNA
gccgcacaaucaguguguau

SEQ ID NO: 75235 - RNA, 20 nt, Artificial Sequence
  MKO10075235_B_Calu
  gRNA
agaugagcggagguuuaaaa

SEQ ID NO: 75236 - RNA, 20 nt, Artificial Sequence
  MKO10075236_B_Calu
  gRNA
auugaucuagaggaguacau

SEQ ID NO: 75237 - RNA, 20 nt, Artificial Sequence
  MKO10075237_B_Calu
  gRNA
ggcacauaagaaacugacgc

SEQ ID NO: 75238 - RNA, 20 nt, Artificial Sequence
  MKO10075238_B_Caly
  gRNA
gcugcagccuagcuucacca

SEQ ID NO: 75239 - RNA, 20 nt, Artificial Sequence
  MKO10075239_B_Caly
  gRNA
acccgaaguaggaagccauc

SEQ ID NO: 75240 - RNA, 20 nt, Artificial Sequence
  MKO10075240_B_Caly
  gRNA
gguaaacuggucauaccaga

SEQ ID NO: 75241 - RNA, 20 nt, Artificial Sequence
  MKO10075241_B_Camk1d
  gRNA
agugaagugcaucccgaaga

SEQ ID NO: 75242 - RNA, 20 nt, Artificial Sequence
  MKO10075242_B_Camk1d
  gRNA
aagcccaaaucaccucuacc

SEQ ID NO: 75243 - RNA, 20 nt, Artificial Sequence
  MKO10075243_B_Camk1d
  gRNA
ugccagcacucucauccgcc

SEQ ID NO: 75244 - RNA, 20 nt, Artificial Sequence
  MKO10075244_B_Camk1g
  gRNA
acacagcgaucucauucucu

SEQ ID NO: 75245 - RNA, 20 nt, Artificial Sequence
  MKO10075245_B_Camk1g
  gRNA
cuguguagacaccacgcucu

SEQ ID NO: 75246 - RNA, 20 nt, Artificial Sequence
  MKO10075246_B_Camk1g
  gRNA
augagaucgcuguguugaaa

SEQ ID NO: 75247 - RNA, 20 nt, Artificial Sequence
  MKO10075247_B_Camk1
  gRNA
gaaccugcuguacuacaguc

SEQ ID NO: 75248 - RNA, 20 nt, Artificial Sequence
  MKO10075248_B_Camk1
  gRNA
ugccacauacuuguguaaga

SEQ ID NO: 75249 - RNA, 20 nt, Artificial Sequence
  MKO10075249_B_Camk1
  gRNA
cacucucauagaugucaucc

SEQ ID NO: 75250 - RNA, 20 nt, Artificial Sequence
  MKO10075250_B_Camk2a
  gRNA
uuuggugucuucguccucaa

SEQ ID NO: 75251 - RNA, 20 nt, Artificial Sequence
  MKO10075251_B_Camk2a
  gRNA
gagcaccaacaccaccauug

SEQ ID NO: 75252 - RNA, 20 nt, Artificial Sequence
  MKO10075252_B_Camk2a
  gRNA
caagaagaacgaugguguga

SEQ ID NO: 75253 - RNA, 20 nt, Artificial Sequence
  MKO10075253_B_Camk2b
  gRNA
uacagagcuugacacagcgu

SEQ ID NO: 75254 - RNA, 20 nt, Artificial Sequence
  MKO10075254_B_Camk2b
  gRNA
caauguuggaaugcuucagc

SEQ ID NO: 75255 - RNA, 20 nt, Artificial Sequence
  MKO10075255_B_Camk2b
  gRNA
cugcugaagcauuccaacau

SEQ ID NO: 75256 - RNA, 20 nt, Artificial Sequence
  MKO10075256_B_Camk2d
  gRNA
uuccaggggggcguucucag

SEQ ID NO: 75257 - RNA, 20 nt, Artificial Sequence
  MKO10075257_B_Camk2d
  gRNA
agauguaugaaaaucccuac

SEQ ID NO: 75258 - RNA, 20 nt, Artificial Sequence
  MKO10075258_B_Camk2d
  gRNA
uucaacagaccaucagaaac

SEQ ID NO: 75259 - RNA, 20 nt, Artificial Sequence
  MKO10075259_B_Camk2g
  gRNA
gcacuuacaggucaaacacg

SEQ ID NO: 75260 - RNA, 20 nt, Artificial Sequence
  MKO10075260_B_Camk2g
  gRNA
gucgucggugaagcgggugc

SEQ ID NO: 75261 - RNA, 20 nt, Artificial Sequence
  MKO10075261_B_Camk2g
  gRNA
ucaucagaaacuagaacgag

SEQ ID NO: 75262 - RNA, 20 nt, Artificial Sequence
  MKO10075262_B_Camk2n1
  gRNA
cuuuggggcaguuagacacc

SEQ ID NO: 75263 - RNA, 20 nt, Artificial Sequence
  MKO10075263_B_Camk2n1
  gRNA
cacgucgccgccgucgccgu

SEQ ID NO: 75264 - RNA, 20 nt, Artificial Sequence
  MKO10075264_B_Camk2n1
  gRNA
gcaggcggcacgagaagauc

SEQ ID NO: 75265 - RNA, 20 nt, Artificial Sequence
  MKO10075265_B_Camk2n2
  gRNA
auguccgagauccuacccua

SEQ ID NO: 75266 - RNA, 20 nt, Artificial Sequence
  MKO10075266_B_Camk2n2
  gRNA
ccuucagcacgucgucuauc

SEQ ID NO: 75267 - RNA, 20 nt, Artificial Sequence
  MKO10075267_B_Camk2n2
  gRNA
augggggagaagccuccguc

SEQ ID NO: 75268 - RNA, 20 nt, Artificial Sequence
  MKO10075268_B_Camk4
  gRNA
caggaggagaacuguuugac

SEQ ID NO: 75269 - RNA, 20 nt, Artificial Sequence
  MKO10075269_B_Camk4
  gRNA
cuuuaacacuuugagagcau

SEQ ID NO: 75270 - RNA, 20 nt, Artificial Sequence
  MKO10075270_B_Camk4
  gRNA
uuguccccagauaaaacuca

SEQ ID NO: 75271 - RNA, 20 nt, Artificial Sequence
  MKO10075271_B_Camkk1
  gRNA
ucugcagggugccuauggug

SEQ ID NO: 75272 - RNA, 20 nt, Artificial Sequence
  MKO10075272_B_Camkk1
  gRNA
uacaagcugcagagugagau

SEQ ID NO: 75273 - RNA, 20 nt, Artificial Sequence
  MKO10075273_B_Camkk1
  gRNA
ucucacucugcagcuuguac

SEQ ID NO: 75274 - RNA, 20 nt, Artificial Sequence
  MKO10075274_B_Camkk2
  gRNA
cuccuaugguguugucaagc

SEQ ID NO: 75275 - RNA, 20 nt, Artificial Sequence
  MKO10075275_B_Camkk2
  gRNA
gcugaaucaguacacccuga

SEQ ID NO: 75276 - RNA, 20 nt, Artificial Sequence
  MKO10075276_B_Camkk2
  gRNA
cacgugggaagccagccugu

SEQ ID NO: 75277 - RNA, 20 nt, Artificial Sequence
  MKO10075277_B_Camkmt
  gRNA
gguggcaugacaugcuuggc

SEQ ID NO: 75278 - RNA, 20 nt, Artificial Sequence
  MKO10075278_B_Camkmt
  gRNA
uuccuucgcaggcauaauag

SEQ ID NO: 75279 - RNA, 20 nt, Artificial Sequence
  MKO10075279_B_Camkmt
  gRNA
cuuaccagcuuugacaacac

SEQ ID NO: 75280 - RNA, 20 nt, Artificial Sequence
  MKO10075280_B_Camkv
  gRNA
gaggauuccaaucucguucu

SEQ ID NO: 75281 - RNA, 20 nt, Artificial Sequence
  MKO10075281_B_Camkv
  gRNA
cuguggaaccccggaguauc

SEQ ID NO: 75282 - RNA, 20 nt, Artificial Sequence
  MKO10075282_B_Camkv
  gRNA
agauguguuugugacccgca

SEQ ID NO: 75283 - RNA, 20 nt, Artificial Sequence
  MKO10075283_B_Caml
  gRNA
uucccgcugaggugaucaac

SEQ ID NO: 75284 - RNA, 20 nt, Artificial Sequence
  MKO10075284_B_Caml
  gRNA
ggaccgguugaucaccucag

SEQ ID NO: 75285 - RNA, 20 nt, Artificial Sequence
  MKO10075285_B_Caml
  gRNA
cuucugccacaccaccgagc

SEQ ID NO: 75286 - RNA, 20 nt, Artificial Sequence
  MKO10075286_B_Camp
  gRNA
aagaaaauuucccggcuggc

SEQ ID NO: 75287 - RNA, 20 nt, Artificial Sequence
  MKO10075287_B_Camp
  gRNA
accugagcaaugugccuuca

SEQ ID NO: 75288 - RNA, 20 nt, Artificial Sequence
  MKO10075288_B_Camp
  gRNA
ugggaaccaugcaguuccag

SEQ ID NO: 75289 - RNA, 20 nt, Artificial Sequence
  MKO10075289_B_Camsap1
  gRNA
uuacaucgaccaguaugagc

SEQ ID NO: 75290 - RNA, 20 nt, Artificial Sequence
  MKO10075290_B_Camsap1
  gRNA
aucaacugcagguccguuau

SEQ ID NO: 75291 - RNA, 20 nt, Artificial Sequence
  MKO10075291_B_Camsap1
  gRNA
gaugguggaugcccugauga

SEQ ID NO: 75292 - RNA, 20 nt, Artificial Sequence
  MKO10075292_B_Camsap2
  gRNA
gacagcauccucaauaucau

SEQ ID NO: 75293 - RNA, 20 nt, Artificial Sequence
  MKO10075293_B_Camsap2
  gRNA
caccacccagcugaagcucc

SEQ ID NO: 75294 - RNA, 20 nt, Artificial Sequence
  MKO10075294_B_Camsap2
  gRNA
ugaacacuugaaagacauaa

SEQ ID NO: 75295 - RNA, 20 nt, Artificial Sequence
  MKO10075295_B_Camsap3
  gRNA
ucucugcggaacuauacugu

SEQ ID NO: 75296 - RNA, 20 nt, Artificial Sequence
  MKO10075296_B_Camsap3
  gRNA
cugaccccuagacuguucgg

SEQ ID NO: 75297 - RNA, 20 nt, Artificial Sequence
  MKO10075297_B_Camsap3
  gRNA
ugagagcaucgaugacagcu

SEQ ID NO: 75298 - RNA, 20 nt, Artificial Sequence
  MKO10075298_B_Camua1
  gRNA
aauggcugccgaaaacaagc

SEQ ID NO: 75299 - RNA, 20 nt, Artificial Sequence
  MKO10075299_B_Camua1
  gRNA
gaggaggaggauguggcgcg

SEQ ID NO: 75300 - RNA, 20 nt, Artificial Sequence
  MKO10075300_B_Camua1
  gRNA
uuggguaaacuugaacauuu

SEQ ID NO: 75301 - RNA, 20 nt, Artificial Sequence
  MKO10075301_B_Camua2
  gRNA
ccuuugagaaacacgaugag

SEQ ID NO: 75302 - RNA, 20 nt, Artificial Sequence
  MKO10075302_B_Camua2
  gRNA
cuuccuccccaagaaauugc

SEQ ID NO: 75303 - RNA, 20 nt, Artificial Sequence
  MKO10075303_B_Camua2
  gRNA
aagacacuccagcaauuucu

SEQ ID NO: 75304 - RNA, 20 nt, Artificial Sequence
  MKO10075304_B_Cand1
  gRNA
ucauggcugacauguugagc

SEQ ID NO: 75305 - RNA, 20 nt, Artificial Sequence
  MKO10075305_B_Cand1
  gRNA
agcagcaauacacuguaugu

SEQ ID NO: 75306 - RNA, 20 nt, Artificial Sequence
  MKO10075306_B_Cand1
  gRNA
uucuguucagcucgaagccu

SEQ ID NO: 75307 - RNA, 20 nt, Artificial Sequence
  MKO10075307_B_Cand2
  gRNA
gagcagcuccgggacaucgc

SEQ ID NO: 75308 - RNA, 20 nt, Artificial Sequence
  MKO10075308_B_Cand2
  gRNA
ugaggacagcgagcguaagg

SEQ ID NO: 75309 - RNA, 20 nt, Artificial Sequence
  MKO10075309_B_Cand2
  gRNA
caccagugccaucgcccagc

SEQ ID NO: 75310 - RNA, 20 nt, Artificial Sequence
  MKO10075310_B_Cant1
  gRNA
uguaaugagagaugcgcugc

SEQ ID NO: 75311 - RNA, 20 nt, Artificial Sequence
  MKO10075311_B_Cant1
  gRNA
acccucgcuuccgcccccgc

SEQ ID NO: 75312 - RNA, 20 nt, Artificial Sequence
  MKO10075312_B_Cant1
  gRNA
ugcucucagggcguuguagc

SEQ ID NO: 75313 - RNA, 20 nt, Artificial Sequence
  MKO10075313_B_Canx
  gRNA
gcaaaauaaaccuccccugu

SEQ ID NO: 75314 - RNA, 20 nt, Artificial Sequence
  MKO10075314_B_Canx
  gRNA
ugaacuuacugaacaaugag

SEQ ID NO: 75315 - RNA, 20 nt, Artificial Sequence
  MKO10075315_B_Canx
  gRNA
uuugcugacuccuuugacag

SEQ ID NO: 75316 - RNA, 20 nt, Artificial Sequence
  MKO10075316_B_Cap1
  gRNA
ggagagcucgcuccaacuuc

SEQ ID NO: 75317 - RNA, 20 nt, Artificial Sequence
  MKO10075317_B_Cap1
  gRNA
cccggaagguuauaacuucu

SEQ ID NO: 75318 - RNA, 20 nt, Artificial Sequence
  MKO10075318_B_Cap1
  gRNA
cucgcugcuugccaaucccg

SEQ ID NO: 75319 - RNA, 20 nt, Artificial Sequence
  MKO10075319_B_Cap2
  gRNA
uccugaaagacuacaagcac

SEQ ID NO: 75320 - RNA, 20 nt, Artificial Sequence
  MKO10075320_B_Cap2
  gRNA
gagucucuacgucaccagca

SEQ ID NO: 75321 - RNA, 20 nt, Artificial Sequence
  MKO10075321_B_Cap2
  gRNA
accugugcuuguagucuuuc

SEQ ID NO: 75322 - RNA, 20 nt, Artificial Sequence
  MKO10075322_B_Capg
  gRNA
guuggacuuuccaccacacc

SEQ ID NO: 75323 - RNA, 20 nt, Artificial Sequence
  MKO10075323_B_Capg
  gRNA
cucucucgugcuaugggcac

SEQ ID NO: 75324 - RNA, 20 nt, Artificial Sequence
  MKO10075324_B_Capg
  gRNA
gcucaucccgggaggacugc

SEQ ID NO: 75325 - RNA, 20 nt, Artificial Sequence
  MKO10075325_B_Capn10
  gRNA
auggaacucuccgaguuccc

SEQ ID NO: 75326 - RNA, 20 nt, Artificial Sequence
  MKO10075326_B_Capn10
  gRNA
acaaggcagacgaucaucua

SEQ ID NO: 75327 - RNA, 20 nt, Artificial Sequence
  MKO10075327_B_Capn10
  gRNA
acucuucugaagggcggcac

SEQ ID NO: 75328 - RNA, 20 nt, Artificial Sequence
  MKO10075328_B_Capn11
  gRNA
ccccaaacugcuguaccgug

SEQ ID NO: 75329 - RNA, 20 nt, Artificial Sequence
  MKO10075329_B_Capn11
  gRNA
caccacacgguacagcaguu

SEQ ID NO: 75330 - RNA, 20 nt, Artificial Sequence
  MKO10075330_B_Capn11
  gRNA
ucuaucggugucaagaaccu

SEQ ID NO: 75331 - RNA, 20 nt, Artificial Sequence
  MKO10075331_B_Capn12
  gRNA
agacccccgcguagccaucu

SEQ ID NO: 75332 - RNA, 20 nt, Artificial Sequence
  MKO10075332_B_Capn12
  gRNA
uguucgugcgcucagaacaa

SEQ ID NO: 75333 - RNA, 20 nt, Artificial Sequence
  MKO10075333_B_Capn12
  gRNA
cgacaaacugccugugcgug

SEQ ID NO: 75334 - RNA, 20 nt, Artificial Sequence
  MKO10075334_B_Capn13
  gRNA
aauuccuuguugccuccucg

SEQ ID NO: 75335 - RNA, 20 nt, Artificial Sequence
  MKO10075335_B_Capn13
  gRNA
guggccugugccaccgaaaa

SEQ ID NO: 75336 - RNA, 20 nt, Artificial Sequence
  MKO10075336_B_Capn13
  gRNA
aaggaaguuaucgccuauga

SEQ ID NO: 75337 - RNA, 20 nt, Artificial Sequence
  MKO10075337_B_Capn15
  gRNA
ccaguacugccaacgcacuc

SEQ ID NO: 75338 - RNA, 20 nt, Artificial Sequence
  MKO10075338_B_Capn15
  gRNA
cugcgggggagguaacauga

SEQ ID NO: 75339 - RNA, 20 nt, Artificial Sequence
  MKO10075339_B_Capn15
  gRNA
agacugaccacggagugccg

SEQ ID NO: 75340 - RNA, 20 nt, Artificial Sequence
  MKO10075340_B_Capn1
  gRNA
cgagacuauucugcaccgag

SEQ ID NO: 75341 - RNA, 20 nt, Artificial Sequence
  MKO10075341_B_Capn1
  gRNA
ugagugguacgaccugcaga

SEQ ID NO: 75342 - RNA, 20 nt, Artificial Sequence
  MKO10075342_B_Capn1
  gRNA
gucaaacccccaguucaucg

SEQ ID NO: 75343 - RNA, 20 nt, Artificial Sequence
  MKO10075343_B_Capn2
  gRNA
cgccucccucaccuugaaug

SEQ ID NO: 75344 - RNA, 20 nt, Artificial Sequence
  MKO10075344_B_Capn2
  gRNA
gacaggcugcccacuaagga

SEQ ID NO: 75345 - RNA, 20 nt, Artificial Sequence
  MKO10075345_B_Capn2
  gRNA
gggugcuaugaagcacucuc

SEQ ID NO: 75346 - RNA, 20 nt, Artificial Sequence
  MKO10075346_B_Capn3
  gRNA
acuuggcauaagccuucuca

SEQ ID NO: 75347 - RNA, 20 nt, Artificial Sequence
  MKO10075347_B_Capn3
  gRNA
uggcuccaccaaugauaaac

SEQ ID NO: 75348 - RNA, 20 nt, Artificial Sequence
  MKO10075348_B_Capn3
  gRNA
ggaaaagcagccgcucauuc

SEQ ID NO: 75349 - RNA, 20 nt, Artificial Sequence
  MKO10075349_B_Capn5
  gRNA
aggcaacacggccgaugcau

SEQ ID NO: 75350 - RNA, 20 nt, Artificial Sequence
  MKO10075350_B_Capn5
  gRNA
ugaacccauugaccugaccg

SEQ ID NO: 75351 - RNA, 20 nt, Artificial Sequence
  MKO10075351_B_Capn5
  gRNA
uggccucccgagagucacuc

SEQ ID NO: 75352 - RNA, 20 nt, Artificial Sequence
  MKO10075352_B_Capn6
  gRNA
gaagaccagaucuccguuga

SEQ ID NO: 75353 - RNA, 20 nt, Artificial Sequence
  MKO10075353_B_Capn6
  gRNA
ugcugauguugcccacaauc

SEQ ID NO: 75354 - RNA, 20 nt, Artificial Sequence
  MKO10075354_B_Capn6
  gRNA
ccacaagucuuucuccgaga

SEQ ID NO: 75355 - RNA, 20 nt, Artificial Sequence
  MKO10075355_B_Capn7
  gRNA
agcuuucgaugaagaugaaa

SEQ ID NO: 75356 - RNA, 20 nt, Artificial Sequence
  MKO10075356_B_Capn7
  gRNA
gugcaagcccuucacucugc

SEQ ID NO: 75357 - RNA, 20 nt, Artificial Sequence
  MKO10075357_B_Capn7
  gRNA
agaauuauauacagaagcug

SEQ ID NO: 75358 - RNA, 20 nt, Artificial Sequence
  MKO10075358_B_Capn8
  gRNA
guuacucaccaagacccccc

SEQ ID NO: 75359 - RNA, 20 nt, Artificial Sequence
  MKO10075359_B_Capn8
  gRNA
ugaaaagcugcuuuaucgag

SEQ ID NO: 75360 - RNA, 20 nt, Artificial Sequence
  MKO10075360_B_Capn8
  gRNA
cucuuccuacacuccgaaga

SEQ ID NO: 75361 - RNA, 20 nt, Artificial Sequence
  MKO10075361_B_Capn9
  gRNA
accaggaccgacauuugcca

SEQ ID NO: 75362 - RNA, 20 nt, Artificial Sequence
  MKO10075362_B_Capn9
  gRNA
uuagggaggcaauggccgcc

SEQ ID NO: 75363 - RNA, 20 nt, Artificial Sequence
  MKO10075363_B_Capn9
  gRNA
ugccgggauauuucauuucc

SEQ ID NO: 75364 - RNA, 20 nt, Artificial Sequence
  MKO10075364_B_Capns1
  gRNA
acucucguuggccucaauau

SEQ ID NO: 75365 - RNA, 20 nt, Artificial Sequence
  MKO10075365_B_Capns1
  gRNA
gacccggaucugaaaacuga

SEQ ID NO: 75366 - RNA, 20 nt, Artificial Sequence
  MKO10075366_B_Capns1
  gRNA
ggcugcugcgcaguacaacc

SEQ ID NO: 75367 - RNA, 20 nt, Artificial Sequence
  MKO10075367_B_Capns2
  gRNA
ggcaagcauguuucucgcaa

SEQ ID NO: 75368 - RNA, 20 nt, Artificial Sequence
  MKO10075368_B_Capns2
  gRNA
ugcuauguuucgagcuuuca

SEQ ID NO: 75369 - RNA, 20 nt, Artificial Sequence
  MKO10075369_B_Capns2
  gRNA
uuuaccuaaugauuguccgu

SEQ ID NO: 75370 - RNA, 20 nt, Artificial Sequence
  MKO10075370_B_Caprin1
  gRNA
ccccuuuauucauucguucc

SEQ ID NO: 75371 - RNA, 20 nt, Artificial Sequence
  MKO10075371_B_Caprin1
  gRNA
aacuccuccucagacaauau

SEQ ID NO: 75372 - RNA, 20 nt, Artificial Sequence
  MKO10075372_B_Caprin1
  gRNA
ccaaauuauuugugacuucc

SEQ ID NO: 75373 - RNA, 20 nt, Artificial Sequence
  MKO10075373_B_Caprin2
  gRNA
ucagcauaugcucccuucuc

SEQ ID NO: 75374 - RNA, 20 nt, Artificial Sequence
  MKO10075374_B_Caprin2
  gRNA
gcugcugaaagcgcagaaaa

SEQ ID NO: 75375 - RNA, 20 nt, Artificial Sequence
  MKO10075375_B_Caprin2
  gRNA
agcagucauccuuguacuuu

SEQ ID NO: 75376 - RNA, 20 nt, Artificial Sequence
  MKO10075376_B_Caps2
  gRNA
uagggucccaccacuugauc

SEQ ID NO: 75377 - RNA, 20 nt, Artificial Sequence
  MKO10075377_B_Caps2
  gRNA
uaacagucagcaucgacuac

SEQ ID NO: 75378 - RNA, 20 nt, Artificial Sequence
  MKO10075378_B_Caps2
  gRNA
uauagcuuacauagguaggc

SEQ ID NO: 75379 - RNA, 20 nt, Artificial Sequence
  MKO10075379_B_Capsl
  gRNA
cagggacagcgcgccaugac

SEQ ID NO: 75380 - RNA, 20 nt, Artificial Sequence
  MKO10075380_B_Capsl
  gRNA
cuucagaguguuucgaauua

SEQ ID NO: 75381 - RNA, 20 nt, Artificial Sequence
  MKO10075381_B_Capsl
  gRNA
gacucacccuaugauaaaga

SEQ ID NO: 75382 - RNA, 20 nt, Artificial Sequence
  MKO10075382_B_Capza1
  gRNA
uucaucacccaugcaccccc

SEQ ID NO: 75383 - RNA, 20 nt, Artificial Sequence
  MKO10075383_B_Capza1
  gRNA
uuaacaaugacaaucuccuc

SEQ ID NO: 75384 - RNA, 20 nt, Artificial Sequence
  MKO10075384_B_Capza1
  gRNA
acugugcugccccuucccug

SEQ ID NO: 75385 - RNA, 20 nt, Artificial Sequence
  MKO10075385_B_Capza2
  gRNA
ugcauuugcacaguauaacc

SEQ ID NO: 75386 - RNA, 20 nt, Artificial Sequence
  MKO10075386_B_Capza2
  gRNA
uuuacaccaguaaaaauuga

SEQ ID NO: 75387 - RNA, 20 nt, Artificial Sequence
  MKO10075387_B_Capza2
  gRNA
aaaaccucauuaaauucucc

SEQ ID NO: 75388 - RNA, 20 nt, Artificial Sequence
  MKO10075388_B_Capza3
  gRNA
gugaaugaucacuacccaaa

SEQ ID NO: 75389 - RNA, 20 nt, Artificial Sequence
  MKO10075389_B_Capza3
  gRNA
ugugucccacucugcaucga

SEQ ID NO: 75390 - RNA, 20 nt, Artificial Sequence
  MKO10075390_B_Capza3
  gRNA
uccaaagucacggaaucauu

SEQ ID NO: 75391 - RNA, 20 nt, Artificial Sequence
  MKO10075391_B_Capzb
  gRNA
uaacaaguaugacccuccuu

SEQ ID NO: 75392 - RNA, 20 nt, Artificial Sequence
  MKO10075392_B_Capzb
  gRNA
cucuguuguagucacacaaa

SEQ ID NO: 75393 - RNA, 20 nt, Artificial Sequence
  MKO10075393_B_Capzb
  gRNA
ccugaaaauugccagagaca

SEQ ID NO: 75394 - RNA, 20 nt, Artificial Sequence
  MKO10075394_B_Car10
  gRNA
ggggucgaagaucaugugac

SEQ ID NO: 75395 - RNA, 20 nt, Artificial Sequence
  MKO10075395_B_Car10
  gRNA
aagaaauccggcuacacuuu

SEQ ID NO: 75396 - RNA, 20 nt, Artificial Sequence
  MKO10075396_B_Car10
  gRNA
gaagcugcgaagagcccgaa

SEQ ID NO: 75397 - RNA, 20 nt, Artificial Sequence
  MKO10075397_B_Car11
  gRNA
cugagaauggccaggccguu

SEQ ID NO: 75398 - RNA, 20 nt, Artificial Sequence
  MKO10075398_B_Car11
  gRNA
cggggaaccuuguacaacac

SEQ ID NO: 75399 - RNA, 20 nt, Artificial Sequence
  MKO10075399_B_Car11
  gRNA
cccccgcucagacucagcac

SEQ ID NO: 75400 - RNA, 20 nt, Artificial Sequence
  MKO10075400_B_Car12
  gRNA
gggaaccgcaaugaccccca

SEQ ID NO: 75401 - RNA, 20 nt, Artificial Sequence
  MKO10075401_B_Car12
  gRNA
ugcaggaggccuccacacga

SEQ ID NO: 75402 - RNA, 20 nt, Artificial Sequence
  MKO10075402_B_Car12
  gRNA
gaggccuucggacuugucac

SEQ ID NO: 75403 - RNA, 20 nt, Artificial Sequence
  MKO10075403_B_Car13
  gRNA
agcaugugguagacggagug

SEQ ID NO: 75404 - RNA, 20 nt, Artificial Sequence
  MKO10075404_B_Car13
  gRNA
caaauacccgagcuuuguag

SEQ ID NO: 75405 - RNA, 20 nt, Artificial Sequence
  MKO10075405_B_Car13
  gRNA
gucgucaaagucaacguuga

SEQ ID NO: 75406 - RNA, 20 nt, Artificial Sequence
  MKO10075406_B_Car14
  gRNA
ugggcaucgccuccacacuc

SEQ ID NO: 75407 - RNA, 20 nt, Artificial Sequence
  MKO10075407_B_Car14
  gRNA
gggagucauagugaaccacg

SEQ ID NO: 75408 - RNA, 20 nt, Artificial Sequence
  MKO10075408_B_Car14
  gRNA
ggucaccacuggacauauga

SEQ ID NO: 75409 - RNA, 20 nt, Artificial Sequence
  MKO10075409_B_Car15
  gRNA
ggcucccgucaccagaguac

SEQ ID NO: 75410 - RNA, 20 nt, Artificial Sequence
  MKO10075410_B_Car15
  gRNA
ugcucggagccuuggugccc

SEQ ID NO: 75411 - RNA, 20 nt, Artificial Sequence
  MKO10075411_B_Car15
  gRNA
gaugcacggagccaaccaga

SEQ ID NO: 75412 - RNA, 20 nt, Artificial Sequence
  MKO10075412_B_Car1
  gRNA
ucuaaacucaguuaaaacua

SEQ ID NO: 75413 - RNA, 20 nt, Artificial Sequence
  MKO10075413_B_Car1
  gRNA
agaauaucuaguuccaucca

SEQ ID NO: 75414 - RNA, 20 nt, Artificial Sequence
  MKO10075414_B_Car1
  gRNA
uggaacuagauauucuggag

SEQ ID NO: 75415 - RNA, 20 nt, Artificial Sequence
  MKO10075415_B_Car2
  gRNA
agccccagugaaagugaaac

SEQ ID NO: 75416 - RNA, 20 nt, Artificial Sequence
  MKO10075416_B_Car2
  gRNA
gccguuguugacaaugcucu

SEQ ID NO: 75417 - RNA, 20 nt, Artificial Sequence
  MKO10075417_B_Car2
  gRNA
ugauccaguuucacuuucac

SEQ ID NO: 75418 - RNA, 20 nt, Artificial Sequence
  MKO10075418_B_Car3
  gRNA
gucuuuaguaugcaguucaa

SEQ ID NO: 75419 - RNA, 20 nt, Artificial Sequence
  MKO10075419_B_Car3
  gRNA
cucagagccguggucaucag

SEQ ID NO: 75420 - RNA, 20 nt, Artificial Sequence
  MKO10075420_B_Car3
  gRNA
aauccaaaguauaacaccuu

SEQ ID NO: 75421 - RNA, 20 nt, Artificial Sequence
  MKO10075421_B_Car4
  gRNA
gaaggacaaguuugcagugc

SEQ ID NO: 75422 - RNA, 20 nt, Artificial Sequence
  MKO10075422_B_Car4
  gRNA
caagaaguugacaucuagca

SEQ ID NO: 75423 - RNA, 20 nt, Artificial Sequence
  MKO10075423_B_Car4
  gRNA
guguguugauuguucuuaau

SEQ ID NO: 75424 - RNA, 20 nt, Artificial Sequence
  MKO10075424_B_Car5a
  gRNA
acagcucggggcgcaucacc

SEQ ID NO: 75425 - RNA, 20 nt, Artificial Sequence
  MKO10075425_B_Car5a
  gRNA
uuuacgaaccucagcugggu

SEQ ID NO: 75426 - RNA, 20 nt, Artificial Sequence
  MKO10075426_B_Car5a
  gRNA
gagaacgggcuggcggucau

SEQ ID NO: 75427 - RNA, 20 nt, Artificial Sequence
  MKO10075427_B_Car5b
  gRNA
auuaccuugugcuuaauuga

SEQ ID NO: 75428 - RNA, 20 nt, Artificial Sequence
  MKO10075428_B_Car5b
  gRNA
caguaaaugcuacccagcag

SEQ ID NO: 75429 - RNA, 20 nt, Artificial Sequence
  MKO10075429_B_Car5b
  gRNA
uuggggcucugagcacaccg

SEQ ID NO: 75430 - RNA, 20 nt, Artificial Sequence
  MKO10075430_B_Car6
  gRNA
gaugaacucagugccgucag

SEQ ID NO: 75431 - RNA, 20 nt, Artificial Sequence
  MKO10075431_B_Car6
  gRNA
aacacaccauugaugggauc

SEQ ID NO: 75432 - RNA, 20 nt, Artificial Sequence
  MKO10075432_B_Car6
  gRNA
uguguuagccgucuuguuua

SEQ ID NO: 75433 - RNA, 20 nt, Artificial Sequence
  MKO10075433_B_Car7
  gRNA
cacugucauugaaguccacc

SEQ ID NO: 75434 - RNA, 20 nt, Artificial Sequence
  MKO10075434_B_Car7
  gRNA
cccaaaagugcuguacuucu

SEQ ID NO: 75435 - RNA, 20 nt, Artificial Sequence
  MKO10075435_B_Car7
  gRNA
guggagcugcuugagacgau

SEQ ID NO: 75436 - RNA, 20 nt, Artificial Sequence
  MKO10075436_B_Car8
  gRNA
ccgugugcucagaaccacgc

SEQ ID NO: 75437 - RNA, 20 nt, Artificial Sequence
  MKO10075437_B_Car8
  gRNA
aucgaugcugccaaacagug

SEQ ID NO: 75438 - RNA, 20 nt, Artificial Sequence
  MKO10075438_B_Car8
  gRNA
cagaucgggaaggaacaugu

SEQ ID NO: 75439 - RNA, 20 nt, Artificial Sequence
  MKO10075439_B_Car9
  gRNA
ccaguguagaugcaacugca

SEQ ID NO: 75440 - RNA, 20 nt, Artificial Sequence
  MKO10075440_B_Car9
  gRNA
cuccauagcuccaaugacug

SEQ ID NO: 75441 - RNA, 20 nt, Artificial Sequence
  MKO10075441_B_Car9
  gRNA
cuccgaacuucaugaagccu

SEQ ID NO: 75442 - RNA, 20 nt, Artificial Sequence
  MKO10075442_B_Card10
  gRNA
cccaguccucccgcagucgc

SEQ ID NO: 75443 - RNA, 20 nt, Artificial Sequence
  MKO10075443_B_Card10
  gRNA
gcagugaagccgucagccgc

SEQ ID NO: 75444 - RNA, 20 nt, Artificial Sequence
  MKO10075444_B_Card10
  gRNA
agcuucgugcagagaaccag

SEQ ID NO: 75445 - RNA, 20 nt, Artificial Sequence
  MKO10075445_B_Card11
  gRNA
uccauguagucauccauagc

SEQ ID NO: 75446 - RNA, 20 nt, Artificial Sequence
  MKO10075446_B_Card11
  gRNA
cuucuccccaggccgauugu

SEQ ID NO: 75447 - RNA, 20 nt, Artificial Sequence
  MKO10075447_B_Card11
  gRNA
aagccacuuacccacaaugg

SEQ ID NO: 75448 - RNA, 20 nt, Artificial Sequence
  MKO10075448_B_Card14
  gRNA
agagagcaguggccgcggag

SEQ ID NO: 75449 - RNA, 20 nt, Artificial Sequence
  MKO10075449_B_Card14
  gRNA
cucuuucacaugacgauaca

SEQ ID NO: 75450 - RNA, 20 nt, Artificial Sequence
  MKO10075450_B_Card14
  gRNA
caacccugaugucuacaccc

SEQ ID NO: 75451 - RNA, 20 nt, Artificial Sequence
  MKO10075451_B_Card6
  gRNA
acagcugucggcguuuccuc

SEQ ID NO: 75452 - RNA, 20 nt, Artificial Sequence
  MKO10075452_B_Card6
  gRNA
ucuuggacacguuaaccucu

SEQ ID NO: 75453 - RNA, 20 nt, Artificial Sequence
  MKO10075453_B_Card6
  gRNA
auugaucucugaacagcuac

SEQ ID NO: 75454 - RNA, 20 nt, Artificial Sequence
  MKO10075454_B_Card9
  gRNA
ggucucucacccgggcccgg

SEQ ID NO: 75455 - RNA, 20 nt, Artificial Sequence
  MKO10075455_B_Card9
  gRNA
cauggagcagcggccuaguc

SEQ ID NO: 75456 - RNA, 20 nt, Artificial Sequence
  MKO10075456_B_Card9
  gRNA
cuccuugaugaagucguccu

SEQ ID NO: 75457 - RNA, 20 nt, Artificial Sequence
  MKO10075457_B_Carf
  gRNA
cugccgucuuaggaguugug

SEQ ID NO: 75458 - RNA, 20 nt, Artificial Sequence
  MKO10075458_B_Carf
  gRNA
agggcuauguucaucugcaa

SEQ ID NO: 75459 - RNA, 20 nt, Artificial Sequence
  MKO10075459_B_Carf
  gRNA
ucaccucacaacuccuaaga

SEQ ID NO: 75460 - RNA, 20 nt, Artificial Sequence
  MKO10075460_B_Carhsp1
  gRNA
acgcugagaagguccuuguc

SEQ ID NO: 75461 - RNA, 20 nt, Artificial Sequence
  MKO10075461_B_Carhsp1
  gRNA
ugggauagagcacaucuuau

SEQ ID NO: 75462 - RNA, 20 nt, Artificial Sequence
  MKO10075462_B_Carhsp1
  gRNA
acccaagaacgagaagcugc

SEQ ID NO: 75463 - RNA, 20 nt, Artificial Sequence
  MKO10075463_B_Carkd
  gRNA
ucugacgucgaagaagcaca

SEQ ID NO: 75464 - RNA, 20 nt, Artificial Sequence
  MKO10075464_B_Carkd
  gRNA
gggcuguaggacuugaucac

SEQ ID NO: 75465 - RNA, 20 nt, Artificial Sequence
  MKO10075465_B_Carkd
  gRNA
gcugagauuccugcaaaaua

SEQ ID NO: 75466 - RNA, 20 nt, Artificial Sequence
  MKO10075466_B_Carm1
  gRNA
ugaggacgcuguugcagccc

SEQ ID NO: 75467 - RNA, 20 nt, Artificial Sequence
  MKO10075467_B_Carm1
  gRNA
ccuuguccuugaaguccgug

SEQ ID NO: 75468 - RNA, 20 nt, Artificial Sequence
  MKO10075468_B_Carm1
  gRNA
auccaguuugccacacccca

SEQ ID NO: 75469 - RNA, 20 nt, Artificial Sequence
  MKO10075469_B_Carns1
  gRNA
gcacggccacaccacucugc

SEQ ID NO: 75470 - RNA, 20 nt, Artificial Sequence
  MKO10075470_B_Carns1
  gRNA
cagcaccguguucaccacug

SEQ ID NO: 75471 - RNA, 20 nt, Artificial Sequence
  MKO10075471_B_Carns1
  gRNA
ggcucuacccgcaggugcag

SEQ ID NO: 75472 - RNA, 20 nt, Artificial Sequence
  MKO10075472_B_Cars2
  gRNA
aagcauggccaagaugugca

SEQ ID NO: 75473 - RNA, 20 nt, Artificial Sequence
  MKO10075473_B_Cars2
  gRNA
auguuagauuugacauuauc

SEQ ID NO: 75474 - RNA, 20 nt, Artificial Sequence
  MKO10075474_B_Cars2
  gRNA
guguacgaccaugcacaucu

SEQ ID NO: 75475 - RNA, 20 nt, Artificial Sequence
  MKO10075475_B_Cars
  gRNA
ugagacgcaucauagacagu

SEQ ID NO: 75476 - RNA, 20 nt, Artificial Sequence
  MKO10075476_B_Cars
  gRNA
agugauggcagguuccuccg

SEQ ID NO: 75477 - RNA, 20 nt, Artificial Sequence
  MKO10075477_B_Cars
  gRNA
gccucuauaauagccucacc

SEQ ID NO: 75478 - RNA, 20 nt, Artificial Sequence
  MKO10075478_B_Cartpt
  gRNA
gucacacagcuucccgaucc

SEQ ID NO: 75479 - RNA, 20 nt, Artificial Sequence
  MKO10075479_B_Cartpt
  gRNA
uacugaccagcuccuucucg

SEQ ID NO: 75480 - RNA, 20 nt, Artificial Sequence
  MKO10075480_B_Cartpt
  gRNA
cuggagagcagugcgcagug

SEQ ID NO: 75481 - RNA, 20 nt, Artificial Sequence
  MKO10075481_B_Casc1
  gRNA
gagcaagcucuucaagcucu

SEQ ID NO: 75482 - RNA, 20 nt, Artificial Sequence
  MKO10075482_B_Casc1
  gRNA
ugaagagcuugcucugcucg

SEQ ID NO: 75483 - RNA, 20 nt, Artificial Sequence
  MKO10075483_B_Casc1
  gRNA
gaaauuugaaaaagaagaac

SEQ ID NO: 75484 - RNA, 20 nt, Artificial Sequence
  MKO10075484_B_Casc3
  gRNA
aucuucugcacuuucauaau

SEQ ID NO: 75485 - RNA, 20 nt, Artificial Sequence
  MKO10075485_B_Casc3
  gRNA
ugauuccucugcgaaagaaa

SEQ ID NO: 75486 - RNA, 20 nt, Artificial Sequence
  MKO10075486_B_Casc3
  gRNA
uccucccaggagagugaaga

SEQ ID NO: 75487 - RNA, 20 nt, Artificial Sequence
  MKO10075487_B_Casc4
  gRNA
aagaucagcuucaagacuac

SEQ ID NO: 75488 - RNA, 20 nt, Artificial Sequence
  MKO10075488_B_Casc4
  gRNA
aaacaacauaucauaucaga

SEQ ID NO: 75489 - RNA, 20 nt, Artificial Sequence
  MKO10075489_B_Casc4
  gRNA
gaccguaaucggccuccuuc

SEQ ID NO: 75490 - RNA, 20 nt, Artificial Sequence
  MKO10075490_B_Casc5
  gRNA
aaccuaauccuccaagaaaa

SEQ ID NO: 75491 - RNA, 20 nt, Artificial Sequence
  MKO10075491_B_Casc5
  gRNA
gagagaaauucagaaauuuc

SEQ ID NO: 75492 - RNA, 20 nt, Artificial Sequence
  MKO10075492_B_Casc5
  gRNA
uuguuugauuuccacauuug

SEQ ID NO: 75493 - RNA, 20 nt, Artificial Sequence
  MKO10075493_B_Casd1
  gRNA
acgcaauguguuuaucuaca

SEQ ID NO: 75494 - RNA, 20 nt, Artificial Sequence
  MKO10075494_B_Casd1
  gRNA
caccuugauacauuguuuca

SEQ ID NO: 75495 - RNA, 20 nt, Artificial Sequence
  MKO10075495_B_Casd1
  gRNA
uuccaugaaacaauguauca

SEQ ID NO: 75496 - RNA, 20 nt, Artificial Sequence
  MKO10075496_B_Caskin1
  gRNA
ccacaucguagugaccaugc

SEQ ID NO: 75497 - RNA, 20 nt, Artificial Sequence
  MKO10075497_B_Caskin1
  gRNA
caacucacccauccgggucc

SEQ ID NO: 75498 - RNA, 20 nt, Artificial Sequence
  MKO10075498_B_Caskin1
  gRNA
ugaucuucuugguagagccc

SEQ ID NO: 75499 - RNA, 20 nt, Artificial Sequence
  MKO10075499_B_Caskin2
  gRNA
gagacucaacauuaacuacc

SEQ ID NO: 75500 - RNA, 20 nt, Artificial Sequence
  MKO10075500_B_Caskin2
  gRNA
cuagaccuagccugugaauu

SEQ ID NO: 75501 - RNA, 20 nt, Artificial Sequence
  MKO10075501_B_Caskin2
  gRNA
ggaacucauagccuugcugc

SEQ ID NO: 75502 - RNA, 20 nt, Artificial Sequence
  MKO10075502_B_Cask
  gRNA
ggggucccuucaguguugua

SEQ ID NO: 75503 - RNA, 20 nt, Artificial Sequence
  MKO10075503_B_Cask
  gRNA
acaucgccguacaacacuga

SEQ ID NO: 75504 - RNA, 20 nt, Artificial Sequence
  MKO10075504_B_Cask
  gRNA
uccacacauuguagagcugu

SEQ ID NO: 75505 - RNA, 20 nt, Artificial Sequence
  MKO10075505_B_Casp12
  gRNA
aucuuacaaaacugaucacg

SEQ ID NO: 75506 - RNA, 20 nt, Artificial Sequence
  MKO10075506_B_Casp12
  gRNA
uguacaccuucuucuccauc

SEQ ID NO: 75507 - RNA, 20 nt, Artificial Sequence
  MKO10075507_B_Casp12
  gRNA
ucagcauuagaugugauuca

SEQ ID NO: 75508 - RNA, 20 nt, Artificial Sequence
  MKO10075508_B_Casp14
  gRNA
uaugaaugaacacauccguc

SEQ ID NO: 75509 - RNA, 20 nt, Artificial Sequence
  MKO10075509_B_Casp14
  gRNA
cuguucaauaccugggcggu

SEQ ID NO: 75510 - RNA, 20 nt, Artificial Sequence
  MKO10075510_B_Casp14
  gRNA
agagcucauacccucuaccg

SEQ ID NO: 75511 - RNA, 20 nt, Artificial Sequence
  MKO10075511_B_Casp1
  gRNA
aguuucaacaucuuucuccg

SEQ ID NO: 75512 - RNA, 20 nt, Artificial Sequence
  MKO10075512_B_Casp1
  gRNA
gcaacaaauguuucagcuga

SEQ ID NO: 75513 - RNA, 20 nt, Artificial Sequence
  MKO10075513_B_Casp1
  gRNA
guauggguaccugaggauga

SEQ ID NO: 75514 - RNA, 20 nt, Artificial Sequence
  MKO10075514_B_Casp2
  gRNA
caggacucacacaccgagaa

SEQ ID NO: 75515 - RNA, 20 nt, Artificial Sequence
  MKO10075515_B_Casp2
  gRNA
guacgugcugaauaucugag

SEQ ID NO: 75516 - RNA, 20 nt, Artificial Sequence
  MKO10075516_B_Casp2
  gRNA
guuagaacaccuccuagaga

SEQ ID NO: 75517 - RNA, 20 nt, Artificial Sequence
  MKO10075517_B_Casp3
  gRNA
aguggacucugggaucuauc

SEQ ID NO: 75518 - RNA, 20 nt, Artificial Sequence
  MKO10075518_B_Casp3
  gRNA
gacuacugccggagucugac

SEQ ID NO: 75519 - RNA, 20 nt, Artificial Sequence
  MKO10075519_B_Casp3
  gRNA
auuaugcauaugcccauuuc

SEQ ID NO: 75520 - RNA, 20 nt, Artificial Sequence
  MKO10075520_B_Casp4
  gRNA
ugauaagagccuuucgugua

SEQ ID NO: 75521 - RNA, 20 nt, Artificial Sequence
  MKO10075521_B_Casp4
  gRNA
ugccaugagacauuagcacc

SEQ ID NO: 75522 - RNA, 20 nt, Artificial Sequence
  MKO10075522_B_Casp4
  gRNA
gcugggcaaagaaguccuua

SEQ ID NO: 75523 - RNA, 20 nt, Artificial Sequence
  MKO10075523_B_Casp6
  gRNA
gcguuggugccccgccucuc

SEQ ID NO: 75524 - RNA, 20 nt, Artificial Sequence
  MKO10075524_B_Casp6
  gRNA
auugaaauucagacguugac

SEQ ID NO: 75525 - RNA, 20 nt, Artificial Sequence
  MKO10075525_B_Casp6
  gRNA
caacgucugaauuucaauuu

SEQ ID NO: 75526 - RNA, 20 nt, Artificial Sequence
  MKO10075526_B_Casp7
  gRNA
ucggucccggccgguccuga

SEQ ID NO: 75527 - RNA, 20 nt, Artificial Sequence
  MKO10075527_B_Casp7
  gRNA
gcccacuuaucuguaccgca

SEQ ID NO: 75528 - RNA, 20 nt, Artificial Sequence
  MKO10075528_B_Casp7
  gRNA
uugcacaagagcagucauug

SEQ ID NO: 75529 - RNA, 20 nt, Artificial Sequence
  MKO10075529_B_Casp8ap2
  gRNA
gauuuaucucuucauccuua

SEQ ID NO: 75530 - RNA, 20 nt, Artificial Sequence
  MKO10075530_B_Casp8ap2
  gRNA
acaguuucugaaugacacac

SEQ ID NO: 75531 - RNA, 20 nt, Artificial Sequence
  MKO10075531_B_Casp8ap2
  gRNA
ucgcaguuccuucuucaguc

SEQ ID NO: 75532 - RNA, 20 nt, Artificial Sequence
  MKO10075532_B_Casp8
  gRNA
ugcagagaugagccucaaaa

SEQ ID NO: 75533 - RNA, 20 nt, Artificial Sequence
  MKO10075533_B_Casp8
  gRNA
agaguugccaccuucaguuu

SEQ ID NO: 75534 - RNA, 20 nt, Artificial Sequence
  MKO10075534_B_Casp8
  gRNA
ccuaaaaucaaucugugacc

SEQ ID NO: 75535 - RNA, 20 nt, Artificial Sequence
  MKO10075535_B_Casp9
  gRNA
ucuagggguuuaacagccuc

SEQ ID NO: 75536 - RNA, 20 nt, Artificial Sequence
  MKO10075536_B_Casp9
  gRNA
ccgugcccuggacugcuuug

SEQ ID NO: 75537 - RNA, 20 nt, Artificial Sequence
  MKO10075537_B_Casp9
  gRNA
ucccuugcagaaaaugguca

SEQ ID NO: 75538 - RNA, 20 nt, Artificial Sequence
  MKO10075538_B_Casq1
  gRNA
gacccuguagaguugauuga

SEQ ID NO: 75539 - RNA, 20 nt, Artificial Sequence
  MKO10075539_B_Casq1
  gRNA
ucaccuucaaucaacucuac

SEQ ID NO: 75540 - RNA, 20 nt, Artificial Sequence
  MKO10075540_B_Casq1
  gRNA
cauccuucucugaguccacc

SEQ ID NO: 75541 - RNA, 20 nt, Artificial Sequence
  MKO10075541_B_Casq2
  gRNA
cugguccucgaugcgcucaa

SEQ ID NO: 75542 - RNA, 20 nt, Artificial Sequence
  MKO10075542_B_Casq2
  gRNA
uuguuauucacgaucuccac

SEQ ID NO: 75543 - RNA, 20 nt, Artificial Sequence
  MKO10075543_B_Casq2
  gRNA
acccagccucuuagcaagcu

SEQ ID NO: 75544 - RNA, 20 nt, Artificial Sequence
  MKO10075544_B_Casr
  gRNA
ucaccacuguacucgccguc

SEQ ID NO: 75545 - RNA, 20 nt, Artificial Sequence
  MKO10075545_B_Casr
  gRNA
cgcaaaaggaccuuuacccg

SEQ ID NO: 75546 - RNA, 20 nt, Artificial Sequence
  MKO10075546_B_Casr
  gRNA
gguugcucccaccacugcga

SEQ ID NO: 75547 - RNA, 20 nt, Artificial Sequence
  MKO10075547_B_Cass4
  gRNA
augguugucguagagugccc

SEQ ID NO: 75548 - RNA, 20 nt, Artificial Sequence
  MKO10075548_B_Cass4
  gRNA
acucaggcaauucguagacu

SEQ ID NO: 75549 - RNA, 20 nt, Artificial Sequence
  MKO10075549_B_Cass4
  gRNA
cugugcuucccagaccgacg

SEQ ID NO: 75550 - RNA, 20 nt, Artificial Sequence
  MKO10075550_B_Cast
  gRNA
agcuucaccaacaugugguc

SEQ ID NO: 75551 - RNA, 20 nt, Artificial Sequence
  MKO10075551_B_Cast
  gRNA
uaagaaaccacaaucaagug

SEQ ID NO: 75552 - RNA, 20 nt, Artificial Sequence
  MKO10075552_B_Cast
  gRNA
caugaguaccacagagacua

SEQ ID NO: 75553 - RNA, 20 nt, Artificial Sequence
  MKO10075553_B_Casz1
  gRNA
aagguagcccacuacauccc

SEQ ID NO: 75554 - RNA, 20 nt, Artificial Sequence
  MKO10075554_B_Casz1
  gRNA
ccuaccuggcaauauauuuc

SEQ ID NO: 75555 - RNA, 20 nt, Artificial Sequence
  MKO10075555_B_Casz1
  gRNA
uuuacaucuucggugacagc

SEQ ID NO: 75556 - RNA, 20 nt, Artificial Sequence
  MKO10075556_B_Causper1
  gRNA
ccugaccagccuccacgaag

SEQ ID NO: 75557 - RNA, 20 nt, Artificial Sequence
  MKO10075557_B_Causper1
  gRNA
ucccggugugugccuucuug

SEQ ID NO: 75558 - RNA, 20 nt, Artificial Sequence
  MKO10075558_B_Causper1
  gRNA
ccccacagaaugguacuuca

SEQ ID NO: 75559 - RNA, 20 nt, Artificial Sequence
  MKO10075559_B_Causper2
  gRNA
cccgacagacccucagcagc

SEQ ID NO: 75560 - RNA, 20 nt, Artificial Sequence
  MKO10075560_B_Causper2
  gRNA
ucugaacaccuuugugcuga

SEQ ID NO: 75561 - RNA, 20 nt, Artificial Sequence
  MKO10075561_B_Causper2
  gRNA
uauuucaaccaucagcacaa

SEQ ID NO: 75562 - RNA, 20 nt, Artificial Sequence
  MKO10075562_B_Causper3
  gRNA
ugucugcgaguuccucauga

SEQ ID NO: 75563 - RNA, 20 nt, Artificial Sequence
  MKO10075563_B_Causper3
  gRNA
caacccuguacgagucaagu

SEQ ID NO: 75564 - RNA, 20 nt, Artificial Sequence
  MKO10075564_B_Causper3
  gRNA
ccguggugaucaucacaauc

SEQ ID NO: 75565 - RNA, 20 nt, Artificial Sequence
  MKO10075565_B_Causper4
  gRNA
caagcaguugcuccgccauc

SEQ ID NO: 75566 - RNA, 20 nt, Artificial Sequence
  MKO10075566_B_Causper4
  gRNA
cuugcuccucaugccgaccc

SEQ ID NO: 75567 - RNA, 20 nt, Artificial Sequence
  MKO10075567_B_Causper4
  gRNA
ggcucucuaccuuagggccc

SEQ ID NO: 75568 - RNA, 20 nt, Artificial Sequence
  MKO10075568_B_Causperb
  gRNA
auuacgaacaguacauucua

SEQ ID NO: 75569 - RNA, 20 nt, Artificial Sequence
  MKO10075569_B_Causperb
  gRNA
ggacuuuaccaaauugucca

SEQ ID NO: 75570 - RNA, 20 nt, Artificial Sequence
  MKO10075570_B_Causperb
  gRNA
aaucaaguuguuccuuacca

SEQ ID NO: 75571 - RNA, 20 nt, Artificial Sequence
  MKO10075571_B_Causperd
  gRNA
gcucaccguucccaagucau

SEQ ID NO: 75572 - RNA, 20 nt, Artificial Sequence
  MKO10075572_B_Causperd
  gRNA
aauaucuaccgccaaugacu

SEQ ID NO: 75573 - RNA, 20 nt, Artificial Sequence
  MKO10075573_B_Causperd
  gRNA
ugugcucaagaacgugugca

SEQ ID NO: 75574 - RNA, 20 nt, Artificial Sequence
  MKO10075574_B_Causperg1
  gRNA
aggccaugugcauccugaac

SEQ ID NO: 75575 - RNA, 20 nt, Artificial Sequence
  MKO10075575_B_Causperg1
  gRNA
ggaaaauuugcagauucuga

SEQ ID NO: 75576 - RNA, 20 nt, Artificial Sequence
  MKO10075576_B_Causperg1
  gRNA
aacucuuaccugucccggac

SEQ ID NO: 75577 - RNA, 20 nt, Artificial Sequence
  MKO10075577_B_Causperg2
  gRNA
aaguugauuugcagguagua

SEQ ID NO: 75578 - RNA, 20 nt, Artificial Sequence
  MKO10075578_B_Causperg2
  gRNA
ggaaaauguacagauucuga

SEQ ID NO: 75579 - RNA, 20 nt, Artificial Sequence
  MKO10075579_B_Causperg2
  gRNA
aacucuuaccugucccggac

SEQ ID NO: 75580 - RNA, 20 nt, Artificial Sequence
  MKO10075580_B_Cau
  gRNA
uuugcguguaccacucucuc

SEQ ID NO: 75581 - RNA, 20 nt, Artificial Sequence
  MKO10075581_B_Cau
  gRNA
cgauaucaccagauacucca

SEQ ID NO: 75582 - RNA, 20 nt, Artificial Sequence
  MKO10075582_B_Cau
  gRNA
ucgucccgagucucuccauc

SEQ ID NO: 75583 - RNA, 20 nt, Artificial Sequence
  MKO10075583_B_Cav1
  gRNA
gggcaaauacguagacuccg

SEQ ID NO: 75584 - RNA, 20 nt, Artificial Sequence
  MKO10075584_B_Cav1
  gRNA
cgcuuguugucuacgaucuu

SEQ ID NO: 75585 - RNA, 20 nt, Artificial Sequence
  MKO10075585_B_Cav1
  gRNA
aguguaugacgcgcacacca

SEQ ID NO: 75586 - RNA, 20 nt, Artificial Sequence
  MKO10075586_B_Cav2
  gRNA
aaacaggauacccgcaauga

SEQ ID NO: 75587 - RNA, 20 nt, Artificial Sequence
  MKO10075587_B_Cav2
  gRNA
caaguuccugaccguauuuc

SEQ ID NO: 75588 - RNA, 20 nt, Artificial Sequence
  MKO10075588_B_Cav2
  gRNA
ugccuuccgugcagacaaua

SEQ ID NO: 75589 - RNA, 20 nt, Artificial Sequence
  MKO10075589_B_Cav3
  gRNA
cgaccccaagaacaucaaug

SEQ ID NO: 75590 - RNA, 20 nt, Artificial Sequence
  MKO10075590_B_Cav3
  gRNA
ugaugcacuggaucucgauc

SEQ ID NO: 75591 - RNA, 20 nt, Artificial Sequence
  MKO10075591_B_Cav3
  gRNA
agcgaagagcggguugcaga

SEQ ID NO: 75592 - RNA, 20 nt, Artificial Sequence
  MKO10075592_B_Cbfa2t2
  gRNA
cucagaauuaccuugagaaa

SEQ ID NO: 75593 - RNA, 20 nt, Artificial Sequence
  MKO10075593_B_Cbfa2t2
  gRNA
auucguuagugcugacgaug

SEQ ID NO: 75594 - RNA, 20 nt, Artificial Sequence
  MKO10075594_B_Cbfa2t2
  gRNA
uuacaguugguugugagaaa

SEQ ID NO: 75595 - RNA, 20 nt, Artificial Sequence
  MKO10075595_B_Cbfa2t3
  gRNA
cugaagugaagacgcagccc

SEQ ID NO: 75596 - RNA, 20 nt, Artificial Sequence
  MKO10075596_B_Cbfa2t3
  gRNA
cguucucguugacuuccagc

SEQ ID NO: 75597 - RNA, 20 nt, Artificial Sequence
  MKO10075597_B_Cbfa2t3
  gRNA
aaacggccucaguggaaagu

SEQ ID NO: 75598 - RNA, 20 nt, Artificial Sequence
  MKO10075598_B_Cbfb
  gRNA
uuccagaacgccugccgcga

SEQ ID NO: 75599 - RNA, 20 nt, Artificial Sequence
  MKO10075599_B_Cbfb
  gRNA
aacccauaccauccaaucug

SEQ ID NO: 75600 - RNA, 20 nt, Artificial Sequence
  MKO10075600_B_Cbfb
  gRNA
cuggauugaucuccacagau

SEQ ID NO: 75601 - RNA, 20 nt, Artificial Sequence
  MKO10075601_B_Cblb
  gRNA
aucaaggcgaucuuucccaa

SEQ ID NO: 75602 - RNA, 20 nt, Artificial Sequence
  MKO10075602_B_Cblb
  gRNA
cguaugaugaaguuaaagcu

SEQ ID NO: 75603 - RNA, 20 nt, Artificial Sequence
  MKO10075603_B_Cblb
  gRNA
aguuccagggagauaacuuc

SEQ ID NO: 75604 - RNA, 20 nt, Artificial Sequence
  MKO10075604_B_Cblc
  gRNA
gguggcaaaggcccggcgcg

SEQ ID NO: 75605 - RNA, 20 nt, Artificial Sequence
  MKO10075605_B_Cblc
  gRNA
caggcgacaacuggccaagc

SEQ ID NO: 75606 - RNA, 20 nt, Artificial Sequence
  MKO10075606_B_Cblc
  gRNA
uugaguuugacgucuucacc

SEQ ID NO: 75607 - RNA, 20 nt, Artificial Sequence
  MKO10075607_B_Cbll1
  gRNA
gaacagcgauaugacuguaa

SEQ ID NO: 75608 - RNA, 20 nt, Artificial Sequence
  MKO10075608_B_Cbll1
  gRNA
gggaaucagcgaagauuucc

SEQ ID NO: 75609 - RNA, 20 nt, Artificial Sequence
  MKO10075609_B_Cbll1
  gRNA
auucucccauagacuuuaau

SEQ ID NO: 75610 - RNA, 20 nt, Artificial Sequence
  MKO10075610_B_Cbln1
  gRNA
ugagacagagcccaucguac

SEQ ID NO: 75611 - RNA, 20 nt, Artificial Sequence
  MKO10075611_B_Cbln1
  gRNA
uguuguagacuuucaccacg

SEQ ID NO: 75612 - RNA, 20 nt, Artificial Sequence
  MKO10075612_B_Cbln1
  gRNA
uacucaucucggacggcuca

SEQ ID NO: 75613 - RNA, 20 nt, Artificial Sequence
  MKO10075613_B_Cbln2
  gRNA
uaggucagcuuaaugcagaa

SEQ ID NO: 75614 - RNA, 20 nt, Artificial Sequence
  MKO10075614_B_Cbln2
  gRNA
uguuguacacuuugaccacg

SEQ ID NO: 75615 - RNA, 20 nt, Artificial Sequence
  MKO10075615_B_Cbln2
  gRNA
uuauagcuucagcuuccacg

SEQ ID NO: 75616 - RNA, 20 nt, Artificial Sequence
  MKO10075616_B_Cbln3
  gRNA
gaaaccggcaacgguaccag

SEQ ID NO: 75617 - RNA, 20 nt, Artificial Sequence
  MKO10075617_B_Cbln3
  gRNA
ugcuucguggccccuguccg

SEQ ID NO: 75618 - RNA, 20 nt, Artificial Sequence
  MKO10075618_B_Cbln3
  gRNA
cgaccuacugcaggaggacc

SEQ ID NO: 75619 - RNA, 20 nt, Artificial Sequence
  MKO10075619_B_Cbln4
  gRNA
auugcagauccugguuaacg

SEQ ID NO: 75620 - RNA, 20 nt, Artificial Sequence
  MKO10075620_B_Cbln4
  gRNA
acccgugaagccgccacuaa

SEQ ID NO: 75621 - RNA, 20 nt, Artificial Sequence
  MKO10075621_B_Cbln4
  gRNA
caggagcacuccauuagugg

SEQ ID NO: 75622 - RNA, 20 nt, Artificial Sequence
  MKO10075622_B_Cbl
  gRNA
gccugucgaaagcucuucca

SEQ ID NO: 75623 - RNA, 20 nt, Artificial Sequence
  MKO10075623_B_Cbl
  gRNA
agccuugcuguaacucaccc

SEQ ID NO: 75624 - RNA, 20 nt, Artificial Sequence
  MKO10075624_B_Cbl
  gRNA
ucacugaccugccagguuug

SEQ ID NO: 75625 - RNA, 20 nt, Artificial Sequence
  MKO10075625_B_Cbr1
  gRNA
ggacgaggagcggggccaaa

SEQ ID NO: 75626 - RNA, 20 nt, Artificial Sequence
  MKO10075626_B_Cbr1
  gRNA
ccccuuccacauucaagcag

SEQ ID NO: 75627 - RNA, 20 nt, Artificial Sequence
  MKO10075627_B_Cbr1
  gRNA
uugucaccucugcuugaaug

SEQ ID NO: 75628 - RNA, 20 nt, Artificial Sequence
  MKO10075628_B_Cbr2
  gRNA
acuggugaacaaugcagcgc

SEQ ID NO: 75629 - RNA, 20 nt, Artificial Sequence
  MKO10075629_B_Cbr2
  gRNA
ccuggucagccuugccaaag

SEQ ID NO: 75630 - RNA, 20 nt, Artificial Sequence
  MKO10075630_B_Cbr2
  gRNA
ccgagucaccgccaccacuu

SEQ ID NO: 75631 - RNA, 20 nt, Artificial Sequence
  MKO10075631_B_Cbr3
  gRNA
gcagaaagucgcgcagcgca

SEQ ID NO: 75632 - RNA, 20 nt, Artificial Sequence
  MKO10075632_B_Cbr3
  gRNA
caccucagcuugaaugucga

SEQ ID NO: 75633 - RNA, 20 nt, Artificial Sequence
  MKO10075633_B_Cbr3
  gRNA
acccuucgacauucaagcug

SEQ ID NO: 75634 - RNA, 20 nt, Artificial Sequence
  MKO10075634_B_Cbr4
  gRNA
cauguucuuaucguggaugg

SEQ ID NO: 75635 - RNA, 20 nt, Artificial Sequence
  MKO10075635_B_Cbr4
  gRNA
ucagcugcacacuaaccucc

SEQ ID NO: 75636 - RNA, 20 nt, Artificial Sequence
  MKO10075636_B_Cbr4
  gRNA
uuugaccaaccuguugauac

SEQ ID NO: 75637 - RNA, 20 nt, Artificial Sequence
  MKO10075637_B_Cbs
  gRNA
aucgaagaugcugagcgagc

SEQ ID NO: 75638 - RNA, 20 nt, Artificial Sequence
  MKO10075638_B_Cbs
  gRNA
aucugcuugggguaucaggc

SEQ ID NO: 75639 - RNA, 20 nt, Artificial Sequence
  MKO10075639_B_Cbs
  gRNA
gacucgauccuuguccccug

SEQ ID NO: 75640 - RNA, 20 nt, Artificial Sequence
  MKO10075640_B_Cbwd1
  gRNA
gggagugauauuuaucuuga

SEQ ID NO: 75641 - RNA, 20 nt, Artificial Sequence
  MKO10075641_B_Cbwd1
  gRNA
uccaccuugacugacagcua

SEQ ID NO: 75642 - RNA, 20 nt, Artificial Sequence
  MKO10075642_B_Cbwd1
  gRNA
agaacucuaugaagaauggc

SEQ ID NO: 75643 - RNA, 20 nt, Artificial Sequence
  MKO10075643_B_Cbx1
  gRNA
guuucagugaggacaacacu

SEQ ID NO: 75644 - RNA, 20 nt, Artificial Sequence
  MKO10075644_B_Cbx1
  gRNA
agccaaugucaagugcccac

SEQ ID NO: 75645 - RNA, 20 nt, Artificial Sequence
  MKO10075645_B_Cbx1
  gRNA
ugguggaaaaaguucuugau

SEQ ID NO: 75646 - RNA, 20 nt, Artificial Sequence
  MKO10075646_B_Cbx2
  gRNA
ucaccuugagcuuggagcgc

SEQ ID NO: 75647 - RNA, 20 nt, Artificial Sequence
  MKO10075647_B_Cbx2
  gRNA
gaguucucacuucuucugga

SEQ ID NO: 75648 - RNA, 20 nt, Artificial Sequence
  MKO10075648_B_Cbx2
  gRNA
gcagggcaagcuggaguacc

SEQ ID NO: 75649 - RNA, 20 nt, Artificial Sequence
  MKO10075649_B_Cbx3
  gRNA
uaacucuccgcugcugucug

SEQ ID NO: 75650 - RNA, 20 nt, Artificial Sequence
  MKO10075650_B_Cbx3
  gRNA
cugugaaccccuuccacuuc

SEQ ID NO: 75651 - RNA, 20 nt, Artificial Sequence
  MKO10075651_B_Cbx3
  gRNA
aaaaugggaaagaaacaaaa

SEQ ID NO: 75652 - RNA, 20 nt, Artificial Sequence
  MKO10075652_B_Cbx4
  gRNA
cacuugcaagauauaacacg

SEQ ID NO: 75653 - RNA, 20 nt, Artificial Sequence
  MKO10075653_B_Cbx4
  gRNA
ugcugaucgccuuccagaac

SEQ ID NO: 75654 - RNA, 20 nt, Artificial Sequence
  MKO10075654_B_Cbx4
  gRNA
acagggcagaguggaguauc

SEQ ID NO: 75655 - RNA, 20 nt, Artificial Sequence
  MKO10075655_B_Cbx5
  gRNA
agcaaagcaaugauaucgcu

SEQ ID NO: 75656 - RNA, 20 nt, Artificial Sequence
  MKO10075656_B_Cbx5
  gRNA
agggugaaaacaauaagccc

SEQ ID NO: 75657 - RNA, 20 nt, Artificial Sequence
  MKO10075657_B_Cbx5
  gRNA
agccgacagcucuucuucag

SEQ ID NO: 75658 - RNA, 20 nt, Artificial Sequence
  MKO10075658_B_Cbx6
  gRNA
uccaacucacuucugcucga

SEQ ID NO: 75659 - RNA, 20 nt, Artificial Sequence
  MKO10075659_B_Cbx6
  gRNA
gacucggcagguacagcacu

SEQ ID NO: 75660 - RNA, 20 nt, Artificial Sequence
  MKO10075660_B_Cbx6
  gRNA
gaaagggaacgugagcugua

SEQ ID NO: 75661 - RNA, 20 nt, Artificial Sequence
  MKO10075661_B_Cbx7
  gRNA
ggguccuuacuucuccucgu

SEQ ID NO: 75662 - RNA, 20 nt, Artificial Sequence
  MKO10075662_B_Cbx7
  gRNA
ggaagagagguccgaaaccc

SEQ ID NO: 75663 - RNA, 20 nt, Artificial Sequence
  MKO10075663_B_Cbx7
  gRNA
ccagacguugugcagacccc

SEQ ID NO: 75664 - RNA, 20 nt, Artificial Sequence
  MKO10075664_B_Cbx8
  gRNA
gcauggaauaucucgugaaa

SEQ ID NO: 75665 - RNA, 20 nt, Artificial Sequence
  MKO10075665_B_Cbx8
  gRNA
uuuccuuuagguacagcacg

SEQ ID NO: 75666 - RNA, 20 nt, Artificial Sequence
  MKO10075666_B_Cbx8
  gRNA
uuucuuuagggaacgggaga

SEQ ID NO: 75667 - RNA, 20 nt, Artificial Sequence
  MKO10075667_B_Cby1
  gRNA
agagaggccgacuuccgagg

SEQ ID NO: 75668 - RNA, 20 nt, Artificial Sequence
  MKO10075668_B_Cby1
  gRNA
ugcacucacagaauguaggu

SEQ ID NO: 75669 - RNA, 20 nt, Artificial Sequence
  MKO10075669_B_Cby1
  gRNA
cuggagcuggggcucgacua

SEQ ID NO: 75670 - RNA, 20 nt, Artificial Sequence
  MKO10075670_B_Cc2d1a
  gRNA
ugcagcguggccucuacucc

SEQ ID NO: 75671 - RNA, 20 nt, Artificial Sequence
  MKO10075671_B_Cc2d1a
  gRNA
gggagguauaccugggccac

SEQ ID NO: 75672 - RNA, 20 nt, Artificial Sequence
  MKO10075672_B_Cc2d1a
  gRNA
gagccgggccaucuucucaa

SEQ ID NO: 75673 - RNA, 20 nt, Artificial Sequence
  MKO10075673_B_Cc2d1b
  gRNA
ucacaggggaaacagcgagc

SEQ ID NO: 75674 - RNA, 20 nt, Artificial Sequence
  MKO10075674_B_Cc2d1b
  gRNA
cacugaacuaccuguagagc

SEQ ID NO: 75675 - RNA, 20 nt, Artificial Sequence
  MKO10075675_B_Cc2d1b
  gRNA
agcaaguccagaccucugug

SEQ ID NO: 75676 - RNA, 20 nt, Artificial Sequence
  MKO10075676_B_Cc2d2a
  gRNA
caagcucaggagguuggucu

SEQ ID NO: 75677 - RNA, 20 nt, Artificial Sequence
  MKO10075677_B_Cc2d2a
  gRNA
cucccucauucguucccuca

SEQ ID NO: 75678 - RNA, 20 nt, Artificial Sequence
  MKO10075678_B_Cc2d2a
  gRNA
aagccgguucuagaagcuga

SEQ ID NO: 75679 - RNA, 20 nt, Artificial Sequence
  MKO10075679_B_Ccar1
  gRNA
gcaauauucacaaccucagc

SEQ ID NO: 75680 - RNA, 20 nt, Artificial Sequence
  MKO10075680_B_Ccar1
  gRNA
uuauacccagcagacugcau

SEQ ID NO: 75681 - RNA, 20 nt, Artificial Sequence
  MKO10075681_B_Ccar1
  gRNA
caaacuaaccuguguuaaaa

SEQ ID NO: 75682 - RNA, 20 nt, Artificial Sequence
  MKO10075682_B_Ccar2
  gRNA
cgugcccuggaaugcuguca

SEQ ID NO: 75683 - RNA, 20 nt, Artificial Sequence
  MKO10075683_B_Ccar2
  gRNA
accagcuugcaugacuacuu

SEQ ID NO: 75684 - RNA, 20 nt, Artificial Sequence
  MKO10075684_B_Ccar2
  gRNA
ggaguaaguagaccaggggg

SEQ ID NO: 75685 - RNA, 20 nt, Artificial Sequence
  MKO10075685_B_Ccbe1
  gRNA
guauuugucuccccuugugc

SEQ ID NO: 75686 - RNA, 20 nt, Artificial Sequence
  MKO10075686_B_Ccbe1
  gRNA
accgcgagagacaccaaaag

SEQ ID NO: 75687 - RNA, 20 nt, Artificial Sequence
  MKO10075687_B_Ccbe1
  gRNA
ggcuacauccuugaggacga

SEQ ID NO: 75688 - RNA, 20 nt, Artificial Sequence
  MKO10075688_B_Ccbl1
  gRNA
ucacaaacgcugagguguac

SEQ ID NO: 75689 - RNA, 20 nt, Artificial Sequence
  MKO10075689_B_Ccbl1
  gRNA
gucaccagcacauucuugag

SEQ ID NO: 75690 - RNA, 20 nt, Artificial Sequence
  MKO10075690_B_Ccbl1
  gRNA
gcuugccaaagaaacuugcc

SEQ ID NO: 75691 - RNA, 20 nt, Artificial Sequence
  MKO10075691_B_Ccbl2
  gRNA
guccacuucaucccgucagu

SEQ ID NO: 75692 - RNA, 20 nt, Artificial Sequence
  MKO10075692_B_Ccbl2
  gRNA
caggguugaauuuacuaagu

SEQ ID NO: 75693 - RNA, 20 nt, Artificial Sequence
  MKO10075693_B_Ccbl2
  gRNA
gagagauccauaugccccca

SEQ ID NO: 75694 - RNA, 20 nt, Artificial Sequence
  MKO10075694_B_Ccdc101
  gRNA
uagcauccuccgcaaagcgc

SEQ ID NO: 75695 - RNA, 20 nt, Artificial Sequence
  MKO10075695_B_Ccdc101
  gRNA
cacaaccgccaagacugaug

SEQ ID NO: 75696 - RNA, 20 nt, Artificial Sequence
  MKO10075696_B_Ccdc101
  gRNA
ucucugucugcauccgcucg

SEQ ID NO: 75697 - RNA, 20 nt, Artificial Sequence
  MKO10075697_B_Ccdc102a
  gRNA
gaacaagaagcugcgcgcac

SEQ ID NO: 75698 - RNA, 20 nt, Artificial Sequence
  MKO10075698_B_Ccdc102a
  gRNA
ucgggucagcucaggacgcc

SEQ ID NO: 75699 - RNA, 20 nt, Artificial Sequence
  MKO10075699_B_Ccdc102a
  gRNA
acaugcggcccaacucaucc

SEQ ID NO: 75700 - RNA, 20 nt, Artificial Sequence
  MKO10075700_B_Ccdc103
  gRNA
ccgaguagugugacaauucc

SEQ ID NO: 75701 - RNA, 20 nt, Artificial Sequence
  MKO10075701_B_Ccdc103
  gRNA
aguuacgggcaguugagcaa

SEQ ID NO: 75702 - RNA, 20 nt, Artificial Sequence
  MKO10075702_B_Ccdc103
  gRNA
auugucacacuacucgggaa

SEQ ID NO: 75703 - RNA, 20 nt, Artificial Sequence
  MKO10075703_B_Ccdc104
  gRNA
uuaccugacugcuuaacuga

SEQ ID NO: 75704 - RNA, 20 nt, Artificial Sequence
  MKO10075704_B_Ccdc104
  gRNA
gcaccaucaguuaagcaguc

SEQ ID NO: 75705 - RNA, 20 nt, Artificial Sequence
  MKO10075705_B_Ccdc104
  gRNA
aaaucuucugcugccaacac

SEQ ID NO: 75706 - RNA, 20 nt, Artificial Sequence
  MKO10075706_B_Ccdc105
  gRNA
uaaugagggggacuauccac

SEQ ID NO: 75707 - RNA, 20 nt, Artificial Sequence
  MKO10075707_B_Ccdc105
  gRNA
caaccguguaugcuccucgc

SEQ ID NO: 75708 - RNA, 20 nt, Artificial Sequence
  MKO10075708_B_Ccdc105
  gRNA
acgcaucuucugugccagcg

SEQ ID NO: 75709 - RNA, 20 nt, Artificial Sequence
  MKO10075709_B_Ccdc106
  gRNA
uucagcgggguuuccgaaga

SEQ ID NO: 75710 - RNA, 20 nt, Artificial Sequence
  MKO10075710_B_Ccdc106
  gRNA
gugguugcagaagcgcauug

SEQ ID NO: 75711 - RNA, 20 nt, Artificial Sequence
  MKO10075711_B_Ccdc106
  gRNA
agccuucgagcaccaccgug

SEQ ID NO: 75712 - RNA, 20 nt, Artificial Sequence
  MKO10075712_B_Ccdc107
  gRNA
uuucuacagggugacgacuu

SEQ ID NO: 75713 - RNA, 20 nt, Artificial Sequence
  MKO10075713_B_Ccdc107
  gRNA
gcucaacccaccugacugcg

SEQ ID NO: 75714 - RNA, 20 nt, Artificial Sequence
  MKO10075714_B_Ccdc107
  gRNA
ggaguggaaguuccagaacc

SEQ ID NO: 75715 - RNA, 20 nt, Artificial Sequence
  MKO10075715_B_Ccdc108
  gRNA
aggucgccgagaagcugcac

SEQ ID NO: 75716 - RNA, 20 nt, Artificial Sequence
  MKO10075716_B_Ccdc108
  gRNA
ugaacagcuuguagaucccc

SEQ ID NO: 75717 - RNA, 20 nt, Artificial Sequence
  MKO10075717_B_Ccdc108
  gRNA
auuucagauacuacccacua

SEQ ID NO: 75718 - RNA, 20 nt, Artificial Sequence
  MKO10075718_B_Ccdc109b
  gRNA
ggucgaucuucgccaucaga

SEQ ID NO: 75719 - RNA, 20 nt, Artificial Sequence
  MKO10075719_B_Ccdc109b
  gRNA
guggcuccacugucccauaa

SEQ ID NO: 75720 - RNA, 20 nt, Artificial Sequence
  MKO10075720_B_Ccdc109b
  gRNA
uaccaccaagcacuccauua

SEQ ID NO: 75721 - RNA, 20 nt, Artificial Sequence
  MKO10075721_B_Ccdc110
  gRNA
cuagguccuacaacaucagc

SEQ ID NO: 75722 - RNA, 20 nt, Artificial Sequence
  MKO10075722_B_Ccdc110
  gRNA
cuuacuuucagugcugauug

SEQ ID NO: 75723 - RNA, 20 nt, Artificial Sequence
  MKO10075723_B_Ccdc110
  gRNA
agaaaccccacaauuuaacu

SEQ ID NO: 75724 - RNA, 20 nt, Artificial Sequence
  MKO10075724_B_Ccdc112
  gRNA
agucauuucuacaaccaaag

SEQ ID NO: 75725 - RNA, 20 nt, Artificial Sequence
  MKO10075725_B_Ccdc112
  gRNA
cuuuacguuguuauguaucu

SEQ ID NO: 75726 - RNA, 20 nt, Artificial Sequence
  MKO10075726_B_Ccdc112
  gRNA
cgagaagcucagagaaauga

SEQ ID NO: 75727 - RNA, 20 nt, Artificial Sequence
  MKO10075727_B_Ccdc113
  gRNA
uaucugacaaccgugucauu

SEQ ID NO: 75728 - RNA, 20 nt, Artificial Sequence
  MKO10075728_B_Ccdc113
  gRNA
aacuucauuccaccgaaugu

SEQ ID NO: 75729 - RNA, 20 nt, Artificial Sequence
  MKO10075729_B_Ccdc113
  gRNA
ccagggaccaccgaaugaca

SEQ ID NO: 75730 - RNA, 20 nt, Artificial Sequence
  MKO10075730_B_Ccdc114
  gRNA
uguaggagauccaccuacuc

SEQ ID NO: 75731 - RNA, 20 nt, Artificial Sequence
  MKO10075731_B_Ccdc114
  gRNA
guucccuccagauccaggac

SEQ ID NO: 75732 - RNA, 20 nt, Artificial Sequence
  MKO10075732_B_Ccdc114
  gRNA
ugagagcuccaaccaucucc

SEQ ID NO: 75733 - RNA, 20 nt, Artificial Sequence
  MKO10075733_B_Ccdc115
  gRNA
aaacucaccaucccggaagc

SEQ ID NO: 75734 - RNA, 20 nt, Artificial Sequence
  MKO10075734_B_Ccdc115
  gRNA
ucucucaccaggccuacagc

SEQ ID NO: 75735 - RNA, 20 nt, Artificial Sequence
  MKO10075735_B_Ccdc115
  gRNA
cucaggucugcgugcgugcc

SEQ ID NO: 75736 - RNA, 20 nt, Artificial Sequence
  MKO10075736_B_Ccdc116
  gRNA
uauacuuaccggggccacau

SEQ ID NO: 75737 - RNA, 20 nt, Artificial Sequence
  MKO10075737_B_Ccdc116
  gRNA
ugcagaagaucggaguuucc

SEQ ID NO: 75738 - RNA, 20 nt, Artificial Sequence
  MKO10075738_B_Ccdc116
  gRNA
gccaucuggacugcauuagg

SEQ ID NO: 75739 - RNA, 20 nt, Artificial Sequence
  MKO10075739_B_Ccdc117
  gRNA
gucagucguuucuuucuuac

SEQ ID NO: 75740 - RNA, 20 nt, Artificial Sequence
  MKO10075740_B_Ccdc117
  gRNA
uugaugaagucuucacaaag

SEQ ID NO: 75741 - RNA, 20 nt, Artificial Sequence
  MKO10075741_B_Ccdc117
  gRNA
gauaauugacgaagaugaag

SEQ ID NO: 75742 - RNA, 20 nt, Artificial Sequence
  MKO10075742_B_Ccdc11
  gRNA
ggacuugaacaugaaacucg

SEQ ID NO: 75743 - RNA, 20 nt, Artificial Sequence
  MKO10075743_B_Ccdc11
  gRNA
cagaucauuaccugaacugc

SEQ ID NO: 75744 - RNA, 20 nt, Artificial Sequence
  MKO10075744_B_Ccdc11
  gRNA
ucuugugcaagcgagagucc

SEQ ID NO: 75745 - RNA, 20 nt, Artificial Sequence
  MKO10075745_B_Ccdc120
  gRNA
ccucuugcaaggcucgcugg

SEQ ID NO: 75746 - RNA, 20 nt, Artificial Sequence
  MKO10075746_B_Ccdc120
  gRNA
gaagugcaucaaccuguacc

SEQ ID NO: 75747 - RNA, 20 nt, Artificial Sequence
  MKO10075747_B_Ccdc120
  gRNA
gccuggugaacgaccucagu

SEQ ID NO: 75748 - RNA, 20 nt, Artificial Sequence
  MKO10075748_B_Ccdc121
  gRNA
gaagugcgccucccgguccu

SEQ ID NO: 75749 - RNA, 20 nt, Artificial Sequence
  MKO10075749_B_Ccdc121
  gRNA
ccgaagugagacugcgacca

SEQ ID NO: 75750 - RNA, 20 nt, Artificial Sequence
  MKO10075750_B_Ccdc121
  gRNA
aaagcaccggcagcuggcga

SEQ ID NO: 75751 - RNA, 20 nt, Artificial Sequence
  MKO10075751_B_Ccdc122
  gRNA
gcaucggcaagaugcugcaa

SEQ ID NO: 75752 - RNA, 20 nt, Artificial Sequence
  MKO10075752_B_Ccdc122
  gRNA
aaaaauucuguuccaguugc

SEQ ID NO: 75753 - RNA, 20 nt, Artificial Sequence
  MKO10075753_B_Ccdc122
  gRNA
uguuugugacuguuguuguu

SEQ ID NO: 75754 - RNA, 20 nt, Artificial Sequence
  MKO10075754_B_Ccdc124
  gRNA
uccugagcgccggaugcgag

SEQ ID NO: 75755 - RNA, 20 nt, Artificial Sequence
  MKO10075755_B_Ccdc124
  gRNA
cacagaucgaggacucgcug

SEQ ID NO: 75756 - RNA, 20 nt, Artificial Sequence
  MKO10075756_B_Ccdc124
  gRNA
cgcccaccugagcacugcga

SEQ ID NO: 75757 - RNA, 20 nt, Artificial Sequence
  MKO10075757_B_Ccdc125
  gRNA
gcgucucaaagacaacuuga

SEQ ID NO: 75758 - RNA, 20 nt, Artificial Sequence
  MKO10075758_B_Ccdc125
  gRNA
auugaaaauccuccaaagca

SEQ ID NO: 75759 - RNA, 20 nt, Artificial Sequence
  MKO10075759_B_Ccdc125
  gRNA
auacaaaccugucacauuuc

SEQ ID NO: 75760 - RNA, 20 nt, Artificial Sequence
  MKO10075760_B_Ccdc126
  gRNA
caacaaaaggacgaguguuu

SEQ ID NO: 75761 - RNA, 20 nt, Artificial Sequence
  MKO10075761_B_Ccdc126
  gRNA
uguggacagcggcgcgucca

SEQ ID NO: 75762 - RNA, 20 nt, Artificial Sequence
  MKO10075762_B_Ccdc126
  gRNA
acuacacuuugcaacagccg

SEQ ID NO: 75763 - RNA, 20 nt, Artificial Sequence
  MKO10075763_B_Ccdc127
  gRNA
ggggucguuuaaguuauuca

SEQ ID NO: 75764 - RNA, 20 nt, Artificial Sequence
  MKO10075764_B_Ccdc127
  gRNA
acagcugagccacagcgcgc

SEQ ID NO: 75765 - RNA, 20 nt, Artificial Sequence
  MKO10075765_B_Ccdc127
  gRNA
aaugcugccaauccgagcau

SEQ ID NO: 75766 - RNA, 20 nt, Artificial Sequence
  MKO10075766_B_Ccdc129
  gRNA
aacucguguuauuccaccac

SEQ ID NO: 75767 - RNA, 20 nt, Artificial Sequence
  MKO10075767_B_Ccdc129
  gRNA
ugaccgugaaagacuacaug

SEQ ID NO: 75768 - RNA, 20 nt, Artificial Sequence
  MKO10075768_B_Ccdc129
  gRNA
ugccuuaccaguaugguuga

SEQ ID NO: 75769 - RNA, 20 nt, Artificial Sequence
  MKO10075769_B_Ccdc12
  gRNA
ucgcccucuaguggaggaga

SEQ ID NO: 75770 - RNA, 20 nt, Artificial Sequence
  MKO10075770_B_Ccdc12
  gRNA
acacucaccaaucagguuuc

SEQ ID NO: 75771 - RNA, 20 nt, Artificial Sequence
  MKO10075771_B_Ccdc12
  gRNA
cucacaggggacucaggcuc

SEQ ID NO: 75772 - RNA, 20 nt, Artificial Sequence
  MKO10075772_B_Ccdc130
  gRNA
ccgucacaccagauguugua

SEQ ID NO: 75773 - RNA, 20 nt, Artificial Sequence
  MKO10075773_B_Ccdc130
  gRNA
cccagacuucaaccccgaaa

SEQ ID NO: 75774 - RNA, 20 nt, Artificial Sequence
  MKO10075774_B_Ccdc130
  gRNA
auuacacgacuccaaucuac

SEQ ID NO: 75775 - RNA, 20 nt, Artificial Sequence
  MKO10075775_B_Ccdc132
  gRNA
ucucaaucugcaagaguuag

SEQ ID NO: 75776 - RNA, 20 nt, Artificial Sequence
  MKO10075776_B_Ccdc132
  gRNA
aaaucaaaucucucaugacc

SEQ ID NO: 75777 - RNA, 20 nt, Artificial Sequence
  MKO10075777_B_Ccdc132
  gRNA
caagggucugaagagcccuc

SEQ ID NO: 75778 - RNA, 20 nt, Artificial Sequence
  MKO10075778_B_Ccdc134
  gRNA
ggaugucauucagcugcgcc

SEQ ID NO: 75779 - RNA, 20 nt, Artificial Sequence
  MKO10075779_B_Ccdc134
  gRNA
gcugccgaugugcuuccaga

SEQ ID NO: 75780 - RNA, 20 nt, Artificial Sequence
  MKO10075780_B_Ccdc134
  gRNA
caugcuuaagggacucuuca

SEQ ID NO: 75781 - RNA, 20 nt, Artificial Sequence
  MKO10075781_B_Ccdc135
  gRNA
auagcacuuaccggcuugag

SEQ ID NO: 75782 - RNA, 20 nt, Artificial Sequence
  MKO10075782_B_Ccdc135
  gRNA
aguucgugagcaccacccug

SEQ ID NO: 75783 - RNA, 20 nt, Artificial Sequence
  MKO10075783_B_Ccdc135
  gRNA
aauacuccaucaagccgccc

SEQ ID NO: 75784 - RNA, 20 nt, Artificial Sequence
  MKO10075784_B_Ccdc136
  gRNA
gcgcuacaacuuacugaaug

SEQ ID NO: 75785 - RNA, 20 nt, Artificial Sequence
  MKO10075785_B_Ccdc136
  gRNA
gaggagacccgugagcuugc

SEQ ID NO: 75786 - RNA, 20 nt, Artificial Sequence
  MKO10075786_B_Ccdc136
  gRNA
gcagcaugaagaugacuccc

SEQ ID NO: 75787 - RNA, 20 nt, Artificial Sequence
  MKO10075787_B_Ccdc137
  gRNA
cugcuccaugcgcuggacgu

SEQ ID NO: 75788 - RNA, 20 nt, Artificial Sequence
  MKO10075788_B_Ccdc137
  gRNA
gaauugcaagccuaagaacc

SEQ ID NO: 75789 - RNA, 20 nt, Artificial Sequence
  MKO10075789_B_Ccdc137
  gRNA
uuggagcaggagcuacugaa

SEQ ID NO: 75790 - RNA, 20 nt, Artificial Sequence
  MKO10075790_B_Ccdc138
  gRNA
ggcugcucugaugaaucaac

SEQ ID NO: 75791 - RNA, 20 nt, Artificial Sequence
  MKO10075791_B_Ccdc138
  gRNA
agaagaauugugaccucccc

SEQ ID NO: 75792 - RNA, 20 nt, Artificial Sequence
  MKO10075792_B_Ccdc138
  gRNA
aagaauccaguucaucaucu

SEQ ID NO: 75793 - RNA, 20 nt, Artificial Sequence
  MKO10075793_B_Ccdc13
  gRNA
ugcgcaggucacucaucuuc

SEQ ID NO: 75794 - RNA, 20 nt, Artificial Sequence
  MKO10075794_B_Ccdc13
  gRNA
ccaaagcucugucucccguc

SEQ ID NO: 75795 - RNA, 20 nt, Artificial Sequence
  MKO10075795_B_Ccdc13
  gRNA
agcaucuucgcagugagcuc

SEQ ID NO: 75796 - RNA, 20 nt, Artificial Sequence
  MKO10075796_B_Ccdc141
  gRNA
cuucaugaccgacaugccaa

SEQ ID NO: 75797 - RNA, 20 nt, Artificial Sequence
  MKO10075797_B_Ccdc141
  gRNA
cccaugccucacccagcguc

SEQ ID NO: 75798 - RNA, 20 nt, Artificial Sequence
  MKO10075798_B_Ccdc141
  gRNA
acaaguacuugcagcaacag

SEQ ID NO: 75799 - RNA, 20 nt, Artificial Sequence
  MKO10075799_B_Ccdc142
  gRNA
cuccagagugagcgcugcuu

SEQ ID NO: 75800 - RNA, 20 nt, Artificial Sequence
  MKO10075800_B_Ccdc142
  gRNA
guacagagccccagagcgac

SEQ ID NO: 75801 - RNA, 20 nt, Artificial Sequence
  MKO10075801_B_Ccdc142
  gRNA
cuccgaagcagcgcucacuc

SEQ ID NO: 75802 - RNA, 20 nt, Artificial Sequence
  MKO10075802_B_Ccdc144b
  gRNA
cugcgucugcaagcuucuua

SEQ ID NO: 75803 - RNA, 20 nt, Artificial Sequence
  MKO10075803_B_Ccdc144b
  gRNA
aaucucauccuguaugauuc

SEQ ID NO: 75804 - RNA, 20 nt, Artificial Sequence
  MKO10075804_B_Ccdc144b
  gRNA
agaagagaaaaaaugucguc

SEQ ID NO: 75805 - RNA, 20 nt, Artificial Sequence
  MKO10075805_B_Ccdc146
  gRNA
caccacuguaucguguagca

SEQ ID NO: 75806 - RNA, 20 nt, Artificial Sequence
  MKO10075806_B_Ccdc146
  gRNA
ugagcaccacaucuucccgc

SEQ ID NO: 75807 - RNA, 20 nt, Artificial Sequence
  MKO10075807_B_Ccdc146
  gRNA
aagcacugaggaacugcgca

SEQ ID NO: 75808 - RNA, 20 nt, Artificial Sequence
  MKO10075808_B_Ccdc147
  gRNA
ccugaccaaacuaguugagc

SEQ ID NO: 75809 - RNA, 20 nt, Artificial Sequence
  MKO10075809_B_Ccdc147
  gRNA
ucagaccaucgaaaagcagc

SEQ ID NO: 75810 - RNA, 20 nt, Artificial Sequence
  MKO10075810_B_Ccdc147
  gRNA
gguggacucggcauaugaca

SEQ ID NO: 75811 - RNA, 20 nt, Artificial Sequence
  MKO10075811_B_Ccdc148
  gRNA
cccguucucagcugcugaau

SEQ ID NO: 75812 - RNA, 20 nt, Artificial Sequence
  MKO10075812_B_Ccdc148
  gRNA
ugccuuugaaagacuucauc

SEQ ID NO: 75813 - RNA, 20 nt, Artificial Sequence
  MKO10075813_B_Ccdc148
  gRNA
gcacuuagaggaagaccuuu

SEQ ID NO: 75814 - RNA, 20 nt, Artificial Sequence
  MKO10075814_B_Ccdc149
  gRNA
gcucucgauacuucuucuuc

SEQ ID NO: 75815 - RNA, 20 nt, Artificial Sequence
  MKO10075815_B_Ccdc149
  gRNA
uguaguaccugguguguaaa

SEQ ID NO: 75816 - RNA, 20 nt, Artificial Sequence
  MKO10075816_B_Ccdc149
  gRNA
acagcugcugagagaaucgc

SEQ ID NO: 75817 - RNA, 20 nt, Artificial Sequence
  MKO10075817_B_Ccdc14
  gRNA
ccuacagacggacacucucc

SEQ ID NO: 75818 - RNA, 20 nt, Artificial Sequence
  MKO10075818_B_Ccdc14
  gRNA
ucaaucugauucagaaaguc

SEQ ID NO: 75819 - RNA, 20 nt, Artificial Sequence
  MKO10075819_B_Ccdc14
  gRNA
ugcaauucuaaaccuuuaga

SEQ ID NO: 75820 - RNA, 20 nt, Artificial Sequence
  MKO10075820_B_Ccdc150
  gRNA
gaagaaugcggcuguuauug

SEQ ID NO: 75821 - RNA, 20 nt, Artificial Sequence
  MKO10075821_B_Ccdc150
  gRNA
agagaugaccuaauaaugcu

SEQ ID NO: 75822 - RNA, 20 nt, Artificial Sequence
  MKO10075822_B_Ccdc150
  gRNA
uaguuccuccacaaauuacc

SEQ ID NO: 75823 - RNA, 20 nt, Artificial Sequence
  MKO10075823_B_Ccdc151
  gRNA
gguucaccgaagcaagucua

SEQ ID NO: 75824 - RNA, 20 nt, Artificial Sequence
  MKO10075824_B_Ccdc151
  gRNA
gaccaccacggugacuagcc

SEQ ID NO: 75825 - RNA, 20 nt, Artificial Sequence
  MKO10075825_B_Ccdc151
  gRNA
agaaaccguucuugaagaac

SEQ ID NO: 75826 - RNA, 20 nt, Artificial Sequence
  MKO10075826_B_Ccdc152
  gRNA
auucuucauacuaugauaaa

SEQ ID NO: 75827 - RNA, 20 nt, Artificial Sequence
  MKO10075827_B_Ccdc152
  gRNA
aagauaaaguuugcucauuu

SEQ ID NO: 75828 - RNA, 20 nt, Artificial Sequence
  MKO10075828_B_Ccdc152
  gRNA
uaucuugauaugcagaaaaa

SEQ ID NO: 75829 - RNA, 20 nt, Artificial Sequence
  MKO10075829_B_Ccdc153
  gRNA
ggcucagcuucaugcccacg

SEQ ID NO: 75830 - RNA, 20 nt, Artificial Sequence
  MKO10075830_B_Ccdc153
  gRNA
ucgcugucuuagccucccuu

SEQ ID NO: 75831 - RNA, 20 nt, Artificial Sequence
  MKO10075831_B_Ccdc153
  gRNA
gauacucacagcucuacaga

SEQ ID NO: 75832 - RNA, 20 nt, Artificial Sequence
  MKO10075832_B_Ccdc154
  gRNA
acgcugugagcaugccacau

SEQ ID NO: 75833 - RNA, 20 nt, Artificial Sequence
  MKO10075833_B_Ccdc154
  gRNA
aggcuuuaacacacaucagg

SEQ ID NO: 75834 - RNA, 20 nt, Artificial Sequence
  MKO10075834_B_Ccdc154
  gRNA
ugaaggugaaagccuuagug

SEQ ID NO: 75835 - RNA, 20 nt, Artificial Sequence
  MKO10075835_B_Ccdc155
  gRNA
ccaagcuccgggccaguguu

SEQ ID NO: 75836 - RNA, 20 nt, Artificial Sequence
  MKO10075836_B_Ccdc155
  gRNA
agaagccagggcucccucgu

SEQ ID NO: 75837 - RNA, 20 nt, Artificial Sequence
  MKO10075837_B_Ccdc155
  gRNA
agcuucgacagcagcuguag

SEQ ID NO: 75838 - RNA, 20 nt, Artificial Sequence
  MKO10075838_B_Ccdc157
  gRNA
cauguuuauugagacgaguc

SEQ ID NO: 75839 - RNA, 20 nt, Artificial Sequence
  MKO10075839_B_Ccdc157
  gRNA
cgacagcaugguccgucauc

SEQ ID NO: 75840 - RNA, 20 nt, Artificial Sequence
  MKO10075840_B_Ccdc157
  gRNA
gggcuagccagcagauccgc

SEQ ID NO: 75841 - RNA, 20 nt, Artificial Sequence
  MKO10075841_B_Ccdc158
  gRNA
ccccaaccugauaucagcca

SEQ ID NO: 75842 - RNA, 20 nt, Artificial Sequence
  MKO10075842_B_Ccdc158
  gRNA
agagcauauugaacguguuu

SEQ ID NO: 75843 - RNA, 20 nt, Artificial Sequence
  MKO10075843_B_Ccdc158
  gRNA
gagaugccauggcugauauc

SEQ ID NO: 75844 - RNA, 20 nt, Artificial Sequence
  MKO10075844_B_Ccdc159
  gRNA
cuuagcagcccaagauguga

SEQ ID NO: 75845 - RNA, 20 nt, Artificial Sequence
  MKO10075845_B_Ccdc159
  gRNA
gaugggagagcaugaacggg

SEQ ID NO: 75846 - RNA, 20 nt, Artificial Sequence
  MKO10075846_B_Ccdc159
  gRNA
cccagcucagccaaaguaaa

SEQ ID NO: 75847 - RNA, 20 nt, Artificial Sequence
  MKO10075847_B_Ccdc15
  gRNA
aaccaggccauaauaccagu

SEQ ID NO: 75848 - RNA, 20 nt, Artificial Sequence
  MKO10075848_B_Ccdc15
  gRNA
gcuuaacccgcugauugacc

SEQ ID NO: 75849 - RNA, 20 nt, Artificial Sequence
  MKO10075849_B_Ccdc15
  gRNA
aauuaauauaccucuugggu

SEQ ID NO: 75850 - RNA, 20 nt, Artificial Sequence
  MKO10075850_B_Ccdc160
  gRNA
caaagucccguucaaucucc

SEQ ID NO: 75851 - RNA, 20 nt, Artificial Sequence
  MKO10075851_B_Ccdc160
  gRNA
aaaucgugcucguuuaaaaa

SEQ ID NO: 75852 - RNA, 20 nt, Artificial Sequence
  MKO10075852_B_Ccdc160
  gRNA
aauccugcugaccacuuuac

SEQ ID NO: 75853 - RNA, 20 nt, Artificial Sequence
  MKO10075853_B_Ccdc162
  gRNA
aggcauuugcguuguucccg

SEQ ID NO: 75854 - RNA, 20 nt, Artificial Sequence
  MKO10075854_B_Ccdc162
  gRNA
gggacaucacuacaucacau

SEQ ID NO: 75855 - RNA, 20 nt, Artificial Sequence
  MKO10075855_B_Ccdc162
  gRNA
aagugacugugaccgcagag

SEQ ID NO: 75856 - RNA, 20 nt, Artificial Sequence
  MKO10075856_B_Ccdc163
  gRNA
accuguagaggaaacucgaa

SEQ ID NO: 75857 - RNA, 20 nt, Artificial Sequence
  MKO10075857_B_Ccdc163
  gRNA
uaaacuccgaucccagcuuc

SEQ ID NO: 75858 - RNA, 20 nt, Artificial Sequence
  MKO10075858_B_Ccdc163
  gRNA
guugcucccgauccuucaac

SEQ ID NO: 75859 - RNA, 20 nt, Artificial Sequence
  MKO10075859_B_Ccdc166
  gRNA
agcgucgcuucaccccgugg

SEQ ID NO: 75860 - RNA, 20 nt, Artificial Sequence
  MKO10075860_B_Ccdc166
  gRNA
guccuucuaccacggccgug

SEQ ID NO: 75861 - RNA, 20 nt, Artificial Sequence
  MKO10075861_B_Ccdc166
  gRNA
gcgccagauccaugcgguuc

SEQ ID NO: 75862 - RNA, 20 nt, Artificial Sequence
  MKO10075862_B_Ccdc167
  gRNA
agcugcuucgacaugagaac

SEQ ID NO: 75863 - RNA, 20 nt, Artificial Sequence
  MKO10075863_B_Ccdc167
  gRNA
uaguccaguaagcauagagc

SEQ ID NO: 75864 - RNA, 20 nt, Artificial Sequence
  MKO10075864_B_Ccdc167
  gRNA
aacuuucuuaccauacuugg

SEQ ID NO: 75865 - RNA, 20 nt, Artificial Sequence
  MKO10075865_B_Ccdc169
  gRNA
gcuccagcugggucucguac

SEQ ID NO: 75866 - RNA, 20 nt, Artificial Sequence
  MKO10075866_B_Ccdc169
  gRNA
caucuucucauagacacgaa

SEQ ID NO: 75867 - RNA, 20 nt, Artificial Sequence
  MKO10075867_B_Ccdc169
  gRNA
gcuggagcugaaugaccaau

SEQ ID NO: 75868 - RNA, 20 nt, Artificial Sequence
  MKO10075868_B_Ccdc170
  gRNA
aaaccgcugcugauuccucc

SEQ ID NO: 75869 - RNA, 20 nt, Artificial Sequence
  MKO10075869_B_Ccdc170
  gRNA
agagcaccuccggaggcacg

SEQ ID NO: 75870 - RNA, 20 nt, Artificial Sequence
  MKO10075870_B_Ccdc170
  gRNA
ggcuggcagccgaagucagc

SEQ ID NO: 75871 - RNA, 20 nt, Artificial Sequence
  MKO10075871_B_Ccdc171
  gRNA
auuucuccuucuuagcccga

SEQ ID NO: 75872 - RNA, 20 nt, Artificial Sequence
  MKO10075872_B_Ccdc171
  gRNA
agaauacgagucacuuaugc

SEQ ID NO: 75873 - RNA, 20 nt, Artificial Sequence
  MKO10075873_B_Ccdc171
  gRNA
ccggcuacaaaaaacucuac

SEQ ID NO: 75874 - RNA, 20 nt, Artificial Sequence
  MKO10075874_B_Ccdc172
  gRNA
cccuucucaaaacaucugcc

SEQ ID NO: 75875 - RNA, 20 nt, Artificial Sequence
  MKO10075875_B_Ccdc172
  gRNA
acucuccagaaaaagcuuaa

SEQ ID NO: 75876 - RNA, 20 nt, Artificial Sequence
  MKO10075876_B_Ccdc172
  gRNA
ucggagauuaccagaugucg

SEQ ID NO: 75877 - RNA, 20 nt, Artificial Sequence
  MKO10075877_B_Ccdc173
  gRNA
guacuguuucagaugauccu

SEQ ID NO: 75878 - RNA, 20 nt, Artificial Sequence
  MKO10075878_B_Ccdc173
  gRNA
agaaagaguagcucuugccg

SEQ ID NO: 75879 - RNA, 20 nt, Artificial Sequence
  MKO10075879_B_Ccdc173
  gRNA
gcacugccuagcacucucaa

SEQ ID NO: 75880 - RNA, 20 nt, Artificial Sequence
  MKO10075880_B_Ccdc174
  gRNA
uucugcagaagccaaguauc

SEQ ID NO: 75881 - RNA, 20 nt, Artificial Sequence
  MKO10075881_B_Ccdc174
  gRNA
uuuaccuuauuaauugucuu

SEQ ID NO: 75882 - RNA, 20 nt, Artificial Sequence
  MKO10075882_B_Ccdc174
  gRNA
agaagacucuagacaaagca

SEQ ID NO: 75883 - RNA, 20 nt, Artificial Sequence
  MKO10075883_B_Ccdc175
  gRNA
cggcuuucucuuccaagguu

SEQ ID NO: 75884 - RNA, 20 nt, Artificial Sequence
  MKO10075884_B_Ccdc175
  gRNA
uacaguaauguccuuaagaa

SEQ ID NO: 75885 - RNA, 20 nt, Artificial Sequence
  MKO10075885_B_Ccdc175
  gRNA
ucuccagcagaaaguaaagu

SEQ ID NO: 75886 - RNA, 20 nt, Artificial Sequence
  MKO10075886_B_Ccdc176
  gRNA
ugcucugcaagugagugagu

SEQ ID NO: 75887 - RNA, 20 nt, Artificial Sequence
  MKO10075887_B_Ccdc176
  gRNA
uuuagcugaaagaaaauuua

SEQ ID NO: 75888 - RNA, 20 nt, Artificial Sequence
  MKO10075888_B_Ccdc176
  gRNA
agaaaaacugaagcagcagu

SEQ ID NO: 75889 - RNA, 20 nt, Artificial Sequence
  MKO10075889_B_Ccdc177
  gRNA
gcucguaguucucuugcgcg

SEQ ID NO: 75890 - RNA, 20 nt, Artificial Sequence
  MKO10075890_B_Ccdc177
  gRNA
aguccuucgagcaacucgcg

SEQ ID NO: 75891 - RNA, 20 nt, Artificial Sequence
  MKO10075891_B_Ccdc177
  gRNA
agcgcgugcgcgccgaacag

SEQ ID NO: 75892 - RNA, 20 nt, Artificial Sequence
  MKO10075892_B_Ccdc178
  gRNA
uucugacaagccuugcauuc

SEQ ID NO: 75893 - RNA, 20 nt, Artificial Sequence
  MKO10075893_B_Ccdc178
  gRNA
auucuucuucuccagacaug

SEQ ID NO: 75894 - RNA, 20 nt, Artificial Sequence
  MKO10075894_B_Ccdc178
  gRNA
uaaaacaugucuucaaauaa

SEQ ID NO: 75895 - RNA, 20 nt, Artificial Sequence
  MKO10075895_B_Ccdc17
  gRNA
aucucugcagccagcguuuc

SEQ ID NO: 75896 - RNA, 20 nt, Artificial Sequence
  MKO10075896_B_Ccdc17
  gRNA
ggagaggcugcgagucuugc

SEQ ID NO: 75897 - RNA, 20 nt, Artificial Sequence
  MKO10075897_B_Ccdc17
  gRNA
acaagaaaagagccgugauc

SEQ ID NO: 75898 - RNA, 20 nt, Artificial Sequence
  MKO10075898_B_Ccdc181
  gRNA
ccggguggcuucaguuguag

SEQ ID NO: 75899 - RNA, 20 nt, Artificial Sequence
  MKO10075899_B_Ccdc181
  gRNA
cauaaccgaaaagcuugcug

SEQ ID NO: 75900 - RNA, 20 nt, Artificial Sequence
  MKO10075900_B_Ccdc181
  gRNA
guacagcauacccgaagcca

SEQ ID NO: 75901 - RNA, 20 nt, Artificial Sequence
  MKO10075901_B_Ccdc18
  gRNA
aaaggagcacaguuuacaag

SEQ ID NO: 75902 - RNA, 20 nt, Artificial Sequence
  MKO10075902_B_Ccdc18
  gRNA
uugauugugucaauucaaag

SEQ ID NO: 75903 - RNA, 20 nt, Artificial Sequence
  MKO10075903_B_Ccdc18
  gRNA
auaaucuguucuucuaagau

SEQ ID NO: 75904 - RNA, 20 nt, Artificial Sequence
  MKO10075904_B_Ccdc19
  gRNA
caagagcgacagcccuaucg

SEQ ID NO: 75905 - RNA, 20 nt, Artificial Sequence
  MKO10075905_B_Ccdc19
  gRNA
uuugauccgcucaaacuccu

SEQ ID NO: 75906 - RNA, 20 nt, Artificial Sequence
  MKO10075906_B_Ccdc19
  gRNA
aucgcuaaucaucagccccg

SEQ ID NO: 75907 - RNA, 20 nt, Artificial Sequence
  MKO10075907_B_Ccdc22
  gRNA
caugucugcccgcuuccgcc

SEQ ID NO: 75908 - RNA, 20 nt, Artificial Sequence
  MKO10075908_B_Ccdc22
  gRNA
ucgagugauuaauccugaug

SEQ ID NO: 75909 - RNA, 20 nt, Artificial Sequence
  MKO10075909_B_Ccdc22
  gRNA
acuacccagcgaugccucug

SEQ ID NO: 75910 - RNA, 20 nt, Artificial Sequence
  MKO10075910_B_Ccdc23
  gRNA
ugcucucaacagagucauga

SEQ ID NO: 75911 - RNA, 20 nt, Artificial Sequence
  MKO10075911_B_Ccdc23
  gRNA
uguaagcagaugcagccgcc

SEQ ID NO: 75912 - RNA, 20 nt, Artificial Sequence
  MKO10075912_B_Ccdc23
  gRNA
uaagcagaaaucugcccagc

SEQ ID NO: 75913 - RNA, 20 nt, Artificial Sequence
  MKO10075913_B_Ccdc24
  gRNA
gaacgagaucucugaccugc

SEQ ID NO: 75914 - RNA, 20 nt, Artificial Sequence
  MKO10075914_B_Ccdc24
  gRNA
uuuggguguccuuagagggc

SEQ ID NO: 75915 - RNA, 20 nt, Artificial Sequence
  MKO10075915_B_Ccdc24
  gRNA
ccugucuagaagccuucugg

SEQ ID NO: 75916 - RNA, 20 nt, Artificial Sequence
  MKO10075916_B_Ccdc25
  gRNA
gcuacuuaccaaauaucuuc

SEQ ID NO: 75917 - RNA, 20 nt, Artificial Sequence
  MKO10075917_B_Ccdc25
  gRNA
aucuacuuacacuauuuaca

SEQ ID NO: 75918 - RNA, 20 nt, Artificial Sequence
  MKO10075918_B_Ccdc25
  gRNA
ucacguggacaaacucucuu

SEQ ID NO: 75919 - RNA, 20 nt, Artificial Sequence
  MKO10075919_B_Ccdc27
  gRNA
uugacugaggaccauccccu

SEQ ID NO: 75920 - RNA, 20 nt, Artificial Sequence
  MKO10075920_B_Ccdc27
  gRNA
auguuguccugguacuaaac

SEQ ID NO: 75921 - RNA, 20 nt, Artificial Sequence
  MKO10075921_B_Ccdc27
  gRNA
cuugugagcucaacuaccca

SEQ ID NO: 75922 - RNA, 20 nt, Artificial Sequence
  MKO10075922_B_Ccdc28a
  gRNA
gcugcuuuccgcuuauccuc

SEQ ID NO: 75923 - RNA, 20 nt, Artificial Sequence
  MKO10075923_B_Ccdc28a
  gRNA
gcuuuagcugcuggacgcau

SEQ ID NO: 75924 - RNA, 20 nt, Artificial Sequence
  MKO10075924_B_Ccdc28a
  gRNA
auccagacagaaacugcacu

SEQ ID NO: 75925 - RNA, 20 nt, Artificial Sequence
  MKO10075925_B_Ccdc28b
  gRNA
ggaauguuccuucgagcagc

SEQ ID NO: 75926 - RNA, 20 nt, Artificial Sequence
  MKO10075926_B_Ccdc28b
  gRNA
ugaggaccagccagcugcgu

SEQ ID NO: 75927 - RNA, 20 nt, Artificial Sequence
  MKO10075927_B_Ccdc28b
  gRNA
aggcaaggagaaaugccgac

SEQ ID NO: 75928 - RNA, 20 nt, Artificial Sequence
  MKO10075928_B_Ccdc30
  gRNA
ccuguggaucuccuccagcg

SEQ ID NO: 75929 - RNA, 20 nt, Artificial Sequence
  MKO10075929_B_Ccdc30
  gRNA
gaggcgcugcagcucuacuc

SEQ ID NO: 75930 - RNA, 20 nt, Artificial Sequence
  MKO10075930_B_Ccdc30
  gRNA
auuguacuuuaauugucucu

SEQ ID NO: 75931 - RNA, 20 nt, Artificial Sequence
  MKO10075931_B_Ccdc32
  gRNA
uguuuccgacaaugccuucu

SEQ ID NO: 75932 - RNA, 20 nt, Artificial Sequence
  MKO10075932_B_Ccdc32
  gRNA
auuuauuguucugcugccgc

SEQ ID NO: 75933 - RNA, 20 nt, Artificial Sequence
  MKO10075933_B_Ccdc32
  gRNA
ggcuucucagccugcgacuc

SEQ ID NO: 75934 - RNA, 20 nt, Artificial Sequence
  MKO10075934_B_Ccdc33
  gRNA
uacccgagcaauuaccacca

SEQ ID NO: 75935 - RNA, 20 nt, Artificial Sequence
  MKO10075935_B_Ccdc33
  gRNA
gaagaugcgcagguauuuaa

SEQ ID NO: 75936 - RNA, 20 nt, Artificial Sequence
  MKO10075936_B_Ccdc33
  gRNA
cuucugcaggucuuucuucg

SEQ ID NO: 75937 - RNA, 20 nt, Artificial Sequence
  MKO10075937_B_Ccdc34
  gRNA
aagagcuaugguuacuccag

SEQ ID NO: 75938 - RNA, 20 nt, Artificial Sequence
  MKO10075938_B_Ccdc34
  gRNA
aauugcugaaguaaagcaca

SEQ ID NO: 75939 - RNA, 20 nt, Artificial Sequence
  MKO10075939_B_Ccdc34
  gRNA
gguucaaaagaaaaauaagc

SEQ ID NO: 75940 - RNA, 20 nt, Artificial Sequence
  MKO10075940_B_Ccdc36
  gRNA
agagacucugcuaccguccu

SEQ ID NO: 75941 - RNA, 20 nt, Artificial Sequence
  MKO10075941_B_Ccdc36
  gRNA
acacucacaagucuuggcua

SEQ ID NO: 75942 - RNA, 20 nt, Artificial Sequence
  MKO10075942_B_Ccdc36
  gRNA
cuuaccuuguuaaugacuuc

SEQ ID NO: 75943 - RNA, 20 nt, Artificial Sequence
  MKO10075943_B_Ccdc37
  gRNA
gcgaagcauguuccuccucc

SEQ ID NO: 75944 - RNA, 20 nt, Artificial Sequence
  MKO10075944_B_Ccdc37
  gRNA
auguagucauucaguguuuc

SEQ ID NO: 75945 - RNA, 20 nt, Artificial Sequence
  MKO10075945_B_Ccdc37
  gRNA
agcuguuguuuauuaaaucc

SEQ ID NO: 75946 - RNA, 20 nt, Artificial Sequence
  MKO10075946_B_Ccdc38
  gRNA
aaaagaugcuguacucaaaa

SEQ ID NO: 75947 - RNA, 20 nt, Artificial Sequence
  MKO10075947_B_Ccdc38
  gRNA
aagagacagauuucuacuug

SEQ ID NO: 75948 - RNA, 20 nt, Artificial Sequence
  MKO10075948_B_Ccdc38
  gRNA
aagaaaaugaaauugcugcc

SEQ ID NO: 75949 - RNA, 20 nt, Artificial Sequence
  MKO10075949_B_Ccdc39
  gRNA
ccauuuggcucuugcgcucc

SEQ ID NO: 75950 - RNA, 20 nt, Artificial Sequence
  MKO10075950_B_Ccdc39
  gRNA
agcaagacgauaacaaaauc

SEQ ID NO: 75951 - RNA, 20 nt, Artificial Sequence
  MKO10075951_B_Ccdc39
  gRNA
acaguuggcaaagcuccgag

SEQ ID NO: 75952 - RNA, 20 nt, Artificial Sequence
  MKO10075952_B_Ccdc3
  gRNA
ucagcagcacauuaacgcuc

SEQ ID NO: 75953 - RNA, 20 nt, Artificial Sequence
  MKO10075953_B_Ccdc3
  gRNA
gugcgugcccccuaucugca

SEQ ID NO: 75954 - RNA, 20 nt, Artificial Sequence
  MKO10075954_B_Ccdc3
  gRNA
aagucgucagcugcugcccu

SEQ ID NO: 75955 - RNA, 20 nt, Artificial Sequence
  MKO10075955_B_Ccdc40
  gRNA
gggaagaucguccguguccg

SEQ ID NO: 75956 - RNA, 20 nt, Artificial Sequence
  MKO10075956_B_Ccdc40
  gRNA
ccaccagagagugccgguca

SEQ ID NO: 75957 - RNA, 20 nt, Artificial Sequence
  MKO10075957_B_Ccdc40
  gRNA
aagucugacucccucggaca

SEQ ID NO: 75958 - RNA, 20 nt, Artificial Sequence
  MKO10075958_B_Ccdc41
  gRNA
aacugcuccuugaagacuua

SEQ ID NO: 75959 - RNA, 20 nt, Artificial Sequence
  MKO10075959_B_Ccdc41
  gRNA
gguacuaacaccacaaaaau

SEQ ID NO: 75960 - RNA, 20 nt, Artificial Sequence
  MKO10075960_B_Ccdc41
  gRNA
auucuccccuuaagucuuca

SEQ ID NO: 75961 - RNA, 20 nt, Artificial Sequence
  MKO10075961_B_Ccdc42b
  gRNA
ucacggacucuaucgugcug

SEQ ID NO: 75962 - RNA, 20 nt, Artificial Sequence
  MKO10075962_B_Ccdc42b
  gRNA
uagaguccgugaaccagcgc

SEQ ID NO: 75963 - RNA, 20 nt, Artificial Sequence
  MKO10075963_B_Ccdc42b
  gRNA
uucggucuugcagcuuauau

SEQ ID NO: 75964 - RNA, 20 nt, Artificial Sequence
  MKO10075964_B_Ccdc42
  gRNA
cccggucgaagcgcaucugc

SEQ ID NO: 75965 - RNA, 20 nt, Artificial Sequence
  MKO10075965_B_Ccdc42
  gRNA
gcggcuggcccgcuacaugg

SEQ ID NO: 75966 - RNA, 20 nt, Artificial Sequence
  MKO10075966_B_Ccdc42
  gRNA
cuucaguucacgcuccuugu

SEQ ID NO: 75967 - RNA, 20 nt, Artificial Sequence
  MKO10075967_B_Ccdc43
  gRNA
uggagcgauggucagaaaca

SEQ ID NO: 75968 - RNA, 20 nt, Artificial Sequence
  MKO10075968_B_Ccdc43
  gRNA
cgccaccuugauugagaagc

SEQ ID NO: 75969 - RNA, 20 nt, Artificial Sequence
  MKO10075969_B_Ccdc43
  gRNA
ugucaccaccaaagucaaaa

SEQ ID NO: 75970 - RNA, 20 nt, Artificial Sequence
  MKO10075970_B_Ccdc47
  gRNA
cuuaccacuugaucacucac

SEQ ID NO: 75971 - RNA, 20 nt, Artificial Sequence
  MKO10075971_B_Ccdc47
  gRNA
cagucaccaucaaaauuucu

SEQ ID NO: 75972 - RNA, 20 nt, Artificial Sequence
  MKO10075972_B_Ccdc47
  gRNA
augagcacaucuauaaccug

SEQ ID NO: 75973 - RNA, 20 nt, Artificial Sequence
  MKO10075973_B_Ccdc50
  gRNA
acuuacucucuuguuccugc

SEQ ID NO: 75974 - RNA, 20 nt, Artificial Sequence
  MKO10075974_B_Ccdc50
  gRNA
gcagaucauguuguaccaga

SEQ ID NO: 75975 - RNA, 20 nt, Artificial Sequence
  MKO10075975_B_Ccdc50
  gRNA
gggccagggugugguccucc

SEQ ID NO: 75976 - RNA, 20 nt, Artificial Sequence
  MKO10075976_B_Ccdc51
  gRNA
accgcuuggaccgagucucc

SEQ ID NO: 75977 - RNA, 20 nt, Artificial Sequence
  MKO10075977_B_Ccdc51
  gRNA
cguguucgcaaugcagcacg

SEQ ID NO: 75978 - RNA, 20 nt, Artificial Sequence
  MKO10075978_B_Ccdc51
  gRNA
cagguacugguuguccuccc

SEQ ID NO: 75979 - RNA, 20 nt, Artificial Sequence
  MKO10075979_B_Ccdc53
  gRNA
acacugugcaguuucucaac

SEQ ID NO: 75980 - RNA, 20 nt, Artificial Sequence
  MKO10075980_B_Ccdc53
  gRNA
gcacagugugcaccacaaac

SEQ ID NO: 75981 - RNA, 20 nt, Artificial Sequence
  MKO10075981_B_Ccdc53
  gRNA
uuguuucaauuugcugaauc

SEQ ID NO: 75982 - RNA, 20 nt, Artificial Sequence
  MKO10075982_B_Ccdc54
  gRNA
cggugaaggcguagucucuc

SEQ ID NO: 75983 - RNA, 20 nt, Artificial Sequence
  MKO10075983_B_Ccdc54
  gRNA
ugcaacccacugaugcauuu

SEQ ID NO: 75984 - RNA, 20 nt, Artificial Sequence
  MKO10075984_B_Ccdc54
  gRNA
aaaagaguaagagcugccgc

SEQ ID NO: 75985 - RNA, 20 nt, Artificial Sequence
  MKO10075985_B_Ccdc55
  gRNA
gcugucauacucauacacag

SEQ ID NO: 75986 - RNA, 20 nt, Artificial Sequence
  MKO10075986_B_Ccdc55
  gRNA
ccgugagcgaaagccuucag

SEQ ID NO: 75987 - RNA, 20 nt, Artificial Sequence
  MKO10075987_B_Ccdc55
  gRNA
cuaaccuuccgauccuuccc

SEQ ID NO: 75988 - RNA, 20 nt, Artificial Sequence
  MKO10075988_B_Ccdc57
  gRNA
ucaugucgucagcccucagc

SEQ ID NO: 75989 - RNA, 20 nt, Artificial Sequence
  MKO10075989_B_Ccdc57
  gRNA
gcgggaacagaaugagcgcc

SEQ ID NO: 75990 - RNA, 20 nt, Artificial Sequence
  MKO10075990_B_Ccdc57
  gRNA
gcucauucuguucccgcugg

SEQ ID NO: 75991 - RNA, 20 nt, Artificial Sequence
  MKO10075991_B_Ccdc58
  gRNA
acuuagaaaagaacagacaa

SEQ ID NO: 75992 - RNA, 20 nt, Artificial Sequence
  MKO10075992_B_Ccdc58
  gRNA
agaagagagagaaaagaacc

SEQ ID NO: 75993 - RNA, 20 nt, Artificial Sequence
  MKO10075993_B_Ccdc58
  gRNA
uuaauaacguuaagucaucc

SEQ ID NO: 75994 - RNA, 20 nt, Artificial Sequence
  MKO10075994_B_Ccdc59
  gRNA
aacugggacuccugugacgc

SEQ ID NO: 75995 - RNA, 20 nt, Artificial Sequence
  MKO10075995_B_Ccdc59
  gRNA
gauacuccaucuguaaauuc

SEQ ID NO: 75996 - RNA, 20 nt, Artificial Sequence
  MKO10075996_B_Ccdc59
  gRNA
gccuaaccugaauuuacaga

SEQ ID NO: 75997 - RNA, 20 nt, Artificial Sequence
  MKO10075997_B_Ccdc60
  gRNA
ccggcuuacacgugagacuc

SEQ ID NO: 75998 - RNA, 20 nt, Artificial Sequence
  MKO10075998_B_Ccdc60
  gRNA
cuacuucaacauccugcgag

SEQ ID NO: 75999 - RNA, 20 nt, Artificial Sequence
  MKO10075999_B_Ccdc60
  gRNA
ggucgauggucagggccucu

SEQ ID NO: 76000 - RNA, 20 nt, Artificial Sequence
  MKO10076000_B_Ccdc61
  gRNA
cggccaggaugcucgggaga

SEQ ID NO: 76001 - RNA, 20 nt, Artificial Sequence
  MKO10076001_B_Ccdc61
  gRNA
cccgcugccccucccguacc

SEQ ID NO: 76002 - RNA, 20 nt, Artificial Sequence
  MKO10076002_B_Ccdc61
  gRNA
gucucugcgcagccgcaagc

SEQ ID NO: 76003 - RNA, 20 nt, Artificial Sequence
  MKO10076003_B_Ccdc62
  gRNA
caaccucaaggucuuccgag

SEQ ID NO: 76004 - RNA, 20 nt, Artificial Sequence
  MKO10076004_B_Ccdc62
  gRNA
acucugcuugauuggacucc

SEQ ID NO: 76005 - RNA, 20 nt, Artificial Sequence
  MKO10076005_B_Ccdc62
  gRNA
aaaucucagcagcacguuag

SEQ ID NO: 76006 - RNA, 20 nt, Artificial Sequence
  MKO10076006_B_Ccdc63
  gRNA
cgugaagucuccgaagaacc

SEQ ID NO: 76007 - RNA, 20 nt, Artificial Sequence
  MKO10076007_B_Ccdc63
  gRNA
ugccccccagaucguucaga

SEQ ID NO: 76008 - RNA, 20 nt, Artificial Sequence
  MKO10076008_B_Ccdc63
  gRNA
cguaggcggccuucucaaag

SEQ ID NO: 76009 - RNA, 20 nt, Artificial Sequence
  MKO10076009_B_Ccdc64b
  gRNA
ucaugagcuccgucgaggac

SEQ ID NO: 76010 - RNA, 20 nt, Artificial Sequence
  MKO10076010_B_Ccdc64b
  gRNA
cugaccgcuguucgccaagc

SEQ ID NO: 76011 - RNA, 20 nt, Artificial Sequence
  MKO10076011_B_Ccdc64b
  gRNA
accagaugcugcaagaccgc

SEQ ID NO: 76012 - RNA, 20 nt, Artificial Sequence
  MKO10076012_B_Ccdc64
  gRNA
gccuuucuaggaucagcacc

SEQ ID NO: 76013 - RNA, 20 nt, Artificial Sequence
  MKO10076013_B_Ccdc64
  gRNA
ccaccaaccagcauaucauc

SEQ ID NO: 76014 - RNA, 20 nt, Artificial Sequence
  MKO10076014_B_Ccdc64
  gRNA
ugugacucacccugcugagu

SEQ ID NO: 76015 - RNA, 20 nt, Artificial Sequence
  MKO10076015_B_Ccdc65
  gRNA
acaguccaccacgcguucaa

SEQ ID NO: 76016 - RNA, 20 nt, Artificial Sequence
  MKO10076016_B_Ccdc65
  gRNA
ucuugacccugcaacgacgc

SEQ ID NO: 76017 - RNA, 20 nt, Artificial Sequence
  MKO10076017_B_Ccdc65
  gRNA
ggcgaucuuccgguccuccg

SEQ ID NO: 76018 - RNA, 20 nt, Artificial Sequence
  MKO10076018_B_Ccdc66
  gRNA
auauggggacaguauuaacu

SEQ ID NO: 76019 - RNA, 20 nt, Artificial Sequence
  MKO10076019_B_Ccdc66
  gRNA
gaaaugccucuugagcucuc

SEQ ID NO: 76020 - RNA, 20 nt, Artificial Sequence
  MKO10076020_B_Ccdc66
  gRNA
aaguuaauacuguccccaua

SEQ ID NO: 76021 - RNA, 20 nt, Artificial Sequence
  MKO10076021_B_Ccdc67
  gRNA
gauggaacaaaucgacauca

SEQ ID NO: 76022 - RNA, 20 nt, Artificial Sequence
  MKO10076022_B_Ccdc67
  gRNA
uaauguaggugggguugcuu

SEQ ID NO: 76023 - RNA, 20 nt, Artificial Sequence
  MKO10076023_B_Ccdc67
  gRNA
aggaguuccgagcaaagucg

SEQ ID NO: 76024 - RNA, 20 nt, Artificial Sequence
  MKO10076024_B_Ccdc68
  gRNA
ggaaaaccguguacagagga

SEQ ID NO: 76025 - RNA, 20 nt, Artificial Sequence
  MKO10076025_B_Ccdc68
  gRNA
agaccuggagaaaaagcacg

SEQ ID NO: 76026 - RNA, 20 nt, Artificial Sequence
  MKO10076026_B_Ccdc68
  gRNA
uuccaugagcaaauccagac

SEQ ID NO: 76027 - RNA, 20 nt, Artificial Sequence
  MKO10076027_B_Ccdc69
  gRNA
cucuaggauuaugggagucc

SEQ ID NO: 76028 - RNA, 20 nt, Artificial Sequence
  MKO10076028_B_Ccdc69
  gRNA
ugcaagucaugucucaccac

SEQ ID NO: 76029 - RNA, 20 nt, Artificial Sequence
  MKO10076029_B_Ccdc69
  gRNA
cuucuuuguccagugccucc

SEQ ID NO: 76030 - RNA, 20 nt, Artificial Sequence
  MKO10076030_B_Ccdc6
  gRNA
gauaugccucaucauguucu

SEQ ID NO: 76031 - RNA, 20 nt, Artificial Sequence
  MKO10076031_B_Ccdc6
  gRNA
gagacgggagaagauugacc

SEQ ID NO: 76032 - RNA, 20 nt, Artificial Sequence
  MKO10076032_B_Ccdc6
  gRNA
cucuuccuucucguaauuca

SEQ ID NO: 76033 - RNA, 20 nt, Artificial Sequence
  MKO10076033_B_Ccdc70
  gRNA
cauccacuugcucaccuuga

SEQ ID NO: 76034 - RNA, 20 nt, Artificial Sequence
  MKO10076034_B_Ccdc70
  gRNA
uucaggaggacaaggcccua

SEQ ID NO: 76035 - RNA, 20 nt, Artificial Sequence
  MKO10076035_B_Ccdc70
  gRNA
ggaaagcccugaucuugccu

SEQ ID NO: 76036 - RNA, 20 nt, Artificial Sequence
  MKO10076036_B_Ccdc71l
  gRNA
acugucgcuggccggaagca

SEQ ID NO: 76037 - RNA, 20 nt, Artificial Sequence
  MKO10076037_B_Ccdc71l
  gRNA
cguagacguccuugcugcgc

SEQ ID NO: 76038 - RNA, 20 nt, Artificial Sequence
  MKO10076038_B_Ccdc71l
  gRNA
gcgcaucacagccggugcac

SEQ ID NO: 76039 - RNA, 20 nt, Artificial Sequence
  MKO10076039_B_Ccdc71
  gRNA
cccaaagcaacggcgcccaa

SEQ ID NO: 76040 - RNA, 20 nt, Artificial Sequence
  MKO10076040_B_Ccdc71
  gRNA
gagcgcgagcagcuuugauc

SEQ ID NO: 76041 - RNA, 20 nt, Artificial Sequence
  MKO10076041_B_Ccdc71
  gRNA
ccuggggcuggucuccgacg

SEQ ID NO: 76042 - RNA, 20 nt, Artificial Sequence
  MKO10076042_B_Ccdc73
  gRNA
acaagaacugaaauggcaaa

SEQ ID NO: 76043 - RNA, 20 nt, Artificial Sequence
  MKO10076043_B_Ccdc73
  gRNA
ggaggcucuucagaaucaaa

SEQ ID NO: 76044 - RNA, 20 nt, Artificial Sequence
  MKO10076044_B_Ccdc73
  gRNA
aaagcaacacaaagaagcaa

SEQ ID NO: 76045 - RNA, 20 nt, Artificial Sequence
  MKO10076045_B_Ccdc74a
  gRNA
gggccauccccgucccuugc

SEQ ID NO: 76046 - RNA, 20 nt, Artificial Sequence
  MKO10076046_B_Ccdc74a
  gRNA
cauucaugauuagcuuguag

SEQ ID NO: 76047 - RNA, 20 nt, Artificial Sequence
  MKO10076047_B_Ccdc74a
  gRNA
agcccuccaaaagacagacc

SEQ ID NO: 76048 - RNA, 20 nt, Artificial Sequence
  MKO10076048_B_Ccdc77
  gRNA
gccagacgauccucgacuga

SEQ ID NO: 76049 - RNA, 20 nt, Artificial Sequence
  MKO10076049_B_Ccdc77
  gRNA
uaggucacuucaccagcauc

SEQ ID NO: 76050 - RNA, 20 nt, Artificial Sequence
  MKO10076050_B_Ccdc77
  gRNA
aaauuacuuacucugugggg

SEQ ID NO: 76051 - RNA, 20 nt, Artificial Sequence
  MKO10076051_B_Ccdc78
  gRNA
gagugaagaacagcgguugc

SEQ ID NO: 76052 - RNA, 20 nt, Artificial Sequence
  MKO10076052_B_Ccdc78
  gRNA
ccuagccugggccacuagcc

SEQ ID NO: 76053 - RNA, 20 nt, Artificial Sequence
  MKO10076053_B_Ccdc78
  gRNA
aagcugaagucuuugagcug

SEQ ID NO: 76054 - RNA, 20 nt, Artificial Sequence
  MKO10076054_B_Ccdc79
  gRNA
acaucaaaccaccaauuucc

SEQ ID NO: 76055 - RNA, 20 nt, Artificial Sequence
  MKO10076055_B_Ccdc79
  gRNA
gacauuccaacaguaacuuc

SEQ ID NO: 76056 - RNA, 20 nt, Artificial Sequence
  MKO10076056_B_Ccdc79
  gRNA
aaguucugucacagauguuc

SEQ ID NO: 76057 - RNA, 20 nt, Artificial Sequence
  MKO10076057_B_Ccdc7
  gRNA
uauggagcuugcuaugauaa

SEQ ID NO: 76058 - RNA, 20 nt, Artificial Sequence
  MKO10076058_B_Ccdc7
  gRNA
uucacaauuuacaucucagc

SEQ ID NO: 76059 - RNA, 20 nt, Artificial Sequence
  MKO10076059_B_Ccdc7
  gRNA
guuuggauuacugaaaauuu

SEQ ID NO: 76060 - RNA, 20 nt, Artificial Sequence
  MKO10076060_B_Ccdc80
  gRNA
gaccuacgaugacuucuuca

SEQ ID NO: 76061 - RNA, 20 nt, Artificial Sequence
  MKO10076061_B_Ccdc80
  gRNA
ccaaucccgaaucaaagaua

SEQ ID NO: 76062 - RNA, 20 nt, Artificial Sequence
  MKO10076062_B_Ccdc80
  gRNA
ccagcugaucaccacuccca

SEQ ID NO: 76063 - RNA, 20 nt, Artificial Sequence
  MKO10076063_B_Ccdc81
  gRNA
aaagcgucccaacagugcga

SEQ ID NO: 76064 - RNA, 20 nt, Artificial Sequence
  MKO10076064_B_Ccdc81
  gRNA
ucuauuguaucccuguuaaa

SEQ ID NO: 76065 - RNA, 20 nt, Artificial Sequence
  MKO10076065_B_Ccdc81
  gRNA
uuucagaagucucuacuauc

SEQ ID NO: 76066 - RNA, 20 nt, Artificial Sequence
  MKO10076066_B_Ccdc82
  gRNA
cucuuucaaagugaguauaa

SEQ ID NO: 76067 - RNA, 20 nt, Artificial Sequence
  MKO10076067_B_Ccdc82
  gRNA
gaugcacugaaaauuuacag

SEQ ID NO: 76068 - RNA, 20 nt, Artificial Sequence
  MKO10076068_B_Ccdc82
  gRNA
gacgagaauagcaaucaaca

SEQ ID NO: 76069 - RNA, 20 nt, Artificial Sequence
  MKO10076069_B_Ccdc83
  gRNA
ucuccucagucgugaaauaa

SEQ ID NO: 76070 - RNA, 20 nt, Artificial Sequence
  MKO10076070_B_Ccdc83
  gRNA
cucgaagcugccugucagug

SEQ ID NO: 76071 - RNA, 20 nt, Artificial Sequence
  MKO10076071_B_Ccdc83
  gRNA
aaugcgcauacaaauaaaug

SEQ ID NO: 76072 - RNA, 20 nt, Artificial Sequence
  MKO10076072_B_Ccdc84
  gRNA
gauggcagcucagauccgug

SEQ ID NO: 76073 - RNA, 20 nt, Artificial Sequence
  MKO10076073_B_Ccdc84
  gRNA
gaagggcuuggauuccuaug

SEQ ID NO: 76074 - RNA, 20 nt, Artificial Sequence
  MKO10076074_B_Ccdc84
  gRNA
gaaguuucugaucucccccc

SEQ ID NO: 76075 - RNA, 20 nt, Artificial Sequence
  MKO10076075_B_Ccdc85a
  gRNA
gcucccacucaacacgugcu

SEQ ID NO: 76076 - RNA, 20 nt, Artificial Sequence
  MKO10076076_B_Ccdc85a
  gRNA
uucacauaggcccuuuguac

SEQ ID NO: 76077 - RNA, 20 nt, Artificial Sequence
  MKO10076077_B_Ccdc85a
  gRNA
agaaaaucgcaugcugcccc

SEQ ID NO: 76078 - RNA, 20 nt, Artificial Sequence
  MKO10076078_B_Ccdc85b
  gRNA
aacuuccaucgccuaggucg

SEQ ID NO: 76079 - RNA, 20 nt, Artificial Sequence
  MKO10076079_B_Ccdc85b
  gRNA
gcgccgcacgccguccucgu

SEQ ID NO: 76080 - RNA, 20 nt, Artificial Sequence
  MKO10076080_B_Ccdc85b
  gRNA
cuggcagcgcuagugcagcg

SEQ ID NO: 76081 - RNA, 20 nt, Artificial Sequence
  MKO10076081_B_Ccdc85c
  gRNA
guugcacaucucucgcacga

SEQ ID NO: 76082 - RNA, 20 nt, Artificial Sequence
  MKO10076082_B_Ccdc85c
  gRNA
gaauuccguacccuucggaa

SEQ ID NO: 76083 - RNA, 20 nt, Artificial Sequence
  MKO10076083_B_Ccdc85c
  gRNA
agggcggcagggaugcgagc

SEQ ID NO: 76084 - RNA, 20 nt, Artificial Sequence
  MKO10076084_B_Ccdc86
  gRNA
acaagccccugcguaccucc

SEQ ID NO: 76085 - RNA, 20 nt, Artificial Sequence
  MKO10076085_B_Ccdc86
  gRNA
uauugaaaaacgagacaccc

SEQ ID NO: 76086 - RNA, 20 nt, Artificial Sequence
  MKO10076086_B_Ccdc86
  gRNA
ccgucuagaaaaugagcgca

SEQ ID NO: 76087 - RNA, 20 nt, Artificial Sequence
  MKO10076087_B_Ccdc87
  gRNA
ugaaucgagacccucaccga

SEQ ID NO: 76088 - RNA, 20 nt, Artificial Sequence
  MKO10076088_B_Ccdc87
  gRNA
cguacgcuaccugcaccugc

SEQ ID NO: 76089 - RNA, 20 nt, Artificial Sequence
  MKO10076089_B_Ccdc87
  gRNA
guggagucgauacucccugc

SEQ ID NO: 76090 - RNA, 20 nt, Artificial Sequence
  MKO10076090_B_Ccdc88a
  gRNA
uugccaaugauuaagauauc

SEQ ID NO: 76091 - RNA, 20 nt, Artificial Sequence
  MKO10076091_B_Ccdc88a
  gRNA
uugccagauaucuuaaucau

SEQ ID NO: 76092 - RNA, 20 nt, Artificial Sequence
  MKO10076092_B_Ccdc88a
  gRNA
aauucacaaucuguccauuu

SEQ ID NO: 76093 - RNA, 20 nt, Artificial Sequence
  MKO10076093_B_Ccdc88b
  gRNA
aggggucacaccccauuguc

SEQ ID NO: 76094 - RNA, 20 nt, Artificial Sequence
  MKO10076094_B_Ccdc88b
  gRNA
acgagcuggaaagcauccuu

SEQ ID NO: 76095 - RNA, 20 nt, Artificial Sequence
  MKO10076095_B_Ccdc88b
  gRNA
uuccacauccgacaggcugc

SEQ ID NO: 76096 - RNA, 20 nt, Artificial Sequence
  MKO10076096_B_Ccdc88c
  gRNA
aauucauuacgaucagcugc

SEQ ID NO: 76097 - RNA, 20 nt, Artificial Sequence
  MKO10076097_B_Ccdc88c
  gRNA
uuugccaaucaucaagacau

SEQ ID NO: 76098 - RNA, 20 nt, Artificial Sequence
  MKO10076098_B_Ccdc88c
  gRNA
aaacaucaagaccuacuacc

SEQ ID NO: 76099 - RNA, 20 nt, Artificial Sequence
  MKO10076099_B_Ccdc89
  gRNA
ccaccccccgacgagaucuu

SEQ ID NO: 76100 - RNA, 20 nt, Artificial Sequence
  MKO10076100_B_Ccdc89
  gRNA
ccugaaacgcagauccgacg

SEQ ID NO: 76101 - RNA, 20 nt, Artificial Sequence
  MKO10076101_B_Ccdc89
  gRNA
gcugaagcucgcgaacucuc

SEQ ID NO: 76102 - RNA, 20 nt, Artificial Sequence
  MKO10076102_B_Ccdc8
  gRNA
cgaaaccaugagaagcgucc

SEQ ID NO: 76103 - RNA, 20 nt, Artificial Sequence
  MKO10076103_B_Ccdc8
  gRNA
agcgucuaguacccagcauc

SEQ ID NO: 76104 - RNA, 20 nt, Artificial Sequence
  MKO10076104_B_Ccdc8
  gRNA
agccauccaaggccgacaga

SEQ ID NO: 76105 - RNA, 20 nt, Artificial Sequence
  MKO10076105_B_Ccdc90b
  gRNA
ccaaguccugcaccaacgca

SEQ ID NO: 76106 - RNA, 20 nt, Artificial Sequence
  MKO10076106_B_Ccdc90b
  gRNA
ucuccuuguagauaguaucc

SEQ ID NO: 76107 - RNA, 20 nt, Artificial Sequence
  MKO10076107_B_Ccdc90b
  gRNA
aucauaaucugacuuaguug

SEQ ID NO: 76108 - RNA, 20 nt, Artificial Sequence
  MKO10076108_B_Ccdc91
  gRNA
agcuggugagagucgcacuc

SEQ ID NO: 76109 - RNA, 20 nt, Artificial Sequence
  MKO10076109_B_Ccdc91
  gRNA
gguaguaguaccugcaggaa

SEQ ID NO: 76110 - RNA, 20 nt, Artificial Sequence
  MKO10076110_B_Ccdc91
  gRNA
agccagauaccgugagcuuc

SEQ ID NO: 76111 - RNA, 20 nt, Artificial Sequence
  MKO10076111_B_Ccdc92
  gRNA
gugcagccccuugagugugc

SEQ ID NO: 76112 - RNA, 20 nt, Artificial Sequence
  MKO10076112_B_Ccdc92
  gRNA
gagcacgccagcacacucaa

SEQ ID NO: 76113 - RNA, 20 nt, Artificial Sequence
  MKO10076113_B_Ccdc92
  gRNA
gaacgccgccaucgcugugc

SEQ ID NO: 76114 - RNA, 20 nt, Artificial Sequence
  MKO10076114_B_Ccdc93
  gRNA
gaagcccucaccugcacgac

SEQ ID NO: 76115 - RNA, 20 nt, Artificial Sequence
  MKO10076115_B_Ccdc93
  gRNA
uccucaccuccgggaguccc

SEQ ID NO: 76116 - RNA, 20 nt, Artificial Sequence
  MKO10076116_B_Ccdc93
  gRNA
agguaguaggaggaaugacg

SEQ ID NO: 76117 - RNA, 20 nt, Artificial Sequence
  MKO10076117_B_Ccdc94
  gRNA
gcaguauguggugcgucuga

SEQ ID NO: 76118 - RNA, 20 nt, Artificial Sequence
  MKO10076118_B_Ccdc94
  gRNA
acccccagguccuagagaac

SEQ ID NO: 76119 - RNA, 20 nt, Artificial Sequence
  MKO10076119_B_Ccdc94
  gRNA
agggauucaccucauguuga

SEQ ID NO: 76120 - RNA, 20 nt, Artificial Sequence
  MKO10076120_B_Ccdc96
  gRNA
gaucgauuacgcgcauguug

SEQ ID NO: 76121 - RNA, 20 nt, Artificial Sequence
  MKO10076121_B_Ccdc96
  gRNA
cguuauaaucugcacguugc

SEQ ID NO: 76122 - RNA, 20 nt, Artificial Sequence
  MKO10076122_B_Ccdc96
  gRNA
ucacgagacccuacgcaaga

SEQ ID NO: 76123 - RNA, 20 nt, Artificial Sequence
  MKO10076123_B_Ccdc97
  gRNA
ccgagucuuuauccgaccuc

SEQ ID NO: 76124 - RNA, 20 nt, Artificial Sequence
  MKO10076124_B_Ccdc97
  gRNA
acuuuagcgacgagcagaug

SEQ ID NO: 76125 - RNA, 20 nt, Artificial Sequence
  MKO10076125_B_Ccdc97
  gRNA
aguaccgguccuccucauca

SEQ ID NO: 76126 - RNA, 20 nt, Artificial Sequence
  MKO10076126_B_Ccdc9
  gRNA
ggcucuucgucggaagaaug

SEQ ID NO: 76127 - RNA, 20 nt, Artificial Sequence
  MKO10076127_B_Ccdc9
  gRNA
gcguggcagugacagccccc

SEQ ID NO: 76128 - RNA, 20 nt, Artificial Sequence
  MKO10076128_B_Ccdc9
  gRNA
ucggaaaaaagcugaacugg

SEQ ID NO: 76129 - RNA, 20 nt, Artificial Sequence
  MKO10076129_B_Ccer1
  gRNA
cgguaucgccgcuuggacac

SEQ ID NO: 76130 - RNA, 20 nt, Artificial Sequence
  MKO10076130_B_Ccer1
  gRNA
cgaagaagauucgcaguugc

SEQ ID NO: 76131 - RNA, 20 nt, Artificial Sequence
  MKO10076131_B_Ccer1
  gRNA
ccgggcgaagcaucuugcuc

SEQ ID NO: 76132 - RNA, 20 nt, Artificial Sequence
  MKO10076132_B_Cchcr1
  gRNA
ccccugcccguuucguuucc

SEQ ID NO: 76133 - RNA, 20 nt, Artificial Sequence
  MKO10076133_B_Cchcr1
  gRNA
aacgucugaagcccaggucg

SEQ ID NO: 76134 - RNA, 20 nt, Artificial Sequence
  MKO10076134_B_Cchcr1
  gRNA
ccagaaggcucucgacaguc

SEQ ID NO: 76135 - RNA, 20 nt, Artificial Sequence
  MKO10076135_B_Ccin
  gRNA
cuucgcacaucgcaacgugc

SEQ ID NO: 76136 - RNA, 20 nt, Artificial Sequence
  MKO10076136_B_Ccin
  gRNA
ccccaucguugaacuuaccg

SEQ ID NO: 76137 - RNA, 20 nt, Artificial Sequence
  MKO10076137_B_Ccin
  gRNA
uauugaaauacugugcgccc

SEQ ID NO: 76138 - RNA, 20 nt, Artificial Sequence
  MKO10076138_B_Cckar
  gRNA
cggugcugauucgaaacaag

SEQ ID NO: 76139 - RNA, 20 nt, Artificial Sequence
  MKO10076139_B_Cckar
  gRNA
caugaacaaacgcuuucgcc

SEQ ID NO: 76140 - RNA, 20 nt, Artificial Sequence
  MKO10076140_B_Cckar
  gRNA
caagacuaccaccuacuuca

SEQ ID NO: 76141 - RNA, 20 nt, Artificial Sequence
  MKO10076141_B_Cckbr
  gRNA
gacccccuugguuucggacc

SEQ ID NO: 76142 - RNA, 20 nt, Artificial Sequence
  MKO10076142_B_Cckbr
  gRNA
ccccuaccccguguacaccg

SEQ ID NO: 76143 - RNA, 20 nt, Artificial Sequence
  MKO10076143_B_Cckbr
  gRNA
acugagccgacgccuaagaa

SEQ ID NO: 76144 - RNA, 20 nt, Artificial Sequence
  MKO10076144_B_Cck
  gRNA
gguucuuaagaacggacaug

SEQ ID NO: 76145 - RNA, 20 nt, Artificial Sequence
  MKO10076145_B_Cck
  gRNA
cguggagcagcgggcgcaag

SEQ ID NO: 76146 - RNA, 20 nt, Artificial Sequence
  MKO10076146_B_Cck
  gRNA
gagcggcguaugucugugcg

SEQ ID NO: 76147 - RNA, 20 nt, Artificial Sequence
  MKO10076147_B_Ccl11
  gRNA
auccuggacccacuucuucu

SEQ ID NO: 76148 - RNA, 20 nt, Artificial Sequence
  MKO10076148_B_Ccl11
  gRNA
aagcgcuguggagcucugca

SEQ ID NO: 76149 - RNA, 20 nt, Artificial Sequence
  MKO10076149_B_Ccl11
  gRNA
aggaagugaccgugagcagc

SEQ ID NO: 76150 - RNA, 20 nt, Artificial Sequence
  MKO10076150_B_Ccl12
  gRNA
acauuauaacagcacgugac

SEQ ID NO: 76151 - RNA, 20 nt, Artificial Sequence
  MKO10076151_B_Ccl12
  gRNA
ccugguccagccaauaccug

SEQ ID NO: 76152 - RNA, 20 nt, Artificial Sequence
  MKO10076152_B_Ccl12
  gRNA
ugauggugguagcuaugagc

SEQ ID NO: 76153 - RNA, 20 nt, Artificial Sequence
  MKO10076153_B_Ccl17
  gRNA
ucagauuggugaaaaaccca

SEQ ID NO: 76154 - RNA, 20 nt, Artificial Sequence
  MKO10076154_B_Ccl17
  gRNA
cagcgggaaggucauggccu

SEQ ID NO: 76155 - RNA, 20 nt, Artificial Sequence
  MKO10076155_B_Ccl17
  gRNA
uuucugcagcaugccagagc

SEQ ID NO: 76156 - RNA, 20 nt, Artificial Sequence
  MKO10076156_B_Ccl19
  gRNA
ugcagccaucuucauuaaga

SEQ ID NO: 76157 - RNA, 20 nt, Artificial Sequence
  MKO10076157_B_Ccl19
  gRNA
gcuacagguucaccacacua

SEQ ID NO: 76158 - RNA, 20 nt, Artificial Sequence
  MKO10076158_B_Ccl19
  gRNA
cagaagacuucuucagucuu

SEQ ID NO: 76159 - RNA, 20 nt, Artificial Sequence
  MKO10076159_B_Ccl1
  gRNA
ggcucacucacaccacagcu

SEQ ID NO: 76160 - RNA, 20 nt, Artificial Sequence
  MKO10076160_B_Ccl1
  gRNA
cuguccugaucccccagcug

SEQ ID NO: 76161 - RNA, 20 nt, Artificial Sequence
  MKO10076161_B_Ccl1
  gRNA
gucaacauccuguauccaca

SEQ ID NO: 76162 - RNA, 20 nt, Artificial Sequence
  MKO10076162_B_Ccl20
  gRNA
auuaaugucacaagcuucau

SEQ ID NO: 76163 - RNA, 20 nt, Artificial Sequence
  MKO10076163_B_Ccl20
  gRNA
aaagggcugugaaccuccuc

SEQ ID NO: 76164 - RNA, 20 nt, Artificial Sequence
  MKO10076164_B_Ccl20
  gRNA
gagcugagaauggccugcgg

SEQ ID NO: 76165 - RNA, 20 nt, Artificial Sequence
  MKO10076165_B_Ccl21a
  gRNA
agcgcacucacaggauugcc

SEQ ID NO: 76166 - RNA, 20 nt, Artificial Sequence
  MKO10076166_B_Ccl21a
  gRNA
caacccucagguucucaccc

SEQ ID NO: 76167 - RNA, 20 nt, Artificial Sequence
  MKO10076167_B_Ccl21a
  gRNA
gccucaccucuugcagcccu

SEQ ID NO: 76168 - RNA, 20 nt, Artificial Sequence
  MKO10076168_B_Ccl21b
  gRNA
uaccuugcaggcagugaugg

SEQ ID NO: 76169 - RNA, 20 nt, Artificial Sequence
  MKO10076169_B_Ccl21b
  gRNA
gccucaccucuugcagcccu

SEQ ID NO: 76170 - RNA, 20 nt, Artificial Sequence
  MKO10076170_B_Ccl21b
  gRNA
caacccucagguucuuaccc

SEQ ID NO: 76171 - RNA, 20 nt, Artificial Sequence
  MKO10076171_B_Ccl22
  gRNA
ucaaaauccugccgcaagcc

SEQ ID NO: 76172 - RNA, 20 nt, Artificial Sequence
  MKO10076172_B_Ccl22
  gRNA
acagauaucucgguucuuga

SEQ ID NO: 76173 - RNA, 20 nt, Artificial Sequence
  MKO10076173_B_Ccl22
  gRNA
ccaccaggagugggacacgc

SEQ ID NO: 76174 - RNA, 20 nt, Artificial Sequence
  MKO10076174_B_Ccl24
  gRNA
aaaccucggugcuauugcca

SEQ ID NO: 76175 - RNA, 20 nt, Artificial Sequence
  MKO10076175_B_Ccl24
  gRNA
uuugcuguccagagacgccg

SEQ ID NO: 76176 - RNA, 20 nt, Artificial Sequence
  MKO10076176_B_Ccl24
  gRNA
uacucacaugaccccugccu

SEQ ID NO: 76177 - RNA, 20 nt, Artificial Sequence
  MKO10076177_B_Ccl25
  gRNA
cauuccauuugauccugugc

SEQ ID NO: 76178 - RNA, 20 nt, Artificial Sequence
  MKO10076178_B_Ccl25
  gRNA
gucaaaccauaugaagucca

SEQ ID NO: 76179 - RNA, 20 nt, Artificial Sequence
  MKO10076179_B_Ccl25
  gRNA
uuccgccagaaaguagugug

SEQ ID NO: 76180 - RNA, 20 nt, Artificial Sequence
  MKO10076180_B_Ccl26
  gRNA
gaugaaucucugcacccauu

SEQ ID NO: 76181 - RNA, 20 nt, Artificial Sequence
  MKO10076181_B_Ccl26
  gRNA
ucagcuacuaugugauccca

SEQ ID NO: 76182 - RNA, 20 nt, Artificial Sequence
  MKO10076182_B_Ccl26
  gRNA
cucuagaauguucuucgauu

SEQ ID NO: 76183 - RNA, 20 nt, Artificial Sequence
  MKO10076183_B_Ccl27a
  gRNA
acuuuaaaucuuuaaugcac

SEQ ID NO: 76184 - RNA, 20 nt, Artificial Sequence
  MKO10076184_B_Ccl27a
  gRNA
aacaagccagagacuaaguc

SEQ ID NO: 76185 - RNA, 20 nt, Artificial Sequence
  MKO10076185_B_Ccl27a
  gRNA
uucugcuuagucuuguucca

SEQ ID NO: 76186 - RNA, 20 nt, Artificial Sequence
  MKO10076186_B_Ccl27b
  gRNA
auagacagccacucccaagc

SEQ ID NO: 76187 - RNA, 20 nt, Artificial Sequence
  MKO10076187_B_Ccl27b
  gRNA
uucucaggcuucaccuggcu

SEQ ID NO: 76188 - RNA, 20 nt, Artificial Sequence
  MKO10076188_B_Ccl27b
  gRNA
uuguaguaccagauuuaaac

SEQ ID NO: 76189 - RNA, 20 nt, Artificial Sequence
  MKO10076189_B_Ccl28
  gRNA
gaggugucucaucauguuuc

SEQ ID NO: 76190 - RNA, 20 nt, Artificial Sequence
  MKO10076190_B_Ccl28
  gRNA
caggcgggaaugcagcaagc

SEQ ID NO: 76191 - RNA, 20 nt, Artificial Sequence
  MKO10076191_B_Ccl28
  gRNA
cauggcuguggcugugugug

SEQ ID NO: 76192 - RNA, 20 nt, Artificial Sequence
  MKO10076192_B_Ccl2
  gRNA
gcuggugaaugaguagcagc

SEQ ID NO: 76193 - RNA, 20 nt, Artificial Sequence
  MKO10076193_B_Ccl2
  gRNA
gugcugaccccaagaaggaa

SEQ ID NO: 76194 - RNA, 20 nt, Artificial Sequence
  MKO10076194_B_Ccl2
  gRNA
gcaagaugaucccaaugagu

SEQ ID NO: 76195 - RNA, 20 nt, Artificial Sequence
  MKO10076195_B_Ccl3
  gRNA
uggagucagcgcagaucugc

SEQ ID NO: 76196 - RNA, 20 nt, Artificial Sequence
  MKO10076196_B_Ccl3
  gRNA
cacauggcgcugagaagacu

SEQ ID NO: 76197 - RNA, 20 nt, Artificial Sequence
  MKO10076197_B_Ccl3
  gRNA
ugguacagagaagaacagca

SEQ ID NO: 76198 - RNA, 20 nt, Artificial Sequence
  MKO10076198_B_Ccl4
  gRNA
agaaggcagccacgagcaag

SEQ ID NO: 76199 - RNA, 20 nt, Artificial Sequence
  MKO10076199_B_Ccl4
  gRNA
uuacuuggugcugagaaccc

SEQ ID NO: 76200 - RNA, 20 nt, Artificial Sequence
  MKO10076200_B_Ccl4
  gRNA
ucuuugcuccaagccagcug

SEQ ID NO: 76201 - RNA, 20 nt, Artificial Sequence
  MKO10076201_B_Ccl5
  gRNA
cucgacuuacauggugaggc

SEQ ID NO: 76202 - RNA, 20 nt, Artificial Sequence
  MKO10076202_B_Ccl5
  gRNA
ucaagaauacaucaacuauu

SEQ ID NO: 76203 - RNA, 20 nt, Artificial Sequence
  MKO10076203_B_Ccl5
  gRNA
ugcagagggcggcugcagug

SEQ ID NO: 76204 - RNA, 20 nt, Artificial Sequence
  MKO10076204_B_Ccl6
  gRNA
aacccuccaauaauucauca

SEQ ID NO: 76205 - RNA, 20 nt, Artificial Sequence
  MKO10076205_B_Ccl6
  gRNA
auauauuauuuccccaccag

SEQ ID NO: 76206 - RNA, 20 nt, Artificial Sequence
  MKO10076206_B_Ccl6
  gRNA
cauuucauucuuuauccuug

SEQ ID NO: 76207 - RNA, 20 nt, Artificial Sequence
  MKO10076207_B_Ccl7
  gRNA
aagcagcggcuaugagcagc

SEQ ID NO: 76208 - RNA, 20 nt, Artificial Sequence
  MKO10076208_B_Ccl7
  gRNA
uacuuacauaacagcuuccc

SEQ ID NO: 76209 - RNA, 20 nt, Artificial Sequence
  MKO10076209_B_Ccl7
  gRNA
ccuccucgacccacuucuga

SEQ ID NO: 76210 - RNA, 20 nt, Artificial Sequence
  MKO10076210_B_Ccl8
  gRNA
guguagaccccacacagaag

SEQ ID NO: 76211 - RNA, 20 nt, Artificial Sequence
  MKO10076211_B_Ccl8
  gRNA
ccuggcccagucagcuucuc

SEQ ID NO: 76212 - RNA, 20 nt, Artificial Sequence
  MKO10076212_B_Ccl8
  gRNA
ccacaguuuccagaccaagc

SEQ ID NO: 76213 - RNA, 20 nt, Artificial Sequence
  MKO10076213_B_Ccl9
  gRNA
ucagagaugcauugaaagau

SEQ ID NO: 76214 - RNA, 20 nt, Artificial Sequence
  MKO10076214_B_Ccl9
  gRNA
ucucugaacucuccgaucac

SEQ ID NO: 76215 - RNA, 20 nt, Artificial Sequence
  MKO10076215_B_Ccl9
  gRNA
caagagcaguuguaagaaug

SEQ ID NO: 76216 - RNA, 20 nt, Artificial Sequence
  MKO10076216_B_Ccm2l
  gRNA
gaugcagagcgucguccugc

SEQ ID NO: 76217 - RNA, 20 nt, Artificial Sequence
  MKO10076217_B_Ccm2l
  gRNA
guucccgaaggcugcacgcc

SEQ ID NO: 76218 - RNA, 20 nt, Artificial Sequence
  MKO10076218_B_Ccm2l
  gRNA
ugugucccccauccgaagac

SEQ ID NO: 76219 - RNA, 20 nt, Artificial Sequence
  MKO10076219_B_Ccm2
  gRNA
ugcagcaucaucucggacau

SEQ ID NO: 76220 - RNA, 20 nt, Artificial Sequence
  MKO10076220_B_Ccm2
  gRNA
acauaccacugugcagcgac

SEQ ID NO: 76221 - RNA, 20 nt, Artificial Sequence
  MKO10076221_B_Ccm2
  gRNA
accaggcaacaugccucuac

SEQ ID NO: 76222 - RNA, 20 nt, Artificial Sequence
  MKO10076222_B_Ccna1
  gRNA
cuauauggaugauccugaac

SEQ ID NO: 76223 - RNA, 20 nt, Artificial Sequence
  MKO10076223_B_Ccna1
  gRNA
gaugcccucuuuccccgagc

SEQ ID NO: 76224 - RNA, 20 nt, Artificial Sequence
  MKO10076224_B_Ccna1
  gRNA
ucgcacagagacccuguacu

SEQ ID NO: 76225 - RNA, 20 nt, Artificial Sequence
  MKO10076225_B_Ccna2
  gRNA
cucaugcuguuagugauguc

SEQ ID NO: 76226 - RNA, 20 nt, Artificial Sequence
  MKO10076226_B_Ccna2
  gRNA
uacacaaacucugcuacuuc

SEQ ID NO: 76227 - RNA, 20 nt, Artificial Sequence
  MKO10076227_B_Ccna2
  gRNA
cgauaccuauuccaagaagc

SEQ ID NO: 76228 - RNA, 20 nt, Artificial Sequence
  MKO10076228_B_Ccnb1ip1
  gRNA
aagugucggaucaagcucuc

SEQ ID NO: 76229 - RNA, 20 nt, Artificial Sequence
  MKO10076229_B_Ccnb1ip1
  gRNA
cauauaccaguuggaaauca

SEQ ID NO: 76230 - RNA, 20 nt, Artificial Sequence
  MKO10076230_B_Ccnb1ip1
  gRNA
ccaccaccuugauuuccaac

SEQ ID NO: 76231 - RNA, 20 nt, Artificial Sequence
  MKO10076231_B_Ccnb1
  gRNA
uaaucccucuccaagcccga

SEQ ID NO: 76232 - RNA, 20 nt, Artificial Sequence
  MKO10076232_B_Ccnb1
  gRNA
gaaaauuaacgcagaaaaua

SEQ ID NO: 76233 - RNA, 20 nt, Artificial Sequence
  MKO10076233_B_Ccnb1
  gRNA
guuacugcugcuuccaagcc

SEQ ID NO: 76234 - RNA, 20 nt, Artificial Sequence
  MKO10076234_B_Ccnb2
  gRNA
gcucugcagugacuacguga

SEQ ID NO: 76235 - RNA, 20 nt, Artificial Sequence
  MKO10076235_B_Ccnb2
  gRNA
uguuaccuucgccaccugag

SEQ ID NO: 76236 - RNA, 20 nt, Artificial Sequence
  MKO10076236_B_Ccnb2
  gRNA
uuucuucuaaaacugcccgc

SEQ ID NO: 76237 - RNA, 20 nt, Artificial Sequence
  MKO10076237_B_Ccnb3
  gRNA
ugaagauccaaccaucauug

SEQ ID NO: 76238 - RNA, 20 nt, Artificial Sequence
  MKO10076238_B_Ccnb3
  gRNA
uagucaauguguccagucaa

SEQ ID NO: 76239 - RNA, 20 nt, Artificial Sequence
  MKO10076239_B_Ccnb3
  gRNA
cuauauugucuuccuuugac

SEQ ID NO: 76240 - RNA, 20 nt, Artificial Sequence
  MKO10076240_B_Ccnc
  gRNA
guuucuggcauccaaaguag

SEQ ID NO: 76241 - RNA, 20 nt, Artificial Sequence
  MKO10076241_B_Ccnc
  gRNA
cucuaguuugcaguggauuu

SEQ ID NO: 76242 - RNA, 20 nt, Artificial Sequence
  MKO10076242_B_Ccnc
  gRNA
uaagauguucaccuaaugcu

SEQ ID NO: 76243 - RNA, 20 nt, Artificial Sequence
  MKO10076243_B_Ccnd1
  gRNA
ggaaguguucgaugaaaucg

SEQ ID NO: 76244 - RNA, 20 nt, Artificial Sequence
  MKO10076244_B_Ccnd1
  gRNA
guucguggccucuaagauga

SEQ ID NO: 76245 - RNA, 20 nt, Artificial Sequence
  MKO10076245_B_Ccnd1
  gRNA
agcgugguggcugcgaugca

SEQ ID NO: 76246 - RNA, 20 nt, Artificial Sequence
  MKO10076246_B_Ccnd2
  gRNA
ucugcgcaugcuugcggauc

SEQ ID NO: 76247 - RNA, 20 nt, Artificial Sequence
  MKO10076247_B_Ccnd2
  gRNA
cggcguuaugcugcucuuga

SEQ ID NO: 76248 - RNA, 20 nt, Artificial Sequence
  MKO10076248_B_Ccnd2
  gRNA
agagaccaucccgcugacug

SEQ ID NO: 76249 - RNA, 20 nt, Artificial Sequence
  MKO10076249_B_Ccnd3
  gRNA
gggcagcuucgaucuguucc

SEQ ID NO: 76250 - RNA, 20 nt, Artificial Sequence
  MKO10076250_B_Ccnd3
  gRNA
ccuccauccaugaucgccac

SEQ ID NO: 76251 - RNA, 20 nt, Artificial Sequence
  MKO10076251_B_Ccnd3
  gRNA
ggcucuuaccuguagcacag

SEQ ID NO: 76252 - RNA, 20 nt, Artificial Sequence
  MKO10076252_B_Ccndbp1
  gRNA
cacuauaauuauuuccucga

SEQ ID NO: 76253 - RNA, 20 nt, Artificial Sequence
  MKO10076253_B_Ccndbp1
  gRNA
gaaugcugcccuggacaucg

SEQ ID NO: 76254 - RNA, 20 nt, Artificial Sequence
  MKO10076254_B_Ccndbp1
  gRNA
gaagugcguugucagaacag

SEQ ID NO: 76255 - RNA, 20 nt, Artificial Sequence
  MKO10076255_B_Ccne1
  gRNA
cugcucucauccucgccugc

SEQ ID NO: 76256 - RNA, 20 nt, Artificial Sequence
  MKO10076256_B_Ccne1
  gRNA
uuucaguccgcuccagaaaa

SEQ ID NO: 76257 - RNA, 20 nt, Artificial Sequence
  MKO10076257_B_Ccne1
  gRNA
gaggaugagagcaguucuuc

SEQ ID NO: 76258 - RNA, 20 nt, Artificial Sequence
  MKO10076258_B_Ccne2
  gRNA
agaagcaucaguaugagauu

SEQ ID NO: 76259 - RNA, 20 nt, Artificial Sequence
  MKO10076259_B_Ccne2
  gRNA
cauguugcuuagcuuguaaa

SEQ ID NO: 76260 - RNA, 20 nt, Artificial Sequence
  MKO10076260_B_Ccne2
  gRNA
agagucuggcugguugggcu

SEQ ID NO: 76261 - RNA, 20 nt, Artificial Sequence
  MKO10076261_B_Ccnf
  gRNA
aacuuacagcucggacagca

SEQ ID NO: 76262 - RNA, 20 nt, Artificial Sequence
  MKO10076262_B_Ccnf
  gRNA
acucaagaugguuaaguuuc

SEQ ID NO: 76263 - RNA, 20 nt, Artificial Sequence
  MKO10076263_B_Ccnf
  gRNA
gguuguccaccagguacuug

SEQ ID NO: 76264 - RNA, 20 nt, Artificial Sequence
  MKO10076264_B_Ccng1
  gRNA
cauuucaacuucugaccguu

SEQ ID NO: 76265 - RNA, 20 nt, Artificial Sequence
  MKO10076265_B_Ccng1
  gRNA
ugaaccuauacugacuuauu

SEQ ID NO: 76266 - RNA, 20 nt, Artificial Sequence
  MKO10076266_B_Ccng1
  gRNA
aagacuagaagcccaacuua

SEQ ID NO: 76267 - RNA, 20 nt, Artificial Sequence
  MKO10076267_B_Ccng2
  gRNA
uggcacugaaacuuucguuc

SEQ ID NO: 76268 - RNA, 20 nt, Artificial Sequence
  MKO10076268_B_Ccng2
  gRNA
aauagaaacgauaaaauccg

SEQ ID NO: 76269 - RNA, 20 nt, Artificial Sequence
  MKO10076269_B_Ccng2
  gRNA
agaaguuuaacuaacuucuu

SEQ ID NO: 76270 - RNA, 20 nt, Artificial Sequence
  MKO10076270_B_Ccnh
  gRNA
cuagacucgguaccccaugu

SEQ ID NO: 76271 - RNA, 20 nt, Artificial Sequence
  MKO10076271_B_Ccnh
  gRNA
cucgaagauuuccaacaaac

SEQ ID NO: 76272 - RNA, 20 nt, Artificial Sequence
  MKO10076272_B_Ccnh
  gRNA
cacuugauaaaauggcgguc

SEQ ID NO: 76273 - RNA, 20 nt, Artificial Sequence
  MKO10076273_B_Ccni
  gRNA
uaagacuguugaggaagaug

SEQ ID NO: 76274 - RNA, 20 nt, Artificial Sequence
  MKO10076274_B_Ccni
  gRNA
auagaaaauuccagugcuaa

SEQ ID NO: 76275 - RNA, 20 nt, Artificial Sequence
  MKO10076275_B_Ccni
  gRNA
agagagaugaaguaauucaa

SEQ ID NO: 76276 - RNA, 20 nt, Artificial Sequence
  MKO10076276_B_Ccnjl
  gRNA
gaaugucuacaaagaaucga

SEQ ID NO: 76277 - RNA, 20 nt, Artificial Sequence
  MKO10076277_B_Ccnjl
  gRNA
cuccaagcagcuguauacug

SEQ ID NO: 76278 - RNA, 20 nt, Artificial Sequence
  MKO10076278_B_Ccnjl
  gRNA
uuacaaauuccagccuuccg

SEQ ID NO: 76279 - RNA, 20 nt, Artificial Sequence
  MKO10076279_B_Ccnj
  gRNA
ugucauagcgguccaugaac

SEQ ID NO: 76280 - RNA, 20 nt, Artificial Sequence
  MKO10076280_B_Ccnj
  gRNA
cacgagacagaccuucacga

SEQ ID NO: 76281 - RNA, 20 nt, Artificial Sequence
  MKO10076281_B_Ccnj
  gRNA
gugaaggucugucucgugca

SEQ ID NO: 76282 - RNA, 20 nt, Artificial Sequence
  MKO10076282_B_Ccnk
  gRNA
ccaguuuggagaugacccaa

SEQ ID NO: 76283 - RNA, 20 nt, Artificial Sequence
  MKO10076283_B_Ccnk
  gRNA
gcugcuuugcauauuugagc

SEQ ID NO: 76284 - RNA, 20 nt, Artificial Sequence
  MKO10076284_B_Ccnk
  gRNA
cauggacauuuguaaaugac

SEQ ID NO: 76285 - RNA, 20 nt, Artificial Sequence
  MKO10076285_B_Ccnl1
  gRNA
cuuaccaggcaguuugaacc

SEQ ID NO: 76286 - RNA, 20 nt, Artificial Sequence
  MKO10076286_B_Ccnl1
  gRNA
ucaugucaagcauccccaua

SEQ ID NO: 76287 - RNA, 20 nt, Artificial Sequence
  MKO10076287_B_Ccnl1
  gRNA
uguuaauguaguucugauca

SEQ ID NO: 76288 - RNA, 20 nt, Artificial Sequence
  MKO10076288_B_Ccnl2
  gRNA
augacaucccugauucgucu

SEQ ID NO: 76289 - RNA, 20 nt, Artificial Sequence
  MKO10076289_B_Ccnl2
  gRNA
gauaaucguuauguaccuuc

SEQ ID NO: 76290 - RNA, 20 nt, Artificial Sequence
  MKO10076290_B_Ccnl2
  gRNA
acuuaguguaaaagaaccgc

SEQ ID NO: 76291 - RNA, 20 nt, Artificial Sequence
  MKO10076291_B_Ccno
  gRNA
cacgcguucagcggccgcag

SEQ ID NO: 76292 - RNA, 20 nt, Artificial Sequence
  MKO10076292_B_Ccno
  gRNA
cuugcaagcgaugagcagac

SEQ ID NO: 76293 - RNA, 20 nt, Artificial Sequence
  MKO10076293_B_Ccno
  gRNA
cugcaaguccaccgccaguu

SEQ ID NO: 76294 - RNA, 20 nt, Artificial Sequence
  MKO10076294_B_Ccnt1
  gRNA
acuuccugacacgaggagug

SEQ ID NO: 76295 - RNA, 20 nt, Artificial Sequence
  MKO10076295_B_Ccnt1
  gRNA
cucaccucacuccucguguc

SEQ ID NO: 76296 - RNA, 20 nt, Artificial Sequence
  MKO10076296_B_Ccnt1
  gRNA
ccuacaacaaguucaagauc

SEQ ID NO: 76297 - RNA, 20 nt, Artificial Sequence
  MKO10076297_B_Ccnt2
  gRNA
acccaguguuuguagcauua

SEQ ID NO: 76298 - RNA, 20 nt, Artificial Sequence
  MKO10076298_B_Ccnt2
  gRNA
gcagccaaaaacaaugcagu

SEQ ID NO: 76299 - RNA, 20 nt, Artificial Sequence
  MKO10076299_B_Ccnt2
  gRNA
ucuucagcagacucaagaac

SEQ ID NO: 76300 - RNA, 20 nt, Artificial Sequence
  MKO10076300_B_Ccnyl1
  gRNA
uuccccuucagguaucucca

SEQ ID NO: 76301 - RNA, 20 nt, Artificial Sequence
  MKO10076301_B_Ccnyl1
  gRNA
uccuucuguagaucuagcuu

SEQ ID NO: 76302 - RNA, 20 nt, Artificial Sequence
  MKO10076302_B_Ccnyl1
  gRNA
auuuacuuacaugguuuaaa

SEQ ID NO: 76303 - RNA, 20 nt, Artificial Sequence
  MKO10076303_B_Ccny
  gRNA
uauuuccuugaugucugccc

SEQ ID NO: 76304 - RNA, 20 nt, Artificial Sequence
  MKO10076304_B_Ccny
  gRNA
uauauuaccacaucaaaaac

SEQ ID NO: 76305 - RNA, 20 nt, Artificial Sequence
  MKO10076305_B_Ccny
  gRNA
cgucugucugagauuugcug

SEQ ID NO: 76306 - RNA, 20 nt, Artificial Sequence
  MKO10076306_B_Ccp110
  gRNA
uaccagaguuguuugaaguc

SEQ ID NO: 76307 - RNA, 20 nt, Artificial Sequence
  MKO10076307_B_Ccp110
  gRNA
cuccagacuucaaacaacuc

SEQ ID NO: 76308 - RNA, 20 nt, Artificial Sequence
  MKO10076308_B_Ccp110
  gRNA
gucacuccucauagcugagc

SEQ ID NO: 76309 - RNA, 20 nt, Artificial Sequence
  MKO10076309_B_Ccpg1os
  gRNA
ucuguaaacgcuugcucuug

SEQ ID NO: 76310 - RNA, 20 nt, Artificial Sequence
  MKO10076310_B_Ccpg1os
  gRNA
cagcccgucuccguggcaac

SEQ ID NO: 76311 - RNA, 20 nt, Artificial Sequence
  MKO10076311_B_Ccpg1os
  gRNA
gucuugcuguugcuuuccgu

SEQ ID NO: 76312 - RNA, 20 nt, Artificial Sequence
  MKO10076312_B_Ccpg1
  gRNA
agcgacagcgacucaucuug

SEQ ID NO: 76313 - RNA, 20 nt, Artificial Sequence
  MKO10076313_B_Ccpg1
  gRNA
agcugcccguucuuuaugua

SEQ ID NO: 76314 - RNA, 20 nt, Artificial Sequence
  MKO10076314_B_Ccpg1
  gRNA
uacacuugaaccaccuaagc

SEQ ID NO: 76315 - RNA, 20 nt, Artificial Sequence
  MKO10076315_B_Ccr10
  gRNA
ccgacucccaccugcucugu

SEQ ID NO: 76316 - RNA, 20 nt, Artificial Sequence
  MKO10076316_B_Ccr10
  gRNA
uaucagcgccgaccgcuaug

SEQ ID NO: 76317 - RNA, 20 nt, Artificial Sequence
  MKO10076317_B_Ccr10
  gRNA
gggagaucggguaguucguc

SEQ ID NO: 76318 - RNA, 20 nt, Artificial Sequence
  MKO10076318_B_Ccr1l1
  gRNA
gccuccgaaacaacugccag

SEQ ID NO: 76319 - RNA, 20 nt, Artificial Sequence
  MKO10076319_B_Ccr1l1
  gRNA
ugaugccaaaagugacaguc

SEQ ID NO: 76320 - RNA, 20 nt, Artificial Sequence
  MKO10076320_B_Ccr1l1
  gRNA
cagcuauaacccugccacaa

SEQ ID NO: 76321 - RNA, 20 nt, Artificial Sequence
  MKO10076321_B_Ccr1
  gRNA
ucaucaccaguauuaucacc

SEQ ID NO: 76322 - RNA, 20 nt, Artificial Sequence
  MKO10076322_B_Ccr1
  gRNA
gcucuaaagcuaaaccuucu

SEQ ID NO: 76323 - RNA, 20 nt, Artificial Sequence
  MKO10076323_B_Ccr1
  gRNA
ugaugaacacuagagaauac

SEQ ID NO: 76324 - RNA, 20 nt, Artificial Sequence
  MKO10076324_B_Ccr2
  gRNA
gaugaucaccauuacaccug

SEQ ID NO: 76325 - RNA, 20 nt, Artificial Sequence
  MKO10076325_B_Ccr2
  gRNA
guaauggugaucaucuuguu

SEQ ID NO: 76326 - RNA, 20 nt, Artificial Sequence
  MKO10076326_B_Ccr2
  gRNA
uacacuuguuaucaccccaa

SEQ ID NO: 76327 - RNA, 20 nt, Artificial Sequence
  MKO10076327_B_Ccr3
  gRNA
cagaaauguggcaguuuacc

SEQ ID NO: 76328 - RNA, 20 nt, Artificial Sequence
  MKO10076328_B_Ccr3
  gRNA
agagguuccggaaacaccuu

SEQ ID NO: 76329 - RNA, 20 nt, Artificial Sequence
  MKO10076329_B_Ccr3
  gRNA
gaaaaagaucucgcuguaca

SEQ ID NO: 76330 - RNA, 20 nt, Artificial Sequence
  MKO10076330_B_Ccr4
  gRNA
guaccuagacuacgccaucc

SEQ ID NO: 76331 - RNA, 20 nt, Artificial Sequence
  MKO10076331_B_Ccr4
  gRNA
gcacgcgguauucuccuuga

SEQ ID NO: 76332 - RNA, 20 nt, Artificial Sequence
  MKO10076332_B_Ccr4
  gRNA
gcuacuacgccgccgaccag

SEQ ID NO: 76333 - RNA, 20 nt, Artificial Sequence
  MKO10076333_B_Ccr5
  gRNA
auaaucgaugucauagcuau

SEQ ID NO: 76334 - RNA, 20 nt, Artificial Sequence
  MKO10076334_B_Ccr5
  gRNA
uaguucuaauagacuagacc

SEQ ID NO: 76335 - RNA, 20 nt, Artificial Sequence
  MKO10076335_B_Ccr5
  gRNA
aguguucuuccgaaaacaca

SEQ ID NO: 76336 - RNA, 20 nt, Artificial Sequence
  MKO10076336_B_Ccr6
  gRNA
cccguguuguaugcguuuau

SEQ ID NO: 76337 - RNA, 20 nt, Artificial Sequence
  MKO10076337_B_Ccr6
  gRNA
ccguguugaccgcagucacg

SEQ ID NO: 76338 - RNA, 20 nt, Artificial Sequence
  MKO10076338_B_Ccr6
  gRNA
gaaccacagcgaucacgacu

SEQ ID NO: 76339 - RNA, 20 nt, Artificial Sequence
  MKO10076339_B_Ccr7
  gRNA
gccucaccuggaaaaugaca

SEQ ID NO: 76340 - RNA, 20 nt, Artificial Sequence
  MKO10076340_B_Ccr7
  gRNA
agcuuacuuaccugggucca

SEQ ID NO: 76341 - RNA, 20 nt, Artificial Sequence
  MKO10076341_B_Ccr7
  gRNA
gagcagguagguauccguca

SEQ ID NO: 76342 - RNA, 20 nt, Artificial Sequence
  MKO10076342_B_Ccr8
  gRNA
ccacuuugaaaucaacgccu

SEQ ID NO: 76343 - RNA, 20 nt, Artificial Sequence
  MKO10076343_B_Ccr8
  gRNA
cuucaucacccuaaugagug

SEQ ID NO: 76344 - RNA, 20 nt, Artificial Sequence
  MKO10076344_B_Ccr8
  gRNA
acaaaugcccgugggggcgu

SEQ ID NO: 76345 - RNA, 20 nt, Artificial Sequence
  MKO10076345_B_Ccr9
  gRNA
cagauacauugccauuguac

SEQ ID NO: 76346 - RNA, 20 nt, Artificial Sequence
  MKO10076346_B_Ccr9
  gRNA
uugugcaauaccaguagaca

SEQ ID NO: 76347 - RNA, 20 nt, Artificial Sequence
  MKO10076347_B_Ccr9
  gRNA
ccccacugacuugacuguac

SEQ ID NO: 76348 - RNA, 20 nt, Artificial Sequence
  MKO10076348_B_Ccrl2
  gRNA
caccucgcuguauaagcccg

SEQ ID NO: 76349 - RNA, 20 nt, Artificial Sequence
  MKO10076349_B_Ccrl2
  gRNA
ccuaaucuuagacgacuacc

SEQ ID NO: 76350 - RNA, 20 nt, Artificial Sequence
  MKO10076350_B_Ccrl2
  gRNA
acaguacgaccuccacaagc

SEQ ID NO: 76351 - RNA, 20 nt, Artificial Sequence
  MKO10076351_B_Ccrn4l
  gRNA
uugggccgagauccgagcac

SEQ ID NO: 76352 - RNA, 20 nt, Artificial Sequence
  MKO10076352_B_Ccrn4l
  gRNA
aagaucccccugaucgucug

SEQ ID NO: 76353 - RNA, 20 nt, Artificial Sequence
  MKO10076353_B_Ccrn4l
  gRNA
gucaacugaccccgaacauc

SEQ ID NO: 76354 - RNA, 20 nt, Artificial Sequence
  MKO10076354_B_Ccsap
  gRNA
aucuugcucgucgaucucug

SEQ ID NO: 76355 - RNA, 20 nt, Artificial Sequence
  MKO10076355_B_Ccsap
  gRNA
cgcagacguugugugucuuc

SEQ ID NO: 76356 - RNA, 20 nt, Artificial Sequence
  MKO10076356_B_Ccsap
  gRNA
cagacgccggcuuuacccuc

SEQ ID NO: 76357 - RNA, 20 nt, Artificial Sequence
  MKO10076357_B_Ccser1
  gRNA
ucuucacugccgugcacucc

SEQ ID NO: 76358 - RNA, 20 nt, Artificial Sequence
  MKO10076358_B_Ccser1
  gRNA
cuguacaggacauuacagag

SEQ ID NO: 76359 - RNA, 20 nt, Artificial Sequence
  MKO10076359_B_Ccser1
  gRNA
gucaucuucauccaguucac

SEQ ID NO: 76360 - RNA, 20 nt, Artificial Sequence
  MKO10076360_B_Ccser2
  gRNA
uccugguagcaugacggaag

SEQ ID NO: 76361 - RNA, 20 nt, Artificial Sequence
  MKO10076361_B_Ccser2
  gRNA
gaggacgcaccucuugaaaa

SEQ ID NO: 76362 - RNA, 20 nt, Artificial Sequence
  MKO10076362_B_Ccser2
  gRNA
ugaugaccuuauguuggaug

SEQ ID NO: 76363 - RNA, 20 nt, Artificial Sequence
  MKO10076363_B_Ccs
  gRNA
gcaggcuguacucaagggua

SEQ ID NO: 76364 - RNA, 20 nt, Artificial Sequence
  MKO10076364_B_Ccs
  gRNA
cccgccagguguccagaaug

SEQ ID NO: 76365 - RNA, 20 nt, Artificial Sequence
  MKO10076365_B_Ccs
  gRNA
cccccaugagaugcuccauc

SEQ ID NO: 76366 - RNA, 20 nt, Artificial Sequence
  MKO10076366_B_Ccu2
  gRNA
gagggccgagacagcucgcc

SEQ ID NO: 76367 - RNA, 20 nt, Artificial Sequence
  MKO10076367_B_Ccu2
  gRNA
gaagagcacuuugggaccga

SEQ ID NO: 76368 - RNA, 20 nt, Artificial Sequence
  MKO10076368_B_Ccu2
  gRNA
gcuuaccaggcgagcugucu

SEQ ID NO: 76369 - RNA, 20 nt, Artificial Sequence
  MKO10076369_B_Ccu3
  gRNA
ccaaccuucaucauagauuu

SEQ ID NO: 76370 - RNA, 20 nt, Artificial Sequence
  MKO10076370_B_Ccu3
  gRNA
accaagaauaauuacugaug

SEQ ID NO: 76371 - RNA, 20 nt, Artificial Sequence
  MKO10076371_B_Ccu3
  gRNA
uggaaauaucaaugcugcaa

SEQ ID NO: 76372 - RNA, 20 nt, Artificial Sequence
  MKO10076372_B_Ccu4
  gRNA
ucucugucgcucaguugcac

SEQ ID NO: 76373 - RNA, 20 nt, Artificial Sequence
  MKO10076373_B_Ccu4
  gRNA
acacuuaccauucuggcugc

SEQ ID NO: 76374 - RNA, 20 nt, Artificial Sequence
  MKO10076374_B_Ccu4
  gRNA
gaugugaccauuacaaauga

SEQ ID NO: 76375 - RNA, 20 nt, Artificial Sequence
  MKO10076375_B_Ccu5
  gRNA
cuuuaucgcugaucuugucc

SEQ ID NO: 76376 - RNA, 20 nt, Artificial Sequence
  MKO10076376_B_Ccu5
  gRNA
gaugugacuauaacaaacga

SEQ ID NO: 76377 - RNA, 20 nt, Artificial Sequence
  MKO10076377_B_Ccu5
  gRNA
ggacaguucaaccaucagcu

SEQ ID NO: 76378 - RNA, 20 nt, Artificial Sequence
  MKO10076378_B_Ccu6a
  gRNA
cagagaaacacucaucgaug

SEQ ID NO: 76379 - RNA, 20 nt, Artificial Sequence
  MKO10076379_B_Ccu6a
  gRNA
caucgccaguuaugucaucc

SEQ ID NO: 76380 - RNA, 20 nt, Artificial Sequence
  MKO10076380_B_Ccu6a
  gRNA
cgagcccauugaccucuuca

SEQ ID NO: 76381 - RNA, 20 nt, Artificial Sequence
  MKO10076381_B_Ccu6b
  gRNA
caauguacugcuucaugaga

SEQ ID NO: 76382 - RNA, 20 nt, Artificial Sequence
  MKO10076382_B_Ccu6b
  gRNA
uuagcaacucuccaaugauc

SEQ ID NO: 76383 - RNA, 20 nt, Artificial Sequence
  MKO10076383_B_Ccu6b
  gRNA
accucaaauguccugaucau

SEQ ID NO: 76384 - RNA, 20 nt, Artificial Sequence
  MKO10076384_B_Ccu7
  gRNA
uuacagccucagcaaucacu

SEQ ID NO: 76385 - RNA, 20 nt, Artificial Sequence
  MKO10076385_B_Ccu7
  gRNA
cugaccuuaccucagcaucc

SEQ ID NO: 76386 - RNA, 20 nt, Artificial Sequence
  MKO10076386_B_Ccu7
  gRNA
aucgaggaguuucagaauug

SEQ ID NO: 76387 - RNA, 20 nt, Artificial Sequence
  MKO10076387_B_Ccu8l1
  gRNA
aauagcccaacuagccauua

SEQ ID NO: 76388 - RNA, 20 nt, Artificial Sequence
  MKO10076388_B_Ccu8l1
  gRNA
ccuuaggggacccaccaucc

SEQ ID NO: 76389 - RNA, 20 nt, Artificial Sequence
  MKO10076389_B_Ccu8l1
  gRNA
acgcacacgacaauacucuc

SEQ ID NO: 76390 - RNA, 20 nt, Artificial Sequence
  MKO10076390_B_Ccu8
  gRNA
ugauggcacaaacuucguuc

SEQ ID NO: 76391 - RNA, 20 nt, Artificial Sequence
  MKO10076391_B_Ccu8
  gRNA
gccguacugcuuacucauga

SEQ ID NO: 76392 - RNA, 20 nt, Artificial Sequence
  MKO10076392_B_Ccu8
  gRNA
uacuugccucugauacugac

SEQ ID NO: 76393 - RNA, 20 nt, Artificial Sequence
  MKO10076393_B_Ccz1
  gRNA
aagcaauuguacaguuuaca

SEQ ID NO: 76394 - RNA, 20 nt, Artificial Sequence
  MKO10076394_B_Ccz1
  gRNA
augaaccagaagaaaauuuc

SEQ ID NO: 76395 - RNA, 20 nt, Artificial Sequence
  MKO10076395_B_Ccz1
  gRNA
aaugaaaaaauuagaaaugu

SEQ ID NO: 76396 - RNA, 20 nt, Artificial Sequence
  MKO10076396_B_Cd101
  gRNA
cuuacgcaguguaugcccag

SEQ ID NO: 76397 - RNA, 20 nt, Artificial Sequence
  MKO10076397_B_Cd101
  gRNA
ucuccgggcccugcgcaccg

SEQ ID NO: 76398 - RNA, 20 nt, Artificial Sequence
  MKO10076398_B_Cd101
  gRNA
acuuccuuggucggggcgcu

SEQ ID NO: 76399 - RNA, 20 nt, Artificial Sequence
  MKO10076399_B_Cd109
  gRNA
ccuggaaaauagccccccac

SEQ ID NO: 76400 - RNA, 20 nt, Artificial Sequence
  MKO10076400_B_Cd109
  gRNA
agucuaaugugauccaacag

SEQ ID NO: 76401 - RNA, 20 nt, Artificial Sequence
  MKO10076401_B_Cd109
  gRNA
gcucagaucucaagccuuau

SEQ ID NO: 76402 - RNA, 20 nt, Artificial Sequence
  MKO10076402_B_Cd14
  gRNA
ccgcaccguaagccgcuuua

SEQ ID NO: 76403 - RNA, 20 nt, Artificial Sequence
  MKO10076403_B_Cd14
  gRNA
uuguugcccacgacacguug

SEQ ID NO: 76404 - RNA, 20 nt, Artificial Sequence
  MKO10076404_B_Cd14
  gRNA
gcuccgaauagaauccgacu

SEQ ID NO: 76405 - RNA, 20 nt, Artificial Sequence
  MKO10076405_B_Cd151
  gRNA
gucaagagauaccaccaguc

SEQ ID NO: 76406 - RNA, 20 nt, Artificial Sequence
  MKO10076406_B_Cd151
  gRNA
ggaugccagcaaugaucucc

SEQ ID NO: 76407 - RNA, 20 nt, Artificial Sequence
  MKO10076407_B_Cd151
  gRNA
uggugaggcagacagccgcg

SEQ ID NO: 76408 - RNA, 20 nt, Artificial Sequence
  MKO10076408_B_Cd160
  gRNA
gguccagucgcccuccuuuc

SEQ ID NO: 76409 - RNA, 20 nt, Artificial Sequence
  MKO10076409_B_Cd160
  gRNA
gcaauugugaacuuccaaca

SEQ ID NO: 76410 - RNA, 20 nt, Artificial Sequence
  MKO10076410_B_Cd160
  gRNA
cagcaugcaaagaauccuga

SEQ ID NO: 76411 - RNA, 20 nt, Artificial Sequence
  MKO10076411_B_Cd163l1
  gRNA
agguucuucggggacugacc

SEQ ID NO: 76412 - RNA, 20 nt, Artificial Sequence
  MKO10076412_B_Cd163l1
  gRNA
agacucaacaacaagcuacg

SEQ ID NO: 76413 - RNA, 20 nt, Artificial Sequence
  MKO10076413_B_Cd163l1
  gRNA
uacccucacaggacacgugg

SEQ ID NO: 76414 - RNA, 20 nt, Artificial Sequence
  MKO10076414_B_Cd163
  gRNA
gacugcaaacaccggggaug

SEQ ID NO: 76415 - RNA, 20 nt, Artificial Sequence
  MKO10076415_B_Cd163
  gRNA
ucugcugucacuaacgcucc

SEQ ID NO: 76416 - RNA, 20 nt, Artificial Sequence
  MKO10076416_B_Cd163
  gRNA
uguaaaagguuuguccaucu

SEQ ID NO: 76417 - RNA, 20 nt, Artificial Sequence
  MKO10076417_B_Cd164l2
  gRNA
uuugauggagcuagcuucau

SEQ ID NO: 76418 - RNA, 20 nt, Artificial Sequence
  MKO10076418_B_Cd164l2
  gRNA
aggacccuaccugugguacu

SEQ ID NO: 76419 - RNA, 20 nt, Artificial Sequence
  MKO10076419_B_Cd164l2
  gRNA
ccuccuugaccacuucagcu

SEQ ID NO: 76420 - RNA, 20 nt, Artificial Sequence
  MKO10076420_B_Cd164
  gRNA
accauuaaguaauuguuccc

SEQ ID NO: 76421 - RNA, 20 nt, Artificial Sequence
  MKO10076421_B_Cd164
  gRNA
aaccgcacugacuuguguuc

SEQ ID NO: 76422 - RNA, 20 nt, Artificial Sequence
  MKO10076422_B_Cd164
  gRNA
acagcuguugaagcucgcac

SEQ ID NO: 76423 - RNA, 20 nt, Artificial Sequence
  MKO10076423_B_Cd177
  gRNA
uacacccgugugugucgcca

SEQ ID NO: 76424 - RNA, 20 nt, Artificial Sequence
  MKO10076424_B_Cd177
  gRNA
cugccagaaaagcagcgcac

SEQ ID NO: 76425 - RNA, 20 nt, Artificial Sequence
  MKO10076425_B_Cd177
  gRNA
agcgaaaacugugaucuuau

SEQ ID NO: 76426 - RNA, 20 nt, Artificial Sequence
  MKO10076426_B_Cd180
  gRNA
cucggcaacuggccaagaag

SEQ ID NO: 76427 - RNA, 20 nt, Artificial Sequence
  MKO10076427_B_Cd180
  gRNA
cucagaucagaagugcauug

SEQ ID NO: 76428 - RNA, 20 nt, Artificial Sequence
  MKO10076428_B_Cd180
  gRNA
uccaaacauucuguugaguu

SEQ ID NO: 76429 - RNA, 20 nt, Artificial Sequence
  MKO10076429_B_Cd19
  gRNA
ugacgucugaagcauuccac

SEQ ID NO: 76430 - RNA, 20 nt, Artificial Sequence
  MKO10076430_B_Cd19
  gRNA
agcacccggucagagagaug

SEQ ID NO: 76431 - RNA, 20 nt, Artificial Sequence
  MKO10076431_B_Cd19
  gRNA
caaucacuagcaagaugccc

SEQ ID NO: 76432 - RNA, 20 nt, Artificial Sequence
  MKO10076432_B_Cd1d1
  gRNA
uuucacagcccgcagacagc

SEQ ID NO: 76433 - RNA, 20 nt, Artificial Sequence
  MKO10076433_B_Cd1d1
  gRNA
caugacacaccagcugccua

SEQ ID NO: 76434 - RNA, 20 nt, Artificial Sequence
  MKO10076434_B_Cd1d1
  gRNA
ucaguacuaugaagacgauc

SEQ ID NO: 76435 - RNA, 20 nt, Artificial Sequence
  MKO10076435_B_Cd1d2
  gRNA
accuaccgugccuguugcug

SEQ ID NO: 76436 - RNA, 20 nt, Artificial Sequence
  MKO10076436_B_Cd1d2
  gRNA
cuuccuuugcuaacauaagc

SEQ ID NO: 76437 - RNA, 20 nt, Artificial Sequence
  MKO10076437_B_Cd1d2
  gRNA
caugacacaccagcugcaga

SEQ ID NO: 76438 - RNA, 20 nt, Artificial Sequence
  MKO10076438_B_Cd200r1
  gRNA
ugcauugucucucauuugac

SEQ ID NO: 76439 - RNA, 20 nt, Artificial Sequence
  MKO10076439_B_Cd200r1
  gRNA
accaccucuacucaguucua

SEQ ID NO: 76440 - RNA, 20 nt, Artificial Sequence
  MKO10076440_B_Cd200r1
  gRNA
aaacuaugaccuccaagugc

SEQ ID NO: 76441 - RNA, 20 nt, Artificial Sequence
  MKO10076441_B_Cd200r2
  gRNA
ugcauugucucucauucgac

SEQ ID NO: 76442 - RNA, 20 nt, Artificial Sequence
  MKO10076442_B_Cd200r2
  gRNA
ccugaaguaaccuacuuucu

SEQ ID NO: 76443 - RNA, 20 nt, Artificial Sequence
  MKO10076443_B_Cd200r2
  gRNA
uccagaagagaaauguuacc

SEQ ID NO: 76444 - RNA, 20 nt, Artificial Sequence
  MKO10076444_B_Cd200r3
  gRNA
gagcauucucuaugugaaac

SEQ ID NO: 76445 - RNA, 20 nt, Artificial Sequence
  MKO10076445_B_Cd200r3
  gRNA
gaugauaauaucuucccuga

SEQ ID NO: 76446 - RNA, 20 nt, Artificial Sequence
  MKO10076446_B_Cd200r3
  gRNA
acucaucuucaucacuauuu

SEQ ID NO: 76447 - RNA, 20 nt, Artificial Sequence
  MKO10076447_B_Cd200r4
  gRNA
accuggcaaaauuucucuuc

SEQ ID NO: 76448 - RNA, 20 nt, Artificial Sequence
  MKO10076448_B_Cd200r4
  gRNA
auuaauacugcauuuaucag

SEQ ID NO: 76449 - RNA, 20 nt, Artificial Sequence
  MKO10076449_B_Cd200r4
  gRNA
cacuacaaugucuguacaga

SEQ ID NO: 76450 - RNA, 20 nt, Artificial Sequence
  MKO10076450_B_Cd200
  gRNA
aacgucaccgaaaucaggag

SEQ ID NO: 76451 - RNA, 20 nt, Artificial Sequence
  MKO10076451_B_Cd200
  gRNA
gauucucaccauagagggua

SEQ ID NO: 76452 - RNA, 20 nt, Artificial Sequence
  MKO10076452_B_Cd200
  gRNA
cagauguagucccauuugaa

SEQ ID NO: 76453 - RNA, 20 nt, Artificial Sequence
  MKO10076453_B_Cd207
  gRNA
aaaucuagauccuagguuga

SEQ ID NO: 76454 - RNA, 20 nt, Artificial Sequence
  MKO10076454_B_Cd207
  gRNA
cuuaccaaagcagggagcga

SEQ ID NO: 76455 - RNA, 20 nt, Artificial Sequence
  MKO10076455_B_Cd207
  gRNA
ggaccagacaucauucaaca

SEQ ID NO: 76456 - RNA, 20 nt, Artificial Sequence
  MKO10076456_B_Cd209a
  gRNA
ggcaguggcagaaucauucc

SEQ ID NO: 76457 - RNA, 20 nt, Artificial Sequence
  MKO10076457_B_Cd209a
  gRNA
aagagcaccugcagugccaa

SEQ ID NO: 76458 - RNA, 20 nt, Artificial Sequence
  MKO10076458_B_Cd209a
  gRNA
ccaagaacugacccaguuga

SEQ ID NO: 76459 - RNA, 20 nt, Artificial Sequence
  MKO10076459_B_Cd209b
  gRNA
cucagacgaugaugaguuga

SEQ ID NO: 76460 - RNA, 20 nt, Artificial Sequence
  MKO10076460_B_Cd209b
  gRNA
ggaacaagagaagauccucc

SEQ ID NO: 76461 - RNA, 20 nt, Artificial Sequence
  MKO10076461_B_Cd209b
  gRNA
guccaggauucccaucuucc

SEQ ID NO: 76462 - RNA, 20 nt, Artificial Sequence
  MKO10076462_B_Cd209c
  gRNA
uaucaaaagugaugaugaac

SEQ ID NO: 76463 - RNA, 20 nt, Artificial Sequence
  MKO10076463_B_Cd209c
  gRNA
gccaucugccuucaugcuuc

SEQ ID NO: 76464 - RNA, 20 nt, Artificial Sequence
  MKO10076464_B_Cd209c
  gRNA
ucuccaaguuccaacagaac

SEQ ID NO: 76465 - RNA, 20 nt, Artificial Sequence
  MKO10076465_B_Cd209d
  gRNA
ucccgauuacaaacaaaauu

SEQ ID NO: 76466 - RNA, 20 nt, Artificial Sequence
  MKO10076466_B_Cd209d
  gRNA
ccuucaguugcaugagcucc

SEQ ID NO: 76467 - RNA, 20 nt, Artificial Sequence
  MKO10076467_B_Cd209d
  gRNA
gucaaagguccccagcucag

SEQ ID NO: 76468 - RNA, 20 nt, Artificial Sequence
  MKO10076468_B_Cd209e
  gRNA
cuugcaggauuucuagacaa

SEQ ID NO: 76469 - RNA, 20 nt, Artificial Sequence
  MKO10076469_B_Cd209e
  gRNA
ccaagaaaaauagcuacacc

SEQ ID NO: 76470 - RNA, 20 nt, Artificial Sequence
  MKO10076470_B_Cd209e
  gRNA
auccugaccuuggaugauga

SEQ ID NO: 76471 - RNA, 20 nt, Artificial Sequence
  MKO10076471_B_Cd209f
  gRNA
cucugacuuaccuugaacca

SEQ ID NO: 76472 - RNA, 20 nt, Artificial Sequence
  MKO10076472_B_Cd209f
  gRNA
caggauucgugcauacucac

SEQ ID NO: 76473 - RNA, 20 nt, Artificial Sequence
  MKO10076473_B_Cd209f
  gRNA
ccaguuacccuuguccaagc

SEQ ID NO: 76474 - RNA, 20 nt, Artificial Sequence
  MKO10076474_B_Cd209g
  gRNA
caggauucgugcauacucac

SEQ ID NO: 76475 - RNA, 20 nt, Artificial Sequence
  MKO10076475_B_Cd209g
  gRNA
ucagcugcugcugaaucugc

SEQ ID NO: 76476 - RNA, 20 nt, Artificial Sequence
  MKO10076476_B_Cd209g
  gRNA
uccuuguaguugccguuccu

SEQ ID NO: 76477 - RNA, 20 nt, Artificial Sequence
  MKO10076477_B_Cd226
  gRNA
ugaaacuaacccuccaacga

SEQ ID NO: 76478 - RNA, 20 nt, Artificial Sequence
  MKO10076478_B_Cd226
  gRNA
gcuauucuucaugugcacaa

SEQ ID NO: 76479 - RNA, 20 nt, Artificial Sequence
  MKO10076479_B_Cd226
  gRNA
cagagauggcuuauguuacu

SEQ ID NO: 76480 - RNA, 20 nt, Artificial Sequence
  MKO10076480_B_Cd22
  gRNA
cucagagcgcacugugcguc

SEQ ID NO: 76481 - RNA, 20 nt, Artificial Sequence
  MKO10076481_B_Cd22
  gRNA
cuacccuucccccgcugaag

SEQ ID NO: 76482 - RNA, 20 nt, Artificial Sequence
  MKO10076482_B_Cd22
  gRNA
cuugaaccaagacaccgcca

SEQ ID NO: 76483 - RNA, 20 nt, Artificial Sequence
  MKO10076483_B_Cd244
  gRNA
gugagcuacgcuuuguacag

SEQ ID NO: 76484 - RNA, 20 nt, Artificial Sequence
  MKO10076484_B_Cd244
  gRNA
cgagccagcagggaucaaca

SEQ ID NO: 76485 - RNA, 20 nt, Artificial Sequence
  MKO10076485_B_Cd244
  gRNA
gcauccuuguugaucccugc

SEQ ID NO: 76486 - RNA, 20 nt, Artificial Sequence
  MKO10076486_B_Cd247
  gRNA
cugcuccugggaaccgcacg

SEQ ID NO: 76487 - RNA, 20 nt, Artificial Sequence
  MKO10076487_B_Cd247
  gRNA
aaacucugcuacuugcuaga

SEQ ID NO: 76488 - RNA, 20 nt, Artificial Sequence
  MKO10076488_B_Cd247
  gRNA
agagacugcugccaaccugc

SEQ ID NO: 76489 - RNA, 20 nt, Artificial Sequence
  MKO10076489_B_Cd248
  gRNA
acucauccguguccacgcag

SEQ ID NO: 76490 - RNA, 20 nt, Artificial Sequence
  MKO10076490_B_Cd248
  gRNA
ccggagccucgagccgcgug

SEQ ID NO: 76491 - RNA, 20 nt, Artificial Sequence
  MKO10076491_B_Cd248
  gRNA
ugggggucgggccggccaac

SEQ ID NO: 76492 - RNA, 20 nt, Artificial Sequence
  MKO10076492_B_Cd24a
  gRNA
agcggacaugggcagagcga

SEQ ID NO: 76493 - RNA, 20 nt, Artificial Sequence
  MKO10076493_B_Cd24a
  gRNA
cagggagcugccacccccuc

SEQ ID NO: 76494 - RNA, 20 nt, Artificial Sequence
  MKO10076494_B_Cd24a
  gRNA
gaagagagagagagagagcc

SEQ ID NO: 76495 - RNA, 20 nt, Artificial Sequence
  MKO10076495_B_Cd274
  gRNA
ggaccguggacacuacaaug

SEQ ID NO: 76496 - RNA, 20 nt, Artificial Sequence
  MKO10076496_B_Cd274
  gRNA
ggaugaucagcuccgcugug

SEQ ID NO: 76497 - RNA, 20 nt, Artificial Sequence
  MKO10076497_B_Cd274
  gRNA
uuuagugagaaugcuagaug

SEQ ID NO: 76498 - RNA, 20 nt, Artificial Sequence
  MKO10076498_B_Cd276
  gRNA
ucggacgcgcugcagccuca

SEQ ID NO: 76499 - RNA, 20 nt, Artificial Sequence
  MKO10076499_B_Cd276
  gRNA
ccuuguaggugccgaggacc

SEQ ID NO: 76500 - RNA, 20 nt, Artificial Sequence
  MKO10076500_B_Cd276
  gRNA
uucuccagcacacgaaagcc

SEQ ID NO: 76501 - RNA, 20 nt, Artificial Sequence
  MKO10076501_B_Cd27
  gRNA
ccaguccaguaguguuuguc

SEQ ID NO: 76502 - RNA, 20 nt, Artificial Sequence
  MKO10076502_B_Cd27
  gRNA
gcuguccagacaaacacuac

SEQ ID NO: 76503 - RNA, 20 nt, Artificial Sequence
  MKO10076503_B_Cd27
  gRNA
uugcacagaugaagaccggc

SEQ ID NO: 76504 - RNA, 20 nt, Artificial Sequence
  MKO10076504_B_Cd28
  gRNA
cuagcaagccauaacaaaac

SEQ ID NO: 76505 - RNA, 20 nt, Artificial Sequence
  MKO10076505_B_Cd28
  gRNA
cccccuagacaaauaguaga

SEQ ID NO: 76506 - RNA, 20 nt, Artificial Sequence
  MKO10076506_B_Cd28
  gRNA
caguggcucuuuguguuauc

SEQ ID NO: 76507 - RNA, 20 nt, Artificial Sequence
  MKO10076507_B_Cd2ap
  gRNA
gugaguuucaccauccucug

SEQ ID NO: 76508 - RNA, 20 nt, Artificial Sequence
  MKO10076508_B_Cd2ap
  gRNA
gaaagaauuagaguccacag

SEQ ID NO: 76509 - RNA, 20 nt, Artificial Sequence
  MKO10076509_B_Cd2ap
  gRNA
cagaaaugugaaaaaacuac

SEQ ID NO: 76510 - RNA, 20 nt, Artificial Sequence
  MKO10076510_B_Cd2bp2
  gRNA
auccucacaccgcccucacu

SEQ ID NO: 76511 - RNA, 20 nt, Artificial Sequence
  MKO10076511_B_Cd2bp2
  gRNA
gguccugggagccgcuucaa

SEQ ID NO: 76512 - RNA, 20 nt, Artificial Sequence
  MKO10076512_B_Cd2bp2
  gRNA
guccagcaaauaugauaucc

SEQ ID NO: 76513 - RNA, 20 nt, Artificial Sequence
  MKO10076513_B_Cd2
  gRNA
uacguuucugauaucaaaaa

SEQ ID NO: 76514 - RNA, 20 nt, Artificial Sequence
  MKO10076514_B_Cd2
  gRNA
caacacaacccugaccugug

SEQ ID NO: 76515 - RNA, 20 nt, Artificial Sequence
  MKO10076515_B_Cd2
  gRNA
guucagccaaaaccucccug

SEQ ID NO: 76516 - RNA, 20 nt, Artificial Sequence
  MKO10076516_B_Cd300a
  gRNA
cauaucgacaugacacacuc

SEQ ID NO: 76517 - RNA, 20 nt, Artificial Sequence
  MKO10076517_B_Cd300a
  gRNA
caccuuugaccagccgcuuc

SEQ ID NO: 76518 - RNA, 20 nt, Artificial Sequence
  MKO10076518_B_Cd300a
  gRNA
ccgugaacaugacuauuccc

SEQ ID NO: 76519 - RNA, 20 nt, Artificial Sequence
  MKO10076519_B_Cd300c
  gRNA
caauuucuucucauacugac

SEQ ID NO: 76520 - RNA, 20 nt, Artificial Sequence
  MKO10076520_B_Cd300c
  gRNA
aaggagaguagcacagcuga

SEQ ID NO: 76521 - RNA, 20 nt, Artificial Sequence
  MKO10076521_B_Cd300c
  gRNA
uucugagcagcccccacuuc

SEQ ID NO: 76522 - RNA, 20 nt, Artificial Sequence
  MKO10076522_B_Cd300e
  gRNA
auccucccacuagugaauuc

SEQ ID NO: 76523 - RNA, 20 nt, Artificial Sequence
  MKO10076523_B_Cd300e
  gRNA
gcaugcucugugcuaucuuc

SEQ ID NO: 76524 - RNA, 20 nt, Artificial Sequence
  MKO10076524_B_Cd300e
  gRNA
aggaggaugaggcuaugugc

SEQ ID NO: 76525 - RNA, 20 nt, Artificial Sequence
  MKO10076525_B_Cd300lb
  gRNA
acacacucucuguagcgauu

SEQ ID NO: 76526 - RNA, 20 nt, Artificial Sequence
  MKO10076526_B_Cd300lb
  gRNA
uuggguaucccgcugagauu

SEQ ID NO: 76527 - RNA, 20 nt, Artificial Sequence
  MKO10076527_B_Cd300lb
  gRNA
aaguugauuagaagucgaca

SEQ ID NO: 76528 - RNA, 20 nt, Artificial Sequence
  MKO10076528_B_Cd300ld
  gRNA
acuuaccugggaggaagaau

SEQ ID NO: 76529 - RNA, 20 nt, Artificial Sequence
  MKO10076529_B_Cd300ld
  gRNA
uugccaguguucucagcgcu

SEQ ID NO: 76530 - RNA, 20 nt, Artificial Sequence
  MKO10076530_B_Cd300ld
  gRNA
ccucucccaaagcaucucug

SEQ ID NO: 76531 - RNA, 20 nt, Artificial Sequence
  MKO10076531_B_Cd300lf
  gRNA
acuagcuacuacucugauaa

SEQ ID NO: 76532 - RNA, 20 nt, Artificial Sequence
  MKO10076532_B_Cd300lf
  gRNA
cauccuccaagcaaagagcg

SEQ ID NO: 76533 - RNA, 20 nt, Artificial Sequence
  MKO10076533_B_Cd300lf
  gRNA
cccuuucucuucuggaucac

SEQ ID NO: 76534 - RNA, 20 nt, Artificial Sequence
  MKO10076534_B_Cd300lg
  gRNA
cuccaguguguccaucccga

SEQ ID NO: 76535 - RNA, 20 nt, Artificial Sequence
  MKO10076535_B_Cd300lg
  gRNA
ggggcagccagacgacugga

SEQ ID NO: 76536 - RNA, 20 nt, Artificial Sequence
  MKO10076536_B_Cd300lg
  gRNA
agcacccaccaugaggccuc

SEQ ID NO: 76537 - RNA, 20 nt, Artificial Sequence
  MKO10076537_B_Cd300lh
  gRNA
ggauccagucacagguccag

SEQ ID NO: 76538 - RNA, 20 nt, Artificial Sequence
  MKO10076538_B_Cd300lh
  gRNA
gacacccacaacaccaacca

SEQ ID NO: 76539 - RNA, 20 nt, Artificial Sequence
  MKO10076539_B_Cd300lh
  gRNA
agagagaguucugagucacc

SEQ ID NO: 76540 - RNA, 20 nt, Artificial Sequence
  MKO10076540_B_Cd302
  gRNA
agaggaaaacgcguuuauac

SEQ ID NO: 76541 - RNA, 20 nt, Artificial Sequence
  MKO10076541_B_Cd302
  gRNA
gaggaccuaguugauaccug

SEQ ID NO: 76542 - RNA, 20 nt, Artificial Sequence
  MKO10076542_B_Cd302
  gRNA
cacuuugcaaaagcgaugga

SEQ ID NO: 76543 - RNA, 20 nt, Artificial Sequence
  MKO10076543_B_Cd320
  gRNA
aauguaacauuuaccucugc

SEQ ID NO: 76544 - RNA, 20 nt, Artificial Sequence
  MKO10076544_B_Cd320
  gRNA
accuuccagugucuuaccag

SEQ ID NO: 76545 - RNA, 20 nt, Artificial Sequence
  MKO10076545_B_Cd320
  gRNA
ccccuuuccuggcgcuguga

SEQ ID NO: 76546 - RNA, 20 nt, Artificial Sequence
  MKO10076546_B_Cd33
  gRNA
cugaggugugaacgucagca

SEQ ID NO: 76547 - RNA, 20 nt, Artificial Sequence
  MKO10076547_B_Cd33
  gRNA
cgagacagagcccaagaauc

SEQ ID NO: 76548 - RNA, 20 nt, Artificial Sequence
  MKO10076548_B_Cd33
  gRNA
ccgcuguucuugcugugugc

SEQ ID NO: 76549 - RNA, 20 nt, Artificial Sequence
  MKO10076549_B_Cd34
  gRNA
ucacccaccuuaauggcacu

SEQ ID NO: 76550 - RNA, 20 nt, Artificial Sequence
  MKO10076550_B_Cd34
  gRNA
gucaacuuuacaguuaccuc

SEQ ID NO: 76551 - RNA, 20 nt, Artificial Sequence
  MKO10076551_B_Cd34
  gRNA
ccgagaagugagguuggccc

SEQ ID NO: 76552 - RNA, 20 nt, Artificial Sequence
  MKO10076552_B_Cd36
  gRNA
ugugcaaaacccagaugacg

SEQ ID NO: 76553 - RNA, 20 nt, Artificial Sequence
  MKO10076553_B_Cd36
  gRNA
caguacaaugacacuguaga

SEQ ID NO: 76554 - RNA, 20 nt, Artificial Sequence
  MKO10076554_B_Cd36
  gRNA
aaauauaacucaggaccccg

SEQ ID NO: 76555 - RNA, 20 nt, Artificial Sequence
  MKO10076555_B_Cd37
  gRNA
gaugcccaggguaaucugug

SEQ ID NO: 76556 - RNA, 20 nt, Artificial Sequence
  MKO10076556_B_Cd37
  gRNA
aggugccgaagcagaaaauc

SEQ ID NO: 76557 - RNA, 20 nt, Artificial Sequence
  MKO10076557_B_Cd37
  gRNA
accuuggaccaagucugcag

SEQ ID NO: 76558 - RNA, 20 nt, Artificial Sequence
  MKO10076558_B_Cd38
  gRNA
cuacgccccacuuguuaaau

SEQ ID NO: 76559 - RNA, 20 nt, Artificial Sequence
  MKO10076559_B_Cd38
  gRNA
uguggagacccuaguacuuc

SEQ ID NO: 76560 - RNA, 20 nt, Artificial Sequence
  MKO10076560_B_Cd38
  gRNA
ucaaaccauaccauguaaca

SEQ ID NO: 76561 - RNA, 20 nt, Artificial Sequence
  MKO10076561_B_Cd3d
  gRNA
aaaggcguucuggacccacg

SEQ ID NO: 76562 - RNA, 20 nt, Artificial Sequence
  MKO10076562_B_Cd3d
  gRNA
ucccuccaagacggcuguac

SEQ ID NO: 76563 - RNA, 20 nt, Artificial Sequence
  MKO10076563_B_Cd3d
  gRNA
caugagaccggaaggccuuc

SEQ ID NO: 76564 - RNA, 20 nt, Artificial Sequence
  MKO10076564_B_Cd3eap
  gRNA
ggaacccucccguuucuccu

SEQ ID NO: 76565 - RNA, 20 nt, Artificial Sequence
  MKO10076565_B_Cd3eap
  gRNA
agcuggaauggcggguaccc

SEQ ID NO: 76566 - RNA, 20 nt, Artificial Sequence
  MKO10076566_B_Cd3eap
  gRNA
gcuccacucacugcaggccu

SEQ ID NO: 76567 - RNA, 20 nt, Artificial Sequence
  MKO10076567_B_Cd3e
  gRNA
ucgggucacaggcuuggccu

SEQ ID NO: 76568 - RNA, 20 nt, Artificial Sequence
  MKO10076568_B_Cd3e
  gRNA
aaucuucuuaccaauguucu

SEQ ID NO: 76569 - RNA, 20 nt, Artificial Sequence
  MKO10076569_B_Cd3e
  gRNA
cuuucagaugccgagaacau

SEQ ID NO: 76570 - RNA, 20 nt, Artificial Sequence
  MKO10076570_B_Cd3g
  gRNA
aacaaugccaaagacccucg

SEQ ID NO: 76571 - RNA, 20 nt, Artificial Sequence
  MKO10076571_B_Cd3g
  gRNA
gcaaaaugaacagcuguacc

SEQ ID NO: 76572 - RNA, 20 nt, Artificial Sequence
  MKO10076572_B_Cd3g
  gRNA
acuguagcccagacaaauaa

SEQ ID NO: 76573 - RNA, 20 nt, Artificial Sequence
  MKO10076573_B_Cd40lg
  gRNA
accggaugcugcauuacugu

SEQ ID NO: 76574 - RNA, 20 nt, Artificial Sequence
  MKO10076574_B_Cd40lg
  gRNA
gcaauuugaagaccuuguca

SEQ ID NO: 76575 - RNA, 20 nt, Artificial Sequence
  MKO10076575_B_Cd40lg
  gRNA
caucuccucacaguucagca

SEQ ID NO: 76576 - RNA, 20 nt, Artificial Sequence
  MKO10076576_B_Cd40
  gRNA
gacaaacaguaccuccacga

SEQ ID NO: 76577 - RNA, 20 nt, Artificial Sequence
  MKO10076577_B_Cd40
  gRNA
agcgaaucucccuguuccac

SEQ ID NO: 76578 - RNA, 20 nt, Artificial Sequence
  MKO10076578_B_Cd40
  gRNA
gcaguguuguccuuccuuac

SEQ ID NO: 76579 - RNA, 20 nt, Artificial Sequence
  MKO10076579_B_Cd44
  gRNA
cuacaguaucucccggacug

SEQ ID NO: 76580 - RNA, 20 nt, Artificial Sequence
  MKO10076580_B_Cd44
  gRNA
agguacauacuuaugguaac

SEQ ID NO: 76581 - RNA, 20 nt, Artificial Sequence
  MKO10076581_B_Cd44
  gRNA
agcacgccauggacaaguuu

SEQ ID NO: 76582 - RNA, 20 nt, Artificial Sequence
  MKO10076582_B_Cd46
  gRNA
uacaguugugauccuacccc

SEQ ID NO: 76583 - RNA, 20 nt, Artificial Sequence
  MKO10076583_B_Cd46
  gRNA
auguuacaagacccuucauu

SEQ ID NO: 76584 - RNA, 20 nt, Artificial Sequence
  MKO10076584_B_Cd46
  gRNA
ccugugagccaaaucauaca

SEQ ID NO: 76585 - RNA, 20 nt, Artificial Sequence
  MKO10076585_B_Cd47
  gRNA
gaaugauucucuuauucgua

SEQ ID NO: 76586 - RNA, 20 nt, Artificial Sequence
  MKO10076586_B_Cd47
  gRNA
uuucuccuccucguaagaac

SEQ ID NO: 76587 - RNA, 20 nt, Artificial Sequence
  MKO10076587_B_Cd47
  gRNA
aucagccuguucuuacgagg

SEQ ID NO: 76588 - RNA, 20 nt, Artificial Sequence
  MKO10076588_B_Cd48
  gRNA
accagcauguugacuauacu

SEQ ID NO: 76589 - RNA, 20 nt, Artificial Sequence
  MKO10076589_B_Cd48
  gRNA
ucacaacacucaucauucac

SEQ ID NO: 76590 - RNA, 20 nt, Artificial Sequence
  MKO10076590_B_Cd48
  gRNA
agaguucuugucagguuaac

SEQ ID NO: 76591 - RNA, 20 nt, Artificial Sequence
  MKO10076591_B_Cd4
  gRNA
ucgcuucaguuugcugguuc

SEQ ID NO: 76592 - RNA, 20 nt, Artificial Sequence
  MKO10076592_B_Cd4
  gRNA
ucaaaacgaucaaacugcga

SEQ ID NO: 76593 - RNA, 20 nt, Artificial Sequence
  MKO10076593_B_Cd4
  gRNA
ucagacuuauaucugugagc

SEQ ID NO: 76594 - RNA, 20 nt, Artificial Sequence
  MKO10076594_B_Cd52
  gRNA
cuuccucacuaucauucuuc

SEQ ID NO: 76595 - RNA, 20 nt, Artificial Sequence
  MKO10076595_B_Cd52
  gRNA
augaggccccacucuuuaag

SEQ ID NO: 76596 - RNA, 20 nt, Artificial Sequence
  MKO10076596_B_Cd52
  gRNA
ggccucauccaucaucgaug

SEQ ID NO: 76597 - RNA, 20 nt, Artificial Sequence
  MKO10076597_B_Cd53
  gRNA
ggcucaagugauuggaccag

SEQ ID NO: 76598 - RNA, 20 nt, Artificial Sequence
  MKO10076598_B_Cd53
  gRNA
cucugacaacagcacuauga

SEQ ID NO: 76599 - RNA, 20 nt, Artificial Sequence
  MKO10076599_B_Cd53
  gRNA
gcaggaagaugguggaccac

SEQ ID NO: 76600 - RNA, 20 nt, Artificial Sequence
  MKO10076600_B_Cd55
  gRNA
cuccagacauuccuaaugcc

SEQ ID NO: 76601 - RNA, 20 nt, Artificial Sequence
  MKO10076601_B_Cd55
  gRNA
uacucucacagaauguuucg

SEQ ID NO: 76602 - RNA, 20 nt, Artificial Sequence
  MKO10076602_B_Cd55
  gRNA
cuauuguggaauaugagugu

SEQ ID NO: 76603 - RNA, 20 nt, Artificial Sequence
  MKO10076603_B_Cd59a
  gRNA
caggaaugcaaguguaucaa

SEQ ID NO: 76604 - RNA, 20 nt, Artificial Sequence
  MKO10076604_B_Cd59a
  gRNA
agaacacagccagaagcagc

SEQ ID NO: 76605 - RNA, 20 nt, Artificial Sequence
  MKO10076605_B_Cd59a
  gRNA
ccagcacaaugagagcucag

SEQ ID NO: 76606 - RNA, 20 nt, Artificial Sequence
  MKO10076606_B_Cd59b
  gRNA
augcuacaacuguuuagacc

SEQ ID NO: 76607 - RNA, 20 nt, Artificial Sequence
  MKO10076607_B_Cd59b
  gRNA
agaagacagccagaagcagc

SEQ ID NO: 76608 - RNA, 20 nt, Artificial Sequence
  MKO10076608_B_Cd59b
  gRNA
ccagcacaaugagagcucag

SEQ ID NO: 76609 - RNA, 20 nt, Artificial Sequence
  MKO10076609_B_Cd5l
  gRNA
ggcugauaugaugcgccacg

SEQ ID NO: 76610 - RNA, 20 nt, Artificial Sequence
  MKO10076610_B_Cd5l
  gRNA
cuggaugacgucaacugcuc

SEQ ID NO: 76611 - RNA, 20 nt, Artificial Sequence
  MKO10076611_B_Cd5l
  gRNA
cccaccagcuucagcucaaa

SEQ ID NO: 76612 - RNA, 20 nt, Artificial Sequence
  MKO10076612_B_Cd5
  gRNA
gcgcucaccgucaucugcuc

SEQ ID NO: 76613 - RNA, 20 nt, Artificial Sequence
  MKO10076613_B_Cd5
  gRNA
caccccuuccagacuguccg

SEQ ID NO: 76614 - RNA, 20 nt, Artificial Sequence
  MKO10076614_B_Cd5
  gRNA
caccccacccaccaccgugc

SEQ ID NO: 76615 - RNA, 20 nt, Artificial Sequence
  MKO10076615_B_Cd63
  gRNA
gagacaguaguucuccuugc

SEQ ID NO: 76616 - RNA, 20 nt, Artificial Sequence
  MKO10076616_B_Cd63
  gRNA
ucuaaacacauagccagcaa

SEQ ID NO: 76617 - RNA, 20 nt, Artificial Sequence
  MKO10076617_B_Cd63
  gRNA
ccugucucuuaucaugcuug

SEQ ID NO: 76618 - RNA, 20 nt, Artificial Sequence
  MKO10076618_B_Cd68
  gRNA
cuuggacuaggcgagggugg

SEQ ID NO: 76619 - RNA, 20 nt, Artificial Sequence
  MKO10076619_B_Cd68
  gRNA
gagcccgaguacagucuacc

SEQ ID NO: 76620 - RNA, 20 nt, Artificial Sequence
  MKO10076620_B_Cd68
  gRNA
auuccaccgccauguagucc

SEQ ID NO: 76621 - RNA, 20 nt, Artificial Sequence
  MKO10076621_B_Cd69
  gRNA
uccaacuucucguacaagcc

SEQ ID NO: 76622 - RNA, 20 nt, Artificial Sequence
  MKO10076622_B_Cd69
  gRNA
gcuugacagguucaacuuga

SEQ ID NO: 76623 - RNA, 20 nt, Artificial Sequence
  MKO10076623_B_Cd69
  gRNA
accacuauuaacacagccca

SEQ ID NO: 76624 - RNA, 20 nt, Artificial Sequence
  MKO10076624_B_Cd6
  gRNA
agcgacugcucccguucacc

SEQ ID NO: 76625 - RNA, 20 nt, Artificial Sequence
  MKO10076625_B_Cd6
  gRNA
gguuugcuuaccuaggucca

SEQ ID NO: 76626 - RNA, 20 nt, Artificial Sequence
  MKO10076626_B_Cd6
  gRNA
caccaucccgaacaugaccu

SEQ ID NO: 76627 - RNA, 20 nt, Artificial Sequence
  MKO10076627_B_Cd70
  gRNA
gcccuugccccuggguucgc

SEQ ID NO: 76628 - RNA, 20 nt, Artificial Sequence
  MKO10076628_B_Cd70
  gRNA
agcuguaacucagcugugug

SEQ ID NO: 76629 - RNA, 20 nt, Artificial Sequence
  MKO10076629_B_Cd70
  gRNA
gaguuacagcugaaucucac

SEQ ID NO: 76630 - RNA, 20 nt, Artificial Sequence
  MKO10076630_B_Cd72
  gRNA
agacacuugcacauucucgu

SEQ ID NO: 76631 - RNA, 20 nt, Artificial Sequence
  MKO10076631_B_Cd72
  gRNA
cucgagccaggacacauuac

SEQ ID NO: 76632 - RNA, 20 nt, Artificial Sequence
  MKO10076632_B_Cd72
  gRNA
ccugcuuuguccgcuagugc

SEQ ID NO: 76633 - RNA, 20 nt, Artificial Sequence
  MKO10076633_B_Cd74
  gRNA
agggaguagccauccgcauc

SEQ ID NO: 76634 - RNA, 20 nt, Artificial Sequence
  MKO10076634_B_Cd74
  gRNA
cugggucauguugccguacu

SEQ ID NO: 76635 - RNA, 20 nt, Artificial Sequence
  MKO10076635_B_Cd74
  gRNA
accgcccuagagagccagaa

SEQ ID NO: 76636 - RNA, 20 nt, Artificial Sequence
  MKO10076636_B_Cd79a
  gRNA
cauacauagaacagucauca

SEQ ID NO: 76637 - RNA, 20 nt, Artificial Sequence
  MKO10076637_B_Cd79a
  gRNA
aaccgcaucaucacagcaga

SEQ ID NO: 76638 - RNA, 20 nt, Artificial Sequence
  MKO10076638_B_Cd79a
  gRNA
ucccuucugcugugaugaug

SEQ ID NO: 76639 - RNA, 20 nt, Artificial Sequence
  MKO10076639_B_Cd79b
  gRNA
ucccccaggauucagcacgu

SEQ ID NO: 76640 - RNA, 20 nt, Artificial Sequence
  MKO10076640_B_Cd79b
  gRNA
cauugugcaggaugacggca

SEQ ID NO: 76641 - RNA, 20 nt, Artificial Sequence
  MKO10076641_B_Cd79b
  gRNA
aggucacugcuugucauugc

SEQ ID NO: 76642 - RNA, 20 nt, Artificial Sequence
  MKO10076642_B_Cd7
  gRNA
augucuucauacacuacgca

SEQ ID NO: 76643 - RNA, 20 nt, Artificial Sequence
  MKO10076643_B_Cd7
  gRNA
uggggaugcauggcgucuug

SEQ ID NO: 76644 - RNA, 20 nt, Artificial Sequence
  MKO10076644_B_Cd7
  gRNA
gaugcuuaccuugggcaucc

SEQ ID NO: 76645 - RNA, 20 nt, Artificial Sequence
  MKO10076645_B_Cd80
  gRNA
uguggcccgaguauaagaac

SEQ ID NO: 76646 - RNA, 20 nt, Artificial Sequence
  MKO10076646_B_Cd80
  gRNA
uguucagcuaaugcuucuuc

SEQ ID NO: 76647 - RNA, 20 nt, Artificial Sequence
  MKO10076647_B_Cd80
  gRNA
acaaguguguucuugcuauc

SEQ ID NO: 76648 - RNA, 20 nt, Artificial Sequence
  MKO10076648_B_Cd81
  gRNA
uuaccguccccagcagacac

SEQ ID NO: 76649 - RNA, 20 nt, Artificial Sequence
  MKO10076649_B_Cd81
  gRNA
ggauggccccauagcacccc

SEQ ID NO: 76650 - RNA, 20 nt, Artificial Sequence
  MKO10076650_B_Cd81
  gRNA
ugugaagcaguucuaugacc

SEQ ID NO: 76651 - RNA, 20 nt, Artificial Sequence
  MKO10076651_B_Cd82
  gRNA
ggcuuacgucuucaucggug

SEQ ID NO: 76652 - RNA, 20 nt, Artificial Sequence
  MKO10076652_B_Cd82
  gRNA
gaauccacaccccgaagccc

SEQ ID NO: 76653 - RNA, 20 nt, Artificial Sequence
  MKO10076653_B_Cd82
  gRNA
cugcgccugcacguaguccc

SEQ ID NO: 76654 - RNA, 20 nt, Artificial Sequence
  MKO10076654_B_Cd83
  gRNA
ggagggcagcgcaacuugag

SEQ ID NO: 76655 - RNA, 20 nt, Artificial Sequence
  MKO10076655_B_Cd83
  gRNA
caagcaaaacagcuccuucg

SEQ ID NO: 76656 - RNA, 20 nt, Artificial Sequence
  MKO10076656_B_Cd83
  gRNA
acuggccccaaauguuugcu

SEQ ID NO: 76657 - RNA, 20 nt, Artificial Sequence
  MKO10076657_B_Cd84
  gRNA
cauagaucagaaguaugacc

SEQ ID NO: 76658 - RNA, 20 nt, Artificial Sequence
  MKO10076658_B_Cd84
  gRNA
gguuaccuguacauggcugc

SEQ ID NO: 76659 - RNA, 20 nt, Artificial Sequence
  MKO10076659_B_Cd84
  gRNA
acauggcccagcgccaucug

SEQ ID NO: 76660 - RNA, 20 nt, Artificial Sequence
  MKO10076660_B_Cd86
  gRNA
cgagcuuugacaggaacaac

SEQ ID NO: 76661 - RNA, 20 nt, Artificial Sequence
  MKO10076661_B_Cd86
  gRNA
gaaauaagcuugcgucucca

SEQ ID NO: 76662 - RNA, 20 nt, Artificial Sequence
  MKO10076662_B_Cd86
  gRNA
aucuccuuccaauacguuug

SEQ ID NO: 76663 - RNA, 20 nt, Artificial Sequence
  MKO10076663_B_Cd8a
  gRNA
cagaagggccacgcagauuc

SEQ ID NO: 76664 - RNA, 20 nt, Artificial Sequence
  MKO10076664_B_Cd8a
  gRNA
gggaguucgcagcacuggcu

SEQ ID NO: 76665 - RNA, 20 nt, Artificial Sequence
  MKO10076665_B_Cd8a
  gRNA
gagcaccuaaccugagccac

SEQ ID NO: 76666 - RNA, 20 nt, Artificial Sequence
  MKO10076666_B_Cd8b1
  gRNA
ugacucacaguaaaaguaga

SEQ ID NO: 76667 - RNA, 20 nt, Artificial Sequence
  MKO10076667_B_Cd8b1
  gRNA
ugcagacuaccagcaggcug

SEQ ID NO: 76668 - RNA, 20 nt, Artificial Sequence
  MKO10076668_B_Cd8b1
  gRNA
acuguuucaugaagugaauu

SEQ ID NO: 76669 - RNA, 20 nt, Artificial Sequence
  MKO10076669_B_Cd93
  gRNA
cguaccaugauuugccaaug

SEQ ID NO: 76670 - RNA, 20 nt, Artificial Sequence
  MKO10076670_B_Cd93
  gRNA
acauaccuccccacgaccuc

SEQ ID NO: 76671 - RNA, 20 nt, Artificial Sequence
  MKO10076671_B_Cd93
  gRNA
ugugggacccccgaagcucc

SEQ ID NO: 76672 - RNA, 20 nt, Artificial Sequence
  MKO10076672_B_Cd96
  gRNA
cuuaccaaaaaccuugacug

SEQ ID NO: 76673 - RNA, 20 nt, Artificial Sequence
  MKO10076673_B_Cd96
  gRNA
gaaccuagguggaauuucug

SEQ ID NO: 76674 - RNA, 20 nt, Artificial Sequence
  MKO10076674_B_Cd96
  gRNA
aacagcaccauggaugucuu

SEQ ID NO: 76675 - RNA, 20 nt, Artificial Sequence
  MKO10076675_B_Cd97
  gRNA
cgaggucucaccaagcaggc

SEQ ID NO: 76676 - RNA, 20 nt, Artificial Sequence
  MKO10076676_B_Cd97
  gRNA
guaccuucacagcucucugc

SEQ ID NO: 76677 - RNA, 20 nt, Artificial Sequence
  MKO10076677_B_Cd97
  gRNA
augaggggcgucagaugccc

SEQ ID NO: 76678 - RNA, 20 nt, Artificial Sequence
  MKO10076678_B_Cd99l2
  gRNA
uugccacuacuacaacuaga

SEQ ID NO: 76679 - RNA, 20 nt, Artificial Sequence
  MKO10076679_B_Cd99l2
  gRNA
uagaucauuucgaucaucca

SEQ ID NO: 76680 - RNA, 20 nt, Artificial Sequence
  MKO10076680_B_Cd99l2
  gRNA
ccaccuuaccucucuggaca

SEQ ID NO: 76681 - RNA, 20 nt, Artificial Sequence
  MKO10076681_B_Cd9
  gRNA
auaggugauuaaagaacucc

SEQ ID NO: 76682 - RNA, 20 nt, Artificial Sequence
  MKO10076682_B_Cd9
  gRNA
aaccauuccaguuucuacac

SEQ ID NO: 76683 - RNA, 20 nt, Artificial Sequence
  MKO10076683_B_Cd9
  gRNA
ccucucaccuguguagaaac

SEQ ID NO: 76684 - RNA, 20 nt, Artificial Sequence
  MKO10076684_B_Cdadc1
  gRNA
cccaguauguaagucuucac

SEQ ID NO: 76685 - RNA, 20 nt, Artificial Sequence
  MKO10076685_B_Cdadc1
  gRNA
agguucacuuuagaaagccu

SEQ ID NO: 76686 - RNA, 20 nt, Artificial Sequence
  MKO10076686_B_Cdadc1
  gRNA
gcuccauccagagacugagc

SEQ ID NO: 76687 - RNA, 20 nt, Artificial Sequence
  MKO10076687_B_Cdan1
  gRNA
gcagaacgaagccuucucga

SEQ ID NO: 76688 - RNA, 20 nt, Artificial Sequence
  MKO10076688_B_Cdan1
  gRNA
guuggguugauccuucgaga

SEQ ID NO: 76689 - RNA, 20 nt, Artificial Sequence
  MKO10076689_B_Cdan1
  gRNA
agugucuucucgacagcgcc

SEQ ID NO: 76690 - RNA, 20 nt, Artificial Sequence
  MKO10076690_B_Cda
  gRNA
cuucuggauggcaguccgcu

SEQ ID NO: 76691 - RNA, 20 nt, Artificial Sequence
  MKO10076691_B_Cda
  gRNA
agagaagauccucccguccc

SEQ ID NO: 76692 - RNA, 20 nt, Artificial Sequence
  MKO10076692_B_Cda
  gRNA
cugccgacaagucaugagag

SEQ ID NO: 76693 - RNA, 20 nt, Artificial Sequence
  MKO10076693_B_Cdc123
  gRNA
agauagucuuucacauucug

SEQ ID NO: 76694 - RNA, 20 nt, Artificial Sequence
  MKO10076694_B_Cdc123
  gRNA
ugagagcacagccacacuua

SEQ ID NO: 76695 - RNA, 20 nt, Artificial Sequence
  MKO10076695_B_Cdc123
  gRNA
aaagacuaucuacuugauga

SEQ ID NO: 76696 - RNA, 20 nt, Artificial Sequence
  MKO10076696_B_Cdc14a
  gRNA
gcaaacgcagcauucuugau

SEQ ID NO: 76697 - RNA, 20 nt, Artificial Sequence
  MKO10076697_B_Cdc14a
  gRNA
ggggcuugcgaguucaugaa

SEQ ID NO: 76698 - RNA, 20 nt, Artificial Sequence
  MKO10076698_B_Cdc14a
  gRNA
cuuaagauggcagcggaguc

SEQ ID NO: 76699 - RNA, 20 nt, Artificial Sequence
  MKO10076699_B_Cdc14b
  gRNA
uuaccauauaacacccgaca

SEQ ID NO: 76700 - RNA, 20 nt, Artificial Sequence
  MKO10076700_B_Cdc14b
  gRNA
auacagccuauauuccuuuc

SEQ ID NO: 76701 - RNA, 20 nt, Artificial Sequence
  MKO10076701_B_Cdc14b
  gRNA
uguucguuuguugcacucuu

SEQ ID NO: 76702 - RNA, 20 nt, Artificial Sequence
  MKO10076702_B_Cdc16
  gRNA
ucgagccauugucauccuuc

SEQ ID NO: 76703 - RNA, 20 nt, Artificial Sequence
  MKO10076703_B_Cdc16
  gRNA
ucuggacauccuugacaugg

SEQ ID NO: 76704 - RNA, 20 nt, Artificial Sequence
  MKO10076704_B_Cdc16
  gRNA
aagguagcuucacucucuca

SEQ ID NO: 76705 - RNA, 20 nt, Artificial Sequence
  MKO10076705_B_Cdc20b
  gRNA
cgauuugcugagcucccuuc

SEQ ID NO: 76706 - RNA, 20 nt, Artificial Sequence
  MKO10076706_B_Cdc20b
  gRNA
ugucuugcaaaaacggagag

SEQ ID NO: 76707 - RNA, 20 nt, Artificial Sequence
  MKO10076707_B_Cdc20b
  gRNA
ucacccaaaacccucucuaa

SEQ ID NO: 76708 - RNA, 20 nt, Artificial Sequence
  MKO10076708_B_Cdc20
  gRNA
caccuggaccucagcauugc

SEQ ID NO: 76709 - RNA, 20 nt, Artificial Sequence
  MKO10076709_B_Cdc20
  gRNA
uuaccuucuggggcauucug

SEQ ID NO: 76710 - RNA, 20 nt, Artificial Sequence
  MKO10076710_B_Cdc20
  gRNA
cccaggcaaaucuaguucca

SEQ ID NO: 76711 - RNA, 20 nt, Artificial Sequence
  MKO10076711_B_Cdc23
  gRNA
gccgccgccgccucugacag

SEQ ID NO: 76712 - RNA, 20 nt, Artificial Sequence
  MKO10076712_B_Cdc23
  gRNA
auccaucaaguccccgagcc

SEQ ID NO: 76713 - RNA, 20 nt, Artificial Sequence
  MKO10076713_B_Cdc23
  gRNA
gacgaaacaguugauagccu

SEQ ID NO: 76714 - RNA, 20 nt, Artificial Sequence
  MKO10076714_B_Cdc25a
  gRNA
cgaugaggugaaaggugucg

SEQ ID NO: 76715 - RNA, 20 nt, Artificial Sequence
  MKO10076715_B_Cdc25a
  gRNA
caccuuucaccucaucgacc

SEQ ID NO: 76716 - RNA, 20 nt, Artificial Sequence
  MKO10076716_B_Cdc25a
  gRNA
gguuucugucuagauucucc

SEQ ID NO: 76717 - RNA, 20 nt, Artificial Sequence
  MKO10076717_B_Cdc25b
  gRNA
accugcauccgaagauucug

SEQ ID NO: 76718 - RNA, 20 nt, Artificial Sequence
  MKO10076718_B_Cdc25b
  gRNA
uagguuugaacaggccauuc

SEQ ID NO: 76719 - RNA, 20 nt, Artificial Sequence
  MKO10076719_B_Cdc25b
  gRNA
auaggucugccagccuguuc

SEQ ID NO: 76720 - RNA, 20 nt, Artificial Sequence
  MKO10076720_B_Cdc25c
  gRNA
cuccacugcuaagauucgaa

SEQ ID NO: 76721 - RNA, 20 nt, Artificial Sequence
  MKO10076721_B_Cdc25c
  gRNA
agcagaaguaguaagcggag

SEQ ID NO: 76722 - RNA, 20 nt, Artificial Sequence
  MKO10076722_B_Cdc25c
  gRNA
acuccgaaugcuaugaauca

SEQ ID NO: 76723 - RNA, 20 nt, Artificial Sequence
  MKO10076723_B_Cdc26
  gRNA
aguuuccaaacugagaugug

SEQ ID NO: 76724 - RNA, 20 nt, Artificial Sequence
  MKO10076724_B_Cdc26
  gRNA
ugagagcauucgcaaggacc

SEQ ID NO: 76725 - RNA, 20 nt, Artificial Sequence
  MKO10076725_B_Cdc26
  gRNA
gcucaagcucgacgacauug

SEQ ID NO: 76726 - RNA, 20 nt, Artificial Sequence
  MKO10076726_B_Cdc27
  gRNA
uauuucacauaacgauucaa

SEQ ID NO: 76727 - RNA, 20 nt, Artificial Sequence
  MKO10076727_B_Cdc27
  gRNA
uuugaaucguuaugugaaau

SEQ ID NO: 76728 - RNA, 20 nt, Artificial Sequence
  MKO10076728_B_Cdc27
  gRNA
cuguuacuaccgcucaggaa

SEQ ID NO: 76729 - RNA, 20 nt, Artificial Sequence
  MKO10076729_B_Cdc34
  gRNA
caccuucucgccugccaacg

SEQ ID NO: 76730 - RNA, 20 nt, Artificial Sequence
  MKO10076730_B_Cdc34
  gRNA
ccaguugacgacccacagag

SEQ ID NO: 76731 - RNA, 20 nt, Artificial Sequence
  MKO10076731_B_Cdc34
  gRNA
cguauuccccaccagccuuc

SEQ ID NO: 76732 - RNA, 20 nt, Artificial Sequence
  MKO10076732_B_Cdc37l1
  gRNA
acacgccaaagcacagaccg

SEQ ID NO: 76733 - RNA, 20 nt, Artificial Sequence
  MKO10076733_B_Cdc37l1
  gRNA
aacugcaauguggauccaag

SEQ ID NO: 76734 - RNA, 20 nt, Artificial Sequence
  MKO10076734_B_Cdc37l1
  gRNA
uaaacugcauuaccacagcu

SEQ ID NO: 76735 - RNA, 20 nt, Artificial Sequence
  MKO10076735_B_Cdc37
  gRNA
cuaccuugcgcuugcacucc

SEQ ID NO: 76736 - RNA, 20 nt, Artificial Sequence
  MKO10076736_B_Cdc37
  gRNA
ucgacccccgagccugcuuc

SEQ ID NO: 76737 - RNA, 20 nt, Artificial Sequence
  MKO10076737_B_Cdc37
  gRNA
ggggucgaccuucagacucu

SEQ ID NO: 76738 - RNA, 20 nt, Artificial Sequence
  MKO10076738_B_Cdc40
  gRNA
ucuuaccucaggagcgaaca

SEQ ID NO: 76739 - RNA, 20 nt, Artificial Sequence
  MKO10076739_B_Cdc40
  gRNA
agccauuugcuguguucgaa

SEQ ID NO: 76740 - RNA, 20 nt, Artificial Sequence
  MKO10076740_B_Cdc40
  gRNA
gccccuagaaauaugcuuuc

SEQ ID NO: 76741 - RNA, 20 nt, Artificial Sequence
  MKO10076741_B_Cdc42bpa
  gRNA
uuacuaaguuauugucaucc

SEQ ID NO: 76742 - RNA, 20 nt, Artificial Sequence
  MKO10076742_B_Cdc42bpa
  gRNA
ccaugaaaauucugaacaag

SEQ ID NO: 76743 - RNA, 20 nt, Artificial Sequence
  MKO10076743_B_Cdc42bpa
  gRNA
ugcuucacuuuagaaguaaa

SEQ ID NO: 76744 - RNA, 20 nt, Artificial Sequence
  MKO10076744_B_Cdc42bpb
  gRNA
gcugcauguccuucacgagc

SEQ ID NO: 76745 - RNA, 20 nt, Artificial Sequence
  MKO10076745_B_Cdc42bpb
  gRNA
gccuuucacccagcucguga

SEQ ID NO: 76746 - RNA, 20 nt, Artificial Sequence
  MKO10076746_B_Cdc42bpb
  gRNA
ugauuugcaguacuugguca

SEQ ID NO: 76747 - RNA, 20 nt, Artificial Sequence
  MKO10076747_B_Cdc42bpg
  gRNA
cacgcugcugagccgcuuug

SEQ ID NO: 76748 - RNA, 20 nt, Artificial Sequence
  MKO10076748_B_Cdc42bpg
  gRNA
ccaugaagaugcugcauaag

SEQ ID NO: 76749 - RNA, 20 nt, Artificial Sequence
  MKO10076749_B_Cdc42bpg
  gRNA
gugggaggcgguccucaaag

SEQ ID NO: 76750 - RNA, 20 nt, Artificial Sequence
  MKO10076750_B_Cdc42ep1
  gRNA
gauggggagcuugccaccgc

SEQ ID NO: 76751 - RNA, 20 nt, Artificial Sequence
  MKO10076751_B_Cdc42ep1
  gRNA
ccgcucaccccgaaguuucc

SEQ ID NO: 76752 - RNA, 20 nt, Artificial Sequence
  MKO10076752_B_Cdc42ep1
  gRNA
caccuaugacagucugguga

SEQ ID NO: 76753 - RNA, 20 nt, Artificial Sequence
  MKO10076753_B_Cdc42ep2
  gRNA
uugaaacguggcagccgcaa

SEQ ID NO: 76754 - RNA, 20 nt, Artificial Sequence
  MKO10076754_B_Cdc42ep2
  gRNA
cugccacguuucaaauagau

SEQ ID NO: 76755 - RNA, 20 nt, Artificial Sequence
  MKO10076755_B_Cdc42ep2
  gRNA
cuaggucgugauccauaauc

SEQ ID NO: 76756 - RNA, 20 nt, Artificial Sequence
  MKO10076756_B_Cdc42ep3
  gRNA
augcucaaacaugucguccg

SEQ ID NO: 76757 - RNA, 20 nt, Artificial Sequence
  MKO10076757_B_Cdc42ep3
  gRNA
agucggaggacuguuccgac

SEQ ID NO: 76758 - RNA, 20 nt, Artificial Sequence
  MKO10076758_B_Cdc42ep3
  gRNA
uugggcguccuaaguugcca

SEQ ID NO: 76759 - RNA, 20 nt, Artificial Sequence
  MKO10076759_B_Cdc42ep4
  gRNA
aagccgaggccuguucaucc

SEQ ID NO: 76760 - RNA, 20 nt, Artificial Sequence
  MKO10076760_B_Cdc42ep4
  gRNA
ccguuccgauggggacucuu

SEQ ID NO: 76761 - RNA, 20 nt, Artificial Sequence
  MKO10076761_B_Cdc42ep4
  gRNA
cgagaugaucagugccccgc

SEQ ID NO: 76762 - RNA, 20 nt, Artificial Sequence
  MKO10076762_B_Cdc42ep5
  gRNA
gggccccucuaugcuggacg

SEQ ID NO: 76763 - RNA, 20 nt, Artificial Sequence
  MKO10076763_B_Cdc42ep5
  gRNA
accucauuccugagucgcca

SEQ ID NO: 76764 - RNA, 20 nt, Artificial Sequence
  MKO10076764_B_Cdc42ep5
  gRNA
cgggaggcggaccgcccccg

SEQ ID NO: 76765 - RNA, 20 nt, Artificial Sequence
  MKO10076765_B_Cdc42se1
  gRNA
ucugucacggugguuucccu

SEQ ID NO: 76766 - RNA, 20 nt, Artificial Sequence
  MKO10076766_B_Cdc42se1
  gRNA
ccccagagccgaugugaguc

SEQ ID NO: 76767 - RNA, 20 nt, Artificial Sequence
  MKO10076767_B_Cdc42se1
  gRNA
cagggaacaugagcgaguuu

SEQ ID NO: 76768 - RNA, 20 nt, Artificial Sequence
  MKO10076768_B_Cdc42se2
  gRNA
cugaguucaucccacuaaau

SEQ ID NO: 76769 - RNA, 20 nt, Artificial Sequence
  MKO10076769_B_Cdc42se2
  gRNA
cugagagcaugagugaauuc

SEQ ID NO: 76770 - RNA, 20 nt, Artificial Sequence
  MKO10076770_B_Cdc42se2
  gRNA
uuugugcacacagcucacgu

SEQ ID NO: 76771 - RNA, 20 nt, Artificial Sequence
  MKO10076771_B_Cdc42
  gRNA
acuagaaaaacaucugucug

SEQ ID NO: 76772 - RNA, 20 nt, Artificial Sequence
  MKO10076772_B_Cdc42
  gRNA
auuugaaaaugugaaagaaa

SEQ ID NO: 76773 - RNA, 20 nt, Artificial Sequence
  MKO10076773_B_Cdc42
  gRNA
uaugcagucacaguuaugau

SEQ ID NO: 76774 - RNA, 20 nt, Artificial Sequence
  MKO10076774_B_Cdc45
  gRNA
aaccgugugcgcuucucuga

SEQ ID NO: 76775 - RNA, 20 nt, Artificial Sequence
  MKO10076775_B_Cdc45
  gRNA
agccuucagagaagcgcaca

SEQ ID NO: 76776 - RNA, 20 nt, Artificial Sequence
  MKO10076776_B_Cdc45
  gRNA
ggacguggucacacugaaac

SEQ ID NO: 76777 - RNA, 20 nt, Artificial Sequence
  MKO10076777_B_Cdc5l
  gRNA
ucacccucauccaugucuau

SEQ ID NO: 76778 - RNA, 20 nt, Artificial Sequence
  MKO10076778_B_Cdc5l
  gRNA
ugaacuugagaugcucuccg

SEQ ID NO: 76779 - RNA, 20 nt, Artificial Sequence
  MKO10076779_B_Cdc5l
  gRNA
ggaugaaauucugaaagcag

SEQ ID NO: 76780 - RNA, 20 nt, Artificial Sequence
  MKO10076780_B_Cdc6
  gRNA
uccugagcagaaauguccgc

SEQ ID NO: 76781 - RNA, 20 nt, Artificial Sequence
  MKO10076781_B_Cdc6
  gRNA
gauccgggacagcuguauuc

SEQ ID NO: 76782 - RNA, 20 nt, Artificial Sequence
  MKO10076782_B_Cdc6
  gRNA
cucaucaaguccuucccagc

SEQ ID NO: 76783 - RNA, 20 nt, Artificial Sequence
  MKO10076783_B_Cdc73
  gRNA
gcgaaaggugcacauuauua

SEQ ID NO: 76784 - RNA, 20 nt, Artificial Sequence
  MKO10076784_B_Cdc73
  gRNA
ccgcugaagaccuauuucca

SEQ ID NO: 76785 - RNA, 20 nt, Artificial Sequence
  MKO10076785_B_Cdc73
  gRNA
caacaucagcaagcauagac

SEQ ID NO: 76786 - RNA, 20 nt, Artificial Sequence
  MKO10076786_B_Cdc7
  gRNA
aaggacucauguuccagaua

SEQ ID NO: 76787 - RNA, 20 nt, Artificial Sequence
  MKO10076787_B_Cdc7
  gRNA
caccuucagcucuguuuauu

SEQ ID NO: 76788 - RNA, 20 nt, Artificial Sequence
  MKO10076788_B_Cdc7
  gRNA
uugaacacauugacuaguug

SEQ ID NO: 76789 - RNA, 20 nt, Artificial Sequence
  MKO10076789_B_Cdca2
  gRNA
aggaagcauaccucgaagug

SEQ ID NO: 76790 - RNA, 20 nt, Artificial Sequence
  MKO10076790_B_Cdca2
  gRNA
ggccaucuuaguuuccugua

SEQ ID NO: 76791 - RNA, 20 nt, Artificial Sequence
  MKO10076791_B_Cdca2
  gRNA
ugauaccuuuaagucaccuu

SEQ ID NO: 76792 - RNA, 20 nt, Artificial Sequence
  MKO10076792_B_Cdca3
  gRNA
agauccucaguuauccccug

SEQ ID NO: 76793 - RNA, 20 nt, Artificial Sequence
  MKO10076793_B_Cdca3
  gRNA
guccgugcaaugccaagagu

SEQ ID NO: 76794 - RNA, 20 nt, Artificial Sequence
  MKO10076794_B_Cdca3
  gRNA
cuuuaccugucguaguguca

SEQ ID NO: 76795 - RNA, 20 nt, Artificial Sequence
  MKO10076795_B_Cdca4
  gRNA
agauccugugucguacagug

SEQ ID NO: 76796 - RNA, 20 nt, Artificial Sequence
  MKO10076796_B_Cdca4
  gRNA
uccucaucgccaacacaguc

SEQ ID NO: 76797 - RNA, 20 nt, Artificial Sequence
  MKO10076797_B_Cdca4
  gRNA
cccaucguuggcucagcacc

SEQ ID NO: 76798 - RNA, 20 nt, Artificial Sequence
  MKO10076798_B_Cdca5
  gRNA
accaaguccuucguacuauc

SEQ ID NO: 76799 - RNA, 20 nt, Artificial Sequence
  MKO10076799_B_Cdca5
  gRNA
guuccggcuagaacgcuccc

SEQ ID NO: 76800 - RNA, 20 nt, Artificial Sequence
  MKO10076800_B_Cdca5
  gRNA
agccuucgaagucguccaag

SEQ ID NO: 76801 - RNA, 20 nt, Artificial Sequence
  MKO10076801_B_Cdca7l
  gRNA
ucaguuccccaccaaaaaau

SEQ ID NO: 76802 - RNA, 20 nt, Artificial Sequence
  MKO10076802_B_Cdca7l
  gRNA
guuucacuuacagaagccga

SEQ ID NO: 76803 - RNA, 20 nt, Artificial Sequence
  MKO10076803_B_Cdca7l
  gRNA
guccgaacagggaagaaauc

SEQ ID NO: 76804 - RNA, 20 nt, Artificial Sequence
  MKO10076804_B_Cdca7
  gRNA
cacuuacaucuuuggcucug

SEQ ID NO: 76805 - RNA, 20 nt, Artificial Sequence
  MKO10076805_B_Cdca7
  gRNA
ucucaaaguaaagaacuuaa

SEQ ID NO: 76806 - RNA, 20 nt, Artificial Sequence
  MKO10076806_B_Cdca7
  gRNA
cggagugccggcacugacuu

SEQ ID NO: 76807 - RNA, 20 nt, Artificial Sequence
  MKO10076807_B_Cdca8
  gRNA
uugcagaucgaagauucuua

SEQ ID NO: 76808 - RNA, 20 nt, Artificial Sequence
  MKO10076808_B_Cdca8
  gRNA
agcccuaggaggaaacaagc

SEQ ID NO: 76809 - RNA, 20 nt, Artificial Sequence
  MKO10076809_B_Cdca8
  gRNA
cgacagacagacccuccuca

SEQ ID NO: 76810 - RNA, 20 nt, Artificial Sequence
  MKO10076810_B_Cdcp1
  gRNA
gcuucgugugucuagagucu

SEQ ID NO: 76811 - RNA, 20 nt, Artificial Sequence
  MKO10076811_B_Cdcp1
  gRNA
caucaucgagucaguauuug

SEQ ID NO: 76812 - RNA, 20 nt, Artificial Sequence
  MKO10076812_B_Cdcp1
  gRNA
cgcguugaauacuauauccc

SEQ ID NO: 76813 - RNA, 20 nt, Artificial Sequence
  MKO10076813_B_Cdcp2
  gRNA
cugaggcgcggaucagccag

SEQ ID NO: 76814 - RNA, 20 nt, Artificial Sequence
  MKO10076814_B_Cdcp2
  gRNA
uacuguuggacuccgauccu

SEQ ID NO: 76815 - RNA, 20 nt, Artificial Sequence
  MKO10076815_B_Cdcp2
  gRNA
cacuggcugauccgcgccuc

SEQ ID NO: 76816 - RNA, 20 nt, Artificial Sequence
  MKO10076816_B_Cdh10
  gRNA
ggccagaugggggguuuguc

SEQ ID NO: 76817 - RNA, 20 nt, Artificial Sequence
  MKO10076817_B_Cdh10
  gRNA
uugugcacguagaguauaaa

SEQ ID NO: 76818 - RNA, 20 nt, Artificial Sequence
  MKO10076818_B_Cdh10
  gRNA
ggauacuucagguacuucug

SEQ ID NO: 76819 - RNA, 20 nt, Artificial Sequence
  MKO10076819_B_Cdh11
  gRNA
accuucagaauucauuguua

SEQ ID NO: 76820 - RNA, 20 nt, Artificial Sequence
  MKO10076820_B_Cdh11
  gRNA
acaacccuauuucucggugg

SEQ ID NO: 76821 - RNA, 20 nt, Artificial Sequence
  MKO10076821_B_Cdh11
  gRNA
cagggacaccaacagaccac

SEQ ID NO: 76822 - RNA, 20 nt, Artificial Sequence
  MKO10076822_B_Cdh12
  gRNA
ccucauucaagcgaaagaca

SEQ ID NO: 76823 - RNA, 20 nt, Artificial Sequence
  MKO10076823_B_Cdh12
  gRNA
agagcaguagauccugauuu

SEQ ID NO: 76824 - RNA, 20 nt, Artificial Sequence
  MKO10076824_B_Cdh12
  gRNA
gguaggaucgucugcaucug

SEQ ID NO: 76825 - RNA, 20 nt, Artificial Sequence
  MKO10076825_B_Cdh13
  gRNA
ugguccucgaugaauucggc

SEQ ID NO: 76826 - RNA, 20 nt, Artificial Sequence
  MKO10076826_B_Cdh13
  gRNA
cacuucaaggugaacagcga

SEQ ID NO: 76827 - RNA, 20 nt, Artificial Sequence
  MKO10076827_B_Cdh13
  gRNA
gaucaucugcagacgugacc

SEQ ID NO: 76828 - RNA, 20 nt, Artificial Sequence
  MKO10076828_B_Cdh15
  gRNA
gauccaccacaacgaucucc

SEQ ID NO: 76829 - RNA, 20 nt, Artificial Sequence
  MKO10076829_B_Cdh15
  gRNA
cacggaccuggagaucguug

SEQ ID NO: 76830 - RNA, 20 nt, Artificial Sequence
  MKO10076830_B_Cdh15
  gRNA
ucgucgaugcugaagaacuc

SEQ ID NO: 76831 - RNA, 20 nt, Artificial Sequence
  MKO10076831_B_Cdh16
  gRNA
uuuaccagacauguuccagc

SEQ ID NO: 76832 - RNA, 20 nt, Artificial Sequence
  MKO10076832_B_Cdh16
  gRNA
cuuaccuugaguauguaaaa

SEQ ID NO: 76833 - RNA, 20 nt, Artificial Sequence
  MKO10076833_B_Cdh16
  gRNA
acuuaccaggccuggugccc

SEQ ID NO: 76834 - RNA, 20 nt, Artificial Sequence
  MKO10076834_B_Cdh17
  gRNA
aagagcgguucaucaucugc

SEQ ID NO: 76835 - RNA, 20 nt, Artificial Sequence
  MKO10076835_B_Cdh17
  gRNA
guaugucaaugcuacagauc

SEQ ID NO: 76836 - RNA, 20 nt, Artificial Sequence
  MKO10076836_B_Cdh17
  gRNA
uauuaacagaccuguggaua

SEQ ID NO: 76837 - RNA, 20 nt, Artificial Sequence
  MKO10076837_B_Cdh18
  gRNA
ucugucaaguacauccugac

SEQ ID NO: 76838 - RNA, 20 nt, Artificial Sequence
  MKO10076838_B_Cdh18
  gRNA
aacucgagcacuguucccau

SEQ ID NO: 76839 - RNA, 20 nt, Artificial Sequence
  MKO10076839_B_Cdh18
  gRNA
gaaccaacuugagcagacuc

SEQ ID NO: 76840 - RNA, 20 nt, Artificial Sequence
  MKO10076840_B_Cdh19
  gRNA
auuccuagaugaaccauaug

SEQ ID NO: 76841 - RNA, 20 nt, Artificial Sequence
  MKO10076841_B_Cdh19
  gRNA
cagauucagauauagugaag

SEQ ID NO: 76842 - RNA, 20 nt, Artificial Sequence
  MKO10076842_B_Cdh19
  gRNA
uuucccuauugauguuccaa

SEQ ID NO: 76843 - RNA, 20 nt, Artificial Sequence
  MKO10076843_B_Cdh1
  gRNA
uuccgaggucuacaccuucc

SEQ ID NO: 76844 - RNA, 20 nt, Artificial Sequence
  MKO10076844_B_Cdh1
  gRNA
auguuucccagcguguaccc

SEQ ID NO: 76845 - RNA, 20 nt, Artificial Sequence
  MKO10076845_B_Cdh1
  gRNA
caccgggaagguguagaccu

SEQ ID NO: 76846 - RNA, 20 nt, Artificial Sequence
  MKO10076846_B_Cdh20
  gRNA
agagaugaaguauaccauug

SEQ ID NO: 76847 - RNA, 20 nt, Artificial Sequence
  MKO10076847_B_Cdh20
  gRNA
uucucggucgagccucugaa

SEQ ID NO: 76848 - RNA, 20 nt, Artificial Sequence
  MKO10076848_B_Cdh20
  gRNA
ggagaaugcuguacacuacc

SEQ ID NO: 76849 - RNA, 20 nt, Artificial Sequence
  MKO10076849_B_Cdh22
  gRNA
uaaccaccucguagcguucc

SEQ ID NO: 76850 - RNA, 20 nt, Artificial Sequence
  MKO10076850_B_Cdh22
  gRNA
caccugucaacucgucaauc

SEQ ID NO: 76851 - RNA, 20 nt, Artificial Sequence
  MKO10076851_B_Cdh22
  gRNA
agcccccaucgguacggcug

SEQ ID NO: 76852 - RNA, 20 nt, Artificial Sequence
  MKO10076852_B_Cdh23
  gRNA
caucagugaagacacgccag

SEQ ID NO: 76853 - RNA, 20 nt, Artificial Sequence
  MKO10076853_B_Cdh23
  gRNA
gcgugucuucacugaugagc

SEQ ID NO: 76854 - RNA, 20 nt, Artificial Sequence
  MKO10076854_B_Cdh23
  gRNA
cuacagcgugcgcaucccug

SEQ ID NO: 76855 - RNA, 20 nt, Artificial Sequence
  MKO10076855_B_Cdh24
  gRNA
cgggcuccuuacuguccgca

SEQ ID NO: 76856 - RNA, 20 nt, Artificial Sequence
  MKO10076856_B_Cdh24
  gRNA
gguugucguugacaucgcug

SEQ ID NO: 76857 - RNA, 20 nt, Artificial Sequence
  MKO10076857_B_Cdh24
  gRNA
ugccugacagcccccccaug

SEQ ID NO: 76858 - RNA, 20 nt, Artificial Sequence
  MKO10076858_B_Cdh26
  gRNA
uuucggauugaucucaucag

SEQ ID NO: 76859 - RNA, 20 nt, Artificial Sequence
  MKO10076859_B_Cdh26
  gRNA
gugaaagagagccaagccgc

SEQ ID NO: 76860 - RNA, 20 nt, Artificial Sequence
  MKO10076860_B_Cdh26
  gRNA
guggacgaauuuccagagau

SEQ ID NO: 76861 - RNA, 20 nt, Artificial Sequence
  MKO10076861_B_Cdh2
  gRNA
gcuaucagcucucgauccag

SEQ ID NO: 76862 - RNA, 20 nt, Artificial Sequence
  MKO10076862_B_Cdh2
  gRNA
uaagguacuaccauugagaa

SEQ ID NO: 76863 - RNA, 20 nt, Artificial Sequence
  MKO10076863_B_Cdh2
  gRNA
cagcgagccagcagauuuca

SEQ ID NO: 76864 - RNA, 20 nt, Artificial Sequence
  MKO10076864_B_Cdh3
  gRNA
ggcgcagacaguccccccga

SEQ ID NO: 76865 - RNA, 20 nt, Artificial Sequence
  MKO10076865_B_Cdh3
  gRNA
ccaauauucguccccgagaa

SEQ ID NO: 76866 - RNA, 20 nt, Artificial Sequence
  MKO10076866_B_Cdh3
  gRNA
agacaucauuaugcugacua

SEQ ID NO: 76867 - RNA, 20 nt, Artificial Sequence
  MKO10076867_B_Cdh4
  gRNA
uucccgcgcagugacgguaa

SEQ ID NO: 76868 - RNA, 20 nt, Artificial Sequence
  MKO10076868_B_Cdh4
  gRNA
gggcgccgaccagcccccca

SEQ ID NO: 76869 - RNA, 20 nt, Artificial Sequence
  MKO10076869_B_Cdh4
  gRNA
ugggccgagugacauacauc

SEQ ID NO: 76870 - RNA, 20 nt, Artificial Sequence
  MKO10076870_B_Cdh5
  gRNA
acaggcugaauacaagaucg

SEQ ID NO: 76871 - RNA, 20 nt, Artificial Sequence
  MKO10076871_B_Cdh5
  gRNA
aguggcguggccggccacag

SEQ ID NO: 76872 - RNA, 20 nt, Artificial Sequence
  MKO10076872_B_Cdh5
  gRNA
aauaccuggugcgaaaacac

SEQ ID NO: 76873 - RNA, 20 nt, Artificial Sequence
  MKO10076873_B_Cdh6
  gRNA
uguggcuguguaaacguccu

SEQ ID NO: 76874 - RNA, 20 nt, Artificial Sequence
  MKO10076874_B_Cdh6
  gRNA
uguugacagcuugagcucga

SEQ ID NO: 76875 - RNA, 20 nt, Artificial Sequence
  MKO10076875_B_Cdh6
  gRNA
uccccgacaguccucccauc

SEQ ID NO: 76876 - RNA, 20 nt, Artificial Sequence
  MKO10076876_B_Cdh7
  gRNA
aaggauaugguuggucaaaa

SEQ ID NO: 76877 - RNA, 20 nt, Artificial Sequence
  MKO10076877_B_Cdh7
  gRNA
uuaccuacaggagacaucuc

SEQ ID NO: 76878 - RNA, 20 nt, Artificial Sequence
  MKO10076878_B_Cdh7
  gRNA
augucaccuagggacuucag

SEQ ID NO: 76879 - RNA, 20 nt, Artificial Sequence
  MKO10076879_B_Cdh8
  gRNA
gaugcugacgacccaguuua

SEQ ID NO: 76880 - RNA, 20 nt, Artificial Sequence
  MKO10076880_B_Cdh8
  gRNA
uacgaccagguauuccuccu

SEQ ID NO: 76881 - RNA, 20 nt, Artificial Sequence
  MKO10076881_B_Cdh8
  gRNA
aaaggcugaauauacguuaa

SEQ ID NO: 76882 - RNA, 20 nt, Artificial Sequence
  MKO10076882_B_Cdh9
  gRNA
uccggguccacugaaaagua

SEQ ID NO: 76883 - RNA, 20 nt, Artificial Sequence
  MKO10076883_B_Cdh9
  gRNA
gcaguaccaaguuguuauuc

SEQ ID NO: 76884 - RNA, 20 nt, Artificial Sequence
  MKO10076884_B_Cdh9
  gRNA
augucaacaacaacccuccu

SEQ ID NO: 76885 - RNA, 20 nt, Artificial Sequence
  MKO10076885_B_Cdhr1
  gRNA
gggcagcaccaacgggaaca

SEQ ID NO: 76886 - RNA, 20 nt, Artificial Sequence
  MKO10076886_B_Cdhr1
  gRNA
gccaucaucagcauuuccga

SEQ ID NO: 76887 - RNA, 20 nt, Artificial Sequence
  MKO10076887_B_Cdhr1
  gRNA
acucaccagguucaggccau

SEQ ID NO: 76888 - RNA, 20 nt, Artificial Sequence
  MKO10076888_B_Cdhr2
  gRNA
gccaacucgccaccaucauu

SEQ ID NO: 76889 - RNA, 20 nt, Artificial Sequence
  MKO10076889_B_Cdhr2
  gRNA
gauguugagaccaucacuug

SEQ ID NO: 76890 - RNA, 20 nt, Artificial Sequence
  MKO10076890_B_Cdhr2
  gRNA
uuccacaaucacuugcaucu

SEQ ID NO: 76891 - RNA, 20 nt, Artificial Sequence
  MKO10076891_B_Cdhr3
  gRNA
aucugcaaaucgaaugcuuu

SEQ ID NO: 76892 - RNA, 20 nt, Artificial Sequence
  MKO10076892_B_Cdhr3
  gRNA
ccugccugccacuagcaacg

SEQ ID NO: 76893 - RNA, 20 nt, Artificial Sequence
  MKO10076893_B_Cdhr3
  gRNA
cugggucaaaugccuccacc

SEQ ID NO: 76894 - RNA, 20 nt, Artificial Sequence
  MKO10076894_B_Cdhr5
  gRNA
agcugccgccaugggggcuc

SEQ ID NO: 76895 - RNA, 20 nt, Artificial Sequence
  MKO10076895_B_Cdhr5
  gRNA
agugcuguuuggccaaccuc

SEQ ID NO: 76896 - RNA, 20 nt, Artificial Sequence
  MKO10076896_B_Cdhr5
  gRNA
ucuuacacuccacaucugcc

SEQ ID NO: 76897 - RNA, 20 nt, Artificial Sequence
  MKO10076897_B_Cdip1
  gRNA
acauccuuaccugggguaag

SEQ ID NO: 76898 - RNA, 20 nt, Artificial Sequence
  MKO10076898_B_Cdip1
  gRNA
cccccccauaugaaugcaga

SEQ ID NO: 76899 - RNA, 20 nt, Artificial Sequence
  MKO10076899_B_Cdip1
  gRNA
gcugugaugcagccuccacc

SEQ ID NO: 76900 - RNA, 20 nt, Artificial Sequence
  MKO10076900_B_Cdipt
  gRNA
guccgucagcaugucgagca

SEQ ID NO: 76901 - RNA, 20 nt, Artificial Sequence
  MKO10076901_B_Cdipt
  gRNA
ggccaugcucgacaugcuga

SEQ ID NO: 76902 - RNA, 20 nt, Artificial Sequence
  MKO10076902_B_Cdipt
  gRNA
uccgcugaguagauagaagg

SEQ ID NO: 76903 - RNA, 20 nt, Artificial Sequence
  MKO10076903_B_Cdk10
  gRNA
aaauaugccaacacccuucu

SEQ ID NO: 76904 - RNA, 20 nt, Artificial Sequence
  MKO10076904_B_Cdk10
  gRNA
ucucaaacuccuuaacgcuu

SEQ ID NO: 76905 - RNA, 20 nt, Artificial Sequence
  MKO10076905_B_Cdk10
  gRNA
ugaaauugucgcccugaaga

SEQ ID NO: 76906 - RNA, 20 nt, Artificial Sequence
  MKO10076906_B_Cdk11b
  gRNA
uacgcgcuucucucucuuug

SEQ ID NO: 76907 - RNA, 20 nt, Artificial Sequence
  MKO10076907_B_Cdk11b
  gRNA
aaccaccccagcaaaugucu

SEQ ID NO: 76908 - RNA, 20 nt, Artificial Sequence
  MKO10076908_B_Cdk11b
  gRNA
accgccuggagcaguuagaa

SEQ ID NO: 76909 - RNA, 20 nt, Artificial Sequence
  MKO10076909_B_Cdk12
  gRNA
cauaguaaaaagaagcgauc

SEQ ID NO: 76910 - RNA, 20 nt, Artificial Sequence
  MKO10076910_B_Cdk12
  gRNA
agaauuuguuguccacguua

SEQ ID NO: 76911 - RNA, 20 nt, Artificial Sequence
  MKO10076911_B_Cdk12
  gRNA
ugaggugguguaauugccuu

SEQ ID NO: 76912 - RNA, 20 nt, Artificial Sequence
  MKO10076912_B_Cdk13
  gRNA
gccaccgcuucaaguaacaa

SEQ ID NO: 76913 - RNA, 20 nt, Artificial Sequence
  MKO10076913_B_Cdk13
  gRNA
cacaguuacauagcaaacga

SEQ ID NO: 76914 - RNA, 20 nt, Artificial Sequence
  MKO10076914_B_Cdk13
  gRNA
gaguaaaccugcugcuacaa

SEQ ID NO: 76915 - RNA, 20 nt, Artificial Sequence
  MKO10076915_B_Cdk14
  gRNA
agcugacucauacgaaaaac

SEQ ID NO: 76916 - RNA, 20 nt, Artificial Sequence
  MKO10076916_B_Cdk14
  gRNA
uagccaacgagucccaaauu

SEQ ID NO: 76917 - RNA, 20 nt, Artificial Sequence
  MKO10076917_B_Cdk14
  gRNA
uuagccuaccucaucaaagg

SEQ ID NO: 76918 - RNA, 20 nt, Artificial Sequence
  MKO10076918_B_Cdk15
  gRNA
gagucccuuucacagccauc

SEQ ID NO: 76919 - RNA, 20 nt, Artificial Sequence
  MKO10076919_B_Cdk15
  gRNA
uggcaugcuucaagcccuuc

SEQ ID NO: 76920 - RNA, 20 nt, Artificial Sequence
  MKO10076920_B_Cdk15
  gRNA
uucauuucaccccaggggac

SEQ ID NO: 76921 - RNA, 20 nt, Artificial Sequence
  MKO10076921_B_Cdk16
  gRNA
ggcacccuguacugcuaucc

SEQ ID NO: 76922 - RNA, 20 nt, Artificial Sequence
  MKO10076922_B_Cdk16
  gRNA
accucaguggagaucuugcg

SEQ ID NO: 76923 - RNA, 20 nt, Artificial Sequence
  MKO10076923_B_Cdk16
  gRNA
ugucacuaccagcugacaua

SEQ ID NO: 76924 - RNA, 20 nt, Artificial Sequence
  MKO10076924_B_Cdk17
  gRNA
gucuauguauacgauuucug

SEQ ID NO: 76925 - RNA, 20 nt, Artificial Sequence
  MKO10076925_B_Cdk17
  gRNA
uugaccagcccaugagccgc

SEQ ID NO: 76926 - RNA, 20 nt, Artificial Sequence
  MKO10076926_B_Cdk17
  gRNA
gaugaaguccagucaccuac

SEQ ID NO: 76927 - RNA, 20 nt, Artificial Sequence
  MKO10076927_B_Cdk18
  gRNA
acccucucgaauagcagugc

SEQ ID NO: 76928 - RNA, 20 nt, Artificial Sequence
  MKO10076928_B_Cdk18
  gRNA
cguuguugauacugcaugcc

SEQ ID NO: 76929 - RNA, 20 nt, Artificial Sequence
  MKO10076929_B_Cdk18
  gRNA
cauggacauccgccuacccc

SEQ ID NO: 76930 - RNA, 20 nt, Artificial Sequence
  MKO10076930_B_Cdk19
  gRNA
cgccuuguagacaugcccgu

SEQ ID NO: 76931 - RNA, 20 nt, Artificial Sequence
  MKO10076931_B_Cdk19
  gRNA
uaugcacuuaagcaaaucga

SEQ ID NO: 76932 - RNA, 20 nt, Artificial Sequence
  MKO10076932_B_Cdk19
  gRNA
uucugcaaugcgaucacauu

SEQ ID NO: 76933 - RNA, 20 nt, Artificial Sequence
  MKO10076933_B_Cdk1
  gRNA
ucugagucgccguggaaaag

SEQ ID NO: 76934 - RNA, 20 nt, Artificial Sequence
  MKO10076934_B_Cdk1
  gRNA
agucucugugaagaacucgc

SEQ ID NO: 76935 - RNA, 20 nt, Artificial Sequence
  MKO10076935_B_Cdk1
  gRNA
cucggcucguuacuccacuc

SEQ ID NO: 76936 - RNA, 20 nt, Artificial Sequence
  MKO10076936_B_Cdk20
  gRNA
aacccgaugcacaauguugu

SEQ ID NO: 76937 - RNA, 20 nt, Artificial Sequence
  MKO10076937_B_Cdk20
  gRNA
cucaccauaggucaacgccc

SEQ ID NO: 76938 - RNA, 20 nt, Artificial Sequence
  MKO10076938_B_Cdk20
  gRNA
uggucgccucuacacacauc

SEQ ID NO: 76939 - RNA, 20 nt, Artificial Sequence
  MKO10076939_B_Cdk2ap1
  gRNA
auagggaacuggaaauagcc

SEQ ID NO: 76940 - RNA, 20 nt, Artificial Sequence
  MKO10076940_B_Cdk2ap1
  gRNA
cccgccgccgcccucaacgc

SEQ ID NO: 76941 - RNA, 20 nt, Artificial Sequence
  MKO10076941_B_Cdk2ap1
  gRNA
ccacucacccucuacuagca

SEQ ID NO: 76942 - RNA, 20 nt, Artificial Sequence
  MKO10076942_B_Cdk2ap2
  gRNA
cucugacuagugcccgagcg

SEQ ID NO: 76943 - RNA, 20 nt, Artificial Sequence
  MKO10076943_B_Cdk2ap2
  gRNA
accucucuucaggcgcucca

SEQ ID NO: 76944 - RNA, 20 nt, Artificial Sequence
  MKO10076944_B_Cdk2ap2
  gRNA
ggagccucaccuguagggac

SEQ ID NO: 76945 - RNA, 20 nt, Artificial Sequence
  MKO10076945_B_Cdk2
  gRNA
accccucugcauugauaagc

SEQ ID NO: 76946 - RNA, 20 nt, Artificial Sequence
  MKO10076946_B_Cdk2
  gRNA
uuguggcgcuuaagaagauc

SEQ ID NO: 76947 - RNA, 20 nt, Artificial Sequence
  MKO10076947_B_Cdk2
  gRNA
ccgagagaucucucuccuua

SEQ ID NO: 76948 - RNA, 20 nt, Artificial Sequence
  MKO10076948_B_Cdk4
  gRNA
ccgguggaggugcuuugucc

SEQ ID NO: 76949 - RNA, 20 nt, Artificial Sequence
  MKO10076949_B_Cdk4
  gRNA
cuaaugcgucaguuucuaag

SEQ ID NO: 76950 - RNA, 20 nt, Artificial Sequence
  MKO10076950_B_Cdk4
  gRNA
aaacucugaagccgaccagu

SEQ ID NO: 76951 - RNA, 20 nt, Artificial Sequence
  MKO10076951_B_Cdk5r1
  gRNA
gcagcucacuaguggacgcc

SEQ ID NO: 76952 - RNA, 20 nt, Artificial Sequence
  MKO10076952_B_Cdk5r1
  gRNA
cgugcucuggcugcgcagcg

SEQ ID NO: 76953 - RNA, 20 nt, Artificial Sequence
  MKO10076953_B_Cdk5r1
  gRNA
ugagaugcgcgauguugcuc

SEQ ID NO: 76954 - RNA, 20 nt, Artificial Sequence
  MKO10076954_B_Cdk5r2
  gRNA
cgucgcggcccuugcggaga

SEQ ID NO: 76955 - RNA, 20 nt, Artificial Sequence
  MKO10076955_B_Cdk5r2
  gRNA
cgcgacggccccgacggugg

SEQ ID NO: 76956 - RNA, 20 nt, Artificial Sequence
  MKO10076956_B_Cdk5r2
  gRNA
cuuggcuguuccgccaccgu

SEQ ID NO: 76957 - RNA, 20 nt, Artificial Sequence
  MKO10076957_B_Cdk5rap1
  gRNA
gcagucuaccucgagaccua

SEQ ID NO: 76958 - RNA, 20 nt, Artificial Sequence
  MKO10076958_B_Cdk5rap1
  gRNA
ggaaggucucgguaggcguc

SEQ ID NO: 76959 - RNA, 20 nt, Artificial Sequence
  MKO10076959_B_Cdk5rap1
  gRNA
uucuugucacguguucuauc

SEQ ID NO: 76960 - RNA, 20 nt, Artificial Sequence
  MKO10076960_B_Cdk5rap2
  gRNA
caccgagcacaucuacaaga

SEQ ID NO: 76961 - RNA, 20 nt, Artificial Sequence
  MKO10076961_B_Cdk5rap2
  gRNA
caucagugacacuucuggcu

SEQ ID NO: 76962 - RNA, 20 nt, Artificial Sequence
  MKO10076962_B_Cdk5rap2
  gRNA
caccagagcccggaacauga

SEQ ID NO: 76963 - RNA, 20 nt, Artificial Sequence
  MKO10076963_B_Cdk5rap3
  gRNA
ucauccguugugaagaguac

SEQ ID NO: 76964 - RNA, 20 nt, Artificial Sequence
  MKO10076964_B_Cdk5rap3
  gRNA
uucucgugcagacuggcugg

SEQ ID NO: 76965 - RNA, 20 nt, Artificial Sequence
  MKO10076965_B_Cdk5rap3
  gRNA
uaagaagguccacuauucuu

SEQ ID NO: 76966 - RNA, 20 nt, Artificial Sequence
  MKO10076966_B_Cdk5
  gRNA
aaauauuucgacagcugcaa

SEQ ID NO: 76967 - RNA, 20 nt, Artificial Sequence
  MKO10076967_B_Cdk5
  gRNA
ccgggaaacucaugagauug

SEQ ID NO: 76968 - RNA, 20 nt, Artificial Sequence
  MKO10076968_B_Cdk5
  gRNA
ccuggacccugagauuguga

SEQ ID NO: 76969 - RNA, 20 nt, Artificial Sequence
  MKO10076969_B_Cdk6
  gRNA
aguucagacguggaucaacu

SEQ ID NO: 76970 - RNA, 20 nt, Artificial Sequence
  MKO10076970_B_Cdk6
  gRNA
uggaacuuuauccaaguaag

SEQ ID NO: 76971 - RNA, 20 nt, Artificial Sequence
  MKO10076971_B_Cdk6
  gRNA
agaugcaaccgacacuccag

SEQ ID NO: 76972 - RNA, 20 nt, Artificial Sequence
  MKO10076972_B_Cdk7
  gRNA
auacucacaccaauuauauu

SEQ ID NO: 76973 - RNA, 20 nt, Artificial Sequence
  MKO10076973_B_Cdk7
  gRNA
cuaagucauccaaauauaau

SEQ ID NO: 76974 - RNA, 20 nt, Artificial Sequence
  MKO10076974_B_Cdk7
  gRNA
uugcagcuccuugaugcauu

SEQ ID NO: 76975 - RNA, 20 nt, Artificial Sequence
  MKO10076975_B_Cdk8
  gRNA
uacgcuuuaaaacaaauaga

SEQ ID NO: 76976 - RNA, 20 nt, Artificial Sequence
  MKO10076976_B_Cdk8
  gRNA
gagacagaaacaccuucaga

SEQ ID NO: 76977 - RNA, 20 nt, Artificial Sequence
  MKO10076977_B_Cdk8
  gRNA
aaacgucaucucccuucuga

SEQ ID NO: 76978 - RNA, 20 nt, Artificial Sequence
  MKO10076978_B_Cdk9
  gRNA
cuuucuucagagccaccuuc

SEQ ID NO: 76979 - RNA, 20 nt, Artificial Sequence
  MKO10076979_B_Cdk9
  gRNA
ugguccgacaaaucucaauu

SEQ ID NO: 76980 - RNA, 20 nt, Artificial Sequence
  MKO10076980_B_Cdk9
  gRNA
aguuccccaucacagccuug

SEQ ID NO: 76981 - RNA, 20 nt, Artificial Sequence
  MKO10076981_B_Cdkal1
  gRNA
gguucagcagauagaucgug

SEQ ID NO: 76982 - RNA, 20 nt, Artificial Sequence
  MKO10076982_B_Cdkal1
  gRNA
acuugauugaguuucuaaag

SEQ ID NO: 76983 - RNA, 20 nt, Artificial Sequence
  MKO10076983_B_Cdkal1
  gRNA
augcaucagaugcagaucug

SEQ ID NO: 76984 - RNA, 20 nt, Artificial Sequence
  MKO10076984_B_Cdkl1
  gRNA
ggacacuuacguuauguuua

SEQ ID NO: 76985 - RNA, 20 nt, Artificial Sequence
  MKO10076985_B_Cdkl1
  gRNA
caaguuauguucuucacgag

SEQ ID NO: 76986 - RNA, 20 nt, Artificial Sequence
  MKO10076986_B_Cdkl1
  gRNA
ccaauugcccagacaucuac

SEQ ID NO: 76987 - RNA, 20 nt, Artificial Sequence
  MKO10076987_B_Cdkl2
  gRNA
acuugauagucuaguccauu

SEQ ID NO: 76988 - RNA, 20 nt, Artificial Sequence
  MKO10076988_B_Cdkl2
  gRNA
uccccucuccaaccaauccu

SEQ ID NO: 76989 - RNA, 20 nt, Artificial Sequence
  MKO10076989_B_Cdkl2
  gRNA
uucaaugaccagacaaccaa

SEQ ID NO: 76990 - RNA, 20 nt, Artificial Sequence
  MKO10076990_B_Cdkl3
  gRNA
ccuuccuagcaguuccgauu

SEQ ID NO: 76991 - RNA, 20 nt, Artificial Sequence
  MKO10076991_B_Cdkl3
  gRNA
gcagcucaucuaagaccgug

SEQ ID NO: 76992 - RNA, 20 nt, Artificial Sequence
  MKO10076992_B_Cdkl3
  gRNA
gggcuguaugaucauugaaa

SEQ ID NO: 76993 - RNA, 20 nt, Artificial Sequence
  MKO10076993_B_Cdkl4
  gRNA
aaaccucgugaaccucaucg

SEQ ID NO: 76994 - RNA, 20 nt, Artificial Sequence
  MKO10076994_B_Cdkl4
  gRNA
aaucuuuaucaucccuugcu

SEQ ID NO: 76995 - RNA, 20 nt, Artificial Sequence
  MKO10076995_B_Cdkl4
  gRNA
auaucuuacaguguauucau

SEQ ID NO: 76996 - RNA, 20 nt, Artificial Sequence
  MKO10076996_B_Cdkl5
  gRNA
ucucaacauauucaaacacc

SEQ ID NO: 76997 - RNA, 20 nt, Artificial Sequence
  MKO10076997_B_Cdkl5
  gRNA
gcauuuaaguacaacuccau

SEQ ID NO: 76998 - RNA, 20 nt, Artificial Sequence
  MKO10076998_B_Cdkl5
  gRNA
ucaggaaacacaugaaauug

SEQ ID NO: 76999 - RNA, 20 nt, Artificial Sequence
  MKO10076999_B_Cdkn1a
  gRNA
gcagaagaccaaucugcgcu

SEQ ID NO: 77000 - RNA, 20 nt, Artificial Sequence
  MKO10077000_B_Cdkn1a
  gRNA
gucccgcagccgugacgacc

SEQ ID NO: 77001 - RNA, 20 nt, Artificial Sequence
  MKO10077001_B_Cdkn1a
  gRNA
agucaaaguuccaccguucu

SEQ ID NO: 77002 - RNA, 20 nt, Artificial Sequence
  MKO10077002_B_Cdkn1b
  gRNA
ugcuccacagugccagcguu

SEQ ID NO: 77003 - RNA, 20 nt, Artificial Sequence
  MKO10077003_B_Cdkn1b
  gRNA
ucaaacgugagagugucuaa

SEQ ID NO: 77004 - RNA, 20 nt, Artificial Sequence
  MKO10077004_B_Cdkn1b
  gRNA
gccugacucgucagacaauc

SEQ ID NO: 77005 - RNA, 20 nt, Artificial Sequence
  MKO10077005_B_Cdkn1c
  gRNA
acucaucucagacguuugcg

SEQ ID NO: 77006 - RNA, 20 nt, Artificial Sequence
  MKO10077006_B_Cdkn1c
  gRNA
cguggcgacucgggacggcg

SEQ ID NO: 77007 - RNA, 20 nt, Artificial Sequence
  MKO10077007_B_Cdkn1c
  gRNA
ccgucccgagucgccacguc

SEQ ID NO: 77008 - RNA, 20 nt, Artificial Sequence
  MKO10077008_B_Cdkn2aipnl
  gRNA
cagaagcgaacuaaugagaa

SEQ ID NO: 77009 - RNA, 20 nt, Artificial Sequence
  MKO10077009_B_Cdkn2aipnl
  gRNA
uuucuucagcaucaaagcua

SEQ ID NO: 77010 - RNA, 20 nt, Artificial Sequence
  MKO10077010_B_Cdkn2aipnl
  gRNA
cgagcaguuucguuccuacu

SEQ ID NO: 77011 - RNA, 20 nt, Artificial Sequence
  MKO10077011_B_Cdkn2aip
  gRNA
cuccgcguccgcagucucgu

SEQ ID NO: 77012 - RNA, 20 nt, Artificial Sequence
  MKO10077012_B_Cdkn2aip
  gRNA
ccaguucgucucguguggua

SEQ ID NO: 77013 - RNA, 20 nt, Artificial Sequence
  MKO10077013_B_Cdkn2aip
  gRNA
acaaacacuggcgccaccgc

SEQ ID NO: 77014 - RNA, 20 nt, Artificial Sequence
  MKO10077014_B_Cdkn2a
  gRNA
ggcuggaugugcgcgaugcc

SEQ ID NO: 77015 - RNA, 20 nt, Artificial Sequence
  MKO10077015_B_Cdkn2a
  gRNA
ucgugcgaucccggagaccc

SEQ ID NO: 77016 - RNA, 20 nt, Artificial Sequence
  MKO10077016_B_Cdkn2a
  gRNA
ccgcaccggaauccuggacc

SEQ ID NO: 77017 - RNA, 20 nt, Artificial Sequence
  MKO10077017_B_Cdkn2b
  gRNA
aacccgcagucaaucuccag

SEQ ID NO: 77018 - RNA, 20 nt, Artificial Sequence
  MKO10077018_B_Cdkn2b
  gRNA
ggcuggaugugugugacgcc

SEQ ID NO: 77019 - RNA, 20 nt, Artificial Sequence
  MKO10077019_B_Cdkn2b
  gRNA
gcagcacgacaagcgugucc

SEQ ID NO: 77020 - RNA, 20 nt, Artificial Sequence
  MKO10077020_B_Cdkn2c
  gRNA
cgaaggcggugucccccuua

SEQ ID NO: 77021 - RNA, 20 nt, Artificial Sequence
  MKO10077021_B_Cdkn2c
  gRNA
auuugggagaacugcgcugc

SEQ ID NO: 77022 - RNA, 20 nt, Artificial Sequence
  MKO10077022_B_Cdkn2c
  gRNA
aguuggcguccgcagcugcc

SEQ ID NO: 77023 - RNA, 20 nt, Artificial Sequence
  MKO10077023_B_Cdkn2d
  gRNA
agguccgccgccuucuucac

SEQ ID NO: 77024 - RNA, 20 nt, Artificial Sequence
  MKO10077024_B_Cdkn2d
  gRNA
cgaccgguugaguggcgcag

SEQ ID NO: 77025 - RNA, 20 nt, Artificial Sequence
  MKO10077025_B_Cdkn2d
  gRNA
ggcccucucuuaucgccaga

SEQ ID NO: 77026 - RNA, 20 nt, Artificial Sequence
  MKO10077026_B_Cdkn3
  gRNA
cucccgacauuggcagcugc

SEQ ID NO: 77027 - RNA, 20 nt, Artificial Sequence
  MKO10077027_B_Cdkn3
  gRNA
cucacuugcuuguauugaaa

SEQ ID NO: 77028 - RNA, 20 nt, Artificial Sequence
  MKO10077028_B_Cdkn3
  gRNA
acauaccaugaaauuugaau

SEQ ID NO: 77029 - RNA, 20 nt, Artificial Sequence
  MKO10077029_B_Cdnf
  gRNA
cgugaaccucauuagagagc

SEQ ID NO: 77030 - RNA, 20 nt, Artificial Sequence
  MKO10077030_B_Cdnf
  gRNA
ugggacgagugacuucuccu

SEQ ID NO: 77031 - RNA, 20 nt, Artificial Sequence
  MKO10077031_B_Cdnf
  gRNA
agucuaugccucugcuuagc

SEQ ID NO: 77032 - RNA, 20 nt, Artificial Sequence
  MKO10077032_B_Cdo1
  gRNA
uagaauguuaccauuaaugu

SEQ ID NO: 77033 - RNA, 20 nt, Artificial Sequence
  MKO10077033_B_Cdo1
  gRNA
aaccagugugccuacauuaa

SEQ ID NO: 77034 - RNA, 20 nt, Artificial Sequence
  MKO10077034_B_Cdo1
  gRNA
uuaaucugaugauucugugc

SEQ ID NO: 77035 - RNA, 20 nt, Artificial Sequence
  MKO10077035_B_Cdon
  gRNA
uugaugaaucgaaaucaccc

SEQ ID NO: 77036 - RNA, 20 nt, Artificial Sequence
  MKO10077036_B_Cdon
  gRNA
accugcagcggacacuguug

SEQ ID NO: 77037 - RNA, 20 nt, Artificial Sequence
  MKO10077037_B_Cdon
  gRNA
cuuauagcgcaccucagcuu

SEQ ID NO: 77038 - RNA, 20 nt, Artificial Sequence
  MKO10077038_B_Cdpf1
  gRNA
cgaauacucacacaacagcc

SEQ ID NO: 77039 - RNA, 20 nt, Artificial Sequence
  MKO10077039_B_Cdpf1
  gRNA
ucaugauguagcucuccucc

SEQ ID NO: 77040 - RNA, 20 nt, Artificial Sequence
  MKO10077040_B_Cdpf1
  gRNA
gaacaugagugcuuucccuc

SEQ ID NO: 77041 - RNA, 20 nt, Artificial Sequence
  MKO10077041_B_Cdr1
  gRNA
aguggaucuuugggaagacu

SEQ ID NO: 77042 - RNA, 20 nt, Artificial Sequence
  MKO10077042_B_Cdr1
  gRNA
ucuggaaagacacagauuac

SEQ ID NO: 77043 - RNA, 20 nt, Artificial Sequence
  MKO10077043_B_Cdr1
  gRNA
uucgggaagacauggaucuu

SEQ ID NO: 77044 - RNA, 20 nt, Artificial Sequence
  MKO10077044_B_Cdr2l
  gRNA
gccgggaaaaacgggaacgc

SEQ ID NO: 77045 - RNA, 20 nt, Artificial Sequence
  MKO10077045_B_Cdr2l
  gRNA
ugcuaaaguguacgagcagc

SEQ ID NO: 77046 - RNA, 20 nt, Artificial Sequence
  MKO10077046_B_Cdr2l
  gRNA
ggccucgaaguugcuccacc

SEQ ID NO: 77047 - RNA, 20 nt, Artificial Sequence
  MKO10077047_B_Cdr2
  gRNA
ccguagaagcuccaccugcu

SEQ ID NO: 77048 - RNA, 20 nt, Artificial Sequence
  MKO10077048_B_Cdr2
  gRNA
uuuacaguaccugaccaagc

SEQ ID NO: 77049 - RNA, 20 nt, Artificial Sequence
  MKO10077049_B_Cdr2
  gRNA
gagcugaagucuuccagcca

SEQ ID NO: 77050 - RNA, 20 nt, Artificial Sequence
  MKO10077050_B_Cdrt4
  gRNA
agaaaaagacguggaacccc

SEQ ID NO: 77051 - RNA, 20 nt, Artificial Sequence
  MKO10077051_B_Cdrt4
  gRNA
uaugguggagcauucccacg

SEQ ID NO: 77052 - RNA, 20 nt, Artificial Sequence
  MKO10077052_B_Cdrt4
  gRNA
cuauguuugcugcgcuuuac

SEQ ID NO: 77053 - RNA, 20 nt, Artificial Sequence
  MKO10077053_B_Cds1
  gRNA
uauggagaucucgaugccag

SEQ ID NO: 77054 - RNA, 20 nt, Artificial Sequence
  MKO10077054_B_Cds1
  gRNA
acccgauggugaugaucuca

SEQ ID NO: 77055 - RNA, 20 nt, Artificial Sequence
  MKO10077055_B_Cds1
  gRNA
ggucguaggagugguagacc

SEQ ID NO: 77056 - RNA, 20 nt, Artificial Sequence
  MKO10077056_B_Cds2
  gRNA
cuccguagaugacaccccag

SEQ ID NO: 77057 - RNA, 20 nt, Artificial Sequence
  MKO10077057_B_Cds2
  gRNA
ugaaccggugguauuuacug

SEQ ID NO: 77058 - RNA, 20 nt, Artificial Sequence
  MKO10077058_B_Cds2
  gRNA
cucuacguagguggaagaac

SEQ ID NO: 77059 - RNA, 20 nt, Artificial Sequence
  MKO10077059_B_Cdsn
  gRNA
ugugcacaauggguuccucu

SEQ ID NO: 77060 - RNA, 20 nt, Artificial Sequence
  MKO10077060_B_Cdsn
  gRNA
aacccuaucaggggcucgcc

SEQ ID NO: 77061 - RNA, 20 nt, Artificial Sequence
  MKO10077061_B_Cdsn
  gRNA
ccccuggcgagccccugaua

SEQ ID NO: 77062 - RNA, 20 nt, Artificial Sequence
  MKO10077062_B_Cdt1
  gRNA
uguccuacccuacaaguauc

SEQ ID NO: 77063 - RNA, 20 nt, Artificial Sequence
  MKO10077063_B_Cdt1
  gRNA
ccaacuuccgugcccgccuc

SEQ ID NO: 77064 - RNA, 20 nt, Artificial Sequence
  MKO10077064_B_Cdt1
  gRNA
gaugggcaaacgggggagcc

SEQ ID NO: 77065 - RNA, 20 nt, Artificial Sequence
  MKO10077065_B_Cdv3
  gRNA
agaucaccuguuacuggagc

SEQ ID NO: 77066 - RNA, 20 nt, Artificial Sequence
  MKO10077066_B_Cdv3
  gRNA
cuuccggcucucuacaugcu

SEQ ID NO: 77067 - RNA, 20 nt, Artificial Sequence
  MKO10077067_B_Cdv3
  gRNA
aaugagaagagagaagaucc

SEQ ID NO: 77068 - RNA, 20 nt, Artificial Sequence
  MKO10077068_B_Cdx1
  gRNA
gcgggcaccgggcuaaaguc

SEQ ID NO: 77069 - RNA, 20 nt, Artificial Sequence
  MKO10077069_B_Cdx1
  gRNA
agucuaugcccuacuaaugc

SEQ ID NO: 77070 - RNA, 20 nt, Artificial Sequence
  MKO10077070_B_Cdx1
  gRNA
uaguagggcauagacuuccu

SEQ ID NO: 77071 - RNA, 20 nt, Artificial Sequence
  MKO10077071_B_Cdx2
  gRNA
ccucucggagagcccaagug

SEQ ID NO: 77072 - RNA, 20 nt, Artificial Sequence
  MKO10077072_B_Cdx2
  gRNA
cuccgcagggcacccggcug

SEQ ID NO: 77073 - RNA, 20 nt, Artificial Sequence
  MKO10077073_B_Cdx2
  gRNA
gucaucucuagguuaaaauu

SEQ ID NO: 77074 - RNA, 20 nt, Artificial Sequence
  MKO10077074_B_Cdx4
  gRNA
ucagccaaucgagauacagc

SEQ ID NO: 77075 - RNA, 20 nt, Artificial Sequence
  MKO10077075_B_Cdx4
  gRNA
cuacacagaucaucaacggc

SEQ ID NO: 77076 - RNA, 20 nt, Artificial Sequence
  MKO10077076_B_Cdx4
  gRNA
gcaauagauacaucaccauc

SEQ ID NO: 77077 - RNA, 20 nt, Artificial Sequence
  MKO10077077_B_Cdyl2
  gRNA
accauccgacucacgccugc

SEQ ID NO: 77078 - RNA, 20 nt, Artificial Sequence
  MKO10077078_B_Cdyl2
  gRNA
cucgaaucgcagaagcuauc

SEQ ID NO: 77079 - RNA, 20 nt, Artificial Sequence
  MKO10077079_B_Cdyl2
  gRNA
cccauuaauggcuaccacga

SEQ ID NO: 77080 - RNA, 20 nt, Artificial Sequence
  MKO10077080_B_Cdyl
  gRNA
uccucggcacccugauccac

SEQ ID NO: 77081 - RNA, 20 nt, Artificial Sequence
  MKO10077081_B_Cdyl
  gRNA
ugcagccgacgacagcaagc

SEQ ID NO: 77082 - RNA, 20 nt, Artificial Sequence
  MKO10077082_B_Cdyl
  gRNA
agaugcuccucccauaaucu

SEQ ID NO: 77083 - RNA, 20 nt, Artificial Sequence
  MKO10077083_B_Ceacam10
  gRNA
ugugagcaguaguccaaccc

SEQ ID NO: 77084 - RNA, 20 nt, Artificial Sequence
  MKO10077084_B_Ceacam10
  gRNA
gauuuguaacauccauuaau

SEQ ID NO: 77085 - RNA, 20 nt, Artificial Sequence
  MKO10077085_B_Ceacam10
  gRNA
uuccacagcuaaaaagcagu

SEQ ID NO: 77086 - RNA, 20 nt, Artificial Sequence
  MKO10077086_B_Ceacam11
  gRNA
gacagcuaccaauucuacug

SEQ ID NO: 77087 - RNA, 20 nt, Artificial Sequence
  MKO10077087_B_Ceacam11
  gRNA
gcaauuucacaauucuugag

SEQ ID NO: 77088 - RNA, 20 nt, Artificial Sequence
  MKO10077088_B_Ceacam11
  gRNA
cacuccccagcauaguugaa

SEQ ID NO: 77089 - RNA, 20 nt, Artificial Sequence
  MKO10077089_B_Ceacam12
  gRNA
gcacugauucaauaguuauc

SEQ ID NO: 77090 - RNA, 20 nt, Artificial Sequence
  MKO10077090_B_Ceacam12
  gRNA
uaaauaugugcgccccagca

SEQ ID NO: 77091 - RNA, 20 nt, Artificial Sequence
  MKO10077091_B_Ceacam12
  gRNA
ccuguaaagacuguacaucc

SEQ ID NO: 77092 - RNA, 20 nt, Artificial Sequence
  MKO10077092_B_Ceacam13
  gRNA
gaacagaagccccugccaag

SEQ ID NO: 77093 - RNA, 20 nt, Artificial Sequence
  MKO10077093_B_Ceacam13
  gRNA
agcucccgaguaccaggaaa

SEQ ID NO: 77094 - RNA, 20 nt, Artificial Sequence
  MKO10077094_B_Ceacam13
  gRNA
gcaauuucacaacacuugaa

SEQ ID NO: 77095 - RNA, 20 nt, Artificial Sequence
  MKO10077095_B_Ceacam14
  gRNA
aguagugggaaucagccagc

SEQ ID NO: 77096 - RNA, 20 nt, Artificial Sequence
  MKO10077096_B_Ceacam14
  gRNA
ccuguaaagucuguaccucc

SEQ ID NO: 77097 - RNA, 20 nt, Artificial Sequence
  MKO10077097_B_Ceacam14
  gRNA
ugugagcaggagccccugcc

SEQ ID NO: 77098 - RNA, 20 nt, Artificial Sequence
  MKO10077098_B_Ceacam15
  gRNA
accugcgugucgccugacac

SEQ ID NO: 77099 - RNA, 20 nt, Artificial Sequence
  MKO10077099_B_Ceacam15
  gRNA
ccuuugcagagaaacaaaga

SEQ ID NO: 77100 - RNA, 20 nt, Artificial Sequence
  MKO10077100_B_Ceacam15
  gRNA
ccuucuuuguuucucugcaa

SEQ ID NO: 77101 - RNA, 20 nt, Artificial Sequence
  MKO10077101_B_Ceacam16
  gRNA
ggcugcuacagacgagacga

SEQ ID NO: 77102 - RNA, 20 nt, Artificial Sequence
  MKO10077102_B_Ceacam16
  gRNA
aagaccgcgccacacaccac

SEQ ID NO: 77103 - RNA, 20 nt, Artificial Sequence
  MKO10077103_B_Ceacam16
  gRNA
cgaggcagguccacgauacc

SEQ ID NO: 77104 - RNA, 20 nt, Artificial Sequence
  MKO10077104_B_Ceacam18
  gRNA
cgugagaaugugacccgugc

SEQ ID NO: 77105 - RNA, 20 nt, Artificial Sequence
  MKO10077105_B_Ceacam18
  gRNA
gggcaguuaccgguguguug

SEQ ID NO: 77106 - RNA, 20 nt, Artificial Sequence
  MKO10077106_B_Ceacam18
  gRNA
ccucccaauacccgacaccc

SEQ ID NO: 77107 - RNA, 20 nt, Artificial Sequence
  MKO10077107_B_Ceacam19
  gRNA
uugggcauuucgaagcagca

SEQ ID NO: 77108 - RNA, 20 nt, Artificial Sequence
  MKO10077108_B_Ceacam19
  gRNA
gugaaccugaguccugaauc

SEQ ID NO: 77109 - RNA, 20 nt, Artificial Sequence
  MKO10077109_B_Ceacam19
  gRNA
gcuuaccagauucaggacuc

SEQ ID NO: 77110 - RNA, 20 nt, Artificial Sequence
  MKO10077110_B_Ceacam1
  gRNA
uccaaucacgaugccagcaa

SEQ ID NO: 77111 - RNA, 20 nt, Artificial Sequence
  MKO10077111_B_Ceacam1
  gRNA
accugcuugucgaaugacau

SEQ ID NO: 77112 - RNA, 20 nt, Artificial Sequence
  MKO10077112_B_Ceacam1
  gRNA
cacugcugaagucaccauug

SEQ ID NO: 77113 - RNA, 20 nt, Artificial Sequence
  MKO10077113_B_Ceacam20
  gRNA
agggggcuggaugaagucgc

SEQ ID NO: 77114 - RNA, 20 nt, Artificial Sequence
  MKO10077114_B_Ceacam20
  gRNA
aagguugggaacucgauauu

SEQ ID NO: 77115 - RNA, 20 nt, Artificial Sequence
  MKO10077115_B_Ceacam20
  gRNA
gacagugucaggcggucacu

SEQ ID NO: 77116 - RNA, 20 nt, Artificial Sequence
  MKO10077116_B_Ceacam2
  gRNA
gaaauuguacgauuuguaac

SEQ ID NO: 77117 - RNA, 20 nt, Artificial Sequence
  MKO10077117_B_Ceacam2
  gRNA
guccuaccagcgagacuucc

SEQ ID NO: 77118 - RNA, 20 nt, Artificial Sequence
  MKO10077118_B_Ceacam2
  gRNA
accgucaagcccacauccau

SEQ ID NO: 77119 - RNA, 20 nt, Artificial Sequence
  MKO10077119_B_Ceacam3
  gRNA
guucucguagauugaaagac

SEQ ID NO: 77120 - RNA, 20 nt, Artificial Sequence
  MKO10077120_B_Ceacam3
  gRNA
uccgagugacauucugaauc

SEQ ID NO: 77121 - RNA, 20 nt, Artificial Sequence
  MKO10077121_B_Ceacam3
  gRNA
agggcguccacaggucaaaa

SEQ ID NO: 77122 - RNA, 20 nt, Artificial Sequence
  MKO10077122_B_Ceacam5
  gRNA
acuguaugcacuccccaaaa

SEQ ID NO: 77123 - RNA, 20 nt, Artificial Sequence
  MKO10077123_B_Ceacam5
  gRNA
gugccaccgagcauuguuga

SEQ ID NO: 77124 - RNA, 20 nt, Artificial Sequence
  MKO10077124_B_Ceacam5
  gRNA
cgagaaacaguauacaacaa

SEQ ID NO: 77125 - RNA, 20 nt, Artificial Sequence
  MKO10077125_B_Ceacam9
  gRNA
agaaccagcuucuguuaccg

SEQ ID NO: 77126 - RNA, 20 nt, Artificial Sequence
  MKO10077126_B_Ceacam9
  gRNA
ccuucucuguuucucugcaa

SEQ ID NO: 77127 - RNA, 20 nt, Artificial Sequence
  MKO10077127_B_Ceacam9
  gRNA
ccuuugcagagaaacagaga

SEQ ID NO: 77128 - RNA, 20 nt, Artificial Sequence
  MKO10077128_B_Cebpa
  gRNA
cgcggacaugaccgcgccgc

SEQ ID NO: 77129 - RNA, 20 nt, Artificial Sequence
  MKO10077129_B_Cebpa
  gRNA
aacucgucguugaaggcggc

SEQ ID NO: 77130 - RNA, 20 nt, Artificial Sequence
  MKO10077130_B_Cebpa
  gRNA
guagaagucggccgacucca

SEQ ID NO: 77131 - RNA, 20 nt, Artificial Sequence
  MKO10077131_B_Cebpb
  gRNA
gucgggcucguaguagaagu

SEQ ID NO: 77132 - RNA, 20 nt, Artificial Sequence
  MKO10077132_B_Cebpb
  gRNA
guccgcgcgcuugcaguccg

SEQ ID NO: 77133 - RNA, 20 nt, Artificial Sequence
  MKO10077133_B_Cebpb
  gRNA
gaccucuucgccgacgacua

SEQ ID NO: 77134 - RNA, 20 nt, Artificial Sequence
  MKO10077134_B_Cebpd
  gRNA
ggucggcgaagaguucgucg

SEQ ID NO: 77135 - RNA, 20 nt, Artificial Sequence
  MKO10077135_B_Cebpd
  gRNA
cucgcggucucuauugcccg

SEQ ID NO: 77136 - RNA, 20 nt, Artificial Sequence
  MKO10077136_B_Cebpd
  gRNA
cucucgucgucguacauggc

SEQ ID NO: 77137 - RNA, 20 nt, Artificial Sequence
  MKO10077137_B_Cebpe
  gRNA
agcccccgacacccuugaug

SEQ ID NO: 77138 - RNA, 20 nt, Artificial Sequence
  MKO10077138_B_Cebpe
  gRNA
ccgaggcucgcacucauagu

SEQ ID NO: 77139 - RNA, 20 nt, Artificial Sequence
  MKO10077139_B_Cebpe
  gRNA
ucugcccgcagugugccacu

SEQ ID NO: 77140 - RNA, 20 nt, Artificial Sequence
  MKO10077140_B_Cebpg
  gRNA
ucgcagccagccacuacucc

SEQ ID NO: 77141 - RNA, 20 nt, Artificial Sequence
  MKO10077141_B_Cebpg
  gRNA
aggaaccugcuguaagccgc

SEQ ID NO: 77142 - RNA, 20 nt, Artificial Sequence
  MKO10077142_B_Cebpg
  gRNA
uggaaggagaucuacugccc

SEQ ID NO: 77143 - RNA, 20 nt, Artificial Sequence
  MKO10077143_B_Cebpz
  gRNA
agaagccgaaggccgcuucc

SEQ ID NO: 77144 - RNA, 20 nt, Artificial Sequence
  MKO10077144_B_Cebpz
  gRNA
ucuucacaaacgccuucacc

SEQ ID NO: 77145 - RNA, 20 nt, Artificial Sequence
  MKO10077145_B_Cebpz
  gRNA
cuugcuuggaacaugucguc

SEQ ID NO: 77146 - RNA, 20 nt, Artificial Sequence
  MKO10077146_B_Cecr2
  gRNA
acaauucaggugcacucuac

SEQ ID NO: 77147 - RNA, 20 nt, Artificial Sequence
  MKO10077147_B_Cecr2
  gRNA
gcacaaggagaguucuccau

SEQ ID NO: 77148 - RNA, 20 nt, Artificial Sequence
  MKO10077148_B_Cecr2
  gRNA
agcucuucacagagaugacg

SEQ ID NO: 77149 - RNA, 20 nt, Artificial Sequence
  MKO10077149_B_Cecr5
  gRNA
cuugcagcauaacaaagccc

SEQ ID NO: 77150 - RNA, 20 nt, Artificial Sequence
  MKO10077150_B_Cecr5
  gRNA
gggccuuuaccuucaauggc

SEQ ID NO: 77151 - RNA, 20 nt, Artificial Sequence
  MKO10077151_B_Cecr5
  gRNA
guccguauuaccauggucuu

SEQ ID NO: 77152 - RNA, 20 nt, Artificial Sequence
  MKO10077152_B_Cecr6
  gRNA
agccccggcgccgaccccua

SEQ ID NO: 77153 - RNA, 20 nt, Artificial Sequence
  MKO10077153_B_Cecr6
  gRNA
caugguaaggcgaaagcccg

SEQ ID NO: 77154 - RNA, 20 nt, Artificial Sequence
  MKO10077154_B_Cecr6
  gRNA
ggacggccgcgugccgcuuc

SEQ ID NO: 77155 - RNA, 20 nt, Artificial Sequence
  MKO10077155_B_Cela1
  gRNA
cagccccaugacuuaucgag

SEQ ID NO: 77156 - RNA, 20 nt, Artificial Sequence
  MKO10077156_B_Cela1
  gRNA
cuucagccccuccaaccacg

SEQ ID NO: 77157 - RNA, 20 nt, Artificial Sequence
  MKO10077157_B_Cela1
  gRNA
ugacaucgcccugcugcgcu

SEQ ID NO: 77158 - RNA, 20 nt, Artificial Sequence
  MKO10077158_B_Cela2a
  gRNA
ccagggagccuccgcaguug

SEQ ID NO: 77159 - RNA, 20 nt, Artificial Sequence
  MKO10077159_B_Cela2a
  gRNA
ggaagguggcgccacaacug

SEQ ID NO: 77160 - RNA, 20 nt, Artificial Sequence
  MKO10077160_B_Cela2a
  gRNA
ugggcuggccaguuugauua

SEQ ID NO: 77161 - RNA, 20 nt, Artificial Sequence
  MKO10077161_B_Cela3b
  gRNA
aaagaggucuccagcguuga

SEQ ID NO: 77162 - RNA, 20 nt, Artificial Sequence
  MKO10077162_B_Cela3b
  gRNA
ucccauccuucucauacuga

SEQ ID NO: 77163 - RNA, 20 nt, Artificial Sequence
  MKO10077163_B_Cela3b
  gRNA
cacuucuugagagcuugacc

SEQ ID NO: 77164 - RNA, 20 nt, Artificial Sequence
  MKO10077164_B_Celf1
  gRNA
aucuugauagcaucaagauc

SEQ ID NO: 77165 - RNA, 20 nt, Artificial Sequence
  MKO10077165_B_Celf1
  gRNA
aaagaaaaugaacggcaccc

SEQ ID NO: 77166 - RNA, 20 nt, Artificial Sequence
  MKO10077166_B_Celf1
  gRNA
gagcuucuaaugcagcuuua

SEQ ID NO: 77167 - RNA, 20 nt, Artificial Sequence
  MKO10077167_B_Celf2
  gRNA
gaggguucugacuccggucc

SEQ ID NO: 77168 - RNA, 20 nt, Artificial Sequence
  MKO10077168_B_Celf2
  gRNA
uaauauugugcagugcauuc

SEQ ID NO: 77169 - RNA, 20 nt, Artificial Sequence
  MKO10077169_B_Celf2
  gRNA
cacaauauuaaaacuuuacc

SEQ ID NO: 77170 - RNA, 20 nt, Artificial Sequence
  MKO10077170_B_Celf3
  gRNA
cuaccuuugcugguaccguc

SEQ ID NO: 77171 - RNA, 20 nt, Artificial Sequence
  MKO10077171_B_Celf3
  gRNA
auagaugaacaggccgaucc

SEQ ID NO: 77172 - RNA, 20 nt, Artificial Sequence
  MKO10077172_B_Celf3
  gRNA
ccagccgacagcgagagucg

SEQ ID NO: 77173 - RNA, 20 nt, Artificial Sequence
  MKO10077173_B_Celf4
  gRNA
ucgacggguuccccgggcug

SEQ ID NO: 77174 - RNA, 20 nt, Artificial Sequence
  MKO10077174_B_Celf4
  gRNA
cgcugacucacgcucgcagu

SEQ ID NO: 77175 - RNA, 20 nt, Artificial Sequence
  MKO10077175_B_Celf4
  gRNA
ucugcucgugcagcgcgcuc

SEQ ID NO: 77176 - RNA, 20 nt, Artificial Sequence
  MKO10077176_B_Celf5
  gRNA
gugggaagaaaacuucacga

SEQ ID NO: 77177 - RNA, 20 nt, Artificial Sequence
  MKO10077177_B_Celf5
  gRNA
ucucacucaccggcauaguc

SEQ ID NO: 77178 - RNA, 20 nt, Artificial Sequence
  MKO10077178_B_Celf5
  gRNA
cagggucuucugcucgugca

SEQ ID NO: 77179 - RNA, 20 nt, Artificial Sequence
  MKO10077179_B_Celf6
  gRNA
guuaccuccucggcccucac

SEQ ID NO: 77180 - RNA, 20 nt, Artificial Sequence
  MKO10077180_B_Celf6
  gRNA
ggcagagucccgggcgcagu

SEQ ID NO: 77181 - RNA, 20 nt, Artificial Sequence
  MKO10077181_B_Celf6
  gRNA
ucguccgauccaagugaagc

SEQ ID NO: 77182 - RNA, 20 nt, Artificial Sequence
  MKO10077182_B_Celsr1
  gRNA
agcugacguccgugucguuc

SEQ ID NO: 77183 - RNA, 20 nt, Artificial Sequence
  MKO10077183_B_Celsr1
  gRNA
cugcggugucaccgugguug

SEQ ID NO: 77184 - RNA, 20 nt, Artificial Sequence
  MKO10077184_B_Celsr1
  gRNA
gcuggugcaguacuacaaca

SEQ ID NO: 77185 - RNA, 20 nt, Artificial Sequence
  MKO10077185_B_Celsr2
  gRNA
aacgggcuacugcuguacaa

SEQ ID NO: 77186 - RNA, 20 nt, Artificial Sequence
  MKO10077186_B_Celsr2
  gRNA
ugaaguggaagcgcuggcgc

SEQ ID NO: 77187 - RNA, 20 nt, Artificial Sequence
  MKO10077187_B_Celsr2
  gRNA
cgcuccuucaucaccuuccg

SEQ ID NO: 77188 - RNA, 20 nt, Artificial Sequence
  MKO10077188_B_Celsr3
  gRNA
acccucgaaagcgccgcccg

SEQ ID NO: 77189 - RNA, 20 nt, Artificial Sequence
  MKO10077189_B_Celsr3
  gRNA
guuguagaagaguagcccgc

SEQ ID NO: 77190 - RNA, 20 nt, Artificial Sequence
  MKO10077190_B_Celsr3
  gRNA
uaugccauuguccgucacuc

SEQ ID NO: 77191 - RNA, 20 nt, Artificial Sequence
  MKO10077191_B_Cel
  gRNA
cuugcccauagguguugucc

SEQ ID NO: 77192 - RNA, 20 nt, Artificial Sequence
  MKO10077192_B_Cel
  gRNA
ucucacuguagggacgcuga

SEQ ID NO: 77193 - RNA, 20 nt, Artificial Sequence
  MKO10077193_B_Cel
  gRNA
uggucuucgagaucagcaca

SEQ ID NO: 77194 - RNA, 20 nt, Artificial Sequence
  MKO10077194_B_Cend1
  gRNA
ggucaaguucucacaaggcc

SEQ ID NO: 77195 - RNA, 20 nt, Artificial Sequence
  MKO10077195_B_Cend1
  gRNA
ugagaacuugaccccuuugc

SEQ ID NO: 77196 - RNA, 20 nt, Artificial Sequence
  MKO10077196_B_Cend1
  gRNA
cuugaccaagccugugaaga

SEQ ID NO: 77197 - RNA, 20 nt, Artificial Sequence
  MKO10077197_B_Cenpa
  gRNA
agaauccgaggcuucgaggg

SEQ ID NO: 77198 - RNA, 20 nt, Artificial Sequence
  MKO10077198_B_Cenpa
  gRNA
uaccuccugaagggccaaca

SEQ ID NO: 77199 - RNA, 20 nt, Artificial Sequence
  MKO10077199_B_Cenpa
  gRNA
auaugugagaaguucagccg

SEQ ID NO: 77200 - RNA, 20 nt, Artificial Sequence
  MKO10077200_B_Cenpb
  gRNA
uacgcaagggcgagaucgcg

SEQ ID NO: 77201 - RNA, 20 nt, Artificial Sequence
  MKO10077201_B_Cenpb
  gRNA
uugcugugcgccaacgccga

SEQ ID NO: 77202 - RNA, 20 nt, Artificial Sequence
  MKO10077202_B_Cenpb
  gRNA
ccgacagaaagucguaccac

SEQ ID NO: 77203 - RNA, 20 nt, Artificial Sequence
  MKO10077203_B_Cenpc1
  gRNA
uagucaaucaucaagcaaaa

SEQ ID NO: 77204 - RNA, 20 nt, Artificial Sequence
  MKO10077204_B_Cenpc1
  gRNA
aaaaaugguaccuggaagac

SEQ ID NO: 77205 - RNA, 20 nt, Artificial Sequence
  MKO10077205_B_Cenpc1
  gRNA
cccaacauucauacaaaaaa

SEQ ID NO: 77206 - RNA, 20 nt, Artificial Sequence
  MKO10077206_B_Cenpe
  gRNA
caaaccauuguagccuugua

SEQ ID NO: 77207 - RNA, 20 nt, Artificial Sequence
  MKO10077207_B_Cenpe
  gRNA
ucuccauguaagaaacucgu

SEQ ID NO: 77208 - RNA, 20 nt, Artificial Sequence
  MKO10077208_B_Cenpe
  gRNA
aacgcuauuuaucagagcga

SEQ ID NO: 77209 - RNA, 20 nt, Artificial Sequence
  MKO10077209_B_Cenpf
  gRNA
ccugaugucucgcaaugucc

SEQ ID NO: 77210 - RNA, 20 nt, Artificial Sequence
  MKO10077210_B_Cenpf
  gRNA
uucuuucagaucuucguaug

SEQ ID NO: 77211 - RNA, 20 nt, Artificial Sequence
  MKO10077211_B_Cenpf
  gRNA
uaccccaagucgccuuucau

SEQ ID NO: 77212 - RNA, 20 nt, Artificial Sequence
  MKO10077212_B_Cenph
  gRNA
agaacaugggaccugagaau

SEQ ID NO: 77213 - RNA, 20 nt, Artificial Sequence
  MKO10077213_B_Cenph
  gRNA
uuauaguaaaauugaagagc

SEQ ID NO: 77214 - RNA, 20 nt, Artificial Sequence
  MKO10077214_B_Cenpi
  gRNA
uguuauauuuacugaccaaa

SEQ ID NO: 77215 - RNA, 20 nt, Artificial Sequence
  MKO10077215_B_Cenpi
  gRNA
agcuucacuaaguaaagaua

SEQ ID NO: 77216 - RNA, 20 nt, Artificial Sequence
  MKO10077216_B_Cenpi
  gRNA
cucuguguugacaaguguuc

SEQ ID NO: 77217 - RNA, 20 nt, Artificial Sequence
  MKO10077217_B_Cenpj
  gRNA
agccagaagcaucgcucucc

SEQ ID NO: 77218 - RNA, 20 nt, Artificial Sequence
  MKO10077218_B_Cenpj
  gRNA
cgcgugcugugcagacacca

SEQ ID NO: 77219 - RNA, 20 nt, Artificial Sequence
  MKO10077219_B_Cenpj
  gRNA
uaagcucccgcucuuccagu

SEQ ID NO: 77220 - RNA, 20 nt, Artificial Sequence
  MKO10077220_B_Cenpk
  gRNA
uuaacaaaacgucuucauuu

SEQ ID NO: 77221 - RNA, 20 nt, Artificial Sequence
  MKO10077221_B_Cenpk
  gRNA
uccagauacuauuacagaug

SEQ ID NO: 77222 - RNA, 20 nt, Artificial Sequence
  MKO10077222_B_Cenpk
  gRNA
uccacaucuguaauaguauc

SEQ ID NO: 77223 - RNA, 20 nt, Artificial Sequence
  MKO10077223_B_Cenpl
  gRNA
ccuggacaagaaacgcuuca

SEQ ID NO: 77224 - RNA, 20 nt, Artificial Sequence
  MKO10077224_B_Cenpl
  gRNA
ccaugaagcguuucuugucc

SEQ ID NO: 77225 - RNA, 20 nt, Artificial Sequence
  MKO10077225_B_Cenpl
  gRNA
caccccucugcagaaacgac

SEQ ID NO: 77226 - RNA, 20 nt, Artificial Sequence
  MKO10077226_B_Cenpm
  gRNA
uucgcagcuggugagcaccg

SEQ ID NO: 77227 - RNA, 20 nt, Artificial Sequence
  MKO10077227_B_Cenpm
  gRNA
uuaaccugcacagcaaauac

SEQ ID NO: 77228 - RNA, 20 nt, Artificial Sequence
  MKO10077228_B_Cenpm
  gRNA
caaacuuacccccugugaca

SEQ ID NO: 77229 - RNA, 20 nt, Artificial Sequence
  MKO10077229_B_Cenpn
  gRNA
acuuacacacgaugucuaaa

SEQ ID NO: 77230 - RNA, 20 nt, Artificial Sequence
  MKO10077230_B_Cenpn
  gRNA
ggaacuguuccauaucaaaa

SEQ ID NO: 77231 - RNA, 20 nt, Artificial Sequence
  MKO10077231_B_Cenpn
  gRNA
gaaaaacauuccaaagcuuc

SEQ ID NO: 77232 - RNA, 20 nt, Artificial Sequence
  MKO10077232_B_Cenpo
  gRNA
gcugucguucaccuauaaag

SEQ ID NO: 77233 - RNA, 20 nt, Artificial Sequence
  MKO10077233_B_Cenpo
  gRNA
agaaccagcaguucguaaaa

SEQ ID NO: 77234 - RNA, 20 nt, Artificial Sequence
  MKO10077234_B_Cenpo
  gRNA
ugaacgacagcaaguugcac

SEQ ID NO: 77235 - RNA, 20 nt, Artificial Sequence
  MKO10077235_B_Cenpp
  gRNA
caacauggugacauuucaac

SEQ ID NO: 77236 - RNA, 20 nt, Artificial Sequence
  MKO10077236_B_Cenpp
  gRNA
acuuaauucugaauauucug

SEQ ID NO: 77237 - RNA, 20 nt, Artificial Sequence
  MKO10077237_B_Cenpp
  gRNA
gaacacauuuaagcauuuca

SEQ ID NO: 77238 - RNA, 20 nt, Artificial Sequence
  MKO10077238_B_Cenpq
  gRNA
aucucaaccaguugaagaaa

SEQ ID NO: 77239 - RNA, 20 nt, Artificial Sequence
  MKO10077239_B_Cenpq
  gRNA
agaguauuugcaaaguauga

SEQ ID NO: 77240 - RNA, 20 nt, Artificial Sequence
  MKO10077240_B_Cenpq
  gRNA
ugugucaaaaaugcugaaaa

SEQ ID NO: 77241 - RNA, 20 nt, Artificial Sequence
  MKO10077241_B_Cenpt
  gRNA
ggcuguuagacccggagcca

SEQ ID NO: 77242 - RNA, 20 nt, Artificial Sequence
  MKO10077242_B_Cenpt
  gRNA
uccccgacugcucucccguc

SEQ ID NO: 77243 - RNA, 20 nt, Artificial Sequence
  MKO10077243_B_Cenpt
  gRNA
gucuaacagccccuggcaaa

SEQ ID NO: 77244 - RNA, 20 nt, Artificial Sequence
  MKO10077244_B_Cenpu
  gRNA
agaccccccucugcacagua

SEQ ID NO: 77245 - RNA, 20 nt, Artificial Sequence
  MKO10077245_B_Cenpu
  gRNA
uaucaaggucagcacaaaaa

SEQ ID NO: 77246 - RNA, 20 nt, Artificial Sequence
  MKO10077246_B_Cenpu
  gRNA
cuuugagaagcacauauucc

SEQ ID NO: 77247 - RNA, 20 nt, Artificial Sequence
  MKO10077247_B_Cenpv
  gRNA
caaaacgaacugcuccacag

SEQ ID NO: 77248 - RNA, 20 nt, Artificial Sequence
  MKO10077248_B_Cenpv
  gRNA
uccgcacagugccuucgucc

SEQ ID NO: 77249 - RNA, 20 nt, Artificial Sequence
  MKO10077249_B_Cenpv
  gRNA
aggaaucgccccccacugcc

SEQ ID NO: 77250 - RNA, 20 nt, Artificial Sequence
  MKO10077250_B_Cenpw
  gRNA
ccaaucgcugaauaaaaagu

SEQ ID NO: 77251 - RNA, 20 nt, Artificial Sequence
  MKO10077251_B_Cenpw
  gRNA
guaauucugaagaagagcag

SEQ ID NO: 77252 - RNA, 20 nt, Artificial Sequence
  MKO10077252_B_Cenpw
  gRNA
aagcagaagaagccucaccu

SEQ ID NO: 77253 - RNA, 20 nt, Artificial Sequence
  MKO10077253_B_Cep104
  gRNA
ugguauggcaccaaguacuc

SEQ ID NO: 77254 - RNA, 20 nt, Artificial Sequence
  MKO10077254_B_Cep104
  gRNA
ggagcucaagucuguuuaug

SEQ ID NO: 77255 - RNA, 20 nt, Artificial Sequence
  MKO10077255_B_Cep104
  gRNA
cauaaacagacuugagcucc

SEQ ID NO: 77256 - RNA, 20 nt, Artificial Sequence
  MKO10077256_B_Cep110
  gRNA
uacuuaccugaguacgccuu

SEQ ID NO: 77257 - RNA, 20 nt, Artificial Sequence
  MKO10077257_B_Cep110
  gRNA
ugauggucugauucacccag

SEQ ID NO: 77258 - RNA, 20 nt, Artificial Sequence
  MKO10077258_B_Cep110
  gRNA
guagcuuccugcacucauuc

SEQ ID NO: 77259 - RNA, 20 nt, Artificial Sequence
  MKO10077259_B_Cep112
  gRNA
cacuucgcaccugaugagag

SEQ ID NO: 77260 - RNA, 20 nt, Artificial Sequence
  MKO10077260_B_Cep112
  gRNA
ugaccaccuaccaaagcaga

SEQ ID NO: 77261 - RNA, 20 nt, Artificial Sequence
  MKO10077261_B_Cep112
  gRNA
aggucaacuuucuacaaaag

SEQ ID NO: 77262 - RNA, 20 nt, Artificial Sequence
  MKO10077262_B_Cep120
  gRNA
agccucaccggugcugauga

SEQ ID NO: 77263 - RNA, 20 nt, Artificial Sequence
  MKO10077263_B_Cep120
  gRNA
cuaccaucagauuggaccag

SEQ ID NO: 77264 - RNA, 20 nt, Artificial Sequence
  MKO10077264_B_Cep120
  gRNA
uugcuuuauaacuauccacc

SEQ ID NO: 77265 - RNA, 20 nt, Artificial Sequence
  MKO10077265_B_Cep128
  gRNA
uguuucguuuaauccccugu

SEQ ID NO: 77266 - RNA, 20 nt, Artificial Sequence
  MKO10077266_B_Cep128
  gRNA
uacaggggauuaaacgaaac

SEQ ID NO: 77267 - RNA, 20 nt, Artificial Sequence
  MKO10077267_B_Cep128
  gRNA
guaagcgcugacuccucagu

SEQ ID NO: 77268 - RNA, 20 nt, Artificial Sequence
  MKO10077268_B_Cep135
  gRNA
agugcuggacuacagcaagc

SEQ ID NO: 77269 - RNA, 20 nt, Artificial Sequence
  MKO10077269_B_Cep135
  gRNA
uucauacgacagaaagccug

SEQ ID NO: 77270 - RNA, 20 nt, Artificial Sequence
  MKO10077270_B_Cep135
  gRNA
gaacaaccaguauguucaca

SEQ ID NO: 77271 - RNA, 20 nt, Artificial Sequence
  MKO10077271_B_Cep152
  gRNA
ccacgauucugacugcagua

SEQ ID NO: 77272 - RNA, 20 nt, Artificial Sequence
  MKO10077272_B_Cep152
  gRNA
uagcaauuugguuuaucucg

SEQ ID NO: 77273 - RNA, 20 nt, Artificial Sequence
  MKO10077273_B_Cep152
  gRNA
acacuuacguucaugcugug

SEQ ID NO: 77274 - RNA, 20 nt, Artificial Sequence
  MKO10077274_B_Cep164
  gRNA
ggcauccccaaggccucgua

SEQ ID NO: 77275 - RNA, 20 nt, Artificial Sequence
  MKO10077275_B_Cep164
  gRNA
ucucuuccccuaaagucaag

SEQ ID NO: 77276 - RNA, 20 nt, Artificial Sequence
  MKO10077276_B_Cep164
  gRNA
agggucaauaccaaucacuc

SEQ ID NO: 77277 - RNA, 20 nt, Artificial Sequence
  MKO10077277_B_Cep170b
  gRNA
acugaccuugagcgccuccu

SEQ ID NO: 77278 - RNA, 20 nt, Artificial Sequence
  MKO10077278_B_Cep170b
  gRNA
acgcucuaacacguacaugu

SEQ ID NO: 77279 - RNA, 20 nt, Artificial Sequence
  MKO10077279_B_Cep170b
  gRNA
ugccgucaucaacuacgacc

SEQ ID NO: 77280 - RNA, 20 nt, Artificial Sequence
  MKO10077280_B_Cep170
  gRNA
ccaaaaucagcaagugccaa

SEQ ID NO: 77281 - RNA, 20 nt, Artificial Sequence
  MKO10077281_B_Cep170
  gRNA
uauccuuacaucauucacaa

SEQ ID NO: 77282 - RNA, 20 nt, Artificial Sequence
  MKO10077282_B_Cep170
  gRNA
ggucccugaagaagcucuua

SEQ ID NO: 77283 - RNA, 20 nt, Artificial Sequence
  MKO10077283_B_Cep192
  gRNA
gaaaucacgguuuggauuca

SEQ ID NO: 77284 - RNA, 20 nt, Artificial Sequence
  MKO10077284_B_Cep192
  gRNA
auaccugguaccuguugcag

SEQ ID NO: 77285 - RNA, 20 nt, Artificial Sequence
  MKO10077285_B_Cep192
  gRNA
aggguugucacucuggcaac

SEQ ID NO: 77286 - RNA, 20 nt, Artificial Sequence
  MKO10077286_B_Cep19
  gRNA
acgcuggcggcucuuuccuu

SEQ ID NO: 77287 - RNA, 20 nt, Artificial Sequence
  MKO10077287_B_Cep19
  gRNA
cuuuaacuguuccgcagcuc

SEQ ID NO: 77288 - RNA, 20 nt, Artificial Sequence
  MKO10077288_B_Cep19
  gRNA
ccugaacaaacuggacgaca

SEQ ID NO: 77289 - RNA, 20 nt, Artificial Sequence
  MKO10077289_B_Cep250
  gRNA
caccgagcuucggcugcaca

SEQ ID NO: 77290 - RNA, 20 nt, Artificial Sequence
  MKO10077290_B_Cep250
  gRNA
gggcccgagaugaguuagug

SEQ ID NO: 77291 - RNA, 20 nt, Artificial Sequence
  MKO10077291_B_Cep250
  gRNA
guucuucaguuuccgccagg

SEQ ID NO: 77292 - RNA, 20 nt, Artificial Sequence
  MKO10077292_B_Cep290
  gRNA
ucgccaacuugagaagcagc

SEQ ID NO: 77293 - RNA, 20 nt, Artificial Sequence
  MKO10077293_B_Cep290
  gRNA
guuccagcugcuucucaagu

SEQ ID NO: 77294 - RNA, 20 nt, Artificial Sequence
  MKO10077294_B_Cep290
  gRNA
aauuacccagucucuaauga

SEQ ID NO: 77295 - RNA, 20 nt, Artificial Sequence
  MKO10077295_B_Cep350
  gRNA
ggucaauaugaccuagaguc

SEQ ID NO: 77296 - RNA, 20 nt, Artificial Sequence
  MKO10077296_B_Cep350
  gRNA
agcuguaaucgauucuguga

SEQ ID NO: 77297 - RNA, 20 nt, Artificial Sequence
  MKO10077297_B_Cep350
  gRNA
gugaaccuuugguuucuuau

SEQ ID NO: 77298 - RNA, 20 nt, Artificial Sequence
  MKO10077298_B_Cep41
  gRNA
uucuagcuucucaauguauu

SEQ ID NO: 77299 - RNA, 20 nt, Artificial Sequence
  MKO10077299_B_Cep41
  gRNA
cuuccaguguuugaucugac

SEQ ID NO: 77300 - RNA, 20 nt, Artificial Sequence
  MKO10077300_B_Cep41
  gRNA
ucaacaugucaagucaagac

SEQ ID NO: 77301 - RNA, 20 nt, Artificial Sequence
  MKO10077301_B_Cep44
  gRNA
uuggcauugacaucacgggc

SEQ ID NO: 77302 - RNA, 20 nt, Artificial Sequence
  MKO10077302_B_Cep44
  gRNA
ccaccuguacacugacgaga

SEQ ID NO: 77303 - RNA, 20 nt, Artificial Sequence
  MKO10077303_B_Cep44
  gRNA
cagugagaaacgcccugcag

SEQ ID NO: 77304 - RNA, 20 nt, Artificial Sequence
  MKO10077304_B_Cep55
  gRNA
caguacacuccaccugucac

SEQ ID NO: 77305 - RNA, 20 nt, Artificial Sequence
  MKO10077305_B_Cep55
  gRNA
cucuaaugcagugucugacu

SEQ ID NO: 77306 - RNA, 20 nt, Artificial Sequence
  MKO10077306_B_Cep55
  gRNA
ugcagccuuuaaaacauccc

SEQ ID NO: 77307 - RNA, 20 nt, Artificial Sequence
  MKO10077307_B_Cep57l1
  gRNA
gacuaugauccuagaacaac

SEQ ID NO: 77308 - RNA, 20 nt, Artificial Sequence
  MKO10077308_B_Cep57l1
  gRNA
gcauuucagaauugccaccc

SEQ ID NO: 77309 - RNA, 20 nt, Artificial Sequence
  MKO10077309_B_Cep57l1
  gRNA
uuuaauaguccaaacaacca

SEQ ID NO: 77310 - RNA, 20 nt, Artificial Sequence
  MKO10077310_B_Cep57
  gRNA
caacaaacucaccgccaugc

SEQ ID NO: 77311 - RNA, 20 nt, Artificial Sequence
  MKO10077311_B_Cep57
  gRNA
aacccauguucagagccagc

SEQ ID NO: 77312 - RNA, 20 nt, Artificial Sequence
  MKO10077312_B_Cep57
  gRNA
uuuagaacuggcaucccagu

SEQ ID NO: 77313 - RNA, 20 nt, Artificial Sequence
  MKO10077313_B_Cep63
  gRNA
gauggaaaagccgaaguucg

SEQ ID NO: 77314 - RNA, 20 nt, Artificial Sequence
  MKO10077314_B_Cep63
  gRNA
agcucuguguccucgaacuu

SEQ ID NO: 77315 - RNA, 20 nt, Artificial Sequence
  MKO10077315_B_Cep63
  gRNA
cccuaguugccaaaacaaag

SEQ ID NO: 77316 - RNA, 20 nt, Artificial Sequence
  MKO10077316_B_Cep68
  gRNA
caccugggguguuauccaac

SEQ ID NO: 77317 - RNA, 20 nt, Artificial Sequence
  MKO10077317_B_Cep68
  gRNA
gcagcagaacacccacauga

SEQ ID NO: 77318 - RNA, 20 nt, Artificial Sequence
  MKO10077318_B_Cep68
  gRNA
gcacccucaucccugacaac

SEQ ID NO: 77319 - RNA, 20 nt, Artificial Sequence
  MKO10077319_B_Cep70
  gRNA
gcuccuuugacuagacauaa

SEQ ID NO: 77320 - RNA, 20 nt, Artificial Sequence
  MKO10077320_B_Cep70
  gRNA
aaaccuuuaugucuagucaa

SEQ ID NO: 77321 - RNA, 20 nt, Artificial Sequence
  MKO10077321_B_Cep70
  gRNA
gcuguuccuggugugccgcu

SEQ ID NO: 77322 - RNA, 20 nt, Artificial Sequence
  MKO10077322_B_Cep72
  gRNA
uaagccggaaguccacgucc

SEQ ID NO: 77323 - RNA, 20 nt, Artificial Sequence
  MKO10077323_B_Cep72
  gRNA
accuuauugccgagugugaa

SEQ ID NO: 77324 - RNA, 20 nt, Artificial Sequence
  MKO10077324_B_Cep72
  gRNA
auaccuuccaacgguuaaag

SEQ ID NO: 77325 - RNA, 20 nt, Artificial Sequence
  MKO10077325_B_Cep76
  gRNA
uauacgagaagaauuagcac

SEQ ID NO: 77326 - RNA, 20 nt, Artificial Sequence
  MKO10077326_B_Cep76
  gRNA
ucuucuccaaagcaaaccgu

SEQ ID NO: 77327 - RNA, 20 nt, Artificial Sequence
  MKO10077327_B_Cep76
  gRNA
uugauuaguaccaugugaau

SEQ ID NO: 77328 - RNA, 20 nt, Artificial Sequence
  MKO10077328_B_Cep78
  gRNA
cugauacacaccgaauuugu

SEQ ID NO: 77329 - RNA, 20 nt, Artificial Sequence
  MKO10077329_B_Cep78
  gRNA
agaggcugcuuaaguguauc

SEQ ID NO: 77330 - RNA, 20 nt, Artificial Sequence
  MKO10077330_B_Cep78
  gRNA
auggcaaggagccugucaua

SEQ ID NO: 77331 - RNA, 20 nt, Artificial Sequence
  MKO10077331_B_Cep85l
  gRNA
uuucaagccuagucgaucau

SEQ ID NO: 77332 - RNA, 20 nt, Artificial Sequence
  MKO10077332_B_Cep85l
  gRNA
cacuucuuguucugacagcg

SEQ ID NO: 77333 - RNA, 20 nt, Artificial Sequence
  MKO10077333_B_Cep85l
  gRNA
cgggcccagcaugcuaugcu

SEQ ID NO: 77334 - RNA, 20 nt, Artificial Sequence
  MKO10077334_B_Cep85
  gRNA
cgccaucuuacuugucaaug

SEQ ID NO: 77335 - RNA, 20 nt, Artificial Sequence
  MKO10077335_B_Cep85
  gRNA
ugcucaagcauugcugacag

SEQ ID NO: 77336 - RNA, 20 nt, Artificial Sequence
  MKO10077336_B_Cep85
  gRNA
ggcggcccaaaagggcacug

SEQ ID NO: 77337 - RNA, 20 nt, Artificial Sequence
  MKO10077337_B_Cep89
  gRNA
gugcguggcaccgcuggcuu

SEQ ID NO: 77338 - RNA, 20 nt, Artificial Sequence
  MKO10077338_B_Cep89
  gRNA
cagcaucgcuccgaagccag

SEQ ID NO: 77339 - RNA, 20 nt, Artificial Sequence
  MKO10077339_B_Cep89
  gRNA
ugaugccuccgacauugaaa

SEQ ID NO: 77340 - RNA, 20 nt, Artificial Sequence
  MKO10077340_B_Cep95
  gRNA
ugcccuuuaucaauccauuu

SEQ ID NO: 77341 - RNA, 20 nt, Artificial Sequence
  MKO10077341_B_Cep95
  gRNA
agacucaccagccucugagc

SEQ ID NO: 77342 - RNA, 20 nt, Artificial Sequence
  MKO10077342_B_Cep95
  gRNA
gcaauccaucaaauauuucu

SEQ ID NO: 77343 - RNA, 20 nt, Artificial Sequence
  MKO10077343_B_Cep97
  gRNA
uuuagcgggcaauaaucuga

SEQ ID NO: 77344 - RNA, 20 nt, Artificial Sequence
  MKO10077344_B_Cep97
  gRNA
cucaaggaucaguggugaac

SEQ ID NO: 77345 - RNA, 20 nt, Artificial Sequence
  MKO10077345_B_Cep97
  gRNA
ugauguccauaccuugauuc

SEQ ID NO: 77346 - RNA, 20 nt, Artificial Sequence
  MKO10077346_B_Cept1
  gRNA
uacuuccguguaaucuucac

SEQ ID NO: 77347 - RNA, 20 nt, Artificial Sequence
  MKO10077347_B_Cept1
  gRNA
aacuaacaguagcucuccuc

SEQ ID NO: 77348 - RNA, 20 nt, Artificial Sequence
  MKO10077348_B_Cept1
  gRNA
acuuguauugcaguacaacu

SEQ ID NO: 77349 - RNA, 20 nt, Artificial Sequence
  MKO10077349_B_Cer1
  gRNA
ugaauuuggugggcgagcag

SEQ ID NO: 77350 - RNA, 20 nt, Artificial Sequence
  MKO10077350_B_Cer1
  gRNA
ucuccacguggccaaccacg

SEQ ID NO: 77351 - RNA, 20 nt, Artificial Sequence
  MKO10077351_B_Cer1
  gRNA
agaaugcauaccugguugaa

SEQ ID NO: 77352 - RNA, 20 nt, Artificial Sequence
  MKO10077352_B_Cercam
  gRNA
cagguccuacccagaugaac

SEQ ID NO: 77353 - RNA, 20 nt, Artificial Sequence
  MKO10077353_B_Cercam
  gRNA
cacugaagcuucucauagau

SEQ ID NO: 77354 - RNA, 20 nt, Artificial Sequence
  MKO10077354_B_Cercam
  gRNA
caaaaacugaugccguucuu

SEQ ID NO: 77355 - RNA, 20 nt, Artificial Sequence
  MKO10077355_B_Cerkl
  gRNA
uguccacgucuauuacgaga

SEQ ID NO: 77356 - RNA, 20 nt, Artificial Sequence
  MKO10077356_B_Cerkl
  gRNA
agcucugcuccaacgagagu

SEQ ID NO: 77357 - RNA, 20 nt, Artificial Sequence
  MKO10077357_B_Cerkl
  gRNA
uaaccuacccaucaaauccu

SEQ ID NO: 77358 - RNA, 20 nt, Artificial Sequence
  MKO10077358_B_Cerk
  gRNA
ugcgagaaacacgccuccag

SEQ ID NO: 77359 - RNA, 20 nt, Artificial Sequence
  MKO10077359_B_Cerk
  gRNA
uucaagaccgaagcacuugc

SEQ ID NO: 77360 - RNA, 20 nt, Artificial Sequence
  MKO10077360_B_Cerk
  gRNA
acugaugaucuccguaguga

SEQ ID NO: 77361 - RNA, 20 nt, Artificial Sequence
  MKO10077361_B_Cers1
  gRNA
ugacgucagcgaugugcagc

SEQ ID NO: 77362 - RNA, 20 nt, Artificial Sequence
  MKO10077362_B_Cers1
  gRNA
augaacucaccggaaggcgu

SEQ ID NO: 77363 - RNA, 20 nt, Artificial Sequence
  MKO10077363_B_Cers1
  gRNA
guaagcgcaguagcuccaac

SEQ ID NO: 77364 - RNA, 20 nt, Artificial Sequence
  MKO10077364_B_Cers2
  gRNA
uugggagggauaucccauac

SEQ ID NO: 77365 - RNA, 20 nt, Artificial Sequence
  MKO10077365_B_Cers2
  gRNA
cugcuugggcugcuugccgc

SEQ ID NO: 77366 - RNA, 20 nt, Artificial Sequence
  MKO10077366_B_Cers2
  gRNA
uaccuaauugccuuuguugc

SEQ ID NO: 77367 - RNA, 20 nt, Artificial Sequence
  MKO10077367_B_Cers3
  gRNA
augccaagugcauuugcuag

SEQ ID NO: 77368 - RNA, 20 nt, Artificial Sequence
  MKO10077368_B_Cers3
  gRNA
auggaauugugauguauaag

SEQ ID NO: 77369 - RNA, 20 nt, Artificial Sequence
  MKO10077369_B_Cers3
  gRNA
acaccucuagcaaaugcacu

SEQ ID NO: 77370 - RNA, 20 nt, Artificial Sequence
  MKO10077370_B_Cers4
  gRNA
ugggugugcaggauccaauc

SEQ ID NO: 77371 - RNA, 20 nt, Artificial Sequence
  MKO10077371_B_Cers4
  gRNA
cugggagaauuacccacauc

SEQ ID NO: 77372 - RNA, 20 nt, Artificial Sequence
  MKO10077372_B_Cers4
  gRNA
cuucauaggaaucaugguug

SEQ ID NO: 77373 - RNA, 20 nt, Artificial Sequence
  MKO10077373_B_Cers5
  gRNA
gauaguuguaccagcacugu

SEQ ID NO: 77374 - RNA, 20 nt, Artificial Sequence
  MKO10077374_B_Cers5
  gRNA
aaugccaacacggagugcac

SEQ ID NO: 77375 - RNA, 20 nt, Artificial Sequence
  MKO10077375_B_Cers5
  gRNA
aagcccugugcacuccgugu

SEQ ID NO: 77376 - RNA, 20 nt, Artificial Sequence
  MKO10077376_B_Cers6
  gRNA
gcccucaacauccaagccaa

SEQ ID NO: 77377 - RNA, 20 nt, Artificial Sequence
  MKO10077377_B_Cers6
  gRNA
cugggcaguuugugguccau

SEQ ID NO: 77378 - RNA, 20 nt, Artificial Sequence
  MKO10077378_B_Cers6
  gRNA
uaccucuauguauuuagcua

SEQ ID NO: 77379 - RNA, 20 nt, Artificial Sequence
  MKO10077379_B_Ces1a
  gRNA
cauggaggcgguuuacucuc

SEQ ID NO: 77380 - RNA, 20 nt, Artificial Sequence
  MKO10077380_B_Ces1a
  gRNA
caccacagccugccgagacc

SEQ ID NO: 77381 - RNA, 20 nt, Artificial Sequence
  MKO10077381_B_Ces1a
  gRNA
cagucuucagaauacucaag

SEQ ID NO: 77382 - RNA, 20 nt, Artificial Sequence
  MKO10077382_B_Ces1b
  gRNA
cauggugguggauugaugac

SEQ ID NO: 77383 - RNA, 20 nt, Artificial Sequence
  MKO10077383_B_Ces1b
  gRNA
uccugcugaugacccaaaga

SEQ ID NO: 77384 - RNA, 20 nt, Artificial Sequence
  MKO10077384_B_Ces1b
  gRNA
cugucaucaauccaccacca

SEQ ID NO: 77385 - RNA, 20 nt, Artificial Sequence
  MKO10077385_B_Ces1c
  gRNA
cagucuuccgaaaucuugag

SEQ ID NO: 77386 - RNA, 20 nt, Artificial Sequence
  MKO10077386_B_Ces1c
  gRNA
ccuugugugguguccaccac

SEQ ID NO: 77387 - RNA, 20 nt, Artificial Sequence
  MKO10077387_B_Ces1c
  gRNA
cugggcucaccuggaccaac

SEQ ID NO: 77388 - RNA, 20 nt, Artificial Sequence
  MKO10077388_B_Ces1d
  gRNA
gugaccauucaguaucgccu

SEQ ID NO: 77389 - RNA, 20 nt, Artificial Sequence
  MKO10077389_B_Ces1d
  gRNA
ucucagagcucuucaccaac

SEQ ID NO: 77390 - RNA, 20 nt, Artificial Sequence
  MKO10077390_B_Ces1d
  gRNA
cuguucuuugucaagucagc

SEQ ID NO: 77391 - RNA, 20 nt, Artificial Sequence
  MKO10077391_B_Ces1e
  gRNA
ugaccuccuaacuaacagaa

SEQ ID NO: 77392 - RNA, 20 nt, Artificial Sequence
  MKO10077392_B_Ces1e
  gRNA
ggcaacuuacauaggagggu

SEQ ID NO: 77393 - RNA, 20 nt, Artificial Sequence
  MKO10077393_B_Ces1e
  gRNA
ucacucuuugucaagucagc

SEQ ID NO: 77394 - RNA, 20 nt, Artificial Sequence
  MKO10077394_B_Ces1f
  gRNA
ucucucugcauacgaaaaug

SEQ ID NO: 77395 - RNA, 20 nt, Artificial Sequence
  MKO10077395_B_Ces1f
  gRNA
cuguucuuugaaaaguccgc

SEQ ID NO: 77396 - RNA, 20 nt, Artificial Sequence
  MKO10077396_B_Ces1f
  gRNA
uucaauaucgccugaguauc

SEQ ID NO: 77397 - RNA, 20 nt, Artificial Sequence
  MKO10077397_B_Ces1g
  gRNA
ccgaagauagucacagaucc

SEQ ID NO: 77398 - RNA, 20 nt, Artificial Sequence
  MKO10077398_B_Ces1g
  gRNA
cugagcucuucaccaaccaa

SEQ ID NO: 77399 - RNA, 20 nt, Artificial Sequence
  MKO10077399_B_Ces1g
  gRNA
uguaccacaggcgguaagga

SEQ ID NO: 77400 - RNA, 20 nt, Artificial Sequence
  MKO10077400_B_Ces2a
  gRNA
augccauuggcuagacuucc

SEQ ID NO: 77401 - RNA, 20 nt, Artificial Sequence
  MKO10077401_B_Ces2a
  gRNA
gccucccaucucuauguccg

SEQ ID NO: 77402 - RNA, 20 nt, Artificial Sequence
  MKO10077402_B_Ces2a
  gRNA
caguuuagauacaucauuca

SEQ ID NO: 77403 - RNA, 20 nt, Artificial Sequence
  MKO10077403_B_Ces2b
  gRNA
uggacaugggggacacaaca

SEQ ID NO: 77404 - RNA, 20 nt, Artificial Sequence
  MKO10077404_B_Ces2b
  gRNA
cagugauaagguaaggaagc

SEQ ID NO: 77405 - RNA, 20 nt, Artificial Sequence
  MKO10077405_B_Ces2b
  gRNA
gccaccugucucuacguccg

SEQ ID NO: 77406 - RNA, 20 nt, Artificial Sequence
  MKO10077406_B_Ces2c
  gRNA
ucaggaggugcaaaucgcag

SEQ ID NO: 77407 - RNA, 20 nt, Artificial Sequence
  MKO10077407_B_Ces2c
  gRNA
caccccagcccaugcccaug

SEQ ID NO: 77408 - RNA, 20 nt, Artificial Sequence
  MKO10077408_B_Ces2c
  gRNA
caaagugagcgauguucugc

SEQ ID NO: 77409 - RNA, 20 nt, Artificial Sequence
  MKO10077409_B_Ces2e
  gRNA
caacagugagugcaccacca

SEQ ID NO: 77410 - RNA, 20 nt, Artificial Sequence
  MKO10077410_B_Ces2e
  gRNA
uguaccagcccaugcccaug

SEQ ID NO: 77411 - RNA, 20 nt, Artificial Sequence
  MKO10077411_B_Ces2e
  gRNA
ugaagaaucccagaacaccc

SEQ ID NO: 77412 - RNA, 20 nt, Artificial Sequence
  MKO10077412_B_Ces2f
  gRNA
ccaaaaagugugacagaauc

SEQ ID NO: 77413 - RNA, 20 nt, Artificial Sequence
  MKO10077413_B_Ces2f
  gRNA
uaugcucaccuguaaaagcc

SEQ ID NO: 77414 - RNA, 20 nt, Artificial Sequence
  MKO10077414_B_Ces2f
  gRNA
cagcuuugaugucugucaag

SEQ ID NO: 77415 - RNA, 20 nt, Artificial Sequence
  MKO10077415_B_Ces2g
  gRNA
gggucaguuucaacuccuuc

SEQ ID NO: 77416 - RNA, 20 nt, Artificial Sequence
  MKO10077416_B_Ces2g
  gRNA
caccucagagaagcuaaaua

SEQ ID NO: 77417 - RNA, 20 nt, Artificial Sequence
  MKO10077417_B_Ces2g
  gRNA
ucacgugaaugagccugccu

SEQ ID NO: 77418 - RNA, 20 nt, Artificial Sequence
  MKO10077418_B_Ces2h
  gRNA
uggauccaugcuagcagcca

SEQ ID NO: 77419 - RNA, 20 nt, Artificial Sequence
  MKO10077419_B_Ces2h
  gRNA
caucacugcaaugaauaugc

SEQ ID NO: 77420 - RNA, 20 nt, Artificial Sequence
  MKO10077420_B_Ces2h
  gRNA
aagaguggacacccacauca

SEQ ID NO: 77421 - RNA, 20 nt, Artificial Sequence
  MKO10077421_B_Ces3a
  gRNA
ugcugauccaucaugagaug

SEQ ID NO: 77422 - RNA, 20 nt, Artificial Sequence
  MKO10077422_B_Ces3a
  gRNA
ccccuuugcucaagcaccac

SEQ ID NO: 77423 - RNA, 20 nt, Artificial Sequence
  MKO10077423_B_Ces3a
  gRNA
caaagucacucagccugaag

SEQ ID NO: 77424 - RNA, 20 nt, Artificial Sequence
  MKO10077424_B_Ces3b
  gRNA
ccccuuugcucaagcaccag

SEQ ID NO: 77425 - RNA, 20 nt, Artificial Sequence
  MKO10077425_B_Ces3b
  gRNA
aucucaggauggaucagcac

SEQ ID NO: 77426 - RNA, 20 nt, Artificial Sequence
  MKO10077426_B_Ces3b
  gRNA
ucccacuggugcuugagcaa

SEQ ID NO: 77427 - RNA, 20 nt, Artificial Sequence
  MKO10077427_B_Ces4a
  gRNA
ggaagccgaaccggcgagga

SEQ ID NO: 77428 - RNA, 20 nt, Artificial Sequence
  MKO10077428_B_Ces4a
  gRNA
uauacuguuuccgaguguua

SEQ ID NO: 77429 - RNA, 20 nt, Artificial Sequence
  MKO10077429_B_Ces4a
  gRNA
gcgggagcgaugagcgucuc

SEQ ID NO: 77430 - RNA, 20 nt, Artificial Sequence
  MKO10077430_B_Ces5a
  gRNA
ucccgcugaguuaccgaaga

SEQ ID NO: 77431 - RNA, 20 nt, Artificial Sequence
  MKO10077431_B_Ces5a
  gRNA
ucccagaaggcccaauuccc

SEQ ID NO: 77432 - RNA, 20 nt, Artificial Sequence
  MKO10077432_B_Ces5a
  gRNA
aaaguaaguuacccuauacu

SEQ ID NO: 77433 - RNA, 20 nt, Artificial Sequence
  MKO10077433_B_Cetn1
  gRNA
gcucauuggccacacgcuug

SEQ ID NO: 77434 - RNA, 20 nt, Artificial Sequence
  MKO10077434_B_Cetn1
  gRNA
auucaaaaaccucaagcgug

SEQ ID NO: 77435 - RNA, 20 nt, Artificial Sequence
  MKO10077435_B_Cetn1
  gRNA
cuucagcuccuucacaucga

SEQ ID NO: 77436 - RNA, 20 nt, Artificial Sequence
  MKO10077436_B_Cetn2
  gRNA
uuucauuguagguggcaaug

SEQ ID NO: 77437 - RNA, 20 nt, Artificial Sequence
  MKO10077437_B_Cetn2
  gRNA
uuugaucucuuugaugcuga

SEQ ID NO: 77438 - RNA, 20 nt, Artificial Sequence
  MKO10077438_B_Cetn2
  gRNA
auugaugaagcugaucgaga

SEQ ID NO: 77439 - RNA, 20 nt, Artificial Sequence
  MKO10077439_B_Cetn3
  gRNA
uucaaaugugaucuugccag

SEQ ID NO: 77440 - RNA, 20 nt, Artificial Sequence
  MKO10077440_B_Cetn3
  gRNA
gggugagaacaugagcgaug

SEQ ID NO: 77441 - RNA, 20 nt, Artificial Sequence
  MKO10077441_B_Cetn3
  gRNA
aaagguggcaaugagagccu

SEQ ID NO: 77442 - RNA, 20 nt, Artificial Sequence
  MKO10077442_B_Cetn4
  gRNA
cauagaucugaaagaacuga

SEQ ID NO: 77443 - RNA, 20 nt, Artificial Sequence
  MKO10077443_B_Cetn4
  gRNA
cuugaugaagcugaucguga

SEQ ID NO: 77444 - RNA, 20 nt, Artificial Sequence
  MKO10077444_B_Cetn4
  gRNA
agcgcauaacuuuagaccaa

SEQ ID NO: 77445 - RNA, 20 nt, Artificial Sequence
  MKO10077445_B_Cfb
  gRNA
agccacgcaggacaaguccc

SEQ ID NO: 77446 - RNA, 20 nt, Artificial Sequence
  MKO10077446_B_Cfb
  gRNA
accgccuuggagaaguugaa

SEQ ID NO: 77447 - RNA, 20 nt, Artificial Sequence
  MKO10077447_B_Cfb
  gRNA
aggugcgauuagcagagccc

SEQ ID NO: 77448 - RNA, 20 nt, Artificial Sequence
  MKO10077448_B_Cfc1
  gRNA
aguucuguccagugucgucc

SEQ ID NO: 77449 - RNA, 20 nt, Artificial Sequence
  MKO10077449_B_Cfc1
  gRNA
acugucgcgcugcagcucau

SEQ ID NO: 77450 - RNA, 20 nt, Artificial Sequence
  MKO10077450_B_Cfc1
  gRNA
uuuaaagguuaucagagcga

SEQ ID NO: 77451 - RNA, 20 nt, Artificial Sequence
  MKO10077451_B_Cfdp1
  gRNA
acuuugguccuacaucauua

SEQ ID NO: 77452 - RNA, 20 nt, Artificial Sequence
  MKO10077452_B_Cfdp1
  gRNA
cuuaccuuaguuugugaacc

SEQ ID NO: 77453 - RNA, 20 nt, Artificial Sequence
  MKO10077453_B_Cfdp1
  gRNA
cauacucacccugacccagc

SEQ ID NO: 77454 - RNA, 20 nt, Artificial Sequence
  MKO10077454_B_Cfd
  gRNA
gacacucggguauagacgcc

SEQ ID NO: 77455 - RNA, 20 nt, Artificial Sequence
  MKO10077455_B_Cfd
  gRNA
agcccaugcucggcccuaca

SEQ ID NO: 77456 - RNA, 20 nt, Artificial Sequence
  MKO10077456_B_Cfd
  gRNA
ccccugaacccuacaagcga

SEQ ID NO: 77457 - RNA, 20 nt, Artificial Sequence
  MKO10077457_B_Cfhr1
  gRNA
agaaggugacauuguacaag

SEQ ID NO: 77458 - RNA, 20 nt, Artificial Sequence
  MKO10077458_B_Cfhr1
  gRNA
ccuuaaguacauaauaguuc

SEQ ID NO: 77459 - RNA, 20 nt, Artificial Sequence
  MKO10077459_B_Cfhr1
  gRNA
agguacuuacauauacaggu

SEQ ID NO: 77460 - RNA, 20 nt, Artificial Sequence
  MKO10077460_B_Cfhr2
  gRNA
ucaccuccuuauauucuaaa

SEQ ID NO: 77461 - RNA, 20 nt, Artificial Sequence
  MKO10077461_B_Cfhr2
  gRNA
ugaagcuuacagguacaucu

SEQ ID NO: 77462 - RNA, 20 nt, Artificial Sequence
  MKO10077462_B_Cfhr2
  gRNA
gaauuuccacaauucaaaua

SEQ ID NO: 77463 - RNA, 20 nt, Artificial Sequence
  MKO10077463_B_Cfh
  gRNA
agauccaacugccagccuaa

SEQ ID NO: 77464 - RNA, 20 nt, Artificial Sequence
  MKO10077464_B_Cfh
  gRNA
gugucuccgggaugcccaca

SEQ ID NO: 77465 - RNA, 20 nt, Artificial Sequence
  MKO10077465_B_Cfh
  gRNA
aaugauauuccacuauguga

SEQ ID NO: 77466 - RNA, 20 nt, Artificial Sequence
  MKO10077466_B_Cfi
  gRNA
ccguggcagagauguaucga

SEQ ID NO: 77467 - RNA, 20 nt, Artificial Sequence
  MKO10077467_B_Cfi
  gRNA
cucaguucuccucuucguaa

SEQ ID NO: 77468 - RNA, 20 nt, Artificial Sequence
  MKO10077468_B_Cfi
  gRNA
cggagugugccuuuacgaag

SEQ ID NO: 77469 - RNA, 20 nt, Artificial Sequence
  MKO10077469_B_Cfl1
  gRNA
uccccccagccccuccgguc

SEQ ID NO: 77470 - RNA, 20 nt, Artificial Sequence
  MKO10077470_B_Cfl1
  gRNA
ugucccucaggccucuggug

SEQ ID NO: 77471 - RNA, 20 nt, Artificial Sequence
  MKO10077471_B_Cfl1
  gRNA
uggcagcgccgucauuuccc

SEQ ID NO: 77472 - RNA, 20 nt, Artificial Sequence
  MKO10077472_B_Cfl2
  gRNA
cagaucuuggugggugacau

SEQ ID NO: 77473 - RNA, 20 nt, Artificial Sequence
  MKO10077473_B_Cfl2
  gRNA
gccauuaaaaagaaauuuac

SEQ ID NO: 77474 - RNA, 20 nt, Artificial Sequence
  MKO10077474_B_Cfl2
  gRNA
cucgacgcugggagagaaac

SEQ ID NO: 77475 - RNA, 20 nt, Artificial Sequence
  MKO10077475_B_Cflar
  gRNA
uucuuagaguuucuuggauc

SEQ ID NO: 77476 - RNA, 20 nt, Artificial Sequence
  MKO10077476_B_Cflar
  gRNA
ccagagcccugugucugccg

SEQ ID NO: 77477 - RNA, 20 nt, Artificial Sequence
  MKO10077477_B_Cflar
  gRNA
ugccuguguaaucccuugua

SEQ ID NO: 77478 - RNA, 20 nt, Artificial Sequence
  MKO10077478_B_Cfp
  gRNA
gcugcgacacaggcgcugug

SEQ ID NO: 77479 - RNA, 20 nt, Artificial Sequence
  MKO10077479_B_Cfp
  gRNA
aguggccuaccaccuugccc

SEQ ID NO: 77480 - RNA, 20 nt, Artificial Sequence
  MKO10077480_B_Cfp
  gRNA
gcaugaugguggccucuguc

SEQ ID NO: 77481 - RNA, 20 nt, Artificial Sequence
  MKO10077481_B_Cftr
  gRNA
cguuccauugccauuuaccu

SEQ ID NO: 77482 - RNA, 20 nt, Artificial Sequence
  MKO10077482_B_Cftr
  gRNA
auaugucugacaacuccaag

SEQ ID NO: 77483 - RNA, 20 nt, Artificial Sequence
  MKO10077483_B_Cftr
  gRNA
guucuugauaaaauaaguau

SEQ ID NO: 77484 - RNA, 20 nt, Artificial Sequence
  MKO10077484_B_Cga
  gRNA
cuccguaugauucuccacuc

SEQ ID NO: 77485 - RNA, 20 nt, Artificial Sequence
  MKO10077485_B_Cga
  gRNA
ugaauaauaaagucuccauc

SEQ ID NO: 77486 - RNA, 20 nt, Artificial Sequence
  MKO10077486_B_Cga
  gRNA
aaaauaugcagcugucauuc

SEQ ID NO: 77487 - RNA, 20 nt, Artificial Sequence
  MKO10077487_B_Cggbp1
  gRNA
aauucagugacucgauccag

SEQ ID NO: 77488 - RNA, 20 nt, Artificial Sequence
  MKO10077488_B_Cggbp1
  gRNA
cgccucagcuggucugacuu

SEQ ID NO: 77489 - RNA, 20 nt, Artificial Sequence
  MKO10077489_B_Cggbp1
  gRNA
acccuccguucuucacaugc

SEQ ID NO: 77490 - RNA, 20 nt, Artificial Sequence
  MKO10077490_B_Cgnl1
  gRNA
gcuccgaauucucccucuga

SEQ ID NO: 77491 - RNA, 20 nt, Artificial Sequence
  MKO10077491_B_Cgnl1
  gRNA
cacccugcagagacggcugg

SEQ ID NO: 77492 - RNA, 20 nt, Artificial Sequence
  MKO10077492_B_Cgnl1
  gRNA
gcuguaguucagacacuucu

SEQ ID NO: 77493 - RNA, 20 nt, Artificial Sequence
  MKO10077493_B_Cgn
  gRNA
cuccagaagcucggagagug

SEQ ID NO: 77494 - RNA, 20 nt, Artificial Sequence
  MKO10077494_B_Cgn
  gRNA
cauagaugguggccuucaca

SEQ ID NO: 77495 - RNA, 20 nt, Artificial Sequence
  MKO10077495_B_Cgn
  gRNA
ucuccagcaacuccugcagu

SEQ ID NO: 77496 - RNA, 20 nt, Artificial Sequence
  MKO10077496_B_Cgref1
  gRNA
gugagcugcuguuguaccuc

SEQ ID NO: 77497 - RNA, 20 nt, Artificial Sequence
  MKO10077497_B_Cgref1
  gRNA
ccuaaagggagcagcaauag

SEQ ID NO: 77498 - RNA, 20 nt, Artificial Sequence
  MKO10077498_B_Cgref1
  gRNA
ugcucccgguccaugugcuc

SEQ ID NO: 77499 - RNA, 20 nt, Artificial Sequence
  MKO10077499_B_Cgrrf1
  gRNA
ugaacgcucuugugcugaac

SEQ ID NO: 77500 - RNA, 20 nt, Artificial Sequence
  MKO10077500_B_Cgrrf1
  gRNA
gcccagaucucgcuauccuu

SEQ ID NO: 77501 - RNA, 20 nt, Artificial Sequence
  MKO10077501_B_Cgrrf1
  gRNA
ggaaguuuguaagucuuauc

SEQ ID NO: 77502 - RNA, 20 nt, Artificial Sequence
  MKO10077502_B_Ch25h
  gRNA
gcgacgcuacaagauccacc

SEQ ID NO: 77503 - RNA, 20 nt, Artificial Sequence
  MKO10077503_B_Ch25h
  gRNA
guucacgcagcgcucaccgc

SEQ ID NO: 77504 - RNA, 20 nt, Artificial Sequence
  MKO10077504_B_Ch25h
  gRNA
acugagagugaugcaugucg

SEQ ID NO: 77505 - RNA, 20 nt, Artificial Sequence
  MKO10077505_B_Chac1
  gRNA
gguguggcauaccaaguucg

SEQ ID NO: 77506 - RNA, 20 nt, Artificial Sequence
  MKO10077506_B_Chac1
  gRNA
cccugucuagccuggccgag

SEQ ID NO: 77507 - RNA, 20 nt, Artificial Sequence
  MKO10077507_B_Chac1
  gRNA
cacuuaccucacggucuuca

SEQ ID NO: 77508 - RNA, 20 nt, Artificial Sequence
  MKO10077508_B_Chac2
  gRNA
auaccccaggaucuucaaca

SEQ ID NO: 77509 - RNA, 20 nt, Artificial Sequence
  MKO10077509_B_Chac2
  gRNA
agaugcucgucugcaucuuc

SEQ ID NO: 77510 - RNA, 20 nt, Artificial Sequence
  MKO10077510_B_Chac2
  gRNA
gugacccuuguugaagaucc

SEQ ID NO: 77511 - RNA, 20 nt, Artificial Sequence
  MKO10077511_B_Chadl
  gRNA
ccggcaccagaaccucaccg

SEQ ID NO: 77512 - RNA, 20 nt, Artificial Sequence
  MKO10077512_B_Chadl
  gRNA
cccagccucagccgacauug

SEQ ID NO: 77513 - RNA, 20 nt, Artificial Sequence
  MKO10077513_B_Chadl
  gRNA
cuguuccucaaugucggcug

SEQ ID NO: 77514 - RNA, 20 nt, Artificial Sequence
  MKO10077514_B_Chad
  gRNA
gcugcaaauccccgaccaag

SEQ ID NO: 77515 - RNA, 20 nt, Artificial Sequence
  MKO10077515_B_Chad
  gRNA
auucucaccgccgaaggcca

SEQ ID NO: 77516 - RNA, 20 nt, Artificial Sequence
  MKO10077516_B_Chad
  gRNA
ucggggauuugcagcugcga

SEQ ID NO: 77517 - RNA, 20 nt, Artificial Sequence
  MKO10077517_B_Chaf1a
  gRNA
ugcccucaagaagcuaucaa

SEQ ID NO: 77518 - RNA, 20 nt, Artificial Sequence
  MKO10077518_B_Chaf1a
  gRNA
guggauugcaaagacagacc

SEQ ID NO: 77519 - RNA, 20 nt, Artificial Sequence
  MKO10077519_B_Chaf1a
  gRNA
ccagugaagagguuaauaca

SEQ ID NO: 77520 - RNA, 20 nt, Artificial Sequence
  MKO10077520_B_Chaf1b
  gRNA
gaugcuaaaaucuccccagu

SEQ ID NO: 77521 - RNA, 20 nt, Artificial Sequence
  MKO10077521_B_Chaf1b
  gRNA
cgcagcugaauaaggagaac

SEQ ID NO: 77522 - RNA, 20 nt, Artificial Sequence
  MKO10077522_B_Chaf1b
  gRNA
cagaugccgucauucuguug

SEQ ID NO: 77523 - RNA, 20 nt, Artificial Sequence
  MKO10077523_B_Champ1
  gRNA
gggaaaagugcgcguuuccg

SEQ ID NO: 77524 - RNA, 20 nt, Artificial Sequence
  MKO10077524_B_Champ1
  gRNA
uaaugcaaaaugcgauaguc

SEQ ID NO: 77525 - RNA, 20 nt, Artificial Sequence
  MKO10077525_B_Champ1
  gRNA
auaagaggaccagcgcccug

SEQ ID NO: 77526 - RNA, 20 nt, Artificial Sequence
  MKO10077526_B_Chau
  gRNA
acgaugacaugcucgggcuc

SEQ ID NO: 77527 - RNA, 20 nt, Artificial Sequence
  MKO10077527_B_Chau
  gRNA
ugagcccgagcaugucaucg

SEQ ID NO: 77528 - RNA, 20 nt, Artificial Sequence
  MKO10077528_B_Chau
  gRNA
ccuucagugcaugcaacacc

SEQ ID NO: 77529 - RNA, 20 nt, Artificial Sequence
  MKO10077529_B_Chchd10
  gRNA
ugcccagccugccguccagc

SEQ ID NO: 77530 - RNA, 20 nt, Artificial Sequence
  MKO10077530_B_Chchd10
  gRNA
gagcgaccuaacccugugug

SEQ ID NO: 77531 - RNA, 20 nt, Artificial Sequence
  MKO10077531_B_Chchd10
  gRNA
gauuguauuugcacuguuug

SEQ ID NO: 77532 - RNA, 20 nt, Artificial Sequence
  MKO10077532_B_Chchd1
  gRNA
caucgacaucuccgugauac

SEQ ID NO: 77533 - RNA, 20 nt, Artificial Sequence
  MKO10077533_B_Chchd1
  gRNA
caggaagaugagaucaaucc

SEQ ID NO: 77534 - RNA, 20 nt, Artificial Sequence
  MKO10077534_B_Chchd1
  gRNA
cggacugucccagagacucc

SEQ ID NO: 77535 - RNA, 20 nt, Artificial Sequence
  MKO10077535_B_Chchd2
  gRNA
gcucaccugguaagugaugu

SEQ ID NO: 77536 - RNA, 20 nt, Artificial Sequence
  MKO10077536_B_Chchd2
  gRNA
cugcagaaccagcagucuuu

SEQ ID NO: 77537 - RNA, 20 nt, Artificial Sequence
  MKO10077537_B_Chchd2
  gRNA
cacagagcuugacaucgcuc

SEQ ID NO: 77538 - RNA, 20 nt, Artificial Sequence
  MKO10077538_B_Chchd3
  gRNA
cagugaagaggagcgcauga

SEQ ID NO: 77539 - RNA, 20 nt, Artificial Sequence
  MKO10077539_B_Chchd3
  gRNA
ggcauuggagcaagccaaaa

SEQ ID NO: 77540 - RNA, 20 nt, Artificial Sequence
  MKO10077540_B_Chchd3
  gRNA
cauccugcuuccgcaucacu

SEQ ID NO: 77541 - RNA, 20 nt, Artificial Sequence
  MKO10077541_B_Chchd4
  gRNA
ggggucaucagcuaccagcu

SEQ ID NO: 77542 - RNA, 20 nt, Artificial Sequence
  MKO10077542_B_Chchd4
  gRNA
cucaccuuccugccggcagu

SEQ ID NO: 77543 - RNA, 20 nt, Artificial Sequence
  MKO10077543_B_Chchd4
  gRNA
cagacuguauagaccaguuc

SEQ ID NO: 77544 - RNA, 20 nt, Artificial Sequence
  MKO10077544_B_Chchd5
  gRNA
gaagugucuucgcuugaaug

SEQ ID NO: 77545 - RNA, 20 nt, Artificial Sequence
  MKO10077545_B_Chchd5
  gRNA
ccaagggguugucaggaggc

SEQ ID NO: 77546 - RNA, 20 nt, Artificial Sequence
  MKO10077546_B_Chchd5
  gRNA
caaucucgaugccacgacuc

SEQ ID NO: 77547 - RNA, 20 nt, Artificial Sequence
  MKO10077547_B_Chchd6
  gRNA
accugucagagggccuuuac

SEQ ID NO: 77548 - RNA, 20 nt, Artificial Sequence
  MKO10077548_B_Chchd6
  gRNA
caguccaggaugagaugguc

SEQ ID NO: 77549 - RNA, 20 nt, Artificial Sequence
  MKO10077549_B_Chchd6
  gRNA
uagguuccaacaggagcagu

SEQ ID NO: 77550 - RNA, 20 nt, Artificial Sequence
  MKO10077550_B_Chchd7
  gRNA
agcagaaagagacgaaauuu

SEQ ID NO: 77551 - RNA, 20 nt, Artificial Sequence
  MKO10077551_B_Chchd7
  gRNA
uuuguacuucaagaaguaac

SEQ ID NO: 77552 - RNA, 20 nt, Artificial Sequence
  MKO10077552_B_Chchd7
  gRNA
ucgucucuuucugcugcugu

SEQ ID NO: 77553 - RNA, 20 nt, Artificial Sequence
  MKO10077553_B_Chd1l
  gRNA
uaucgcucuccucauuuacu

SEQ ID NO: 77554 - RNA, 20 nt, Artificial Sequence
  MKO10077554_B_Chd1l
  gRNA
gucaccuguguaugucacac

SEQ ID NO: 77555 - RNA, 20 nt, Artificial Sequence
  MKO10077555_B_Chd1l
  gRNA
cagugcuuccauugccagaa

SEQ ID NO: 77556 - RNA, 20 nt, Artificial Sequence
  MKO10077556_B_Chd1
  gRNA
gauccacuauuagaugaagc

SEQ ID NO: 77557 - RNA, 20 nt, Artificial Sequence
  MKO10077557_B_Chd1
  gRNA
gucgucggagucuucacugc

SEQ ID NO: 77558 - RNA, 20 nt, Artificial Sequence
  MKO10077558_B_Chd1
  gRNA
gcaaaaccaccaaaagucga

SEQ ID NO: 77559 - RNA, 20 nt, Artificial Sequence
  MKO10077559_B_Chd2
  gRNA
cuagaagaccggucccuaga

SEQ ID NO: 77560 - RNA, 20 nt, Artificial Sequence
  MKO10077560_B_Chd2
  gRNA
agaagacuccgaacugcuau

SEQ ID NO: 77561 - RNA, 20 nt, Artificial Sequence
  MKO10077561_B_Chd2
  gRNA
ccacacugaaggcaaguagc

SEQ ID NO: 77562 - RNA, 20 nt, Artificial Sequence
  MKO10077562_B_Chd3
  gRNA
gccacccccauagcaccauc

SEQ ID NO: 77563 - RNA, 20 nt, Artificial Sequence
  MKO10077563_B_Chd3
  gRNA
acgagcuucuuccguuuccu

SEQ ID NO: 77564 - RNA, 20 nt, Artificial Sequence
  MKO10077564_B_Chd3
  gRNA
uuccuucuucguuuccgacc

SEQ ID NO: 77565 - RNA, 20 nt, Artificial Sequence
  MKO10077565_B_Chd4
  gRNA
uugcggaucggcaccuccac

SEQ ID NO: 77566 - RNA, 20 nt, Artificial Sequence
  MKO10077566_B_Chd4
  gRNA
uaagagcaagcgccaaaaaa

SEQ ID NO: 77567 - RNA, 20 nt, Artificial Sequence
  MKO10077567_B_Chd4
  gRNA
ggcucugcgcucagacagug

SEQ ID NO: 77568 - RNA, 20 nt, Artificial Sequence
  MKO10077568_B_Chd5
  gRNA
ugacgagaugucagacaacg

SEQ ID NO: 77569 - RNA, 20 nt, Artificial Sequence
  MKO10077569_B_Chd5
  gRNA
gccgggcaugcggggcccgc

SEQ ID NO: 77570 - RNA, 20 nt, Artificial Sequence
  MKO10077570_B_Chd5
  gRNA
aaagagagcaaguccuccaa

SEQ ID NO: 77571 - RNA, 20 nt, Artificial Sequence
  MKO10077571_B_Chd6
  gRNA
accgaccuccuggacagucu

SEQ ID NO: 77572 - RNA, 20 nt, Artificial Sequence
  MKO10077572_B_Chd6
  gRNA
gggcuguaccucagccugcc

SEQ ID NO: 77573 - RNA, 20 nt, Artificial Sequence
  MKO10077573_B_Chd6
  gRNA
augucuuguagcagggagca

SEQ ID NO: 77574 - RNA, 20 nt, Artificial Sequence
  MKO10077574_B_Chd7
  gRNA
uguagaagaggcgguccagc

SEQ ID NO: 77575 - RNA, 20 nt, Artificial Sequence
  MKO10077575_B_Chd7
  gRNA
cagccgccuagugaaaaagc

SEQ ID NO: 77576 - RNA, 20 nt, Artificial Sequence
  MKO10077576_B_Chd7
  gRNA
gaagcgauacacugaagauu

SEQ ID NO: 77577 - RNA, 20 nt, Artificial Sequence
  MKO10077577_B_Chd8
  gRNA
cauaccucgaguccugaaug

SEQ ID NO: 77578 - RNA, 20 nt, Artificial Sequence
  MKO10077578_B_Chd8
  gRNA
uuaugccugcacaaucgccc

SEQ ID NO: 77579 - RNA, 20 nt, Artificial Sequence
  MKO10077579_B_Chd8
  gRNA
ccagucuucccugcaguaug

SEQ ID NO: 77580 - RNA, 20 nt, Artificial Sequence
  MKO10077580_B_Chd9
  gRNA
cacuaagcugcagaauaccc

SEQ ID NO: 77581 - RNA, 20 nt, Artificial Sequence
  MKO10077581_B_Chd9
  gRNA
gaucaaaucgacaaauuaag

SEQ ID NO: 77582 - RNA, 20 nt, Artificial Sequence
  MKO10077582_B_Chd9
  gRNA
uagacaaaauacuagcuugu

SEQ ID NO: 77583 - RNA, 20 nt, Artificial Sequence
  MKO10077583_B_Chdh
  gRNA
ccaucgcaagugauugacca

SEQ ID NO: 77584 - RNA, 20 nt, Artificial Sequence
  MKO10077584_B_Chdh
  gRNA
ucuuccaggcuuacgucagc

SEQ ID NO: 77585 - RNA, 20 nt, Artificial Sequence
  MKO10077585_B_Chdh
  gRNA
agccugcgccuacuugcacc

SEQ ID NO: 77586 - RNA, 20 nt, Artificial Sequence
  MKO10077586_B_Chek1
  gRNA
agaauuucacuacauucucg

SEQ ID NO: 77587 - RNA, 20 nt, Artificial Sequence
  MKO10077587_B_Chek1
  gRNA
gagaauguagugaaauucua

SEQ ID NO: 77588 - RNA, 20 nt, Artificial Sequence
  MKO10077588_B_Chek1
  gRNA
ucuuaccccuuucauccaag

SEQ ID NO: 77589 - RNA, 20 nt, Artificial Sequence
  MKO10077589_B_Chek2
  gRNA
uuguccguccuucucaacag

SEQ ID NO: 77590 - RNA, 20 nt, Artificial Sequence
  MKO10077590_B_Chek2
  gRNA
uuuccccuuaguggugcgug

SEQ ID NO: 77591 - RNA, 20 nt, Artificial Sequence
  MKO10077591_B_Chek2
  gRNA
uucguaaauaccgagcuuau

SEQ ID NO: 77592 - RNA, 20 nt, Artificial Sequence
  MKO10077592_B_Cherp
  gRNA
uggaugagcucguccauuga

SEQ ID NO: 77593 - RNA, 20 nt, Artificial Sequence
  MKO10077593_B_Cherp
  gRNA
cgaguucgagaaaaugacga

SEQ ID NO: 77594 - RNA, 20 nt, Artificial Sequence
  MKO10077594_B_Cherp
  gRNA
gcuaguaaucugcaagcagc

SEQ ID NO: 77595 - RNA, 20 nt, Artificial Sequence
  MKO10077595_B_Chfr
  gRNA
auaucaucuauuugguguac

SEQ ID NO: 77596 - RNA, 20 nt, Artificial Sequence
  MKO10077596_B_Chfr
  gRNA
uccagagaccaguuuauugc

SEQ ID NO: 77597 - RNA, 20 nt, Artificial Sequence
  MKO10077597_B_Chfr
  gRNA
ugccacuuaaagauucauag

SEQ ID NO: 77598 - RNA, 20 nt, Artificial Sequence
  MKO10077598_B_Chga
  gRNA
cugaaauaccuuggagagcc

SEQ ID NO: 77599 - RNA, 20 nt, Artificial Sequence
  MKO10077599_B_Chga
  gRNA
uccuacaaggugccaaggag

SEQ ID NO: 77600 - RNA, 20 nt, Artificial Sequence
  MKO10077600_B_Chga
  gRNA
gugaacagccccaugacaaa

SEQ ID NO: 77601 - RNA, 20 nt, Artificial Sequence
  MKO10077601_B_Chgb
  gRNA
aggggugaucguuggaacac

SEQ ID NO: 77602 - RNA, 20 nt, Artificial Sequence
  MKO10077602_B_Chgb
  gRNA
ucuccaacugucagccccgc

SEQ ID NO: 77603 - RNA, 20 nt, Artificial Sequence
  MKO10077603_B_Chgb
  gRNA
caacgaucaccccugagugc

SEQ ID NO: 77604 - RNA, 20 nt, Artificial Sequence
  MKO10077604_B_Chia1
  gRNA
acgcagaaauuugaugacug

SEQ ID NO: 77605 - RNA, 20 nt, Artificial Sequence
  MKO10077605_B_Chia1
  gRNA
aguuccagccuccaauugcc

SEQ ID NO: 77606 - RNA, 20 nt, Artificial Sequence
  MKO10077606_B_Chia1
  gRNA
ucuucugcugaaugcucagc

SEQ ID NO: 77607 - RNA, 20 nt, Artificial Sequence
  MKO10077607_B_Chic1
  gRNA
cgauucagaaguuacuagaa

SEQ ID NO: 77608 - RNA, 20 nt, Artificial Sequence
  MKO10077608_B_Chic1
  gRNA
cucucccugucaaugugaaa

SEQ ID NO: 77609 - RNA, 20 nt, Artificial Sequence
  MKO10077609_B_Chic1
  gRNA
augugaaacuagcaauauga

SEQ ID NO: 77610 - RNA, 20 nt, Artificial Sequence
  MKO10077610_B_Chic2
  gRNA
gcuguuaacucuguugaugc
